United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 25

SEQ ID NO: 1033384 - DNA, 13 bp, Homo sapiens
ctgatacgtgtat

SEQ ID NO: 1033385 - DNA, 18 bp, Homo sapiens
ctgatagcttacactgag

SEQ ID NO: 1033386 - DNA, 20 bp, Homo sapiens
ctgatagcttacactgagga

SEQ ID NO: 1033387 - DNA, 22 bp, Homo sapiens
ctgatagtcctttttccaatgt

SEQ ID NO: 1033388 - DNA, 20 bp, Homo sapiens
ggctctgggctcagggctgg

SEQ ID NO: 1033389 - DNA, 16 bp, Homo sapiens
ggctctggggtatgtg

SEQ ID NO: 1033390 - DNA, 15 bp, Homo sapiens
ggctctgtgcaggga

SEQ ID NO: 1033391 - DNA, 13 bp, Homo sapiens
ggctctgttcctc

SEQ ID NO: 1033392 - DNA, 16 bp, Homo sapiens
ggctctgttcctcaat

SEQ ID NO: 1033393 - DNA, 20 bp, Homo sapiens
ggctctgttcctcaatggcc

SEQ ID NO: 1033394 - DNA, 11 bp, Homo sapiens
ggctctgtttg

SEQ ID NO: 1033395 - DNA, 16 bp, Homo sapiens
ggctctgtttgatgct

SEQ ID NO: 1033396 - DNA, 19 bp, Homo sapiens
ggctcttatgtgtgccttt

SEQ ID NO: 1033397 - DNA, 11 bp, Homo sapiens
ggctcttccaa

SEQ ID NO: 1033398 - DNA, 13 bp, Homo sapiens
ggctcttctcctt

SEQ ID NO: 1033399 - DNA, 16 bp, Homo sapiens
ggctcttctgagcaga

SEQ ID NO: 1033400 - DNA, 19 bp, Homo sapiens
ggctcttgatacccccctc

SEQ ID NO: 1033401 - DNA, 20 bp, Homo sapiens
ggctcttgatacccccctct

SEQ ID NO: 1033402 - DNA, 13 bp, Homo sapiens
ggctcttggcttc

SEQ ID NO: 1033403 - DNA, 23 bp, Homo sapiens
ggctcttggcttccagaaggcag

SEQ ID NO: 1033404 - DNA, 13 bp, Homo sapiens
ggctctttccttg

SEQ ID NO: 1033405 - DNA, 16 bp, Homo sapiens
ggctctttccttgctc

SEQ ID NO: 1033406 - DNA, 17 bp, Homo sapiens
ggctctttccttgctca

SEQ ID NO: 1033407 - DNA, 18 bp, Homo sapiens
ggctctttctctctgctg

SEQ ID NO: 1033408 - DNA, 13 bp, Homo sapiens
ggctgaaagacag

SEQ ID NO: 1033409 - DNA, 16 bp, Homo sapiens
ggctgaacatgcctgc

SEQ ID NO: 1033410 - DNA, 14 bp, Homo sapiens
ggctgaaccctgtg

SEQ ID NO: 1033411 - DNA, 15 bp, Homo sapiens
ggctgaaccctgtgc

SEQ ID NO: 1033412 - DNA, 20 bp, Homo sapiens
ggctgaactgagaaggcagg

SEQ ID NO: 1033413 - DNA, 19 bp, Homo sapiens
ggctgaagagagggacagg

SEQ ID NO: 1033414 - DNA, 19 bp, Homo sapiens
ggctgaagctggagcagcg

SEQ ID NO: 1033415 - DNA, 20 bp, Homo sapiens
ggctgaagctggagcagcgg

SEQ ID NO: 1033416 - DNA, 15 bp, Homo sapiens
ggctgaattaaaatg

SEQ ID NO: 1033417 - DNA, 18 bp, Homo sapiens
ggctgaattaaaatggtt

SEQ ID NO: 1033418 - DNA, 16 bp, Homo sapiens
ggctgacacctaccat

SEQ ID NO: 1033419 - DNA, 19 bp, Homo sapiens
ggctgacacctaccatgct

SEQ ID NO: 1033420 - DNA, 21 bp, Homo sapiens
ggctgacacctaccatgctgc

SEQ ID NO: 1033421 - DNA, 14 bp, Homo sapiens
ggctgacatctgtg

SEQ ID NO: 1033422 - DNA, 22 bp, Homo sapiens
ggctgacatgaagctgttgtgt

SEQ ID NO: 1033423 - DNA, 17 bp, Homo sapiens
ggctgaccacagcacag

SEQ ID NO: 1033424 - DNA, 22 bp, Homo sapiens
ggctgaccacagcacagccaac

SEQ ID NO: 1033425 - DNA, 20 bp, Homo sapiens
ggctgacccagcatctccca

SEQ ID NO: 1033426 - DNA, 14 bp, Homo sapiens
ggctgacctgggcc

SEQ ID NO: 1033427 - DNA, 19 bp, Homo sapiens
ggctgacctgggcccacag

SEQ ID NO: 1033428 - DNA, 17 bp, Homo sapiens
ggctgactgggccacag

SEQ ID NO: 1033429 - DNA, 14 bp, Homo sapiens
ggctgactggggct

SEQ ID NO: 1033430 - DNA, 15 bp, Homo sapiens
ggctgactggggctg

SEQ ID NO: 1033431 - DNA, 20 bp, Homo sapiens
ggctgacttctctgaatcag

SEQ ID NO: 1033432 - DNA, 11 bp, Homo sapiens
ggctgagacct

SEQ ID NO: 1033433 - DNA, 21 bp, Homo sapiens
ggctgagactgcgggatggtc

SEQ ID NO: 1033434 - DNA, 12 bp, Homo sapiens
ggctgagactgg

SEQ ID NO: 1033435 - DNA, 21 bp, Homo sapiens
ggctgagactggatactgccc

SEQ ID NO: 1033436 - DNA, 22 bp, Homo sapiens
ggctgagcccctaccccacacc

SEQ ID NO: 1033437 - DNA, 13 bp, Homo sapiens
ggctgagccctgt

SEQ ID NO: 1033438 - DNA, 22 bp, Homo sapiens
ggctgagccctgtacccacccc

SEQ ID NO: 1033439 - DNA, 24 bp, Homo sapiens
ggctgagccctgtacccaccccag

SEQ ID NO: 1033440 - DNA, 15 bp, Homo sapiens
ggctgagctctctgt

SEQ ID NO: 1033441 - DNA, 13 bp, Homo sapiens
ggctgaggagcag

SEQ ID NO: 1033442 - DNA, 15 bp, Homo sapiens
ggctgaggagcagcc

SEQ ID NO: 1033443 - DNA, 20 bp, Homo sapiens
ggctgaggagcagccaggac

SEQ ID NO: 1033444 - DNA, 21 bp, Homo sapiens
ggctgaggatttcaagcctgc

SEQ ID NO: 1033445 - DNA, 17 bp, Homo sapiens
ggctgaggcagaagaat

SEQ ID NO: 1033446 - DNA, 18 bp, Homo sapiens
ggctgaggctggcacagg

SEQ ID NO: 1033447 - DNA, 14 bp, Homo sapiens
ggctgagggcctgc

SEQ ID NO: 1033448 - DNA, 17 bp, Homo sapiens
ggctgagggcctgctgg

SEQ ID NO: 1033449 - DNA, 18 bp, Homo sapiens
ggctgagggcctgctgga

SEQ ID NO: 1033450 - DNA, 21 bp, Homo sapiens
ggctgaggggcctgcgcccag

SEQ ID NO: 1033451 - DNA, 16 bp, Homo sapiens
ggctgagggtgccctt

SEQ ID NO: 1033452 - DNA, 15 bp, Homo sapiens
ggctgaggtggggaa

SEQ ID NO: 1033453 - DNA, 23 bp, Homo sapiens
ggctgaggttcctctgcctgccc

SEQ ID NO: 1033454 - DNA, 15 bp, Homo sapiens
ggctgagtgcagcca

SEQ ID NO: 1033455 - DNA, 20 bp, Homo sapiens
ggctggagtgcagtggtgtg

SEQ ID NO: 1033456 - DNA, 13 bp, Homo sapiens
ggctggatggaca

SEQ ID NO: 1033457 - DNA, 16 bp, Homo sapiens
ggctggatggacagac

SEQ ID NO: 1033458 - DNA, 21 bp, Homo sapiens
ggctggatggacagacacctc

SEQ ID NO: 1033459 - DNA, 19 bp, Homo sapiens
ggctggatggcacctcagg

SEQ ID NO: 1033460 - DNA, 19 bp, Homo sapiens
ggctggatgtggtggcata

SEQ ID NO: 1033461 - DNA, 21 bp, Homo sapiens
ggctggcaaaccctcccagaa

SEQ ID NO: 1033462 - DNA, 14 bp, Homo sapiens
ggctggcaagcagg

SEQ ID NO: 1033463 - DNA, 19 bp, Homo sapiens
ggctggcaccgccttctct

SEQ ID NO: 1033464 - DNA, 20 bp, Homo sapiens
ggctggcacgtgacaggctc

SEQ ID NO: 1033465 - DNA, 15 bp, Homo sapiens
ggctggcagctctcc

SEQ ID NO: 1033466 - DNA, 16 bp, Homo sapiens
ggctggcagctctcca

SEQ ID NO: 1033467 - DNA, 20 bp, Homo sapiens
ggctggcagctctccagtca

SEQ ID NO: 1033468 - DNA, 13 bp, Homo sapiens
ggctggccaaggt

SEQ ID NO: 1033469 - DNA, 18 bp, Homo sapiens
ggctggccagcaaggcag

SEQ ID NO: 1033470 - DNA, 19 bp, Homo sapiens
ggctggccagcaaggcagg

SEQ ID NO: 1033471 - DNA, 16 bp, Homo sapiens
ggctggccagtccagg

SEQ ID NO: 1033472 - DNA, 21 bp, Homo sapiens
ggctggccagtccaggctgcc

SEQ ID NO: 1033473 - DNA, 22 bp, Homo sapiens
ggctggccagtccaggctgccg

SEQ ID NO: 1033474 - DNA, 11 bp, Homo sapiens
ggctggccctg

SEQ ID NO: 1033475 - DNA, 13 bp, Homo sapiens
ggctggccctgtg

SEQ ID NO: 1033476 - DNA, 18 bp, Homo sapiens
ggctggccctgtgcagac

SEQ ID NO: 1033477 - DNA, 13 bp, Homo sapiens
ggctggcctggag

SEQ ID NO: 1033478 - DNA, 20 bp, Homo sapiens
ggctggcctggaggctcagc

SEQ ID NO: 1033479 - DNA, 19 bp, Homo sapiens
ggctggcgcagccaaggcc

SEQ ID NO: 1033480 - DNA, 22 bp, Homo sapiens
ggctggctccagatgcagggca

SEQ ID NO: 1033481 - DNA, 19 bp, Homo sapiens
ggctggctctaccttcctg

SEQ ID NO: 1033482 - DNA, 22 bp, Homo sapiens
ggctggctctaccttcctgtcc

SEQ ID NO: 1033483 - DNA, 14 bp, Homo sapiens
ggctggctgcagtg

SEQ ID NO: 1033484 - DNA, 10 bp, Homo sapiens
ggctggctgg

SEQ ID NO: 1033485 - DNA, 13 bp, Homo sapiens
ggctggctggcct

SEQ ID NO: 1033486 - DNA, 13 bp, Homo sapiens
ggctggctgggca

SEQ ID NO: 1033487 - DNA, 22 bp, Homo sapiens
ggctgggaatggaggggcagag

SEQ ID NO: 1033488 - DNA, 18 bp, Homo sapiens
ggctgggacgtggctcag

SEQ ID NO: 1033489 - DNA, 19 bp, Homo sapiens
ggctgggacgtggctcagc

SEQ ID NO: 1033490 - DNA, 22 bp, Homo sapiens
ggctgggagcctcgcccctcca

SEQ ID NO: 1033491 - DNA, 15 bp, Homo sapiens
ggctgggaggaggaa

SEQ ID NO: 1033492 - DNA, 23 bp, Homo sapiens
ggctgggagtagttgtctttcct

SEQ ID NO: 1033493 - DNA, 13 bp, Homo sapiens
ggctgggcacctg

SEQ ID NO: 1033494 - DNA, 15 bp, Homo sapiens
ggctgggcatcccag

SEQ ID NO: 1033495 - DNA, 16 bp, Homo sapiens
ggctgggcccacccag

SEQ ID NO: 1033496 - DNA, 18 bp, Homo sapiens
ggctgggccctctttccc

SEQ ID NO: 1033497 - DNA, 20 bp, Homo sapiens
ggctgggccgcaagggcctg

SEQ ID NO: 1033498 - DNA, 22 bp, Homo sapiens
ggctgggcctctggttctgaca

SEQ ID NO: 1033499 - DNA, 11 bp, Homo sapiens
ggctgggctac

SEQ ID NO: 1033500 - DNA, 13 bp, Homo sapiens
ggctgggctgggc

SEQ ID NO: 1033501 - DNA, 16 bp, Homo sapiens
ggctggggacccaccc

SEQ ID NO: 1033502 - DNA, 12 bp, Homo sapiens
ggctggggcaga

SEQ ID NO: 1033503 - DNA, 13 bp, Homo sapiens
ggctggggcagag

SEQ ID NO: 1033504 - DNA, 16 bp, Homo sapiens
ggctggggcagagggg

SEQ ID NO: 1033505 - DNA, 15 bp, Homo sapiens
ggctggggcaggggc

SEQ ID NO: 1033506 - DNA, 18 bp, Homo sapiens
ggctggggcaggggcctg

SEQ ID NO: 1033507 - DNA, 21 bp, Homo sapiens
ggctggggccccatcttgatc

SEQ ID NO: 1033508 - DNA, 23 bp, Homo sapiens
ggctggggccttttgacggcctt

SEQ ID NO: 1033509 - DNA, 12 bp, Homo sapiens
ggctggggcgga

SEQ ID NO: 1033510 - DNA, 14 bp, Homo sapiens
ggctggggcggagc

SEQ ID NO: 1033511 - DNA, 16 bp, Homo sapiens
ggctggggctgctccc

SEQ ID NO: 1033512 - DNA, 18 bp, Homo sapiens
ggctgggggagagccgtg

SEQ ID NO: 1033513 - DNA, 20 bp, Homo sapiens
ggctgggggaggtccaagca

SEQ ID NO: 1033514 - DNA, 19 bp, Homo sapiens
ggctgggggccagggctgg

SEQ ID NO: 1033515 - DNA, 21 bp, Homo sapiens
ggctgggggccagggctggat

SEQ ID NO: 1033516 - DNA, 15 bp, Homo sapiens
ctgatatatgtgttt

SEQ ID NO: 1033517 - DNA, 22 bp, Homo sapiens
ctgatatatgtgtttttcacat

SEQ ID NO: 1033518 - DNA, 16 bp, Homo sapiens
ctgatatattttacaa

SEQ ID NO: 1033519 - DNA, 18 bp, Homo sapiens
ctgatatattttacaatt

SEQ ID NO: 1033520 - DNA, 16 bp, Homo sapiens
ctgatatggaagcacc

SEQ ID NO: 1033521 - DNA, 19 bp, Homo sapiens
ctgatattaaagatttctt

SEQ ID NO: 1033522 - DNA, 13 bp, Homo sapiens
ctgatattaatca

SEQ ID NO: 1033523 - DNA, 16 bp, Homo sapiens
ctgatattatttcttc

SEQ ID NO: 1033524 - DNA, 17 bp, Homo sapiens
ctgatattatttcttct

SEQ ID NO: 1033525 - DNA, 20 bp, Homo sapiens
ctgatattatttcttctctt

SEQ ID NO: 1033526 - DNA, 20 bp, Homo sapiens
ctgatattcaaatggacaaa

SEQ ID NO: 1033527 - DNA, 19 bp, Homo sapiens
ctgatattccatgaatgta

SEQ ID NO: 1033528 - DNA, 18 bp, Homo sapiens
ctgatattttctctagga

SEQ ID NO: 1033529 - DNA, 14 bp, Homo sapiens
ctgatcacttcatg

SEQ ID NO: 1033530 - DNA, 14 bp, Homo sapiens
ctgatcagagccgt

SEQ ID NO: 1033531 - DNA, 22 bp, Homo sapiens
ctgatcagtgggcctccaagga

SEQ ID NO: 1033532 - DNA, 18 bp, Homo sapiens
ctgatcatcgccagaggt

SEQ ID NO: 1033533 - DNA, 16 bp, Homo sapiens
ctgatcatgcattgtt

SEQ ID NO: 1033534 - DNA, 20 bp, Homo sapiens
ctgatcattacatggctgtg

SEQ ID NO: 1033535 - DNA, 13 bp, Homo sapiens
ctgatccagagca

SEQ ID NO: 1033536 - DNA, 21 bp, Homo sapiens
ctgatccagagcacagatctg

SEQ ID NO: 1033537 - DNA, 20 bp, Homo sapiens
ctgatccagcctttccaagt

SEQ ID NO: 1033538 - DNA, 20 bp, Homo sapiens
ctgatcccagacccattcct

SEQ ID NO: 1033539 - DNA, 20 bp, Homo sapiens
ctgatcccattttcctctga

SEQ ID NO: 1033540 - DNA, 15 bp, Homo sapiens
ctgatccctctacag

SEQ ID NO: 1033541 - DNA, 21 bp, Homo sapiens
ctgatccctgaacccctggcc

SEQ ID NO: 1033542 - DNA, 23 bp, Homo sapiens
ctgatccctgaacccctggccag

SEQ ID NO: 1033543 - DNA, 14 bp, Homo sapiens
ctgatccctggcca

SEQ ID NO: 1033544 - DNA, 16 bp, Homo sapiens
ctgatccctggccact

SEQ ID NO: 1033545 - DNA, 16 bp, Homo sapiens
ctgatccttttcaata

SEQ ID NO: 1033546 - DNA, 17 bp, Homo sapiens
ctgatcgtagaaaattt

SEQ ID NO: 1033547 - DNA, 19 bp, Homo sapiens
ctgatcgtgctaaattttc

SEQ ID NO: 1033548 - DNA, 21 bp, Homo sapiens
ctgatctctactaccacaagg

SEQ ID NO: 1033549 - DNA, 14 bp, Homo sapiens
ctgatctctgacct

SEQ ID NO: 1033550 - DNA, 14 bp, Homo sapiens
ctgatctcttcctg

SEQ ID NO: 1033551 - DNA, 15 bp, Homo sapiens
ctgatctcttcctgt

SEQ ID NO: 1033552 - DNA, 12 bp, Homo sapiens
ctgatctgcgga

SEQ ID NO: 1033553 - DNA, 15 bp, Homo sapiens
ctgatctggctgcag

SEQ ID NO: 1033554 - DNA, 14 bp, Homo sapiens
ctgatctgtacttt

SEQ ID NO: 1033555 - DNA, 17 bp, Homo sapiens
ctgatctgtactttgtg

SEQ ID NO: 1033556 - DNA, 14 bp, Homo sapiens
ctgatcttgcctgt

SEQ ID NO: 1033557 - DNA, 16 bp, Homo sapiens
ctgatcttgcctgtct

SEQ ID NO: 1033558 - DNA, 18 bp, Homo sapiens
ctgatcttttaaaatcat

SEQ ID NO: 1033559 - DNA, 16 bp, Homo sapiens
ctgatctttttataca

SEQ ID NO: 1033560 - DNA, 19 bp, Homo sapiens
ctgatctttttatacacaa

SEQ ID NO: 1033561 - DNA, 13 bp, Homo sapiens
ctgatgaaatctg

SEQ ID NO: 1033562 - DNA, 19 bp, Homo sapiens
ctgatgaaatctgctagaa

SEQ ID NO: 1033563 - DNA, 23 bp, Homo sapiens
ctgatgaaatctgctagaaagtt

SEQ ID NO: 1033564 - DNA, 20 bp, Homo sapiens
ctgatgaacttattctgtag

SEQ ID NO: 1033565 - DNA, 15 bp, Homo sapiens
ctgatgacagagcga

SEQ ID NO: 1033566 - DNA, 17 bp, Homo sapiens
ctgatgacagagcgaga

SEQ ID NO: 1033567 - DNA, 23 bp, Homo sapiens
ctgatgacagtgttatcccaaga

SEQ ID NO: 1033568 - DNA, 18 bp, Homo sapiens
ctgatgacgcctgtctgt

SEQ ID NO: 1033569 - DNA, 14 bp, Homo sapiens
ctgatgacttgctt

SEQ ID NO: 1033570 - DNA, 19 bp, Homo sapiens
ctgatgagactccactcag

SEQ ID NO: 1033571 - DNA, 17 bp, Homo sapiens
ctgatgagatttttaaa

SEQ ID NO: 1033572 - DNA, 11 bp, Homo sapiens
ctgatgagcaa

SEQ ID NO: 1033573 - DNA, 21 bp, Homo sapiens
ctgatgagcaaccgcttccct

SEQ ID NO: 1033574 - DNA, 14 bp, Homo sapiens
ctgatgagcacatc

SEQ ID NO: 1033575 - DNA, 22 bp, Homo sapiens
ctgatgagcacatctctctgcc

SEQ ID NO: 1033576 - DNA, 21 bp, Homo sapiens
ctgatgagtaaactgaggccc

SEQ ID NO: 1033577 - DNA, 14 bp, Homo sapiens
ggctgtgtctctgc

SEQ ID NO: 1033578 - DNA, 15 bp, Homo sapiens
ggctgtgtggccaag

SEQ ID NO: 1033579 - DNA, 23 bp, Homo sapiens
ggctgtgttcgggggagcagaga

SEQ ID NO: 1033580 - DNA, 21 bp, Homo sapiens
ggctgtgttgactgctgctcc

SEQ ID NO: 1033581 - DNA, 20 bp, Homo sapiens
ggctgttattatgaaggaat

SEQ ID NO: 1033582 - DNA, 22 bp, Homo sapiens
ggctgttccagactcaggttcc

SEQ ID NO: 1033583 - DNA, 13 bp, Homo sapiens
ggctgttccatgt

SEQ ID NO: 1033584 - DNA, 14 bp, Homo sapiens
ggctgttccctttg

SEQ ID NO: 1033585 - DNA, 20 bp, Homo sapiens
ggctgttgctagggagaggg

SEQ ID NO: 1033586 - DNA, 17 bp, Homo sapiens
ggctgttggacagctgc

SEQ ID NO: 1033587 - DNA, 12 bp, Homo sapiens
ggctgttggcac

SEQ ID NO: 1033588 - DNA, 17 bp, Homo sapiens
ggctgttggcactcaca

SEQ ID NO: 1033589 - DNA, 15 bp, Homo sapiens
ggcttaaagtgaagg

SEQ ID NO: 1033590 - DNA, 19 bp, Homo sapiens
ggcttaagaaatctagtat

SEQ ID NO: 1033591 - DNA, 14 bp, Homo sapiens
ggcttaatgtttat

SEQ ID NO: 1033592 - DNA, 15 bp, Homo sapiens
ggcttacagaaatga

SEQ ID NO: 1033593 - DNA, 17 bp, Homo sapiens
ggcttacagaaatgact

SEQ ID NO: 1033594 - DNA, 22 bp, Homo sapiens
ggcttacaggggggtcggaagc

SEQ ID NO: 1033595 - DNA, 22 bp, Homo sapiens
ggcttacctgacctcttgctgt

SEQ ID NO: 1033596 - DNA, 16 bp, Homo sapiens
ggcttaggtgccaggc

SEQ ID NO: 1033597 - DNA, 20 bp, Homo sapiens
ggcttagtatttctcaggaa

SEQ ID NO: 1033598 - DNA, 21 bp, Homo sapiens
ggcttataaacacattgaatg

SEQ ID NO: 1033599 - DNA, 17 bp, Homo sapiens
ggcttataagttaaaac

SEQ ID NO: 1033600 - DNA, 21 bp, Homo sapiens
ggcttcacggaagagccttgc

SEQ ID NO: 1033601 - DNA, 21 bp, Homo sapiens
ggcttcactctccctgacggc

SEQ ID NO: 1033602 - DNA, 20 bp, Homo sapiens
ggcttcagcatatttatagc

SEQ ID NO: 1033603 - DNA, 18 bp, Homo sapiens
ggcttcaggggagtcccg

SEQ ID NO: 1033604 - DNA, 17 bp, Homo sapiens
ggcttccagaaggcagc

SEQ ID NO: 1033605 - DNA, 21 bp, Homo sapiens
ggcttccagaaggcagcaaag

SEQ ID NO: 1033606 - DNA, 14 bp, Homo sapiens
ggcttccaggctct

SEQ ID NO: 1033607 - DNA, 22 bp, Homo sapiens
ggcttccatttgtgtgtgtgca

SEQ ID NO: 1033608 - DNA, 17 bp, Homo sapiens
ggcttccccatcagctc

SEQ ID NO: 1033609 - DNA, 14 bp, Homo sapiens
ggcttcccgctcag

SEQ ID NO: 1033610 - DNA, 15 bp, Homo sapiens
ggcttcccgctcagc

SEQ ID NO: 1033611 - DNA, 22 bp, Homo sapiens
ggcttcccgctcagccctccct

SEQ ID NO: 1033612 - DNA, 20 bp, Homo sapiens
ggcttccctaaactgcagcc

SEQ ID NO: 1033613 - DNA, 20 bp, Homo sapiens
ggcttccctgacttgcttta

SEQ ID NO: 1033614 - DNA, 20 bp, Homo sapiens
ggcttccctggcatgatgga

SEQ ID NO: 1033615 - DNA, 20 bp, Homo sapiens
ggcttccgcgcccagcgctc

SEQ ID NO: 1033616 - DNA, 22 bp, Homo sapiens
ggcttccgtgtcctctccccca

SEQ ID NO: 1033617 - DNA, 12 bp, Homo sapiens
ggcttcctcctc

SEQ ID NO: 1033618 - DNA, 17 bp, Homo sapiens
ggcttcctcttcttgtt

SEQ ID NO: 1033619 - DNA, 22 bp, Homo sapiens
ggcttcctgcccttccctctgg

SEQ ID NO: 1033620 - DNA, 19 bp, Homo sapiens
ggcttcctgcgtcctcctc

SEQ ID NO: 1033621 - DNA, 18 bp, Homo sapiens
ggcttcctgctgggactg

SEQ ID NO: 1033622 - DNA, 10 bp, Homo sapiens
ggcttcctgt

SEQ ID NO: 1033623 - DNA, 14 bp, Homo sapiens
ggcttcctgtccac

SEQ ID NO: 1033624 - DNA, 17 bp, Homo sapiens
ggcttcctgtccactct

SEQ ID NO: 1033625 - DNA, 18 bp, Homo sapiens
ggcttcctgtccactctc

SEQ ID NO: 1033626 - DNA, 18 bp, Homo sapiens
ggcttcggagggccgcag

SEQ ID NO: 1033627 - DNA, 17 bp, Homo sapiens
ggcttctccgccagcct

SEQ ID NO: 1033628 - DNA, 18 bp, Homo sapiens
ggcttctccgccagcctc

SEQ ID NO: 1033629 - DNA, 16 bp, Homo sapiens
ggcttctcctcctctg

SEQ ID NO: 1033630 - DNA, 12 bp, Homo sapiens
ggcttctcctga

SEQ ID NO: 1033631 - DNA, 16 bp, Homo sapiens
ggcttctctgtctctg

SEQ ID NO: 1033632 - DNA, 14 bp, Homo sapiens
ggcttctgcaccct

SEQ ID NO: 1033633 - DNA, 20 bp, Homo sapiens
ggcttctgcaccctccaccc

SEQ ID NO: 1033634 - DNA, 22 bp, Homo sapiens
ggcttctgcaccctccaccctg

SEQ ID NO: 1033635 - DNA, 13 bp, Homo sapiens
ggcttctggagcc

SEQ ID NO: 1033636 - DNA, 18 bp, Homo sapiens
ggcttctggagcccttgg

SEQ ID NO: 1033637 - DNA, 20 bp, Homo sapiens
ggcttctggagcccttgggt

SEQ ID NO: 1033638 - DNA, 17 bp, Homo sapiens
ggcttctggctcctcgg

SEQ ID NO: 1033639 - DNA, 15 bp, Homo sapiens
ggcttctgggacctg

SEQ ID NO: 1033640 - DNA, 18 bp, Homo sapiens
ggcttctgtgatgagctg

SEQ ID NO: 1033641 - DNA, 21 bp, Homo sapiens
ggcttctgtgatgagctgatc

SEQ ID NO: 1033642 - DNA, 23 bp, Homo sapiens
ggcttctgtgcactagcctgtga

SEQ ID NO: 1033643 - DNA, 19 bp, Homo sapiens
ctgatgtttacaatgatgc

SEQ ID NO: 1033644 - DNA, 20 bp, Homo sapiens
ctgatgtttataaactgaga

SEQ ID NO: 1033645 - DNA, 21 bp, Homo sapiens
ctgattaagttgtctaaacaa

SEQ ID NO: 1033646 - DNA, 13 bp, Homo sapiens
ctgattactgtca

SEQ ID NO: 1033647 - DNA, 19 bp, Homo sapiens
ctgattactgtcaataaac

SEQ ID NO: 1033648 - DNA, 19 bp, Homo sapiens
ctgattagaaatgaccaat

SEQ ID NO: 1033649 - DNA, 22 bp, Homo sapiens
ctgattagaagtataaggtgct

SEQ ID NO: 1033650 - DNA, 16 bp, Homo sapiens
ctgattataggatttt

SEQ ID NO: 1033651 - DNA, 12 bp, Homo sapiens
ctgattattact

SEQ ID NO: 1033652 - DNA, 20 bp, Homo sapiens
ctgattattgagttccagtt

SEQ ID NO: 1033653 - DNA, 17 bp, Homo sapiens
ctgattatttagagcca

SEQ ID NO: 1033654 - DNA, 18 bp, Homo sapiens
ctgattatttatgacctg

SEQ ID NO: 1033655 - DNA, 22 bp, Homo sapiens
ctgattcaaaccaaagctgcct

SEQ ID NO: 1033656 - DNA, 15 bp, Homo sapiens
ctgattcacctcttc

SEQ ID NO: 1033657 - DNA, 20 bp, Homo sapiens
ctgattcacctcttcctctg

SEQ ID NO: 1033658 - DNA, 21 bp, Homo sapiens
ctgattcacctcttcctctgg

SEQ ID NO: 1033659 - DNA, 20 bp, Homo sapiens
ctgattcactgcatggctcc

SEQ ID NO: 1033660 - DNA, 22 bp, Homo sapiens
ctgattcataataaatatctgt

SEQ ID NO: 1033661 - DNA, 13 bp, Homo sapiens
ctgattccaaata

SEQ ID NO: 1033662 - DNA, 16 bp, Homo sapiens
ctgattcctttaaaat

SEQ ID NO: 1033663 - DNA, 21 bp, Homo sapiens
ctgattctctttaactgtgtg

SEQ ID NO: 1033664 - DNA, 16 bp, Homo sapiens
ctgattcttgattcct

SEQ ID NO: 1033665 - DNA, 18 bp, Homo sapiens
ctgattcttgattcctgg

SEQ ID NO: 1033666 - DNA, 19 bp, Homo sapiens
ctgattcttgattcctggc

SEQ ID NO: 1033667 - DNA, 15 bp, Homo sapiens
ctgattcttgtaaat

SEQ ID NO: 1033668 - DNA, 21 bp, Homo sapiens
ctgattcttgtaaatcttttt

SEQ ID NO: 1033669 - DNA, 22 bp, Homo sapiens
ctgattcttgttgctgtacaaa

SEQ ID NO: 1033670 - DNA, 16 bp, Homo sapiens
ctgattcttttttcag

SEQ ID NO: 1033671 - DNA, 16 bp, Homo sapiens
ctgattgacctgctcc

SEQ ID NO: 1033672 - DNA, 17 bp, Homo sapiens
ctgattgacctgctccg

SEQ ID NO: 1033673 - DNA, 20 bp, Homo sapiens
ctgattgacctgctccgctg

SEQ ID NO: 1033674 - DNA, 13 bp, Homo sapiens
ctgattgatcaca

SEQ ID NO: 1033675 - DNA, 19 bp, Homo sapiens
ctgattgatcacacagtgt

SEQ ID NO: 1033676 - DNA, 23 bp, Homo sapiens
ctgattggaattctttctgttga

SEQ ID NO: 1033677 - DNA, 21 bp, Homo sapiens
ctgattggaatttctggcctc

SEQ ID NO: 1033678 - DNA, 14 bp, Homo sapiens
ctgattggctcacc

SEQ ID NO: 1033679 - DNA, 15 bp, Homo sapiens
ctgattggtgattca

SEQ ID NO: 1033680 - DNA, 15 bp, Homo sapiens
ctgatttaacacttt

SEQ ID NO: 1033681 - DNA, 16 bp, Homo sapiens
ctgatttaacactttt

SEQ ID NO: 1033682 - DNA, 21 bp, Homo sapiens
ctgatttagaagcaaagattt

SEQ ID NO: 1033683 - DNA, 22 bp, Homo sapiens
ctgatttatttctactatatac

SEQ ID NO: 1033684 - DNA, 14 bp, Homo sapiens
ctgatttattttgt

SEQ ID NO: 1033685 - DNA, 17 bp, Homo sapiens
ctgatttattttgtatg

SEQ ID NO: 1033686 - DNA, 23 bp, Homo sapiens
ctgatttattttgtatgaaatat

SEQ ID NO: 1033687 - DNA, 21 bp, Homo sapiens
ctgatttcagtttttcatttg

SEQ ID NO: 1033688 - DNA, 23 bp, Homo sapiens
ctgatttcattacatttctgaat

SEQ ID NO: 1033689 - DNA, 14 bp, Homo sapiens
ctgatttccaggcc

SEQ ID NO: 1033690 - DNA, 15 bp, Homo sapiens
ctgatttccaggccc

SEQ ID NO: 1033691 - DNA, 22 bp, Homo sapiens
ctgatttccaggcccctgagga

SEQ ID NO: 1033692 - DNA, 14 bp, Homo sapiens
ctgatttccttcca

SEQ ID NO: 1033693 - DNA, 19 bp, Homo sapiens
ctgatttctagtgtatact

SEQ ID NO: 1033694 - DNA, 16 bp, Homo sapiens
ctgatttgcaaaaaaa

SEQ ID NO: 1033695 - DNA, 19 bp, Homo sapiens
ctgatttgggctgaatgta

SEQ ID NO: 1033696 - DNA, 11 bp, Homo sapiens
ctgatttgtcc

SEQ ID NO: 1033697 - DNA, 14 bp, Homo sapiens
ctgattttgtatgt

SEQ ID NO: 1033698 - DNA, 20 bp, Homo sapiens
ctgcacatgcagctgcaccc

SEQ ID NO: 1033699 - DNA, 21 bp, Homo sapiens
ctgcacatgcagctgcaccct

SEQ ID NO: 1033700 - DNA, 18 bp, Homo sapiens
ctgcacattcctggcccc

SEQ ID NO: 1033701 - DNA, 22 bp, Homo sapiens
ctgcacattcctggccccgggc

SEQ ID NO: 1033702 - DNA, 14 bp, Homo sapiens
ctgcacattgcctg

SEQ ID NO: 1033703 - DNA, 16 bp, Homo sapiens
ctgcacattgcctgtt

SEQ ID NO: 1033704 - DNA, 23 bp, Homo sapiens
ctgcacattgcctgttctgcttc

SEQ ID NO: 1033705 - DNA, 21 bp, Homo sapiens
ctgcaccaacctcactgccct

SEQ ID NO: 1033706 - DNA, 16 bp, Homo sapiens
ctgcaccaccatgccc

SEQ ID NO: 1033707 - DNA, 20 bp, Homo sapiens
ctgcaccagagcaacctctc

SEQ ID NO: 1033708 - DNA, 17 bp, Homo sapiens
ctgcaccagcaggtgcc

SEQ ID NO: 1033709 - DNA, 20 bp, Homo sapiens
ctgcacccagctccaggggc

SEQ ID NO: 1033710 - DNA, 13 bp, Homo sapiens
ctgcaccccagca

SEQ ID NO: 1033711 - DNA, 16 bp, Homo sapiens
ctgcaccccagcattc

SEQ ID NO: 1033712 - DNA, 19 bp, Homo sapiens
ctgcaccccagcgtcaggc

SEQ ID NO: 1033713 - DNA, 21 bp, Homo sapiens
ctgcaccccagcgtcaggcct

SEQ ID NO: 1033714 - DNA, 17 bp, Homo sapiens
ctgcacccctgggccag

SEQ ID NO: 1033715 - DNA, 13 bp, Homo sapiens
ctgcaccctccac

SEQ ID NO: 1033716 - DNA, 15 bp, Homo sapiens
ctgcaccctccaccc

SEQ ID NO: 1033717 - DNA, 12 bp, Homo sapiens
ctgcaccctgcg

SEQ ID NO: 1033718 - DNA, 16 bp, Homo sapiens
ctgcaccctgcgcctc

SEQ ID NO: 1033719 - DNA, 17 bp, Homo sapiens
ctgcaccctgcgcctcc

SEQ ID NO: 1033720 - DNA, 22 bp, Homo sapiens
ctgcaccctgcgcctccagagg

SEQ ID NO: 1033721 - DNA, 21 bp, Homo sapiens
ctgcaccctggggcctggacc

SEQ ID NO: 1033722 - DNA, 23 bp, Homo sapiens
ctgcaccctggggcctggacctg

SEQ ID NO: 1033723 - DNA, 13 bp, Homo sapiens
ctgcacccttctt

SEQ ID NO: 1033724 - DNA, 18 bp, Homo sapiens
ctgcacccttcttttctc

SEQ ID NO: 1033725 - DNA, 19 bp, Homo sapiens
ctgcacccttgtacagtgt

SEQ ID NO: 1033726 - DNA, 18 bp, Homo sapiens
ctgcaccgaccccgggcc

SEQ ID NO: 1033727 - DNA, 14 bp, Homo sapiens
ctgcaccgacccga

SEQ ID NO: 1033728 - DNA, 15 bp, Homo sapiens
ctgcaccgccgcaga

SEQ ID NO: 1033729 - DNA, 20 bp, Homo sapiens
ctgcaccgccgcagaagcag

SEQ ID NO: 1033730 - DNA, 22 bp, Homo sapiens
ctgcaccgccgcagaagcagcc

SEQ ID NO: 1033731 - DNA, 23 bp, Homo sapiens
ctgcaccgtctcactgtgtgtct

SEQ ID NO: 1033732 - DNA, 17 bp, Homo sapiens
ctgcacctccccccact

SEQ ID NO: 1033733 - DNA, 18 bp, Homo sapiens
ctgcacctccccccactg

SEQ ID NO: 1033734 - DNA, 20 bp, Homo sapiens
ctgcacctccccccactgca

SEQ ID NO: 1033735 - DNA, 22 bp, Homo sapiens
ctgcacctccccccactgcagg

SEQ ID NO: 1033736 - DNA, 16 bp, Homo sapiens
ctgcacctcctaccct

SEQ ID NO: 1033737 - DNA, 13 bp, Homo sapiens
ctgcacctgccag

SEQ ID NO: 1033738 - DNA, 16 bp, Homo sapiens
ctgcacctgccagcct

SEQ ID NO: 1033739 - DNA, 20 bp, Homo sapiens
ctgcacctgccagcctggct

SEQ ID NO: 1033740 - DNA, 15 bp, Homo sapiens
ctgcacctgcccagc

SEQ ID NO: 1033741 - DNA, 15 bp, Homo sapiens
ctgcacctgcctgcc

SEQ ID NO: 1033742 - DNA, 14 bp, Homo sapiens
ctgcacctgctgcg

SEQ ID NO: 1033743 - DNA, 20 bp, Homo sapiens
ctgcacctggcctgggccac

SEQ ID NO: 1033744 - DNA, 15 bp, Homo sapiens
ctgcacgctcccctc

SEQ ID NO: 1033745 - DNA, 16 bp, Homo sapiens
ctgcacgctcccctcc

SEQ ID NO: 1033746 - DNA, 16 bp, Homo sapiens
ctgcacgggatgcgtg

SEQ ID NO: 1033747 - DNA, 20 bp, Homo sapiens
ctgcacgtaggttccccaga

SEQ ID NO: 1033748 - DNA, 12 bp, Homo sapiens
ctgcacgtcatg

SEQ ID NO: 1033749 - DNA, 18 bp, Homo sapiens
ctgcacgttgctgaaggt

SEQ ID NO: 1033750 - DNA, 19 bp, Homo sapiens
ctgcactaaagccagcctg

SEQ ID NO: 1033751 - DNA, 17 bp, Homo sapiens
ctgcactaacagagtgg

SEQ ID NO: 1033752 - DNA, 19 bp, Homo sapiens
ctgcactactcctctgcag

SEQ ID NO: 1033753 - DNA, 23 bp, Homo sapiens
ctgcactactcctctgcagtgcc

SEQ ID NO: 1033754 - DNA, 19 bp, Homo sapiens
ctgcactaggcaggtaata

SEQ ID NO: 1033755 - DNA, 13 bp, Homo sapiens
ctgcactccagcc

SEQ ID NO: 1033756 - DNA, 17 bp, Homo sapiens
ctgcactccagcctggg

SEQ ID NO: 1033757 - DNA, 20 bp, Homo sapiens
ctgcactccagcctgggtga

SEQ ID NO: 1033758 - DNA, 18 bp, Homo sapiens
ctgcactccatggccacc

SEQ ID NO: 1033759 - DNA, 22 bp, Homo sapiens
ctgcactcccacctgacacacc

SEQ ID NO: 1033760 - DNA, 21 bp, Homo sapiens
ctgcactccctcctggagctc

SEQ ID NO: 1033761 - DNA, 14 bp, Homo sapiens
ctgcactccctggc

SEQ ID NO: 1033762 - DNA, 18 bp, Homo sapiens
ctgcactccctggccttg

SEQ ID NO: 1033763 - DNA, 19 bp, Homo sapiens
ctgcactccctggccttgc

SEQ ID NO: 1033764 - DNA, 18 bp, Homo sapiens
ctgcactctaaactgcaa

SEQ ID NO: 1033765 - DNA, 20 bp, Homo sapiens
ctgcactctaaactgcaaac

SEQ ID NO: 1033766 - DNA, 18 bp, Homo sapiens
ctgcactgaaacctgaga

SEQ ID NO: 1033767 - DNA, 14 bp, Homo sapiens
ctgcactgagaggg

SEQ ID NO: 1033768 - DNA, 11 bp, Homo sapiens
ctgcactgagt

SEQ ID NO: 1033769 - DNA, 15 bp, Homo sapiens
ctgcactggagccac

SEQ ID NO: 1033770 - DNA, 19 bp, Homo sapiens
ctgcactggagccacaggc

SEQ ID NO: 1033771 - DNA, 17 bp, Homo sapiens
ctgcactgggaaggaaa

SEQ ID NO: 1033772 - DNA, 20 bp, Homo sapiens
gggaaggagggttagggagg

SEQ ID NO: 1033773 - DNA, 13 bp, Homo sapiens
gggaaggatacaa

SEQ ID NO: 1033774 - DNA, 16 bp, Homo sapiens
gggaaggatacaaaag

SEQ ID NO: 1033775 - DNA, 21 bp, Homo sapiens
gggaaggatacaaaagcatgt

SEQ ID NO: 1033776 - DNA, 15 bp, Homo sapiens
gggaaggcagaggct

SEQ ID NO: 1033777 - DNA, 14 bp, Homo sapiens
gggaagggacacac

SEQ ID NO: 1033778 - DNA, 12 bp, Homo sapiens
gggaagggcagg

SEQ ID NO: 1033779 - DNA, 15 bp, Homo sapiens
gggaagggcatgcac

SEQ ID NO: 1033780 - DNA, 20 bp, Homo sapiens
gggaagggccaccctgctgc

SEQ ID NO: 1033781 - DNA, 16 bp, Homo sapiens
gggaagggcctgccca

SEQ ID NO: 1033782 - DNA, 16 bp, Homo sapiens
gggaaggggaggaggg

SEQ ID NO: 1033783 - DNA, 16 bp, Homo sapiens
gggaaggggatggagg

SEQ ID NO: 1033784 - DNA, 23 bp, Homo sapiens
gggaaggggatggaggccagagt

SEQ ID NO: 1033785 - DNA, 18 bp, Homo sapiens
gggaaggggcctccctcc

SEQ ID NO: 1033786 - DNA, 19 bp, Homo sapiens
gggaaggggtcctgcaggg

SEQ ID NO: 1033787 - DNA, 17 bp, Homo sapiens
gggaagggtcatagaaa

SEQ ID NO: 1033788 - DNA, 13 bp, Homo sapiens
gggaaggtgaccg

SEQ ID NO: 1033789 - DNA, 21 bp, Homo sapiens
gggaaggtggggtcctggagc

SEQ ID NO: 1033790 - DNA, 14 bp, Homo sapiens
gggaagtaacagac

SEQ ID NO: 1033791 - DNA, 16 bp, Homo sapiens
gggaagtacgtcccag

SEQ ID NO: 1033792 - DNA, 16 bp, Homo sapiens
gggaagtcctgggagg

SEQ ID NO: 1033793 - DNA, 20 bp, Homo sapiens
gggaagtcgggcatggtggc

SEQ ID NO: 1033794 - DNA, 14 bp, Homo sapiens
gggaataaccttcc

SEQ ID NO: 1033795 - DNA, 18 bp, Homo sapiens
gggaatactcacattttg

SEQ ID NO: 1033796 - DNA, 15 bp, Homo sapiens
gggaatccaagcctc

SEQ ID NO: 1033797 - DNA, 15 bp, Homo sapiens
gggaatgagcccaga

SEQ ID NO: 1033798 - DNA, 18 bp, Homo sapiens
gggaatgcacctccccaa

SEQ ID NO: 1033799 - DNA, 15 bp, Homo sapiens
gggaatgcagcagga

SEQ ID NO: 1033800 - DNA, 13 bp, Homo sapiens
gggaatgcctagg

SEQ ID NO: 1033801 - DNA, 15 bp, Homo sapiens
gggaatgcctggagg

SEQ ID NO: 1033802 - DNA, 13 bp, Homo sapiens
gggaatggaataa

SEQ ID NO: 1033803 - DNA, 22 bp, Homo sapiens
gggaatgggggagagaagggaa

SEQ ID NO: 1033804 - DNA, 21 bp, Homo sapiens
gggaatgttccctgcaccctg

SEQ ID NO: 1033805 - DNA, 17 bp, Homo sapiens
gggaattccctccccct

SEQ ID NO: 1033806 - DNA, 22 bp, Homo sapiens
gggaattgaggtctgctcggcc

SEQ ID NO: 1033807 - DNA, 18 bp, Homo sapiens
gggacaaaacccaccttg

SEQ ID NO: 1033808 - DNA, 14 bp, Homo sapiens
gggacaaagaaatc

SEQ ID NO: 1033809 - DNA, 18 bp, Homo sapiens
gggacaagtggactcagg

SEQ ID NO: 1033810 - DNA, 19 bp, Homo sapiens
gggacaagtggactcaggg

SEQ ID NO: 1033811 - DNA, 22 bp, Homo sapiens
gggacaagtggactcagggcag

SEQ ID NO: 1033812 - DNA, 19 bp, Homo sapiens
gggacacaaaactccgccc

SEQ ID NO: 1033813 - DNA, 23 bp, Homo sapiens
gggacacaaaactccgcccccag

SEQ ID NO: 1033814 - DNA, 14 bp, Homo sapiens
gggacacacacaca

SEQ ID NO: 1033815 - DNA, 14 bp, Homo sapiens
gggacacatgcccc

SEQ ID NO: 1033816 - DNA, 16 bp, Homo sapiens
gggacaccccccgccc

SEQ ID NO: 1033817 - DNA, 19 bp, Homo sapiens
gggacaccgtggggaaggg

SEQ ID NO: 1033818 - DNA, 14 bp, Homo sapiens
gggacacctgccct

SEQ ID NO: 1033819 - DNA, 17 bp, Homo sapiens
gggacagagacacctgc

SEQ ID NO: 1033820 - DNA, 14 bp, Homo sapiens
gggagagccaggct

SEQ ID NO: 1033821 - DNA, 13 bp, Homo sapiens
gggagagcctgct

SEQ ID NO: 1033822 - DNA, 14 bp, Homo sapiens
gggagagcctggca

SEQ ID NO: 1033823 - DNA, 13 bp, Homo sapiens
gggagagcgcctc

SEQ ID NO: 1033824 - DNA, 14 bp, Homo sapiens
gggagaggaagaga

SEQ ID NO: 1033825 - DNA, 14 bp, Homo sapiens
gggagaggactctg

SEQ ID NO: 1033826 - DNA, 14 bp, Homo sapiens
gggagaggctggga

SEQ ID NO: 1033827 - DNA, 17 bp, Homo sapiens
gggagagggaggtcact

SEQ ID NO: 1033828 - DNA, 15 bp, Homo sapiens
gggagagggggaggt

SEQ ID NO: 1033829 - DNA, 15 bp, Homo sapiens
gggagagggtctgga

SEQ ID NO: 1033830 - DNA, 14 bp, Homo sapiens
gggagatgggggct

SEQ ID NO: 1033831 - DNA, 17 bp, Homo sapiens
gggagattcaagggacc

SEQ ID NO: 1033832 - DNA, 15 bp, Homo sapiens
gggagattctgggtt

SEQ ID NO: 1033833 - DNA, 14 bp, Homo sapiens
gggagcaagacaga

SEQ ID NO: 1033834 - DNA, 14 bp, Homo sapiens
gggagcacaaggcc

SEQ ID NO: 1033835 - DNA, 21 bp, Homo sapiens
gggagcacaggtgtctgccta

SEQ ID NO: 1033836 - DNA, 12 bp, Homo sapiens
gggagcacccag

SEQ ID NO: 1033837 - DNA, 20 bp, Homo sapiens
gggagcacggactgtcagtt

SEQ ID NO: 1033838 - DNA, 14 bp, Homo sapiens
gggagcactggagt

SEQ ID NO: 1033839 - DNA, 22 bp, Homo sapiens
gggagcacttgcgtcctgcaga

SEQ ID NO: 1033840 - DNA, 23 bp, Homo sapiens
gggagcacttgcgtcctgcagag

SEQ ID NO: 1033841 - DNA, 16 bp, Homo sapiens
gggagcagacaggagg

SEQ ID NO: 1033842 - DNA, 12 bp, Homo sapiens
gggagcagcttc

SEQ ID NO: 1033843 - DNA, 15 bp, Homo sapiens
gggagcaggaggcca

SEQ ID NO: 1033844 - DNA, 15 bp, Homo sapiens
gggagcaggcggtgg

SEQ ID NO: 1033845 - DNA, 21 bp, Homo sapiens
gggagcaggcggtgggcaccc

SEQ ID NO: 1033846 - DNA, 11 bp, Homo sapiens
gggagcagtgt

SEQ ID NO: 1033847 - DNA, 21 bp, Homo sapiens
gggagcatttaatggcagcta

SEQ ID NO: 1033848 - DNA, 22 bp, Homo sapiens
gggagcatttaatggcagctag

SEQ ID NO: 1033849 - DNA, 12 bp, Homo sapiens
gggagccagggt

SEQ ID NO: 1033850 - DNA, 13 bp, Homo sapiens
gggagccccaggg

SEQ ID NO: 1033851 - DNA, 16 bp, Homo sapiens
gggagcccccaccaca

SEQ ID NO: 1033852 - DNA, 16 bp, Homo sapiens
gggagcccccgccccg

SEQ ID NO: 1033853 - DNA, 16 bp, Homo sapiens
gggagccgctggcaga

SEQ ID NO: 1033854 - DNA, 12 bp, Homo sapiens
gggagcctagct

SEQ ID NO: 1033855 - DNA, 18 bp, Homo sapiens
gggagcctagctcctgcc

SEQ ID NO: 1033856 - DNA, 20 bp, Homo sapiens
gggagcctaggaccactcag

SEQ ID NO: 1033857 - DNA, 18 bp, Homo sapiens
gggagcctcgcccctcca

SEQ ID NO: 1033858 - DNA, 20 bp, Homo sapiens
gggagcctgaggcaggagaa

SEQ ID NO: 1033859 - DNA, 18 bp, Homo sapiens
gggagcgcctgaccctgg

SEQ ID NO: 1033860 - DNA, 17 bp, Homo sapiens
gggagctcctgggaccc

SEQ ID NO: 1033861 - DNA, 18 bp, Homo sapiens
gggagctctggggacagc

SEQ ID NO: 1033862 - DNA, 22 bp, Homo sapiens
gggagctgagctggaaggggcc

SEQ ID NO: 1033863 - DNA, 13 bp, Homo sapiens
gggagctgcacac

SEQ ID NO: 1033864 - DNA, 14 bp, Homo sapiens
gggagctgctggct

SEQ ID NO: 1033865 - DNA, 16 bp, Homo sapiens
gggagctgctgggcta

SEQ ID NO: 1033866 - DNA, 19 bp, Homo sapiens
gggagctggttagaaatgc

SEQ ID NO: 1033867 - DNA, 15 bp, Homo sapiens
gggagcttcctggct

SEQ ID NO: 1033868 - DNA, 19 bp, Homo sapiens
gggagcttcctggctctgg

SEQ ID NO: 1033869 - DNA, 15 bp, Homo sapiens
gggagcttgccacac

SEQ ID NO: 1033870 - DNA, 24 bp, Homo sapiens
gggaggaaatttgaatgggtccat

SEQ ID NO: 1033871 - DNA, 11 bp, Homo sapiens
gggaggaaggg

SEQ ID NO: 1033872 - DNA, 19 bp, Homo sapiens
gggaggaatcgaggaacca

SEQ ID NO: 1033873 - DNA, 15 bp, Homo sapiens
gggaggacctgctct

SEQ ID NO: 1033874 - DNA, 12 bp, Homo sapiens
gggaggacctgg

SEQ ID NO: 1033875 - DNA, 16 bp, Homo sapiens
gggaggacctggggca

SEQ ID NO: 1033876 - DNA, 19 bp, Homo sapiens
gggaggacctggggcacag

SEQ ID NO: 1033877 - DNA, 19 bp, Homo sapiens
gggaggagagccactgggc

SEQ ID NO: 1033878 - DNA, 15 bp, Homo sapiens
gggaggagcctctgg

SEQ ID NO: 1033879 - DNA, 19 bp, Homo sapiens
gggaggagcctctggcttc

SEQ ID NO: 1033880 - DNA, 18 bp, Homo sapiens
gggaggagggagagggag

SEQ ID NO: 1033881 - DNA, 12 bp, Homo sapiens
gggaggagggga

SEQ ID NO: 1033882 - DNA, 20 bp, Homo sapiens
gggaggaggtggcagccctg

SEQ ID NO: 1033883 - DNA, 14 bp, Homo sapiens
gggaggagtcaggg

SEQ ID NO: 1033884 - DNA, 18 bp, Homo sapiens
gggaggagtgacatgaag

SEQ ID NO: 1033885 - DNA, 13 bp, Homo sapiens
gggaggatacaga

SEQ ID NO: 1033886 - DNA, 18 bp, Homo sapiens
gggaggcaagaggggtgg

SEQ ID NO: 1033887 - DNA, 18 bp, Homo sapiens
gggaggcaagtgtggggg

SEQ ID NO: 1033888 - DNA, 11 bp, Homo sapiens
gggaggcagcg

SEQ ID NO: 1033889 - DNA, 20 bp, Homo sapiens
gggaggccaaggtgggcgga

SEQ ID NO: 1033890 - DNA, 16 bp, Homo sapiens
gggaggccaccccaaa

SEQ ID NO: 1033891 - DNA, 19 bp, Homo sapiens
gggaggccaggcgagcctg

SEQ ID NO: 1033892 - DNA, 16 bp, Homo sapiens
gggaggccaggcgggc

SEQ ID NO: 1033893 - DNA, 14 bp, Homo sapiens
gggaggccctgcct

SEQ ID NO: 1033894 - DNA, 18 bp, Homo sapiens
gggaggccgaggtgggca

SEQ ID NO: 1033895 - DNA, 14 bp, Homo sapiens
gggaggcgcaggga

SEQ ID NO: 1033896 - DNA, 18 bp, Homo sapiens
gggaggcgtggagggtga

SEQ ID NO: 1033897 - DNA, 13 bp, Homo sapiens
gggaggctcaggt

SEQ ID NO: 1033898 - DNA, 13 bp, Homo sapiens
gggaggctggggc

SEQ ID NO: 1033899 - DNA, 13 bp, Homo sapiens
gggagggaaaagg

SEQ ID NO: 1033900 - DNA, 15 bp, Homo sapiens
gggagggaagggcca

SEQ ID NO: 1033901 - DNA, 18 bp, Homo sapiens
gggagggacagggcaggc

SEQ ID NO: 1033902 - DNA, 21 bp, Homo sapiens
gggagggaccgcgcaggctcc

SEQ ID NO: 1033903 - DNA, 22 bp, Homo sapiens
gggagggagtctcaggaggagg

SEQ ID NO: 1033904 - DNA, 17 bp, Homo sapiens
ctgcaggcagacacgga

SEQ ID NO: 1033905 - DNA, 16 bp, Homo sapiens
ctgcaggcagagctgg

SEQ ID NO: 1033906 - DNA, 21 bp, Homo sapiens
ctgcaggcagagctggagccc

SEQ ID NO: 1033907 - DNA, 15 bp, Homo sapiens
ctgcaggcaggcggc

SEQ ID NO: 1033908 - DNA, 19 bp, Homo sapiens
ctgcaggccaagagcagag

SEQ ID NO: 1033909 - DNA, 20 bp, Homo sapiens
ctgcaggccactgtgagcgc

SEQ ID NO: 1033910 - DNA, 18 bp, Homo sapiens
ctgcaggccaggccagct

SEQ ID NO: 1033911 - DNA, 14 bp, Homo sapiens
ctgcaggccccgct

SEQ ID NO: 1033912 - DNA, 17 bp, Homo sapiens
ctgcaggccctccctct

SEQ ID NO: 1033913 - DNA, 15 bp, Homo sapiens
ctgcaggccctggcc

SEQ ID NO: 1033914 - DNA, 18 bp, Homo sapiens
ctgcaggccctggcctcc

SEQ ID NO: 1033915 - DNA, 21 bp, Homo sapiens
ctgcaggccctggcctcccct

SEQ ID NO: 1033916 - DNA, 23 bp, Homo sapiens
ctgcaggcctaggtgcagctcct

SEQ ID NO: 1033917 - DNA, 17 bp, Homo sapiens
ctgcaggctcccgagtg

SEQ ID NO: 1033918 - DNA, 19 bp, Homo sapiens
ctgcaggctgcaggagggc

SEQ ID NO: 1033919 - DNA, 18 bp, Homo sapiens
ctgcaggctggagactgg

SEQ ID NO: 1033920 - DNA, 12 bp, Homo sapiens
ctgcagggaaaa

SEQ ID NO: 1033921 - DNA, 11 bp, Homo sapiens
ctgcagggcac

SEQ ID NO: 1033922 - DNA, 20 bp, Homo sapiens
ctgcagggcacggggacctg

SEQ ID NO: 1033923 - DNA, 16 bp, Homo sapiens
ctgcagggccaagcac

SEQ ID NO: 1033924 - DNA, 15 bp, Homo sapiens
ctgcagggctcccat

SEQ ID NO: 1033925 - DNA, 16 bp, Homo sapiens
ctgcagggctcccatg

SEQ ID NO: 1033926 - DNA, 16 bp, Homo sapiens
ctgcagggcttctcct

SEQ ID NO: 1033927 - DNA, 20 bp, Homo sapiens
ctgcaggggccactccaaac

SEQ ID NO: 1033928 - DNA, 15 bp, Homo sapiens
ctgcaggggcctgga

SEQ ID NO: 1033929 - DNA, 18 bp, Homo sapiens
ctgcaggggcctggagga

SEQ ID NO: 1033930 - DNA, 23 bp, Homo sapiens
ctgcagggggtgtgtctgctcag

SEQ ID NO: 1033931 - DNA, 13 bp, Homo sapiens
ctgcagggtgacg

SEQ ID NO: 1033932 - DNA, 19 bp, Homo sapiens
ctgcagggtgacgcctgag

SEQ ID NO: 1033933 - DNA, 23 bp, Homo sapiens
ctgcagggtgacgcctgagacag

SEQ ID NO: 1033934 - DNA, 19 bp, Homo sapiens
ctgcagggtggtgctggga

SEQ ID NO: 1033935 - DNA, 23 bp, Homo sapiens
ctgcaggtacttcctcctgatgg

SEQ ID NO: 1033936 - DNA, 15 bp, Homo sapiens
ctgcaggtgctgctg

SEQ ID NO: 1033937 - DNA, 14 bp, Homo sapiens
ctgcaggtgtctga

SEQ ID NO: 1033938 - DNA, 20 bp, Homo sapiens
ctgcaggttcttcttcctga

SEQ ID NO: 1033939 - DNA, 17 bp, Homo sapiens
ctgcaggttgaagccat

SEQ ID NO: 1033940 - DNA, 14 bp, Homo sapiens
ctgcaggttgttca

SEQ ID NO: 1033941 - DNA, 15 bp, Homo sapiens
ctgcaggtttctcct

SEQ ID NO: 1033942 - DNA, 13 bp, Homo sapiens
ctgcaggtttgta

SEQ ID NO: 1033943 - DNA, 21 bp, Homo sapiens
gggcacgtgtgggccgtggct

SEQ ID NO: 1033944 - DNA, 21 bp, Homo sapiens
gggcactccgcgccgatgcca

SEQ ID NO: 1033945 - DNA, 18 bp, Homo sapiens
gggcactgaccaggccca

SEQ ID NO: 1033946 - DNA, 18 bp, Homo sapiens
gggcactgctccaaggga

SEQ ID NO: 1033947 - DNA, 21 bp, Homo sapiens
gggcactgctccaagggacag

SEQ ID NO: 1033948 - DNA, 14 bp, Homo sapiens
gggcactgggctgt

SEQ ID NO: 1033949 - DNA, 22 bp, Homo sapiens
gggcacttaatttgtaaacttc

SEQ ID NO: 1033950 - DNA, 16 bp, Homo sapiens
gggcacttcaggtccg

SEQ ID NO: 1033951 - DNA, 17 bp, Homo sapiens
gggcacttcctccacag

SEQ ID NO: 1033952 - DNA, 22 bp, Homo sapiens
gggcactttttaattcaccaaa

SEQ ID NO: 1033953 - DNA, 14 bp, Homo sapiens
gggcagaagggaga

SEQ ID NO: 1033954 - DNA, 19 bp, Homo sapiens
gggcagaagggagaaggat

SEQ ID NO: 1033955 - DNA, 20 bp, Homo sapiens
gggcagaatgaattcgatgc

SEQ ID NO: 1033956 - DNA, 14 bp, Homo sapiens
gggcagactgtgaa

SEQ ID NO: 1033957 - DNA, 18 bp, Homo sapiens
gggcagactgtgaacttg

SEQ ID NO: 1033958 - DNA, 16 bp, Homo sapiens
gggcagagccaggaag

SEQ ID NO: 1033959 - DNA, 14 bp, Homo sapiens
gggcagagccatgg

SEQ ID NO: 1033960 - DNA, 18 bp, Homo sapiens
gggcagagccatgggcct

SEQ ID NO: 1033961 - DNA, 19 bp, Homo sapiens
gggcagagccatgggcctg

SEQ ID NO: 1033962 - DNA, 14 bp, Homo sapiens
gggcagagcccaag

SEQ ID NO: 1033963 - DNA, 17 bp, Homo sapiens
gggcagagccgggaagc

SEQ ID NO: 1033964 - DNA, 19 bp, Homo sapiens
gggcagagctggctctgag

SEQ ID NO: 1033965 - DNA, 15 bp, Homo sapiens
gggcagaggaagaga

SEQ ID NO: 1033966 - DNA, 16 bp, Homo sapiens
gggcagaggctggagg

SEQ ID NO: 1033967 - DNA, 14 bp, Homo sapiens
gggcagagggaatg

SEQ ID NO: 1033968 - DNA, 15 bp, Homo sapiens
gggcagagggctgga

SEQ ID NO: 1033969 - DNA, 14 bp, Homo sapiens
gggcagaggggcag

SEQ ID NO: 1033970 - DNA, 21 bp, Homo sapiens
gggcagatccccactgtccta

SEQ ID NO: 1033971 - DNA, 16 bp, Homo sapiens
gggcagattttcagca

SEQ ID NO: 1033972 - DNA, 14 bp, Homo sapiens
gggcagcaaggcct

SEQ ID NO: 1033973 - DNA, 13 bp, Homo sapiens
gggcagcaaggct

SEQ ID NO: 1033974 - DNA, 16 bp, Homo sapiens
gggcagcaatttaaat

SEQ ID NO: 1033975 - DNA, 12 bp, Homo sapiens
gggcagcaccct

SEQ ID NO: 1033976 - DNA, 15 bp, Homo sapiens
gggcagcaccctccc

SEQ ID NO: 1033977 - DNA, 17 bp, Homo sapiens
gggcagcaccctccccc

SEQ ID NO: 1033978 - DNA, 23 bp, Homo sapiens
gggcagcagcatcccagccttga

SEQ ID NO: 1033979 - DNA, 17 bp, Homo sapiens
gggcagcagtggggtga

SEQ ID NO: 1033980 - DNA, 20 bp, Homo sapiens
gggcagcatagcaagacaca

SEQ ID NO: 1033981 - DNA, 16 bp, Homo sapiens
gggcagcatgcccaga

SEQ ID NO: 1033982 - DNA, 17 bp, Homo sapiens
gggcagccacaggactg

SEQ ID NO: 1033983 - DNA, 18 bp, Homo sapiens
gggcagccacaggactga

SEQ ID NO: 1033984 - DNA, 12 bp, Homo sapiens
gggcagccaggc

SEQ ID NO: 1033985 - DNA, 18 bp, Homo sapiens
gggcagccaggctgggcc

SEQ ID NO: 1033986 - DNA, 13 bp, Homo sapiens
gggcagccctcca

SEQ ID NO: 1033987 - DNA, 12 bp, Homo sapiens
gggcagccctga

SEQ ID NO: 1033988 - DNA, 14 bp, Homo sapiens
gggcagcccttgct

SEQ ID NO: 1033989 - DNA, 12 bp, Homo sapiens
gggcagcctgct

SEQ ID NO: 1033990 - DNA, 15 bp, Homo sapiens
gggcagcgccaggct

SEQ ID NO: 1033991 - DNA, 17 bp, Homo sapiens
gggcagcggctccactt

SEQ ID NO: 1033992 - DNA, 17 bp, Homo sapiens
gggcagctccatcctct

SEQ ID NO: 1033993 - DNA, 11 bp, Homo sapiens
gggcagctcct

SEQ ID NO: 1033994 - DNA, 21 bp, Homo sapiens
gggcagctcctccctgtgccc

SEQ ID NO: 1033995 - DNA, 16 bp, Homo sapiens
gggcagctgccagaga

SEQ ID NO: 1033996 - DNA, 18 bp, Homo sapiens
gggcagctgccagagaag

SEQ ID NO: 1033997 - DNA, 12 bp, Homo sapiens
gggcagctgcct

SEQ ID NO: 1033998 - DNA, 11 bp, Homo sapiens
gggcagctgtg

SEQ ID NO: 1033999 - DNA, 18 bp, Homo sapiens
gggcaggaaggagagcct

SEQ ID NO: 1034000 - DNA, 16 bp, Homo sapiens
gggcaggaccctgctg

SEQ ID NO: 1034001 - DNA, 19 bp, Homo sapiens
gggcaggaccctgctgact

SEQ ID NO: 1034002 - DNA, 17 bp, Homo sapiens
gggcaggagtgccagga

SEQ ID NO: 1034003 - DNA, 20 bp, Homo sapiens
gggcaggagtgccaggacca

SEQ ID NO: 1034004 - DNA, 14 bp, Homo sapiens
gggcaggcctggga

SEQ ID NO: 1034005 - DNA, 23 bp, Homo sapiens
gggcaggcctgggacccagctac

SEQ ID NO: 1034006 - DNA, 18 bp, Homo sapiens
gggcaggccttgctgggg

SEQ ID NO: 1034007 - DNA, 17 bp, Homo sapiens
gggcaggcgcagaggtc

SEQ ID NO: 1034008 - DNA, 12 bp, Homo sapiens
gggcaggctggg

SEQ ID NO: 1034009 - DNA, 14 bp, Homo sapiens
gggcaggctgggcc

SEQ ID NO: 1034010 - DNA, 16 bp, Homo sapiens
gggcaggctgggccat

SEQ ID NO: 1034011 - DNA, 20 bp, Homo sapiens
gggcagggaaggggaggcag

SEQ ID NO: 1034012 - DNA, 17 bp, Homo sapiens
gggcagggacttgcctc

SEQ ID NO: 1034013 - DNA, 16 bp, Homo sapiens
gggcaggggagccagg

SEQ ID NO: 1034014 - DNA, 13 bp, Homo sapiens
gggcagggtctgg

SEQ ID NO: 1034015 - DNA, 18 bp, Homo sapiens
gggcagggttatttaata

SEQ ID NO: 1034016 - DNA, 21 bp, Homo sapiens
gggcaggtggccgcccctgag

SEQ ID NO: 1034017 - DNA, 18 bp, Homo sapiens
gggcaggtggtggcactg

SEQ ID NO: 1034018 - DNA, 19 bp, Homo sapiens
gggcaggtgtttctttcct

SEQ ID NO: 1034019 - DNA, 16 bp, Homo sapiens
gggcaggttcctgggg

SEQ ID NO: 1034020 - DNA, 21 bp, Homo sapiens
gggcaggttcctggggccgcc

SEQ ID NO: 1034021 - DNA, 21 bp, Homo sapiens
gggcaggttctgcctgctttg

SEQ ID NO: 1034022 - DNA, 22 bp, Homo sapiens
gggcagtacctgggaaaggacc

SEQ ID NO: 1034023 - DNA, 19 bp, Homo sapiens
gggcagtatgtgatggact

SEQ ID NO: 1034024 - DNA, 21 bp, Homo sapiens
gggcagtcaccacccagccct

SEQ ID NO: 1034025 - DNA, 15 bp, Homo sapiens
gggcagtctgctctg

SEQ ID NO: 1034026 - DNA, 24 bp, Homo sapiens
gggcagtctgctctgctgctctga

SEQ ID NO: 1034027 - DNA, 23 bp, Homo sapiens
gggcagtcttgcaacagtgccat

SEQ ID NO: 1034028 - DNA, 15 bp, Homo sapiens
gggcagtgactggca

SEQ ID NO: 1034029 - DNA, 16 bp, Homo sapiens
gggcagtgagtgccat

SEQ ID NO: 1034030 - DNA, 15 bp, Homo sapiens
gggcagtgccacagc

SEQ ID NO: 1034031 - DNA, 16 bp, Homo sapiens
gggcagtgccacagcc

SEQ ID NO: 1034032 - DNA, 19 bp, Homo sapiens
gggcagtgccacagcctgc

SEQ ID NO: 1034033 - DNA, 13 bp, Homo sapiens
gggcagtgccagc

SEQ ID NO: 1034034 - DNA, 17 bp, Homo sapiens
gggcagtgccagccaat

SEQ ID NO: 1034035 - DNA, 14 bp, Homo sapiens
gggcagtgcccttt

SEQ ID NO: 1034036 - DNA, 15 bp, Homo sapiens
gggcagtgccctttg

SEQ ID NO: 1034037 - DNA, 21 bp, Homo sapiens
gggcagtgggacccatagatc

SEQ ID NO: 1034038 - DNA, 19 bp, Homo sapiens
ctgccaggcgttggtgcca

SEQ ID NO: 1034039 - DNA, 22 bp, Homo sapiens
ctgccaggcgttggtgccactt

SEQ ID NO: 1034040 - DNA, 15 bp, Homo sapiens
ctgccaggctgtttc

SEQ ID NO: 1034041 - DNA, 12 bp, Homo sapiens
ctgccagggcag

SEQ ID NO: 1034042 - DNA, 13 bp, Homo sapiens
ctgccagggcagg

SEQ ID NO: 1034043 - DNA, 15 bp, Homo sapiens
ctgccagggcagggc

SEQ ID NO: 1034044 - DNA, 12 bp, Homo sapiens
ctgccagggctt

SEQ ID NO: 1034045 - DNA, 13 bp, Homo sapiens
ctgccagggcttc

SEQ ID NO: 1034046 - DNA, 21 bp, Homo sapiens
ctgccaggggtaacctggcca

SEQ ID NO: 1034047 - DNA, 18 bp, Homo sapiens
ctgccaggtgagaaactg

SEQ ID NO: 1034048 - DNA, 20 bp, Homo sapiens
ctgccagtccccctgcccca

SEQ ID NO: 1034049 - DNA, 21 bp, Homo sapiens
ctgccagtccccctgccccag

SEQ ID NO: 1034050 - DNA, 17 bp, Homo sapiens
ctgccagtctgccttcc

SEQ ID NO: 1034051 - DNA, 20 bp, Homo sapiens
ctgccagtgaagtccttcag

SEQ ID NO: 1034052 - DNA, 21 bp, Homo sapiens
ctgccagtgaagtccttcagt

SEQ ID NO: 1034053 - DNA, 19 bp, Homo sapiens
ctgccagtgacagacaggc

SEQ ID NO: 1034054 - DNA, 21 bp, Homo sapiens
ctgccagtgacagacaggctc

SEQ ID NO: 1034055 - DNA, 14 bp, Homo sapiens
ctgccagtgcagcc

SEQ ID NO: 1034056 - DNA, 13 bp, Homo sapiens
ctgccagtgccag

SEQ ID NO: 1034057 - DNA, 16 bp, Homo sapiens
ctgccagtgccagggt

SEQ ID NO: 1034058 - DNA, 17 bp, Homo sapiens
ctgccagtgccagggtg

SEQ ID NO: 1034059 - DNA, 17 bp, Homo sapiens
ctgccagtgccttacct

SEQ ID NO: 1034060 - DNA, 18 bp, Homo sapiens
ctgccagtgccttacctc

SEQ ID NO: 1034061 - DNA, 21 bp, Homo sapiens
ctgccagtggggaaggaggcc

SEQ ID NO: 1034062 - DNA, 15 bp, Homo sapiens
ctgccagtgtggagt

SEQ ID NO: 1034063 - DNA, 22 bp, Homo sapiens
ctgccataaaacattaagaaaa

SEQ ID NO: 1034064 - DNA, 23 bp, Homo sapiens
ctgccataaaacattaagaaaat

SEQ ID NO: 1034065 - DNA, 15 bp, Homo sapiens
gggcatgccaccctc

SEQ ID NO: 1034066 - DNA, 19 bp, Homo sapiens
gggcatgccaccctcacac

SEQ ID NO: 1034067 - DNA, 17 bp, Homo sapiens
gggcatggacagggcca

SEQ ID NO: 1034068 - DNA, 22 bp, Homo sapiens
gggcatggacgttcggggcatg

SEQ ID NO: 1034069 - DNA, 13 bp, Homo sapiens
gggcatggccgct

SEQ ID NO: 1034070 - DNA, 20 bp, Homo sapiens
gggcatgtattggcctggag

SEQ ID NO: 1034071 - DNA, 16 bp, Homo sapiens
gggcatgtcctttcca

SEQ ID NO: 1034072 - DNA, 20 bp, Homo sapiens
gggcatgtcctttccatctg

SEQ ID NO: 1034073 - DNA, 18 bp, Homo sapiens
gggcatgtgcggctgaac

SEQ ID NO: 1034074 - DNA, 20 bp, Homo sapiens
gggcatgtgcggctgaactg

SEQ ID NO: 1034075 - DNA, 20 bp, Homo sapiens
gggcatgtgtgcctgtggca

SEQ ID NO: 1034076 - DNA, 15 bp, Homo sapiens
gggcattagtgtccc

SEQ ID NO: 1034077 - DNA, 19 bp, Homo sapiens
gggcattagtgtcccccct

SEQ ID NO: 1034078 - DNA, 22 bp, Homo sapiens
gggcattagtgtccccccttga

SEQ ID NO: 1034079 - DNA, 23 bp, Homo sapiens
gggcattgcagccttgcgctgtc

SEQ ID NO: 1034080 - DNA, 14 bp, Homo sapiens
gggcattgggctga

SEQ ID NO: 1034081 - DNA, 16 bp, Homo sapiens
gggcatttattttata

SEQ ID NO: 1034082 - DNA, 21 bp, Homo sapiens
gggcatttcttgcgagcctcg

SEQ ID NO: 1034083 - DNA, 15 bp, Homo sapiens
gggcatttggtgaga

SEQ ID NO: 1034084 - DNA, 19 bp, Homo sapiens
gggcattttcctcctctgc

SEQ ID NO: 1034085 - DNA, 21 bp, Homo sapiens
gggcattttcctcctctgcct

SEQ ID NO: 1034086 - DNA, 12 bp, Homo sapiens
gggcatttttat

SEQ ID NO: 1034087 - DNA, 23 bp, Homo sapiens
gggccaacttgagggcccagagc

SEQ ID NO: 1034088 - DNA, 17 bp, Homo sapiens
gggccaagacagatgga

SEQ ID NO: 1034089 - DNA, 18 bp, Homo sapiens
gggccaagtccactgtcc

SEQ ID NO: 1034090 - DNA, 20 bp, Homo sapiens
gggccacacccaggaaggga

SEQ ID NO: 1034091 - DNA, 20 bp, Homo sapiens
gggccacacctgagcgctgt

SEQ ID NO: 1034092 - DNA, 14 bp, Homo sapiens
gggccacagggcaa

SEQ ID NO: 1034093 - DNA, 14 bp, Homo sapiens
gggccaccaaagct

SEQ ID NO: 1034094 - DNA, 19 bp, Homo sapiens
gggccaccaaagctgccca

SEQ ID NO: 1034095 - DNA, 19 bp, Homo sapiens
gggccaccatgaccccttc

SEQ ID NO: 1034096 - DNA, 20 bp, Homo sapiens
gggccaccatgaccccttct

SEQ ID NO: 1034097 - DNA, 19 bp, Homo sapiens
gggccaccccgtgcccctg

SEQ ID NO: 1034098 - DNA, 10 bp, Homo sapiens
gggccaccct

SEQ ID NO: 1034099 - DNA, 15 bp, Homo sapiens
gggccaccctgctgc

SEQ ID NO: 1034100 - DNA, 16 bp, Homo sapiens
gggccaccctgctgca

SEQ ID NO: 1034101 - DNA, 17 bp, Homo sapiens
gggccaccctgctgcac

SEQ ID NO: 1034102 - DNA, 11 bp, Homo sapiens
gggccacctcc

SEQ ID NO: 1034103 - DNA, 12 bp, Homo sapiens
gggccacctcct

SEQ ID NO: 1034104 - DNA, 16 bp, Homo sapiens
gggccacctcctcccc

SEQ ID NO: 1034105 - DNA, 15 bp, Homo sapiens
gggccacctgcagga

SEQ ID NO: 1034106 - DNA, 17 bp, Homo sapiens
gggccacctgcaggacc

SEQ ID NO: 1034107 - DNA, 13 bp, Homo sapiens
gggccacctgcct

SEQ ID NO: 1034108 - DNA, 14 bp, Homo sapiens
gggccacctgcctg

SEQ ID NO: 1034109 - DNA, 20 bp, Homo sapiens
gggccacgctcttgaggaag

SEQ ID NO: 1034110 - DNA, 19 bp, Homo sapiens
gggccactctcccctccct

SEQ ID NO: 1034111 - DNA, 14 bp, Homo sapiens
gggccactgaccca

SEQ ID NO: 1034112 - DNA, 23 bp, Homo sapiens
gggccactgacccacctgcgctt

SEQ ID NO: 1034113 - DNA, 11 bp, Homo sapiens
gggccactggg

SEQ ID NO: 1034114 - DNA, 20 bp, Homo sapiens
gggccactgtggtggcagtg

SEQ ID NO: 1034115 - DNA, 21 bp, Homo sapiens
gggccactttttttttatact

SEQ ID NO: 1034116 - DNA, 21 bp, Homo sapiens
gggccagaaggagggcagagc

SEQ ID NO: 1034117 - DNA, 16 bp, Homo sapiens
gggccagactggaaga

SEQ ID NO: 1034118 - DNA, 19 bp, Homo sapiens
gggccagagagcaggggag

SEQ ID NO: 1034119 - DNA, 20 bp, Homo sapiens
gggccagagagcaggggagc

SEQ ID NO: 1034120 - DNA, 22 bp, Homo sapiens
gggccagagagcaggggagctt

SEQ ID NO: 1034121 - DNA, 16 bp, Homo sapiens
gggccagagctagggc

SEQ ID NO: 1034122 - DNA, 21 bp, Homo sapiens
gggccagagctagggctgctg

SEQ ID NO: 1034123 - DNA, 22 bp, Homo sapiens
gggccagagctagggctgctgc

SEQ ID NO: 1034124 - DNA, 20 bp, Homo sapiens
gggccagatgattttcctcc

SEQ ID NO: 1034125 - DNA, 12 bp, Homo sapiens
gggccagcagag

SEQ ID NO: 1034126 - DNA, 15 bp, Homo sapiens
gggccagcaggctcc

SEQ ID NO: 1034127 - DNA, 21 bp, Homo sapiens
gggccagcataggggggaggg

SEQ ID NO: 1034128 - DNA, 15 bp, Homo sapiens
gggccagccaggcgg

SEQ ID NO: 1034129 - DNA, 23 bp, Homo sapiens
gggccagccccacccccagccag

SEQ ID NO: 1034130 - DNA, 12 bp, Homo sapiens
gggccagcccct

SEQ ID NO: 1034131 - DNA, 13 bp, Homo sapiens
gggccagcccctc

SEQ ID NO: 1034132 - DNA, 20 bp, Homo sapiens
gggccagcgatttttgagga

SEQ ID NO: 1034133 - DNA, 18 bp, Homo sapiens
gggccagctggggagatg

SEQ ID NO: 1034134 - DNA, 16 bp, Homo sapiens
gggccaggacaggccc

SEQ ID NO: 1034135 - DNA, 13 bp, Homo sapiens
gggccaggcactg

SEQ ID NO: 1034136 - DNA, 13 bp, Homo sapiens
gggccaggcaggc

SEQ ID NO: 1034137 - DNA, 15 bp, Homo sapiens
gggccagggaggcag

SEQ ID NO: 1034138 - DNA, 12 bp, Homo sapiens
gggccagggcaa

SEQ ID NO: 1034139 - DNA, 16 bp, Homo sapiens
gggccagggcaatgcc

SEQ ID NO: 1034140 - DNA, 16 bp, Homo sapiens
gggccagggcagatgt

SEQ ID NO: 1034141 - DNA, 13 bp, Homo sapiens
gggccagggccct

SEQ ID NO: 1034142 - DNA, 13 bp, Homo sapiens
gggccagggctgc

SEQ ID NO: 1034143 - DNA, 20 bp, Homo sapiens
gggccagggctgccctgaga

SEQ ID NO: 1034144 - DNA, 21 bp, Homo sapiens
gggccagggctgccctgagaa

SEQ ID NO: 1034145 - DNA, 14 bp, Homo sapiens
gggccagggctgga

SEQ ID NO: 1034146 - DNA, 22 bp, Homo sapiens
gggccagggctggatggacaga

SEQ ID NO: 1034147 - DNA, 15 bp, Homo sapiens
gggccaggggcaggc

SEQ ID NO: 1034148 - DNA, 16 bp, Homo sapiens
gggccaggggcaggca

SEQ ID NO: 1034149 - DNA, 18 bp, Homo sapiens
gggccaggggcaggcagg

SEQ ID NO: 1034150 - DNA, 20 bp, Homo sapiens
gggccaggggcaggcagggc

SEQ ID NO: 1034151 - DNA, 23 bp, Homo sapiens
gggccaggggtctccctggagtg

SEQ ID NO: 1034152 - DNA, 17 bp, Homo sapiens
gggccaggtgcggcctg

SEQ ID NO: 1034153 - DNA, 18 bp, Homo sapiens
gggccagtcctcctggga

SEQ ID NO: 1034154 - DNA, 22 bp, Homo sapiens
gggccagtcctgcctggccagg

SEQ ID NO: 1034155 - DNA, 16 bp, Homo sapiens
gggccagtctgggctg

SEQ ID NO: 1034156 - DNA, 22 bp, Homo sapiens
gggccagtctgtggatcagaga

SEQ ID NO: 1034157 - DNA, 15 bp, Homo sapiens
gggccagtggggcct

SEQ ID NO: 1034158 - DNA, 18 bp, Homo sapiens
gggccagtggggcctgtg

SEQ ID NO: 1034159 - DNA, 19 bp, Homo sapiens
gggccagtggggcctgtgg

SEQ ID NO: 1034160 - DNA, 22 bp, Homo sapiens
gggccatgcctcctcaggagcc

SEQ ID NO: 1034161 - DNA, 14 bp, Homo sapiens
gggccatgctgaag

SEQ ID NO: 1034162 - DNA, 15 bp, Homo sapiens
gggccatgctgaggc

SEQ ID NO: 1034163 - DNA, 20 bp, Homo sapiens
gggccatgctgaggcctggg

SEQ ID NO: 1034164 - DNA, 19 bp, Homo sapiens
gggccatggtggagggcac

SEQ ID NO: 1034165 - DNA, 16 bp, Homo sapiens
ctgacctcaggtgatc

SEQ ID NO: 1034166 - DNA, 16 bp, Homo sapiens
ctgacctcccaactct

SEQ ID NO: 1034167 - DNA, 12 bp, Homo sapiens
ctgacctcccag

SEQ ID NO: 1034168 - DNA, 14 bp, Homo sapiens
ctgacctcccagcc

SEQ ID NO: 1034169 - DNA, 18 bp, Homo sapiens
ctgacctccctctaattt

SEQ ID NO: 1034170 - DNA, 21 bp, Homo sapiens
ctgacctccctctaatttatc

SEQ ID NO: 1034171 - DNA, 14 bp, Homo sapiens
ctgacctccgccat

SEQ ID NO: 1034172 - DNA, 19 bp, Homo sapiens
ctgacctccgccatccacc

SEQ ID NO: 1034173 - DNA, 13 bp, Homo sapiens
ctgacctctgctg

SEQ ID NO: 1034174 - DNA, 23 bp, Homo sapiens
ctgacctctgctgagtgctgggc

SEQ ID NO: 1034175 - DNA, 15 bp, Homo sapiens
ctgacctcttgctgt

SEQ ID NO: 1034176 - DNA, 17 bp, Homo sapiens
ctgacctcttgctgtct

SEQ ID NO: 1034177 - DNA, 20 bp, Homo sapiens
ctgacctcttgctgtctctg

SEQ ID NO: 1034178 - DNA, 23 bp, Homo sapiens
ctgacctcttgctgtctctgctc

SEQ ID NO: 1034179 - DNA, 12 bp, Homo sapiens
ctgacctgagcg

SEQ ID NO: 1034180 - DNA, 19 bp, Homo sapiens
ctgacctgagcggcaccct

SEQ ID NO: 1034181 - DNA, 21 bp, Homo sapiens
ctgacctgagcggcaccctgg

SEQ ID NO: 1034182 - DNA, 14 bp, Homo sapiens
ctgacctgcactgg

SEQ ID NO: 1034183 - DNA, 12 bp, Homo sapiens
ctgacctgcagg

SEQ ID NO: 1034184 - DNA, 17 bp, Homo sapiens
ctgacctgccagccggt

SEQ ID NO: 1034185 - DNA, 20 bp, Homo sapiens
ctgacctgcgggtcctcagc

SEQ ID NO: 1034186 - DNA, 18 bp, Homo sapiens
ctgacctgctccgccagg

SEQ ID NO: 1034187 - DNA, 20 bp, Homo sapiens
ctgacctgctccgccaggaa

SEQ ID NO: 1034188 - DNA, 14 bp, Homo sapiens
ctgacctgctgacc

SEQ ID NO: 1034189 - DNA, 15 bp, Homo sapiens
ctgacctgctgacct

SEQ ID NO: 1034190 - DNA, 13 bp, Homo sapiens
ctgacctgggccc

SEQ ID NO: 1034191 - DNA, 20 bp, Homo sapiens
ctgacctgggcccacagagc

SEQ ID NO: 1034192 - DNA, 21 bp, Homo sapiens
ctgacctgggcccacagagcc

SEQ ID NO: 1034193 - DNA, 18 bp, Homo sapiens
ctgacctgtcatgccccc

SEQ ID NO: 1034194 - DNA, 13 bp, Homo sapiens
ctgacctgtccag

SEQ ID NO: 1034195 - DNA, 15 bp, Homo sapiens
ggcctgatgctgccc

SEQ ID NO: 1034196 - DNA, 19 bp, Homo sapiens
ggcctgcaaaccttcctgg

SEQ ID NO: 1034197 - DNA, 22 bp, Homo sapiens
ggcctgcaaatctagtgccgaa

SEQ ID NO: 1034198 - DNA, 14 bp, Homo sapiens
ggcctgcacagata

SEQ ID NO: 1034199 - DNA, 19 bp, Homo sapiens
ggcctgcacagatacctca

SEQ ID NO: 1034200 - DNA, 18 bp, Homo sapiens
ggcctgcaccgaccccgg

SEQ ID NO: 1034201 - DNA, 16 bp, Homo sapiens
ggcctgccccctgggc

SEQ ID NO: 1034202 - DNA, 22 bp, Homo sapiens
ggcctgccccctgggctggggc

SEQ ID NO: 1034203 - DNA, 16 bp, Homo sapiens
ggcctgccctcaggga

SEQ ID NO: 1034204 - DNA, 13 bp, Homo sapiens
ggcctgccctccc

SEQ ID NO: 1034205 - DNA, 17 bp, Homo sapiens
ggcctgccggacacagc

SEQ ID NO: 1034206 - DNA, 18 bp, Homo sapiens
ggcctgccggacacagca

SEQ ID NO: 1034207 - DNA, 18 bp, Homo sapiens
ggcctgcctgcctccacc

SEQ ID NO: 1034208 - DNA, 14 bp, Homo sapiens
ggcctgcctggccc

SEQ ID NO: 1034209 - DNA, 23 bp, Homo sapiens
ggcctgcctggcccctcgcctgt

SEQ ID NO: 1034210 - DNA, 12 bp, Homo sapiens
ggcctgcgccca

SEQ ID NO: 1034211 - DNA, 18 bp, Homo sapiens
ggcctgcgcccagagctg

SEQ ID NO: 1034212 - DNA, 19 bp, Homo sapiens
ggcctgcgcccagagctgg

SEQ ID NO: 1034213 - DNA, 22 bp, Homo sapiens
ggcctgcgtctccatatgtgta

SEQ ID NO: 1034214 - DNA, 17 bp, Homo sapiens
ggcctgcgtgccgggag

SEQ ID NO: 1034215 - DNA, 20 bp, Homo sapiens
ggcctgctaaggctcctcct

SEQ ID NO: 1034216 - DNA, 21 bp, Homo sapiens
ggcctgctaaggctcctcctt

SEQ ID NO: 1034217 - DNA, 17 bp, Homo sapiens
ggcctgctcccagcagc

SEQ ID NO: 1034218 - DNA, 17 bp, Homo sapiens
ggcctgctgaggccttc

SEQ ID NO: 1034219 - DNA, 23 bp, Homo sapiens
ggcctgctgccagtgcagccact

SEQ ID NO: 1034220 - DNA, 11 bp, Homo sapiens
ggcctgctgcg

SEQ ID NO: 1034221 - DNA, 15 bp, Homo sapiens
ggcctgctggaggcc

SEQ ID NO: 1034222 - DNA, 20 bp, Homo sapiens
ggcctgctgggctctccacc

SEQ ID NO: 1034223 - DNA, 21 bp, Homo sapiens
ggcctgctgggctctccacct

SEQ ID NO: 1034224 - DNA, 23 bp, Homo sapiens
ggcctgctgggctctccacctca

SEQ ID NO: 1034225 - DNA, 19 bp, Homo sapiens
ggcctgcttttccaggatc

SEQ ID NO: 1034226 - DNA, 20 bp, Homo sapiens
ggcctgcttttccaggatcc

SEQ ID NO: 1034227 - DNA, 21 bp, Homo sapiens
ggcctgcttttccaggatcct

SEQ ID NO: 1034228 - DNA, 18 bp, Homo sapiens
ggcctggaccgagatgtg

SEQ ID NO: 1034229 - DNA, 20 bp, Homo sapiens
ggcctggaccgagatgtgag

SEQ ID NO: 1034230 - DNA, 20 bp, Homo sapiens
ggcctggacctatgcaggga

SEQ ID NO: 1034231 - DNA, 22 bp, Homo sapiens
ggcctggacctatgcagggagg

SEQ ID NO: 1034232 - DNA, 13 bp, Homo sapiens
ggcctggacctgc

SEQ ID NO: 1034233 - DNA, 21 bp, Homo sapiens
ggcctggacctgcctcctgcc

SEQ ID NO: 1034234 - DNA, 22 bp, Homo sapiens
ggcctggacctgcctcctgcct

SEQ ID NO: 1034235 - DNA, 20 bp, Homo sapiens
ggcctggacgggccctcctt

SEQ ID NO: 1034236 - DNA, 17 bp, Homo sapiens
ggcctggagatcctcct

SEQ ID NO: 1034237 - DNA, 18 bp, Homo sapiens
ggcctggagatcctcctg

SEQ ID NO: 1034238 - DNA, 15 bp, Homo sapiens
ggcctggagccccat

SEQ ID NO: 1034239 - DNA, 23 bp, Homo sapiens
ggcctggagccccatcggccaag

SEQ ID NO: 1034240 - DNA, 23 bp, Homo sapiens
ggcctggagcgtttgctgtgcca

SEQ ID NO: 1034241 - DNA, 14 bp, Homo sapiens
ggcctggaggaatc

SEQ ID NO: 1034242 - DNA, 15 bp, Homo sapiens
ggcctggaggctcag

SEQ ID NO: 1034243 - DNA, 22 bp, Homo sapiens
ggcctggagggcacttcctcca

SEQ ID NO: 1034244 - DNA, 19 bp, Homo sapiens
ggcctggattcatttcctg

SEQ ID NO: 1034245 - DNA, 14 bp, Homo sapiens
ggcctggcagccgt

SEQ ID NO: 1034246 - DNA, 16 bp, Homo sapiens
ggcctggcatctgtgc

SEQ ID NO: 1034247 - DNA, 14 bp, Homo sapiens
ggcctggccacctc

SEQ ID NO: 1034248 - DNA, 13 bp, Homo sapiens
ggcctggccaggc

SEQ ID NO: 1034249 - DNA, 14 bp, Homo sapiens
ggcctggccaggca

SEQ ID NO: 1034250 - DNA, 16 bp, Homo sapiens
ggcctggccatgtggc

SEQ ID NO: 1034251 - DNA, 15 bp, Homo sapiens
ggcctggcctcgcct

SEQ ID NO: 1034252 - DNA, 14 bp, Homo sapiens
ggcctggcctgagc

SEQ ID NO: 1034253 - DNA, 15 bp, Homo sapiens
ggcctggcggcctgt

SEQ ID NO: 1034254 - DNA, 17 bp, Homo sapiens
ggcctggcggcctgtgg

SEQ ID NO: 1034255 - DNA, 14 bp, Homo sapiens
ggcctggctcccca

SEQ ID NO: 1034256 - DNA, 23 bp, Homo sapiens
ggcctggctccccacgagtcacc

SEQ ID NO: 1034257 - DNA, 22 bp, Homo sapiens
ggcctggctggaggagcagcag

SEQ ID NO: 1034258 - DNA, 13 bp, Homo sapiens
ggcctggcttcac

SEQ ID NO: 1034259 - DNA, 17 bp, Homo sapiens
ggcctggcttgctccag

SEQ ID NO: 1034260 - DNA, 15 bp, Homo sapiens
ggcctgggacccagc

SEQ ID NO: 1034261 - DNA, 16 bp, Homo sapiens
ggcctgggacccagct

SEQ ID NO: 1034262 - DNA, 20 bp, Homo sapiens
ggcctgggagggttcccctg

SEQ ID NO: 1034263 - DNA, 15 bp, Homo sapiens
ggcctgggatgcagt

SEQ ID NO: 1034264 - DNA, 17 bp, Homo sapiens
ggcctgggcagccccac

SEQ ID NO: 1034265 - DNA, 18 bp, Homo sapiens
ggcctgggcaggaccctg

SEQ ID NO: 1034266 - DNA, 15 bp, Homo sapiens
ggcctgggcttggcc

SEQ ID NO: 1034267 - DNA, 23 bp, Homo sapiens
ggcctggggatgtaaccaagctg

SEQ ID NO: 1034268 - DNA, 14 bp, Homo sapiens
ggcctggggcctga

SEQ ID NO: 1034269 - DNA, 15 bp, Homo sapiens
ggcctggggcctgag

SEQ ID NO: 1034270 - DNA, 14 bp, Homo sapiens
ggcctggggctcct

SEQ ID NO: 1034271 - DNA, 20 bp, Homo sapiens
ggcctgggggacccctggct

SEQ ID NO: 1034272 - DNA, 22 bp, Homo sapiens
ggcctgggggacccctggctct

SEQ ID NO: 1034273 - DNA, 15 bp, Homo sapiens
ggcctgggggcagtg

SEQ ID NO: 1034274 - DNA, 17 bp, Homo sapiens
ggcctgggggcagtgac

SEQ ID NO: 1034275 - DNA, 20 bp, Homo sapiens
ggcctgggggcagtgactgg

SEQ ID NO: 1034276 - DNA, 19 bp, Homo sapiens
ggcctggggtccctctgaa

SEQ ID NO: 1034277 - DNA, 24 bp, Homo sapiens
ggcctggggtgcatcctcctcagc

SEQ ID NO: 1034278 - DNA, 18 bp, Homo sapiens
ggcctggggtgggacagg

SEQ ID NO: 1034279 - DNA, 19 bp, Homo sapiens
ggcctggggtgggacaggg

SEQ ID NO: 1034280 - DNA, 21 bp, Homo sapiens
ggcctgggtgctggctgccca

SEQ ID NO: 1034281 - DNA, 22 bp, Homo sapiens
ggcctggtgggtcagggggagt

SEQ ID NO: 1034282 - DNA, 23 bp, Homo sapiens
ggcctgtccacctgtgctgctgc

SEQ ID NO: 1034283 - DNA, 14 bp, Homo sapiens
ggcctgtcctccaa

SEQ ID NO: 1034284 - DNA, 15 bp, Homo sapiens
ggcctgtcgtgccag

SEQ ID NO: 1034285 - DNA, 17 bp, Homo sapiens
ggcctgtctcatcccca

SEQ ID NO: 1034286 - DNA, 19 bp, Homo sapiens
ggcctgtctccctagggaa

SEQ ID NO: 1034287 - DNA, 15 bp, Homo sapiens
ggcctgtgcactggg

SEQ ID NO: 1034288 - DNA, 21 bp, Homo sapiens
ggcctgtgcactgggcaggtt

SEQ ID NO: 1034289 - DNA, 13 bp, Homo sapiens
ggcctgtgcagca

SEQ ID NO: 1034290 - DNA, 14 bp, Homo sapiens
ggcctgtgcagcag

SEQ ID NO: 1034291 - DNA, 16 bp, Homo sapiens
ggcctgtgcagcagcc

SEQ ID NO: 1034292 - DNA, 17 bp, Homo sapiens
ggcctgtgcagcagccc

SEQ ID NO: 1034293 - DNA, 21 bp, Homo sapiens
ggcctgtgccagcaccacagc

SEQ ID NO: 1034294 - DNA, 18 bp, Homo sapiens
ggcctgtggaatgagtgt

SEQ ID NO: 1034295 - DNA, 22 bp, Homo sapiens
ggcctgtggaatgagtgtgcat

SEQ ID NO: 1034296 - DNA, 21 bp, Homo sapiens
ggcctgtgggtctctgaaggg

SEQ ID NO: 1034297 - DNA, 17 bp, Homo sapiens
ggcctgtggtggctccc

SEQ ID NO: 1034298 - DNA, 15 bp, Homo sapiens
ggcctgtgtccagca

SEQ ID NO: 1034299 - DNA, 19 bp, Homo sapiens
ggcctgtgtccagcagctg

SEQ ID NO: 1034300 - DNA, 21 bp, Homo sapiens
ggcctgtgtccagcagctgcg

SEQ ID NO: 1034301 - DNA, 20 bp, Homo sapiens
ggcctgtgtcccatgaccca

SEQ ID NO: 1034302 - DNA, 18 bp, Homo sapiens
ggcctgtgtgtgggtggg

SEQ ID NO: 1034303 - DNA, 19 bp, Homo sapiens
ggcctgtttgatgtatgtg

SEQ ID NO: 1034304 - DNA, 16 bp, Homo sapiens
ggccttaaagagggac

SEQ ID NO: 1034305 - DNA, 19 bp, Homo sapiens
ggccttaaagagggacagg

SEQ ID NO: 1034306 - DNA, 14 bp, Homo sapiens
ggccttaagaactg

SEQ ID NO: 1034307 - DNA, 20 bp, Homo sapiens
ggccttaatttcctttttga

SEQ ID NO: 1034308 - DNA, 18 bp, Homo sapiens
ggccttacatctggctgg

SEQ ID NO: 1034309 - DNA, 22 bp, Homo sapiens
ggccttagtagtcaaaaacaaa

SEQ ID NO: 1034310 - DNA, 22 bp, Homo sapiens
ggccttagtgggccagggctgc

SEQ ID NO: 1034311 - DNA, 17 bp, Homo sapiens
ggccttattgcatccca

SEQ ID NO: 1034312 - DNA, 12 bp, Homo sapiens
ggccttcacaat

SEQ ID NO: 1034313 - DNA, 19 bp, Homo sapiens
ggccttcgggaccctgggg

SEQ ID NO: 1034314 - DNA, 18 bp, Homo sapiens
ggccttctgtggggctgg

SEQ ID NO: 1034315 - DNA, 20 bp, Homo sapiens
ggccttctgtggggctgggc

SEQ ID NO: 1034316 - DNA, 12 bp, Homo sapiens
ggccttcttggt

SEQ ID NO: 1034317 - DNA, 18 bp, Homo sapiens
ggccttgaagacagagca

SEQ ID NO: 1034318 - DNA, 14 bp, Homo sapiens
ggccttgcccagag

SEQ ID NO: 1034319 - DNA, 21 bp, Homo sapiens
ctgacctgtgagcccagctgg

SEQ ID NO: 1034320 - DNA, 16 bp, Homo sapiens
ctgaccttagcgttct

SEQ ID NO: 1034321 - DNA, 19 bp, Homo sapiens
ctgaccttagcgttctgga

SEQ ID NO: 1034322 - DNA, 21 bp, Homo sapiens
ctgaccttagcgttctggact

SEQ ID NO: 1034323 - DNA, 22 bp, Homo sapiens
ctgaccttagcgttctggactc

SEQ ID NO: 1034324 - DNA, 13 bp, Homo sapiens
ctgaccttccttc

SEQ ID NO: 1034325 - DNA, 16 bp, Homo sapiens
ctgaccttgctgccac

SEQ ID NO: 1034326 - DNA, 20 bp, Homo sapiens
ctgaccttgctgccacaacc

SEQ ID NO: 1034327 - DNA, 21 bp, Homo sapiens
ctgaccttggaggaatgacaa

SEQ ID NO: 1034328 - DNA, 22 bp, Homo sapiens
ctgaccttggaggaatgacaat

SEQ ID NO: 1034329 - DNA, 21 bp, Homo sapiens
ctgaccttggctgactggggc

SEQ ID NO: 1034330 - DNA, 21 bp, Homo sapiens
ctgacctttgtcatctttctt

SEQ ID NO: 1034331 - DNA, 23 bp, Homo sapiens
ctgacctttgtcatctttcttct

SEQ ID NO: 1034332 - DNA, 17 bp, Homo sapiens
ctgacgaaactggcccc

SEQ ID NO: 1034333 - DNA, 20 bp, Homo sapiens
ctgacgaaactggccccgga

SEQ ID NO: 1034334 - DNA, 22 bp, Homo sapiens
ctgacgcattctcgtatccaac

SEQ ID NO: 1034335 - DNA, 23 bp, Homo sapiens
ctgacgccaataataaaaaacaa

SEQ ID NO: 1034336 - DNA, 21 bp, Homo sapiens
ctgacgccctgcgttggagcc

SEQ ID NO: 1034337 - DNA, 22 bp, Homo sapiens
ctgacgccctgcgttggagcca

SEQ ID NO: 1034338 - DNA, 17 bp, Homo sapiens
ctgacgctggagatgca

SEQ ID NO: 1034339 - DNA, 23 bp, Homo sapiens
ctgacgcttgtgacagtgcctct

SEQ ID NO: 1034340 - DNA, 19 bp, Homo sapiens
ctgacggcgcccccagtgt

SEQ ID NO: 1034341 - DNA, 22 bp, Homo sapiens
ctgacggcgcccccagtgtgca

SEQ ID NO: 1034342 - DNA, 14 bp, Homo sapiens
ctgacggctgggga

SEQ ID NO: 1034343 - DNA, 20 bp, Homo sapiens
ctgacggctggggacccacc

SEQ ID NO: 1034344 - DNA, 18 bp, Homo sapiens
ctgacggtgcagtctggg

SEQ ID NO: 1034345 - DNA, 23 bp, Homo sapiens
ctgacgtcaacccaagctctggg

SEQ ID NO: 1034346 - DNA, 20 bp, Homo sapiens
ctgacgtcagcgcaccaaaa

SEQ ID NO: 1034347 - DNA, 23 bp, Homo sapiens
ctgacgtctgaagcttgactccc

SEQ ID NO: 1034348 - DNA, 13 bp, Homo sapiens
ctgacgttccggg

SEQ ID NO: 1034349 - DNA, 23 bp, Homo sapiens
ctgacgttccgggcaaatgccag

SEQ ID NO: 1034350 - DNA, 15 bp, Homo sapiens
ctgactaaacttttt

SEQ ID NO: 1034351 - DNA, 22 bp, Homo sapiens
ctgactaaactttttttctgta

SEQ ID NO: 1034352 - DNA, 17 bp, Homo sapiens
ctgactactactctgcc

SEQ ID NO: 1034353 - DNA, 15 bp, Homo sapiens
ctgactactttgcct

SEQ ID NO: 1034354 - DNA, 22 bp, Homo sapiens
ctgactagaagggccagtcctg

SEQ ID NO: 1034355 - DNA, 23 bp, Homo sapiens
ctgactagaagggccagtcctgc

SEQ ID NO: 1034356 - DNA, 20 bp, Homo sapiens
ctgactagtttaaagatgga

SEQ ID NO: 1034357 - DNA, 13 bp, Homo sapiens
ctgactcacaaga

SEQ ID NO: 1034358 - DNA, 16 bp, Homo sapiens
ctgactcacaagaaga

SEQ ID NO: 1034359 - DNA, 21 bp, Homo sapiens
ctgactcacaagaagaccaga

SEQ ID NO: 1034360 - DNA, 12 bp, Homo sapiens
ctgactcagggc

SEQ ID NO: 1034361 - DNA, 14 bp, Homo sapiens
ctgactcagggctc

SEQ ID NO: 1034362 - DNA, 15 bp, Homo sapiens
ctgactcagggctcc

SEQ ID NO: 1034363 - DNA, 18 bp, Homo sapiens
ctgactcagggctcctgg

SEQ ID NO: 1034364 - DNA, 23 bp, Homo sapiens
ctgactcagtgtctgcctttaaa

SEQ ID NO: 1034365 - DNA, 21 bp, Homo sapiens
ctgactccagagtctgagccc

SEQ ID NO: 1034366 - DNA, 12 bp, Homo sapiens
ctgactccctcc

SEQ ID NO: 1034367 - DNA, 14 bp, Homo sapiens
ctgactccctgtgg

SEQ ID NO: 1034368 - DNA, 16 bp, Homo sapiens
ctgactccctgtgggg

SEQ ID NO: 1034369 - DNA, 17 bp, Homo sapiens
ctgactcctctaagcca

SEQ ID NO: 1034370 - DNA, 13 bp, Homo sapiens
ctgactcctctgg

SEQ ID NO: 1034371 - DNA, 14 bp, Homo sapiens
ctgactcctctggc

SEQ ID NO: 1034372 - DNA, 12 bp, Homo sapiens
ctgactcctgga

SEQ ID NO: 1034373 - DNA, 13 bp, Homo sapiens
ctgactcctggac

SEQ ID NO: 1034374 - DNA, 14 bp, Homo sapiens
ctgactcctggact

SEQ ID NO: 1034375 - DNA, 15 bp, Homo sapiens
ctgactcggtttctc

SEQ ID NO: 1034376 - DNA, 16 bp, Homo sapiens
ctgactcggtttctcc

SEQ ID NO: 1034377 - DNA, 13 bp, Homo sapiens
ctgactctctgag

SEQ ID NO: 1034378 - DNA, 18 bp, Homo sapiens
ctgactctctgagctggg

SEQ ID NO: 1034379 - DNA, 20 bp, Homo sapiens
ctgactctctgagctgggga

SEQ ID NO: 1034380 - DNA, 13 bp, Homo sapiens
ctgactctctgtg

SEQ ID NO: 1034381 - DNA, 18 bp, Homo sapiens
ctgactctctgtgacctg

SEQ ID NO: 1034382 - DNA, 14 bp, Homo sapiens
ctgactctgaaatc

SEQ ID NO: 1034383 - DNA, 13 bp, Homo sapiens
ctgactctgggtt

SEQ ID NO: 1034384 - DNA, 14 bp, Homo sapiens
ctgactctgggttc

SEQ ID NO: 1034385 - DNA, 22 bp, Homo sapiens
ctgactctgggttcgttgggga

SEQ ID NO: 1034386 - DNA, 14 bp, Homo sapiens
ctgactctgttatt

SEQ ID NO: 1034387 - DNA, 21 bp, Homo sapiens
ctgactgaaagtagggggctt

SEQ ID NO: 1034388 - DNA, 21 bp, Homo sapiens
ctgactgcccgctcctcggga

SEQ ID NO: 1034389 - DNA, 14 bp, Homo sapiens
ctgactgctcagaa

SEQ ID NO: 1034390 - DNA, 21 bp, Homo sapiens
ctgactggattcattctcata

SEQ ID NO: 1034391 - DNA, 21 bp, Homo sapiens
ctgactggccaaacccttgct

SEQ ID NO: 1034392 - DNA, 14 bp, Homo sapiens
ctgactgggccaca

SEQ ID NO: 1034393 - DNA, 15 bp, Homo sapiens
ctgactgggccacag

SEQ ID NO: 1034394 - DNA, 20 bp, Homo sapiens
ctgactgggccacagccccg

SEQ ID NO: 1034395 - DNA, 20 bp, Homo sapiens
ctgactggttaacagcagtc

SEQ ID NO: 1034396 - DNA, 21 bp, Homo sapiens
ctgactggttgtcagaatgga

SEQ ID NO: 1034397 - DNA, 14 bp, Homo sapiens
ctgactgtccagga

SEQ ID NO: 1034398 - DNA, 12 bp, Homo sapiens
ctgactgtccct

SEQ ID NO: 1034399 - DNA, 21 bp, Homo sapiens
ctgactgtcgggctttaaaaa

SEQ ID NO: 1034400 - DNA, 18 bp, Homo sapiens
ctgactgttgccccccag

SEQ ID NO: 1034401 - DNA, 13 bp, Homo sapiens
ctgactgtttcat

SEQ ID NO: 1034402 - DNA, 22 bp, Homo sapiens
ctgactgtttcattcactgtgc

SEQ ID NO: 1034403 - DNA, 22 bp, Homo sapiens
ctgacttaactttaacttttga

SEQ ID NO: 1034404 - DNA, 16 bp, Homo sapiens
ctgacttcagtgggac

SEQ ID NO: 1034405 - DNA, 23 bp, Homo sapiens
ctgacttcagtgggactcggtga

SEQ ID NO: 1034406 - DNA, 17 bp, Homo sapiens
ctgacttcatctcccac

SEQ ID NO: 1034407 - DNA, 15 bp, Homo sapiens
ggcgctgcctcaggc

SEQ ID NO: 1034408 - DNA, 13 bp, Homo sapiens
ggcgctgctggga

SEQ ID NO: 1034409 - DNA, 19 bp, Homo sapiens
ggcgctggcccagccggcc

SEQ ID NO: 1034410 - DNA, 13 bp, Homo sapiens
ggcgctgggaagg

SEQ ID NO: 1034411 - DNA, 23 bp, Homo sapiens
ggcgctgggtgcctgcagcgcct

SEQ ID NO: 1034412 - DNA, 12 bp, Homo sapiens
ggcgctgtcctg

SEQ ID NO: 1034413 - DNA, 18 bp, Homo sapiens
ggcgctgtgcggcctcac

SEQ ID NO: 1034414 - DNA, 18 bp, Homo sapiens
ggcgcttggatctggggt

SEQ ID NO: 1034415 - DNA, 19 bp, Homo sapiens
ggcgctttctcctgtgccc

SEQ ID NO: 1034416 - DNA, 19 bp, Homo sapiens
ggcggaaggtgaaaggcat

SEQ ID NO: 1034417 - DNA, 19 bp, Homo sapiens
ggcggacaaaagggccagg

SEQ ID NO: 1034418 - DNA, 20 bp, Homo sapiens
ggcggacaaaagggccaggt

SEQ ID NO: 1034419 - DNA, 22 bp, Homo sapiens
ggcggacaaaagggccaggtgc

SEQ ID NO: 1034420 - DNA, 20 bp, Homo sapiens
ggcggaccttgtagtgagcc

SEQ ID NO: 1034421 - DNA, 20 bp, Homo sapiens
ggcggagagtacagtgagcc

SEQ ID NO: 1034422 - DNA, 17 bp, Homo sapiens
ggcggagatgggtcctg

SEQ ID NO: 1034423 - DNA, 13 bp, Homo sapiens
ggcggagccggcc

SEQ ID NO: 1034424 - DNA, 13 bp, Homo sapiens
ggcggagctggcc

SEQ ID NO: 1034425 - DNA, 15 bp, Homo sapiens
ggcggagctggcccc

SEQ ID NO: 1034426 - DNA, 20 bp, Homo sapiens
ggcggagctggccccgccgc

SEQ ID NO: 1034427 - DNA, 21 bp, Homo sapiens
ggcggagctggggtctgggca

SEQ ID NO: 1034428 - DNA, 14 bp, Homo sapiens
ggcggaggaggaca

SEQ ID NO: 1034429 - DNA, 14 bp, Homo sapiens
ggcggcagggctgg

SEQ ID NO: 1034430 - DNA, 11 bp, Homo sapiens
ggcggccaggg

SEQ ID NO: 1034431 - DNA, 20 bp, Homo sapiens
ggcggccagggcggccaggg

SEQ ID NO: 1034432 - DNA, 14 bp, Homo sapiens
ggcggcccgtggac

SEQ ID NO: 1034433 - DNA, 15 bp, Homo sapiens
ggcggccctggggag

SEQ ID NO: 1034434 - DNA, 14 bp, Homo sapiens
ggcggcctgtgggt

SEQ ID NO: 1034435 - DNA, 16 bp, Homo sapiens
ggcggcgggcggctgg

SEQ ID NO: 1034436 - DNA, 20 bp, Homo sapiens
ggcggcgttttggacccgcg

SEQ ID NO: 1034437 - DNA, 20 bp, Homo sapiens
ggcggctactcagcagccct

SEQ ID NO: 1034438 - DNA, 15 bp, Homo sapiens
ggcggctactctgga

SEQ ID NO: 1034439 - DNA, 16 bp, Homo sapiens
ggcggctactctggaa

SEQ ID NO: 1034440 - DNA, 13 bp, Homo sapiens
ggcggctctgagc

SEQ ID NO: 1034441 - DNA, 14 bp, Homo sapiens
ggcggctctgagca

SEQ ID NO: 1034442 - DNA, 12 bp, Homo sapiens
ggcggctctgcc

SEQ ID NO: 1034443 - DNA, 17 bp, Homo sapiens
ggcggcttcctgtccac

SEQ ID NO: 1034444 - DNA, 21 bp, Homo sapiens
ggcggcttcctgtccactctc

SEQ ID NO: 1034445 - DNA, 14 bp, Homo sapiens
ggcgggagaactga

SEQ ID NO: 1034446 - DNA, 12 bp, Homo sapiens
ctgagacagcac

SEQ ID NO: 1034447 - DNA, 16 bp, Homo sapiens
ctgagacagcaccact

SEQ ID NO: 1034448 - DNA, 18 bp, Homo sapiens
ctgagacagcaccactgc

SEQ ID NO: 1034449 - DNA, 23 bp, Homo sapiens
ctgagacagcaccactgctgagg

SEQ ID NO: 1034450 - DNA, 13 bp, Homo sapiens
ctgagacaggaga

SEQ ID NO: 1034451 - DNA, 16 bp, Homo sapiens
ctgagacagtgaattt

SEQ ID NO: 1034452 - DNA, 19 bp, Homo sapiens
ctgagacatccctgattct

SEQ ID NO: 1034453 - DNA, 19 bp, Homo sapiens
ctgagaccacccccaaaca

SEQ ID NO: 1034454 - DNA, 14 bp, Homo sapiens
ctgagaccagggtc

SEQ ID NO: 1034455 - DNA, 22 bp, Homo sapiens
ctgagaccagttgggagcactg

SEQ ID NO: 1034456 - DNA, 23 bp, Homo sapiens
ctgagaccagttgggagcactgg

SEQ ID NO: 1034457 - DNA, 20 bp, Homo sapiens
ctgagaccctactgaagtgg

SEQ ID NO: 1034458 - DNA, 23 bp, Homo sapiens
ctgagaccctactgaagtggctg

SEQ ID NO: 1034459 - DNA, 20 bp, Homo sapiens
ctgagaccctgggagagaag

SEQ ID NO: 1034460 - DNA, 14 bp, Homo sapiens
ctgagacctgggat

SEQ ID NO: 1034461 - DNA, 21 bp, Homo sapiens
ctgagacgggcatcgcaggag

SEQ ID NO: 1034462 - DNA, 22 bp, Homo sapiens
ctgagacgggcatcgcaggagt

SEQ ID NO: 1034463 - DNA, 12 bp, Homo sapiens
ctgagactcaca

SEQ ID NO: 1034464 - DNA, 19 bp, Homo sapiens
ctgagactcacaggaagga

SEQ ID NO: 1034465 - DNA, 23 bp, Homo sapiens
ctgagactccggggagcgcccgc

SEQ ID NO: 1034466 - DNA, 20 bp, Homo sapiens
ctgagactgtcggagaggct

SEQ ID NO: 1034467 - DNA, 12 bp, Homo sapiens
ctgagactgtgc

SEQ ID NO: 1034468 - DNA, 15 bp, Homo sapiens
ctgagactgtgctgt

SEQ ID NO: 1034469 - DNA, 21 bp, Homo sapiens
ctgagactttcagtgcactgt

SEQ ID NO: 1034470 - DNA, 12 bp, Homo sapiens
ctgagagaaata

SEQ ID NO: 1034471 - DNA, 14 bp, Homo sapiens
ctgagagaccctgg

SEQ ID NO: 1034472 - DNA, 20 bp, Homo sapiens
ctgagagaccctggcctcaa

SEQ ID NO: 1034473 - DNA, 18 bp, Homo sapiens
ctgagagacttttaatca

SEQ ID NO: 1034474 - DNA, 18 bp, Homo sapiens
ctgagagagaatagagct

SEQ ID NO: 1034475 - DNA, 16 bp, Homo sapiens
ctgagagagtataaat

SEQ ID NO: 1034476 - DNA, 17 bp, Homo sapiens
ctgagagagtataaata

SEQ ID NO: 1034477 - DNA, 12 bp, Homo sapiens
ctgagagccctg

SEQ ID NO: 1034478 - DNA, 12 bp, Homo sapiens
ctgagaggcagg

SEQ ID NO: 1034479 - DNA, 15 bp, Homo sapiens
ctgagaggcctggag

SEQ ID NO: 1034480 - DNA, 14 bp, Homo sapiens
ctgagaggctctcc

SEQ ID NO: 1034481 - DNA, 14 bp, Homo sapiens
ctgagaggctgtct

SEQ ID NO: 1034482 - DNA, 18 bp, Homo sapiens
ctgagagggcaaggaagt

SEQ ID NO: 1034483 - DNA, 11 bp, Homo sapiens
ctgagaggttt

SEQ ID NO: 1034484 - DNA, 19 bp, Homo sapiens
ctgagagtatttaggcaga

SEQ ID NO: 1034485 - DNA, 20 bp, Homo sapiens
ctgagagtatttaggcagat

SEQ ID NO: 1034486 - DNA, 15 bp, Homo sapiens
ctgagagtcaggagt

SEQ ID NO: 1034487 - DNA, 15 bp, Homo sapiens
ctgagatacttccca

SEQ ID NO: 1034488 - DNA, 12 bp, Homo sapiens
ctgagatatgaa

SEQ ID NO: 1034489 - DNA, 16 bp, Homo sapiens
ctgagatatgaacata

SEQ ID NO: 1034490 - DNA, 21 bp, Homo sapiens
ctgagatatgaacatattgtt

SEQ ID NO: 1034491 - DNA, 17 bp, Homo sapiens
ctgagatcccctgagcc

SEQ ID NO: 1034492 - DNA, 16 bp, Homo sapiens
ctgagatgcaggtgat

SEQ ID NO: 1034493 - DNA, 22 bp, Homo sapiens
ctgagatgctcactttattatc

SEQ ID NO: 1034494 - DNA, 17 bp, Homo sapiens
ctgagatgctgggctgt

SEQ ID NO: 1034495 - DNA, 13 bp, Homo sapiens
ctgagatggagct

SEQ ID NO: 1034496 - DNA, 14 bp, Homo sapiens
ctgagatggagctg

SEQ ID NO: 1034497 - DNA, 19 bp, Homo sapiens
ctgagatttttgatatctc

SEQ ID NO: 1034498 - DNA, 18 bp, Homo sapiens
ctgagatttttttgtgta

SEQ ID NO: 1034499 - DNA, 22 bp, Homo sapiens
ctgagatttttttgtgtatgtt

SEQ ID NO: 1034500 - DNA, 16 bp, Homo sapiens
ctgagcaacagagtga

SEQ ID NO: 1034501 - DNA, 15 bp, Homo sapiens
ctgagcaagagctgg

SEQ ID NO: 1034502 - DNA, 22 bp, Homo sapiens
ctgagcaatggtaactgcacct

SEQ ID NO: 1034503 - DNA, 17 bp, Homo sapiens
ctgagcacactttagtg

SEQ ID NO: 1034504 - DNA, 19 bp, Homo sapiens
ctgagcacaggtgacagat

SEQ ID NO: 1034505 - DNA, 20 bp, Homo sapiens
ctgagcacagtcaggggctg

SEQ ID NO: 1034506 - DNA, 21 bp, Homo sapiens
ctgagcaccccctcattcccc

SEQ ID NO: 1034507 - DNA, 15 bp, Homo sapiens
ctgagcaccctctgg

SEQ ID NO: 1034508 - DNA, 17 bp, Homo sapiens
ctgagcaccctctggat

SEQ ID NO: 1034509 - DNA, 16 bp, Homo sapiens
ctgagcacctgcttca

SEQ ID NO: 1034510 - DNA, 20 bp, Homo sapiens
ctgagcactgtttatacact

SEQ ID NO: 1034511 - DNA, 17 bp, Homo sapiens
ctgagcagccgccagct

SEQ ID NO: 1034512 - DNA, 20 bp, Homo sapiens
ctgagcagccgccagctggg

SEQ ID NO: 1034513 - DNA, 22 bp, Homo sapiens
ctgagcagccgccagctgggag

SEQ ID NO: 1034514 - DNA, 13 bp, Homo sapiens
ctgagcagcctct

SEQ ID NO: 1034515 - DNA, 23 bp, Homo sapiens
ctgagcaggacagccagcagcag

SEQ ID NO: 1034516 - DNA, 12 bp, Homo sapiens
ctgagcaggggc

SEQ ID NO: 1034517 - DNA, 15 bp, Homo sapiens
ctgagcaggggcagg

SEQ ID NO: 1034518 - DNA, 20 bp, Homo sapiens
ctgagcagtgaatgattcag

SEQ ID NO: 1034519 - DNA, 19 bp, Homo sapiens
ctgagcataagtcctctag

SEQ ID NO: 1034520 - DNA, 16 bp, Homo sapiens
ctgagcataatgctcc

SEQ ID NO: 1034521 - DNA, 18 bp, Homo sapiens
ctgagcattcaggcagca

SEQ ID NO: 1034522 - DNA, 17 bp, Homo sapiens
ctgagccaaggaggcct

SEQ ID NO: 1034523 - DNA, 18 bp, Homo sapiens
ctgagccaaggaggcctg

SEQ ID NO: 1034524 - DNA, 22 bp, Homo sapiens
ctgagccaagggagggaagggc

SEQ ID NO: 1034525 - DNA, 19 bp, Homo sapiens
ctgagccagtcccaggggc

SEQ ID NO: 1034526 - DNA, 17 bp, Homo sapiens
ctgagccatcatttcct

SEQ ID NO: 1034527 - DNA, 16 bp, Homo sapiens
ctgagcccaggccgtt

SEQ ID NO: 1034528 - DNA, 20 bp, Homo sapiens
ctgagcccatgttctgcccc

SEQ ID NO: 1034529 - DNA, 19 bp, Homo sapiens
ggctatgggggcactgagg

SEQ ID NO: 1034530 - DNA, 19 bp, Homo sapiens
ggctatgtatggaatacag

SEQ ID NO: 1034531 - DNA, 15 bp, Homo sapiens
ggctattatttattg

SEQ ID NO: 1034532 - DNA, 13 bp, Homo sapiens
ggctattcacaac

SEQ ID NO: 1034533 - DNA, 19 bp, Homo sapiens
ggctcaagcaatcctcctg

SEQ ID NO: 1034534 - DNA, 22 bp, Homo sapiens
ggctcaagcaatcctcctgcct

SEQ ID NO: 1034535 - DNA, 23 bp, Homo sapiens
ggctcaagcaatcctcctgcctc

SEQ ID NO: 1034536 - DNA, 16 bp, Homo sapiens
ggctcaagtgatcctc

SEQ ID NO: 1034537 - DNA, 15 bp, Homo sapiens
ggctcacactcctgg

SEQ ID NO: 1034538 - DNA, 14 bp, Homo sapiens
ggctcacagggcag

SEQ ID NO: 1034539 - DNA, 15 bp, Homo sapiens
ggctcacagggcagg

SEQ ID NO: 1034540 - DNA, 22 bp, Homo sapiens
ggctcacgccccgctgtgtcct

SEQ ID NO: 1034541 - DNA, 17 bp, Homo sapiens
ggctcacgcgttctggg

SEQ ID NO: 1034542 - DNA, 19 bp, Homo sapiens
ggctcacgcgttctgggag

SEQ ID NO: 1034543 - DNA, 13 bp, Homo sapiens
ggctcacgtgtgt

SEQ ID NO: 1034544 - DNA, 14 bp, Homo sapiens
ggctcactgccagg

SEQ ID NO: 1034545 - DNA, 19 bp, Homo sapiens
ggctcactgccaggccagc

SEQ ID NO: 1034546 - DNA, 18 bp, Homo sapiens
ggctcactggctgggagt

SEQ ID NO: 1034547 - DNA, 14 bp, Homo sapiens
ggctcagactctgg

SEQ ID NO: 1034548 - DNA, 15 bp, Homo sapiens
ggctcagagctttgt

SEQ ID NO: 1034549 - DNA, 12 bp, Homo sapiens
ggctcagagggg

SEQ ID NO: 1034550 - DNA, 21 bp, Homo sapiens
ggctcagatcggccacagggc

SEQ ID NO: 1034551 - DNA, 16 bp, Homo sapiens
ggctcagattgtaata

SEQ ID NO: 1034552 - DNA, 23 bp, Homo sapiens
ggctcagcaaaagatgcttctca

SEQ ID NO: 1034553 - DNA, 16 bp, Homo sapiens
ggctcagcccaccctc

SEQ ID NO: 1034554 - DNA, 10 bp, Homo sapiens
ggctcagcct

SEQ ID NO: 1034555 - DNA, 20 bp, Homo sapiens
ggctcagcctggtgggcctc

SEQ ID NO: 1034556 - DNA, 14 bp, Homo sapiens
ggctcagcctgtct

SEQ ID NO: 1034557 - DNA, 23 bp, Homo sapiens
ggctcagcctgtctcgggctgac

SEQ ID NO: 1034558 - DNA, 22 bp, Homo sapiens
ggctcagccttgcacacccact

SEQ ID NO: 1034559 - DNA, 14 bp, Homo sapiens
ggctcaggcaagcc

SEQ ID NO: 1034560 - DNA, 20 bp, Homo sapiens
ggctcaggcaagcccctcag

SEQ ID NO: 1034561 - DNA, 16 bp, Homo sapiens
ggctcagggctggagt

SEQ ID NO: 1034562 - DNA, 13 bp, Homo sapiens
ggctcagtgccac

SEQ ID NO: 1034563 - DNA, 17 bp, Homo sapiens
ggctcagtgccacctat

SEQ ID NO: 1034564 - DNA, 13 bp, Homo sapiens
ggctcagtgcctt

SEQ ID NO: 1034565 - DNA, 17 bp, Homo sapiens
ggctcatatgcgtccca

SEQ ID NO: 1034566 - DNA, 12 bp, Homo sapiens
ggctcatgcctg

SEQ ID NO: 1034567 - DNA, 21 bp, Homo sapiens
ggctcatgcctgtaatctcag

SEQ ID NO: 1034568 - DNA, 21 bp, Homo sapiens
ggctcatggcgtaatgggcct

SEQ ID NO: 1034569 - DNA, 13 bp, Homo sapiens
ggctcattttcta

SEQ ID NO: 1034570 - DNA, 17 bp, Homo sapiens
ggctccaagaggctgag

SEQ ID NO: 1034571 - DNA, 20 bp, Homo sapiens
ggctccaagaggctgaggac

SEQ ID NO: 1034572 - DNA, 15 bp, Homo sapiens
ggctccagaggacct

SEQ ID NO: 1034573 - DNA, 18 bp, Homo sapiens
ctgagctagctagcgcac

SEQ ID NO: 1034574 - DNA, 13 bp, Homo sapiens
ctgagctatttca

SEQ ID NO: 1034575 - DNA, 19 bp, Homo sapiens
ctgagctattttcctctgg

SEQ ID NO: 1034576 - DNA, 22 bp, Homo sapiens
ctgagctattttcctctggccg

SEQ ID NO: 1034577 - DNA, 20 bp, Homo sapiens
ctgagctcacatgggactgg

SEQ ID NO: 1034578 - DNA, 15 bp, Homo sapiens
ctgagctccacctct

SEQ ID NO: 1034579 - DNA, 14 bp, Homo sapiens
ctgagctcccacct

SEQ ID NO: 1034580 - DNA, 20 bp, Homo sapiens
ctgagctcccacctcccttc

SEQ ID NO: 1034581 - DNA, 23 bp, Homo sapiens
ctgagctcccacctcccttccca

SEQ ID NO: 1034582 - DNA, 17 bp, Homo sapiens
ctgagctccccagatct

SEQ ID NO: 1034583 - DNA, 19 bp, Homo sapiens
ctgagctccccagatctcc

SEQ ID NO: 1034584 - DNA, 21 bp, Homo sapiens
ctgagctccccagatctccca

SEQ ID NO: 1034585 - DNA, 15 bp, Homo sapiens
ctgagctccccatca

SEQ ID NO: 1034586 - DNA, 18 bp, Homo sapiens
ctgagctcggtggaccca

SEQ ID NO: 1034587 - DNA, 18 bp, Homo sapiens
ctgagctctccaggccag

SEQ ID NO: 1034588 - DNA, 10 bp, Homo sapiens
ctgagctggg

SEQ ID NO: 1034589 - DNA, 19 bp, Homo sapiens
ctgagctgggcccagcccc

SEQ ID NO: 1034590 - DNA, 13 bp, Homo sapiens
ctgagctggggaa

SEQ ID NO: 1034591 - DNA, 14 bp, Homo sapiens
ctgagctggggaag

SEQ ID NO: 1034592 - DNA, 14 bp, Homo sapiens
ctgagctggggagg

SEQ ID NO: 1034593 - DNA, 22 bp, Homo sapiens
ctgagctggggaggtgggaggc

SEQ ID NO: 1034594 - DNA, 13 bp, Homo sapiens
ctgagctgtgcag

SEQ ID NO: 1034595 - DNA, 21 bp, Homo sapiens
ctgagcttagccttgtgccct

SEQ ID NO: 1034596 - DNA, 23 bp, Homo sapiens
ctgagcttcggttctccagaatg

SEQ ID NO: 1034597 - DNA, 16 bp, Homo sapiens
ctgagcttggccagaa

SEQ ID NO: 1034598 - DNA, 18 bp, Homo sapiens
ctgagcttggccagaagg

SEQ ID NO: 1034599 - DNA, 16 bp, Homo sapiens
ctgagctttggggaca

SEQ ID NO: 1034600 - DNA, 20 bp, Homo sapiens
ctgagcttttcatggaagtg

SEQ ID NO: 1034601 - DNA, 21 bp, Homo sapiens
ctgagcttttgagtgttccca

SEQ ID NO: 1034602 - DNA, 23 bp, Homo sapiens
ctgagcttttgatgccaggtgca

SEQ ID NO: 1034603 - DNA, 21 bp, Homo sapiens
ctgaggaaattgctttgtatt

SEQ ID NO: 1034604 - DNA, 20 bp, Homo sapiens
ctgaggaacaggttcctgtg

SEQ ID NO: 1034605 - DNA, 13 bp, Homo sapiens
ctgaggaagaagg

SEQ ID NO: 1034606 - DNA, 23 bp, Homo sapiens
ctgaggacaagagaaaaaagcca

SEQ ID NO: 1034607 - DNA, 16 bp, Homo sapiens
ctgaggacagaggccg

SEQ ID NO: 1034608 - DNA, 16 bp, Homo sapiens
ctgaggacagctgtcc

SEQ ID NO: 1034609 - DNA, 17 bp, Homo sapiens
ctgaggacagctgtcct

SEQ ID NO: 1034610 - DNA, 20 bp, Homo sapiens
ctgaggacaggctctagaga

SEQ ID NO: 1034611 - DNA, 17 bp, Homo sapiens
ctgaggagatgaccagg

SEQ ID NO: 1034612 - DNA, 20 bp, Homo sapiens
ctgaggagatgaccagggat

SEQ ID NO: 1034613 - DNA, 11 bp, Homo sapiens
ctgaggagcag

SEQ ID NO: 1034614 - DNA, 18 bp, Homo sapiens
ctgaggagcagccaggac

SEQ ID NO: 1034615 - DNA, 13 bp, Homo sapiens
ctgaggagccctg

SEQ ID NO: 1034616 - DNA, 15 bp, Homo sapiens
ctgaggagccctgag

SEQ ID NO: 1034617 - DNA, 16 bp, Homo sapiens
ctgaggagccctgagg

SEQ ID NO: 1034618 - DNA, 21 bp, Homo sapiens
ctgaggagccctgaggacctc

SEQ ID NO: 1034619 - DNA, 14 bp, Homo sapiens
ctgaggaggccgct

SEQ ID NO: 1034620 - DNA, 15 bp, Homo sapiens
ctgaggagtaagtgt

SEQ ID NO: 1034621 - DNA, 19 bp, Homo sapiens
ctgaggagtaagtgtacaa

SEQ ID NO: 1034622 - DNA, 13 bp, Homo sapiens
ctgaggatgagct

SEQ ID NO: 1034623 - DNA, 15 bp, Homo sapiens
ctgaggatgagctgg

SEQ ID NO: 1034624 - DNA, 17 bp, Homo sapiens
ctgaggatgagctggaa

SEQ ID NO: 1034625 - DNA, 18 bp, Homo sapiens
ctgaggatgagctggaag

SEQ ID NO: 1034626 - DNA, 14 bp, Homo sapiens
ctgaggatttcaag

SEQ ID NO: 1034627 - DNA, 17 bp, Homo sapiens
ctgaggatttcaagcct

SEQ ID NO: 1034628 - DNA, 16 bp, Homo sapiens
ctgaggatttcctgga

SEQ ID NO: 1034629 - DNA, 19 bp, Homo sapiens
ctgaggatttcctggagtg

SEQ ID NO: 1034630 - DNA, 22 bp, Homo sapiens
ctgaggcaaccccctcggagcc

SEQ ID NO: 1034631 - DNA, 12 bp, Homo sapiens
ctgaggcaagag

SEQ ID NO: 1034632 - DNA, 15 bp, Homo sapiens
ctgaggcagaagaat

SEQ ID NO: 1034633 - DNA, 17 bp, Homo sapiens
ctgaggcaggagactgg

SEQ ID NO: 1034634 - DNA, 19 bp, Homo sapiens
ctgaggcaggcaatcactt

SEQ ID NO: 1034635 - DNA, 21 bp, Homo sapiens
ctgaggccacactcagcacaa

SEQ ID NO: 1034636 - DNA, 13 bp, Homo sapiens
ctgaggccagagt

SEQ ID NO: 1034637 - DNA, 23 bp, Homo sapiens
ctgaggccagagtcaccttttct

SEQ ID NO: 1034638 - DNA, 15 bp, Homo sapiens
ctgaggccagggctg

SEQ ID NO: 1034639 - DNA, 16 bp, Homo sapiens
ctgaggccatcagggc

SEQ ID NO: 1034640 - DNA, 17 bp, Homo sapiens
ctgaggccatcagggcc

SEQ ID NO: 1034641 - DNA, 19 bp, Homo sapiens
ctgaggccatcagggccct

SEQ ID NO: 1034642 - DNA, 19 bp, Homo sapiens
ctgaggccccttaactcat

SEQ ID NO: 1034643 - DNA, 23 bp, Homo sapiens
ctgaggccccttaactcatctgt

SEQ ID NO: 1034644 - DNA, 21 bp, Homo sapiens
ctgaggccctcactgagcctc

SEQ ID NO: 1034645 - DNA, 22 bp, Homo sapiens
ctgaggccctcactgagcctca

SEQ ID NO: 1034646 - DNA, 16 bp, Homo sapiens
ctgaggccctgcccaa

SEQ ID NO: 1034647 - DNA, 15 bp, Homo sapiens
ctgaggccctgggct

SEQ ID NO: 1034648 - DNA, 15 bp, Homo sapiens
ctgaggcctcatccc

SEQ ID NO: 1034649 - DNA, 20 bp, Homo sapiens
ctgaggcctgccccctgggc

SEQ ID NO: 1034650 - DNA, 22 bp, Homo sapiens
ctgaggcctgccccctgggctg

SEQ ID NO: 1034651 - DNA, 22 bp, Homo sapiens
ggccacaactgctgtggccccc

SEQ ID NO: 1034652 - DNA, 17 bp, Homo sapiens
ggccacacgctgcacct

SEQ ID NO: 1034653 - DNA, 21 bp, Homo sapiens
ggccacactattaccatgaga

SEQ ID NO: 1034654 - DNA, 22 bp, Homo sapiens
ggccacactattaccatgagaa

SEQ ID NO: 1034655 - DNA, 11 bp, Homo sapiens
ggccacagact

SEQ ID NO: 1034656 - DNA, 23 bp, Homo sapiens
ggccacagactgacccccatctg

SEQ ID NO: 1034657 - DNA, 13 bp, Homo sapiens
ggccacagcaccc

SEQ ID NO: 1034658 - DNA, 13 bp, Homo sapiens
ggccacagccccc

SEQ ID NO: 1034659 - DNA, 15 bp, Homo sapiens
ggccacagccccctt

SEQ ID NO: 1034660 - DNA, 12 bp, Homo sapiens
ggccacagccct

SEQ ID NO: 1034661 - DNA, 17 bp, Homo sapiens
ggccacagctgctggag

SEQ ID NO: 1034662 - DNA, 23 bp, Homo sapiens
ggccacagggcgagactccgtct

SEQ ID NO: 1034663 - DNA, 20 bp, Homo sapiens
ggccacagtggggctgcagg

SEQ ID NO: 1034664 - DNA, 16 bp, Homo sapiens
ggccacatcaaagagg

SEQ ID NO: 1034665 - DNA, 18 bp, Homo sapiens
ggccacatgggaggctca

SEQ ID NO: 1034666 - DNA, 17 bp, Homo sapiens
ggccaccaaagctgccc

SEQ ID NO: 1034667 - DNA, 20 bp, Homo sapiens
ggccaccacctttggctggt

SEQ ID NO: 1034668 - DNA, 24 bp, Homo sapiens
ggccaccacctttggctggtagca

SEQ ID NO: 1034669 - DNA, 13 bp, Homo sapiens
ggccaccactgca

SEQ ID NO: 1034670 - DNA, 14 bp, Homo sapiens
ggccaccaggatgg

SEQ ID NO: 1034671 - DNA, 21 bp, Homo sapiens
ggccaccaggctggcgcagcc

SEQ ID NO: 1034672 - DNA, 20 bp, Homo sapiens
ggccaccccaaaccccagcc

SEQ ID NO: 1034673 - DNA, 17 bp, Homo sapiens
ggccaccccagagtggg

SEQ ID NO: 1034674 - DNA, 22 bp, Homo sapiens
ggccaccccagagtgggagagg

SEQ ID NO: 1034675 - DNA, 19 bp, Homo sapiens
ggccaccccctatcctctg

SEQ ID NO: 1034676 - DNA, 17 bp, Homo sapiens
ggccaccccgtgcccct

SEQ ID NO: 1034677 - DNA, 18 bp, Homo sapiens
ggccaccccgtgcccctg

SEQ ID NO: 1034678 - DNA, 15 bp, Homo sapiens
ggccacccctcccca

SEQ ID NO: 1034679 - DNA, 14 bp, Homo sapiens
ggccacccgggctg

SEQ ID NO: 1034680 - DNA, 17 bp, Homo sapiens
ggccacccgggctgcct

SEQ ID NO: 1034681 - DNA, 18 bp, Homo sapiens
ggccacccgggctgcctg

SEQ ID NO: 1034682 - DNA, 20 bp, Homo sapiens
ggccacccggggcctggacc

SEQ ID NO: 1034683 - DNA, 12 bp, Homo sapiens
ggccaccctcct

SEQ ID NO: 1034684 - DNA, 17 bp, Homo sapiens
ggccaccctgctgcact

SEQ ID NO: 1034685 - DNA, 15 bp, Homo sapiens
ggccaccctggcccg

SEQ ID NO: 1034686 - DNA, 20 bp, Homo sapiens
ggccaccgggggtggctctg

SEQ ID NO: 1034687 - DNA, 13 bp, Homo sapiens
ggccacctcccca

SEQ ID NO: 1034688 - DNA, 18 bp, Homo sapiens
ggccacctcctacccctt

SEQ ID NO: 1034689 - DNA, 18 bp, Homo sapiens
ggccacctcctccccctg

SEQ ID NO: 1034690 - DNA, 14 bp, Homo sapiens
ggccacctctccaa

SEQ ID NO: 1034691 - DNA, 18 bp, Homo sapiens
ggccacctctccaagggc

SEQ ID NO: 1034692 - DNA, 20 bp, Homo sapiens
ggccacctctccaagggctt

SEQ ID NO: 1034693 - DNA, 23 bp, Homo sapiens
ggccacctgaggtgggcccagga

SEQ ID NO: 1034694 - DNA, 14 bp, Homo sapiens
ggccacctgcagga

SEQ ID NO: 1034695 - DNA, 13 bp, Homo sapiens
ggccacctgcccc

SEQ ID NO: 1034696 - DNA, 15 bp, Homo sapiens
ggccacctgcctgcg

SEQ ID NO: 1034697 - DNA, 21 bp, Homo sapiens
ggccacctgcctgcgtcttcc

SEQ ID NO: 1034698 - DNA, 19 bp, Homo sapiens
ggccaccttgcttgaggga

SEQ ID NO: 1034699 - DNA, 16 bp, Homo sapiens
ggccaccttggaggag

SEQ ID NO: 1034700 - DNA, 18 bp, Homo sapiens
ggccacctttgtgcagct

SEQ ID NO: 1034701 - DNA, 19 bp, Homo sapiens
ggccacgcaggggccctga

SEQ ID NO: 1034702 - DNA, 16 bp, Homo sapiens
ggccacgccccagccc

SEQ ID NO: 1034703 - DNA, 17 bp, Homo sapiens
ggccacgccccagcccg

SEQ ID NO: 1034704 - DNA, 20 bp, Homo sapiens
ggccacgggggcagtgtgag

SEQ ID NO: 1034705 - DNA, 22 bp, Homo sapiens
ggccacgtatagtcctagctga

SEQ ID NO: 1034706 - DNA, 23 bp, Homo sapiens
ggccacgtgggcaaacaggcagt

SEQ ID NO: 1034707 - DNA, 22 bp, Homo sapiens
ggccacgtgtgctgtggccagg

SEQ ID NO: 1034708 - DNA, 18 bp, Homo sapiens
ggccacgttcagggaggg

SEQ ID NO: 1034709 - DNA, 15 bp, Homo sapiens
ggccactaaagcttc

SEQ ID NO: 1034710 - DNA, 19 bp, Homo sapiens
ggccactaaagcttcagac

SEQ ID NO: 1034711 - DNA, 20 bp, Homo sapiens
ggccactaagcagaggaggg

SEQ ID NO: 1034712 - DNA, 14 bp, Homo sapiens
ggccactagtgaca

SEQ ID NO: 1034713 - DNA, 16 bp, Homo sapiens
ggccactcagaggccc

SEQ ID NO: 1034714 - DNA, 18 bp, Homo sapiens
ggccactcagaggccccc

SEQ ID NO: 1034715 - DNA, 17 bp, Homo sapiens
ggccactccagacccct

SEQ ID NO: 1034716 - DNA, 12 bp, Homo sapiens
ggccactcctcc

SEQ ID NO: 1034717 - DNA, 13 bp, Homo sapiens
ggccactcctcca

SEQ ID NO: 1034718 - DNA, 21 bp, Homo sapiens
ggccactctcccctccctctt

SEQ ID NO: 1034719 - DNA, 13 bp, Homo sapiens
ggccactgctccc

SEQ ID NO: 1034720 - DNA, 13 bp, Homo sapiens
ggccactggggac

SEQ ID NO: 1034721 - DNA, 20 bp, Homo sapiens
ggccactggggactttattt

SEQ ID NO: 1034722 - DNA, 17 bp, Homo sapiens
ggccactgtccctgtcc

SEQ ID NO: 1034723 - DNA, 14 bp, Homo sapiens
ggccactgtggcca

SEQ ID NO: 1034724 - DNA, 19 bp, Homo sapiens
ggccactgtggccagagct

SEQ ID NO: 1034725 - DNA, 12 bp, Homo sapiens
ggccactgtgtc

SEQ ID NO: 1034726 - DNA, 23 bp, Homo sapiens
ggccacttcattccagcagctgc

SEQ ID NO: 1034727 - DNA, 21 bp, Homo sapiens
ggccactttcagagcccccag

SEQ ID NO: 1034728 - DNA, 23 bp, Homo sapiens
ggccagaaactccttttgctgtc

SEQ ID NO: 1034729 - DNA, 19 bp, Homo sapiens
ggccagaaggagggcagag

SEQ ID NO: 1034730 - DNA, 21 bp, Homo sapiens
ggccagaaggagggcagagcc

SEQ ID NO: 1034731 - DNA, 12 bp, Homo sapiens
ggccagaagtac

SEQ ID NO: 1034732 - DNA, 16 bp, Homo sapiens
ggccagaccatggaca

SEQ ID NO: 1034733 - DNA, 20 bp, Homo sapiens
ggccagagagcaggggagct

SEQ ID NO: 1034734 - DNA, 17 bp, Homo sapiens
ggccagagagggcccag

SEQ ID NO: 1034735 - DNA, 18 bp, Homo sapiens
ggccagagagggcccagc

SEQ ID NO: 1034736 - DNA, 11 bp, Homo sapiens
ggccagagcta

SEQ ID NO: 1034737 - DNA, 18 bp, Homo sapiens
ggccagagctagggctgc

SEQ ID NO: 1034738 - DNA, 21 bp, Homo sapiens
ggccagagctagggctgctgc

SEQ ID NO: 1034739 - DNA, 23 bp, Homo sapiens
ggccagagctagggctgctgctt

SEQ ID NO: 1034740 - DNA, 14 bp, Homo sapiens
ggccagagctggga

SEQ ID NO: 1034741 - DNA, 16 bp, Homo sapiens
ggccagagctgggagg

SEQ ID NO: 1034742 - DNA, 21 bp, Homo sapiens
ggccagaggaactgtccagag

SEQ ID NO: 1034743 - DNA, 13 bp, Homo sapiens
ggccagaggctgg

SEQ ID NO: 1034744 - DNA, 15 bp, Homo sapiens
ggccagatgcgggga

SEQ ID NO: 1034745 - DNA, 15 bp, Homo sapiens
ggccagatggcccct

SEQ ID NO: 1034746 - DNA, 18 bp, Homo sapiens
ggccagattgtggggtgc

SEQ ID NO: 1034747 - DNA, 17 bp, Homo sapiens
ggccagcaaggcaggtt

SEQ ID NO: 1034748 - DNA, 21 bp, Homo sapiens
ggccagcacaccaagtggctg

SEQ ID NO: 1034749 - DNA, 13 bp, Homo sapiens
ggccagcaccctc

SEQ ID NO: 1034750 - DNA, 19 bp, Homo sapiens
ggccagcaccctctcctgg

SEQ ID NO: 1034751 - DNA, 23 bp, Homo sapiens
ggccagcaccctctcctgggggt

SEQ ID NO: 1034752 - DNA, 13 bp, Homo sapiens
ggccagcagaggg

SEQ ID NO: 1034753 - DNA, 12 bp, Homo sapiens
ggccagcaggct

SEQ ID NO: 1034754 - DNA, 17 bp, Homo sapiens
ggccagcaggctcctgg

SEQ ID NO: 1034755 - DNA, 20 bp, Homo sapiens
ggccagcaggctcctggctg

SEQ ID NO: 1034756 - DNA, 22 bp, Homo sapiens
ggccagccaatttcccggagcc

SEQ ID NO: 1034757 - DNA, 13 bp, Homo sapiens
ggccagccaggcg

SEQ ID NO: 1034758 - DNA, 15 bp, Homo sapiens
ggccagccagtgcca

SEQ ID NO: 1034759 - DNA, 16 bp, Homo sapiens
ggccagccagtgccat

SEQ ID NO: 1034760 - DNA, 14 bp, Homo sapiens
ggccagccatgtct

SEQ ID NO: 1034761 - DNA, 15 bp, Homo sapiens
ggccagcccagccag

SEQ ID NO: 1034762 - DNA, 17 bp, Homo sapiens
ggccagcccagccaggc

SEQ ID NO: 1034763 - DNA, 13 bp, Homo sapiens
ggccagccccacc

SEQ ID NO: 1034764 - DNA, 16 bp, Homo sapiens
ggccagccccacccag

SEQ ID NO: 1034765 - DNA, 16 bp, Homo sapiens
ggccagcccccccacc

SEQ ID NO: 1034766 - DNA, 17 bp, Homo sapiens
ggccagcccccccaccc

SEQ ID NO: 1034767 - DNA, 19 bp, Homo sapiens
ggccagcccccccacccac

SEQ ID NO: 1034768 - DNA, 16 bp, Homo sapiens
ggccagcccctcccac

SEQ ID NO: 1034769 - DNA, 23 bp, Homo sapiens
ggccagcccctcccaccacagca

SEQ ID NO: 1034770 - DNA, 13 bp, Homo sapiens
ggccagcccctgg

SEQ ID NO: 1034771 - DNA, 20 bp, Homo sapiens
ggccagcccctggggcccag

SEQ ID NO: 1034772 - DNA, 23 bp, Homo sapiens
ggccagcccctggggcccagccc

SEQ ID NO: 1034773 - DNA, 16 bp, Homo sapiens
ggccagcccggctggt

SEQ ID NO: 1034774 - DNA, 19 bp, Homo sapiens
ggccagcccggctggtttt

SEQ ID NO: 1034775 - DNA, 19 bp, Homo sapiens
ggccagccctgcagcccaa

SEQ ID NO: 1034776 - DNA, 19 bp, Homo sapiens
ggccagcctccgagaggga

SEQ ID NO: 1034777 - DNA, 15 bp, Homo sapiens
ggccagcgccagggc

SEQ ID NO: 1034778 - DNA, 19 bp, Homo sapiens
ggccagcgccagggcccag

SEQ ID NO: 1034779 - DNA, 19 bp, Homo sapiens
ggccagcgcttctggtctg

SEQ ID NO: 1034780 - DNA, 20 bp, Homo sapiens
ggccagcggtgaccagcctg

SEQ ID NO: 1034781 - DNA, 24 bp, Homo sapiens
ggccagcggtgaccagcctgtcac

SEQ ID NO: 1034782 - DNA, 16 bp, Homo sapiens
ggccagctggggagat

SEQ ID NO: 1034783 - DNA, 14 bp, Homo sapiens
ggccaggagatgga

SEQ ID NO: 1034784 - DNA, 10 bp, Homo sapiens
ggccaggagg

SEQ ID NO: 1034785 - DNA, 11 bp, Homo sapiens
ggccaggaggt

SEQ ID NO: 1034786 - DNA, 21 bp, Homo sapiens
ggccaggatccccctctttgc

SEQ ID NO: 1034787 - DNA, 16 bp, Homo sapiens
ggccaggatggagggg

SEQ ID NO: 1034788 - DNA, 23 bp, Homo sapiens
ggccaggcagaatggctgcacgt

SEQ ID NO: 1034789 - DNA, 12 bp, Homo sapiens
ggccaggcaggt

SEQ ID NO: 1034790 - DNA, 17 bp, Homo sapiens
ggccaggccaccaggat

SEQ ID NO: 1034791 - DNA, 10 bp, Homo sapiens
ggccaggcct

SEQ ID NO: 1034792 - DNA, 16 bp, Homo sapiens
ggccaggcctgcagac

SEQ ID NO: 1034793 - DNA, 16 bp, Homo sapiens
ggccaggcgagcctga

SEQ ID NO: 1034794 - DNA, 18 bp, Homo sapiens
ggccaggcgagcctgact

SEQ ID NO: 1034795 - DNA, 11 bp, Homo sapiens
ggccaggctgg

SEQ ID NO: 1034796 - DNA, 20 bp, Homo sapiens
ggccaggctggagtgcagtg

SEQ ID NO: 1034797 - DNA, 14 bp, Homo sapiens
ggccaggctggtct

SEQ ID NO: 1034798 - DNA, 16 bp, Homo sapiens
ggccagggaggcagag

SEQ ID NO: 1034799 - DNA, 21 bp, Homo sapiens
ggccagggaggcagagcggga

SEQ ID NO: 1034800 - DNA, 15 bp, Homo sapiens
ggccagggaggcgca

SEQ ID NO: 1034801 - DNA, 17 bp, Homo sapiens
ggccagggaggcgcagg

SEQ ID NO: 1034802 - DNA, 23 bp, Homo sapiens
ggccagggcaatgccatcagccc

SEQ ID NO: 1034803 - DNA, 13 bp, Homo sapiens
ggccagggcagag

SEQ ID NO: 1034804 - DNA, 18 bp, Homo sapiens
ggccagggcagcaaggga

SEQ ID NO: 1034805 - DNA, 19 bp, Homo sapiens
ggccagggcagcaagggac

SEQ ID NO: 1034806 - DNA, 16 bp, Homo sapiens
ggccagggcatgtgta

SEQ ID NO: 1034807 - DNA, 19 bp, Homo sapiens
ggccagggcatgtgtatgt

SEQ ID NO: 1034808 - DNA, 21 bp, Homo sapiens
ggccagggccacgctccagct

SEQ ID NO: 1034809 - DNA, 15 bp, Homo sapiens
ggccagggcctctcc

SEQ ID NO: 1034810 - DNA, 22 bp, Homo sapiens
ggccagggcctctccaaccact

SEQ ID NO: 1034811 - DNA, 11 bp, Homo sapiens
ggccagggctg

SEQ ID NO: 1034812 - DNA, 19 bp, Homo sapiens
ggccagggctgccctgaga

SEQ ID NO: 1034813 - DNA, 13 bp, Homo sapiens
ggccagggctgga

SEQ ID NO: 1034814 - DNA, 14 bp, Homo sapiens
ggccagggctggat

SEQ ID NO: 1034815 - DNA, 21 bp, Homo sapiens
ggccagggctggatggacaga

SEQ ID NO: 1034816 - DNA, 23 bp, Homo sapiens
ggccagggctggatggacagaca

SEQ ID NO: 1034817 - DNA, 17 bp, Homo sapiens
ggccaggggtctccctg

SEQ ID NO: 1034818 - DNA, 19 bp, Homo sapiens
ggccagggtctgtgtgaat

SEQ ID NO: 1034819 - DNA, 22 bp, Homo sapiens
ggccagggtctgtgtgaatgtg

SEQ ID NO: 1034820 - DNA, 19 bp, Homo sapiens
ggccaggtgcttttcccta

SEQ ID NO: 1034821 - DNA, 22 bp, Homo sapiens
ggccaggtgcttttccctatcc

SEQ ID NO: 1034822 - DNA, 18 bp, Homo sapiens
ggccaggtgggcggacaa

SEQ ID NO: 1034823 - DNA, 19 bp, Homo sapiens
ggccaggtgggcggacaaa

SEQ ID NO: 1034824 - DNA, 17 bp, Homo sapiens
ggccaggtttctgccca

SEQ ID NO: 1034825 - DNA, 16 bp, Homo sapiens
ggccagtacctttcca

SEQ ID NO: 1034826 - DNA, 14 bp, Homo sapiens
ggccagtccaggct

SEQ ID NO: 1034827 - DNA, 19 bp, Homo sapiens
ggccagtcctgcctggcca

SEQ ID NO: 1034828 - DNA, 20 bp, Homo sapiens
ggccagtcctgcctggccag

SEQ ID NO: 1034829 - DNA, 16 bp, Homo sapiens
ggccagtcctggtcct

SEQ ID NO: 1034830 - DNA, 16 bp, Homo sapiens
ggccagtctgggctgc

SEQ ID NO: 1034831 - DNA, 13 bp, Homo sapiens
ggccagtctgtgg

SEQ ID NO: 1034832 - DNA, 23 bp, Homo sapiens
ggccagtctgtggatcagagatg

SEQ ID NO: 1034833 - DNA, 13 bp, Homo sapiens
ggccagtgagggc

SEQ ID NO: 1034834 - DNA, 14 bp, Homo sapiens
ggccagtgatgatg

SEQ ID NO: 1034835 - DNA, 14 bp, Homo sapiens
ggccagtgctgctt

SEQ ID NO: 1034836 - DNA, 15 bp, Homo sapiens
ggccagtggaagaaa

SEQ ID NO: 1034837 - DNA, 20 bp, Homo sapiens
ggccagtggattcccacagc

SEQ ID NO: 1034838 - DNA, 21 bp, Homo sapiens
ggccagtggcccccgggcctg

SEQ ID NO: 1034839 - DNA, 19 bp, Homo sapiens
ggccagtgtttaaaacttc

SEQ ID NO: 1034840 - DNA, 13 bp, Homo sapiens
ggccatactgcct

SEQ ID NO: 1034841 - DNA, 14 bp, Homo sapiens
ggccatagaggccc

SEQ ID NO: 1034842 - DNA, 17 bp, Homo sapiens
ggccatagaggcccagg

SEQ ID NO: 1034843 - DNA, 21 bp, Homo sapiens
ggccatagaggcccaggcacc

SEQ ID NO: 1034844 - DNA, 15 bp, Homo sapiens
ggccatatatgctgt

SEQ ID NO: 1034845 - DNA, 20 bp, Homo sapiens
ggccatatatgctgtatttc

SEQ ID NO: 1034846 - DNA, 19 bp, Homo sapiens
ggccatcactcagccccta

SEQ ID NO: 1034847 - DNA, 23 bp, Homo sapiens
ggccatcactcagcccctacccc

SEQ ID NO: 1034848 - DNA, 23 bp, Homo sapiens
ggccatcagggccctgccccagg

SEQ ID NO: 1034849 - DNA, 19 bp, Homo sapiens
ggccatccctgggcccctc

SEQ ID NO: 1034850 - DNA, 14 bp, Homo sapiens
ggccatcctaccca

SEQ ID NO: 1034851 - DNA, 16 bp, Homo sapiens
ggccatcctacccagc

SEQ ID NO: 1034852 - DNA, 20 bp, Homo sapiens
ggccatcctacccagcgtgg

SEQ ID NO: 1034853 - DNA, 14 bp, Homo sapiens
ggccatctcaggag

SEQ ID NO: 1034854 - DNA, 15 bp, Homo sapiens
ggccatctccctccc

SEQ ID NO: 1034855 - DNA, 22 bp, Homo sapiens
ggccatctgggctcctccaggg

SEQ ID NO: 1034856 - DNA, 15 bp, Homo sapiens
ggccatctgtaaata

SEQ ID NO: 1034857 - DNA, 20 bp, Homo sapiens
ggccatgaatctctgcctct

SEQ ID NO: 1034858 - DNA, 16 bp, Homo sapiens
ggccatgagctccaga

SEQ ID NO: 1034859 - DNA, 21 bp, Homo sapiens
ggccatgatgtccttggactc

SEQ ID NO: 1034860 - DNA, 22 bp, Homo sapiens
ggccatgatgtccttggactcc

SEQ ID NO: 1034861 - DNA, 21 bp, Homo sapiens
ggccatgattcgcccaaagcc

SEQ ID NO: 1034862 - DNA, 15 bp, Homo sapiens
ggccatgcagacctc

SEQ ID NO: 1034863 - DNA, 13 bp, Homo sapiens
ggccatgcaggag

SEQ ID NO: 1034864 - DNA, 12 bp, Homo sapiens
ggccatgcccca

SEQ ID NO: 1034865 - DNA, 18 bp, Homo sapiens
ggccatgctcaacccccc

SEQ ID NO: 1034866 - DNA, 17 bp, Homo sapiens
ggccatgctgaagggac

SEQ ID NO: 1034867 - DNA, 18 bp, Homo sapiens
ggccatgctgaggcctgg

SEQ ID NO: 1034868 - DNA, 19 bp, Homo sapiens
ggccatgctgaggcctggg

SEQ ID NO: 1034869 - DNA, 15 bp, Homo sapiens
ggccatgctgtccct

SEQ ID NO: 1034870 - DNA, 21 bp, Homo sapiens
ggccatggacgaatatgaatg

SEQ ID NO: 1034871 - DNA, 24 bp, Homo sapiens
ggccatggacgaatatgaatgtca

SEQ ID NO: 1034872 - DNA, 13 bp, Homo sapiens
ggccatggcctct

SEQ ID NO: 1034873 - DNA, 15 bp, Homo sapiens
ggccatggcctctgc

SEQ ID NO: 1034874 - DNA, 19 bp, Homo sapiens
ggccatggtggagggcact

SEQ ID NO: 1034875 - DNA, 14 bp, Homo sapiens
ggccatgtgagcca

SEQ ID NO: 1034876 - DNA, 22 bp, Homo sapiens
ggccatgtggcctgcccagcct

SEQ ID NO: 1034877 - DNA, 20 bp, Homo sapiens
ggccattctccacagcaacc

SEQ ID NO: 1034878 - DNA, 10 bp, Homo sapiens
ggccatttct

SEQ ID NO: 1034879 - DNA, 14 bp, Homo sapiens
ggccatttgcaata

SEQ ID NO: 1034880 - DNA, 20 bp, Homo sapiens
ggccatttgcaataacagct

SEQ ID NO: 1034881 - DNA, 23 bp, Homo sapiens
ggccatttgcaataacagctgca

SEQ ID NO: 1034882 - DNA, 23 bp, Homo sapiens
ggccatttgctagttctgctgcc

SEQ ID NO: 1034883 - DNA, 14 bp, Homo sapiens
ggccatttggcccc

SEQ ID NO: 1034884 - DNA, 16 bp, Homo sapiens
ggccatttttctgggg

SEQ ID NO: 1034885 - DNA, 14 bp, Homo sapiens
ggcccaaaggccca

SEQ ID NO: 1034886 - DNA, 17 bp, Homo sapiens
ggcccaaaggcccaggg

SEQ ID NO: 1034887 - DNA, 13 bp, Homo sapiens
ggcccaagaactg

SEQ ID NO: 1034888 - DNA, 19 bp, Homo sapiens
ggcccaagagatgaagagt

SEQ ID NO: 1034889 - DNA, 17 bp, Homo sapiens
ggcccaagagccctgtg

SEQ ID NO: 1034890 - DNA, 18 bp, Homo sapiens
ggcccaaggagcttaccc

SEQ ID NO: 1034891 - DNA, 19 bp, Homo sapiens
ggcccaaggtcccctccac

SEQ ID NO: 1034892 - DNA, 20 bp, Homo sapiens
ggcccaaggtcccctccaca

SEQ ID NO: 1034893 - DNA, 21 bp, Homo sapiens
ggcccaagtggggtgctctgg

SEQ ID NO: 1034894 - DNA, 14 bp, Homo sapiens
ggcccaagttgcag

SEQ ID NO: 1034895 - DNA, 23 bp, Homo sapiens
ggcccaagttgcagtgagcaggg

SEQ ID NO: 1034896 - DNA, 14 bp, Homo sapiens
ggcccacagagcct

SEQ ID NO: 1034897 - DNA, 17 bp, Homo sapiens
ggcccacagagcctggc

SEQ ID NO: 1034898 - DNA, 13 bp, Homo sapiens
ggcccacagctcc

SEQ ID NO: 1034899 - DNA, 18 bp, Homo sapiens
ggcccacagctcccaccc

SEQ ID NO: 1034900 - DNA, 19 bp, Homo sapiens
ggcccacagctcccacccc

SEQ ID NO: 1034901 - DNA, 21 bp, Homo sapiens
ctctgttgtcgtaaagatttg

SEQ ID NO: 1034902 - DNA, 19 bp, Homo sapiens
ctctgttgtttggttcagg

SEQ ID NO: 1034903 - DNA, 13 bp, Homo sapiens
ctctgtttcctga

SEQ ID NO: 1034904 - DNA, 17 bp, Homo sapiens
ctcttaaaaaataaaaa

SEQ ID NO: 1034905 - DNA, 15 bp, Homo sapiens
ctcttaaaatatctt

SEQ ID NO: 1034906 - DNA, 16 bp, Homo sapiens
ctcttaaaatatcttc

SEQ ID NO: 1034907 - DNA, 23 bp, Homo sapiens
ctcttaaaatatcttcctttggg

SEQ ID NO: 1034908 - DNA, 20 bp, Homo sapiens
ctcttaaagctgcctgtagt

SEQ ID NO: 1034909 - DNA, 12 bp, Homo sapiens
ctcttaaagttg

SEQ ID NO: 1034910 - DNA, 14 bp, Homo sapiens
ctcttaaatcattt

SEQ ID NO: 1034911 - DNA, 22 bp, Homo sapiens
ctcttaagcttccgccgtctca

SEQ ID NO: 1034912 - DNA, 21 bp, Homo sapiens
ctcttaataatctcatgctgt

SEQ ID NO: 1034913 - DNA, 20 bp, Homo sapiens
ctcttaatattgagaatcag

SEQ ID NO: 1034914 - DNA, 17 bp, Homo sapiens
ctcttaatcactactgt

SEQ ID NO: 1034915 - DNA, 19 bp, Homo sapiens
ctcttaatcactactgtat

SEQ ID NO: 1034916 - DNA, 14 bp, Homo sapiens
ctcttaatctgtgt

SEQ ID NO: 1034917 - DNA, 13 bp, Homo sapiens
ctcttaatgttgc

SEQ ID NO: 1034918 - DNA, 20 bp, Homo sapiens
ctcttacatcagtagcattt

SEQ ID NO: 1034919 - DNA, 12 bp, Homo sapiens
ctcttacctgtt

SEQ ID NO: 1034920 - DNA, 22 bp, Homo sapiens
ctcttacgcccaacccttcccc

SEQ ID NO: 1034921 - DNA, 22 bp, Homo sapiens
ctcttacgtggagagtgcactg

SEQ ID NO: 1034922 - DNA, 15 bp, Homo sapiens
ctcttactctttcct

SEQ ID NO: 1034923 - DNA, 16 bp, Homo sapiens
ctcttactctttccta

SEQ ID NO: 1034924 - DNA, 14 bp, Homo sapiens
ctcttactttgctt

SEQ ID NO: 1034925 - DNA, 13 bp, Homo sapiens
ctcttagaaaaac

SEQ ID NO: 1034926 - DNA, 13 bp, Homo sapiens
ctcttagaaatac

SEQ ID NO: 1034927 - DNA, 16 bp, Homo sapiens
ctcttagaaatgaagg

SEQ ID NO: 1034928 - DNA, 13 bp, Homo sapiens
ctcttagaagcca

SEQ ID NO: 1034929 - DNA, 20 bp, Homo sapiens
ctcttagaagccatgggacc

SEQ ID NO: 1034930 - DNA, 16 bp, Homo sapiens
ctcttagattgggcca

SEQ ID NO: 1034931 - DNA, 22 bp, Homo sapiens
ctcttagattgggccatggctt

SEQ ID NO: 1034932 - DNA, 12 bp, Homo sapiens
ctcttagctgag

SEQ ID NO: 1034933 - DNA, 13 bp, Homo sapiens
ctcttagctgtct

SEQ ID NO: 1034934 - DNA, 16 bp, Homo sapiens
ctcttagcttacagga

SEQ ID NO: 1034935 - DNA, 17 bp, Homo sapiens
ctcttagcttacaggaa

SEQ ID NO: 1034936 - DNA, 18 bp, Homo sapiens
ctcttagctttctcaggg

SEQ ID NO: 1034937 - DNA, 18 bp, Homo sapiens
ctcttagtctctttggta

SEQ ID NO: 1034938 - DNA, 20 bp, Homo sapiens
ctcttagtgattgtgtctgc

SEQ ID NO: 1034939 - DNA, 13 bp, Homo sapiens
ctcttagtgcccg

SEQ ID NO: 1034940 - DNA, 22 bp, Homo sapiens
ctcttatagaatatttattacc

SEQ ID NO: 1034941 - DNA, 15 bp, Homo sapiens
ctcttatcctctctc

SEQ ID NO: 1034942 - DNA, 14 bp, Homo sapiens
ctcttattctaata

SEQ ID NO: 1034943 - DNA, 15 bp, Homo sapiens
ctcttattttacaat

SEQ ID NO: 1034944 - DNA, 18 bp, Homo sapiens
ctcttcaaagcagagtgg

SEQ ID NO: 1034945 - DNA, 16 bp, Homo sapiens
ctcttcaactgaccag

SEQ ID NO: 1034946 - DNA, 20 bp, Homo sapiens
ctcttcaactgaccagcctc

SEQ ID NO: 1034947 - DNA, 19 bp, Homo sapiens
ctcttcaagcatcctcaga

SEQ ID NO: 1034948 - DNA, 12 bp, Homo sapiens
ctcttcaatgaa

SEQ ID NO: 1034949 - DNA, 21 bp, Homo sapiens
ctcttcacatctcccccatag

SEQ ID NO: 1034950 - DNA, 16 bp, Homo sapiens
ctcttcactaccctga

SEQ ID NO: 1034951 - DNA, 17 bp, Homo sapiens
ctcttcactcccaataa

SEQ ID NO: 1034952 - DNA, 13 bp, Homo sapiens
ctcttcagaacac

SEQ ID NO: 1034953 - DNA, 17 bp, Homo sapiens
ctcttcagaggccctcg

SEQ ID NO: 1034954 - DNA, 18 bp, Homo sapiens
ctcttcagatctctaact

SEQ ID NO: 1034955 - DNA, 23 bp, Homo sapiens
ctcttcagcccctagtgctattc

SEQ ID NO: 1034956 - DNA, 14 bp, Homo sapiens
ctcttcaggcctcc

SEQ ID NO: 1034957 - DNA, 15 bp, Homo sapiens
ctcttcaggcctccc

SEQ ID NO: 1034958 - DNA, 14 bp, Homo sapiens
ctcttcagttaatt

SEQ ID NO: 1034959 - DNA, 14 bp, Homo sapiens
ctcttcatctgcct

SEQ ID NO: 1034960 - DNA, 20 bp, Homo sapiens
ctcttccagaagatgccctc

SEQ ID NO: 1034961 - DNA, 14 bp, Homo sapiens
ctcttccagcttct

SEQ ID NO: 1034962 - DNA, 14 bp, Homo sapiens
ctcttccagggcag

SEQ ID NO: 1034963 - DNA, 22 bp, Homo sapiens
ctcttccagtcttcctgacact

SEQ ID NO: 1034964 - DNA, 23 bp, Homo sapiens
ctcttccagtcttcctgacactt

SEQ ID NO: 1034965 - DNA, 14 bp, Homo sapiens
ctcttccatgctgt

SEQ ID NO: 1034966 - DNA, 15 bp, Homo sapiens
ctcttccatgctgtg

SEQ ID NO: 1034967 - DNA, 16 bp, Homo sapiens
ctcttccatgctgtgc

SEQ ID NO: 1034968 - DNA, 12 bp, Homo sapiens
ctcttcccaggc

SEQ ID NO: 1034969 - DNA, 14 bp, Homo sapiens
ctcttcccaggcct

SEQ ID NO: 1034970 - DNA, 18 bp, Homo sapiens
ctcttcccaggcctttgg

SEQ ID NO: 1034971 - DNA, 19 bp, Homo sapiens
ctcttcccaggcctttgga

SEQ ID NO: 1034972 - DNA, 20 bp, Homo sapiens
ctcttcccatgactgcaccc

SEQ ID NO: 1034973 - DNA, 21 bp, Homo sapiens
ctcttccccagaaaggagact

SEQ ID NO: 1034974 - DNA, 15 bp, Homo sapiens
ctcttcccccaccac

SEQ ID NO: 1034975 - DNA, 19 bp, Homo sapiens
ctcttccccttcctgtttc

SEQ ID NO: 1034976 - DNA, 21 bp, Homo sapiens
ctcttccctccggactctaaa

SEQ ID NO: 1034977 - DNA, 16 bp, Homo sapiens
ctcttccctctgattt

SEQ ID NO: 1034978 - DNA, 15 bp, Homo sapiens
ctcttccctgaacgt

SEQ ID NO: 1034979 - DNA, 21 bp, Homo sapiens
ctcttcccttcctccattgca

SEQ ID NO: 1034980 - DNA, 22 bp, Homo sapiens
ctcttccggagatgtagcaaaa

SEQ ID NO: 1034981 - DNA, 16 bp, Homo sapiens
ctcttccgggagctgg

SEQ ID NO: 1034982 - DNA, 21 bp, Homo sapiens
ctcttccgggagctggtgaca

SEQ ID NO: 1034983 - DNA, 18 bp, Homo sapiens
ctcttccgggcagaaaca

SEQ ID NO: 1034984 - DNA, 15 bp, Homo sapiens
ctcttcctcatcctg

SEQ ID NO: 1034985 - DNA, 15 bp, Homo sapiens
ctcttcctcccctct

SEQ ID NO: 1034986 - DNA, 11 bp, Homo sapiens
ctcttcctctg

SEQ ID NO: 1034987 - DNA, 12 bp, Homo sapiens
ctcttcctctga

SEQ ID NO: 1034988 - DNA, 13 bp, Homo sapiens
ctcttcctctgag

SEQ ID NO: 1034989 - DNA, 13 bp, Homo sapiens
ctcttcctctgtt

SEQ ID NO: 1034990 - DNA, 13 bp, Homo sapiens
ctcttcctcttcc

SEQ ID NO: 1034991 - DNA, 17 bp, Homo sapiens
ctcttcctcttgaccct

SEQ ID NO: 1034992 - DNA, 14 bp, Homo sapiens
ctcttcctgcccct

SEQ ID NO: 1034993 - DNA, 18 bp, Homo sapiens
ctcttcctggacctgagt

SEQ ID NO: 1034994 - DNA, 10 bp, Homo sapiens
ctcttcctgt

SEQ ID NO: 1034995 - DNA, 18 bp, Homo sapiens
ctcttcgaagccttgcct

SEQ ID NO: 1034996 - DNA, 14 bp, Homo sapiens
ctcttcggcaggga

SEQ ID NO: 1034997 - DNA, 18 bp, Homo sapiens
ctcttcggtttctgagca

SEQ ID NO: 1034998 - DNA, 16 bp, Homo sapiens
ctcttcgtcctgatcc

SEQ ID NO: 1034999 - DNA, 22 bp, Homo sapiens
ctcttcgtcctgatccctccac

SEQ ID NO: 1035000 - DNA, 21 bp, Homo sapiens
ctcttctagatgattttttga

SEQ ID NO: 1035001 - DNA, 14 bp, Homo sapiens
ctcttctcaagtgc

SEQ ID NO: 1035002 - DNA, 22 bp, Homo sapiens
ctcttctccacgtctttcctgc

SEQ ID NO: 1035003 - DNA, 13 bp, Homo sapiens
ctcttctccactg

SEQ ID NO: 1035004 - DNA, 14 bp, Homo sapiens
ctcttctccactgg

SEQ ID NO: 1035005 - DNA, 15 bp, Homo sapiens
ctcttctccactgga

SEQ ID NO: 1035006 - DNA, 15 bp, Homo sapiens
ctcttctcccagaat

SEQ ID NO: 1035007 - DNA, 16 bp, Homo sapiens
ctcttctcccagaatc

SEQ ID NO: 1035008 - DNA, 22 bp, Homo sapiens
ctcttctcccagaatcccagcc

SEQ ID NO: 1035009 - DNA, 11 bp, Homo sapiens
ctcttctcctt

SEQ ID NO: 1035010 - DNA, 20 bp, Homo sapiens
ctcttctccttgccttgctt

SEQ ID NO: 1035011 - DNA, 13 bp, Homo sapiens
ctcttctctcctc

SEQ ID NO: 1035012 - DNA, 21 bp, Homo sapiens
ctcttctctcctttctccctg

SEQ ID NO: 1035013 - DNA, 14 bp, Homo sapiens
ctcttctcttcctg

SEQ ID NO: 1035014 - DNA, 16 bp, Homo sapiens
ctcttctcttcctgta

SEQ ID NO: 1035015 - DNA, 22 bp, Homo sapiens
ctcttctcttgacagtctgaag

SEQ ID NO: 1035016 - DNA, 22 bp, Homo sapiens
ctcttctgacgtgccttttgca

SEQ ID NO: 1035017 - DNA, 21 bp, Homo sapiens
ctcttctgagctatttcatct

SEQ ID NO: 1035018 - DNA, 14 bp, Homo sapiens
ctcttctgctccac

SEQ ID NO: 1035019 - DNA, 15 bp, Homo sapiens
ctcttctgctccacc

SEQ ID NO: 1035020 - DNA, 16 bp, Homo sapiens
ctcttctgctccaccc

SEQ ID NO: 1035021 - DNA, 11 bp, Homo sapiens
ctcttctggct

SEQ ID NO: 1035022 - DNA, 10 bp, Homo sapiens
ctcttctggg

SEQ ID NO: 1035023 - DNA, 21 bp, Homo sapiens
ctcttctgggagggcagcagg

SEQ ID NO: 1035024 - DNA, 19 bp, Homo sapiens
ctcttctgggcagagcctg

SEQ ID NO: 1035025 - DNA, 23 bp, Homo sapiens
ctcttctgggcagagcctgtccc

SEQ ID NO: 1035026 - DNA, 19 bp, Homo sapiens
ctcttctggggcaggctgg

SEQ ID NO: 1035027 - DNA, 20 bp, Homo sapiens
ggcccacagggaaccctgct

SEQ ID NO: 1035028 - DNA, 14 bp, Homo sapiens
ggcccaccagggtc

SEQ ID NO: 1035029 - DNA, 20 bp, Homo sapiens
ggcccaccctgcctgcacct

SEQ ID NO: 1035030 - DNA, 15 bp, Homo sapiens
ggcccacctggccac

SEQ ID NO: 1035031 - DNA, 17 bp, Homo sapiens
ggcccacctggccacct

SEQ ID NO: 1035032 - DNA, 19 bp, Homo sapiens
ggcccacctggccacctga

SEQ ID NO: 1035033 - DNA, 18 bp, Homo sapiens
ggcccaccttggaccctg

SEQ ID NO: 1035034 - DNA, 13 bp, Homo sapiens
ggcccacgaggag

SEQ ID NO: 1035035 - DNA, 13 bp, Homo sapiens
ggcccactagagg

SEQ ID NO: 1035036 - DNA, 15 bp, Homo sapiens
ggcccactagagggc

SEQ ID NO: 1035037 - DNA, 17 bp, Homo sapiens
ggcccactccccagccc

SEQ ID NO: 1035038 - DNA, 17 bp, Homo sapiens
ggcccactgtgcctcag

SEQ ID NO: 1035039 - DNA, 18 bp, Homo sapiens
ggcccactgtgcctcaga

SEQ ID NO: 1035040 - DNA, 16 bp, Homo sapiens
ggcccacttggggcct

SEQ ID NO: 1035041 - DNA, 16 bp, Homo sapiens
ggcccagaaagcctct

SEQ ID NO: 1035042 - DNA, 21 bp, Homo sapiens
ggcccagaaagcctctctctc

SEQ ID NO: 1035043 - DNA, 16 bp, Homo sapiens
ggcccagacccactct

SEQ ID NO: 1035044 - DNA, 18 bp, Homo sapiens
ggcccagaccggcttctc

SEQ ID NO: 1035045 - DNA, 17 bp, Homo sapiens
ggcccagagaccccttc

SEQ ID NO: 1035046 - DNA, 14 bp, Homo sapiens
ggcccagagcagga

SEQ ID NO: 1035047 - DNA, 20 bp, Homo sapiens
ggcccagagcgaggaaagga

SEQ ID NO: 1035048 - DNA, 17 bp, Homo sapiens
ggcccagcattgctggt

SEQ ID NO: 1035049 - DNA, 16 bp, Homo sapiens
ggcccagccagggtgt

SEQ ID NO: 1035050 - DNA, 15 bp, Homo sapiens
ggcccagcccagagc

SEQ ID NO: 1035051 - DNA, 22 bp, Homo sapiens
ggcccagcccagagccacctgg

SEQ ID NO: 1035052 - DNA, 13 bp, Homo sapiens
ggcccagccccta

SEQ ID NO: 1035053 - DNA, 24 bp, Homo sapiens
ggcccagcccctagaaacccaagc

SEQ ID NO: 1035054 - DNA, 22 bp, Homo sapiens
ggcccagccggcctctctggcc

SEQ ID NO: 1035055 - DNA, 12 bp, Homo sapiens
ggcccagcctgt

SEQ ID NO: 1035056 - DNA, 13 bp, Homo sapiens
ggcccagccttgt

SEQ ID NO: 1035057 - DNA, 17 bp, Homo sapiens
ggcccagcggcccctcc

SEQ ID NO: 1035058 - DNA, 18 bp, Homo sapiens
ggcccagcggtccctgca

SEQ ID NO: 1035059 - DNA, 15 bp, Homo sapiens
ggcccagctgctccc

SEQ ID NO: 1035060 - DNA, 14 bp, Homo sapiens
ggcccagctgtagc

SEQ ID NO: 1035061 - DNA, 16 bp, Homo sapiens
ggcccagctgtagcca

SEQ ID NO: 1035062 - DNA, 12 bp, Homo sapiens
ggcccaggagct

SEQ ID NO: 1035063 - DNA, 13 bp, Homo sapiens
ggcccaggagctc

SEQ ID NO: 1035064 - DNA, 15 bp, Homo sapiens
ggcccaggagctctg

SEQ ID NO: 1035065 - DNA, 16 bp, Homo sapiens
ggcccaggagctctgc

SEQ ID NO: 1035066 - DNA, 12 bp, Homo sapiens
ggcccaggcacc

SEQ ID NO: 1035067 - DNA, 17 bp, Homo sapiens
ggcccaggcaccaccag

SEQ ID NO: 1035068 - DNA, 21 bp, Homo sapiens
ggcccaggcaccaccaggagc

SEQ ID NO: 1035069 - DNA, 12 bp, Homo sapiens
ggcccaggcagc

SEQ ID NO: 1035070 - DNA, 20 bp, Homo sapiens
ggcccaggcaggtctgcaag

SEQ ID NO: 1035071 - DNA, 15 bp, Homo sapiens
ggcccaggcccccgg

SEQ ID NO: 1035072 - DNA, 12 bp, Homo sapiens
ggcccaggcctg

SEQ ID NO: 1035073 - DNA, 15 bp, Homo sapiens
ggcccaggcctggag

SEQ ID NO: 1035074 - DNA, 11 bp, Homo sapiens
ggcccagggag

SEQ ID NO: 1035075 - DNA, 21 bp, Homo sapiens
ggcccagggaggcagcgtggg

SEQ ID NO: 1035076 - DNA, 22 bp, Homo sapiens
ggcccagtacctagctggctct

SEQ ID NO: 1035077 - DNA, 20 bp, Homo sapiens
ggcccagtgacaaagactcc

SEQ ID NO: 1035078 - DNA, 22 bp, Homo sapiens
ggcccagtgacaaagactcctc

SEQ ID NO: 1035079 - DNA, 14 bp, Homo sapiens
ggcccagtgccact

SEQ ID NO: 1035080 - DNA, 19 bp, Homo sapiens
ggcccagtgccactgcccc

SEQ ID NO: 1035081 - DNA, 13 bp, Homo sapiens
ggcccagtgccag

SEQ ID NO: 1035082 - DNA, 17 bp, Homo sapiens
ggcccagtgccagctcc

SEQ ID NO: 1035083 - DNA, 23 bp, Homo sapiens
ggcccagtgtcaagttgtgcttg

SEQ ID NO: 1035084 - DNA, 24 bp, Homo sapiens
ggcccatatctgtgaaatgctggc

SEQ ID NO: 1035085 - DNA, 14 bp, Homo sapiens
ggcccatcactgta

SEQ ID NO: 1035086 - DNA, 14 bp, Homo sapiens
ggcccatcaggcag

SEQ ID NO: 1035087 - DNA, 22 bp, Homo sapiens
ggcccatcaggcagtgttacct

SEQ ID NO: 1035088 - DNA, 16 bp, Homo sapiens
ggcccatctccctgct

SEQ ID NO: 1035089 - DNA, 14 bp, Homo sapiens
ggcccatgccccct

SEQ ID NO: 1035090 - DNA, 15 bp, Homo sapiens
ggcccatgccccctt

SEQ ID NO: 1035091 - DNA, 17 bp, Homo sapiens
ggcccattgtcctcctt

SEQ ID NO: 1035092 - DNA, 20 bp, Homo sapiens
ggccccaaaaccacagccct

SEQ ID NO: 1035093 - DNA, 18 bp, Homo sapiens
ggccccaaccctgtcctc

SEQ ID NO: 1035094 - DNA, 16 bp, Homo sapiens
ggccccacatgggaac

SEQ ID NO: 1035095 - DNA, 23 bp, Homo sapiens
ggccccacccaccctctggtcct

SEQ ID NO: 1035096 - DNA, 12 bp, Homo sapiens
ggccccaccccc

SEQ ID NO: 1035097 - DNA, 21 bp, Homo sapiens
ggccccaccccctgggcagat

SEQ ID NO: 1035098 - DNA, 13 bp, Homo sapiens
ggccccaccctgg

SEQ ID NO: 1035099 - DNA, 15 bp, Homo sapiens
ggccccacctccctg

SEQ ID NO: 1035100 - DNA, 19 bp, Homo sapiens
ggccccacctccctgcgcc

SEQ ID NO: 1035101 - DNA, 21 bp, Homo sapiens
ggccccacctccctgcgccct

SEQ ID NO: 1035102 - DNA, 15 bp, Homo sapiens
ggccccacgccctct

SEQ ID NO: 1035103 - DNA, 13 bp, Homo sapiens
ggccccactggac

SEQ ID NO: 1035104 - DNA, 13 bp, Homo sapiens
ggccccactggct

SEQ ID NO: 1035105 - DNA, 19 bp, Homo sapiens
ggccccactttgaagggca

SEQ ID NO: 1035106 - DNA, 19 bp, Homo sapiens
ggccccagacgcatagact

SEQ ID NO: 1035107 - DNA, 11 bp, Homo sapiens
ggccccagaga

SEQ ID NO: 1035108 - DNA, 13 bp, Homo sapiens
ggccccagaggac

SEQ ID NO: 1035109 - DNA, 14 bp, Homo sapiens
ggccccagaggacc

SEQ ID NO: 1035110 - DNA, 18 bp, Homo sapiens
ggccccagatctgcctgg

SEQ ID NO: 1035111 - DNA, 13 bp, Homo sapiens
ggccccagcacta

SEQ ID NO: 1035112 - DNA, 21 bp, Homo sapiens
ggccccagcctaggtggaggc

SEQ ID NO: 1035113 - DNA, 13 bp, Homo sapiens
ggccccagcgtct

SEQ ID NO: 1035114 - DNA, 20 bp, Homo sapiens
ggccccagcgtctgcagggt

SEQ ID NO: 1035115 - DNA, 22 bp, Homo sapiens
ggccccagcgtctgcagggtga

SEQ ID NO: 1035116 - DNA, 18 bp, Homo sapiens
ggccccaggaaaggccca

SEQ ID NO: 1035117 - DNA, 22 bp, Homo sapiens
ggccccaggcattgccaagggc

SEQ ID NO: 1035118 - DNA, 12 bp, Homo sapiens
ggccccaggccc

SEQ ID NO: 1035119 - DNA, 13 bp, Homo sapiens
ggccccaggcccc

SEQ ID NO: 1035120 - DNA, 12 bp, Homo sapiens
ggccccagggac

SEQ ID NO: 1035121 - DNA, 20 bp, Homo sapiens
ggccccagggacagaggcca

SEQ ID NO: 1035122 - DNA, 17 bp, Homo sapiens
ggccccagggctaccct

SEQ ID NO: 1035123 - DNA, 20 bp, Homo sapiens
ggccccaggggcagcaaggc

SEQ ID NO: 1035124 - DNA, 23 bp, Homo sapiens
ggccccatccaaccactgtacac

SEQ ID NO: 1035125 - DNA, 17 bp, Homo sapiens
ggccccatcctcatccc

SEQ ID NO: 1035126 - DNA, 21 bp, Homo sapiens
ggccccatcctcatccctgac

SEQ ID NO: 1035127 - DNA, 16 bp, Homo sapiens
ggccccatgctctgcc

SEQ ID NO: 1035128 - DNA, 21 bp, Homo sapiens
ggccccatgctctgccccaag

SEQ ID NO: 1035129 - DNA, 20 bp, Homo sapiens
ggcccccaaacatagcccct

SEQ ID NO: 1035130 - DNA, 21 bp, Homo sapiens
ggcccccaacctcagggctcc

SEQ ID NO: 1035131 - DNA, 23 bp, Homo sapiens
ggcccccaacctcagggctccca

SEQ ID NO: 1035132 - DNA, 14 bp, Homo sapiens
ggcccccaataaag

SEQ ID NO: 1035133 - DNA, 17 bp, Homo sapiens
ggcccccaataaaggca

SEQ ID NO: 1035134 - DNA, 18 bp, Homo sapiens
ggcccccaataaaggcag

SEQ ID NO: 1035135 - DNA, 22 bp, Homo sapiens
ggcccccaataaaggcagctgc

SEQ ID NO: 1035136 - DNA, 18 bp, Homo sapiens
ggcccccacttgcctctt

SEQ ID NO: 1035137 - DNA, 17 bp, Homo sapiens
ggcccccagcccagggc

SEQ ID NO: 1035138 - DNA, 18 bp, Homo sapiens
ggcccccagcctggccag

SEQ ID NO: 1035139 - DNA, 15 bp, Homo sapiens
ggcccccagtgggga

SEQ ID NO: 1035140 - DNA, 19 bp, Homo sapiens
ggcccccagtggggacagg

SEQ ID NO: 1035141 - DNA, 22 bp, Homo sapiens
ggccccccactcccccttccct

SEQ ID NO: 1035142 - DNA, 15 bp, Homo sapiens
ggcccccctcccccc

SEQ ID NO: 1035143 - DNA, 14 bp, Homo sapiens
ggcccccgccccgc

SEQ ID NO: 1035144 - DNA, 19 bp, Homo sapiens
ggcccccgccccgcccccg

SEQ ID NO: 1035145 - DNA, 19 bp, Homo sapiens
ggcccccggctttcctccg

SEQ ID NO: 1035146 - DNA, 16 bp, Homo sapiens
ggcccccgggcctgca

SEQ ID NO: 1035147 - DNA, 17 bp, Homo sapiens
ggcccccgggcctgcac

SEQ ID NO: 1035148 - DNA, 19 bp, Homo sapiens
ggcccccgggcctgcacag

SEQ ID NO: 1035149 - DNA, 20 bp, Homo sapiens
ggccccctcaccccagctcc

SEQ ID NO: 1035150 - DNA, 21 bp, Homo sapiens
ggccccctcattcagagactg

SEQ ID NO: 1035151 - DNA, 19 bp, Homo sapiens
ggccccctccccccagact

SEQ ID NO: 1035152 - DNA, 18 bp, Homo sapiens
ctcttctgggttccttcc

SEQ ID NO: 1035153 - DNA, 13 bp, Homo sapiens
ctcttctgtccat

SEQ ID NO: 1035154 - DNA, 22 bp, Homo sapiens
ctcttctgtccatcagtgcatg

SEQ ID NO: 1035155 - DNA, 13 bp, Homo sapiens
ctcttctgtccct

SEQ ID NO: 1035156 - DNA, 16 bp, Homo sapiens
ctcttctgttgaaaca

SEQ ID NO: 1035157 - DNA, 19 bp, Homo sapiens
ctcttcttaacttaaattt

SEQ ID NO: 1035158 - DNA, 16 bp, Homo sapiens
ctcttcttcccagcac

SEQ ID NO: 1035159 - DNA, 17 bp, Homo sapiens
ctcttctttaagccata

SEQ ID NO: 1035160 - DNA, 21 bp, Homo sapiens
ctcttctttatactgtaattt

SEQ ID NO: 1035161 - DNA, 17 bp, Homo sapiens
ctcttctttattgcact

SEQ ID NO: 1035162 - DNA, 20 bp, Homo sapiens
ctcttctttccattcttctt

SEQ ID NO: 1035163 - DNA, 14 bp, Homo sapiens
ctcttctttctgag

SEQ ID NO: 1035164 - DNA, 15 bp, Homo sapiens
ctcttctttctgaga

SEQ ID NO: 1035165 - DNA, 14 bp, Homo sapiens
ctcttgaaaagttc

SEQ ID NO: 1035166 - DNA, 22 bp, Homo sapiens
ctcttgaaaagttcagggaccg

SEQ ID NO: 1035167 - DNA, 21 bp, Homo sapiens
ctcttgaaatattcagaaatt

SEQ ID NO: 1035168 - DNA, 19 bp, Homo sapiens
ctcttgaccctgcaccctc

SEQ ID NO: 1035169 - DNA, 16 bp, Homo sapiens
ctcttgaccttgtaga

SEQ ID NO: 1035170 - DNA, 15 bp, Homo sapiens
ctcttgagcctggga

SEQ ID NO: 1035171 - DNA, 22 bp, Homo sapiens
ctcttgagctggcctctctagc

SEQ ID NO: 1035172 - DNA, 14 bp, Homo sapiens
ctcttgaggccagg

SEQ ID NO: 1035173 - DNA, 16 bp, Homo sapiens
ctcttgaggccaggag

SEQ ID NO: 1035174 - DNA, 16 bp, Homo sapiens
ctcttgaggcctgtgc

SEQ ID NO: 1035175 - DNA, 16 bp, Homo sapiens
ctcttgagttcctctg

SEQ ID NO: 1035176 - DNA, 21 bp, Homo sapiens
ctcttgagttcctctgcagtt

SEQ ID NO: 1035177 - DNA, 23 bp, Homo sapiens
ctcttgatacccccctctgtctt

SEQ ID NO: 1035178 - DNA, 21 bp, Homo sapiens
ctcttgatggtggactaagca

SEQ ID NO: 1035179 - DNA, 17 bp, Homo sapiens
ctcttgattataaatgt

SEQ ID NO: 1035180 - DNA, 12 bp, Homo sapiens
ctcttgcacccg

SEQ ID NO: 1035181 - DNA, 21 bp, Homo sapiens
ctcttgcacccgcctctcccg

SEQ ID NO: 1035182 - DNA, 16 bp, Homo sapiens
ctcttgcagttgctct

SEQ ID NO: 1035183 - DNA, 22 bp, Homo sapiens
ctcttgccactgcctcttcctc

SEQ ID NO: 1035184 - DNA, 13 bp, Homo sapiens
ctcttgccagcct

SEQ ID NO: 1035185 - DNA, 16 bp, Homo sapiens
ctcttgccagcctcct

SEQ ID NO: 1035186 - DNA, 17 bp, Homo sapiens
ctcttgccagcctcctt

SEQ ID NO: 1035187 - DNA, 20 bp, Homo sapiens
ctcttgccagcctccttgct

SEQ ID NO: 1035188 - DNA, 16 bp, Homo sapiens
ctcttgccatcctgat

SEQ ID NO: 1035189 - DNA, 12 bp, Homo sapiens
ctcttgcccccc

SEQ ID NO: 1035190 - DNA, 19 bp, Homo sapiens
ctcttgccccccaccccag

SEQ ID NO: 1035191 - DNA, 17 bp, Homo sapiens
ctcttgccccttgtcct

SEQ ID NO: 1035192 - DNA, 23 bp, Homo sapiens
ctcttgcccgcacccctccctgc

SEQ ID NO: 1035193 - DNA, 14 bp, Homo sapiens
ctcttgcccttccc

SEQ ID NO: 1035194 - DNA, 17 bp, Homo sapiens
ctcttgcgggcctggac

SEQ ID NO: 1035195 - DNA, 16 bp, Homo sapiens
ctcttgctgaaagcca

SEQ ID NO: 1035196 - DNA, 12 bp, Homo sapiens
ctcttgctgtct

SEQ ID NO: 1035197 - DNA, 13 bp, Homo sapiens
ctcttgctgtctc

SEQ ID NO: 1035198 - DNA, 20 bp, Homo sapiens
ctcttggacaacagctctcg

SEQ ID NO: 1035199 - DNA, 20 bp, Homo sapiens
ctcttggacctctgctctga

SEQ ID NO: 1035200 - DNA, 19 bp, Homo sapiens
ctcttggagaagtctcagc

SEQ ID NO: 1035201 - DNA, 23 bp, Homo sapiens
ctcttggagcctctttttccttc

SEQ ID NO: 1035202 - DNA, 17 bp, Homo sapiens
ctcttggataccagctc

SEQ ID NO: 1035203 - DNA, 21 bp, Homo sapiens
ctcttggcaagatgtttctta

SEQ ID NO: 1035204 - DNA, 14 bp, Homo sapiens
ctcttggctccact

SEQ ID NO: 1035205 - DNA, 13 bp, Homo sapiens
ctcttggctgacc

SEQ ID NO: 1035206 - DNA, 17 bp, Homo sapiens
ctcttggctgacccctc

SEQ ID NO: 1035207 - DNA, 18 bp, Homo sapiens
ctcttggctgacccctct

SEQ ID NO: 1035208 - DNA, 21 bp, Homo sapiens
ctcttggctgacccctctggt

SEQ ID NO: 1035209 - DNA, 14 bp, Homo sapiens
ctcttggcttccag

SEQ ID NO: 1035210 - DNA, 18 bp, Homo sapiens
ctcttggcttccagaagg

SEQ ID NO: 1035211 - DNA, 17 bp, Homo sapiens
ctcttggcttctcagcc

SEQ ID NO: 1035212 - DNA, 23 bp, Homo sapiens
ctcttgggaactccactctcctt

SEQ ID NO: 1035213 - DNA, 19 bp, Homo sapiens
ctcttgggaagtgtgttta

SEQ ID NO: 1035214 - DNA, 13 bp, Homo sapiens
ctcttgggcaggc

SEQ ID NO: 1035215 - DNA, 15 bp, Homo sapiens
ctcttgggctgagac

SEQ ID NO: 1035216 - DNA, 17 bp, Homo sapiens
ctcttggtcagcttttg

SEQ ID NO: 1035217 - DNA, 13 bp, Homo sapiens
ctcttggtccctg

SEQ ID NO: 1035218 - DNA, 16 bp, Homo sapiens
ctcttggtccctggtc

SEQ ID NO: 1035219 - DNA, 13 bp, Homo sapiens
ctcttggtgtctg

SEQ ID NO: 1035220 - DNA, 15 bp, Homo sapiens
ctcttgtaaagactg

SEQ ID NO: 1035221 - DNA, 16 bp, Homo sapiens
ctcttgtaaagactgg

SEQ ID NO: 1035222 - DNA, 19 bp, Homo sapiens
ctcttgtaaataaagccct

SEQ ID NO: 1035223 - DNA, 24 bp, Homo sapiens
ctcttgtaaataaagccctgggat

SEQ ID NO: 1035224 - DNA, 15 bp, Homo sapiens
ctcttgtattaaact

SEQ ID NO: 1035225 - DNA, 13 bp, Homo sapiens
ctcttgtcccttg

SEQ ID NO: 1035226 - DNA, 15 bp, Homo sapiens
ctcttgtcctggccc

SEQ ID NO: 1035227 - DNA, 16 bp, Homo sapiens
ctcttgtcctggccct

SEQ ID NO: 1035228 - DNA, 21 bp, Homo sapiens
ctcttgtcctggcccttcagt

SEQ ID NO: 1035229 - DNA, 14 bp, Homo sapiens
ctcttgtctcccct

SEQ ID NO: 1035230 - DNA, 20 bp, Homo sapiens
ctcttgtctcccctgttccc

SEQ ID NO: 1035231 - DNA, 20 bp, Homo sapiens
ctcttgtgactcagcagagg

SEQ ID NO: 1035232 - DNA, 12 bp, Homo sapiens
ctcttgtgattt

SEQ ID NO: 1035233 - DNA, 19 bp, Homo sapiens
ctcttgtgcaaggtggcct

SEQ ID NO: 1035234 - DNA, 12 bp, Homo sapiens
ctcttgtgcatt

SEQ ID NO: 1035235 - DNA, 23 bp, Homo sapiens
ctcttgtggtgcattgaaagaag

SEQ ID NO: 1035236 - DNA, 20 bp, Homo sapiens
ctcttgttgcactaaaaagt

SEQ ID NO: 1035237 - DNA, 17 bp, Homo sapiens
ctcttgttgtccaggct

SEQ ID NO: 1035238 - DNA, 18 bp, Homo sapiens
ctcttgtttcactccacc

SEQ ID NO: 1035239 - DNA, 13 bp, Homo sapiens
ctcttgtttgtct

SEQ ID NO: 1035240 - DNA, 21 bp, Homo sapiens
ctcttgtttttattaatttat

SEQ ID NO: 1035241 - DNA, 23 bp, Homo sapiens
ctctttaaaaggaaagaaaacat

SEQ ID NO: 1035242 - DNA, 13 bp, Homo sapiens
ctctttaaaggca

SEQ ID NO: 1035243 - DNA, 17 bp, Homo sapiens
ctctttaagttttgatt

SEQ ID NO: 1035244 - DNA, 20 bp, Homo sapiens
ctctttaatgctgtctttgt

SEQ ID NO: 1035245 - DNA, 14 bp, Homo sapiens
ctctttacatggtg

SEQ ID NO: 1035246 - DNA, 15 bp, Homo sapiens
ctctttaccttctaa

SEQ ID NO: 1035247 - DNA, 20 bp, Homo sapiens
ctctttactcccttcctggc

SEQ ID NO: 1035248 - DNA, 23 bp, Homo sapiens
ctctttactcccttcctggcctc

SEQ ID NO: 1035249 - DNA, 16 bp, Homo sapiens
ctctttagtataattg

SEQ ID NO: 1035250 - DNA, 20 bp, Homo sapiens
ctctttatgcttgcttgggg

SEQ ID NO: 1035251 - DNA, 21 bp, Homo sapiens
ctctttatttttctctttctc

SEQ ID NO: 1035252 - DNA, 22 bp, Homo sapiens
ctctttcaaagaaatccaaatt

SEQ ID NO: 1035253 - DNA, 18 bp, Homo sapiens
ctctttcaataaatgtat

SEQ ID NO: 1035254 - DNA, 20 bp, Homo sapiens
ctctttcaataaatgtatca

SEQ ID NO: 1035255 - DNA, 15 bp, Homo sapiens
ctctttcacattgtt

SEQ ID NO: 1035256 - DNA, 12 bp, Homo sapiens
ctctttcagaga

SEQ ID NO: 1035257 - DNA, 17 bp, Homo sapiens
ctctttcagagaggtct

SEQ ID NO: 1035258 - DNA, 12 bp, Homo sapiens
ctctttcatcca

SEQ ID NO: 1035259 - DNA, 22 bp, Homo sapiens
ctctttcccaccctccacctct

SEQ ID NO: 1035260 - DNA, 12 bp, Homo sapiens
ctctttccctgc

SEQ ID NO: 1035261 - DNA, 22 bp, Homo sapiens
ctctttcctgttgttgttaatg

SEQ ID NO: 1035262 - DNA, 15 bp, Homo sapiens
ctctttccttgagct

SEQ ID NO: 1035263 - DNA, 20 bp, Homo sapiens
ctctttctacatgactgggc

SEQ ID NO: 1035264 - DNA, 23 bp, Homo sapiens
ctctttctacatgactgggcctc

SEQ ID NO: 1035265 - DNA, 12 bp, Homo sapiens
ctctttctccct

SEQ ID NO: 1035266 - DNA, 15 bp, Homo sapiens
ctctttctccctcac

SEQ ID NO: 1035267 - DNA, 14 bp, Homo sapiens
ctctttctctcttc

SEQ ID NO: 1035268 - DNA, 13 bp, Homo sapiens
ctctttctctgcc

SEQ ID NO: 1035269 - DNA, 17 bp, Homo sapiens
ctctttctctgccagtg

SEQ ID NO: 1035270 - DNA, 18 bp, Homo sapiens
ctctttctctttcttcct

SEQ ID NO: 1035271 - DNA, 14 bp, Homo sapiens
ctctttctgtatat

SEQ ID NO: 1035272 - DNA, 21 bp, Homo sapiens
ctctttcttataatactctgt

SEQ ID NO: 1035273 - DNA, 12 bp, Homo sapiens
ctctttcttcct

SEQ ID NO: 1035274 - DNA, 13 bp, Homo sapiens
ctctttcttcctt

SEQ ID NO: 1035275 - DNA, 14 bp, Homo sapiens
ctctttcttccttt

SEQ ID NO: 1035276 - DNA, 23 bp, Homo sapiens
ctctttgaagaaaagaaaaaaca

SEQ ID NO: 1035277 - DNA, 21 bp, Homo sapiens
ggccccctccccccagactct

SEQ ID NO: 1035278 - DNA, 12 bp, Homo sapiens
ggccccctgtcc

SEQ ID NO: 1035279 - DNA, 14 bp, Homo sapiens
ggccccctgtcccc

SEQ ID NO: 1035280 - DNA, 14 bp, Homo sapiens
ggccccgagctcag

SEQ ID NO: 1035281 - DNA, 16 bp, Homo sapiens
ggccccgccagggctg

SEQ ID NO: 1035282 - DNA, 20 bp, Homo sapiens
ggccccgccagggctgggga

SEQ ID NO: 1035283 - DNA, 14 bp, Homo sapiens
ggccccggccccag

SEQ ID NO: 1035284 - DNA, 21 bp, Homo sapiens
ggccccggccccagccagagt

SEQ ID NO: 1035285 - DNA, 18 bp, Homo sapiens
ggccccgggctctggcca

SEQ ID NO: 1035286 - DNA, 22 bp, Homo sapiens
ggccccgggctctggccaccct

SEQ ID NO: 1035287 - DNA, 22 bp, Homo sapiens
ggcccctatgtagtccgtgctg

SEQ ID NO: 1035288 - DNA, 16 bp, Homo sapiens
ggcccctcacccacca

SEQ ID NO: 1035289 - DNA, 15 bp, Homo sapiens
ggcccctcaccctct

SEQ ID NO: 1035290 - DNA, 17 bp, Homo sapiens
ggcccctcaccctctgt

SEQ ID NO: 1035291 - DNA, 19 bp, Homo sapiens
ggcccctcaccctgcctta

SEQ ID NO: 1035292 - DNA, 14 bp, Homo sapiens
ggcccctcagagcc

SEQ ID NO: 1035293 - DNA, 14 bp, Homo sapiens
ggcccctccagacc

SEQ ID NO: 1035294 - DNA, 20 bp, Homo sapiens
ggcccctccagaccctgcct

SEQ ID NO: 1035295 - DNA, 13 bp, Homo sapiens
ggcccctccatcc

SEQ ID NO: 1035296 - DNA, 22 bp, Homo sapiens
ggcccctcccacacacacccac

SEQ ID NO: 1035297 - DNA, 14 bp, Homo sapiens
ggcccctccctctg

SEQ ID NO: 1035298 - DNA, 23 bp, Homo sapiens
ggcccctccttgcaaccaggcag

SEQ ID NO: 1035299 - DNA, 17 bp, Homo sapiens
ggcccctgcgtgggggc

SEQ ID NO: 1035300 - DNA, 19 bp, Homo sapiens
ggcccctggcagcacagcc

SEQ ID NO: 1035301 - DNA, 23 bp, Homo sapiens
ggcccctggcagcacagcccagg

SEQ ID NO: 1035302 - DNA, 13 bp, Homo sapiens
ggcccctggccca

SEQ ID NO: 1035303 - DNA, 17 bp, Homo sapiens
ggcccctggcccagcgg

SEQ ID NO: 1035304 - DNA, 20 bp, Homo sapiens
ggcccctggcccagcggccc

SEQ ID NO: 1035305 - DNA, 23 bp, Homo sapiens
ggcccctgggcttggcctgctgt

SEQ ID NO: 1035306 - DNA, 12 bp, Homo sapiens
ggcccctgggga

SEQ ID NO: 1035307 - DNA, 15 bp, Homo sapiens
ggcccctggggacag

SEQ ID NO: 1035308 - DNA, 22 bp, Homo sapiens
ggccccttcacttctgaccaca

SEQ ID NO: 1035309 - DNA, 22 bp, Homo sapiens
ggccccttcccagccagcccgc

SEQ ID NO: 1035310 - DNA, 15 bp, Homo sapiens
ggcccgacagcctgg

SEQ ID NO: 1035311 - DNA, 19 bp, Homo sapiens
ggcccgacaggtgggcctg

SEQ ID NO: 1035312 - DNA, 14 bp, Homo sapiens
ggcccgcccctcgc

SEQ ID NO: 1035313 - DNA, 13 bp, Homo sapiens
ggcccgcggcctg

SEQ ID NO: 1035314 - DNA, 15 bp, Homo sapiens
ggcccgcggcctgca

SEQ ID NO: 1035315 - DNA, 13 bp, Homo sapiens
ggcccgcgggcac

SEQ ID NO: 1035316 - DNA, 16 bp, Homo sapiens
ggcccgcgggcacagc

SEQ ID NO: 1035317 - DNA, 14 bp, Homo sapiens
ggcccgctgcctct

SEQ ID NO: 1035318 - DNA, 17 bp, Homo sapiens
ggcccgctgcctcttgg

SEQ ID NO: 1035319 - DNA, 21 bp, Homo sapiens
ggcccggccacacccagcggc

SEQ ID NO: 1035320 - DNA, 15 bp, Homo sapiens
ggcccggcccctcac

SEQ ID NO: 1035321 - DNA, 17 bp, Homo sapiens
ggcccggcccctcaccc

SEQ ID NO: 1035322 - DNA, 18 bp, Homo sapiens
ggcccggcccctcaccct

SEQ ID NO: 1035323 - DNA, 19 bp, Homo sapiens
ggcccggcccctcaccctc

SEQ ID NO: 1035324 - DNA, 14 bp, Homo sapiens
ggcccgggcccccg

SEQ ID NO: 1035325 - DNA, 16 bp, Homo sapiens
ggcccgggcccccgcc

SEQ ID NO: 1035326 - DNA, 19 bp, Homo sapiens
ggcccggggctggcggcta

SEQ ID NO: 1035327 - DNA, 22 bp, Homo sapiens
ggcccggggctggcggctactc

SEQ ID NO: 1035328 - DNA, 16 bp, Homo sapiens
ggcccgtcggagctgc

SEQ ID NO: 1035329 - DNA, 18 bp, Homo sapiens
ggcccgtggcctggcatc

SEQ ID NO: 1035330 - DNA, 21 bp, Homo sapiens
ggcccgtggcttggcatctgt

SEQ ID NO: 1035331 - DNA, 22 bp, Homo sapiens
ggcccgttgaggatgaggccgc

SEQ ID NO: 1035332 - DNA, 22 bp, Homo sapiens
ggccctaccagcgcccgctggg

SEQ ID NO: 1035333 - DNA, 13 bp, Homo sapiens
ggccctagcattg

SEQ ID NO: 1035334 - DNA, 16 bp, Homo sapiens
ggccctcactaagccc

SEQ ID NO: 1035335 - DNA, 12 bp, Homo sapiens
ggccctcaggcc

SEQ ID NO: 1035336 - DNA, 14 bp, Homo sapiens
ggccctcaggccat

SEQ ID NO: 1035337 - DNA, 19 bp, Homo sapiens
ggccctcaggccattcccc

SEQ ID NO: 1035338 - DNA, 21 bp, Homo sapiens
ggccctcagtagtccctgcac

SEQ ID NO: 1035339 - DNA, 22 bp, Homo sapiens
ggccctcatctatgaggaaagg

SEQ ID NO: 1035340 - DNA, 14 bp, Homo sapiens
ggccctccatgggc

SEQ ID NO: 1035341 - DNA, 11 bp, Homo sapiens
ggccctcccac

SEQ ID NO: 1035342 - DNA, 15 bp, Homo sapiens
ggccctcccaccacc

SEQ ID NO: 1035343 - DNA, 16 bp, Homo sapiens
ggccctcccaccaccc

SEQ ID NO: 1035344 - DNA, 17 bp, Homo sapiens
ggccctcccaccacccc

SEQ ID NO: 1035345 - DNA, 14 bp, Homo sapiens
ggccctcccagccc

SEQ ID NO: 1035346 - DNA, 21 bp, Homo sapiens
ggccctcccagcccattgctg

SEQ ID NO: 1035347 - DNA, 23 bp, Homo sapiens
ggccctcccccagctccttggct

SEQ ID NO: 1035348 - DNA, 11 bp, Homo sapiens
ggccctccctc

SEQ ID NO: 1035349 - DNA, 12 bp, Homo sapiens
ggccctccctca

SEQ ID NO: 1035350 - DNA, 15 bp, Homo sapiens
ggccctccctcccag

SEQ ID NO: 1035351 - DNA, 21 bp, Homo sapiens
ggccctccctccctagccctt

SEQ ID NO: 1035352 - DNA, 11 bp, Homo sapiens
ggccctccctg

SEQ ID NO: 1035353 - DNA, 13 bp, Homo sapiens
ggccctccctgac

SEQ ID NO: 1035354 - DNA, 21 bp, Homo sapiens
ggccctccctgactccctgtg

SEQ ID NO: 1035355 - DNA, 23 bp, Homo sapiens
ggccctccctgtctccagggccc

SEQ ID NO: 1035356 - DNA, 22 bp, Homo sapiens
ggccctccgaccacttccaggg

SEQ ID NO: 1035357 - DNA, 17 bp, Homo sapiens
ggccctcctaccctgcg

SEQ ID NO: 1035358 - DNA, 21 bp, Homo sapiens
ggccctcctaccctgcgccca

SEQ ID NO: 1035359 - DNA, 19 bp, Homo sapiens
ggccctccttccctcctgt

SEQ ID NO: 1035360 - DNA, 22 bp, Homo sapiens
ggccctccttccctcctgtgcc

SEQ ID NO: 1035361 - DNA, 23 bp, Homo sapiens
ggccctcgacactcaccatgaag

SEQ ID NO: 1035362 - DNA, 21 bp, Homo sapiens
ggccctcgctgccagctctgt

SEQ ID NO: 1035363 - DNA, 16 bp, Homo sapiens
ggccctcggagctggc

SEQ ID NO: 1035364 - DNA, 18 bp, Homo sapiens
ggccctcggagctggctg

SEQ ID NO: 1035365 - DNA, 21 bp, Homo sapiens
ggccctcggagctggctgtgc

SEQ ID NO: 1035366 - DNA, 19 bp, Homo sapiens
ggccctcggtcagcgactg

SEQ ID NO: 1035367 - DNA, 20 bp, Homo sapiens
ggccctcggtggctgcacag

SEQ ID NO: 1035368 - DNA, 19 bp, Homo sapiens
ggccctctatgctggcttt

SEQ ID NO: 1035369 - DNA, 21 bp, Homo sapiens
ggccctctctgctctgcgtgt

SEQ ID NO: 1035370 - DNA, 12 bp, Homo sapiens
ggccctctcttc

SEQ ID NO: 1035371 - DNA, 11 bp, Homo sapiens
ggccctctgcc

SEQ ID NO: 1035372 - DNA, 15 bp, Homo sapiens
ggccctctgcctgca

SEQ ID NO: 1035373 - DNA, 17 bp, Homo sapiens
ggccctctgcctgcact

SEQ ID NO: 1035374 - DNA, 19 bp, Homo sapiens
ggccctcttgccagcctcc

SEQ ID NO: 1035375 - DNA, 21 bp, Homo sapiens
ggccctcttgccagcctcctt

SEQ ID NO: 1035376 - DNA, 18 bp, Homo sapiens
ggccctcttgcgggcctg

SEQ ID NO: 1035377 - DNA, 20 bp, Homo sapiens
ggccctctttccctgcgaga

SEQ ID NO: 1035378 - DNA, 15 bp, Homo sapiens
ggccctgaaccacga

SEQ ID NO: 1035379 - DNA, 16 bp, Homo sapiens
ggccctgactcctctg

SEQ ID NO: 1035380 - DNA, 20 bp, Homo sapiens
ggccctgactgtcagggagg

SEQ ID NO: 1035381 - DNA, 14 bp, Homo sapiens
ggccctgagctcgg

SEQ ID NO: 1035382 - DNA, 11 bp, Homo sapiens
ggccctgaggc

SEQ ID NO: 1035383 - DNA, 14 bp, Homo sapiens
ggccctgaggcgga

SEQ ID NO: 1035384 - DNA, 23 bp, Homo sapiens
ggccctgaggcggaggctgtgct

SEQ ID NO: 1035385 - DNA, 17 bp, Homo sapiens
ggccctgaggtgtgggg

SEQ ID NO: 1035386 - DNA, 21 bp, Homo sapiens
ggccctgaggtgtgggggctg

SEQ ID NO: 1035387 - DNA, 17 bp, Homo sapiens
ggccctgcagccagctc

SEQ ID NO: 1035388 - DNA, 15 bp, Homo sapiens
ggccctgcaggagca

SEQ ID NO: 1035389 - DNA, 18 bp, Homo sapiens
ggccctgcaggagcaggg

SEQ ID NO: 1035390 - DNA, 20 bp, Homo sapiens
ggccctgcaggagcagggcg

SEQ ID NO: 1035391 - DNA, 16 bp, Homo sapiens
ggccctgccacgtccc

SEQ ID NO: 1035392 - DNA, 19 bp, Homo sapiens
ggccctgccacgtcccgct

SEQ ID NO: 1035393 - DNA, 19 bp, Homo sapiens
ggccctgccattggcctct

SEQ ID NO: 1035394 - DNA, 11 bp, Homo sapiens
ggccctgccca

SEQ ID NO: 1035395 - DNA, 20 bp, Homo sapiens
ggccctgccccaccccatcc

SEQ ID NO: 1035396 - DNA, 17 bp, Homo sapiens
ggccctgccccagcccc

SEQ ID NO: 1035397 - DNA, 18 bp, Homo sapiens
ggccctgccccagcccct

SEQ ID NO: 1035398 - DNA, 19 bp, Homo sapiens
ggccctgccccaggcctgg

SEQ ID NO: 1035399 - DNA, 22 bp, Homo sapiens
ggccctgcccggggagctgcag

SEQ ID NO: 1035400 - DNA, 17 bp, Homo sapiens
ggccctgccctggcagg

SEQ ID NO: 1035401 - DNA, 15 bp, Homo sapiens
ctctttgagatagaa

SEQ ID NO: 1035402 - DNA, 14 bp, Homo sapiens
ctctttgattattt

SEQ ID NO: 1035403 - DNA, 17 bp, Homo sapiens
ctctttgattatttgca

SEQ ID NO: 1035404 - DNA, 18 bp, Homo sapiens
ctctttgattatttgcat

SEQ ID NO: 1035405 - DNA, 19 bp, Homo sapiens
ctctttgattatttgcatg

SEQ ID NO: 1035406 - DNA, 21 bp, Homo sapiens
ctctttgattatttgcatgtt

SEQ ID NO: 1035407 - DNA, 12 bp, Homo sapiens
ctctttgctgca

SEQ ID NO: 1035408 - DNA, 15 bp, Homo sapiens
ctctttgctggagtc

SEQ ID NO: 1035409 - DNA, 12 bp, Homo sapiens
ctctttgctttc

SEQ ID NO: 1035410 - DNA, 13 bp, Homo sapiens
ctctttggaaata

SEQ ID NO: 1035411 - DNA, 21 bp, Homo sapiens
ctctttggcgacctcctttca

SEQ ID NO: 1035412 - DNA, 20 bp, Homo sapiens
ctctttggggtcagccaggg

SEQ ID NO: 1035413 - DNA, 12 bp, Homo sapiens
ctctttgtaaga

SEQ ID NO: 1035414 - DNA, 21 bp, Homo sapiens
ctctttgtggggaagaggggc

SEQ ID NO: 1035415 - DNA, 15 bp, Homo sapiens
ctctttgtttctgtt

SEQ ID NO: 1035416 - DNA, 22 bp, Homo sapiens
ctctttgtttctgtttcttgct

SEQ ID NO: 1035417 - DNA, 16 bp, Homo sapiens
ctcttttaaaatatcc

SEQ ID NO: 1035418 - DNA, 15 bp, Homo sapiens
ctcttttaaagtatt

SEQ ID NO: 1035419 - DNA, 15 bp, Homo sapiens
ctcttttatatttgt

SEQ ID NO: 1035420 - DNA, 22 bp, Homo sapiens
ctcttttatatttgtaggagaa

SEQ ID NO: 1035421 - DNA, 23 bp, Homo sapiens
ctcttttatatttgtaggagaaa

SEQ ID NO: 1035422 - DNA, 16 bp, Homo sapiens
ctcttttcctctctgt

SEQ ID NO: 1035423 - DNA, 22 bp, Homo sapiens
ctcttttcctttggtccttcaa

SEQ ID NO: 1035424 - DNA, 19 bp, Homo sapiens
ctcttttctaagtggcgtg

SEQ ID NO: 1035425 - DNA, 13 bp, Homo sapiens
ctcttttctcttt

SEQ ID NO: 1035426 - DNA, 14 bp, Homo sapiens
ctcttttctgcatc

SEQ ID NO: 1035427 - DNA, 16 bp, Homo sapiens
ctcttttcttactcct

SEQ ID NO: 1035428 - DNA, 18 bp, Homo sapiens
ctcttttcttactcctcc

SEQ ID NO: 1035429 - DNA, 21 bp, Homo sapiens
ctcttttcttactcctcctct

SEQ ID NO: 1035430 - DNA, 22 bp, Homo sapiens
ctcttttcttactcctcctctt

SEQ ID NO: 1035431 - DNA, 20 bp, Homo sapiens
ctcttttgaaagtagagcta

SEQ ID NO: 1035432 - DNA, 20 bp, Homo sapiens
ctcttttgaatccatgcttg

SEQ ID NO: 1035433 - DNA, 21 bp, Homo sapiens
ctcttttgagactttgcccag

SEQ ID NO: 1035434 - DNA, 14 bp, Homo sapiens
ctcttttggccttg

SEQ ID NO: 1035435 - DNA, 13 bp, Homo sapiens
ctcttttgtgatg

SEQ ID NO: 1035436 - DNA, 17 bp, Homo sapiens
ctcttttgtgatgaaca

SEQ ID NO: 1035437 - DNA, 19 bp, Homo sapiens
ctcttttgttaaataatat

SEQ ID NO: 1035438 - DNA, 18 bp, Homo sapiens
ctctttttagggccaggc

SEQ ID NO: 1035439 - DNA, 20 bp, Homo sapiens
ctctttttagggccaggcag

SEQ ID NO: 1035440 - DNA, 19 bp, Homo sapiens
ctctttttatttaaatgtg

SEQ ID NO: 1035441 - DNA, 13 bp, Homo sapiens
ctctttttcctcc

SEQ ID NO: 1035442 - DNA, 18 bp, Homo sapiens
ctctttttccttcttcag

SEQ ID NO: 1035443 - DNA, 16 bp, Homo sapiens
ctctttttgtattttg

SEQ ID NO: 1035444 - DNA, 19 bp, Homo sapiens
ctcttttttgtttgtttct

SEQ ID NO: 1035445 - DNA, 16 bp, Homo sapiens
ctctttttttaaaagg

SEQ ID NO: 1035446 - DNA, 22 bp, Homo sapiens
ctctttttttaagtgcttacat

SEQ ID NO: 1035447 - DNA, 22 bp, Homo sapiens
ctctttttttgagtgacagctt

SEQ ID NO: 1035448 - DNA, 20 bp, Homo sapiens
ctgaaaaaaagtttacaagt

SEQ ID NO: 1035449 - DNA, 14 bp, Homo sapiens
ctgaaaaaatacta

SEQ ID NO: 1035450 - DNA, 19 bp, Homo sapiens
ctgaaaaagtagattgagt

SEQ ID NO: 1035451 - DNA, 13 bp, Homo sapiens
ctgaaaaatgtca

SEQ ID NO: 1035452 - DNA, 14 bp, Homo sapiens
ctgaaaacatctgg

SEQ ID NO: 1035453 - DNA, 20 bp, Homo sapiens
ctgaaaacatttcaaagctg

SEQ ID NO: 1035454 - DNA, 14 bp, Homo sapiens
ctgaaaacccagag

SEQ ID NO: 1035455 - DNA, 19 bp, Homo sapiens
ctgaaaacctaagtccttt

SEQ ID NO: 1035456 - DNA, 14 bp, Homo sapiens
ctgaaaacctacca

SEQ ID NO: 1035457 - DNA, 15 bp, Homo sapiens
ctgaaaacctctcct

SEQ ID NO: 1035458 - DNA, 11 bp, Homo sapiens
ctgaaaactaa

SEQ ID NO: 1035459 - DNA, 20 bp, Homo sapiens
ctgaaaactaatgtactgta

SEQ ID NO: 1035460 - DNA, 16 bp, Homo sapiens
ctgaaaagaaggaaag

SEQ ID NO: 1035461 - DNA, 18 bp, Homo sapiens
ctgaaaaggatcgaggca

SEQ ID NO: 1035462 - DNA, 10 bp, Homo sapiens
ctgaaaaggg

SEQ ID NO: 1035463 - DNA, 23 bp, Homo sapiens
ctgaaaagggcactcccaaccct

SEQ ID NO: 1035464 - DNA, 21 bp, Homo sapiens
ctgaaaatacaaaaattagct

SEQ ID NO: 1035465 - DNA, 13 bp, Homo sapiens
ctgaaaatataac

SEQ ID NO: 1035466 - DNA, 22 bp, Homo sapiens
ctgaaaatataaccagccattg

SEQ ID NO: 1035467 - DNA, 15 bp, Homo sapiens
ctgaaaatatgtctg

SEQ ID NO: 1035468 - DNA, 22 bp, Homo sapiens
ctgaaaatatgtctgcaggttt

SEQ ID NO: 1035469 - DNA, 16 bp, Homo sapiens
ctgaaaatcaaagtaa

SEQ ID NO: 1035470 - DNA, 18 bp, Homo sapiens
ctgaaaatcaaagtaaaa

SEQ ID NO: 1035471 - DNA, 12 bp, Homo sapiens
ctgaaaatgtgc

SEQ ID NO: 1035472 - DNA, 14 bp, Homo sapiens
ctgaaaatgtttaa

SEQ ID NO: 1035473 - DNA, 22 bp, Homo sapiens
ctgaaaattccagaaaggatat

SEQ ID NO: 1035474 - DNA, 16 bp, Homo sapiens
ctgaaaatttaacagt

SEQ ID NO: 1035475 - DNA, 14 bp, Homo sapiens
ctgaaacacacgag

SEQ ID NO: 1035476 - DNA, 23 bp, Homo sapiens
ctgaaacacacgagcaaacccag

SEQ ID NO: 1035477 - DNA, 20 bp, Homo sapiens
ctgaaacacgaaacttgtta

SEQ ID NO: 1035478 - DNA, 14 bp, Homo sapiens
ctgaaacactggac

SEQ ID NO: 1035479 - DNA, 15 bp, Homo sapiens
ctgaaacactggacc

SEQ ID NO: 1035480 - DNA, 16 bp, Homo sapiens
ctgaaacactggacct

SEQ ID NO: 1035481 - DNA, 13 bp, Homo sapiens
ctgaaacagattt

SEQ ID NO: 1035482 - DNA, 14 bp, Homo sapiens
ctgaaaccagtgtt

SEQ ID NO: 1035483 - DNA, 12 bp, Homo sapiens
ctgaaaccattt

SEQ ID NO: 1035484 - DNA, 13 bp, Homo sapiens
ctgaaaccatttt

SEQ ID NO: 1035485 - DNA, 15 bp, Homo sapiens
ctgaaaccattttcc

SEQ ID NO: 1035486 - DNA, 20 bp, Homo sapiens
ctgaaacccgccctcagggg

SEQ ID NO: 1035487 - DNA, 19 bp, Homo sapiens
ctgaaacgctcctttgtgt

SEQ ID NO: 1035488 - DNA, 19 bp, Homo sapiens
ctgaaactcatagacactg

SEQ ID NO: 1035489 - DNA, 17 bp, Homo sapiens
ctgaaacttacacacaa

SEQ ID NO: 1035490 - DNA, 15 bp, Homo sapiens
ctgaaacttttctaa

SEQ ID NO: 1035491 - DNA, 20 bp, Homo sapiens
ctgaaagaaacagttaactt

SEQ ID NO: 1035492 - DNA, 21 bp, Homo sapiens
ctgaaagaaacagttaacttt

SEQ ID NO: 1035493 - DNA, 17 bp, Homo sapiens
ctgaaagacagaatgtc

SEQ ID NO: 1035494 - DNA, 14 bp, Homo sapiens
ctgaaagagaaaca

SEQ ID NO: 1035495 - DNA, 22 bp, Homo sapiens
ctgaaagaggaggacccctgcc

SEQ ID NO: 1035496 - DNA, 17 bp, Homo sapiens
ctgaaagatacagggga

SEQ ID NO: 1035497 - DNA, 16 bp, Homo sapiens
ctgaaagcagcagcta

SEQ ID NO: 1035498 - DNA, 17 bp, Homo sapiens
ctgaaagcagcagctag

SEQ ID NO: 1035499 - DNA, 17 bp, Homo sapiens
ctgaaagccaaggcagc

SEQ ID NO: 1035500 - DNA, 14 bp, Homo sapiens
ctgaaagccagctg

SEQ ID NO: 1035501 - DNA, 23 bp, Homo sapiens
ctgaaagccctgagctttctgct

SEQ ID NO: 1035502 - DNA, 14 bp, Homo sapiens
ctgaaagcctcacg

SEQ ID NO: 1035503 - DNA, 13 bp, Homo sapiens
ctgaaagcctgtc

SEQ ID NO: 1035504 - DNA, 22 bp, Homo sapiens
ctgaaagcctgtctctttccac

SEQ ID NO: 1035505 - DNA, 12 bp, Homo sapiens
ctgaaaggaaat

SEQ ID NO: 1035506 - DNA, 17 bp, Homo sapiens
ctgaaaggaacactggc

SEQ ID NO: 1035507 - DNA, 14 bp, Homo sapiens
ctgaaaggagacat

SEQ ID NO: 1035508 - DNA, 24 bp, Homo sapiens
ctgaaaggagacattgctctatgt

SEQ ID NO: 1035509 - DNA, 19 bp, Homo sapiens
ctgaaagtgaaagtccaga

SEQ ID NO: 1035510 - DNA, 22 bp, Homo sapiens
ctgaaagtgttttactcttttt

SEQ ID NO: 1035511 - DNA, 13 bp, Homo sapiens
ctgaaagttttgt

SEQ ID NO: 1035512 - DNA, 18 bp, Homo sapiens
ctgaaagttttgtaaaag

SEQ ID NO: 1035513 - DNA, 20 bp, Homo sapiens
ctgaaagttttgtaaaagaa

SEQ ID NO: 1035514 - DNA, 22 bp, Homo sapiens
ctgaaagttttgtaaaagaaat

SEQ ID NO: 1035515 - DNA, 17 bp, Homo sapiens
ctgaaataaaatgccat

SEQ ID NO: 1035516 - DNA, 18 bp, Homo sapiens
ctgaaataaacctgcact

SEQ ID NO: 1035517 - DNA, 20 bp, Homo sapiens
ctgaaataaacctgcactga

SEQ ID NO: 1035518 - DNA, 23 bp, Homo sapiens
ctgaaataaacctgcactgaaac

SEQ ID NO: 1035519 - DNA, 16 bp, Homo sapiens
ctgaaataatatattt

SEQ ID NO: 1035520 - DNA, 19 bp, Homo sapiens
ctgaaataatatatttctt

SEQ ID NO: 1035521 - DNA, 20 bp, Homo sapiens
ctgaaataatatatttcttc

SEQ ID NO: 1035522 - DNA, 21 bp, Homo sapiens
ctgaaatataaactgtagcga

SEQ ID NO: 1035523 - DNA, 22 bp, Homo sapiens
ctgaaatatccacccagcaggc

SEQ ID NO: 1035524 - DNA, 16 bp, Homo sapiens
ctgaaatctgaagacc

SEQ ID NO: 1035525 - DNA, 19 bp, Homo sapiens
ctgaaatgaaacaaataat

SEQ ID NO: 1035526 - DNA, 18 bp, Homo sapiens
ggccctgccgggaccctg

SEQ ID NO: 1035527 - DNA, 10 bp, Homo sapiens
ggccctgcct

SEQ ID NO: 1035528 - DNA, 16 bp, Homo sapiens
ggccctgcctgcctct

SEQ ID NO: 1035529 - DNA, 18 bp, Homo sapiens
ggccctgctcctgcagca

SEQ ID NO: 1035530 - DNA, 14 bp, Homo sapiens
ggccctgcttcctg

SEQ ID NO: 1035531 - DNA, 16 bp, Homo sapiens
ggccctgcttcctgct

SEQ ID NO: 1035532 - DNA, 17 bp, Homo sapiens
ggccctgctttttttct

SEQ ID NO: 1035533 - DNA, 19 bp, Homo sapiens
ggccctggagccagggcag

SEQ ID NO: 1035534 - DNA, 22 bp, Homo sapiens
ggccctggaggaattcagctca

SEQ ID NO: 1035535 - DNA, 12 bp, Homo sapiens
ggccctggccct

SEQ ID NO: 1035536 - DNA, 16 bp, Homo sapiens
ggccctggcctgctgg

SEQ ID NO: 1035537 - DNA, 17 bp, Homo sapiens
ggccctggcctgctggg

SEQ ID NO: 1035538 - DNA, 14 bp, Homo sapiens
ggccctgggcaggg

SEQ ID NO: 1035539 - DNA, 12 bp, Homo sapiens
ggccctgggctg

SEQ ID NO: 1035540 - DNA, 14 bp, Homo sapiens
ggccctgggctgga

SEQ ID NO: 1035541 - DNA, 21 bp, Homo sapiens
ggccctgggctgggtgctggg

SEQ ID NO: 1035542 - DNA, 21 bp, Homo sapiens
ggccctggggcgggcagccag

SEQ ID NO: 1035543 - DNA, 22 bp, Homo sapiens
ggccctggggcgggcagccagg

SEQ ID NO: 1035544 - DNA, 15 bp, Homo sapiens
ggccctggggtccca

SEQ ID NO: 1035545 - DNA, 15 bp, Homo sapiens
ggccctggtcctggc

SEQ ID NO: 1035546 - DNA, 15 bp, Homo sapiens
ggccctggtccttcc

SEQ ID NO: 1035547 - DNA, 17 bp, Homo sapiens
ggccctggtccttccag

SEQ ID NO: 1035548 - DNA, 19 bp, Homo sapiens
ggccctgtcccaggccggc

SEQ ID NO: 1035549 - DNA, 12 bp, Homo sapiens
ggccctgtcccc

SEQ ID NO: 1035550 - DNA, 15 bp, Homo sapiens
ggccctgtcccctgg

SEQ ID NO: 1035551 - DNA, 16 bp, Homo sapiens
ggccctgtgcagacct

SEQ ID NO: 1035552 - DNA, 15 bp, Homo sapiens
ggccctgtgcctggg

SEQ ID NO: 1035553 - DNA, 20 bp, Homo sapiens
ggccctgtgcctgggccctg

SEQ ID NO: 1035554 - DNA, 20 bp, Homo sapiens
ggccctgtggagtccagctc

SEQ ID NO: 1035555 - DNA, 16 bp, Homo sapiens
ggccctgttccctgga

SEQ ID NO: 1035556 - DNA, 16 bp, Homo sapiens
ggcccttagagacccc

SEQ ID NO: 1035557 - DNA, 19 bp, Homo sapiens
ggcccttcagtctgctcca

SEQ ID NO: 1035558 - DNA, 20 bp, Homo sapiens
ggcccttcagtctgctccac

SEQ ID NO: 1035559 - DNA, 22 bp, Homo sapiens
ggcccttcctctccactgcctt

SEQ ID NO: 1035560 - DNA, 14 bp, Homo sapiens
ggcccttccttcca

SEQ ID NO: 1035561 - DNA, 18 bp, Homo sapiens
ggcccttcttgctgccct

SEQ ID NO: 1035562 - DNA, 21 bp, Homo sapiens
ggcccttgcagttcagcacca

SEQ ID NO: 1035563 - DNA, 16 bp, Homo sapiens
ggcccttggaataaag

SEQ ID NO: 1035564 - DNA, 16 bp, Homo sapiens
ggcccttggctgcagg

SEQ ID NO: 1035565 - DNA, 17 bp, Homo sapiens
ggcccttgggacagcca

SEQ ID NO: 1035566 - DNA, 19 bp, Homo sapiens
ggcccttggggcctggctt

SEQ ID NO: 1035567 - DNA, 20 bp, Homo sapiens
ggcccttggggcctggcttg

SEQ ID NO: 1035568 - DNA, 16 bp, Homo sapiens
ggcccttgtcctgcca

SEQ ID NO: 1035569 - DNA, 20 bp, Homo sapiens
ggcccttgtcctgccagctg

SEQ ID NO: 1035570 - DNA, 18 bp, Homo sapiens
ggcccttgtcttttcaag

SEQ ID NO: 1035571 - DNA, 19 bp, Homo sapiens
ggccgaagccccttggaga

SEQ ID NO: 1035572 - DNA, 17 bp, Homo sapiens
ggccgaagctctggctg

SEQ ID NO: 1035573 - DNA, 19 bp, Homo sapiens
ggccgaatcccctccctgt

SEQ ID NO: 1035574 - DNA, 21 bp, Homo sapiens
ggccgaatcccctccctgtca

SEQ ID NO: 1035575 - DNA, 19 bp, Homo sapiens
ggccgacattgtctcccgc

SEQ ID NO: 1035576 - DNA, 17 bp, Homo sapiens
ggccgaccctgcggcct

SEQ ID NO: 1035577 - DNA, 18 bp, Homo sapiens
ggccgaccctgcggcctc

SEQ ID NO: 1035578 - DNA, 20 bp, Homo sapiens
ggccgaccctgcggcctcca

SEQ ID NO: 1035579 - DNA, 16 bp, Homo sapiens
ggccgagctcctgggg

SEQ ID NO: 1035580 - DNA, 13 bp, Homo sapiens
ggccgaggacttt

SEQ ID NO: 1035581 - DNA, 13 bp, Homo sapiens
ggccgaggcctgc

SEQ ID NO: 1035582 - DNA, 12 bp, Homo sapiens
ggccgaggcggg

SEQ ID NO: 1035583 - DNA, 16 bp, Homo sapiens
ggccgagggccaggca

SEQ ID NO: 1035584 - DNA, 18 bp, Homo sapiens
ggccgagggccaggcaga

SEQ ID NO: 1035585 - DNA, 13 bp, Homo sapiens
ggccgagtccaag

SEQ ID NO: 1035586 - DNA, 16 bp, Homo sapiens
ggccgcaagggcctgg

SEQ ID NO: 1035587 - DNA, 18 bp, Homo sapiens
ggccgcagctcttgccct

SEQ ID NO: 1035588 - DNA, 22 bp, Homo sapiens
ggccgcagctcttgcccttccc

SEQ ID NO: 1035589 - DNA, 23 bp, Homo sapiens
ggccgcagctcttgcccttccct

SEQ ID NO: 1035590 - DNA, 12 bp, Homo sapiens
ggccgcagggcc

SEQ ID NO: 1035591 - DNA, 14 bp, Homo sapiens
ggccgcagggcggg

SEQ ID NO: 1035592 - DNA, 18 bp, Homo sapiens
ggccgcagggcggggctg

SEQ ID NO: 1035593 - DNA, 20 bp, Homo sapiens
ggccgcataggcccagccag

SEQ ID NO: 1035594 - DNA, 13 bp, Homo sapiens
ggccgccaccccc

SEQ ID NO: 1035595 - DNA, 18 bp, Homo sapiens
ggccgccacccccatctt

SEQ ID NO: 1035596 - DNA, 19 bp, Homo sapiens
ggccgccagcgtgtggagc

SEQ ID NO: 1035597 - DNA, 16 bp, Homo sapiens
ggccgccatctgcgca

SEQ ID NO: 1035598 - DNA, 19 bp, Homo sapiens
ggccgccccccgcccctcg

SEQ ID NO: 1035599 - DNA, 12 bp, Homo sapiens
ggccgccccctg

SEQ ID NO: 1035600 - DNA, 15 bp, Homo sapiens
ggccgcccgctccct

SEQ ID NO: 1035601 - DNA, 16 bp, Homo sapiens
ggccgccgtgacctat

SEQ ID NO: 1035602 - DNA, 14 bp, Homo sapiens
ggccgcctgccctg

SEQ ID NO: 1035603 - DNA, 19 bp, Homo sapiens
ggccgccttctcccctctc

SEQ ID NO: 1035604 - DNA, 21 bp, Homo sapiens
ggccgcgccacccgggcaagg

SEQ ID NO: 1035605 - DNA, 18 bp, Homo sapiens
ggccgcgcgtccagctgc

SEQ ID NO: 1035606 - DNA, 13 bp, Homo sapiens
ggccgcggcccag

SEQ ID NO: 1035607 - DNA, 15 bp, Homo sapiens
ggccgcggcccagac

SEQ ID NO: 1035608 - DNA, 18 bp, Homo sapiens
ggccgcggcccagaccca

SEQ ID NO: 1035609 - DNA, 21 bp, Homo sapiens
ggccgctagaggcctgaggat

SEQ ID NO: 1035610 - DNA, 14 bp, Homo sapiens
ggccgctcctccct

SEQ ID NO: 1035611 - DNA, 18 bp, Homo sapiens
ggccgctcgatgcctttg

SEQ ID NO: 1035612 - DNA, 14 bp, Homo sapiens
ggccgctggctggt

SEQ ID NO: 1035613 - DNA, 19 bp, Homo sapiens
ggccgctgttcacccacag

SEQ ID NO: 1035614 - DNA, 21 bp, Homo sapiens
ggccgcttctagagcctcgac

SEQ ID NO: 1035615 - DNA, 16 bp, Homo sapiens
ggccggacctgagccc

SEQ ID NO: 1035616 - DNA, 16 bp, Homo sapiens
ggccggacgcatctca

SEQ ID NO: 1035617 - DNA, 14 bp, Homo sapiens
ggccggagagctgg

SEQ ID NO: 1035618 - DNA, 13 bp, Homo sapiens
ggccggagcccag

SEQ ID NO: 1035619 - DNA, 14 bp, Homo sapiens
ggccggagcccaga

SEQ ID NO: 1035620 - DNA, 15 bp, Homo sapiens
ggccggccagcccct

SEQ ID NO: 1035621 - DNA, 14 bp, Homo sapiens
ggccggcggctctg

SEQ ID NO: 1035622 - DNA, 18 bp, Homo sapiens
ggccggcggctctgagca

SEQ ID NO: 1035623 - DNA, 21 bp, Homo sapiens
ggccggcggctctgagcaggg

SEQ ID NO: 1035624 - DNA, 13 bp, Homo sapiens
ggccggctggcct

SEQ ID NO: 1035625 - DNA, 21 bp, Homo sapiens
ggccggctggcctggaggctc

SEQ ID NO: 1035626 - DNA, 19 bp, Homo sapiens
ggccggcttgccacacccc

SEQ ID NO: 1035627 - DNA, 18 bp, Homo sapiens
ggccgggaagagccacct

SEQ ID NO: 1035628 - DNA, 19 bp, Homo sapiens
ggccgggaagagccacctg

SEQ ID NO: 1035629 - DNA, 24 bp, Homo sapiens
ggccgggaagttttacagcaaggc

SEQ ID NO: 1035630 - DNA, 20 bp, Homo sapiens
ggccgggcaggtcctgccca

SEQ ID NO: 1035631 - DNA, 18 bp, Homo sapiens
ggccgggctgtagatcag

SEQ ID NO: 1035632 - DNA, 15 bp, Homo sapiens
ggccggggcccctca

SEQ ID NO: 1035633 - DNA, 13 bp, Homo sapiens
ggccggggctgag

SEQ ID NO: 1035634 - DNA, 19 bp, Homo sapiens
ggccggggggaggggacag

SEQ ID NO: 1035635 - DNA, 20 bp, Homo sapiens
ggccggggggaggggacaga

SEQ ID NO: 1035636 - DNA, 19 bp, Homo sapiens
ggccggggggggtaggaga

SEQ ID NO: 1035637 - DNA, 22 bp, Homo sapiens
ggccggggggggtaggagagga

SEQ ID NO: 1035638 - DNA, 17 bp, Homo sapiens
ggccggggtccaggccc

SEQ ID NO: 1035639 - DNA, 16 bp, Homo sapiens
ggccggtgaggggagg

SEQ ID NO: 1035640 - DNA, 23 bp, Homo sapiens
ggccggtttcgaagttgatgcaa

SEQ ID NO: 1035641 - DNA, 17 bp, Homo sapiens
ggccgtaccccaccctc

SEQ ID NO: 1035642 - DNA, 22 bp, Homo sapiens
ggccgtaccccaccctcagcac

SEQ ID NO: 1035643 - DNA, 15 bp, Homo sapiens
ggccgtatctgtcac

SEQ ID NO: 1035644 - DNA, 23 bp, Homo sapiens
ggccgtatctgtcacaataaatg

SEQ ID NO: 1035645 - DNA, 17 bp, Homo sapiens
ggccgtcccctctcccc

SEQ ID NO: 1035646 - DNA, 14 bp, Homo sapiens
ggccgtcctcccgg

SEQ ID NO: 1035647 - DNA, 15 bp, Homo sapiens
ggccgtcctcccggg

SEQ ID NO: 1035648 - DNA, 18 bp, Homo sapiens
ggccgtcctcccgggccc

SEQ ID NO: 1035649 - DNA, 22 bp, Homo sapiens
ggccgtcctcccgggccctccc

SEQ ID NO: 1035650 - DNA, 18 bp, Homo sapiens
ggccgtctcctccctcag

SEQ ID NO: 1035651 - DNA, 18 bp, Homo sapiens
ctgaaatgaccaagacag

SEQ ID NO: 1035652 - DNA, 16 bp, Homo sapiens
ctgaaatgccaagtgc

SEQ ID NO: 1035653 - DNA, 18 bp, Homo sapiens
ctgaaatgccaagtgcct

SEQ ID NO: 1035654 - DNA, 18 bp, Homo sapiens
ctgaaattaaagaaatga

SEQ ID NO: 1035655 - DNA, 21 bp, Homo sapiens
ctgaaattaatttgtgaattt

SEQ ID NO: 1035656 - DNA, 16 bp, Homo sapiens
ctgaaattctcctgga

SEQ ID NO: 1035657 - DNA, 17 bp, Homo sapiens
ctgaaattctcctggag

SEQ ID NO: 1035658 - DNA, 17 bp, Homo sapiens
ctgaaatttagtacact

SEQ ID NO: 1035659 - DNA, 22 bp, Homo sapiens
ctgaaattttatatgcttactg

SEQ ID NO: 1035660 - DNA, 18 bp, Homo sapiens
ctgaaatttttttcctaa

SEQ ID NO: 1035661 - DNA, 16 bp, Homo sapiens
ctgaacaaaagctcag

SEQ ID NO: 1035662 - DNA, 21 bp, Homo sapiens
ctgaacaaactaaaggtgcac

SEQ ID NO: 1035663 - DNA, 12 bp, Homo sapiens
ctgaacaagaat

SEQ ID NO: 1035664 - DNA, 14 bp, Homo sapiens
ctgaacaagaattg

SEQ ID NO: 1035665 - DNA, 14 bp, Homo sapiens
ctgaacacatgtgt

SEQ ID NO: 1035666 - DNA, 15 bp, Homo sapiens
ctgaacacatgtgta

SEQ ID NO: 1035667 - DNA, 16 bp, Homo sapiens
ctgaacacatgtgtat

SEQ ID NO: 1035668 - DNA, 22 bp, Homo sapiens
ctgaacaccataggtagaatgt

SEQ ID NO: 1035669 - DNA, 19 bp, Homo sapiens
ctgaacaccattgaaggct

SEQ ID NO: 1035670 - DNA, 20 bp, Homo sapiens
ctgaacaccattgaaggctt

SEQ ID NO: 1035671 - DNA, 18 bp, Homo sapiens
ctgaacaggctggggcct

SEQ ID NO: 1035672 - DNA, 19 bp, Homo sapiens
ctgaacaggctggggcctt

SEQ ID NO: 1035673 - DNA, 17 bp, Homo sapiens
ctgaacatccttccttc

SEQ ID NO: 1035674 - DNA, 15 bp, Homo sapiens
ctgaacatctgagtc

SEQ ID NO: 1035675 - DNA, 18 bp, Homo sapiens
ctgaacattgttctgaac

SEQ ID NO: 1035676 - DNA, 19 bp, Homo sapiens
ctgaaccaacagaagcaga

SEQ ID NO: 1035677 - DNA, 15 bp, Homo sapiens
ctgaaccacgaggct

SEQ ID NO: 1035678 - DNA, 22 bp, Homo sapiens
ctgaaccacgaggctgccccca

SEQ ID NO: 1035679 - DNA, 17 bp, Homo sapiens
ctgaacccacacctggg

SEQ ID NO: 1035680 - DNA, 17 bp, Homo sapiens
ctgaacccagctgtgcc

SEQ ID NO: 1035681 - DNA, 15 bp, Homo sapiens
ctgaacccctggcca

SEQ ID NO: 1035682 - DNA, 16 bp, Homo sapiens
ctgaacccctggccag

SEQ ID NO: 1035683 - DNA, 11 bp, Homo sapiens
ctgaaccctgc

SEQ ID NO: 1035684 - DNA, 17 bp, Homo sapiens
ctgaaccctgtgctggt

SEQ ID NO: 1035685 - DNA, 18 bp, Homo sapiens
ctgaaccctgtgctggtg

SEQ ID NO: 1035686 - DNA, 20 bp, Homo sapiens
ctgaaccctgtgctggtgtc

SEQ ID NO: 1035687 - DNA, 15 bp, Homo sapiens
ctgaaccgcacagct

SEQ ID NO: 1035688 - DNA, 20 bp, Homo sapiens
ctgaaccgcacagctcagga

SEQ ID NO: 1035689 - DNA, 14 bp, Homo sapiens
ctgaacgcagaaga

SEQ ID NO: 1035690 - DNA, 23 bp, Homo sapiens
ctgaacgcagaagaaagggtgga

SEQ ID NO: 1035691 - DNA, 13 bp, Homo sapiens
ctgaacggggaga

SEQ ID NO: 1035692 - DNA, 22 bp, Homo sapiens
ctgaactaataaatctgttgcc

SEQ ID NO: 1035693 - DNA, 22 bp, Homo sapiens
ctgaactccaccgaccaactgc

SEQ ID NO: 1035694 - DNA, 13 bp, Homo sapiens
ctgaactccattt

SEQ ID NO: 1035695 - DNA, 16 bp, Homo sapiens
ctgaactcgcagggaa

SEQ ID NO: 1035696 - DNA, 17 bp, Homo sapiens
ctgaactcttcagaaca

SEQ ID NO: 1035697 - DNA, 16 bp, Homo sapiens
ctgaactgagaaggca

SEQ ID NO: 1035698 - DNA, 17 bp, Homo sapiens
ctgaactgagaaggcag

SEQ ID NO: 1035699 - DNA, 18 bp, Homo sapiens
ctgaactgagaaggcagg

SEQ ID NO: 1035700 - DNA, 12 bp, Homo sapiens
ctgaactgagga

SEQ ID NO: 1035701 - DNA, 17 bp, Homo sapiens
ctgaactgaggccttgt

SEQ ID NO: 1035702 - DNA, 18 bp, Homo sapiens
ctgaactgcaacactgga

SEQ ID NO: 1035703 - DNA, 22 bp, Homo sapiens
ctgaactgctctactttgagaa

SEQ ID NO: 1035704 - DNA, 13 bp, Homo sapiens
ctgaactgtgcat

SEQ ID NO: 1035705 - DNA, 20 bp, Homo sapiens
ctgaactgtgcatcaaccag

SEQ ID NO: 1035706 - DNA, 20 bp, Homo sapiens
ctgaactgtgtgtaattgtt

SEQ ID NO: 1035707 - DNA, 17 bp, Homo sapiens
ctgaacttccaagctcc

SEQ ID NO: 1035708 - DNA, 23 bp, Homo sapiens
ctgaacttggtctgcagaccatc

SEQ ID NO: 1035709 - DNA, 15 bp, Homo sapiens
ctgaactttctccct

SEQ ID NO: 1035710 - DNA, 21 bp, Homo sapiens
ctgaagaaaaggttcttcttg

SEQ ID NO: 1035711 - DNA, 23 bp, Homo sapiens
ctgaagacaccgttcattcaggc

SEQ ID NO: 1035712 - DNA, 21 bp, Homo sapiens
ctgaagacatgtttcaagaac

SEQ ID NO: 1035713 - DNA, 15 bp, Homo sapiens
ctgaagacattcaaa

SEQ ID NO: 1035714 - DNA, 19 bp, Homo sapiens
ctgaagacctaaagtgctt

SEQ ID NO: 1035715 - DNA, 16 bp, Homo sapiens
ctgaagacctcgagca

SEQ ID NO: 1035716 - DNA, 21 bp, Homo sapiens
ctgaagacgagcatccccctc

SEQ ID NO: 1035717 - DNA, 14 bp, Homo sapiens
ctgaagactctgca

SEQ ID NO: 1035718 - DNA, 16 bp, Homo sapiens
ctgaagagacaggcac

SEQ ID NO: 1035719 - DNA, 13 bp, Homo sapiens
ctgaagagacctt

SEQ ID NO: 1035720 - DNA, 12 bp, Homo sapiens
ctgaagagcaag

SEQ ID NO: 1035721 - DNA, 14 bp, Homo sapiens
ctgaagagcaaggt

SEQ ID NO: 1035722 - DNA, 23 bp, Homo sapiens
ctgaagagcgctcctctgccttg

SEQ ID NO: 1035723 - DNA, 16 bp, Homo sapiens
ctgaagaggcgggcca

SEQ ID NO: 1035724 - DNA, 18 bp, Homo sapiens
ctgaagaggcgggccagc

SEQ ID NO: 1035725 - DNA, 20 bp, Homo sapiens
ctgaagaggcgggccagcca

SEQ ID NO: 1035726 - DNA, 22 bp, Homo sapiens
ctgaagaggcgggccagccagg

SEQ ID NO: 1035727 - DNA, 20 bp, Homo sapiens
ctgaagagtatccttccttc

SEQ ID NO: 1035728 - DNA, 21 bp, Homo sapiens
ctgaagagtatccttccttca

SEQ ID NO: 1035729 - DNA, 18 bp, Homo sapiens
ctgaagagtcctctgaat

SEQ ID NO: 1035730 - DNA, 14 bp, Homo sapiens
ctgaagatatattt

SEQ ID NO: 1035731 - DNA, 23 bp, Homo sapiens
ctgaagatggcatcctgtgaagt

SEQ ID NO: 1035732 - DNA, 14 bp, Homo sapiens
ctgaagcaacttga

SEQ ID NO: 1035733 - DNA, 14 bp, Homo sapiens
ctgaagcagcctct

SEQ ID NO: 1035734 - DNA, 20 bp, Homo sapiens
ctgaagcagcctctccccag

SEQ ID NO: 1035735 - DNA, 20 bp, Homo sapiens
ctgaagcaggttcccaagct

SEQ ID NO: 1035736 - DNA, 13 bp, Homo sapiens
ctgaagccacttg

SEQ ID NO: 1035737 - DNA, 22 bp, Homo sapiens
ctgaagccatgtagccacccaa

SEQ ID NO: 1035738 - DNA, 16 bp, Homo sapiens
ctgaagcctctgccct

SEQ ID NO: 1035739 - DNA, 22 bp, Homo sapiens
ctgaagcctggattccagcagt

SEQ ID NO: 1035740 - DNA, 13 bp, Homo sapiens
ctgaagccttctt

SEQ ID NO: 1035741 - DNA, 17 bp, Homo sapiens
ctgaagccttcttctgc

SEQ ID NO: 1035742 - DNA, 16 bp, Homo sapiens
ctgaagcgactctcct

SEQ ID NO: 1035743 - DNA, 18 bp, Homo sapiens
ctgaagcgactctcctgt

SEQ ID NO: 1035744 - DNA, 21 bp, Homo sapiens
ctgaagctacaggttgtgaaa

SEQ ID NO: 1035745 - DNA, 12 bp, Homo sapiens
ctgaagctgagg

SEQ ID NO: 1035746 - DNA, 15 bp, Homo sapiens
ctgaagctgctgtgt

SEQ ID NO: 1035747 - DNA, 16 bp, Homo sapiens
ctgaagctgctgtgtc

SEQ ID NO: 1035748 - DNA, 16 bp, Homo sapiens
ctgaagctggagcagc

SEQ ID NO: 1035749 - DNA, 15 bp, Homo sapiens
ctgaagctggcctgg

SEQ ID NO: 1035750 - DNA, 18 bp, Homo sapiens
ctgaagcttcggccgcgc

SEQ ID NO: 1035751 - DNA, 14 bp, Homo sapiens
ctgaagcttgactc

SEQ ID NO: 1035752 - DNA, 20 bp, Homo sapiens
ctgaagcttgactcccaagt

SEQ ID NO: 1035753 - DNA, 14 bp, Homo sapiens
ctgaagctttacca

SEQ ID NO: 1035754 - DNA, 18 bp, Homo sapiens
ctgaagctttaccagctg

SEQ ID NO: 1035755 - DNA, 16 bp, Homo sapiens
ctgaaggaaaaacaca

SEQ ID NO: 1035756 - DNA, 21 bp, Homo sapiens
ctgaaggaaaaacacaagcaa

SEQ ID NO: 1035757 - DNA, 22 bp, Homo sapiens
ctgaaggaaaaacacaagcaaa

SEQ ID NO: 1035758 - DNA, 17 bp, Homo sapiens
ctgaaggaaaagcaaga

SEQ ID NO: 1035759 - DNA, 23 bp, Homo sapiens
ctgaaggaaaagcaagaaacagt

SEQ ID NO: 1035760 - DNA, 15 bp, Homo sapiens
ctgaaggaagagaag

SEQ ID NO: 1035761 - DNA, 17 bp, Homo sapiens
ctgaaggacacttcctg

SEQ ID NO: 1035762 - DNA, 21 bp, Homo sapiens
ctgaaggacacttcctgccta

SEQ ID NO: 1035763 - DNA, 16 bp, Homo sapiens
ctgaaggaccccaggt

SEQ ID NO: 1035764 - DNA, 12 bp, Homo sapiens
ctgaaggagagg

SEQ ID NO: 1035765 - DNA, 12 bp, Homo sapiens
ctgaaggagccc

SEQ ID NO: 1035766 - DNA, 18 bp, Homo sapiens
ctgaagggaaggcaaagg

SEQ ID NO: 1035767 - DNA, 19 bp, Homo sapiens
ctgaaggtaaaattgaaag

SEQ ID NO: 1035768 - DNA, 17 bp, Homo sapiens
ctgaaggtattggcctg

SEQ ID NO: 1035769 - DNA, 13 bp, Homo sapiens
ctgaaggtttttt

SEQ ID NO: 1035770 - DNA, 15 bp, Homo sapiens
ctgaagtaaacagct

SEQ ID NO: 1035771 - DNA, 15 bp, Homo sapiens
ctgaagtacaaacat

SEQ ID NO: 1035772 - DNA, 17 bp, Homo sapiens
ctgaagtacaaacatga

SEQ ID NO: 1035773 - DNA, 18 bp, Homo sapiens
ctgaagtacaaacatgaa

SEQ ID NO: 1035774 - DNA, 13 bp, Homo sapiens
ctgaagtcactgc

SEQ ID NO: 1035775 - DNA, 15 bp, Homo sapiens
ctgaagtcactgcac

SEQ ID NO: 1035776 - DNA, 15 bp, Homo sapiens
ggccgtgcccttgcc

SEQ ID NO: 1035777 - DNA, 18 bp, Homo sapiens
ggccgtggcacagctggg

SEQ ID NO: 1035778 - DNA, 22 bp, Homo sapiens
ggccgtggccatcagggtgggc

SEQ ID NO: 1035779 - DNA, 16 bp, Homo sapiens
ggccgtggcttgggct

SEQ ID NO: 1035780 - DNA, 20 bp, Homo sapiens
ggccgtgtgacactctcgtg

SEQ ID NO: 1035781 - DNA, 18 bp, Homo sapiens
ggccgttccccttggctt

SEQ ID NO: 1035782 - DNA, 16 bp, Homo sapiens
ggcctaaaagtaaaca

SEQ ID NO: 1035783 - DNA, 17 bp, Homo sapiens
ggcctaaggaagccagt

SEQ ID NO: 1035784 - DNA, 20 bp, Homo sapiens
ggcctaatcactctgagtca

SEQ ID NO: 1035785 - DNA, 20 bp, Homo sapiens
ggcctacagctttgatccct

SEQ ID NO: 1035786 - DNA, 16 bp, Homo sapiens
ggcctaccccgcagac

SEQ ID NO: 1035787 - DNA, 20 bp, Homo sapiens
ggcctaccccgcagacacct

SEQ ID NO: 1035788 - DNA, 18 bp, Homo sapiens
ggcctactggggatcaga

SEQ ID NO: 1035789 - DNA, 14 bp, Homo sapiens
ggcctaggcctcag

SEQ ID NO: 1035790 - DNA, 20 bp, Homo sapiens
ggcctaggcctcagccagag

SEQ ID NO: 1035791 - DNA, 22 bp, Homo sapiens
ggcctaggtcacgttggccctc

SEQ ID NO: 1035792 - DNA, 21 bp, Homo sapiens
ggcctatgcagacatctctgg

SEQ ID NO: 1035793 - DNA, 20 bp, Homo sapiens
ggcctcaaaggcccgctcta

SEQ ID NO: 1035794 - DNA, 15 bp, Homo sapiens
ggcctcaacaaggat

SEQ ID NO: 1035795 - DNA, 19 bp, Homo sapiens
ggcctcaaccctccctcag

SEQ ID NO: 1035796 - DNA, 21 bp, Homo sapiens
ggcctcaaccctccctcagcc

SEQ ID NO: 1035797 - DNA, 20 bp, Homo sapiens
ggcctcaagaacaaacactg

SEQ ID NO: 1035798 - DNA, 22 bp, Homo sapiens
ggcctcaagaacaaacactgca

SEQ ID NO: 1035799 - DNA, 17 bp, Homo sapiens
ggcctcacctgcccctc

SEQ ID NO: 1035800 - DNA, 19 bp, Homo sapiens
ggcctcacctgcccctctg

SEQ ID NO: 1035801 - DNA, 20 bp, Homo sapiens
ggcctcacctgcccctctgt

SEQ ID NO: 1035802 - DNA, 15 bp, Homo sapiens
ggcctcactggctca

SEQ ID NO: 1035803 - DNA, 22 bp, Homo sapiens
ggcctcactggctcatgcccct

SEQ ID NO: 1035804 - DNA, 19 bp, Homo sapiens
ggcctcactggctggggca

SEQ ID NO: 1035805 - DNA, 23 bp, Homo sapiens
ggcctcactggctggggcagagg

SEQ ID NO: 1035806 - DNA, 10 bp, Homo sapiens
ggcctcagaa

SEQ ID NO: 1035807 - DNA, 14 bp, Homo sapiens
ggcctcagagcctg

SEQ ID NO: 1035808 - DNA, 10 bp, Homo sapiens
ggcctcagcc

SEQ ID NO: 1035809 - DNA, 14 bp, Homo sapiens
ggcctcagcctggg

SEQ ID NO: 1035810 - DNA, 23 bp, Homo sapiens
ggcctcagcctggggctctctga

SEQ ID NO: 1035811 - DNA, 15 bp, Homo sapiens
ggcctcagctgcctc

SEQ ID NO: 1035812 - DNA, 14 bp, Homo sapiens
ggcctcagggtcta

SEQ ID NO: 1035813 - DNA, 17 bp, Homo sapiens
ggcctcaggtttgcctg

SEQ ID NO: 1035814 - DNA, 22 bp, Homo sapiens
ggcctcagtggactttccaccc

SEQ ID NO: 1035815 - DNA, 20 bp, Homo sapiens
ggcctcagttcccagctccc

SEQ ID NO: 1035816 - DNA, 23 bp, Homo sapiens
ggcctcagttcccagctcccccc

SEQ ID NO: 1035817 - DNA, 19 bp, Homo sapiens
ggcctcagtttctccatca

SEQ ID NO: 1035818 - DNA, 15 bp, Homo sapiens
ggcctcatccagggc

SEQ ID NO: 1035819 - DNA, 13 bp, Homo sapiens
ggcctcatccctc

SEQ ID NO: 1035820 - DNA, 15 bp, Homo sapiens
ggcctcatccctcgg

SEQ ID NO: 1035821 - DNA, 21 bp, Homo sapiens
ggcctcatctcacctctcgca

SEQ ID NO: 1035822 - DNA, 17 bp, Homo sapiens
ggcctcatgtggctgga

SEQ ID NO: 1035823 - DNA, 19 bp, Homo sapiens
ggcctcatgtggctggaag

SEQ ID NO: 1035824 - DNA, 16 bp, Homo sapiens
ggcctccaacgcccct

SEQ ID NO: 1035825 - DNA, 17 bp, Homo sapiens
ggcctccaacgcccctg

SEQ ID NO: 1035826 - DNA, 24 bp, Homo sapiens
ggcctccaccaaccccgcggccca

SEQ ID NO: 1035827 - DNA, 14 bp, Homo sapiens
ggcctccactcccc

SEQ ID NO: 1035828 - DNA, 15 bp, Homo sapiens
ggcctccagaactca

SEQ ID NO: 1035829 - DNA, 16 bp, Homo sapiens
ggcctccagaagctgc

SEQ ID NO: 1035830 - DNA, 17 bp, Homo sapiens
ggcctccagaagctgct

SEQ ID NO: 1035831 - DNA, 22 bp, Homo sapiens
ggcctccagaagctgctccttt

SEQ ID NO: 1035832 - DNA, 13 bp, Homo sapiens
ggcctccagcctc

SEQ ID NO: 1035833 - DNA, 14 bp, Homo sapiens
ggcctccagcctct

SEQ ID NO: 1035834 - DNA, 13 bp, Homo sapiens
ggcctccagctgt

SEQ ID NO: 1035835 - DNA, 15 bp, Homo sapiens
ggcctccagggccca

SEQ ID NO: 1035836 - DNA, 12 bp, Homo sapiens
ggcctccatgcc

SEQ ID NO: 1035837 - DNA, 23 bp, Homo sapiens
ggcctcccaaagtgctgagattg

SEQ ID NO: 1035838 - DNA, 19 bp, Homo sapiens
ggcctcccaaagtgctggg

SEQ ID NO: 1035839 - DNA, 12 bp, Homo sapiens
ggcctcccaccc

SEQ ID NO: 1035840 - DNA, 23 bp, Homo sapiens
ggcctcccacccgatgctgcttt

SEQ ID NO: 1035841 - DNA, 19 bp, Homo sapiens
ggcctcccagagtgctggg

SEQ ID NO: 1035842 - DNA, 23 bp, Homo sapiens
ggcctccccgaggttgtggggag

SEQ ID NO: 1035843 - DNA, 14 bp, Homo sapiens
ggcctcccctgggc

SEQ ID NO: 1035844 - DNA, 15 bp, Homo sapiens
ggcctcccctgggca

SEQ ID NO: 1035845 - DNA, 21 bp, Homo sapiens
ggcctcccctgggcagggttc

SEQ ID NO: 1035846 - DNA, 16 bp, Homo sapiens
ggcctccctgctgtgc

SEQ ID NO: 1035847 - DNA, 17 bp, Homo sapiens
ggcctccctgctgtgcc

SEQ ID NO: 1035848 - DNA, 21 bp, Homo sapiens
ggcctccctggctcctccgtc

SEQ ID NO: 1035849 - DNA, 23 bp, Homo sapiens
ggcctccctgttcacggtgacac

SEQ ID NO: 1035850 - DNA, 17 bp, Homo sapiens
ggcctcccttgggctgg

SEQ ID NO: 1035851 - DNA, 15 bp, Homo sapiens
ggcctccgaggctcc

SEQ ID NO: 1035852 - DNA, 14 bp, Homo sapiens
ggcctccggcctcc

SEQ ID NO: 1035853 - DNA, 22 bp, Homo sapiens
ggcctccggcgtcttgcccagc

SEQ ID NO: 1035854 - DNA, 21 bp, Homo sapiens
ggcctccgtccaggagcctgg

SEQ ID NO: 1035855 - DNA, 16 bp, Homo sapiens
ggcctccgtcttccca

SEQ ID NO: 1035856 - DNA, 21 bp, Homo sapiens
ggcctcctaaggctccccacc

SEQ ID NO: 1035857 - DNA, 23 bp, Homo sapiens
ggcctcctaaggctccccacccc

SEQ ID NO: 1035858 - DNA, 15 bp, Homo sapiens
ggcctcctcagcctc

SEQ ID NO: 1035859 - DNA, 18 bp, Homo sapiens
ggcctcctcagcctctgc

SEQ ID NO: 1035860 - DNA, 21 bp, Homo sapiens
ggcctcctcggagagcagcag

SEQ ID NO: 1035861 - DNA, 19 bp, Homo sapiens
ggcctccttcccatgcctg

SEQ ID NO: 1035862 - DNA, 21 bp, Homo sapiens
ggcctccttcccatgcctgtc

SEQ ID NO: 1035863 - DNA, 19 bp, Homo sapiens
ggcctcggagcctcatccg

SEQ ID NO: 1035864 - DNA, 16 bp, Homo sapiens
ggcctcgggacctcag

SEQ ID NO: 1035865 - DNA, 17 bp, Homo sapiens
ggcctctcaccccactt

SEQ ID NO: 1035866 - DNA, 13 bp, Homo sapiens
ggcctctctagca

SEQ ID NO: 1035867 - DNA, 13 bp, Homo sapiens
ggcctctctatcc

SEQ ID NO: 1035868 - DNA, 14 bp, Homo sapiens
ggcctctctcctgc

SEQ ID NO: 1035869 - DNA, 13 bp, Homo sapiens
ggcctctctctgc

SEQ ID NO: 1035870 - DNA, 14 bp, Homo sapiens
ggcctctctctgct

SEQ ID NO: 1035871 - DNA, 19 bp, Homo sapiens
ggcctctctctgctccatc

SEQ ID NO: 1035872 - DNA, 17 bp, Homo sapiens
ggcctctctggcctccc

SEQ ID NO: 1035873 - DNA, 19 bp, Homo sapiens
ggcctctctggcctcccac

SEQ ID NO: 1035874 - DNA, 20 bp, Homo sapiens
ggcctctctggcctcccacc

SEQ ID NO: 1035875 - DNA, 12 bp, Homo sapiens
ggcctctctggg

SEQ ID NO: 1035876 - DNA, 21 bp, Homo sapiens
ggcctctgcaaaggaaatacc

SEQ ID NO: 1035877 - DNA, 14 bp, Homo sapiens
ggcctctgctgaat

SEQ ID NO: 1035878 - DNA, 13 bp, Homo sapiens
ggcctctgctgcc

SEQ ID NO: 1035879 - DNA, 15 bp, Homo sapiens
ggcctctgctgcccc

SEQ ID NO: 1035880 - DNA, 18 bp, Homo sapiens
ggcctctgctgccccctt

SEQ ID NO: 1035881 - DNA, 20 bp, Homo sapiens
ggcctctgtgattacataga

SEQ ID NO: 1035882 - DNA, 21 bp, Homo sapiens
ggcctctgtgattacatagat

SEQ ID NO: 1035883 - DNA, 13 bp, Homo sapiens
ggcctcttgagca

SEQ ID NO: 1035884 - DNA, 16 bp, Homo sapiens
ggcctcttgagcagtg

SEQ ID NO: 1035885 - DNA, 20 bp, Homo sapiens
ggcctcttggataccagctc

SEQ ID NO: 1035886 - DNA, 17 bp, Homo sapiens
ggcctgaactgaggaga

SEQ ID NO: 1035887 - DNA, 23 bp, Homo sapiens
ggcctgaagagtcctctgaatga

SEQ ID NO: 1035888 - DNA, 18 bp, Homo sapiens
ggcctgaagccagctgcc

SEQ ID NO: 1035889 - DNA, 21 bp, Homo sapiens
ggcctgacaccccctccccgc

SEQ ID NO: 1035890 - DNA, 20 bp, Homo sapiens
ggcctgaccaaacagccaac

SEQ ID NO: 1035891 - DNA, 14 bp, Homo sapiens
ggcctgactgctca

SEQ ID NO: 1035892 - DNA, 22 bp, Homo sapiens
ggcctgacttgagccactcctt

SEQ ID NO: 1035893 - DNA, 20 bp, Homo sapiens
ggcctgagaatgagtgggaa

SEQ ID NO: 1035894 - DNA, 18 bp, Homo sapiens
ggcctgagaggggaagcg

SEQ ID NO: 1035895 - DNA, 15 bp, Homo sapiens
ggcctgagagtcagc

SEQ ID NO: 1035896 - DNA, 18 bp, Homo sapiens
ggcctgatgacagagcga

SEQ ID NO: 1035897 - DNA, 22 bp, Homo sapiens
ggcctgatgagactccactcag

SEQ ID NO: 1035898 - DNA, 17 bp, Homo sapiens
ggcctgatgctccctcc

SEQ ID NO: 1035899 - DNA, 20 bp, Homo sapiens
ggcctgatgctccctcccct

SEQ ID NO: 1035900 - DNA, 17 bp, Homo sapiens
ctgaagtcactgcacag

SEQ ID NO: 1035901 - DNA, 16 bp, Homo sapiens
ctgaagtctctttttc

SEQ ID NO: 1035902 - DNA, 18 bp, Homo sapiens
ctgaagtcttctcctcca

SEQ ID NO: 1035903 - DNA, 16 bp, Homo sapiens
ctgaagtgcatccaaa

SEQ ID NO: 1035904 - DNA, 18 bp, Homo sapiens
ctgaagtgcatccaaagg

SEQ ID NO: 1035905 - DNA, 19 bp, Homo sapiens
ctgaagtgcatccaaaggt

SEQ ID NO: 1035906 - DNA, 14 bp, Homo sapiens
ctgaagtgctcttt

SEQ ID NO: 1035907 - DNA, 12 bp, Homo sapiens
ctgaagtgcttg

SEQ ID NO: 1035908 - DNA, 19 bp, Homo sapiens
ctgaagtggccctccctca

SEQ ID NO: 1035909 - DNA, 18 bp, Homo sapiens
ctgaagtgtgtccatcct

SEQ ID NO: 1035910 - DNA, 19 bp, Homo sapiens
ctgaagttcagccaccctg

SEQ ID NO: 1035911 - DNA, 14 bp, Homo sapiens
ctgaagttctgagc

SEQ ID NO: 1035912 - DNA, 20 bp, Homo sapiens
ctgaagttctgagccgggca

SEQ ID NO: 1035913 - DNA, 22 bp, Homo sapiens
ctgaagttggagtgagtgtggc

SEQ ID NO: 1035914 - DNA, 13 bp, Homo sapiens
ctgaagttggcca

SEQ ID NO: 1035915 - DNA, 17 bp, Homo sapiens
ctgaagtttcatttatg

SEQ ID NO: 1035916 - DNA, 13 bp, Homo sapiens
ctgaataaaccag

SEQ ID NO: 1035917 - DNA, 14 bp, Homo sapiens
ctgaataaatggta

SEQ ID NO: 1035918 - DNA, 15 bp, Homo sapiens
ctgaataacatttgt

SEQ ID NO: 1035919 - DNA, 20 bp, Homo sapiens
ctgaataacatttgtgtggt

SEQ ID NO: 1035920 - DNA, 14 bp, Homo sapiens
ctgaataatgctac

SEQ ID NO: 1035921 - DNA, 17 bp, Homo sapiens
ctgaataatgctaccag

SEQ ID NO: 1035922 - DNA, 23 bp, Homo sapiens
ctgaataatgctaccaggatgct

SEQ ID NO: 1035923 - DNA, 13 bp, Homo sapiens
ctgaataatttct

SEQ ID NO: 1035924 - DNA, 15 bp, Homo sapiens
ctgaataatttctta

SEQ ID NO: 1035925 - DNA, 17 bp, Homo sapiens
ctgaatacaagcctatg

SEQ ID NO: 1035926 - DNA, 19 bp, Homo sapiens
ctgaatacacagtattcag

SEQ ID NO: 1035927 - DNA, 16 bp, Homo sapiens
ctgaatacagaggcaa

SEQ ID NO: 1035928 - DNA, 17 bp, Homo sapiens
ctgaataccactctgta

SEQ ID NO: 1035929 - DNA, 18 bp, Homo sapiens
ctgaataccactctgtaa

SEQ ID NO: 1035930 - DNA, 20 bp, Homo sapiens
ctgaataccactctgtaatt

SEQ ID NO: 1035931 - DNA, 23 bp, Homo sapiens
ctgaataccactctgtaattgca

SEQ ID NO: 1035932 - DNA, 15 bp, Homo sapiens
ctgaatatataaaca

SEQ ID NO: 1035933 - DNA, 16 bp, Homo sapiens
ctgaatatataaacac

SEQ ID NO: 1035934 - DNA, 17 bp, Homo sapiens
ctgaatatataaacact

SEQ ID NO: 1035935 - DNA, 20 bp, Homo sapiens
ctgaatatctgttcactttt

SEQ ID NO: 1035936 - DNA, 21 bp, Homo sapiens
ctgaatatctgttcacttttc

SEQ ID NO: 1035937 - DNA, 14 bp, Homo sapiens
ctgaatattttgga

SEQ ID NO: 1035938 - DNA, 17 bp, Homo sapiens
ctgaatattttggaaac

SEQ ID NO: 1035939 - DNA, 19 bp, Homo sapiens
ctgaatattttggaaactg

SEQ ID NO: 1035940 - DNA, 20 bp, Homo sapiens
ctgaatattttttatttcta

SEQ ID NO: 1035941 - DNA, 14 bp, Homo sapiens
ctgaatcagctgct

SEQ ID NO: 1035942 - DNA, 17 bp, Homo sapiens
ctgaatcagctggacat

SEQ ID NO: 1035943 - DNA, 13 bp, Homo sapiens
ctgaatcaggaaa

SEQ ID NO: 1035944 - DNA, 18 bp, Homo sapiens
ctgaatcaggaaactcaa

SEQ ID NO: 1035945 - DNA, 13 bp, Homo sapiens
ctgaatcatgagc

SEQ ID NO: 1035946 - DNA, 22 bp, Homo sapiens
ctgaatcattctcgatttaact

SEQ ID NO: 1035947 - DNA, 13 bp, Homo sapiens
ctgaatctgtaca

SEQ ID NO: 1035948 - DNA, 15 bp, Homo sapiens
ctgaatctgtgcaaa

SEQ ID NO: 1035949 - DNA, 15 bp, Homo sapiens
ctgaatctgtgcctg

SEQ ID NO: 1035950 - DNA, 23 bp, Homo sapiens
ctgaatcttcacgacaatgttga

SEQ ID NO: 1035951 - DNA, 17 bp, Homo sapiens
ctgaatgaaatatcaga

SEQ ID NO: 1035952 - DNA, 19 bp, Homo sapiens
ctgaatgaatccattggag

SEQ ID NO: 1035953 - DNA, 16 bp, Homo sapiens
ctgaatgcataatgtt

SEQ ID NO: 1035954 - DNA, 23 bp, Homo sapiens
ctgaatgcctcaatgtgaccagg

SEQ ID NO: 1035955 - DNA, 19 bp, Homo sapiens
ctgaatgcctcctgtgggg

SEQ ID NO: 1035956 - DNA, 17 bp, Homo sapiens
ctgaatgctctgtgcga

SEQ ID NO: 1035957 - DNA, 16 bp, Homo sapiens
ctgaatgctgctactt

SEQ ID NO: 1035958 - DNA, 15 bp, Homo sapiens
ctgaatgcttctaag

SEQ ID NO: 1035959 - DNA, 22 bp, Homo sapiens
ctgaatggaaggtttgtatatt

SEQ ID NO: 1035960 - DNA, 21 bp, Homo sapiens
ctgaatgggagccagaattca

SEQ ID NO: 1035961 - DNA, 14 bp, Homo sapiens
ctgaatggtccagg

SEQ ID NO: 1035962 - DNA, 11 bp, Homo sapiens
ctgaatgtatt

SEQ ID NO: 1035963 - DNA, 22 bp, Homo sapiens
ctgaatgtcattgaaaaactaa

SEQ ID NO: 1035964 - DNA, 13 bp, Homo sapiens
ctgaatgttctga

SEQ ID NO: 1035965 - DNA, 17 bp, Homo sapiens
ctgaatgttctgacatt

SEQ ID NO: 1035966 - DNA, 15 bp, Homo sapiens
ctgaatgttgggact

SEQ ID NO: 1035967 - DNA, 19 bp, Homo sapiens
ctgaatgttgggactgcta

SEQ ID NO: 1035968 - DNA, 14 bp, Homo sapiens
ctgaattacagtga

SEQ ID NO: 1035969 - DNA, 23 bp, Homo sapiens
ctgaattatctatacatatcttt

SEQ ID NO: 1035970 - DNA, 12 bp, Homo sapiens
ctgaattattct

SEQ ID NO: 1035971 - DNA, 15 bp, Homo sapiens
ctgaattcagttgct

SEQ ID NO: 1035972 - DNA, 20 bp, Homo sapiens
ctgaattcctttacaactaa

SEQ ID NO: 1035973 - DNA, 18 bp, Homo sapiens
ctgaattgacatgaccct

SEQ ID NO: 1035974 - DNA, 16 bp, Homo sapiens
ctgaattgagaataag

SEQ ID NO: 1035975 - DNA, 16 bp, Homo sapiens
ctgaattgtccccagt

SEQ ID NO: 1035976 - DNA, 14 bp, Homo sapiens
ctgaattgtttata

SEQ ID NO: 1035977 - DNA, 15 bp, Homo sapiens
ctgaattgtttataa

SEQ ID NO: 1035978 - DNA, 17 bp, Homo sapiens
ctgaattgtttataatg

SEQ ID NO: 1035979 - DNA, 13 bp, Homo sapiens
ctgaatttcttct

SEQ ID NO: 1035980 - DNA, 19 bp, Homo sapiens
ctgaatttcttcttttcct

SEQ ID NO: 1035981 - DNA, 14 bp, Homo sapiens
ctgaatttgataaa

SEQ ID NO: 1035982 - DNA, 16 bp, Homo sapiens
ctgaattttaaatgtt

SEQ ID NO: 1035983 - DNA, 21 bp, Homo sapiens
ctgaattttggggattttcaa

SEQ ID NO: 1035984 - DNA, 12 bp, Homo sapiens
ctgaatttttaa

SEQ ID NO: 1035985 - DNA, 21 bp, Homo sapiens
ctgaatttttaaacaagtatt

SEQ ID NO: 1035986 - DNA, 14 bp, Homo sapiens
ctgaatttttttgt

SEQ ID NO: 1035987 - DNA, 15 bp, Homo sapiens
ctgaatttttttgta

SEQ ID NO: 1035988 - DNA, 19 bp, Homo sapiens
ctgaatttttttgtaataa

SEQ ID NO: 1035989 - DNA, 23 bp, Homo sapiens
ctgaatttttttgtaataagcaa

SEQ ID NO: 1035990 - DNA, 18 bp, Homo sapiens
ctgacaaaggagccttga

SEQ ID NO: 1035991 - DNA, 14 bp, Homo sapiens
ctgacaaatatttt

SEQ ID NO: 1035992 - DNA, 15 bp, Homo sapiens
ctgacaaatatttta

SEQ ID NO: 1035993 - DNA, 17 bp, Homo sapiens
ctgacaaattttaatta

SEQ ID NO: 1035994 - DNA, 20 bp, Homo sapiens
ctgacaaccaccgctcccca

SEQ ID NO: 1035995 - DNA, 20 bp, Homo sapiens
ctgacaaccattaaagtcag

SEQ ID NO: 1035996 - DNA, 19 bp, Homo sapiens
ctgacaacttagctcaggt

SEQ ID NO: 1035997 - DNA, 13 bp, Homo sapiens
ctgacaatcaact

SEQ ID NO: 1035998 - DNA, 15 bp, Homo sapiens
ctgacaatgaaggga

SEQ ID NO: 1035999 - DNA, 16 bp, Homo sapiens
ctgacaatggcagcta

SEQ ID NO: 1036000 - DNA, 18 bp, Homo sapiens
ctgacaatggcagctaga

SEQ ID NO: 1036001 - DNA, 17 bp, Homo sapiens
ctgacacaccaggcgct

SEQ ID NO: 1036002 - DNA, 23 bp, Homo sapiens
ctgacacaccaggcgctaattca

SEQ ID NO: 1036003 - DNA, 23 bp, Homo sapiens
ctgacacactaaccaagctgagt

SEQ ID NO: 1036004 - DNA, 20 bp, Homo sapiens
ctgacacagaggctggcact

SEQ ID NO: 1036005 - DNA, 21 bp, Homo sapiens
ctgacacagaggctggcactg

SEQ ID NO: 1036006 - DNA, 22 bp, Homo sapiens
ctgacacagaggctggcactga

SEQ ID NO: 1036007 - DNA, 23 bp, Homo sapiens
ctgacaccctgggatggaacctc

SEQ ID NO: 1036008 - DNA, 17 bp, Homo sapiens
ctgacaccgtccctcag

SEQ ID NO: 1036009 - DNA, 22 bp, Homo sapiens
ctgacaccgtcgaccaggaaag

SEQ ID NO: 1036010 - DNA, 17 bp, Homo sapiens
ctgacacctaccatgct

SEQ ID NO: 1036011 - DNA, 20 bp, Homo sapiens
ctgacacctaccatgctgct

SEQ ID NO: 1036012 - DNA, 20 bp, Homo sapiens
ctgacacgcagcctgctctg

SEQ ID NO: 1036013 - DNA, 19 bp, Homo sapiens
ctgacagaaagattttcct

SEQ ID NO: 1036014 - DNA, 21 bp, Homo sapiens
ctgacagaaggtgccacttta

SEQ ID NO: 1036015 - DNA, 16 bp, Homo sapiens
ctgacagactcactgg

SEQ ID NO: 1036016 - DNA, 12 bp, Homo sapiens
ctgacagaggag

SEQ ID NO: 1036017 - DNA, 14 bp, Homo sapiens
ctgacagcagcctg

SEQ ID NO: 1036018 - DNA, 16 bp, Homo sapiens
ctgacagcagcctgtg

SEQ ID NO: 1036019 - DNA, 21 bp, Homo sapiens
ctgacagcaggccactagtga

SEQ ID NO: 1036020 - DNA, 15 bp, Homo sapiens
ctgacagcatgtgcc

SEQ ID NO: 1036021 - DNA, 18 bp, Homo sapiens
ctgacagcatgtgccctc

SEQ ID NO: 1036022 - DNA, 16 bp, Homo sapiens
ctgacagcccaacttc

SEQ ID NO: 1036023 - DNA, 12 bp, Homo sapiens
ctgacagcctcc

SEQ ID NO: 1036024 - DNA, 18 bp, Homo sapiens
ctgacagccttccccagc

SEQ ID NO: 1036025 - DNA, 17 bp, Homo sapiens
ctctgctgagtgctggg

SEQ ID NO: 1036026 - DNA, 12 bp, Homo sapiens
ctctgctgcccc

SEQ ID NO: 1036027 - DNA, 13 bp, Homo sapiens
ctctgctgccccc

SEQ ID NO: 1036028 - DNA, 18 bp, Homo sapiens
ctctgctgcccccttccc

SEQ ID NO: 1036029 - DNA, 19 bp, Homo sapiens
ctctgctgcccccttcccc

SEQ ID NO: 1036030 - DNA, 13 bp, Homo sapiens
ctctgctgcctct

SEQ ID NO: 1036031 - DNA, 16 bp, Homo sapiens
ctctgctgcctctgtg

SEQ ID NO: 1036032 - DNA, 13 bp, Homo sapiens
ctctgctgctcat

SEQ ID NO: 1036033 - DNA, 11 bp, Homo sapiens
ctctgctgctt

SEQ ID NO: 1036034 - DNA, 20 bp, Homo sapiens
ctctgctggaaggggcagca

SEQ ID NO: 1036035 - DNA, 14 bp, Homo sapiens
ctctgctggcccag

SEQ ID NO: 1036036 - DNA, 14 bp, Homo sapiens
ctctgctggccgga

SEQ ID NO: 1036037 - DNA, 11 bp, Homo sapiens
ctctgctggga

SEQ ID NO: 1036038 - DNA, 17 bp, Homo sapiens
ctctgctggtcttcaat

SEQ ID NO: 1036039 - DNA, 22 bp, Homo sapiens
ctctgcttccatggcttcctga

SEQ ID NO: 1036040 - DNA, 23 bp, Homo sapiens
ctctgcttccatggcttcctgag

SEQ ID NO: 1036041 - DNA, 16 bp, Homo sapiens
ctctgcttctcatccc

SEQ ID NO: 1036042 - DNA, 22 bp, Homo sapiens
ctctgcttctcggggtccagtg

SEQ ID NO: 1036043 - DNA, 12 bp, Homo sapiens
ctctgcttctct

SEQ ID NO: 1036044 - DNA, 17 bp, Homo sapiens
ctctgcttgcctagccc

SEQ ID NO: 1036045 - DNA, 16 bp, Homo sapiens
ctctgctttccttttc

SEQ ID NO: 1036046 - DNA, 20 bp, Homo sapiens
ctctgcttttagttcatata

SEQ ID NO: 1036047 - DNA, 14 bp, Homo sapiens
ctctggaaaactat

SEQ ID NO: 1036048 - DNA, 17 bp, Homo sapiens
ctctggaaaactcagga

SEQ ID NO: 1036049 - DNA, 19 bp, Homo sapiens
ctctggaaaatgtgaccca

SEQ ID NO: 1036050 - DNA, 20 bp, Homo sapiens
ctctggaaaatgtgacccag

SEQ ID NO: 1036051 - DNA, 14 bp, Homo sapiens
ctctggaaagaaac

SEQ ID NO: 1036052 - DNA, 21 bp, Homo sapiens
ctctggaaaggggggagctgg

SEQ ID NO: 1036053 - DNA, 22 bp, Homo sapiens
ctctggaaaggggggagctggg

SEQ ID NO: 1036054 - DNA, 15 bp, Homo sapiens
ctctggaagcctgga

SEQ ID NO: 1036055 - DNA, 20 bp, Homo sapiens
ctctggaaggggcagccctg

SEQ ID NO: 1036056 - DNA, 21 bp, Homo sapiens
ctctggaaggggcagccctga

SEQ ID NO: 1036057 - DNA, 22 bp, Homo sapiens
ctctggaaggggcagccctgag

SEQ ID NO: 1036058 - DNA, 23 bp, Homo sapiens
ctctggaaggggcagccctgagt

SEQ ID NO: 1036059 - DNA, 19 bp, Homo sapiens
ctctggaataaagttgcag

SEQ ID NO: 1036060 - DNA, 16 bp, Homo sapiens
ctctggaatcttcccc

SEQ ID NO: 1036061 - DNA, 20 bp, Homo sapiens
ctctggaatcttccccaagg

SEQ ID NO: 1036062 - DNA, 21 bp, Homo sapiens
ctctggacacgtaacctatgt

SEQ ID NO: 1036063 - DNA, 19 bp, Homo sapiens
ctctggacagcagaagcct

SEQ ID NO: 1036064 - DNA, 21 bp, Homo sapiens
ctctggacagcagaagcctcc

SEQ ID NO: 1036065 - DNA, 16 bp, Homo sapiens
ctctggacagccagtg

SEQ ID NO: 1036066 - DNA, 22 bp, Homo sapiens
ctctggaccaaccctgtttcct

SEQ ID NO: 1036067 - DNA, 20 bp, Homo sapiens
ctctggaccagcctgttgga

SEQ ID NO: 1036068 - DNA, 15 bp, Homo sapiens
ctctggacctcagga

SEQ ID NO: 1036069 - DNA, 17 bp, Homo sapiens
ctctggacctcaggagg

SEQ ID NO: 1036070 - DNA, 22 bp, Homo sapiens
ctctggacctcaggagggcagg

SEQ ID NO: 1036071 - DNA, 23 bp, Homo sapiens
ctctggacggcaggctcactgcc

SEQ ID NO: 1036072 - DNA, 14 bp, Homo sapiens
ctctggactggcct

SEQ ID NO: 1036073 - DNA, 14 bp, Homo sapiens
ctctggactggcta

SEQ ID NO: 1036074 - DNA, 12 bp, Homo sapiens
ctctggactgtg

SEQ ID NO: 1036075 - DNA, 21 bp, Homo sapiens
ctctggacttgccctctccct

SEQ ID NO: 1036076 - DNA, 15 bp, Homo sapiens
ctctggagcagccaa

SEQ ID NO: 1036077 - DNA, 12 bp, Homo sapiens
ctctggagccag

SEQ ID NO: 1036078 - DNA, 13 bp, Homo sapiens
ctctggagccaga

SEQ ID NO: 1036079 - DNA, 15 bp, Homo sapiens
ctctggagccagaga

SEQ ID NO: 1036080 - DNA, 14 bp, Homo sapiens
ctctggagcccctc

SEQ ID NO: 1036081 - DNA, 17 bp, Homo sapiens
ctctggaggaagttctc

SEQ ID NO: 1036082 - DNA, 22 bp, Homo sapiens
ctctggaggaagttctccagct

SEQ ID NO: 1036083 - DNA, 16 bp, Homo sapiens
ctctggaggcctctgg

SEQ ID NO: 1036084 - DNA, 19 bp, Homo sapiens
ggagttgagtacagtgagg

SEQ ID NO: 1036085 - DNA, 20 bp, Homo sapiens
ggagttgatcgcctttccca

SEQ ID NO: 1036086 - DNA, 12 bp, Homo sapiens
ggagttggggct

SEQ ID NO: 1036087 - DNA, 14 bp, Homo sapiens
ggagttggggctgc

SEQ ID NO: 1036088 - DNA, 17 bp, Homo sapiens
ggagttggtctgagtga

SEQ ID NO: 1036089 - DNA, 23 bp, Homo sapiens
ggagttgtcgtttttagctttgt

SEQ ID NO: 1036090 - DNA, 21 bp, Homo sapiens
ggagtttaaaaacatttttta

SEQ ID NO: 1036091 - DNA, 20 bp, Homo sapiens
ggagtttaagaccagcctgg

SEQ ID NO: 1036092 - DNA, 12 bp, Homo sapiens
ggagtttctcta

SEQ ID NO: 1036093 - DNA, 13 bp, Homo sapiens
ggagtttctctgt

SEQ ID NO: 1036094 - DNA, 17 bp, Homo sapiens
ggagtttgagacaagcc

SEQ ID NO: 1036095 - DNA, 20 bp, Homo sapiens
ggagtttgagacaagccctg

SEQ ID NO: 1036096 - DNA, 19 bp, Homo sapiens
ggagtttgaggctgcagcg

SEQ ID NO: 1036097 - DNA, 20 bp, Homo sapiens
ggagtttgaggctgcagcga

SEQ ID NO: 1036098 - DNA, 15 bp, Homo sapiens
ggagttttattttta

SEQ ID NO: 1036099 - DNA, 17 bp, Homo sapiens
ggagtttttttgtcaga

SEQ ID NO: 1036100 - DNA, 18 bp, Homo sapiens
ggataaaaagccagggct

SEQ ID NO: 1036101 - DNA, 20 bp, Homo sapiens
ggataaaaagccagggctgg

SEQ ID NO: 1036102 - DNA, 15 bp, Homo sapiens
ggataaaaaggaagg

SEQ ID NO: 1036103 - DNA, 14 bp, Homo sapiens
ggataaaatgaggt

SEQ ID NO: 1036104 - DNA, 22 bp, Homo sapiens
ggataaaccaccctctggggac

SEQ ID NO: 1036105 - DNA, 16 bp, Homo sapiens
ggataaactgagcctc

SEQ ID NO: 1036106 - DNA, 19 bp, Homo sapiens
ggataaagaaaagacattt

SEQ ID NO: 1036107 - DNA, 20 bp, Homo sapiens
ggataactttacagaaatgg

SEQ ID NO: 1036108 - DNA, 21 bp, Homo sapiens
ggataagaaagcctaaaattg

SEQ ID NO: 1036109 - DNA, 14 bp, Homo sapiens
ggataatagagtag

SEQ ID NO: 1036110 - DNA, 16 bp, Homo sapiens
ggataatatatttgca

SEQ ID NO: 1036111 - DNA, 21 bp, Homo sapiens
ggataatgaaataatcagtga

SEQ ID NO: 1036112 - DNA, 14 bp, Homo sapiens
ggatacagagccac

SEQ ID NO: 1036113 - DNA, 13 bp, Homo sapiens
ggatacagtgccc

SEQ ID NO: 1036114 - DNA, 13 bp, Homo sapiens
ggatacatctgct

SEQ ID NO: 1036115 - DNA, 15 bp, Homo sapiens
ggatactggcacaga

SEQ ID NO: 1036116 - DNA, 17 bp, Homo sapiens
ggatactggcacagagg

SEQ ID NO: 1036117 - DNA, 23 bp, Homo sapiens
ggatacttagtggtatgtctctt

SEQ ID NO: 1036118 - DNA, 14 bp, Homo sapiens
ggatagacactgga

SEQ ID NO: 1036119 - DNA, 15 bp, Homo sapiens
ggatagacactggac

SEQ ID NO: 1036120 - DNA, 16 bp, Homo sapiens
ggatagacactggaca

SEQ ID NO: 1036121 - DNA, 16 bp, Homo sapiens
ggataggtattttata

SEQ ID NO: 1036122 - DNA, 18 bp, Homo sapiens
ggataggttttctgctag

SEQ ID NO: 1036123 - DNA, 16 bp, Homo sapiens
ggatagtatgagccct

SEQ ID NO: 1036124 - DNA, 16 bp, Homo sapiens
ggatagtgttctgctc

SEQ ID NO: 1036125 - DNA, 19 bp, Homo sapiens
ggatagtgttctgctcctg

SEQ ID NO: 1036126 - DNA, 22 bp, Homo sapiens
ggatagtgttctgctcctgctt

SEQ ID NO: 1036127 - DNA, 14 bp, Homo sapiens
ggatataaaaacag

SEQ ID NO: 1036128 - DNA, 22 bp, Homo sapiens
ggatataaaaacagattctgat

SEQ ID NO: 1036129 - DNA, 17 bp, Homo sapiens
ggatataaaaggatgtt

SEQ ID NO: 1036130 - DNA, 19 bp, Homo sapiens
ggatatataggctattttc

SEQ ID NO: 1036131 - DNA, 20 bp, Homo sapiens
ggatatccttatcagagcta

SEQ ID NO: 1036132 - DNA, 16 bp, Homo sapiens
ggatatggcaggactc

SEQ ID NO: 1036133 - DNA, 22 bp, Homo sapiens
ggatatggcaggactcctggca

SEQ ID NO: 1036134 - DNA, 14 bp, Homo sapiens
ggatatggctgccc

SEQ ID NO: 1036135 - DNA, 20 bp, Homo sapiens
ggatatggctgcccaggaga

SEQ ID NO: 1036136 - DNA, 21 bp, Homo sapiens
ggatatgtccagtcatcctgc

SEQ ID NO: 1036137 - DNA, 19 bp, Homo sapiens
ggatattaaacgtgtaaat

SEQ ID NO: 1036138 - DNA, 9 bp, Homo sapiens
ggatattat

SEQ ID NO: 1036139 - DNA, 14 bp, Homo sapiens
ggatattatagaaa

SEQ ID NO: 1036140 - DNA, 17 bp, Homo sapiens
ggatattatagaaaatt

SEQ ID NO: 1036141 - DNA, 21 bp, Homo sapiens
ggatattgccttatttgtctg

SEQ ID NO: 1036142 - DNA, 23 bp, Homo sapiens
ggatattgccttatttgtctgta

SEQ ID NO: 1036143 - DNA, 18 bp, Homo sapiens
ggatatttagaactttgt

SEQ ID NO: 1036144 - DNA, 22 bp, Homo sapiens
ggatcaaaccccgaccacctgc

SEQ ID NO: 1036145 - DNA, 12 bp, Homo sapiens
ggatcaaataac

SEQ ID NO: 1036146 - DNA, 20 bp, Homo sapiens
ggatcaagcttgtgtacttg

SEQ ID NO: 1036147 - DNA, 19 bp, Homo sapiens
ggatcacacctcagtggga

SEQ ID NO: 1036148 - DNA, 20 bp, Homo sapiens
ggatcacacctcagtgggaa

SEQ ID NO: 1036149 - DNA, 22 bp, Homo sapiens
ggatcacacctcagtgggaaga

SEQ ID NO: 1036150 - DNA, 19 bp, Homo sapiens
ggatcacgacgctgcagag

SEQ ID NO: 1036151 - DNA, 14 bp, Homo sapiens
ggatcactggagcc

SEQ ID NO: 1036152 - DNA, 17 bp, Homo sapiens
ggatcactggagcccag

SEQ ID NO: 1036153 - DNA, 15 bp, Homo sapiens
ggagggatcagcccc

SEQ ID NO: 1036154 - DNA, 16 bp, Homo sapiens
ggagggatggagaggc

SEQ ID NO: 1036155 - DNA, 21 bp, Homo sapiens
ggagggcaagggccatgctga

SEQ ID NO: 1036156 - DNA, 15 bp, Homo sapiens
ggagggcacttcagg

SEQ ID NO: 1036157 - DNA, 17 bp, Homo sapiens
ggagggcacttcctcca

SEQ ID NO: 1036158 - DNA, 20 bp, Homo sapiens
ggagggcacttcctccacag

SEQ ID NO: 1036159 - DNA, 15 bp, Homo sapiens
ggagggcagagccat

SEQ ID NO: 1036160 - DNA, 17 bp, Homo sapiens
ggagggcagagccatgg

SEQ ID NO: 1036161 - DNA, 22 bp, Homo sapiens
ggagggcagagccatgggcctg

SEQ ID NO: 1036162 - DNA, 13 bp, Homo sapiens
ggagggcagcagg

SEQ ID NO: 1036163 - DNA, 15 bp, Homo sapiens
ggagggcagctggcc

SEQ ID NO: 1036164 - DNA, 15 bp, Homo sapiens
ggagggcaggctgag

SEQ ID NO: 1036165 - DNA, 16 bp, Homo sapiens
ggagggcaggctgagg

SEQ ID NO: 1036166 - DNA, 14 bp, Homo sapiens
ggagggccagcgct

SEQ ID NO: 1036167 - DNA, 21 bp, Homo sapiens
ggagggcccctgcgtgggggc

SEQ ID NO: 1036168 - DNA, 14 bp, Homo sapiens
ggagggcgtcaggc

SEQ ID NO: 1036169 - DNA, 20 bp, Homo sapiens
ggagggcgtcaggcagaggc

SEQ ID NO: 1036170 - DNA, 17 bp, Homo sapiens
ggagggcgtgactcacc

SEQ ID NO: 1036171 - DNA, 14 bp, Homo sapiens
ggagggctcctggg

SEQ ID NO: 1036172 - DNA, 22 bp, Homo sapiens
ggagggctgtcatctgtgcact

SEQ ID NO: 1036173 - DNA, 20 bp, Homo sapiens
ggaggggaaatgtaatactg

SEQ ID NO: 1036174 - DNA, 18 bp, Homo sapiens
ggaggggaagctgggccc

SEQ ID NO: 1036175 - DNA, 19 bp, Homo sapiens
ggaggggacagagctgagg

SEQ ID NO: 1036176 - DNA, 20 bp, Homo sapiens
ggaggggactatttatgaag

SEQ ID NO: 1036177 - DNA, 22 bp, Homo sapiens
ggaggggacttgtaggaatctg

SEQ ID NO: 1036178 - DNA, 20 bp, Homo sapiens
ggaggggagagacaggcagc

SEQ ID NO: 1036179 - DNA, 13 bp, Homo sapiens
ggaggggaggcag

SEQ ID NO: 1036180 - DNA, 14 bp, Homo sapiens
ggaggggcagagag

SEQ ID NO: 1036181 - DNA, 13 bp, Homo sapiens
ggaggggcagagc

SEQ ID NO: 1036182 - DNA, 16 bp, Homo sapiens
ggaggggcagagccag

SEQ ID NO: 1036183 - DNA, 19 bp, Homo sapiens
ggaggggcagcctgtgcct

SEQ ID NO: 1036184 - DNA, 14 bp, Homo sapiens
ggaggggcaggctg

SEQ ID NO: 1036185 - DNA, 13 bp, Homo sapiens
ggaggggcctagg

SEQ ID NO: 1036186 - DNA, 15 bp, Homo sapiens
ggaggggcctaggga

SEQ ID NO: 1036187 - DNA, 14 bp, Homo sapiens
ggaggggcctggca

SEQ ID NO: 1036188 - DNA, 14 bp, Homo sapiens
ggaggggcctgggc

SEQ ID NO: 1036189 - DNA, 17 bp, Homo sapiens
ggaggggcctgggcagc

SEQ ID NO: 1036190 - DNA, 19 bp, Homo sapiens
ggaggggcctgggcagccc

SEQ ID NO: 1036191 - DNA, 16 bp, Homo sapiens
ggaggggcgctggccc

SEQ ID NO: 1036192 - DNA, 21 bp, Homo sapiens
ggaggggctggggcaggctct

SEQ ID NO: 1036193 - DNA, 23 bp, Homo sapiens
ggaggggctgtcctccttcctgg

SEQ ID NO: 1036194 - DNA, 16 bp, Homo sapiens
ggagggggaagcaaag

SEQ ID NO: 1036195 - DNA, 12 bp, Homo sapiens
ggagggggagga

SEQ ID NO: 1036196 - DNA, 14 bp, Homo sapiens
ggagggggatccga

SEQ ID NO: 1036197 - DNA, 13 bp, Homo sapiens
ggagggggcacgg

SEQ ID NO: 1036198 - DNA, 17 bp, Homo sapiens
ggagggggcacggcagg

SEQ ID NO: 1036199 - DNA, 16 bp, Homo sapiens
ggagggggcgctcagg

SEQ ID NO: 1036200 - DNA, 21 bp, Homo sapiens
ggagggggcgctcaggaccca

SEQ ID NO: 1036201 - DNA, 20 bp, Homo sapiens
ggagggggcggcagggctgg

SEQ ID NO: 1036202 - DNA, 24 bp, Homo sapiens
ggagggggcggcagggctgggcct

SEQ ID NO: 1036203 - DNA, 21 bp, Homo sapiens
ggagggggcttgaagccaaag

SEQ ID NO: 1036204 - DNA, 15 bp, Homo sapiens
ggaggggggagccat

SEQ ID NO: 1036205 - DNA, 21 bp, Homo sapiens
ggagggggtacctcatgagga

SEQ ID NO: 1036206 - DNA, 16 bp, Homo sapiens
ggagggggttacaaac

SEQ ID NO: 1036207 - DNA, 18 bp, Homo sapiens
ggagggggtttgggggct

SEQ ID NO: 1036208 - DNA, 17 bp, Homo sapiens
ggaggggtggtcctgac

SEQ ID NO: 1036209 - DNA, 20 bp, Homo sapiens
ggagggtaaataaaccactg

SEQ ID NO: 1036210 - DNA, 23 bp, Homo sapiens
ggagggtgacatggggaaggcag

SEQ ID NO: 1036211 - DNA, 21 bp, Homo sapiens
ggagggtgacccacagctctg

SEQ ID NO: 1036212 - DNA, 22 bp, Homo sapiens
ggagggtgacccacagctctgg

SEQ ID NO: 1036213 - DNA, 23 bp, Homo sapiens
ggagggtgacccacagctctggg

SEQ ID NO: 1036214 - DNA, 16 bp, Homo sapiens
ggagggtgacgcccag

SEQ ID NO: 1036215 - DNA, 17 bp, Homo sapiens
ggagggtgacgcccagc

SEQ ID NO: 1036216 - DNA, 23 bp, Homo sapiens
ggagggtgccctctgctcaggcc

SEQ ID NO: 1036217 - DNA, 19 bp, Homo sapiens
ggagggtgggagagcccag

SEQ ID NO: 1036218 - DNA, 22 bp, Homo sapiens
ggagggtgggggccacctgcct

SEQ ID NO: 1036219 - DNA, 20 bp, Homo sapiens
ggagggttctaagtgggaga

SEQ ID NO: 1036220 - DNA, 17 bp, Homo sapiens
ggaggtactgagacagg

SEQ ID NO: 1036221 - DNA, 20 bp, Homo sapiens
ggaggtactgagacagggtg

SEQ ID NO: 1036222 - DNA, 20 bp, Homo sapiens
ggaggtaggctgtggggtgg

SEQ ID NO: 1036223 - DNA, 13 bp, Homo sapiens
ggaggtcactgga

SEQ ID NO: 1036224 - DNA, 13 bp, Homo sapiens
ggaggtccaagca

SEQ ID NO: 1036225 - DNA, 16 bp, Homo sapiens
ggaggtcgaggcagga

SEQ ID NO: 1036226 - DNA, 18 bp, Homo sapiens
ggaggtcggtaggttcag

SEQ ID NO: 1036227 - DNA, 22 bp, Homo sapiens
ggaggtgagagaaggatgggtc

SEQ ID NO: 1036228 - DNA, 22 bp, Homo sapiens
ggaggtgagatcacagcctcca

SEQ ID NO: 1036229 - DNA, 13 bp, Homo sapiens
ggaggtgagggat

SEQ ID NO: 1036230 - DNA, 18 bp, Homo sapiens
ggaggtgatagcattgct

SEQ ID NO: 1036231 - DNA, 14 bp, Homo sapiens
ggaggtgctgctct

SEQ ID NO: 1036232 - DNA, 19 bp, Homo sapiens
ggaggtggagcttgcagtg

SEQ ID NO: 1036233 - DNA, 20 bp, Homo sapiens
ggaggtggagcttgcagtga

SEQ ID NO: 1036234 - DNA, 20 bp, Homo sapiens
ggaggtggaggctgcagtga

SEQ ID NO: 1036235 - DNA, 20 bp, Homo sapiens
ggaggtggaggttgcagtga

SEQ ID NO: 1036236 - DNA, 12 bp, Homo sapiens
ggaggtgggagg

SEQ ID NO: 1036237 - DNA, 19 bp, Homo sapiens
ggaggtgggaggccaggcg

SEQ ID NO: 1036238 - DNA, 16 bp, Homo sapiens
ggaggtgggcatgcca

SEQ ID NO: 1036239 - DNA, 18 bp, Homo sapiens
ggaggtgggcatgccacc

SEQ ID NO: 1036240 - DNA, 21 bp, Homo sapiens
ggaggtgggcatgccaccctc

SEQ ID NO: 1036241 - DNA, 14 bp, Homo sapiens
ggaggtgggctgat

SEQ ID NO: 1036242 - DNA, 16 bp, Homo sapiens
ggaggtgggctgatgg

SEQ ID NO: 1036243 - DNA, 22 bp, Homo sapiens
ggaggtgtcacatggtgcccct

SEQ ID NO: 1036244 - DNA, 21 bp, Homo sapiens
ggaggttctgtattttaagaa

SEQ ID NO: 1036245 - DNA, 14 bp, Homo sapiens
ggaggttgaagcca

SEQ ID NO: 1036246 - DNA, 14 bp, Homo sapiens
ggaggttgagtgag

SEQ ID NO: 1036247 - DNA, 18 bp, Homo sapiens
ggaggttgagtgagccgg

SEQ ID NO: 1036248 - DNA, 14 bp, Homo sapiens
ggaggttgcaggga

SEQ ID NO: 1036249 - DNA, 17 bp, Homo sapiens
ggaggttgcagggagcc

SEQ ID NO: 1036250 - DNA, 21 bp, Homo sapiens
ggaggttgcagtgagctgaga

SEQ ID NO: 1036251 - DNA, 20 bp, Homo sapiens
ggaggttggttccttggggg

SEQ ID NO: 1036252 - DNA, 11 bp, Homo sapiens
ggagtaaatat

SEQ ID NO: 1036253 - DNA, 22 bp, Homo sapiens
ggagtaaatatatatgtcaata

SEQ ID NO: 1036254 - DNA, 16 bp, Homo sapiens
ggagtaaatattggga

SEQ ID NO: 1036255 - DNA, 19 bp, Homo sapiens
ggagtaacagggcagaaat

SEQ ID NO: 1036256 - DNA, 18 bp, Homo sapiens
ggagtaatcaggcagcct

SEQ ID NO: 1036257 - DNA, 18 bp, Homo sapiens
ggagtaatctgtgtacaa

SEQ ID NO: 1036258 - DNA, 14 bp, Homo sapiens
ggagtaattgcaca

SEQ ID NO: 1036259 - DNA, 17 bp, Homo sapiens
ggagtaccatgtggcaa

SEQ ID NO: 1036260 - DNA, 16 bp, Homo sapiens
ggagtattgaatggtg

SEQ ID NO: 1036261 - DNA, 22 bp, Homo sapiens
ggagtcaccttcccttgccact

SEQ ID NO: 1036262 - DNA, 15 bp, Homo sapiens
ggagtcactgagacc

SEQ ID NO: 1036263 - DNA, 15 bp, Homo sapiens
ggagtcagagccctg

SEQ ID NO: 1036264 - DNA, 21 bp, Homo sapiens
ggagtcagagccctggctggg

SEQ ID NO: 1036265 - DNA, 18 bp, Homo sapiens
ggagtcagccaggagctg

SEQ ID NO: 1036266 - DNA, 19 bp, Homo sapiens
ggagtcagccaggagctgt

SEQ ID NO: 1036267 - DNA, 12 bp, Homo sapiens
ggagtcaggcct

SEQ ID NO: 1036268 - DNA, 18 bp, Homo sapiens
ggagtcaggcctgggcag

SEQ ID NO: 1036269 - DNA, 19 bp, Homo sapiens
ggagtcaggcctgggcagg

SEQ ID NO: 1036270 - DNA, 21 bp, Homo sapiens
ggagtcagtaggtccaagggc

SEQ ID NO: 1036271 - DNA, 21 bp, Homo sapiens
ggagtcatttgagtctcttaa

SEQ ID NO: 1036272 - DNA, 13 bp, Homo sapiens
ggagtccagctct

SEQ ID NO: 1036273 - DNA, 16 bp, Homo sapiens
ggagtccaggcacagg

SEQ ID NO: 1036274 - DNA, 17 bp, Homo sapiens
ggagtccaggcacagga

SEQ ID NO: 1036275 - DNA, 12 bp, Homo sapiens
ggagtcccaccc

SEQ ID NO: 1036276 - DNA, 13 bp, Homo sapiens
ggagtcccacccg

SEQ ID NO: 1036277 - DNA, 17 bp, Homo sapiens
ggagctgatttccaggc

SEQ ID NO: 1036278 - DNA, 20 bp, Homo sapiens
ggagctgatttccaggcccc

SEQ ID NO: 1036279 - DNA, 13 bp, Homo sapiens
ggagctgcacaca

SEQ ID NO: 1036280 - DNA, 14 bp, Homo sapiens
ggagctgcactgat

SEQ ID NO: 1036281 - DNA, 18 bp, Homo sapiens
ggagctgccacagagaag

SEQ ID NO: 1036282 - DNA, 14 bp, Homo sapiens
ggagctgccagccg

SEQ ID NO: 1036283 - DNA, 13 bp, Homo sapiens
ggagctgcctgca

SEQ ID NO: 1036284 - DNA, 20 bp, Homo sapiens
ggagctgcgcttccctgcag

SEQ ID NO: 1036285 - DNA, 19 bp, Homo sapiens
ggagctgctatagcctggg

SEQ ID NO: 1036286 - DNA, 18 bp, Homo sapiens
ggagctgctggctgacct

SEQ ID NO: 1036287 - DNA, 15 bp, Homo sapiens
ggagctgctggcttg

SEQ ID NO: 1036288 - DNA, 23 bp, Homo sapiens
ggagctgctggcttgcagtgcgc

SEQ ID NO: 1036289 - DNA, 16 bp, Homo sapiens
ggagctggccccgccg

SEQ ID NO: 1036290 - DNA, 17 bp, Homo sapiens
ggagctggcgtctgtct

SEQ ID NO: 1036291 - DNA, 21 bp, Homo sapiens
ggagctggctgtgcctgcttc

SEQ ID NO: 1036292 - DNA, 15 bp, Homo sapiens
ggagctgggagccag

SEQ ID NO: 1036293 - DNA, 17 bp, Homo sapiens
ggagctgggagccaggc

SEQ ID NO: 1036294 - DNA, 14 bp, Homo sapiens
ggagctgggaggaa

SEQ ID NO: 1036295 - DNA, 16 bp, Homo sapiens
ggagctgggaggtctc

SEQ ID NO: 1036296 - DNA, 20 bp, Homo sapiens
ggagctggggtctgggcagt

SEQ ID NO: 1036297 - DNA, 23 bp, Homo sapiens
ggagctggggtctgggcagtgcc

SEQ ID NO: 1036298 - DNA, 20 bp, Homo sapiens
ggagctgtgagttctccctg

SEQ ID NO: 1036299 - DNA, 22 bp, Homo sapiens
ggagctgttactgaatattaaa

SEQ ID NO: 1036300 - DNA, 14 bp, Homo sapiens
ggagcttcctggct

SEQ ID NO: 1036301 - DNA, 16 bp, Homo sapiens
ggagcttcctggctct

SEQ ID NO: 1036302 - DNA, 17 bp, Homo sapiens
ggagcttcctggctctg

SEQ ID NO: 1036303 - DNA, 19 bp, Homo sapiens
ggagcttcctggctctggg

SEQ ID NO: 1036304 - DNA, 18 bp, Homo sapiens
ggagcttcggggcctcct

SEQ ID NO: 1036305 - DNA, 15 bp, Homo sapiens
ggagcttgggaatgg

SEQ ID NO: 1036306 - DNA, 14 bp, Homo sapiens
ggagcttgggactc

SEQ ID NO: 1036307 - DNA, 21 bp, Homo sapiens
ggagcttgggactcaggtctg

SEQ ID NO: 1036308 - DNA, 19 bp, Homo sapiens
ggagctttgttttgggggt

SEQ ID NO: 1036309 - DNA, 12 bp, Homo sapiens
ggaggaaaaaag

SEQ ID NO: 1036310 - DNA, 18 bp, Homo sapiens
ggaggaaaacacagcctc

SEQ ID NO: 1036311 - DNA, 19 bp, Homo sapiens
ggaggaaaacacagcctcc

SEQ ID NO: 1036312 - DNA, 21 bp, Homo sapiens
ggaggaaaacacagcctccct

SEQ ID NO: 1036313 - DNA, 20 bp, Homo sapiens
ggaggaaagggcctggccag

SEQ ID NO: 1036314 - DNA, 13 bp, Homo sapiens
ggaggaacgggca

SEQ ID NO: 1036315 - DNA, 16 bp, Homo sapiens
ggaggaacgggcagcc

SEQ ID NO: 1036316 - DNA, 17 bp, Homo sapiens
ggaggaacgggcagcca

SEQ ID NO: 1036317 - DNA, 18 bp, Homo sapiens
ggaggaacttgctgctgt

SEQ ID NO: 1036318 - DNA, 12 bp, Homo sapiens
ggaggaagagaa

SEQ ID NO: 1036319 - DNA, 17 bp, Homo sapiens
ggaggaagatggctccc

SEQ ID NO: 1036320 - DNA, 20 bp, Homo sapiens
ggaggaagccggtgtccctg

SEQ ID NO: 1036321 - DNA, 21 bp, Homo sapiens
ggaggaaggcctttcttctgt

SEQ ID NO: 1036322 - DNA, 15 bp, Homo sapiens
ggaggaaggctctgt

SEQ ID NO: 1036323 - DNA, 14 bp, Homo sapiens
ggaggaaggtgctg

SEQ ID NO: 1036324 - DNA, 20 bp, Homo sapiens
ggaggaagtatgagtgctga

SEQ ID NO: 1036325 - DNA, 12 bp, Homo sapiens
ggaggaatactg

SEQ ID NO: 1036326 - DNA, 16 bp, Homo sapiens
ggaggaatttactttc

SEQ ID NO: 1036327 - DNA, 19 bp, Homo sapiens
ggaggaatttactttcttc

SEQ ID NO: 1036328 - DNA, 15 bp, Homo sapiens
ggaggacaagcaata

SEQ ID NO: 1036329 - DNA, 21 bp, Homo sapiens
ggaggacacagcacaagggca

SEQ ID NO: 1036330 - DNA, 15 bp, Homo sapiens
ggaggacaggcaggc

SEQ ID NO: 1036331 - DNA, 23 bp, Homo sapiens
ggaggacatgcgtgtgtcaggga

SEQ ID NO: 1036332 - DNA, 12 bp, Homo sapiens
ggaggacccagg

SEQ ID NO: 1036333 - DNA, 15 bp, Homo sapiens
ggaggacccaggaca

SEQ ID NO: 1036334 - DNA, 16 bp, Homo sapiens
ggaggacccaggacag

SEQ ID NO: 1036335 - DNA, 23 bp, Homo sapiens
ggaggaccccgagggctgaggag

SEQ ID NO: 1036336 - DNA, 16 bp, Homo sapiens
ggaggacccctgcctt

SEQ ID NO: 1036337 - DNA, 18 bp, Homo sapiens
ggaggactgagcccccac

SEQ ID NO: 1036338 - DNA, 20 bp, Homo sapiens
ggaggagagccactgggccc

SEQ ID NO: 1036339 - DNA, 14 bp, Homo sapiens
ggaggagcagcctc

SEQ ID NO: 1036340 - DNA, 14 bp, Homo sapiens
ggaggagccttgct

SEQ ID NO: 1036341 - DNA, 22 bp, Homo sapiens
ggaggagccttgctgggccagg

SEQ ID NO: 1036342 - DNA, 21 bp, Homo sapiens
ggaggagctgagggagggagc

SEQ ID NO: 1036343 - DNA, 21 bp, Homo sapiens
ggaggagctgcctcttctctt

SEQ ID NO: 1036344 - DNA, 16 bp, Homo sapiens
ggaggagctgggccag

SEQ ID NO: 1036345 - DNA, 21 bp, Homo sapiens
ggaggaggaacgggcagccac

SEQ ID NO: 1036346 - DNA, 12 bp, Homo sapiens
ggaggaggacac

SEQ ID NO: 1036347 - DNA, 15 bp, Homo sapiens
ggaggaggagccttg

SEQ ID NO: 1036348 - DNA, 14 bp, Homo sapiens
ggaggaggaggagc

SEQ ID NO: 1036349 - DNA, 13 bp, Homo sapiens
ggaggaggccacc

SEQ ID NO: 1036350 - DNA, 14 bp, Homo sapiens
ggaggaggccacct

SEQ ID NO: 1036351 - DNA, 15 bp, Homo sapiens
ggaggaggctgccct

SEQ ID NO: 1036352 - DNA, 13 bp, Homo sapiens
ggaggaggggaag

SEQ ID NO: 1036353 - DNA, 20 bp, Homo sapiens
ggaggaggtggcttcatgtg

SEQ ID NO: 1036354 - DNA, 20 bp, Homo sapiens
ggaggagtcaggggctctgt

SEQ ID NO: 1036355 - DNA, 17 bp, Homo sapiens
ggaggatacagaggaga

SEQ ID NO: 1036356 - DNA, 21 bp, Homo sapiens
ggaggatcactggagcccagg

SEQ ID NO: 1036357 - DNA, 17 bp, Homo sapiens
ggaggatctcttgagcc

SEQ ID NO: 1036358 - DNA, 13 bp, Homo sapiens
ggaggatggagag

SEQ ID NO: 1036359 - DNA, 21 bp, Homo sapiens
ggaggatggagagaggggaat

SEQ ID NO: 1036360 - DNA, 20 bp, Homo sapiens
ggaggatgtccctgggccag

SEQ ID NO: 1036361 - DNA, 15 bp, Homo sapiens
ggaggatgtgggcag

SEQ ID NO: 1036362 - DNA, 15 bp, Homo sapiens
ggaggattgccttta

SEQ ID NO: 1036363 - DNA, 22 bp, Homo sapiens
ggaggcaaaatgtgttgaagtg

SEQ ID NO: 1036364 - DNA, 19 bp, Homo sapiens
ggaggcaagaaaaggacaa

SEQ ID NO: 1036365 - DNA, 20 bp, Homo sapiens
ggaggcaagaaaaggacaaa

SEQ ID NO: 1036366 - DNA, 15 bp, Homo sapiens
ggaggcaagagggag

SEQ ID NO: 1036367 - DNA, 16 bp, Homo sapiens
ggaggcaagagggagg

SEQ ID NO: 1036368 - DNA, 14 bp, Homo sapiens
ggaggcaagccctg

SEQ ID NO: 1036369 - DNA, 22 bp, Homo sapiens
ggaggcaccagctctgtggcct

SEQ ID NO: 1036370 - DNA, 14 bp, Homo sapiens
ggaggcacctccag

SEQ ID NO: 1036371 - DNA, 15 bp, Homo sapiens
ggaggcacctccagg

SEQ ID NO: 1036372 - DNA, 16 bp, Homo sapiens
ggaggcacctccaggc

SEQ ID NO: 1036373 - DNA, 23 bp, Homo sapiens
ggaggcagaaacctatctcaggg

SEQ ID NO: 1036374 - DNA, 17 bp, Homo sapiens
ggaggcagagaggagtg

SEQ ID NO: 1036375 - DNA, 21 bp, Homo sapiens
ggaggcagagcgggagggagt

SEQ ID NO: 1036376 - DNA, 12 bp, Homo sapiens
ggaggcagagtt

SEQ ID NO: 1036377 - DNA, 14 bp, Homo sapiens
ggaggcagcagagc

SEQ ID NO: 1036378 - DNA, 19 bp, Homo sapiens
ggaggcagcgtgggctctg

SEQ ID NO: 1036379 - DNA, 15 bp, Homo sapiens
ggaggcaggagcatg

SEQ ID NO: 1036380 - DNA, 19 bp, Homo sapiens
ggaggcagggccttgccca

SEQ ID NO: 1036381 - DNA, 12 bp, Homo sapiens
ggaggcagggct

SEQ ID NO: 1036382 - DNA, 13 bp, Homo sapiens
ggaggcagggctc

SEQ ID NO: 1036383 - DNA, 13 bp, Homo sapiens
ggaggcagtggct

SEQ ID NO: 1036384 - DNA, 16 bp, Homo sapiens
ggaggcatcagtgtcc

SEQ ID NO: 1036385 - DNA, 15 bp, Homo sapiens
ggaggccaaccagcc

SEQ ID NO: 1036386 - DNA, 22 bp, Homo sapiens
ggaggccaagcagtgcctgcct

SEQ ID NO: 1036387 - DNA, 13 bp, Homo sapiens
ggaggccaaggca

SEQ ID NO: 1036388 - DNA, 15 bp, Homo sapiens
ggaggccaaggcagg

SEQ ID NO: 1036389 - DNA, 18 bp, Homo sapiens
ggaggccaaggcaggtag

SEQ ID NO: 1036390 - DNA, 18 bp, Homo sapiens
ggaggccaagtgcaggct

SEQ ID NO: 1036391 - DNA, 19 bp, Homo sapiens
ggaggccacctctccaagg

SEQ ID NO: 1036392 - DNA, 17 bp, Homo sapiens
ggaggccattgtgtgag

SEQ ID NO: 1036393 - DNA, 18 bp, Homo sapiens
ggaggccccccgtgtgga

SEQ ID NO: 1036394 - DNA, 15 bp, Homo sapiens
ggaggcccctggagc

SEQ ID NO: 1036395 - DNA, 16 bp, Homo sapiens
ggaggcccctggccca

SEQ ID NO: 1036396 - DNA, 19 bp, Homo sapiens
ggaggcccctggcccagcg

SEQ ID NO: 1036397 - DNA, 22 bp, Homo sapiens
ggaggcccctggcccagcggcc

SEQ ID NO: 1036398 - DNA, 16 bp, Homo sapiens
ggaggccctcctgtgc

SEQ ID NO: 1036399 - DNA, 14 bp, Homo sapiens
ggaggccctgcctg

SEQ ID NO: 1036400 - DNA, 22 bp, Homo sapiens
ggaggccctgcctgacccatcc

SEQ ID NO: 1036401 - DNA, 21 bp, Homo sapiens
ggaggccctggtgtcaggcag

SEQ ID NO: 1036402 - DNA, 19 bp, Homo sapiens
ggaggcccttgtcgtggga

SEQ ID NO: 1036403 - DNA, 20 bp, Homo sapiens
ggaggccgacgttttctccg

SEQ ID NO: 1036404 - DNA, 18 bp, Homo sapiens
ggaggccgaggtgggcag

SEQ ID NO: 1036405 - DNA, 15 bp, Homo sapiens
ggaggcctcaggtgc

SEQ ID NO: 1036406 - DNA, 14 bp, Homo sapiens
ggaggcctctggcc

SEQ ID NO: 1036407 - DNA, 19 bp, Homo sapiens
ggaggccttccagctgctg

SEQ ID NO: 1036408 - DNA, 21 bp, Homo sapiens
ggaggccttccagctgctgtc

SEQ ID NO: 1036409 - DNA, 19 bp, Homo sapiens
ggaggccttggggtggggg

SEQ ID NO: 1036410 - DNA, 17 bp, Homo sapiens
ggaggcgcagggacatg

SEQ ID NO: 1036411 - DNA, 21 bp, Homo sapiens
ggaggcgcagggacatggggc

SEQ ID NO: 1036412 - DNA, 12 bp, Homo sapiens
ggaggcggagag

SEQ ID NO: 1036413 - DNA, 20 bp, Homo sapiens
ggaggcggagcttgcagtga

SEQ ID NO: 1036414 - DNA, 23 bp, Homo sapiens
ggaggcggcagctcttctgggca

SEQ ID NO: 1036415 - DNA, 18 bp, Homo sapiens
ggaggcgtctcgggagag

SEQ ID NO: 1036416 - DNA, 17 bp, Homo sapiens
ggaggcgtggaggagag

SEQ ID NO: 1036417 - DNA, 20 bp, Homo sapiens
ggaggcgtggagggtgacca

SEQ ID NO: 1036418 - DNA, 19 bp, Homo sapiens
ggaggctacctcacctggg

SEQ ID NO: 1036419 - DNA, 21 bp, Homo sapiens
ggaggctcacccccttctcca

SEQ ID NO: 1036420 - DNA, 15 bp, Homo sapiens
ggaggctcagcccac

SEQ ID NO: 1036421 - DNA, 15 bp, Homo sapiens
ggaggctccagaggg

SEQ ID NO: 1036422 - DNA, 20 bp, Homo sapiens
ggaggctcggccgtgggccg

SEQ ID NO: 1036423 - DNA, 14 bp, Homo sapiens
ggaggctgagacag

SEQ ID NO: 1036424 - DNA, 19 bp, Homo sapiens
ggaggctgagacaggagaa

SEQ ID NO: 1036425 - DNA, 12 bp, Homo sapiens
ggaggctgaggc

SEQ ID NO: 1036426 - DNA, 15 bp, Homo sapiens
ggaggctgaggcaga

SEQ ID NO: 1036427 - DNA, 13 bp, Homo sapiens
ggaggctgaggcg

SEQ ID NO: 1036428 - DNA, 23 bp, Homo sapiens
ggaggctgcactggagccacagg

SEQ ID NO: 1036429 - DNA, 13 bp, Homo sapiens
ggaggctgcagag

SEQ ID NO: 1036430 - DNA, 18 bp, Homo sapiens
ggaggctgcatgctctgg

SEQ ID NO: 1036431 - DNA, 19 bp, Homo sapiens
ggaggctgcatgctctgga

SEQ ID NO: 1036432 - DNA, 22 bp, Homo sapiens
ggaggctgcatgctctggaagc

SEQ ID NO: 1036433 - DNA, 14 bp, Homo sapiens
ggaggctgccctga

SEQ ID NO: 1036434 - DNA, 18 bp, Homo sapiens
ggaggctgccctgagggg

SEQ ID NO: 1036435 - DNA, 20 bp, Homo sapiens
ggaggctgccctgaggggct

SEQ ID NO: 1036436 - DNA, 20 bp, Homo sapiens
ggaggctggccaaggtgtcc

SEQ ID NO: 1036437 - DNA, 20 bp, Homo sapiens
ggaggctttaagctccagct

SEQ ID NO: 1036438 - DNA, 21 bp, Homo sapiens
ggaggctttgggtggctcact

SEQ ID NO: 1036439 - DNA, 15 bp, Homo sapiens
ggaggcttttcactg

SEQ ID NO: 1036440 - DNA, 19 bp, Homo sapiens
ggagggaagagtggaggtg

SEQ ID NO: 1036441 - DNA, 18 bp, Homo sapiens
ggagggaagggccaccct

SEQ ID NO: 1036442 - DNA, 15 bp, Homo sapiens
ggagggaaggggatg

SEQ ID NO: 1036443 - DNA, 15 bp, Homo sapiens
ggagggaattgaggt

SEQ ID NO: 1036444 - DNA, 19 bp, Homo sapiens
ggagggaattgaggtctgc

SEQ ID NO: 1036445 - DNA, 17 bp, Homo sapiens
ggagggacagggcaggc

SEQ ID NO: 1036446 - DNA, 19 bp, Homo sapiens
ggagggacgcggaggagga

SEQ ID NO: 1036447 - DNA, 16 bp, Homo sapiens
ggagggagcagacagg

SEQ ID NO: 1036448 - DNA, 12 bp, Homo sapiens
ggagggaggcac

SEQ ID NO: 1036449 - DNA, 14 bp, Homo sapiens
ggagggaggcgggg

SEQ ID NO: 1036450 - DNA, 19 bp, Homo sapiens
ggagggaggctgggcgggt

SEQ ID NO: 1036451 - DNA, 13 bp, Homo sapiens
ggagggagtccca

SEQ ID NO: 1036452 - DNA, 18 bp, Homo sapiens
ggagactccaaggagcta

SEQ ID NO: 1036453 - DNA, 21 bp, Homo sapiens
ggagactccatgagaagccgt

SEQ ID NO: 1036454 - DNA, 16 bp, Homo sapiens
ggagactcctggtctg

SEQ ID NO: 1036455 - DNA, 12 bp, Homo sapiens
ggagactgagat

SEQ ID NO: 1036456 - DNA, 15 bp, Homo sapiens
ggagactgcccagct

SEQ ID NO: 1036457 - DNA, 18 bp, Homo sapiens
ggagactgcttcccatcc

SEQ ID NO: 1036458 - DNA, 23 bp, Homo sapiens
ggagactgcttcccatcctaccc

SEQ ID NO: 1036459 - DNA, 23 bp, Homo sapiens
ggagactgggctgagggagcctg

SEQ ID NO: 1036460 - DNA, 22 bp, Homo sapiens
ggagacttagggcaccaggggt

SEQ ID NO: 1036461 - DNA, 17 bp, Homo sapiens
ggagacttggggccagc

SEQ ID NO: 1036462 - DNA, 22 bp, Homo sapiens
ggagacttggggccagcgcttc

SEQ ID NO: 1036463 - DNA, 22 bp, Homo sapiens
ggagactttgctgttactgctt

SEQ ID NO: 1036464 - DNA, 12 bp, Homo sapiens
ggagagaaaaaa

SEQ ID NO: 1036465 - DNA, 21 bp, Homo sapiens
ggagagacaggcagcccagca

SEQ ID NO: 1036466 - DNA, 14 bp, Homo sapiens
ggagagagaggctg

SEQ ID NO: 1036467 - DNA, 12 bp, Homo sapiens
ggagagagccag

SEQ ID NO: 1036468 - DNA, 14 bp, Homo sapiens
ggagagagccagga

SEQ ID NO: 1036469 - DNA, 12 bp, Homo sapiens
ggagagagggga

SEQ ID NO: 1036470 - DNA, 17 bp, Homo sapiens
ggagagcaaaggcccat

SEQ ID NO: 1036471 - DNA, 22 bp, Homo sapiens
ggagagcaaaggcccatgcccc

SEQ ID NO: 1036472 - DNA, 16 bp, Homo sapiens
ggagagcactgcctct

SEQ ID NO: 1036473 - DNA, 18 bp, Homo sapiens
ggagagcagcaggtgctg

SEQ ID NO: 1036474 - DNA, 15 bp, Homo sapiens
ggagagcagctggct

SEQ ID NO: 1036475 - DNA, 21 bp, Homo sapiens
ggagagccactgggcccctgt

SEQ ID NO: 1036476 - DNA, 11 bp, Homo sapiens
ggagagccagc

SEQ ID NO: 1036477 - DNA, 18 bp, Homo sapiens
ggagagccagccctccct

SEQ ID NO: 1036478 - DNA, 15 bp, Homo sapiens
ggagagccagctctc

SEQ ID NO: 1036479 - DNA, 21 bp, Homo sapiens
ggagagccatacataaaagaa

SEQ ID NO: 1036480 - DNA, 13 bp, Homo sapiens
ggagagcccccac

SEQ ID NO: 1036481 - DNA, 13 bp, Homo sapiens
ggagagcctgctg

SEQ ID NO: 1036482 - DNA, 20 bp, Homo sapiens
ggagagcgcctcttcctctg

SEQ ID NO: 1036483 - DNA, 23 bp, Homo sapiens
ggagagcgcctcttcctctgggc

SEQ ID NO: 1036484 - DNA, 17 bp, Homo sapiens
ggagagcggaggaggaa

SEQ ID NO: 1036485 - DNA, 15 bp, Homo sapiens
ggagagctggtgact

SEQ ID NO: 1036486 - DNA, 15 bp, Homo sapiens
ggagagctggtgccc

SEQ ID NO: 1036487 - DNA, 23 bp, Homo sapiens
ggagagcttgtcattgagcctgg

SEQ ID NO: 1036488 - DNA, 17 bp, Homo sapiens
ggagaggaaaagtaagg

SEQ ID NO: 1036489 - DNA, 17 bp, Homo sapiens
ggagaggaaaatgtttc

SEQ ID NO: 1036490 - DNA, 10 bp, Homo sapiens
ctctgcacaa

SEQ ID NO: 1036491 - DNA, 17 bp, Homo sapiens
ctctgcacaagctgcac

SEQ ID NO: 1036492 - DNA, 20 bp, Homo sapiens
ctctgcacaagctgcaccct

SEQ ID NO: 1036493 - DNA, 20 bp, Homo sapiens
ctctgcacaccctccagaga

SEQ ID NO: 1036494 - DNA, 22 bp, Homo sapiens
ctctgcacagaaacttgaactc

SEQ ID NO: 1036495 - DNA, 14 bp, Homo sapiens
ctctgcacccagaa

SEQ ID NO: 1036496 - DNA, 15 bp, Homo sapiens
ctctgcactactcct

SEQ ID NO: 1036497 - DNA, 23 bp, Homo sapiens
ctctgcactactcctctgcagtg

SEQ ID NO: 1036498 - DNA, 20 bp, Homo sapiens
ctctgcactactgacatgtg

SEQ ID NO: 1036499 - DNA, 13 bp, Homo sapiens
ctctgcactccat

SEQ ID NO: 1036500 - DNA, 19 bp, Homo sapiens
ctctgcactccatggccac

SEQ ID NO: 1036501 - DNA, 13 bp, Homo sapiens
ctctgcagatgtg

SEQ ID NO: 1036502 - DNA, 18 bp, Homo sapiens
ctctgcagcaataaagca

SEQ ID NO: 1036503 - DNA, 13 bp, Homo sapiens
ctctgcagccagc

SEQ ID NO: 1036504 - DNA, 15 bp, Homo sapiens
ctctgcagccagccc

SEQ ID NO: 1036505 - DNA, 16 bp, Homo sapiens
ctctgcagccagccca

SEQ ID NO: 1036506 - DNA, 17 bp, Homo sapiens
ctctgcagccagcccag

SEQ ID NO: 1036507 - DNA, 18 bp, Homo sapiens
ctctgcagccagcccagc

SEQ ID NO: 1036508 - DNA, 19 bp, Homo sapiens
ctctgcagccagcccagcc

SEQ ID NO: 1036509 - DNA, 21 bp, Homo sapiens
ctctgcagcccagcctagtca

SEQ ID NO: 1036510 - DNA, 16 bp, Homo sapiens
ctctgcagctgacctc

SEQ ID NO: 1036511 - DNA, 14 bp, Homo sapiens
ctctgcaggctggg

SEQ ID NO: 1036512 - DNA, 15 bp, Homo sapiens
ctctgcaggctgggg

SEQ ID NO: 1036513 - DNA, 13 bp, Homo sapiens
ctctgcatcccag

SEQ ID NO: 1036514 - DNA, 22 bp, Homo sapiens
ctctgcatcccagcacctgcct

SEQ ID NO: 1036515 - DNA, 19 bp, Homo sapiens
ctctgcatctactcccaag

SEQ ID NO: 1036516 - DNA, 22 bp, Homo sapiens
ctctgcatctactcccaagtat

SEQ ID NO: 1036517 - DNA, 14 bp, Homo sapiens
ctctgcatctgacc

SEQ ID NO: 1036518 - DNA, 23 bp, Homo sapiens
ctctgcattgagcatattttctt

SEQ ID NO: 1036519 - DNA, 14 bp, Homo sapiens
ctctgccaaaggat

SEQ ID NO: 1036520 - DNA, 19 bp, Homo sapiens
ctctgccaaaggatgtgat

SEQ ID NO: 1036521 - DNA, 16 bp, Homo sapiens
ctctgccacccactca

SEQ ID NO: 1036522 - DNA, 18 bp, Homo sapiens
ctctgccacccactcagg

SEQ ID NO: 1036523 - DNA, 17 bp, Homo sapiens
ctctgccaccctacctg

SEQ ID NO: 1036524 - DNA, 22 bp, Homo sapiens
ctctgccaccctacctgttcag

SEQ ID NO: 1036525 - DNA, 20 bp, Homo sapiens
ctctgccagtgacagacagg

SEQ ID NO: 1036526 - DNA, 16 bp, Homo sapiens
ctctgccatcttcagg

SEQ ID NO: 1036527 - DNA, 24 bp, Homo sapiens
ctctgcccaagcagcctggagact

SEQ ID NO: 1036528 - DNA, 17 bp, Homo sapiens
ctctgcccaccctcctg

SEQ ID NO: 1036529 - DNA, 15 bp, Homo sapiens
ctctgcccacctctc

SEQ ID NO: 1036530 - DNA, 16 bp, Homo sapiens
ctctgcccacctctct

SEQ ID NO: 1036531 - DNA, 16 bp, Homo sapiens
ctctgcccacctgggg

SEQ ID NO: 1036532 - DNA, 14 bp, Homo sapiens
ctctgcccagcttg

SEQ ID NO: 1036533 - DNA, 17 bp, Homo sapiens
ctctgcccagcttgggc

SEQ ID NO: 1036534 - DNA, 14 bp, Homo sapiens
ctctgccccaagca

SEQ ID NO: 1036535 - DNA, 24 bp, Homo sapiens
ctctgccccaagcagccagccagt

SEQ ID NO: 1036536 - DNA, 12 bp, Homo sapiens
ctctgccccaat

SEQ ID NO: 1036537 - DNA, 21 bp, Homo sapiens
ctctgccccaatcgggtccag

SEQ ID NO: 1036538 - DNA, 21 bp, Homo sapiens
ctctgccccaccttgccaggg

SEQ ID NO: 1036539 - DNA, 22 bp, Homo sapiens
ctctgccccaccttgccagggc

SEQ ID NO: 1036540 - DNA, 19 bp, Homo sapiens
ctctgccccacgctgtggc

SEQ ID NO: 1036541 - DNA, 20 bp, Homo sapiens
ctctgccccacgctgtggcc

SEQ ID NO: 1036542 - DNA, 11 bp, Homo sapiens
ctctgccccag

SEQ ID NO: 1036543 - DNA, 12 bp, Homo sapiens
ctctgccccagc

SEQ ID NO: 1036544 - DNA, 13 bp, Homo sapiens
ctctgccccagtc

SEQ ID NO: 1036545 - DNA, 21 bp, Homo sapiens
ctctgccccatcctccagcag

SEQ ID NO: 1036546 - DNA, 21 bp, Homo sapiens
ctctgcccccatttccccgat

SEQ ID NO: 1036547 - DNA, 18 bp, Homo sapiens
ctctgccccctcccccat

SEQ ID NO: 1036548 - DNA, 14 bp, Homo sapiens
ctctgcccctcagg

SEQ ID NO: 1036549 - DNA, 15 bp, Homo sapiens
ctctgcccctcaggg

SEQ ID NO: 1036550 - DNA, 11 bp, Homo sapiens
ctctgcccctg

SEQ ID NO: 1036551 - DNA, 20 bp, Homo sapiens
ctctgcccctggacctggga

SEQ ID NO: 1036552 - DNA, 13 bp, Homo sapiens
ctctgccctgcct

SEQ ID NO: 1036553 - DNA, 14 bp, Homo sapiens
ctctgccctgcctc

SEQ ID NO: 1036554 - DNA, 17 bp, Homo sapiens
ctctgccctgcctccct

SEQ ID NO: 1036555 - DNA, 18 bp, Homo sapiens
ctctgccctgcctccctt

SEQ ID NO: 1036556 - DNA, 19 bp, Homo sapiens
ctctgcccttgttccctag

SEQ ID NO: 1036557 - DNA, 20 bp, Homo sapiens
ctctgccgcaatacaggaac

SEQ ID NO: 1036558 - DNA, 21 bp, Homo sapiens
ctctgccgcaatacaggaacc

SEQ ID NO: 1036559 - DNA, 14 bp, Homo sapiens
ctctgccgctacct

SEQ ID NO: 1036560 - DNA, 19 bp, Homo sapiens
ctctgccgctacctccctc

SEQ ID NO: 1036561 - DNA, 13 bp, Homo sapiens
ctctgccggctct

SEQ ID NO: 1036562 - DNA, 15 bp, Homo sapiens
ctctgccggctcttt

SEQ ID NO: 1036563 - DNA, 20 bp, Homo sapiens
ctctgccggtcgggcagcca

SEQ ID NO: 1036564 - DNA, 21 bp, Homo sapiens
ctctgccggtcgggcagccag

SEQ ID NO: 1036565 - DNA, 22 bp, Homo sapiens
ctctgccggtcgggcagccagc

SEQ ID NO: 1036566 - DNA, 16 bp, Homo sapiens
ctctgccgtctctgga

SEQ ID NO: 1036567 - DNA, 15 bp, Homo sapiens
ctctgcctacagaac

SEQ ID NO: 1036568 - DNA, 14 bp, Homo sapiens
ctctgcctacagcc

SEQ ID NO: 1036569 - DNA, 12 bp, Homo sapiens
ctctgcctcaga

SEQ ID NO: 1036570 - DNA, 13 bp, Homo sapiens
ctctgcctccctc

SEQ ID NO: 1036571 - DNA, 20 bp, Homo sapiens
ctctgcctccctcaccctga

SEQ ID NO: 1036572 - DNA, 14 bp, Homo sapiens
ctctgcctccctct

SEQ ID NO: 1036573 - DNA, 12 bp, Homo sapiens
ctctgcctcctc

SEQ ID NO: 1036574 - DNA, 12 bp, Homo sapiens
ggagcagctggg

SEQ ID NO: 1036575 - DNA, 11 bp, Homo sapiens
ggagcagcttc

SEQ ID NO: 1036576 - DNA, 23 bp, Homo sapiens
ggagcagcttccttctgggactg

SEQ ID NO: 1036577 - DNA, 20 bp, Homo sapiens
ggagcaggaggccaataaaa

SEQ ID NO: 1036578 - DNA, 16 bp, Homo sapiens
ggagcaggcacgggtg

SEQ ID NO: 1036579 - DNA, 16 bp, Homo sapiens
ggagcagggaaggcct

SEQ ID NO: 1036580 - DNA, 22 bp, Homo sapiens
ggagcagggcggctgccgactc

SEQ ID NO: 1036581 - DNA, 13 bp, Homo sapiens
ggagcagtgtctt

SEQ ID NO: 1036582 - DNA, 17 bp, Homo sapiens
ggagcagttttcccctg

SEQ ID NO: 1036583 - DNA, 22 bp, Homo sapiens
ggagcagttttcccctggcctc

SEQ ID NO: 1036584 - DNA, 17 bp, Homo sapiens
ggagcatcagccagtga

SEQ ID NO: 1036585 - DNA, 15 bp, Homo sapiens
ggagcatcccaggcg

SEQ ID NO: 1036586 - DNA, 20 bp, Homo sapiens
ggagcatctcttgaggccag

SEQ ID NO: 1036587 - DNA, 14 bp, Homo sapiens
ggagcatctgactc

SEQ ID NO: 1036588 - DNA, 22 bp, Homo sapiens
ggagcatgcttaccttctgctg

SEQ ID NO: 1036589 - DNA, 20 bp, Homo sapiens
ggagcatgtatgtctgcagg

SEQ ID NO: 1036590 - DNA, 16 bp, Homo sapiens
ggagcattggcccctg

SEQ ID NO: 1036591 - DNA, 22 bp, Homo sapiens
ggagcattggcccctgagccca

SEQ ID NO: 1036592 - DNA, 15 bp, Homo sapiens
ggagcattgggacct

SEQ ID NO: 1036593 - DNA, 20 bp, Homo sapiens
ggagccaacagaagcttcca

SEQ ID NO: 1036594 - DNA, 23 bp, Homo sapiens
ggagccaagggttcagagactca

SEQ ID NO: 1036595 - DNA, 22 bp, Homo sapiens
ggagccacgcctatgccctgcc

SEQ ID NO: 1036596 - DNA, 11 bp, Homo sapiens
ggagccactcc

SEQ ID NO: 1036597 - DNA, 19 bp, Homo sapiens
ggagccactcctctgactc

SEQ ID NO: 1036598 - DNA, 18 bp, Homo sapiens
ggagccactcctgtcccg

SEQ ID NO: 1036599 - DNA, 20 bp, Homo sapiens
ggagccactcctgtcccgcc

SEQ ID NO: 1036600 - DNA, 18 bp, Homo sapiens
ggagccagaaatgggcag

SEQ ID NO: 1036601 - DNA, 20 bp, Homo sapiens
ggagccagaaatgggcagtt

SEQ ID NO: 1036602 - DNA, 21 bp, Homo sapiens
ggagccagaattcactaggag

SEQ ID NO: 1036603 - DNA, 11 bp, Homo sapiens
ggagccagctg

SEQ ID NO: 1036604 - DNA, 12 bp, Homo sapiens
ggagccagctgc

SEQ ID NO: 1036605 - DNA, 15 bp, Homo sapiens
ggagccagctgcttg

SEQ ID NO: 1036606 - DNA, 13 bp, Homo sapiens
ggagccagggcct

SEQ ID NO: 1036607 - DNA, 15 bp, Homo sapiens
ggagcccacaacctt

SEQ ID NO: 1036608 - DNA, 13 bp, Homo sapiens
ggagcccacagcg

SEQ ID NO: 1036609 - DNA, 17 bp, Homo sapiens
ggagcccacagcgagcc

SEQ ID NO: 1036610 - DNA, 19 bp, Homo sapiens
ggagcccacagcgagcctg

SEQ ID NO: 1036611 - DNA, 14 bp, Homo sapiens
ggagcccagccaga

SEQ ID NO: 1036612 - DNA, 16 bp, Homo sapiens
ggagcccagccctccc

SEQ ID NO: 1036613 - DNA, 16 bp, Homo sapiens
ggagcccagctctgaa

SEQ ID NO: 1036614 - DNA, 12 bp, Homo sapiens
ggagcccagtga

SEQ ID NO: 1036615 - DNA, 20 bp, Homo sapiens
ggagcccagtgaagcctctg

SEQ ID NO: 1036616 - DNA, 16 bp, Homo sapiens
ggagcccagtgggctg

SEQ ID NO: 1036617 - DNA, 17 bp, Homo sapiens
ggagcccagtgggctgc

SEQ ID NO: 1036618 - DNA, 16 bp, Homo sapiens
ggaagtgtaacagctg

SEQ ID NO: 1036619 - DNA, 15 bp, Homo sapiens
ggaagtgtggaaaaa

SEQ ID NO: 1036620 - DNA, 16 bp, Homo sapiens
ggaagtgttcaagaaa

SEQ ID NO: 1036621 - DNA, 19 bp, Homo sapiens
ggaagttcagaaggtgtgt

SEQ ID NO: 1036622 - DNA, 20 bp, Homo sapiens
ggaagttcttcaagaggaaa

SEQ ID NO: 1036623 - DNA, 16 bp, Homo sapiens
ggaagttgtggatatc

SEQ ID NO: 1036624 - DNA, 23 bp, Homo sapiens
ggaagttgtggatatcagggtat

SEQ ID NO: 1036625 - DNA, 14 bp, Homo sapiens
ggaagttttcaatg

SEQ ID NO: 1036626 - DNA, 17 bp, Homo sapiens
ggaataaaaggcttgaa

SEQ ID NO: 1036627 - DNA, 18 bp, Homo sapiens
ggaataaaaggcttgaag

SEQ ID NO: 1036628 - DNA, 21 bp, Homo sapiens
ggaataaaatataaaactgaa

SEQ ID NO: 1036629 - DNA, 21 bp, Homo sapiens
ggaataaacagtgagcatatc

SEQ ID NO: 1036630 - DNA, 18 bp, Homo sapiens
ggaataaagttgcagatg

SEQ ID NO: 1036631 - DNA, 12 bp, Homo sapiens
ggaataaatcct

SEQ ID NO: 1036632 - DNA, 23 bp, Homo sapiens
ggaataactcttacagctttgcc

SEQ ID NO: 1036633 - DNA, 17 bp, Homo sapiens
ggaataagacagagacc

SEQ ID NO: 1036634 - DNA, 18 bp, Homo sapiens
ggaataaggcccagagcg

SEQ ID NO: 1036635 - DNA, 13 bp, Homo sapiens
ggaataataccta

SEQ ID NO: 1036636 - DNA, 21 bp, Homo sapiens
ggaataattatttatttaata

SEQ ID NO: 1036637 - DNA, 13 bp, Homo sapiens
ggaatacatttta

SEQ ID NO: 1036638 - DNA, 16 bp, Homo sapiens
ggaatactcacatttt

SEQ ID NO: 1036639 - DNA, 17 bp, Homo sapiens
ggaatactcacattttg

SEQ ID NO: 1036640 - DNA, 17 bp, Homo sapiens
ggaatactttttgttat

SEQ ID NO: 1036641 - DNA, 14 bp, Homo sapiens
ggaatagagcctcg

SEQ ID NO: 1036642 - DNA, 14 bp, Homo sapiens
ggaatagccagaga

SEQ ID NO: 1036643 - DNA, 21 bp, Homo sapiens
ggaatagccagagaggagcac

SEQ ID NO: 1036644 - DNA, 15 bp, Homo sapiens
ggaatataaaacagt

SEQ ID NO: 1036645 - DNA, 16 bp, Homo sapiens
ggaatataaatagctg

SEQ ID NO: 1036646 - DNA, 16 bp, Homo sapiens
ggaatatataaccagt

SEQ ID NO: 1036647 - DNA, 22 bp, Homo sapiens
ggaatatatcagtacctctcaa

SEQ ID NO: 1036648 - DNA, 15 bp, Homo sapiens
ggaatatttataaat

SEQ ID NO: 1036649 - DNA, 19 bp, Homo sapiens
ggaatatttataggccagg

SEQ ID NO: 1036650 - DNA, 21 bp, Homo sapiens
ggaatattttatcctgtattc

SEQ ID NO: 1036651 - DNA, 20 bp, Homo sapiens
ggaatcagtatttccttcca

SEQ ID NO: 1036652 - DNA, 21 bp, Homo sapiens
ggaatcatactgcctactgtt

SEQ ID NO: 1036653 - DNA, 23 bp, Homo sapiens
ggaatcattaatttcaaaattta

SEQ ID NO: 1036654 - DNA, 20 bp, Homo sapiens
ggaatccaaaagacaaaaat

SEQ ID NO: 1036655 - DNA, 20 bp, Homo sapiens
ggaatccaagcctccacagc

SEQ ID NO: 1036656 - DNA, 23 bp, Homo sapiens
ggaatccagctccctagactgca

SEQ ID NO: 1036657 - DNA, 17 bp, Homo sapiens
ggaatcccttgtatatg

SEQ ID NO: 1036658 - DNA, 16 bp, Homo sapiens
ggaatcctcctccagg

SEQ ID NO: 1036659 - DNA, 13 bp, Homo sapiens
ggaatcctggcag

SEQ ID NO: 1036660 - DNA, 21 bp, Homo sapiens
ggaatcctggcagcccagaga

SEQ ID NO: 1036661 - DNA, 21 bp, Homo sapiens
ggaatctagccgatggaaaat

SEQ ID NO: 1036662 - DNA, 15 bp, Homo sapiens
ggaatctgccttcca

SEQ ID NO: 1036663 - DNA, 16 bp, Homo sapiens
ggaatctgtttctctg

SEQ ID NO: 1036664 - DNA, 17 bp, Homo sapiens
ggaatctgtttctctgc

SEQ ID NO: 1036665 - DNA, 16 bp, Homo sapiens
ggaatcttcacctcag

SEQ ID NO: 1036666 - DNA, 14 bp, Homo sapiens
ggaatcttgctgca

SEQ ID NO: 1036667 - DNA, 13 bp, Homo sapiens
ggaatgagcccag

SEQ ID NO: 1036668 - DNA, 20 bp, Homo sapiens
ggaatgagcccagagaacag

SEQ ID NO: 1036669 - DNA, 21 bp, Homo sapiens
ggaatgaggtgggaggtggaa

SEQ ID NO: 1036670 - DNA, 15 bp, Homo sapiens
ggaatgagtgtgcat

SEQ ID NO: 1036671 - DNA, 13 bp, Homo sapiens
ggaatgcagaggt

SEQ ID NO: 1036672 - DNA, 13 bp, Homo sapiens
ggaatgcagcagg

SEQ ID NO: 1036673 - DNA, 21 bp, Homo sapiens
ggaatgcagggaagagggcag

SEQ ID NO: 1036674 - DNA, 16 bp, Homo sapiens
ggaatgcctgtgccaa

SEQ ID NO: 1036675 - DNA, 16 bp, Homo sapiens
ggaatgcggcaagaag

SEQ ID NO: 1036676 - DNA, 21 bp, Homo sapiens
ggaatgctcccagctgtgctg

SEQ ID NO: 1036677 - DNA, 22 bp, Homo sapiens
ggaatgctgggtatgctctgtg

SEQ ID NO: 1036678 - DNA, 23 bp, Homo sapiens
ggaatgctgggtatgctctgtga

SEQ ID NO: 1036679 - DNA, 14 bp, Homo sapiens
ggaatggaataact

SEQ ID NO: 1036680 - DNA, 17 bp, Homo sapiens
ggaatggaataactatc

SEQ ID NO: 1036681 - DNA, 17 bp, Homo sapiens
ggaatggaggggcagag

SEQ ID NO: 1036682 - DNA, 21 bp, Homo sapiens
ggaatggaggggcagagccag

SEQ ID NO: 1036683 - DNA, 16 bp, Homo sapiens
ggaatgggggcctctt

SEQ ID NO: 1036684 - DNA, 21 bp, Homo sapiens
ggaatggggggcgggccaggg

SEQ ID NO: 1036685 - DNA, 21 bp, Homo sapiens
ggaatgggtctgcacagattc

SEQ ID NO: 1036686 - DNA, 22 bp, Homo sapiens
ggaatggtaaccgagccagcag

SEQ ID NO: 1036687 - DNA, 18 bp, Homo sapiens
ggaatgtcagggccaggt

SEQ ID NO: 1036688 - DNA, 19 bp, Homo sapiens
ggaatgtcagggccaggtg

SEQ ID NO: 1036689 - DNA, 16 bp, Homo sapiens
ggaatgtgccacctgt

SEQ ID NO: 1036690 - DNA, 18 bp, Homo sapiens
ggaatgttccctgcaccc

SEQ ID NO: 1036691 - DNA, 18 bp, Homo sapiens
ggaatgtttttccctccc

SEQ ID NO: 1036692 - DNA, 20 bp, Homo sapiens
ggaatgtttttccctcccca

SEQ ID NO: 1036693 - DNA, 16 bp, Homo sapiens
ggaattaaaaagaaga

SEQ ID NO: 1036694 - DNA, 14 bp, Homo sapiens
ggaattaaatagtg

SEQ ID NO: 1036695 - DNA, 18 bp, Homo sapiens
ggaattaaccatttaata

SEQ ID NO: 1036696 - DNA, 22 bp, Homo sapiens
ggaattaagttatctttaaaat

SEQ ID NO: 1036697 - DNA, 13 bp, Homo sapiens
ggaattacatttt

SEQ ID NO: 1036698 - DNA, 19 bp, Homo sapiens
ggaattacgtgctctgtgg

SEQ ID NO: 1036699 - DNA, 14 bp, Homo sapiens
ggaattagagggcc

SEQ ID NO: 1036700 - DNA, 16 bp, Homo sapiens
ggaattattgtagaca

SEQ ID NO: 1036701 - DNA, 21 bp, Homo sapiens
ggaattattttgaatgtcaca

SEQ ID NO: 1036702 - DNA, 18 bp, Homo sapiens
ggaattcaccagtgttcc

SEQ ID NO: 1036703 - DNA, 15 bp, Homo sapiens
ggaattcagcaccct

SEQ ID NO: 1036704 - DNA, 20 bp, Homo sapiens
ggaattcagcaccctgggtg

SEQ ID NO: 1036705 - DNA, 22 bp, Homo sapiens
ggaattcagcaccctgggtgcc

SEQ ID NO: 1036706 - DNA, 17 bp, Homo sapiens
ggaattccaacttgaag

SEQ ID NO: 1036707 - DNA, 23 bp, Homo sapiens
ggaattccaacttgaaggattgc

SEQ ID NO: 1036708 - DNA, 15 bp, Homo sapiens
ggaattccctccccc

SEQ ID NO: 1036709 - DNA, 19 bp, Homo sapiens
ggaattcgtgttatgaatc

SEQ ID NO: 1036710 - DNA, 18 bp, Homo sapiens
ggaattctcaagacctga

SEQ ID NO: 1036711 - DNA, 16 bp, Homo sapiens
ggaattcttcctcctc

SEQ ID NO: 1036712 - DNA, 15 bp, Homo sapiens
ggaattgatttgcat

SEQ ID NO: 1036713 - DNA, 17 bp, Homo sapiens
ggaattggggagggaga

SEQ ID NO: 1036714 - DNA, 21 bp, Homo sapiens
ggaattggtggcagattttac

SEQ ID NO: 1036715 - DNA, 14 bp, Homo sapiens
ggaattggtgtata

SEQ ID NO: 1036716 - DNA, 23 bp, Homo sapiens
ggaattgtctttagtgccggctg

SEQ ID NO: 1036717 - DNA, 11 bp, Homo sapiens
ggaatttaaaa

SEQ ID NO: 1036718 - DNA, 20 bp, Homo sapiens
ggaatttccctgtgtggatg

SEQ ID NO: 1036719 - DNA, 21 bp, Homo sapiens
ggaatttccctgtgtggatgc

SEQ ID NO: 1036720 - DNA, 22 bp, Homo sapiens
ggaatttcttaacttcttgctt

SEQ ID NO: 1036721 - DNA, 20 bp, Homo sapiens
ggaatttgattgctttgctg

SEQ ID NO: 1036722 - DNA, 11 bp, Homo sapiens
ggaattttatt

SEQ ID NO: 1036723 - DNA, 13 bp, Homo sapiens
ggacaaaagggcc

SEQ ID NO: 1036724 - DNA, 15 bp, Homo sapiens
ggacaaaagggccag

SEQ ID NO: 1036725 - DNA, 17 bp, Homo sapiens
ggacaaaagggccaggt

SEQ ID NO: 1036726 - DNA, 13 bp, Homo sapiens
ggacaaacctaga

SEQ ID NO: 1036727 - DNA, 15 bp, Homo sapiens
ggacaacactgattc

SEQ ID NO: 1036728 - DNA, 14 bp, Homo sapiens
ggacaacagctctc

SEQ ID NO: 1036729 - DNA, 19 bp, Homo sapiens
ggacaacagtgctttgtaa

SEQ ID NO: 1036730 - DNA, 20 bp, Homo sapiens
ggacaacagtgctttgtaaa

SEQ ID NO: 1036731 - DNA, 14 bp, Homo sapiens
ggacaacttattta

SEQ ID NO: 1036732 - DNA, 15 bp, Homo sapiens
ggacaagcagtccct

SEQ ID NO: 1036733 - DNA, 23 bp, Homo sapiens
ggacaagccaacttgtaaataca

SEQ ID NO: 1036734 - DNA, 21 bp, Homo sapiens
ggacaaggccttgctcactca

SEQ ID NO: 1036735 - DNA, 14 bp, Homo sapiens
ggacaagggaggca

SEQ ID NO: 1036736 - DNA, 20 bp, Homo sapiens
ggacaagtggactcagggca

SEQ ID NO: 1036737 - DNA, 16 bp, Homo sapiens
ggacaatcagtcccct

SEQ ID NO: 1036738 - DNA, 17 bp, Homo sapiens
ggacaatcagtcccctc

SEQ ID NO: 1036739 - DNA, 17 bp, Homo sapiens
ggacacaaaactccgcc

SEQ ID NO: 1036740 - DNA, 21 bp, Homo sapiens
ggacacaaaactccgccccca

SEQ ID NO: 1036741 - DNA, 22 bp, Homo sapiens
ggacacaaattttcaagtttac

SEQ ID NO: 1036742 - DNA, 22 bp, Homo sapiens
ggaaatgttgagggcaagccac

SEQ ID NO: 1036743 - DNA, 18 bp, Homo sapiens
ggaaatgttttgtaaaca

SEQ ID NO: 1036744 - DNA, 19 bp, Homo sapiens
ggaaattgaagtgtcttct

SEQ ID NO: 1036745 - DNA, 18 bp, Homo sapiens
ggaaattgctattttatt

SEQ ID NO: 1036746 - DNA, 20 bp, Homo sapiens
ggaaatttgtttgtattttt

SEQ ID NO: 1036747 - DNA, 15 bp, Homo sapiens
ggaaattttatatgt

SEQ ID NO: 1036748 - DNA, 20 bp, Homo sapiens
ggaaattttatatgtaaatg

SEQ ID NO: 1036749 - DNA, 14 bp, Homo sapiens
ggaacaaagacagg

SEQ ID NO: 1036750 - DNA, 13 bp, Homo sapiens
ggaacaacttgta

SEQ ID NO: 1036751 - DNA, 13 bp, Homo sapiens
ggaacagacctga

SEQ ID NO: 1036752 - DNA, 21 bp, Homo sapiens
ggaacagcactggggagtctt

SEQ ID NO: 1036753 - DNA, 19 bp, Homo sapiens
ggaacagcgggagacctgt

SEQ ID NO: 1036754 - DNA, 19 bp, Homo sapiens
ggaacagctatgggagccc

SEQ ID NO: 1036755 - DNA, 12 bp, Homo sapiens
ggaacaggcccc

SEQ ID NO: 1036756 - DNA, 13 bp, Homo sapiens
ggaacaggcccca

SEQ ID NO: 1036757 - DNA, 17 bp, Homo sapiens
ggaacaggccccacgcc

SEQ ID NO: 1036758 - DNA, 18 bp, Homo sapiens
ggaacaggccccacgccc

SEQ ID NO: 1036759 - DNA, 17 bp, Homo sapiens
ggaacagtggctgggtg

SEQ ID NO: 1036760 - DNA, 18 bp, Homo sapiens
ggaacatacagacacatt

SEQ ID NO: 1036761 - DNA, 16 bp, Homo sapiens
ggaacatgacccagcc

SEQ ID NO: 1036762 - DNA, 19 bp, Homo sapiens
ggaacatgacccagcctga

SEQ ID NO: 1036763 - DNA, 22 bp, Homo sapiens
ggaacattctggatctgaccct

SEQ ID NO: 1036764 - DNA, 21 bp, Homo sapiens
ggaacatttgatatttttcca

SEQ ID NO: 1036765 - DNA, 22 bp, Homo sapiens
ggaaccaaagtctaaactgagc

SEQ ID NO: 1036766 - DNA, 13 bp, Homo sapiens
ggaaccaccagcg

SEQ ID NO: 1036767 - DNA, 13 bp, Homo sapiens
ggaaccactccca

SEQ ID NO: 1036768 - DNA, 14 bp, Homo sapiens
ggaaccactcccac

SEQ ID NO: 1036769 - DNA, 13 bp, Homo sapiens
ggaaccagactct

SEQ ID NO: 1036770 - DNA, 12 bp, Homo sapiens
ggaaccagagcc

SEQ ID NO: 1036771 - DNA, 21 bp, Homo sapiens
ggaaccagcatctcagcgcca

SEQ ID NO: 1036772 - DNA, 13 bp, Homo sapiens
ggaaccagggaga

SEQ ID NO: 1036773 - DNA, 17 bp, Homo sapiens
ggaaccagggaggagag

SEQ ID NO: 1036774 - DNA, 13 bp, Homo sapiens
ggaaccagggcct

SEQ ID NO: 1036775 - DNA, 18 bp, Homo sapiens
ggaaccatgaagacagga

SEQ ID NO: 1036776 - DNA, 14 bp, Homo sapiens
ggaacccaggaggt

SEQ ID NO: 1036777 - DNA, 19 bp, Homo sapiens
ggaaccccgcagcccgtga

SEQ ID NO: 1036778 - DNA, 24 bp, Homo sapiens
ggaacccttacagtaggagcccag

SEQ ID NO: 1036779 - DNA, 19 bp, Homo sapiens
ggaaccgctcacctagagc

SEQ ID NO: 1036780 - DNA, 22 bp, Homo sapiens
ggaacctagtactctctgctct

SEQ ID NO: 1036781 - DNA, 13 bp, Homo sapiens
ggaacctcccaga

SEQ ID NO: 1036782 - DNA, 23 bp, Homo sapiens
ggaacctcccagaggtccagccc

SEQ ID NO: 1036783 - DNA, 23 bp, Homo sapiens
ggaacctctgtctcatcctcctg

SEQ ID NO: 1036784 - DNA, 13 bp, Homo sapiens
ggaacctgccatg

SEQ ID NO: 1036785 - DNA, 23 bp, Homo sapiens
ggaaccttaacctctctaagcca

SEQ ID NO: 1036786 - DNA, 23 bp, Homo sapiens
ggaaccttctcccttcttgggtc

SEQ ID NO: 1036787 - DNA, 13 bp, Homo sapiens
ggaacgagcactg

SEQ ID NO: 1036788 - DNA, 21 bp, Homo sapiens
ggaacgagcactggccagaga

SEQ ID NO: 1036789 - DNA, 13 bp, Homo sapiens
ggaacgggcagcc

SEQ ID NO: 1036790 - DNA, 14 bp, Homo sapiens
ggaacgggcagcca

SEQ ID NO: 1036791 - DNA, 22 bp, Homo sapiens
ggaacgggcatgggcctctctg

SEQ ID NO: 1036792 - DNA, 23 bp, Homo sapiens
ggaacgggcatgggcctctctgg

SEQ ID NO: 1036793 - DNA, 18 bp, Homo sapiens
ggaacggggtccttcaag

SEQ ID NO: 1036794 - DNA, 22 bp, Homo sapiens
ggaacggtgaaggtgacagcag

SEQ ID NO: 1036795 - DNA, 16 bp, Homo sapiens
ggaacgtgactgcccc

SEQ ID NO: 1036796 - DNA, 17 bp, Homo sapiens
ggaacgtgactgcccca

SEQ ID NO: 1036797 - DNA, 15 bp, Homo sapiens
ggaacgttggacttt

SEQ ID NO: 1036798 - DNA, 14 bp, Homo sapiens
ggaactaataaata

SEQ ID NO: 1036799 - DNA, 21 bp, Homo sapiens
ggaactagagggatacactga

SEQ ID NO: 1036800 - DNA, 18 bp, Homo sapiens
ggaactatggcaaggaac

SEQ ID NO: 1036801 - DNA, 19 bp, Homo sapiens
ggaactccactctccttcg

SEQ ID NO: 1036802 - DNA, 15 bp, Homo sapiens
ggaactccaggacga

SEQ ID NO: 1036803 - DNA, 11 bp, Homo sapiens
ggaactcccag

SEQ ID NO: 1036804 - DNA, 15 bp, Homo sapiens
ggaactcctggaaat

SEQ ID NO: 1036805 - DNA, 20 bp, Homo sapiens
ggaactctggcttccaggta

SEQ ID NO: 1036806 - DNA, 17 bp, Homo sapiens
ggaactgaacattccag

SEQ ID NO: 1036807 - DNA, 14 bp, Homo sapiens
ggaactgggctggc

SEQ ID NO: 1036808 - DNA, 16 bp, Homo sapiens
ggaactgggctgggcc

SEQ ID NO: 1036809 - DNA, 21 bp, Homo sapiens
ggaacttaaaaccttgaaggt

SEQ ID NO: 1036810 - DNA, 14 bp, Homo sapiens
ggaacttcagagat

SEQ ID NO: 1036811 - DNA, 14 bp, Homo sapiens
ggaacttgaactga

SEQ ID NO: 1036812 - DNA, 18 bp, Homo sapiens
ggaacttgtctcttcatc

SEQ ID NO: 1036813 - DNA, 22 bp, Homo sapiens
ggaactttagggggtgggaggg

SEQ ID NO: 1036814 - DNA, 13 bp, Homo sapiens
ggaacttttaaaa

SEQ ID NO: 1036815 - DNA, 11 bp, Homo sapiens
ggaagaaaaag

SEQ ID NO: 1036816 - DNA, 14 bp, Homo sapiens
ggaagaaaaagcaa

SEQ ID NO: 1036817 - DNA, 16 bp, Homo sapiens
ggaagaaaactatcct

SEQ ID NO: 1036818 - DNA, 18 bp, Homo sapiens
ggaagaaacactcttatt

SEQ ID NO: 1036819 - DNA, 19 bp, Homo sapiens
ggaagaaacactttctctt

SEQ ID NO: 1036820 - DNA, 15 bp, Homo sapiens
ggaagaaagaagaca

SEQ ID NO: 1036821 - DNA, 14 bp, Homo sapiens
ggaagaacatagaa

SEQ ID NO: 1036822 - DNA, 12 bp, Homo sapiens
ggaagaagaaat

SEQ ID NO: 1036823 - DNA, 14 bp, Homo sapiens
ggaagaagcagaga

SEQ ID NO: 1036824 - DNA, 16 bp, Homo sapiens
ggaagaagcagagaga

SEQ ID NO: 1036825 - DNA, 13 bp, Homo sapiens
ggaagaatttaat

SEQ ID NO: 1036826 - DNA, 15 bp, Homo sapiens
ggaagacacttcaga

SEQ ID NO: 1036827 - DNA, 22 bp, Homo sapiens
ggaagacacttcagatctgagg

SEQ ID NO: 1036828 - DNA, 13 bp, Homo sapiens
ggaagacaggtct

SEQ ID NO: 1036829 - DNA, 21 bp, Homo sapiens
ggaagacatttctgcacatgg

SEQ ID NO: 1036830 - DNA, 15 bp, Homo sapiens
ggaagacatttttcc

SEQ ID NO: 1036831 - DNA, 16 bp, Homo sapiens
ggaagaccaaggcctc

SEQ ID NO: 1036832 - DNA, 15 bp, Homo sapiens
ggaagaccccaccca

SEQ ID NO: 1036833 - DNA, 16 bp, Homo sapiens
ggaagactcaggagtc

SEQ ID NO: 1036834 - DNA, 22 bp, Homo sapiens
ggaagagaagaaatagcagagc

SEQ ID NO: 1036835 - DNA, 21 bp, Homo sapiens
ggaagagacaaagtgggtgtg

SEQ ID NO: 1036836 - DNA, 16 bp, Homo sapiens
ggaagagacatgagaa

SEQ ID NO: 1036837 - DNA, 19 bp, Homo sapiens
ggaagagaggcacctgctg

SEQ ID NO: 1036838 - DNA, 16 bp, Homo sapiens
ggaagagatgtttaca

SEQ ID NO: 1036839 - DNA, 19 bp, Homo sapiens
ggaagagcagaacggagcc

SEQ ID NO: 1036840 - DNA, 12 bp, Homo sapiens
ggaagagcagcc

SEQ ID NO: 1036841 - DNA, 13 bp, Homo sapiens
ggaagagcaggac

SEQ ID NO: 1036842 - DNA, 21 bp, Homo sapiens
ggaagagcaggcacatggagg

SEQ ID NO: 1036843 - DNA, 16 bp, Homo sapiens
ggaagagcccagtctg

SEQ ID NO: 1036844 - DNA, 13 bp, Homo sapiens
ggaagagctcccc

SEQ ID NO: 1036845 - DNA, 16 bp, Homo sapiens
ggaagaggatgagcag

SEQ ID NO: 1036846 - DNA, 13 bp, Homo sapiens
ggaagaggcccac

SEQ ID NO: 1036847 - DNA, 14 bp, Homo sapiens
ggaagaggcccact

SEQ ID NO: 1036848 - DNA, 22 bp, Homo sapiens
ggaagagggctgagctgagctt

SEQ ID NO: 1036849 - DNA, 18 bp, Homo sapiens
ggaagaggggctggggca

SEQ ID NO: 1036850 - DNA, 17 bp, Homo sapiens
ggaagagttggtctctg

SEQ ID NO: 1036851 - DNA, 21 bp, Homo sapiens
ggaagataggctctgcacaga

SEQ ID NO: 1036852 - DNA, 12 bp, Homo sapiens
ggaagatcctgc

SEQ ID NO: 1036853 - DNA, 18 bp, Homo sapiens
ggaagattttatgcacag

SEQ ID NO: 1036854 - DNA, 22 bp, Homo sapiens
ggaagattttatgcacagccta

SEQ ID NO: 1036855 - DNA, 14 bp, Homo sapiens
ggaagcaaagacaa

SEQ ID NO: 1036856 - DNA, 17 bp, Homo sapiens
ggaagcaaagacaaaag

SEQ ID NO: 1036857 - DNA, 17 bp, Homo sapiens
ggaagcaaagagtgaga

SEQ ID NO: 1036858 - DNA, 16 bp, Homo sapiens
ggaagcacagcctcgg

SEQ ID NO: 1036859 - DNA, 23 bp, Homo sapiens
ggaagcacatgtttatttattct

SEQ ID NO: 1036860 - DNA, 15 bp, Homo sapiens
ggaagcaccccatgc

SEQ ID NO: 1036861 - DNA, 11 bp, Homo sapiens
ggaagcaggga

SEQ ID NO: 1036862 - DNA, 17 bp, Homo sapiens
ggaagcagggacacccc

SEQ ID NO: 1036863 - DNA, 20 bp, Homo sapiens
ggaagcaggtgctacaacat

SEQ ID NO: 1036864 - DNA, 19 bp, Homo sapiens
ggaagcagtgccttccata

SEQ ID NO: 1036865 - DNA, 15 bp, Homo sapiens
ggaagcagttggggc

SEQ ID NO: 1036866 - DNA, 15 bp, Homo sapiens
ggaagcatggctgtc

SEQ ID NO: 1036867 - DNA, 18 bp, Homo sapiens
ggaagcatggctgtctgc

SEQ ID NO: 1036868 - DNA, 16 bp, Homo sapiens
ggaagcattcagagag

SEQ ID NO: 1036869 - DNA, 18 bp, Homo sapiens
ggaagcattcagagagca

SEQ ID NO: 1036870 - DNA, 19 bp, Homo sapiens
ggaagcatttgtttctact

SEQ ID NO: 1036871 - DNA, 11 bp, Homo sapiens
ggaagccagag

SEQ ID NO: 1036872 - DNA, 12 bp, Homo sapiens
ggaagccagagc

SEQ ID NO: 1036873 - DNA, 16 bp, Homo sapiens
ggaagccagctttccc

SEQ ID NO: 1036874 - DNA, 18 bp, Homo sapiens
ggaagccaggtacaggag

SEQ ID NO: 1036875 - DNA, 22 bp, Homo sapiens
ggaagccagtcaccttctgggc

SEQ ID NO: 1036876 - DNA, 19 bp, Homo sapiens
ggaagccagtggagctggt

SEQ ID NO: 1036877 - DNA, 22 bp, Homo sapiens
ggaagccatgtggggttgctga

SEQ ID NO: 1036878 - DNA, 21 bp, Homo sapiens
ggaagcccaccaatctgccct

SEQ ID NO: 1036879 - DNA, 13 bp, Homo sapiens
ggaagcccaggct

SEQ ID NO: 1036880 - DNA, 14 bp, Homo sapiens
ggaagcccaggctc

SEQ ID NO: 1036881 - DNA, 13 bp, Homo sapiens
ggaagcccccacc

SEQ ID NO: 1036882 - DNA, 21 bp, Homo sapiens
ggaagcccccaccgtgggcag

SEQ ID NO: 1036883 - DNA, 22 bp, Homo sapiens
ggaagccccctcttcctccctg

SEQ ID NO: 1036884 - DNA, 14 bp, Homo sapiens
ggaagcccctgggc

SEQ ID NO: 1036885 - DNA, 19 bp, Homo sapiens
ggaagcccctgggcccagt

SEQ ID NO: 1036886 - DNA, 15 bp, Homo sapiens
ggaagccctccttcc

SEQ ID NO: 1036887 - DNA, 23 bp, Homo sapiens
ggaagccctggatttcagaaaga

SEQ ID NO: 1036888 - DNA, 21 bp, Homo sapiens
ggaagccggggtgtaacttcc

SEQ ID NO: 1036889 - DNA, 15 bp, Homo sapiens
ggaagccgtctgact

SEQ ID NO: 1036890 - DNA, 20 bp, Homo sapiens
ggaagccgtctgactccaga

SEQ ID NO: 1036891 - DNA, 22 bp, Homo sapiens
ggaagccgtctgactccagagt

SEQ ID NO: 1036892 - DNA, 20 bp, Homo sapiens
ggaagccgtgctcgccccag

SEQ ID NO: 1036893 - DNA, 21 bp, Homo sapiens
ggaagcggccctaagggagtg

SEQ ID NO: 1036894 - DNA, 17 bp, Homo sapiens
ggaagcgtcgccccagt

SEQ ID NO: 1036895 - DNA, 19 bp, Homo sapiens
ggaagcgtcgccccagtgg

SEQ ID NO: 1036896 - DNA, 18 bp, Homo sapiens
ggaagctagacacatgaa

SEQ ID NO: 1036897 - DNA, 22 bp, Homo sapiens
ggaagctagacacatgaaggta

SEQ ID NO: 1036898 - DNA, 19 bp, Homo sapiens
ggaagctagtcttttgctt

SEQ ID NO: 1036899 - DNA, 23 bp, Homo sapiens
ggaagctagtcttttgcttttgc

SEQ ID NO: 1036900 - DNA, 14 bp, Homo sapiens
ggaagctccactgt

SEQ ID NO: 1036901 - DNA, 22 bp, Homo sapiens
ggaagctcccaccccactcagg

SEQ ID NO: 1036902 - DNA, 18 bp, Homo sapiens
ggaagctctgaagtcaca

SEQ ID NO: 1036903 - DNA, 13 bp, Homo sapiens
ggaagctcttctt

SEQ ID NO: 1036904 - DNA, 20 bp, Homo sapiens
ggaagctcttggagctgtga

SEQ ID NO: 1036905 - DNA, 17 bp, Homo sapiens
ggaagctgccctgccca

SEQ ID NO: 1036906 - DNA, 16 bp, Homo sapiens
ggaagctgctgaggcc

SEQ ID NO: 1036907 - DNA, 23 bp, Homo sapiens
ggaagctgctgaggcccccaagt

SEQ ID NO: 1036908 - DNA, 18 bp, Homo sapiens
ggaagctggcagaacgga

SEQ ID NO: 1036909 - DNA, 16 bp, Homo sapiens
ggaagctgggggaagg

SEQ ID NO: 1036910 - DNA, 22 bp, Homo sapiens
ggaagctgggggaagggtggtc

SEQ ID NO: 1036911 - DNA, 15 bp, Homo sapiens
ggaagcttggggaac

SEQ ID NO: 1036912 - DNA, 14 bp, Homo sapiens
ggaaggaaaggcag

SEQ ID NO: 1036913 - DNA, 15 bp, Homo sapiens
ggaaggaacaaagac

SEQ ID NO: 1036914 - DNA, 20 bp, Homo sapiens
ggaaggaacaaagacaggca

SEQ ID NO: 1036915 - DNA, 19 bp, Homo sapiens
ggaaggaatggaggagtct

SEQ ID NO: 1036916 - DNA, 22 bp, Homo sapiens
ggaaggacacagcagtattgga

SEQ ID NO: 1036917 - DNA, 14 bp, Homo sapiens
ggaaggaccccaca

SEQ ID NO: 1036918 - DNA, 15 bp, Homo sapiens
ggaaggagactcacc

SEQ ID NO: 1036919 - DNA, 20 bp, Homo sapiens
ggaaggagactcacctctgc

SEQ ID NO: 1036920 - DNA, 13 bp, Homo sapiens
ggaaggagagcct

SEQ ID NO: 1036921 - DNA, 14 bp, Homo sapiens
ggaaggagagcctg

SEQ ID NO: 1036922 - DNA, 21 bp, Homo sapiens
ggaaggagccagtttgccgga

SEQ ID NO: 1036923 - DNA, 16 bp, Homo sapiens
ggaaggaggacccagg

SEQ ID NO: 1036924 - DNA, 16 bp, Homo sapiens
ggaaggaggagccgac

SEQ ID NO: 1036925 - DNA, 21 bp, Homo sapiens
ggaaggaggccaaccagcccg

SEQ ID NO: 1036926 - DNA, 14 bp, Homo sapiens
ggaaggagggcaca

SEQ ID NO: 1036927 - DNA, 20 bp, Homo sapiens
ggaaggagggttagggaggg

SEQ ID NO: 1036928 - DNA, 13 bp, Homo sapiens
ggaaggagtgaga

SEQ ID NO: 1036929 - DNA, 18 bp, Homo sapiens
ggaaggatctgctgaggc

SEQ ID NO: 1036930 - DNA, 19 bp, Homo sapiens
ggaaggatctgctgaggcc

SEQ ID NO: 1036931 - DNA, 20 bp, Homo sapiens
ggaaggatgggatctttctg

SEQ ID NO: 1036932 - DNA, 13 bp, Homo sapiens
ggaaggcagacag

SEQ ID NO: 1036933 - DNA, 20 bp, Homo sapiens
ggaaggcagggcagagggaa

SEQ ID NO: 1036934 - DNA, 19 bp, Homo sapiens
ggaaggcccctctgtggag

SEQ ID NO: 1036935 - DNA, 22 bp, Homo sapiens
ggaaggcccctctgtggagcgc

SEQ ID NO: 1036936 - DNA, 14 bp, Homo sapiens
ggaaggccctgagg

SEQ ID NO: 1036937 - DNA, 15 bp, Homo sapiens
ggaaggcctccctct

SEQ ID NO: 1036938 - DNA, 12 bp, Homo sapiens
ggaaggcctgac

SEQ ID NO: 1036939 - DNA, 16 bp, Homo sapiens
ggaaggcctttcttct

SEQ ID NO: 1036940 - DNA, 18 bp, Homo sapiens
ggaaggcctttcttctgt

SEQ ID NO: 1036941 - DNA, 12 bp, Homo sapiens
ggaaggctggct

SEQ ID NO: 1036942 - DNA, 14 bp, Homo sapiens
ggaaggctggctga

SEQ ID NO: 1036943 - DNA, 16 bp, Homo sapiens
ggaagggaccaaggca

SEQ ID NO: 1036944 - DNA, 15 bp, Homo sapiens
ggaagggataattta

SEQ ID NO: 1036945 - DNA, 17 bp, Homo sapiens
ggaagggcatgcacggg

SEQ ID NO: 1036946 - DNA, 18 bp, Homo sapiens
ggaagggccaccctgctg

SEQ ID NO: 1036947 - DNA, 21 bp, Homo sapiens
ggaagggccagtctgggctgc

SEQ ID NO: 1036948 - DNA, 23 bp, Homo sapiens
ggaagggctttggttccttctct

SEQ ID NO: 1036949 - DNA, 22 bp, Homo sapiens
ggaaggggacccccgccccctg

SEQ ID NO: 1036950 - DNA, 16 bp, Homo sapiens
ggaaggggatggaggc

SEQ ID NO: 1036951 - DNA, 17 bp, Homo sapiens
ggaaggggatggaggcc

SEQ ID NO: 1036952 - DNA, 20 bp, Homo sapiens
ggaaggggatggaggccaga

SEQ ID NO: 1036953 - DNA, 16 bp, Homo sapiens
ggaaggggcagcagga

SEQ ID NO: 1036954 - DNA, 16 bp, Homo sapiens
ggaaggggcagccctg

SEQ ID NO: 1036955 - DNA, 16 bp, Homo sapiens
ggaaggggcctccctc

SEQ ID NO: 1036956 - DNA, 13 bp, Homo sapiens
ggaagggggagga

SEQ ID NO: 1036957 - DNA, 15 bp, Homo sapiens
ggaagggggtgtgcg

SEQ ID NO: 1036958 - DNA, 14 bp, Homo sapiens
ggaaggggtcctgc

SEQ ID NO: 1036959 - DNA, 16 bp, Homo sapiens
ggaaggggtcctgcag

SEQ ID NO: 1036960 - DNA, 17 bp, Homo sapiens
ggaaggggtcctgcagg

SEQ ID NO: 1036961 - DNA, 21 bp, Homo sapiens
ggaaggggtgcaggtggggtg

SEQ ID NO: 1036962 - DNA, 18 bp, Homo sapiens
ggaagggttggtgggctg

SEQ ID NO: 1036963 - DNA, 22 bp, Homo sapiens
ggaagggttggtgggctggccc

SEQ ID NO: 1036964 - DNA, 23 bp, Homo sapiens
ggaagggttggtgggctggccca

SEQ ID NO: 1036965 - DNA, 15 bp, Homo sapiens
ggaagggtttctcta

SEQ ID NO: 1036966 - DNA, 18 bp, Homo sapiens
ggaagggtttgtggctgg

SEQ ID NO: 1036967 - DNA, 19 bp, Homo sapiens
ggaaggtcccttgtttcca

SEQ ID NO: 1036968 - DNA, 17 bp, Homo sapiens
ggaaggtgactgtgtgt

SEQ ID NO: 1036969 - DNA, 13 bp, Homo sapiens
ggaaggtgccaga

SEQ ID NO: 1036970 - DNA, 16 bp, Homo sapiens
ggaaggtgctgagctt

SEQ ID NO: 1036971 - DNA, 17 bp, Homo sapiens
ggaaggtggccacagca

SEQ ID NO: 1036972 - DNA, 22 bp, Homo sapiens
ggaaggtttgcggatgagggca

SEQ ID NO: 1036973 - DNA, 24 bp, Homo sapiens
ggaaggtttgcggatgagggcatg

SEQ ID NO: 1036974 - DNA, 19 bp, Homo sapiens
ggaaggtttggtgtgtgga

SEQ ID NO: 1036975 - DNA, 18 bp, Homo sapiens
ggaaggtttgtatattgt

SEQ ID NO: 1036976 - DNA, 15 bp, Homo sapiens
ggaagtaaaaaaaca

SEQ ID NO: 1036977 - DNA, 16 bp, Homo sapiens
ggaagtaacagacaca

SEQ ID NO: 1036978 - DNA, 16 bp, Homo sapiens
ggaagtatacctggct

SEQ ID NO: 1036979 - DNA, 18 bp, Homo sapiens
ggaagtatgtatattaaa

SEQ ID NO: 1036980 - DNA, 17 bp, Homo sapiens
ggaagtcacctttctgg

SEQ ID NO: 1036981 - DNA, 20 bp, Homo sapiens
ggaagtcacctttctgggct

SEQ ID NO: 1036982 - DNA, 14 bp, Homo sapiens
ggaagtcaggggag

SEQ ID NO: 1036983 - DNA, 23 bp, Homo sapiens
ggaagtcaggggagaagctgaag

SEQ ID NO: 1036984 - DNA, 15 bp, Homo sapiens
ggaagtccaatgtgg

SEQ ID NO: 1036985 - DNA, 17 bp, Homo sapiens
ggaagtccaatgtggca

SEQ ID NO: 1036986 - DNA, 23 bp, Homo sapiens
ggaagtgaagagggagaagggat

SEQ ID NO: 1036987 - DNA, 17 bp, Homo sapiens
ggaagtgacaaggcccc

SEQ ID NO: 1036988 - DNA, 14 bp, Homo sapiens
ggaagtgaggccca

SEQ ID NO: 1036989 - DNA, 17 bp, Homo sapiens
ggaagtgcttgatatgt

SEQ ID NO: 1036990 - DNA, 14 bp, Homo sapiens
ggaagtggctggtc

SEQ ID NO: 1036991 - DNA, 16 bp, Homo sapiens
ggaagtggtctgtctg

SEQ ID NO: 1036992 - DNA, 21 bp, Homo sapiens
ccttggttgggtcaaggacag

SEQ ID NO: 1036993 - DNA, 24 bp, Homo sapiens
ccttggttgggtcaaggacagggc

SEQ ID NO: 1036994 - DNA, 21 bp, Homo sapiens
ccttggttgtctggcaaggac

SEQ ID NO: 1036995 - DNA, 21 bp, Homo sapiens
ccttggtttttactgctctga

SEQ ID NO: 1036996 - DNA, 23 bp, Homo sapiens
ccttggtttttactgctctgaga

SEQ ID NO: 1036997 - DNA, 16 bp, Homo sapiens
ccttgtaaaaaaagca

SEQ ID NO: 1036998 - DNA, 18 bp, Homo sapiens
ccttgtaaaaaaagcaaa

SEQ ID NO: 1036999 - DNA, 14 bp, Homo sapiens
ccttgtaagttatt

SEQ ID NO: 1037000 - DNA, 22 bp, Homo sapiens
ccttgtacagtgtctgtgccat

SEQ ID NO: 1037001 - DNA, 11 bp, Homo sapiens
ccttgtataaa

SEQ ID NO: 1037002 - DNA, 18 bp, Homo sapiens
ccttgtataatattgaaa

SEQ ID NO: 1037003 - DNA, 22 bp, Homo sapiens
ccttgtatgaataaaaggctgg

SEQ ID NO: 1037004 - DNA, 13 bp, Homo sapiens
ccttgtatttaaa

SEQ ID NO: 1037005 - DNA, 14 bp, Homo sapiens
ccttgtcatcctcc

SEQ ID NO: 1037006 - DNA, 14 bp, Homo sapiens
ccttgtccaggaac

SEQ ID NO: 1037007 - DNA, 23 bp, Homo sapiens
ccttgtcgcgcgtctcccatcct

SEQ ID NO: 1037008 - DNA, 19 bp, Homo sapiens
ccttgtctgggtgcagctg

SEQ ID NO: 1037009 - DNA, 18 bp, Homo sapiens
ccttgtcttcccccctct

SEQ ID NO: 1037010 - DNA, 12 bp, Homo sapiens
ccttgtcttttc

SEQ ID NO: 1037011 - DNA, 22 bp, Homo sapiens
ccttgtgcccagggttttgccc

SEQ ID NO: 1037012 - DNA, 18 bp, Homo sapiens
ccttgtgcctgctcctgt

SEQ ID NO: 1037013 - DNA, 24 bp, Homo sapiens
ccttgtgcttggtggggctcgtgg

SEQ ID NO: 1037014 - DNA, 15 bp, Homo sapiens
ccttgtggactggct

SEQ ID NO: 1037015 - DNA, 21 bp, Homo sapiens
ccttgtgggcaaaggcagggc

SEQ ID NO: 1037016 - DNA, 23 bp, Homo sapiens
ccttgtgggcaaaggcagggcca

SEQ ID NO: 1037017 - DNA, 15 bp, Homo sapiens
ccttgtgtcagagct

SEQ ID NO: 1037018 - DNA, 17 bp, Homo sapiens
ccttgtgtgtgccctgg

SEQ ID NO: 1037019 - DNA, 13 bp, Homo sapiens
ccttgtgtttctg

SEQ ID NO: 1037020 - DNA, 16 bp, Homo sapiens
ccttgtgtttctgtgg

SEQ ID NO: 1037021 - DNA, 16 bp, Homo sapiens
ccttgtgttttgtcct

SEQ ID NO: 1037022 - DNA, 21 bp, Homo sapiens
ccttgtgttttgtcctgcctc

SEQ ID NO: 1037023 - DNA, 15 bp, Homo sapiens
ccttgttacttctga

SEQ ID NO: 1037024 - DNA, 18 bp, Homo sapiens
ccttgttacttctgaggt

SEQ ID NO: 1037025 - DNA, 13 bp, Homo sapiens
ccttgttctctgc

SEQ ID NO: 1037026 - DNA, 14 bp, Homo sapiens
ccttgttgcactgc

SEQ ID NO: 1037027 - DNA, 23 bp, Homo sapiens
ccttgttgcactgccccctgctt

SEQ ID NO: 1037028 - DNA, 23 bp, Homo sapiens
ccttgttggggagtgggtggcag

SEQ ID NO: 1037029 - DNA, 17 bp, Homo sapiens
ccttgttggtcagagga

SEQ ID NO: 1037030 - DNA, 11 bp, Homo sapiens
ccttgtttaca

SEQ ID NO: 1037031 - DNA, 17 bp, Homo sapiens
ccttgtttacagtgagg

SEQ ID NO: 1037032 - DNA, 18 bp, Homo sapiens
ccttgtttacagtgagga

SEQ ID NO: 1037033 - DNA, 19 bp, Homo sapiens
ccttgtttacagtgaggac

SEQ ID NO: 1037034 - DNA, 22 bp, Homo sapiens
ccttgtttatcagatacatcac

SEQ ID NO: 1037035 - DNA, 15 bp, Homo sapiens
ccttgtttctgatga

SEQ ID NO: 1037036 - DNA, 15 bp, Homo sapiens
ccttgttttcagccc

SEQ ID NO: 1037037 - DNA, 16 bp, Homo sapiens
ccttgttttcagcccc

SEQ ID NO: 1037038 - DNA, 16 bp, Homo sapiens
ccttgttttggacagt

SEQ ID NO: 1037039 - DNA, 20 bp, Homo sapiens
ccttgtttttaatctcctgt

SEQ ID NO: 1037040 - DNA, 22 bp, Homo sapiens
cctttaaagagagtttgccact

SEQ ID NO: 1037041 - DNA, 15 bp, Homo sapiens
cctttaagaacctta

SEQ ID NO: 1037042 - DNA, 19 bp, Homo sapiens
cctttaagaaccttaatga

SEQ ID NO: 1037043 - DNA, 22 bp, Homo sapiens
cctttaagccaaagaaacaagc

SEQ ID NO: 1037044 - DNA, 11 bp, Homo sapiens
cctttaatgag

SEQ ID NO: 1037045 - DNA, 19 bp, Homo sapiens
cctttaattaagactgaaa

SEQ ID NO: 1037046 - DNA, 14 bp, Homo sapiens
cctttaattcaggt

SEQ ID NO: 1037047 - DNA, 23 bp, Homo sapiens
cctttacacattcggctccctgg

SEQ ID NO: 1037048 - DNA, 19 bp, Homo sapiens
cctttacactcaggctttc

SEQ ID NO: 1037049 - DNA, 17 bp, Homo sapiens
cctttacattcaacttt

SEQ ID NO: 1037050 - DNA, 21 bp, Homo sapiens
cctttaccctctttgctgcag

SEQ ID NO: 1037051 - DNA, 22 bp, Homo sapiens
cctttaccctctttgctgcaga

SEQ ID NO: 1037052 - DNA, 19 bp, Homo sapiens
cctttaccttttctataag

SEQ ID NO: 1037053 - DNA, 14 bp, Homo sapiens
cctttacggacacc

SEQ ID NO: 1037054 - DNA, 15 bp, Homo sapiens
cctttacgttcatca

SEQ ID NO: 1037055 - DNA, 19 bp, Homo sapiens
cctttactatcattctcag

SEQ ID NO: 1037056 - DNA, 13 bp, Homo sapiens
cctttactcctgg

SEQ ID NO: 1037057 - DNA, 20 bp, Homo sapiens
cctttagaaactcaaaaact

SEQ ID NO: 1037058 - DNA, 15 bp, Homo sapiens
cctttagcctggacc

SEQ ID NO: 1037059 - DNA, 22 bp, Homo sapiens
cctttagcgggactcagtgagc

SEQ ID NO: 1037060 - DNA, 16 bp, Homo sapiens
cctttaggcagcctgc

SEQ ID NO: 1037061 - DNA, 14 bp, Homo sapiens
cctttagggcagct

SEQ ID NO: 1037062 - DNA, 17 bp, Homo sapiens
cctttagggctgttgct

SEQ ID NO: 1037063 - DNA, 18 bp, Homo sapiens
cctttagggttctgcctc

SEQ ID NO: 1037064 - DNA, 16 bp, Homo sapiens
cctttatctttcacct

SEQ ID NO: 1037065 - DNA, 17 bp, Homo sapiens
cctttatgtgaattttt

SEQ ID NO: 1037066 - DNA, 14 bp, Homo sapiens
cctttattctcact

SEQ ID NO: 1037067 - DNA, 24 bp, Homo sapiens
cctttattggtaaattctggtata

SEQ ID NO: 1037068 - DNA, 18 bp, Homo sapiens
cctttatttaggaaacac

SEQ ID NO: 1037069 - DNA, 21 bp, Homo sapiens
cctttatttttggcgtggctg

SEQ ID NO: 1037070 - DNA, 21 bp, Homo sapiens
cctttcaaatttagaaactaa

SEQ ID NO: 1037071 - DNA, 15 bp, Homo sapiens
cctttcaaggaaagt

SEQ ID NO: 1037072 - DNA, 17 bp, Homo sapiens
cctttcacaagcaacag

SEQ ID NO: 1037073 - DNA, 19 bp, Homo sapiens
cctttcaccctcatgaaaa

SEQ ID NO: 1037074 - DNA, 22 bp, Homo sapiens
cctttcacctttgtgtattttt

SEQ ID NO: 1037075 - DNA, 20 bp, Homo sapiens
cctttcacttttagttggca

SEQ ID NO: 1037076 - DNA, 17 bp, Homo sapiens
cctttcagatgaccttt

SEQ ID NO: 1037077 - DNA, 14 bp, Homo sapiens
cctttcagatgtct

SEQ ID NO: 1037078 - DNA, 22 bp, Homo sapiens
cctttcagatgtcttctgcctg

SEQ ID NO: 1037079 - DNA, 18 bp, Homo sapiens
cctttcaggtccaggcca

SEQ ID NO: 1037080 - DNA, 21 bp, Homo sapiens
cctttcagtgtagcgggagga

SEQ ID NO: 1037081 - DNA, 18 bp, Homo sapiens
cctttcataatttttaaa

SEQ ID NO: 1037082 - DNA, 18 bp, Homo sapiens
cctttcatctctctacct

SEQ ID NO: 1037083 - DNA, 20 bp, Homo sapiens
cctttcatctctctacctcc

SEQ ID NO: 1037084 - DNA, 22 bp, Homo sapiens
cctttcatctctctacctccac

SEQ ID NO: 1037085 - DNA, 20 bp, Homo sapiens
cctttcatcttgaagttttt

SEQ ID NO: 1037086 - DNA, 17 bp, Homo sapiens
cctttcattaggcaaag

SEQ ID NO: 1037087 - DNA, 24 bp, Homo sapiens
cctttccaatgaaggaaacatcag

SEQ ID NO: 1037088 - DNA, 20 bp, Homo sapiens
cctttccagagaactgcaga

SEQ ID NO: 1037089 - DNA, 13 bp, Homo sapiens
cctttccagcctc

SEQ ID NO: 1037090 - DNA, 11 bp, Homo sapiens
cctttccataa

SEQ ID NO: 1037091 - DNA, 14 bp, Homo sapiens
cctttccatctgtc

SEQ ID NO: 1037092 - DNA, 15 bp, Homo sapiens
cctttccatctgtcc

SEQ ID NO: 1037093 - DNA, 22 bp, Homo sapiens
cctttccatctgtccacatccc

SEQ ID NO: 1037094 - DNA, 22 bp, Homo sapiens
cctttcccaccattcctgcctt

SEQ ID NO: 1037095 - DNA, 17 bp, Homo sapiens
cctttcccccctcacac

SEQ ID NO: 1037096 - DNA, 22 bp, Homo sapiens
cctttcccccctcacacatgca

SEQ ID NO: 1037097 - DNA, 12 bp, Homo sapiens
cctttcccgggc

SEQ ID NO: 1037098 - DNA, 14 bp, Homo sapiens
cctttcccgggctg

SEQ ID NO: 1037099 - DNA, 21 bp, Homo sapiens
cctttccctcaccccctccca

SEQ ID NO: 1037100 - DNA, 11 bp, Homo sapiens
cctttccctct

SEQ ID NO: 1037101 - DNA, 15 bp, Homo sapiens
cctttccctggagct

SEQ ID NO: 1037102 - DNA, 16 bp, Homo sapiens
cctttcccttcctctt

SEQ ID NO: 1037103 - DNA, 11 bp, Homo sapiens
cctttcctaaa

SEQ ID NO: 1037104 - DNA, 20 bp, Homo sapiens
cctttcctatcacctcgaga

SEQ ID NO: 1037105 - DNA, 18 bp, Homo sapiens
ggaaaaaaaaaaagaaaa

SEQ ID NO: 1037106 - DNA, 13 bp, Homo sapiens
ggaaaaaaaagaa

SEQ ID NO: 1037107 - DNA, 16 bp, Homo sapiens
ggaaaaaaaagagact

SEQ ID NO: 1037108 - DNA, 14 bp, Homo sapiens
ggaaaaaaaatata

SEQ ID NO: 1037109 - DNA, 15 bp, Homo sapiens
ggaaaaaaacaaaaa

SEQ ID NO: 1037110 - DNA, 14 bp, Homo sapiens
ggaaaaaaactgaa

SEQ ID NO: 1037111 - DNA, 14 bp, Homo sapiens
ggaaaaaaatgact

SEQ ID NO: 1037112 - DNA, 12 bp, Homo sapiens
ggaaaaaaatgt

SEQ ID NO: 1037113 - DNA, 14 bp, Homo sapiens
ggaaaaaagaaaga

SEQ ID NO: 1037114 - DNA, 20 bp, Homo sapiens
ggaaaaaattgtattgaaaa

SEQ ID NO: 1037115 - DNA, 10 bp, Homo sapiens
ggaaaaagag

SEQ ID NO: 1037116 - DNA, 13 bp, Homo sapiens
ggaaaaataaacg

SEQ ID NO: 1037117 - DNA, 18 bp, Homo sapiens
ggaaaaatagtaaacatt

SEQ ID NO: 1037118 - DNA, 13 bp, Homo sapiens
ggaaaaatggttg

SEQ ID NO: 1037119 - DNA, 15 bp, Homo sapiens
ggaaaacacagcctc

SEQ ID NO: 1037120 - DNA, 16 bp, Homo sapiens
ggaaaacacagcctcc

SEQ ID NO: 1037121 - DNA, 22 bp, Homo sapiens
ggaaaacagaacatcattagaa

SEQ ID NO: 1037122 - DNA, 18 bp, Homo sapiens
ggaaaacatgctacacac

SEQ ID NO: 1037123 - DNA, 22 bp, Homo sapiens
ggaaaaccaagccgtggcttcc

SEQ ID NO: 1037124 - DNA, 12 bp, Homo sapiens
ggaaaaccagga

SEQ ID NO: 1037125 - DNA, 20 bp, Homo sapiens
ggaaaactattgagccttgc

SEQ ID NO: 1037126 - DNA, 23 bp, Homo sapiens
ggaaaacttttgttttttggggt

SEQ ID NO: 1037127 - DNA, 14 bp, Homo sapiens
ggaaaagaatacag

SEQ ID NO: 1037128 - DNA, 17 bp, Homo sapiens
ggaaaagaccagggctt

SEQ ID NO: 1037129 - DNA, 18 bp, Homo sapiens
ggaaaagataaagaccag

SEQ ID NO: 1037130 - DNA, 14 bp, Homo sapiens
ggaaaagcagctct

SEQ ID NO: 1037131 - DNA, 14 bp, Homo sapiens
ggaaaagggagcta

SEQ ID NO: 1037132 - DNA, 19 bp, Homo sapiens
ggaaaagggtcttcttggc

SEQ ID NO: 1037133 - DNA, 21 bp, Homo sapiens
ggaaaataaacatcagtttct

SEQ ID NO: 1037134 - DNA, 14 bp, Homo sapiens
ggaaaataaattat

SEQ ID NO: 1037135 - DNA, 17 bp, Homo sapiens
ggaaaatatttcctgac

SEQ ID NO: 1037136 - DNA, 23 bp, Homo sapiens
ggaaaatcagcctgctccagctg

SEQ ID NO: 1037137 - DNA, 23 bp, Homo sapiens
ggaaaatctatatttgtcttccg

SEQ ID NO: 1037138 - DNA, 15 bp, Homo sapiens
ggaaaatctgtgatt

SEQ ID NO: 1037139 - DNA, 19 bp, Homo sapiens
ggaaaatgagaggagaaca

SEQ ID NO: 1037140 - DNA, 14 bp, Homo sapiens
ggaaaatgcatttt

SEQ ID NO: 1037141 - DNA, 19 bp, Homo sapiens
ggaaaatgccatgaattac

SEQ ID NO: 1037142 - DNA, 15 bp, Homo sapiens
ggaaaatgcttctgt

SEQ ID NO: 1037143 - DNA, 21 bp, Homo sapiens
ggaaaatggccatgcaggagg

SEQ ID NO: 1037144 - DNA, 17 bp, Homo sapiens
ggaaaatgtgtctctgc

SEQ ID NO: 1037145 - DNA, 18 bp, Homo sapiens
ggaaaattctaacccagg

SEQ ID NO: 1037146 - DNA, 14 bp, Homo sapiens
ggaaaattgaaagt

SEQ ID NO: 1037147 - DNA, 19 bp, Homo sapiens
ggaaacaacacccaagatg

SEQ ID NO: 1037148 - DNA, 16 bp, Homo sapiens
ggaaacaacagcttta

SEQ ID NO: 1037149 - DNA, 11 bp, Homo sapiens
ggaaacaatga

SEQ ID NO: 1037150 - DNA, 17 bp, Homo sapiens
ggaaacaatgaaaacaa

SEQ ID NO: 1037151 - DNA, 12 bp, Homo sapiens
ggaaacagaact

SEQ ID NO: 1037152 - DNA, 13 bp, Homo sapiens
ggaaacagaggct

SEQ ID NO: 1037153 - DNA, 22 bp, Homo sapiens
ggaaacagagtccaatttaagg

SEQ ID NO: 1037154 - DNA, 15 bp, Homo sapiens
ggaaacagcatgaat

SEQ ID NO: 1037155 - DNA, 18 bp, Homo sapiens
ggaaacagctttaggggt

SEQ ID NO: 1037156 - DNA, 15 bp, Homo sapiens
ggaaacaggaccaca

SEQ ID NO: 1037157 - DNA, 20 bp, Homo sapiens
ggaaacaggtgtgtgtgaac

SEQ ID NO: 1037158 - DNA, 21 bp, Homo sapiens
ggaaaccaagtcaggccaggt

SEQ ID NO: 1037159 - DNA, 19 bp, Homo sapiens
ggaaaccctggagccatcc

SEQ ID NO: 1037160 - DNA, 21 bp, Homo sapiens
ggaaacctcacgactggtcac

SEQ ID NO: 1037161 - DNA, 19 bp, Homo sapiens
ggaaacctgccctgcctga

SEQ ID NO: 1037162 - DNA, 12 bp, Homo sapiens
ggaaacctgcct

SEQ ID NO: 1037163 - DNA, 16 bp, Homo sapiens
ggaaaccttggagagg

SEQ ID NO: 1037164 - DNA, 15 bp, Homo sapiens
ggaaacgagactttc

SEQ ID NO: 1037165 - DNA, 17 bp, Homo sapiens
ggaaacgcacttacaag

SEQ ID NO: 1037166 - DNA, 23 bp, Homo sapiens
ggaaacgctacctctctgtccct

SEQ ID NO: 1037167 - DNA, 16 bp, Homo sapiens
ggaaactaagattctt

SEQ ID NO: 1037168 - DNA, 17 bp, Homo sapiens
ggaaactaagattcttt

SEQ ID NO: 1037169 - DNA, 15 bp, Homo sapiens
ggaaactcaaggagg

SEQ ID NO: 1037170 - DNA, 22 bp, Homo sapiens
ggaaactcacctgctggcccct

SEQ ID NO: 1037171 - DNA, 17 bp, Homo sapiens
ggaaactgctaaattct

SEQ ID NO: 1037172 - DNA, 11 bp, Homo sapiens
ggaaactggct

SEQ ID NO: 1037173 - DNA, 17 bp, Homo sapiens
ggaaagacaggaagacc

SEQ ID NO: 1037174 - DNA, 21 bp, Homo sapiens
ggaaagagcaccctcgagaag

SEQ ID NO: 1037175 - DNA, 23 bp, Homo sapiens
ggaaagatggtgtgggtgtcctg

SEQ ID NO: 1037176 - DNA, 15 bp, Homo sapiens
ggaaagcagagcctc

SEQ ID NO: 1037177 - DNA, 19 bp, Homo sapiens
ggaaagcagagcctcctgg

SEQ ID NO: 1037178 - DNA, 20 bp, Homo sapiens
ggaaagcagagcctcctggg

SEQ ID NO: 1037179 - DNA, 15 bp, Homo sapiens
ggaaagcaggatgta

SEQ ID NO: 1037180 - DNA, 11 bp, Homo sapiens
ggaaagcaggt

SEQ ID NO: 1037181 - DNA, 14 bp, Homo sapiens
ggaaagccacatct

SEQ ID NO: 1037182 - DNA, 20 bp, Homo sapiens
ggaaagccacctctccctca

SEQ ID NO: 1037183 - DNA, 20 bp, Homo sapiens
ggaaagctgatgatgtctct

SEQ ID NO: 1037184 - DNA, 15 bp, Homo sapiens
ggaaagcttactgtt

SEQ ID NO: 1037185 - DNA, 19 bp, Homo sapiens
ggaaaggacccacccatct

SEQ ID NO: 1037186 - DNA, 22 bp, Homo sapiens
ggaaaggccctgcacaggtggc

SEQ ID NO: 1037187 - DNA, 16 bp, Homo sapiens
ggaaaggctcatttaa

SEQ ID NO: 1037188 - DNA, 13 bp, Homo sapiens
ggaaagggaagag

SEQ ID NO: 1037189 - DNA, 15 bp, Homo sapiens
ggaaagggctggctc

SEQ ID NO: 1037190 - DNA, 13 bp, Homo sapiens
ggaaaggggagag

SEQ ID NO: 1037191 - DNA, 21 bp, Homo sapiens
ggaaaggggagagcctgctgg

SEQ ID NO: 1037192 - DNA, 21 bp, Homo sapiens
ggaaaggggttggggtgacag

SEQ ID NO: 1037193 - DNA, 22 bp, Homo sapiens
ggaaaggggttggggtgacagt

SEQ ID NO: 1037194 - DNA, 15 bp, Homo sapiens
ggaaagggtgctgct

SEQ ID NO: 1037195 - DNA, 15 bp, Homo sapiens
ggaaaggtgttgatt

SEQ ID NO: 1037196 - DNA, 19 bp, Homo sapiens
ggaaagtacactctgctgt

SEQ ID NO: 1037197 - DNA, 17 bp, Homo sapiens
ggaaagtcaagaagaat

SEQ ID NO: 1037198 - DNA, 14 bp, Homo sapiens
ggaaagtcacccaa

SEQ ID NO: 1037199 - DNA, 22 bp, Homo sapiens
ggaaagtcacccaaacacttct

SEQ ID NO: 1037200 - DNA, 13 bp, Homo sapiens
ggaaagtgaattt

SEQ ID NO: 1037201 - DNA, 16 bp, Homo sapiens
ggaaataaaacctttc

SEQ ID NO: 1037202 - DNA, 19 bp, Homo sapiens
ggaaataaaggtaaaatca

SEQ ID NO: 1037203 - DNA, 21 bp, Homo sapiens
ggaaataaaggtaaaatcact

SEQ ID NO: 1037204 - DNA, 19 bp, Homo sapiens
ggaaataacagagagaatg

SEQ ID NO: 1037205 - DNA, 20 bp, Homo sapiens
ggaaataatcatctaagacc

SEQ ID NO: 1037206 - DNA, 18 bp, Homo sapiens
ggaaatacacttcttttg

SEQ ID NO: 1037207 - DNA, 18 bp, Homo sapiens
ggaaatacagttctgctc

SEQ ID NO: 1037208 - DNA, 16 bp, Homo sapiens
ggaaataccagttctg

SEQ ID NO: 1037209 - DNA, 20 bp, Homo sapiens
ggaaatagaaagaagccata

SEQ ID NO: 1037210 - DNA, 23 bp, Homo sapiens
ggaaataggcccaaccaccagat

SEQ ID NO: 1037211 - DNA, 17 bp, Homo sapiens
ggaaatatttagcaaat

SEQ ID NO: 1037212 - DNA, 22 bp, Homo sapiens
ggaaatcaaaagggccaaagaa

SEQ ID NO: 1037213 - DNA, 16 bp, Homo sapiens
ggaaatcaaccctctc

SEQ ID NO: 1037214 - DNA, 18 bp, Homo sapiens
ggaaatccattgtttaaa

SEQ ID NO: 1037215 - DNA, 19 bp, Homo sapiens
ggaaatcttttacattttt

SEQ ID NO: 1037216 - DNA, 16 bp, Homo sapiens
ggaaatgagtggccag

SEQ ID NO: 1037217 - DNA, 21 bp, Homo sapiens
ggaaatgagtggccagcgcca

SEQ ID NO: 1037218 - DNA, 14 bp, Homo sapiens
ggaaatggggaaag

SEQ ID NO: 1037219 - DNA, 21 bp, Homo sapiens
ggaaatgtaatactggaataa

SEQ ID NO: 1037220 - DNA, 15 bp, Homo sapiens
ggaaatgtagcactt

SEQ ID NO: 1037221 - DNA, 16 bp, Homo sapiens
ggaaatgtctgctggt

SEQ ID NO: 1037222 - DNA, 15 bp, Homo sapiens
ggaaatgtgagaaat

SEQ ID NO: 1037223 - DNA, 16 bp, Homo sapiens
ggaaatgtgagaaatg

SEQ ID NO: 1037224 - DNA, 15 bp, Homo sapiens
gaatactcacatttt

SEQ ID NO: 1037225 - DNA, 14 bp, Homo sapiens
gaatactcttgaaa

SEQ ID NO: 1037226 - DNA, 13 bp, Homo sapiens
gaatactgctaca

SEQ ID NO: 1037227 - DNA, 16 bp, Homo sapiens
gaatactgggttctta

SEQ ID NO: 1037228 - DNA, 18 bp, Homo sapiens
gaatactgggttcttagt

SEQ ID NO: 1037229 - DNA, 15 bp, Homo sapiens
gaatactttttaaaa

SEQ ID NO: 1037230 - DNA, 20 bp, Homo sapiens
gaatactttttacaattaaa

SEQ ID NO: 1037231 - DNA, 23 bp, Homo sapiens
gaatagaaataaaggatgtgatt

SEQ ID NO: 1037232 - DNA, 14 bp, Homo sapiens
gaatagacatcaaa

SEQ ID NO: 1037233 - DNA, 13 bp, Homo sapiens
gaatagagctgcc

SEQ ID NO: 1037234 - DNA, 17 bp, Homo sapiens
gaatagagctgccactg

SEQ ID NO: 1037235 - DNA, 14 bp, Homo sapiens
gaatagaggaagaa

SEQ ID NO: 1037236 - DNA, 15 bp, Homo sapiens
gaatagccacatttg

SEQ ID NO: 1037237 - DNA, 18 bp, Homo sapiens
gactggatcttctatcat

SEQ ID NO: 1037238 - DNA, 16 bp, Homo sapiens
gactggatgctcgcca

SEQ ID NO: 1037239 - DNA, 15 bp, Homo sapiens
gactggcaataaact

SEQ ID NO: 1037240 - DNA, 16 bp, Homo sapiens
gactggcaataaactc

SEQ ID NO: 1037241 - DNA, 16 bp, Homo sapiens
gactggcacttagccc

SEQ ID NO: 1037242 - DNA, 19 bp, Homo sapiens
gactggcagactcaagggg

SEQ ID NO: 1037243 - DNA, 16 bp, Homo sapiens
gactggcagtaaccta

SEQ ID NO: 1037244 - DNA, 15 bp, Homo sapiens
gactggccagggcca

SEQ ID NO: 1037245 - DNA, 17 bp, Homo sapiens
gactggccatttttctg

SEQ ID NO: 1037246 - DNA, 20 bp, Homo sapiens
gactggccatttttctgggg

SEQ ID NO: 1037247 - DNA, 17 bp, Homo sapiens
gactggcgttcacctcc

SEQ ID NO: 1037248 - DNA, 21 bp, Homo sapiens
gactggcgttcacctccctgc

SEQ ID NO: 1037249 - DNA, 22 bp, Homo sapiens
gactggcgttcacctccctgct

SEQ ID NO: 1037250 - DNA, 23 bp, Homo sapiens
gactgggaccgtgcgagctgccg

SEQ ID NO: 1037251 - DNA, 19 bp, Homo sapiens
gactgggagccacttctcc

SEQ ID NO: 1037252 - DNA, 17 bp, Homo sapiens
gactgggagtcagagcc

SEQ ID NO: 1037253 - DNA, 12 bp, Homo sapiens
gactgggcccag

SEQ ID NO: 1037254 - DNA, 17 bp, Homo sapiens
gactgggcccaggcagg

SEQ ID NO: 1037255 - DNA, 21 bp, Homo sapiens
gactgggcccaggcaggtctg

SEQ ID NO: 1037256 - DNA, 12 bp, Homo sapiens
gactgggcctcc

SEQ ID NO: 1037257 - DNA, 15 bp, Homo sapiens
gactgggctgaggga

SEQ ID NO: 1037258 - DNA, 17 bp, Homo sapiens
gactggggatgtgggag

SEQ ID NO: 1037259 - DNA, 18 bp, Homo sapiens
gactggggatgtgggagg

SEQ ID NO: 1037260 - DNA, 15 bp, Homo sapiens
gactggggtgggagg

SEQ ID NO: 1037261 - DNA, 23 bp, Homo sapiens
gactgggtctcgctttgttgccc

SEQ ID NO: 1037262 - DNA, 18 bp, Homo sapiens
gactgggttagaggagtc

SEQ ID NO: 1037263 - DNA, 23 bp, Homo sapiens
gactgggtttggaccccagctgg

SEQ ID NO: 1037264 - DNA, 19 bp, Homo sapiens
gactggtgctataggctgg

SEQ ID NO: 1037265 - DNA, 22 bp, Homo sapiens
gactggtgctataggctggaga

SEQ ID NO: 1037266 - DNA, 13 bp, Homo sapiens
gactggtgggggt

SEQ ID NO: 1037267 - DNA, 21 bp, Homo sapiens
gactggtgggggttctggcag

SEQ ID NO: 1037268 - DNA, 15 bp, Homo sapiens
gactggttagtgatg

SEQ ID NO: 1037269 - DNA, 19 bp, Homo sapiens
gactggttagtgatgcagt

SEQ ID NO: 1037270 - DNA, 20 bp, Homo sapiens
gactggttgtcagaatggaa

SEQ ID NO: 1037271 - DNA, 17 bp, Homo sapiens
gactggtttacaggccc

SEQ ID NO: 1037272 - DNA, 19 bp, Homo sapiens
gactggtttacaggccctg

SEQ ID NO: 1037273 - DNA, 13 bp, Homo sapiens
gactgtaaagatt

SEQ ID NO: 1037274 - DNA, 20 bp, Homo sapiens
gactgtaccacagacacaat

SEQ ID NO: 1037275 - DNA, 16 bp, Homo sapiens
gactgtactcctccca

SEQ ID NO: 1037276 - DNA, 16 bp, Homo sapiens
gactgtactggccagt

SEQ ID NO: 1037277 - DNA, 11 bp, Homo sapiens
gactgtagaaa

SEQ ID NO: 1037278 - DNA, 21 bp, Homo sapiens
gactgtagattgcttctgtag

SEQ ID NO: 1037279 - DNA, 19 bp, Homo sapiens
gactgtagccacagctgct

SEQ ID NO: 1037280 - DNA, 13 bp, Homo sapiens
gactgtagggagg

SEQ ID NO: 1037281 - DNA, 22 bp, Homo sapiens
gactgtagggagggcggcaggg

SEQ ID NO: 1037282 - DNA, 23 bp, Homo sapiens
gactgtagggagggcggcagggg

SEQ ID NO: 1037283 - DNA, 18 bp, Homo sapiens
gactgtataggtagatcc

SEQ ID NO: 1037284 - DNA, 17 bp, Homo sapiens
gactgtatattgctaag

SEQ ID NO: 1037285 - DNA, 18 bp, Homo sapiens
gactgtatctaggcattt

SEQ ID NO: 1037286 - DNA, 17 bp, Homo sapiens
gactgtatctgtgtaga

SEQ ID NO: 1037287 - DNA, 19 bp, Homo sapiens
gactgtatctgtgtagact

SEQ ID NO: 1037288 - DNA, 17 bp, Homo sapiens
gactgtcaaatgaactt

SEQ ID NO: 1037289 - DNA, 18 bp, Homo sapiens
gactgtcaaatgaacttt

SEQ ID NO: 1037290 - DNA, 18 bp, Homo sapiens
gactgtcacactggtgct

SEQ ID NO: 1037291 - DNA, 18 bp, Homo sapiens
gactgtcaggaagtaaaa

SEQ ID NO: 1037292 - DNA, 15 bp, Homo sapiens
gactgtcagggaggg

SEQ ID NO: 1037293 - DNA, 11 bp, Homo sapiens
gactgtcccac

SEQ ID NO: 1037294 - DNA, 17 bp, Homo sapiens
gactgtcctcccacaga

SEQ ID NO: 1037295 - DNA, 20 bp, Homo sapiens
gactgtcctcccacagacct

SEQ ID NO: 1037296 - DNA, 15 bp, Homo sapiens
gactgtcctgaggag

SEQ ID NO: 1037297 - DNA, 19 bp, Homo sapiens
gactgtcctgaggagccct

SEQ ID NO: 1037298 - DNA, 21 bp, Homo sapiens
gactgtctagccactccctcc

SEQ ID NO: 1037299 - DNA, 14 bp, Homo sapiens
gactgtctcaaaaa

SEQ ID NO: 1037300 - DNA, 22 bp, Homo sapiens
gactgtctcaagagggcactgg

SEQ ID NO: 1037301 - DNA, 18 bp, Homo sapiens
gactgtctccatggccct

SEQ ID NO: 1037302 - DNA, 21 bp, Homo sapiens
gactgtgaacttgactgggtg

SEQ ID NO: 1037303 - DNA, 15 bp, Homo sapiens
gactgtgaatttcaa

SEQ ID NO: 1037304 - DNA, 19 bp, Homo sapiens
gactgtgaatttcaaaaaa

SEQ ID NO: 1037305 - DNA, 13 bp, Homo sapiens
gactgtgatgcca

SEQ ID NO: 1037306 - DNA, 17 bp, Homo sapiens
gactgtgattagatcac

SEQ ID NO: 1037307 - DNA, 23 bp, Homo sapiens
gactgtggccatatatgctgtat

SEQ ID NO: 1037308 - DNA, 12 bp, Homo sapiens
gactgtggctgc

SEQ ID NO: 1037309 - DNA, 21 bp, Homo sapiens
gactgtgggtggggaggccct

SEQ ID NO: 1037310 - DNA, 22 bp, Homo sapiens
cttgtgttcagctctttccaaa

SEQ ID NO: 1037311 - DNA, 14 bp, Homo sapiens
cttgtgtttgagaa

SEQ ID NO: 1037312 - DNA, 14 bp, Homo sapiens
cttgtgtttgctgc

SEQ ID NO: 1037313 - DNA, 16 bp, Homo sapiens
cttgtgtttgctgcag

SEQ ID NO: 1037314 - DNA, 14 bp, Homo sapiens
cttgtgtttgctta

SEQ ID NO: 1037315 - DNA, 21 bp, Homo sapiens
cttgtgtttgcttaaacaaag

SEQ ID NO: 1037316 - DNA, 22 bp, Homo sapiens
cttgttacaaattttttaattt

SEQ ID NO: 1037317 - DNA, 18 bp, Homo sapiens
cttgttactgctgattct

SEQ ID NO: 1037318 - DNA, 14 bp, Homo sapiens
cttgttacttctga

SEQ ID NO: 1037319 - DNA, 16 bp, Homo sapiens
cttgttagaaaacaaa

SEQ ID NO: 1037320 - DNA, 16 bp, Homo sapiens
cttgttagagagaaag

SEQ ID NO: 1037321 - DNA, 18 bp, Homo sapiens
cttgttagagagaaagag

SEQ ID NO: 1037322 - DNA, 20 bp, Homo sapiens
cttgttatattaagcagaaa

SEQ ID NO: 1037323 - DNA, 17 bp, Homo sapiens
cttgttatgtacaaact

SEQ ID NO: 1037324 - DNA, 16 bp, Homo sapiens
cttgttattaccaaaa

SEQ ID NO: 1037325 - DNA, 16 bp, Homo sapiens
cttgttattgaagtgt

SEQ ID NO: 1037326 - DNA, 13 bp, Homo sapiens
cttgttattgtga

SEQ ID NO: 1037327 - DNA, 16 bp, Homo sapiens
cttgttattgtgaatg

SEQ ID NO: 1037328 - DNA, 18 bp, Homo sapiens
cttgttcaaaatgcagat

SEQ ID NO: 1037329 - DNA, 12 bp, Homo sapiens
cttgttcatttt

SEQ ID NO: 1037330 - DNA, 23 bp, Homo sapiens
cttgttccactgcaaataaagcc

SEQ ID NO: 1037331 - DNA, 16 bp, Homo sapiens
cttgttccagctcttt

SEQ ID NO: 1037332 - DNA, 16 bp, Homo sapiens
cttgttccagctttga

SEQ ID NO: 1037333 - DNA, 18 bp, Homo sapiens
cttgttcccgaagtaaaa

SEQ ID NO: 1037334 - DNA, 14 bp, Homo sapiens
cttgttccctctcc

SEQ ID NO: 1037335 - DNA, 21 bp, Homo sapiens
cttgttctctaagttccactg

SEQ ID NO: 1037336 - DNA, 18 bp, Homo sapiens
cttgttctgagtaagtgt

SEQ ID NO: 1037337 - DNA, 14 bp, Homo sapiens
ctttacgtactgta

SEQ ID NO: 1037338 - DNA, 17 bp, Homo sapiens
ctttacgtactgtaact

SEQ ID NO: 1037339 - DNA, 22 bp, Homo sapiens
ctttacgtgtttaaaaaaaagc

SEQ ID NO: 1037340 - DNA, 14 bp, Homo sapiens
ctttactaacactg

SEQ ID NO: 1037341 - DNA, 16 bp, Homo sapiens
ctttactaacactggc

SEQ ID NO: 1037342 - DNA, 12 bp, Homo sapiens
ctttactactgt

SEQ ID NO: 1037343 - DNA, 19 bp, Homo sapiens
ctttactactgtggaaaga

SEQ ID NO: 1037344 - DNA, 22 bp, Homo sapiens
ctttactataagactataaata

SEQ ID NO: 1037345 - DNA, 15 bp, Homo sapiens
ctttactattaaaat

SEQ ID NO: 1037346 - DNA, 19 bp, Homo sapiens
ctttactcccttcctggcc

SEQ ID NO: 1037347 - DNA, 15 bp, Homo sapiens
ctttactcctggctc

SEQ ID NO: 1037348 - DNA, 17 bp, Homo sapiens
ctttactctgtgtttaa

SEQ ID NO: 1037349 - DNA, 23 bp, Homo sapiens
ctttactgcctgaataaagagcc

SEQ ID NO: 1037350 - DNA, 13 bp, Homo sapiens
ctttactggccat

SEQ ID NO: 1037351 - DNA, 14 bp, Homo sapiens
ctttactgtttctc

SEQ ID NO: 1037352 - DNA, 12 bp, Homo sapiens
ctttactgtttg

SEQ ID NO: 1037353 - DNA, 19 bp, Homo sapiens
ctttactttcccttgcttt

SEQ ID NO: 1037354 - DNA, 14 bp, Homo sapiens
ctttacttttaaac

SEQ ID NO: 1037355 - DNA, 23 bp, Homo sapiens
ctttacttttgctgtttatactt

SEQ ID NO: 1037356 - DNA, 12 bp, Homo sapiens
ctttagaaaata

SEQ ID NO: 1037357 - DNA, 13 bp, Homo sapiens
ctttagaaaatat

SEQ ID NO: 1037358 - DNA, 12 bp, Homo sapiens
ctttagaataat

SEQ ID NO: 1037359 - DNA, 14 bp, Homo sapiens
ctttagaatatctt

SEQ ID NO: 1037360 - DNA, 18 bp, Homo sapiens
ctttagacacacaaaaca

SEQ ID NO: 1037361 - DNA, 20 bp, Homo sapiens
ctttagaggctttcaaatgt

SEQ ID NO: 1037362 - DNA, 19 bp, Homo sapiens
ctttagatagccctgtcct

SEQ ID NO: 1037363 - DNA, 20 bp, Homo sapiens
ctttagatgttttgggatca

SEQ ID NO: 1037364 - DNA, 19 bp, Homo sapiens
ctttagcatttttatgcag

SEQ ID NO: 1037365 - DNA, 21 bp, Homo sapiens
ctttagcatttttatgcagac

SEQ ID NO: 1037366 - DNA, 15 bp, Homo sapiens
ctttagccaaaccct

SEQ ID NO: 1037367 - DNA, 20 bp, Homo sapiens
ctttagcgggactcagtgag

SEQ ID NO: 1037368 - DNA, 14 bp, Homo sapiens
ctttagggcagctt

SEQ ID NO: 1037369 - DNA, 15 bp, Homo sapiens
ctttagggcagcttg

SEQ ID NO: 1037370 - DNA, 16 bp, Homo sapiens
ctttagggcagcttgc

SEQ ID NO: 1037371 - DNA, 23 bp, Homo sapiens
ctttagggctgttgctagggaga

SEQ ID NO: 1037372 - DNA, 18 bp, Homo sapiens
ctttagggggtgggaggg

SEQ ID NO: 1037373 - DNA, 18 bp, Homo sapiens
ctttaggtttttttaatg

SEQ ID NO: 1037374 - DNA, 22 bp, Homo sapiens
ctttaggtttttttaatgatat

SEQ ID NO: 1037375 - DNA, 22 bp, Homo sapiens
ctttagtacctgaaaagtaact

SEQ ID NO: 1037376 - DNA, 14 bp, Homo sapiens
ctttagtctgcaaa

SEQ ID NO: 1037377 - DNA, 20 bp, Homo sapiens
ctttagtgaaacataataat

SEQ ID NO: 1037378 - DNA, 15 bp, Homo sapiens
ctttagtgtatttat

SEQ ID NO: 1037379 - DNA, 15 bp, Homo sapiens
ctttagtgttctgtt

SEQ ID NO: 1037380 - DNA, 14 bp, Homo sapiens
ctttataaaatgta

SEQ ID NO: 1037381 - DNA, 16 bp, Homo sapiens
ctttataaatctttct

SEQ ID NO: 1037382 - DNA, 20 bp, Homo sapiens
ctttataaatctttctctca

SEQ ID NO: 1037383 - DNA, 20 bp, Homo sapiens
ctttataagtcattgtatgt

SEQ ID NO: 1037384 - DNA, 13 bp, Homo sapiens
ctttataattcta

SEQ ID NO: 1037385 - DNA, 23 bp, Homo sapiens
ctttatacacttctggctcacag

SEQ ID NO: 1037386 - DNA, 14 bp, Homo sapiens
ctttatacagattt

SEQ ID NO: 1037387 - DNA, 14 bp, Homo sapiens
ctttatacagctgt

SEQ ID NO: 1037388 - DNA, 23 bp, Homo sapiens
ctttatacagctgtattgtctga

SEQ ID NO: 1037389 - DNA, 21 bp, Homo sapiens
ctttatagaaggaatttgtac

SEQ ID NO: 1037390 - DNA, 15 bp, Homo sapiens
ctttatatatggaca

SEQ ID NO: 1037391 - DNA, 20 bp, Homo sapiens
ctttatatcttgtttacaat

SEQ ID NO: 1037392 - DNA, 21 bp, Homo sapiens
ctttatatcttgtttacaata

SEQ ID NO: 1037393 - DNA, 16 bp, Homo sapiens
ctttatattttcctct

SEQ ID NO: 1037394 - DNA, 15 bp, Homo sapiens
ctttatcattgctaa

SEQ ID NO: 1037395 - DNA, 16 bp, Homo sapiens
ctttatcgccctgaga

SEQ ID NO: 1037396 - DNA, 16 bp, Homo sapiens
ctttatctcaacggaa

SEQ ID NO: 1037397 - DNA, 15 bp, Homo sapiens
ctttatctcctgctc

SEQ ID NO: 1037398 - DNA, 16 bp, Homo sapiens
ctttatctctgaggct

SEQ ID NO: 1037399 - DNA, 18 bp, Homo sapiens
ctttatctgttcttgcta

SEQ ID NO: 1037400 - DNA, 16 bp, Homo sapiens
ctttatcttgaagtca

SEQ ID NO: 1037401 - DNA, 18 bp, Homo sapiens
ctttatctttcacctttc

SEQ ID NO: 1037402 - DNA, 15 bp, Homo sapiens
ctttatctttgtgta

SEQ ID NO: 1037403 - DNA, 23 bp, Homo sapiens
ctttatgactgtttttgtagtgg

SEQ ID NO: 1037404 - DNA, 20 bp, Homo sapiens
ctttatgccggatgtgcttt

SEQ ID NO: 1037405 - DNA, 22 bp, Homo sapiens
ctttatgccggatgtgcttttc

SEQ ID NO: 1037406 - DNA, 15 bp, Homo sapiens
ctttatgctgtattt

SEQ ID NO: 1037407 - DNA, 13 bp, Homo sapiens
ctttatggtttct

SEQ ID NO: 1037408 - DNA, 15 bp, Homo sapiens
ctttatgtgaatttt

SEQ ID NO: 1037409 - DNA, 18 bp, Homo sapiens
ctttatgtggaaaacaga

SEQ ID NO: 1037410 - DNA, 20 bp, Homo sapiens
ctttatgttcatttgtttgt

SEQ ID NO: 1037411 - DNA, 17 bp, Homo sapiens
ctttatgttgtatgatt

SEQ ID NO: 1037412 - DNA, 18 bp, Homo sapiens
ctttatgttgtatgattc

SEQ ID NO: 1037413 - DNA, 17 bp, Homo sapiens
ctttatgtttttggtta

SEQ ID NO: 1037414 - DNA, 14 bp, Homo sapiens
ctttattaaaaact

SEQ ID NO: 1037415 - DNA, 14 bp, Homo sapiens
ctttattaagtaaa

SEQ ID NO: 1037416 - DNA, 16 bp, Homo sapiens
ctttattaagtaaaat

SEQ ID NO: 1037417 - DNA, 14 bp, Homo sapiens
ctttattaccccct

SEQ ID NO: 1037418 - DNA, 18 bp, Homo sapiens
ctttattcattaagcttt

SEQ ID NO: 1037419 - DNA, 16 bp, Homo sapiens
ctttattctttactat

SEQ ID NO: 1037420 - DNA, 18 bp, Homo sapiens
ctttattgaacttgaaat

SEQ ID NO: 1037421 - DNA, 16 bp, Homo sapiens
ctttattgaattagaa

SEQ ID NO: 1037422 - DNA, 20 bp, Homo sapiens
ctttattgaattagaaaatt

SEQ ID NO: 1037423 - DNA, 17 bp, Homo sapiens
ctttattgatatctcca

SEQ ID NO: 1037424 - DNA, 13 bp, Homo sapiens
ctttattgcacta

SEQ ID NO: 1037425 - DNA, 17 bp, Homo sapiens
ctttattgcatatagat

SEQ ID NO: 1037426 - DNA, 22 bp, Homo sapiens
ctttattgctatcgccctcctt

SEQ ID NO: 1037427 - DNA, 22 bp, Homo sapiens
ctttattgcttaatttctgcct

SEQ ID NO: 1037428 - DNA, 18 bp, Homo sapiens
ctttattgcttttttgta

SEQ ID NO: 1037429 - DNA, 12 bp, Homo sapiens
ctttattggaaa

SEQ ID NO: 1037430 - DNA, 18 bp, Homo sapiens
ctttattgtacagactgt

SEQ ID NO: 1037431 - DNA, 13 bp, Homo sapiens
ctttattgtctgt

SEQ ID NO: 1037432 - DNA, 20 bp, Homo sapiens
ctttatttaaatgcatgtct

SEQ ID NO: 1037433 - DNA, 15 bp, Homo sapiens
ctttatttatttcta

SEQ ID NO: 1037434 - DNA, 11 bp, Homo sapiens
ctttatttctg

SEQ ID NO: 1037435 - DNA, 13 bp, Homo sapiens
ctttatttgtaaa

SEQ ID NO: 1037436 - DNA, 13 bp, Homo sapiens
ctttatttgtttt

SEQ ID NO: 1037437 - DNA, 16 bp, Homo sapiens
ctttatttgttttttt

SEQ ID NO: 1037438 - DNA, 22 bp, Homo sapiens
ctttattttaacctttgataga

SEQ ID NO: 1037439 - DNA, 20 bp, Homo sapiens
ctttattttatataataaag

SEQ ID NO: 1037440 - DNA, 22 bp, Homo sapiens
ctttattttatataataaagta

SEQ ID NO: 1037441 - DNA, 20 bp, Homo sapiens
ccagcagtggtattaatact

SEQ ID NO: 1037442 - DNA, 17 bp, Homo sapiens
ccagcatccagcctgtg

SEQ ID NO: 1037443 - DNA, 18 bp, Homo sapiens
ccagcatccagcctgtgt

SEQ ID NO: 1037444 - DNA, 23 bp, Homo sapiens
ccagcatccctggagcaggagcc

SEQ ID NO: 1037445 - DNA, 19 bp, Homo sapiens
ccagcatccttttctgcag

SEQ ID NO: 1037446 - DNA, 14 bp, Homo sapiens
ccagcatctggaag

SEQ ID NO: 1037447 - DNA, 15 bp, Homo sapiens
ccagcattcagcaca

SEQ ID NO: 1037448 - DNA, 16 bp, Homo sapiens
ccagcattcagcacac

SEQ ID NO: 1037449 - DNA, 16 bp, Homo sapiens
ccagcattccagcccc

SEQ ID NO: 1037450 - DNA, 20 bp, Homo sapiens
ccagcattccagcccctctg

SEQ ID NO: 1037451 - DNA, 21 bp, Homo sapiens
ccagcattccagcccctctgg

SEQ ID NO: 1037452 - DNA, 15 bp, Homo sapiens
ccagcattccagctc

SEQ ID NO: 1037453 - DNA, 20 bp, Homo sapiens
ccagcattccagctctgccc

SEQ ID NO: 1037454 - DNA, 21 bp, Homo sapiens
ccagcattccagctctgcccc

SEQ ID NO: 1037455 - DNA, 17 bp, Homo sapiens
ccagcattgctggttct

SEQ ID NO: 1037456 - DNA, 15 bp, Homo sapiens
ccagcatttgtcctt

SEQ ID NO: 1037457 - DNA, 17 bp, Homo sapiens
ccagccaaaccctgtct

SEQ ID NO: 1037458 - DNA, 15 bp, Homo sapiens
ccagccaaagcctcc

SEQ ID NO: 1037459 - DNA, 14 bp, Homo sapiens
ctttcaagtgcctt

SEQ ID NO: 1037460 - DNA, 14 bp, Homo sapiens
ctttcaattgacaa

SEQ ID NO: 1037461 - DNA, 19 bp, Homo sapiens
ctttcaattgtcacttttt

SEQ ID NO: 1037462 - DNA, 20 bp, Homo sapiens
ctttcaattgtcacttttta

SEQ ID NO: 1037463 - DNA, 17 bp, Homo sapiens
ctttcacaaaattttat

SEQ ID NO: 1037464 - DNA, 14 bp, Homo sapiens
ctttcacaagcaac

SEQ ID NO: 1037465 - DNA, 15 bp, Homo sapiens
ctttcacagctcctc

SEQ ID NO: 1037466 - DNA, 16 bp, Homo sapiens
ctttcacatagatgtc

SEQ ID NO: 1037467 - DNA, 18 bp, Homo sapiens
ctttcaccctcatgaaaa

SEQ ID NO: 1037468 - DNA, 16 bp, Homo sapiens
ctttcacctttgtgta

SEQ ID NO: 1037469 - DNA, 19 bp, Homo sapiens
ctttcacggaaactcccga

SEQ ID NO: 1037470 - DNA, 15 bp, Homo sapiens
ctttcacgggcccca

SEQ ID NO: 1037471 - DNA, 16 bp, Homo sapiens
ctttcactatttcctt

SEQ ID NO: 1037472 - DNA, 21 bp, Homo sapiens
ctttcactatttcctttataa

SEQ ID NO: 1037473 - DNA, 22 bp, Homo sapiens
ctttcactatttcctttataat

SEQ ID NO: 1037474 - DNA, 15 bp, Homo sapiens
ctttcactggaatga

SEQ ID NO: 1037475 - DNA, 12 bp, Homo sapiens
ctttcactttga

SEQ ID NO: 1037476 - DNA, 18 bp, Homo sapiens
ctttcacttttagttggc

SEQ ID NO: 1037477 - DNA, 15 bp, Homo sapiens
ctttcagagccagcc

SEQ ID NO: 1037478 - DNA, 15 bp, Homo sapiens
ctttcagagccagtg

SEQ ID NO: 1037479 - DNA, 19 bp, Homo sapiens
ctttcagatacatggttgt

SEQ ID NO: 1037480 - DNA, 12 bp, Homo sapiens
ctttcagatgtc

SEQ ID NO: 1037481 - DNA, 15 bp, Homo sapiens
ctttcagatgtcttc

SEQ ID NO: 1037482 - DNA, 19 bp, Homo sapiens
ctttcagatgtcttctgcc

SEQ ID NO: 1037483 - DNA, 21 bp, Homo sapiens
ctttcagatgtcttctgcctg

SEQ ID NO: 1037484 - DNA, 12 bp, Homo sapiens
ctttcagatgtt

SEQ ID NO: 1037485 - DNA, 13 bp, Homo sapiens
ctttcagatgttt

SEQ ID NO: 1037486 - DNA, 21 bp, Homo sapiens
ctttcagcattaggcttttaa

SEQ ID NO: 1037487 - DNA, 23 bp, Homo sapiens
ctttcagctcatttaatcccagg

SEQ ID NO: 1037488 - DNA, 13 bp, Homo sapiens
ctttcaggctacc

SEQ ID NO: 1037489 - DNA, 14 bp, Homo sapiens
ctttcagtactttt

SEQ ID NO: 1037490 - DNA, 23 bp, Homo sapiens
ctttcagttcgttggtagagccc

SEQ ID NO: 1037491 - DNA, 14 bp, Homo sapiens
ctttcatagagagg

SEQ ID NO: 1037492 - DNA, 16 bp, Homo sapiens
ctttcatattttaaac

SEQ ID NO: 1037493 - DNA, 19 bp, Homo sapiens
ctttcatattttaaacaga

SEQ ID NO: 1037494 - DNA, 18 bp, Homo sapiens
ctttcatcacactgggtg

SEQ ID NO: 1037495 - DNA, 19 bp, Homo sapiens
ctttcatcacactgggtgg

SEQ ID NO: 1037496 - DNA, 12 bp, Homo sapiens
ctttcatcctgt

SEQ ID NO: 1037497 - DNA, 14 bp, Homo sapiens
ctttcatcctgtgt

SEQ ID NO: 1037498 - DNA, 21 bp, Homo sapiens
ctttcatcctgtgtcccctga

SEQ ID NO: 1037499 - DNA, 20 bp, Homo sapiens
ctttcatctcctgagtatgt

SEQ ID NO: 1037500 - DNA, 18 bp, Homo sapiens
ctttcatctctctacctc

SEQ ID NO: 1037501 - DNA, 20 bp, Homo sapiens
ctttcatctctctacctcca

SEQ ID NO: 1037502 - DNA, 22 bp, Homo sapiens
ctttcatgaccactgggcctgc

SEQ ID NO: 1037503 - DNA, 23 bp, Homo sapiens
ctttcatgaccactgggcctgct

SEQ ID NO: 1037504 - DNA, 18 bp, Homo sapiens
ctttcattaggcaaagta

SEQ ID NO: 1037505 - DNA, 21 bp, Homo sapiens
ctttcattcggtgtgaacttt

SEQ ID NO: 1037506 - DNA, 22 bp, Homo sapiens
ctttccaaatacccaaatgtcc

SEQ ID NO: 1037507 - DNA, 16 bp, Homo sapiens
ctttccaaatgcccag

SEQ ID NO: 1037508 - DNA, 19 bp, Homo sapiens
ctttccaaatgcccagctt

SEQ ID NO: 1037509 - DNA, 11 bp, Homo sapiens
ctttccaaatt

SEQ ID NO: 1037510 - DNA, 13 bp, Homo sapiens
ctttccaaattaa

SEQ ID NO: 1037511 - DNA, 18 bp, Homo sapiens
ctttccaaattaaaacaa

SEQ ID NO: 1037512 - DNA, 23 bp, Homo sapiens
ctttccaatgaaggaaacatcag

SEQ ID NO: 1037513 - DNA, 15 bp, Homo sapiens
ctttccaccacagcc

SEQ ID NO: 1037514 - DNA, 20 bp, Homo sapiens
ctttccaccccctccctggc

SEQ ID NO: 1037515 - DNA, 21 bp, Homo sapiens
ctttccaccccctccctggcc

SEQ ID NO: 1037516 - DNA, 22 bp, Homo sapiens
ctttccaccccctccctggcct

SEQ ID NO: 1037517 - DNA, 23 bp, Homo sapiens
ctttccaccccctccctggcctg

SEQ ID NO: 1037518 - DNA, 22 bp, Homo sapiens
ctttccacggagccactcctct

SEQ ID NO: 1037519 - DNA, 17 bp, Homo sapiens
ctttccactccctgctt

SEQ ID NO: 1037520 - DNA, 11 bp, Homo sapiens
ctttccaggca

SEQ ID NO: 1037521 - DNA, 21 bp, Homo sapiens
ctttccagggtcaaagtacag

SEQ ID NO: 1037522 - DNA, 14 bp, Homo sapiens
ctttccatctgtcc

SEQ ID NO: 1037523 - DNA, 15 bp, Homo sapiens
ctttccatctgtcca

SEQ ID NO: 1037524 - DNA, 23 bp, Homo sapiens
ctttccatctgtccacatcccca

SEQ ID NO: 1037525 - DNA, 18 bp, Homo sapiens
ctttccatgggagccagc

SEQ ID NO: 1037526 - DNA, 23 bp, Homo sapiens
ctttccatgggagccagctgctt

SEQ ID NO: 1037527 - DNA, 22 bp, Homo sapiens
ctttccatgggcccgctgcctc

SEQ ID NO: 1037528 - DNA, 17 bp, Homo sapiens
ctttccattaaatcaat

SEQ ID NO: 1037529 - DNA, 18 bp, Homo sapiens
ctttccattcttcttgct

SEQ ID NO: 1037530 - DNA, 22 bp, Homo sapiens
ctttccatttggtttagaacat

SEQ ID NO: 1037531 - DNA, 21 bp, Homo sapiens
ctttcccaaatgtattgatta

SEQ ID NO: 1037532 - DNA, 16 bp, Homo sapiens
ctttcccaactctagc

SEQ ID NO: 1037533 - DNA, 22 bp, Homo sapiens
ctttcccaggtaatttaaattg

SEQ ID NO: 1037534 - DNA, 16 bp, Homo sapiens
ctttcccatcttccaa

SEQ ID NO: 1037535 - DNA, 17 bp, Homo sapiens
ctttccccaacaatgtg

SEQ ID NO: 1037536 - DNA, 22 bp, Homo sapiens
ctttccccacgcccacccccag

SEQ ID NO: 1037537 - DNA, 13 bp, Homo sapiens
ctttccccagagg

SEQ ID NO: 1037538 - DNA, 22 bp, Homo sapiens
ctttccccagaggctcccaatc

SEQ ID NO: 1037539 - DNA, 22 bp, Homo sapiens
ctttccccagcagtttctgtcc

SEQ ID NO: 1037540 - DNA, 21 bp, Homo sapiens
ctttccccgggggaggaaggg

SEQ ID NO: 1037541 - DNA, 12 bp, Homo sapiens
ctttcccctcct

SEQ ID NO: 1037542 - DNA, 19 bp, Homo sapiens
ctttcccgggctgtccact

SEQ ID NO: 1037543 - DNA, 23 bp, Homo sapiens
ctttccctagaaagccatattcc

SEQ ID NO: 1037544 - DNA, 13 bp, Homo sapiens
ctttccctcttcc

SEQ ID NO: 1037545 - DNA, 14 bp, Homo sapiens
ctttccctgaggaa

SEQ ID NO: 1037546 - DNA, 14 bp, Homo sapiens
ctttccctggacag

SEQ ID NO: 1037547 - DNA, 15 bp, Homo sapiens
ctttcccttatcaaa

SEQ ID NO: 1037548 - DNA, 16 bp, Homo sapiens
ctttcccttattgcct

SEQ ID NO: 1037549 - DNA, 14 bp, Homo sapiens
ctttcccttccagt

SEQ ID NO: 1037550 - DNA, 17 bp, Homo sapiens
ctttcccttcctcttcg

SEQ ID NO: 1037551 - DNA, 16 bp, Homo sapiens
ctttcccttgcttttc

SEQ ID NO: 1037552 - DNA, 19 bp, Homo sapiens
ctttccgacacatttacca

SEQ ID NO: 1037553 - DNA, 17 bp, Homo sapiens
ctttccgtggcactgca

SEQ ID NO: 1037554 - DNA, 14 bp, Homo sapiens
ctttcctaaagcca

SEQ ID NO: 1037555 - DNA, 16 bp, Homo sapiens
ctttcctaaagccaaa

SEQ ID NO: 1037556 - DNA, 17 bp, Homo sapiens
ctttcctaaggctgcaa

SEQ ID NO: 1037557 - DNA, 20 bp, Homo sapiens
ctttcctaaggctgcaaggt

SEQ ID NO: 1037558 - DNA, 23 bp, Homo sapiens
ctttcctagactaattaaaatct

SEQ ID NO: 1037559 - DNA, 19 bp, Homo sapiens
ctttcctaggcccaggcct

SEQ ID NO: 1037560 - DNA, 17 bp, Homo sapiens
ctttcctatctagcatt

SEQ ID NO: 1037561 - DNA, 19 bp, Homo sapiens
ctttcctatctagcattta

SEQ ID NO: 1037562 - DNA, 13 bp, Homo sapiens
ctttcctcacatt

SEQ ID NO: 1037563 - DNA, 18 bp, Homo sapiens
ctttcctcattaaattac

SEQ ID NO: 1037564 - DNA, 12 bp, Homo sapiens
ctttcctcccca

SEQ ID NO: 1037565 - DNA, 14 bp, Homo sapiens
ctttcctccccata

SEQ ID NO: 1037566 - DNA, 18 bp, Homo sapiens
ctttcctccggagcctca

SEQ ID NO: 1037567 - DNA, 20 bp, Homo sapiens
ctttcctccggagcctcatg

SEQ ID NO: 1037568 - DNA, 23 bp, Homo sapiens
ttgaactctgttcccccaccctc

SEQ ID NO: 1037569 - DNA, 14 bp, Homo sapiens
ttgaactgaggccc

SEQ ID NO: 1037570 - DNA, 16 bp, Homo sapiens
ttgaactgaggccctg

SEQ ID NO: 1037571 - DNA, 13 bp, Homo sapiens
ttgaactgattca

SEQ ID NO: 1037572 - DNA, 17 bp, Homo sapiens
ttgaactgttagatgct

SEQ ID NO: 1037573 - DNA, 22 bp, Homo sapiens
ttgaacttgaaatctaatattt

SEQ ID NO: 1037574 - DNA, 20 bp, Homo sapiens
ttgaactttgacctctgcag

SEQ ID NO: 1037575 - DNA, 22 bp, Homo sapiens
ttgaactttgacctctgcagca

SEQ ID NO: 1037576 - DNA, 19 bp, Homo sapiens
ttgaacttttcattccctg

SEQ ID NO: 1037577 - DNA, 14 bp, Homo sapiens
ttgaacttttgtac

SEQ ID NO: 1037578 - DNA, 23 bp, Homo sapiens
ttgaagaaaagaaaaaacaacta

SEQ ID NO: 1037579 - DNA, 17 bp, Homo sapiens
ttgaagaaacagagtgg

SEQ ID NO: 1037580 - DNA, 15 bp, Homo sapiens
ttgaagaactgcact

SEQ ID NO: 1037581 - DNA, 16 bp, Homo sapiens
ttgaagaactgcactt

SEQ ID NO: 1037582 - DNA, 17 bp, Homo sapiens
ttgaagaactgcacttt

SEQ ID NO: 1037583 - DNA, 19 bp, Homo sapiens
ttgaagaactgcaggccct

SEQ ID NO: 1037584 - DNA, 17 bp, Homo sapiens
ttgaagaataaattcta

SEQ ID NO: 1037585 - DNA, 14 bp, Homo sapiens
ttgaagaatctgcc

SEQ ID NO: 1037586 - DNA, 15 bp, Homo sapiens
ttgaagaatctgccc

SEQ ID NO: 1037587 - DNA, 12 bp, Homo sapiens
ttgaagacaatt

SEQ ID NO: 1037588 - DNA, 16 bp, Homo sapiens
ttgaagacaatttgat

SEQ ID NO: 1037589 - DNA, 19 bp, Homo sapiens
ttgaagacaatttgataca

SEQ ID NO: 1037590 - DNA, 23 bp, Homo sapiens
ttgaagacaatttgatacataat

SEQ ID NO: 1037591 - DNA, 16 bp, Homo sapiens
ttgaagacaccagact

SEQ ID NO: 1037592 - DNA, 18 bp, Homo sapiens
ttgaagacggaaaacaat

SEQ ID NO: 1037593 - DNA, 16 bp, Homo sapiens
ttgaagacttcaaaat

SEQ ID NO: 1037594 - DNA, 16 bp, Homo sapiens
ttgaagacttcctctc

SEQ ID NO: 1037595 - DNA, 17 bp, Homo sapiens
ttgaagacttcctctct

SEQ ID NO: 1037596 - DNA, 18 bp, Homo sapiens
ttgaagatagtaactgta

SEQ ID NO: 1037597 - DNA, 22 bp, Homo sapiens
ttgaagatatcttgaaatgaaa

SEQ ID NO: 1037598 - DNA, 13 bp, Homo sapiens
ttgaagcaaatgt

SEQ ID NO: 1037599 - DNA, 17 bp, Homo sapiens
ttgaagcaactacaact

SEQ ID NO: 1037600 - DNA, 12 bp, Homo sapiens
ttgaagcaataa

SEQ ID NO: 1037601 - DNA, 15 bp, Homo sapiens
ttgaagcagttgtgt

SEQ ID NO: 1037602 - DNA, 22 bp, Homo sapiens
ttgaagcatagctacaatttgt

SEQ ID NO: 1037603 - DNA, 16 bp, Homo sapiens
ttgaagcatttcaaag

SEQ ID NO: 1037604 - DNA, 22 bp, Homo sapiens
ttgaagcatttcaaagccctgc

SEQ ID NO: 1037605 - DNA, 23 bp, Homo sapiens
ttgaagcatttcaaagccctgcc

SEQ ID NO: 1037606 - DNA, 20 bp, Homo sapiens
ttgaagccaagtggggtgct

SEQ ID NO: 1037607 - DNA, 17 bp, Homo sapiens
ttgaagccgactctggc

SEQ ID NO: 1037608 - DNA, 18 bp, Homo sapiens
ttgaagccgactctggcc

SEQ ID NO: 1037609 - DNA, 18 bp, Homo sapiens
ttgaagctaaaaggaaaa

SEQ ID NO: 1037610 - DNA, 23 bp, Homo sapiens
ttgaagctgttgctatttgtatt

SEQ ID NO: 1037611 - DNA, 11 bp, Homo sapiens
ttgaaggaaac

SEQ ID NO: 1037612 - DNA, 14 bp, Homo sapiens
ttgaaggaaacagt

SEQ ID NO: 1037613 - DNA, 14 bp, Homo sapiens
ttgaaggactaata

SEQ ID NO: 1037614 - DNA, 18 bp, Homo sapiens
ttgaaggattgcatcctg

SEQ ID NO: 1037615 - DNA, 15 bp, Homo sapiens
ttgaaggcagaaagc

SEQ ID NO: 1037616 - DNA, 20 bp, Homo sapiens
ttgaaggccctgctgagtca

SEQ ID NO: 1037617 - DNA, 15 bp, Homo sapiens
ttgaagggaggggct

SEQ ID NO: 1037618 - DNA, 13 bp, Homo sapiens
ttgaagggtcctg

SEQ ID NO: 1037619 - DNA, 14 bp, Homo sapiens
ttgaagggtcctgc

SEQ ID NO: 1037620 - DNA, 17 bp, Homo sapiens
ttgaaggtttcagatga

SEQ ID NO: 1037621 - DNA, 12 bp, Homo sapiens
ttgaagtaatga

SEQ ID NO: 1037622 - DNA, 16 bp, Homo sapiens
ttgaagtaatgaattt

SEQ ID NO: 1037623 - DNA, 17 bp, Homo sapiens
ttgaagtaatgaatttt

SEQ ID NO: 1037624 - DNA, 14 bp, Homo sapiens
ttgaagtcagccac

SEQ ID NO: 1037625 - DNA, 23 bp, Homo sapiens
ttgaagtcagccacactgggcct

SEQ ID NO: 1037626 - DNA, 17 bp, Homo sapiens
ttgaagtcttccctcag

SEQ ID NO: 1037627 - DNA, 18 bp, Homo sapiens
ttgaagtggccagatgag

SEQ ID NO: 1037628 - DNA, 19 bp, Homo sapiens
ttgaagtggtttctaagat

SEQ ID NO: 1037629 - DNA, 14 bp, Homo sapiens
ttgaagtgtcttct

SEQ ID NO: 1037630 - DNA, 15 bp, Homo sapiens
ttgaagtgtcttctg

SEQ ID NO: 1037631 - DNA, 16 bp, Homo sapiens
ttgaagtgtcttctgt

SEQ ID NO: 1037632 - DNA, 23 bp, Homo sapiens
ttgaagttagctttaacttaaat

SEQ ID NO: 1037633 - DNA, 19 bp, Homo sapiens
ttgaataaaaaatagacat

SEQ ID NO: 1037634 - DNA, 12 bp, Homo sapiens
ttgaataaaaag

SEQ ID NO: 1037635 - DNA, 16 bp, Homo sapiens
ttgaataaaaagtgaa

SEQ ID NO: 1037636 - DNA, 16 bp, Homo sapiens
ttgaataaaagtgcac

SEQ ID NO: 1037637 - DNA, 12 bp, Homo sapiens
ttgaataaagag

SEQ ID NO: 1037638 - DNA, 12 bp, Homo sapiens
ttgaataaataa

SEQ ID NO: 1037639 - DNA, 16 bp, Homo sapiens
ttgaataccattaaaa

SEQ ID NO: 1037640 - DNA, 19 bp, Homo sapiens
ttgaataccattaaaactg

SEQ ID NO: 1037641 - DNA, 12 bp, Homo sapiens
ttgaatactttt

SEQ ID NO: 1037642 - DNA, 21 bp, Homo sapiens
ttgaatagttgcttaattttg

SEQ ID NO: 1037643 - DNA, 23 bp, Homo sapiens
ttgaatagttgcttaattttgat

SEQ ID NO: 1037644 - DNA, 17 bp, Homo sapiens
ttgaatataaaaaatca

SEQ ID NO: 1037645 - DNA, 22 bp, Homo sapiens
ttgaatataatatatttgtgta

SEQ ID NO: 1037646 - DNA, 19 bp, Homo sapiens
ttgaatatattataatctt

SEQ ID NO: 1037647 - DNA, 22 bp, Homo sapiens
ttgaatatctttcgataaacaa

SEQ ID NO: 1037648 - DNA, 13 bp, Homo sapiens
ttgaatatgtagc

SEQ ID NO: 1037649 - DNA, 23 bp, Homo sapiens
ttgaatattattcctcaaaaaat

SEQ ID NO: 1037650 - DNA, 22 bp, Homo sapiens
ttgaatattggtaattaaaaga

SEQ ID NO: 1037651 - DNA, 16 bp, Homo sapiens
ttgaatatttaagaaa

SEQ ID NO: 1037652 - DNA, 10 bp, Homo sapiens
ttgaatcaat

SEQ ID NO: 1037653 - DNA, 22 bp, Homo sapiens
ttgaatcaataatatattttct

SEQ ID NO: 1037654 - DNA, 23 bp, Homo sapiens
ttgaatcaataatatattttctg

SEQ ID NO: 1037655 - DNA, 20 bp, Homo sapiens
ttgaatccaaatctgtcctc

SEQ ID NO: 1037656 - DNA, 14 bp, Homo sapiens
ttgaatcctttgcc

SEQ ID NO: 1037657 - DNA, 20 bp, Homo sapiens
ttgaatctatttaagtaaaa

SEQ ID NO: 1037658 - DNA, 15 bp, Homo sapiens
ttgaatctgagtgaa

SEQ ID NO: 1037659 - DNA, 11 bp, Homo sapiens
ttgaatgaaaa

SEQ ID NO: 1037660 - DNA, 20 bp, Homo sapiens
ttgaatgaaaaatttaagca

SEQ ID NO: 1037661 - DNA, 23 bp, Homo sapiens
ttgaatgaaaaatttaagcattg

SEQ ID NO: 1037662 - DNA, 16 bp, Homo sapiens
ttgaatgaaaacattt

SEQ ID NO: 1037663 - DNA, 18 bp, Homo sapiens
ttgaatgacaacagaagc

SEQ ID NO: 1037664 - DNA, 22 bp, Homo sapiens
ttgaatgagacctggaacaaat

SEQ ID NO: 1037665 - DNA, 16 bp, Homo sapiens
ttgaatgcaaaccata

SEQ ID NO: 1037666 - DNA, 13 bp, Homo sapiens
ttgaatgctgcca

SEQ ID NO: 1037667 - DNA, 15 bp, Homo sapiens
ttgaatgctgccagt

SEQ ID NO: 1037668 - DNA, 18 bp, Homo sapiens
ttgaatggcctgccttga

SEQ ID NO: 1037669 - DNA, 20 bp, Homo sapiens
ttgaatggtgttgtatgcct

SEQ ID NO: 1037670 - DNA, 22 bp, Homo sapiens
ttgaatggttaataaaactgca

SEQ ID NO: 1037671 - DNA, 15 bp, Homo sapiens
ttgaatgtaaaacag

SEQ ID NO: 1037672 - DNA, 15 bp, Homo sapiens
ttgaatgtattttgg

SEQ ID NO: 1037673 - DNA, 23 bp, Homo sapiens
ttgaatgtggataaaactgtgta

SEQ ID NO: 1037674 - DNA, 20 bp, Homo sapiens
ttgaatgtgtgaattcaata

SEQ ID NO: 1037675 - DNA, 23 bp, Homo sapiens
ttgaattaaattaggaataaata

SEQ ID NO: 1037676 - DNA, 16 bp, Homo sapiens
ttgaattagaaaatta

SEQ ID NO: 1037677 - DNA, 17 bp, Homo sapiens
ttgaattagaaaattag

SEQ ID NO: 1037678 - DNA, 23 bp, Homo sapiens
ttgaattagattatttctgtatt

SEQ ID NO: 1037679 - DNA, 16 bp, Homo sapiens
ttgaattaggctaaaa

SEQ ID NO: 1037680 - DNA, 18 bp, Homo sapiens
ttgaattgttatgaaaat

SEQ ID NO: 1037681 - DNA, 17 bp, Homo sapiens
ttgaatttcactgtctt

SEQ ID NO: 1037682 - DNA, 22 bp, Homo sapiens
ttgaatttgttagactagttct

SEQ ID NO: 1037683 - DNA, 15 bp, Homo sapiens
ttgaattttaaatct

SEQ ID NO: 1037684 - DNA, 11 bp, Homo sapiens
ttgacaaaaaa

SEQ ID NO: 1037685 - DNA, 21 bp, Homo sapiens
ttgacaaaacctaacttgcgc

SEQ ID NO: 1037686 - DNA, 18 bp, Homo sapiens
ttgacaaaggcaagcact

SEQ ID NO: 1037687 - DNA, 14 bp, Homo sapiens
ttgacaacagactg

SEQ ID NO: 1037688 - DNA, 14 bp, Homo sapiens
ttgacaactgtgac

SEQ ID NO: 1037689 - DNA, 16 bp, Homo sapiens
ttgacaactgtgactg

SEQ ID NO: 1037690 - DNA, 20 bp, Homo sapiens
ttgacaagctgacttggcac

SEQ ID NO: 1037691 - DNA, 18 bp, Homo sapiens
ttgacaaggaaaatctat

SEQ ID NO: 1037692 - DNA, 21 bp, Homo sapiens
ttgacaagttgcgacggagag

SEQ ID NO: 1037693 - DNA, 13 bp, Homo sapiens
ttgccatcactgg

SEQ ID NO: 1037694 - DNA, 23 bp, Homo sapiens
ttgccatgcaggaagaggcccac

SEQ ID NO: 1037695 - DNA, 14 bp, Homo sapiens
ttgccatgttgcca

SEQ ID NO: 1037696 - DNA, 18 bp, Homo sapiens
ttgccatttgtagctttg

SEQ ID NO: 1037697 - DNA, 15 bp, Homo sapiens
ttgcccacaggtgcg

SEQ ID NO: 1037698 - DNA, 12 bp, Homo sapiens
ttgcccacccct

SEQ ID NO: 1037699 - DNA, 19 bp, Homo sapiens
ttgcccagagatgcctcca

SEQ ID NO: 1037700 - DNA, 22 bp, Homo sapiens
ttgcccagagatgcctccaccg

SEQ ID NO: 1037701 - DNA, 15 bp, Homo sapiens
ttgcccagcagctca

SEQ ID NO: 1037702 - DNA, 16 bp, Homo sapiens
ttgcccagtcctgggt

SEQ ID NO: 1037703 - DNA, 17 bp, Homo sapiens
ttgcccagtcctgggtt

SEQ ID NO: 1037704 - DNA, 14 bp, Homo sapiens
ttgcccatcagcca

SEQ ID NO: 1037705 - DNA, 13 bp, Homo sapiens
ttgcccatcctga

SEQ ID NO: 1037706 - DNA, 16 bp, Homo sapiens
ttgcccatcctgactg

SEQ ID NO: 1037707 - DNA, 17 bp, Homo sapiens
ttgcccatcctgactga

SEQ ID NO: 1037708 - DNA, 14 bp, Homo sapiens
ttgcccatgggata

SEQ ID NO: 1037709 - DNA, 15 bp, Homo sapiens
ttgccccactctgcc

SEQ ID NO: 1037710 - DNA, 19 bp, Homo sapiens
ttgccccagacctggaaga

SEQ ID NO: 1037711 - DNA, 21 bp, Homo sapiens
ttgccccaggactctggcact

SEQ ID NO: 1037712 - DNA, 13 bp, Homo sapiens
ttgccccccaggg

SEQ ID NO: 1037713 - DNA, 16 bp, Homo sapiens
ttgcccgcacccctcc

SEQ ID NO: 1037714 - DNA, 22 bp, Homo sapiens
ttgcccgccagcctcagtgcca

SEQ ID NO: 1037715 - DNA, 13 bp, Homo sapiens
ttgcccgctccca

SEQ ID NO: 1037716 - DNA, 17 bp, Homo sapiens
ttgcccggattctggga

SEQ ID NO: 1037717 - DNA, 15 bp, Homo sapiens
ttgccctagcccaga

SEQ ID NO: 1037718 - DNA, 18 bp, Homo sapiens
ttgccctccgcctgggat

SEQ ID NO: 1037719 - DNA, 15 bp, Homo sapiens
ttgccctcctgccca

SEQ ID NO: 1037720 - DNA, 13 bp, Homo sapiens
ttgccctgacctc

SEQ ID NO: 1037721 - DNA, 15 bp, Homo sapiens
ttgccctgacctccc

SEQ ID NO: 1037722 - DNA, 21 bp, Homo sapiens
ttgccctgacctcccagccct

SEQ ID NO: 1037723 - DNA, 14 bp, Homo sapiens
ttgcccttcacagt

SEQ ID NO: 1037724 - DNA, 18 bp, Homo sapiens
ttgcccttcacagtgttt

SEQ ID NO: 1037725 - DNA, 14 bp, Homo sapiens
ttgcccttgccctg

SEQ ID NO: 1037726 - DNA, 15 bp, Homo sapiens
ttgcccttgccctga

SEQ ID NO: 1037727 - DNA, 14 bp, Homo sapiens
ttgcccttggagct

SEQ ID NO: 1037728 - DNA, 22 bp, Homo sapiens
ttgccgcagcggtgggaaggaa

SEQ ID NO: 1037729 - DNA, 22 bp, Homo sapiens
ttgccgcgtcgccctcccaggc

SEQ ID NO: 1037730 - DNA, 14 bp, Homo sapiens
ttgccgctcccctt

SEQ ID NO: 1037731 - DNA, 18 bp, Homo sapiens
ttgcctaaatttaatgct

SEQ ID NO: 1037732 - DNA, 18 bp, Homo sapiens
ttgcctaactaactggca

SEQ ID NO: 1037733 - DNA, 19 bp, Homo sapiens
ttgcctaataaacatcctt

SEQ ID NO: 1037734 - DNA, 15 bp, Homo sapiens
ttgcctacaataaaa

SEQ ID NO: 1037735 - DNA, 18 bp, Homo sapiens
ttgcctacaataaaaaga

SEQ ID NO: 1037736 - DNA, 19 bp, Homo sapiens
ttgcctacaataaaaagaa

SEQ ID NO: 1037737 - DNA, 17 bp, Homo sapiens
ttgcctactatgccaga

SEQ ID NO: 1037738 - DNA, 23 bp, Homo sapiens
ttgcctagccccaggtcttttct

SEQ ID NO: 1037739 - DNA, 23 bp, Homo sapiens
ttgcctccactcaccacaagctg

SEQ ID NO: 1037740 - DNA, 21 bp, Homo sapiens
ttgcctcccaggcaagcagct

SEQ ID NO: 1037741 - DNA, 15 bp, Homo sapiens
ttgcctcctgtgtaa

SEQ ID NO: 1037742 - DNA, 21 bp, Homo sapiens
ttgcctctcttgccccttgtc

SEQ ID NO: 1037743 - DNA, 13 bp, Homo sapiens
ttgcctctgtcca

SEQ ID NO: 1037744 - DNA, 21 bp, Homo sapiens
ttgcctctgtcctcccatccc

SEQ ID NO: 1037745 - DNA, 12 bp, Homo sapiens
ttgcctctgtgc

SEQ ID NO: 1037746 - DNA, 13 bp, Homo sapiens
ttgcctctgtgct

SEQ ID NO: 1037747 - DNA, 17 bp, Homo sapiens
ttgcctcttccagtctt

SEQ ID NO: 1037748 - DNA, 19 bp, Homo sapiens
ttgcctcttccagtcttcc

SEQ ID NO: 1037749 - DNA, 19 bp, Homo sapiens
ttgcctgaacatccttcct

SEQ ID NO: 1037750 - DNA, 15 bp, Homo sapiens
ttgcctgaactccag

SEQ ID NO: 1037751 - DNA, 20 bp, Homo sapiens
ttgcctgaagttggagtgag

SEQ ID NO: 1037752 - DNA, 13 bp, Homo sapiens
ttgcctgcagaga

SEQ ID NO: 1037753 - DNA, 22 bp, Homo sapiens
ttgcctgcgttttggaagctct

SEQ ID NO: 1037754 - DNA, 21 bp, Homo sapiens
ttgcctgctgtatttatagta

SEQ ID NO: 1037755 - DNA, 20 bp, Homo sapiens
ttgcctggctgtggaggcct

SEQ ID NO: 1037756 - DNA, 12 bp, Homo sapiens
ttgcctgggctg

SEQ ID NO: 1037757 - DNA, 18 bp, Homo sapiens
ttgcctgggctgggcagc

SEQ ID NO: 1037758 - DNA, 21 bp, Homo sapiens
ttgcctgggctgggcagcctt

SEQ ID NO: 1037759 - DNA, 14 bp, Homo sapiens
ttgcctggtacagt

SEQ ID NO: 1037760 - DNA, 12 bp, Homo sapiens
ttgcctgtgcca

SEQ ID NO: 1037761 - DNA, 16 bp, Homo sapiens
ttgcctgttctgcttc

SEQ ID NO: 1037762 - DNA, 16 bp, Homo sapiens
ttgccttaaacctgaa

SEQ ID NO: 1037763 - DNA, 22 bp, Homo sapiens
ttgccttaaacctgaagatgtc

SEQ ID NO: 1037764 - DNA, 16 bp, Homo sapiens
ttgccttaaagaaagt

SEQ ID NO: 1037765 - DNA, 13 bp, Homo sapiens
ttgccttatttcc

SEQ ID NO: 1037766 - DNA, 12 bp, Homo sapiens
ttgccttatttg

SEQ ID NO: 1037767 - DNA, 20 bp, Homo sapiens
ttgccttccatttcccctct

SEQ ID NO: 1037768 - DNA, 20 bp, Homo sapiens
ttgccttcctcgtgcagagc

SEQ ID NO: 1037769 - DNA, 20 bp, Homo sapiens
ttgccttcctttctccagga

SEQ ID NO: 1037770 - DNA, 15 bp, Homo sapiens
ttgccttctggttat

SEQ ID NO: 1037771 - DNA, 19 bp, Homo sapiens
ttgccttcttcacccagct

SEQ ID NO: 1037772 - DNA, 21 bp, Homo sapiens
ttgccttgaaccacttccctc

SEQ ID NO: 1037773 - DNA, 14 bp, Homo sapiens
ttgccttgcttctc

SEQ ID NO: 1037774 - DNA, 20 bp, Homo sapiens
ttgccttgggctgctcctca

SEQ ID NO: 1037775 - DNA, 22 bp, Homo sapiens
ttgccttgtatgcaaatgagtt

SEQ ID NO: 1037776 - DNA, 15 bp, Homo sapiens
ttgcctttaatattt

SEQ ID NO: 1037777 - DNA, 12 bp, Homo sapiens
ttgcctttccag

SEQ ID NO: 1037778 - DNA, 16 bp, Homo sapiens
ttgcctttgaatgtta

SEQ ID NO: 1037779 - DNA, 17 bp, Homo sapiens
ttgcctttgttttgatg

SEQ ID NO: 1037780 - DNA, 22 bp, Homo sapiens
ttgcctttttaagtaaaaaaga

SEQ ID NO: 1037781 - DNA, 22 bp, Homo sapiens
ttgcgacgcgggcttctggagc

SEQ ID NO: 1037782 - DNA, 14 bp, Homo sapiens
ttgcggaagccata

SEQ ID NO: 1037783 - DNA, 15 bp, Homo sapiens
ttgcggaagccatag

SEQ ID NO: 1037784 - DNA, 14 bp, Homo sapiens
ttgcgggacagagt

SEQ ID NO: 1037785 - DNA, 15 bp, Homo sapiens
ttgcgtacacagaga

SEQ ID NO: 1037786 - DNA, 13 bp, Homo sapiens
ttgcgtagaggct

SEQ ID NO: 1037787 - DNA, 16 bp, Homo sapiens
ttgcgtatgtctgtta

SEQ ID NO: 1037788 - DNA, 18 bp, Homo sapiens
ttgcgtatgtctgttacc

SEQ ID NO: 1037789 - DNA, 14 bp, Homo sapiens
ttgcgtcaagtcta

SEQ ID NO: 1037790 - DNA, 16 bp, Homo sapiens
ttgcgtggatcaagct

SEQ ID NO: 1037791 - DNA, 16 bp, Homo sapiens
ttgcgttacacccttt

SEQ ID NO: 1037792 - DNA, 12 bp, Homo sapiens
ttgacaataaaa

SEQ ID NO: 1037793 - DNA, 14 bp, Homo sapiens
ttgacaataaaata

SEQ ID NO: 1037794 - DNA, 15 bp, Homo sapiens
ttgacaataaaatat

SEQ ID NO: 1037795 - DNA, 16 bp, Homo sapiens
ttgacaataaaatatt

SEQ ID NO: 1037796 - DNA, 18 bp, Homo sapiens
ttgacaataatttcaggt

SEQ ID NO: 1037797 - DNA, 12 bp, Homo sapiens
ttgacaatcaaa

SEQ ID NO: 1037798 - DNA, 14 bp, Homo sapiens
ttgacaattctgca

SEQ ID NO: 1037799 - DNA, 22 bp, Homo sapiens
ttgacacaaagcttctaaagca

SEQ ID NO: 1037800 - DNA, 18 bp, Homo sapiens
ttgacacaagtggacctt

SEQ ID NO: 1037801 - DNA, 13 bp, Homo sapiens
ttgacacaggtct

SEQ ID NO: 1037802 - DNA, 22 bp, Homo sapiens
ttgacacaggtctttcctaagg

SEQ ID NO: 1037803 - DNA, 17 bp, Homo sapiens
ttgacacatatgaacac

SEQ ID NO: 1037804 - DNA, 15 bp, Homo sapiens
ttgacaccttagaga

SEQ ID NO: 1037805 - DNA, 14 bp, Homo sapiens
ttgacactgaactt

SEQ ID NO: 1037806 - DNA, 15 bp, Homo sapiens
ttgacactgaactta

SEQ ID NO: 1037807 - DNA, 22 bp, Homo sapiens
ttgacactgaacttaataactg

SEQ ID NO: 1037808 - DNA, 14 bp, Homo sapiens
ttgacactgctcta

SEQ ID NO: 1037809 - DNA, 22 bp, Homo sapiens
ttgacactgctctaacagccct

SEQ ID NO: 1037810 - DNA, 23 bp, Homo sapiens
ttgacactgctctaacagccctc

SEQ ID NO: 1037811 - DNA, 21 bp, Homo sapiens
ttgacacttttaaaaaacaaa

SEQ ID NO: 1037812 - DNA, 18 bp, Homo sapiens
ttgacacttttcatatca

SEQ ID NO: 1037813 - DNA, 19 bp, Homo sapiens
ttgacacttttcatatcat

SEQ ID NO: 1037814 - DNA, 20 bp, Homo sapiens
ttgacactttttgtattttt

SEQ ID NO: 1037815 - DNA, 23 bp, Homo sapiens
ttgacagaaccctttgggagcaa

SEQ ID NO: 1037816 - DNA, 17 bp, Homo sapiens
ttgacagatcaagctgt

SEQ ID NO: 1037817 - DNA, 19 bp, Homo sapiens
ttgacagatcaagctgtga

SEQ ID NO: 1037818 - DNA, 23 bp, Homo sapiens
ttgacagcaaaatgttgaagaaa

SEQ ID NO: 1037819 - DNA, 18 bp, Homo sapiens
ttgacagctttgctgctg

SEQ ID NO: 1037820 - DNA, 19 bp, Homo sapiens
ttgacagctttgctgctga

SEQ ID NO: 1037821 - DNA, 18 bp, Homo sapiens
ttgacatcagttcctttg

SEQ ID NO: 1037822 - DNA, 17 bp, Homo sapiens
ttgacatccaaatctag

SEQ ID NO: 1037823 - DNA, 22 bp, Homo sapiens
ttgacatgaccctctgtcccca

SEQ ID NO: 1037824 - DNA, 13 bp, Homo sapiens
ttgacatggaaat

SEQ ID NO: 1037825 - DNA, 16 bp, Homo sapiens
ttgacatggaaatgaa

SEQ ID NO: 1037826 - DNA, 21 bp, Homo sapiens
ttgacatgtgaagctatttga

SEQ ID NO: 1037827 - DNA, 14 bp, Homo sapiens
ttgacattctgaat

SEQ ID NO: 1037828 - DNA, 18 bp, Homo sapiens
ttgacattctgaatgctt

SEQ ID NO: 1037829 - DNA, 20 bp, Homo sapiens
ttgacattctgaatgcttct

SEQ ID NO: 1037830 - DNA, 18 bp, Homo sapiens
ttgacattgcgtttgacc

SEQ ID NO: 1037831 - DNA, 14 bp, Homo sapiens
ttgaccaagaactg

SEQ ID NO: 1037832 - DNA, 16 bp, Homo sapiens
ttgaccaagaactgca

SEQ ID NO: 1037833 - DNA, 13 bp, Homo sapiens
ttgaccactccag

SEQ ID NO: 1037834 - DNA, 17 bp, Homo sapiens
ttgaccagatctttctc

SEQ ID NO: 1037835 - DNA, 22 bp, Homo sapiens
ttgaccagatctttctcttccc

SEQ ID NO: 1037836 - DNA, 20 bp, Homo sapiens
ttgacctcaatggaggtttg

SEQ ID NO: 1037837 - DNA, 15 bp, Homo sapiens
ttgacctcagctgca

SEQ ID NO: 1037838 - DNA, 16 bp, Homo sapiens
ttgacctcagctgcac

SEQ ID NO: 1037839 - DNA, 22 bp, Homo sapiens
ttgacctcagctgcacattcct

SEQ ID NO: 1037840 - DNA, 23 bp, Homo sapiens
ttgacctcagctgcacattcctg

SEQ ID NO: 1037841 - DNA, 16 bp, Homo sapiens
ttgacctctataaact

SEQ ID NO: 1037842 - DNA, 13 bp, Homo sapiens
ttgacctgaggct

SEQ ID NO: 1037843 - DNA, 17 bp, Homo sapiens
ttgacctgcattgtaaa

SEQ ID NO: 1037844 - DNA, 20 bp, Homo sapiens
ttgacctttaaatgcaacag

SEQ ID NO: 1037845 - DNA, 18 bp, Homo sapiens
ttgacggccttcttggtt

SEQ ID NO: 1037846 - DNA, 15 bp, Homo sapiens
ttgacgtttcttctt

SEQ ID NO: 1037847 - DNA, 15 bp, Homo sapiens
ttgactaaagctatg

SEQ ID NO: 1037848 - DNA, 17 bp, Homo sapiens
ttgactaagaattttgt

SEQ ID NO: 1037849 - DNA, 23 bp, Homo sapiens
ttgactagatgatggatgccaat

SEQ ID NO: 1037850 - DNA, 19 bp, Homo sapiens
ttgactagggattcaggct

SEQ ID NO: 1037851 - DNA, 15 bp, Homo sapiens
ttgactcaggattta

SEQ ID NO: 1037852 - DNA, 21 bp, Homo sapiens
ttgactcctttccaatagaaa

SEQ ID NO: 1037853 - DNA, 12 bp, Homo sapiens
ttgactcttccg

SEQ ID NO: 1037854 - DNA, 14 bp, Homo sapiens
ttgactctttcaaa

SEQ ID NO: 1037855 - DNA, 20 bp, Homo sapiens
ttgactcttttgagtggtaa

SEQ ID NO: 1037856 - DNA, 21 bp, Homo sapiens
ttgactggtttacaggccctg

SEQ ID NO: 1037857 - DNA, 16 bp, Homo sapiens
ttgactgtagccacag

SEQ ID NO: 1037858 - DNA, 15 bp, Homo sapiens
ttgactgtcagcaag

SEQ ID NO: 1037859 - DNA, 21 bp, Homo sapiens
ttgactgtctagccactccct

SEQ ID NO: 1037860 - DNA, 22 bp, Homo sapiens
ttgactgtctagccactccctc

SEQ ID NO: 1037861 - DNA, 19 bp, Homo sapiens
ttgactgtctcacttttta

SEQ ID NO: 1037862 - DNA, 21 bp, Homo sapiens
ttgactgtgattagatcacat

SEQ ID NO: 1037863 - DNA, 21 bp, Homo sapiens
ttgacttaatgtgattactgc

SEQ ID NO: 1037864 - DNA, 18 bp, Homo sapiens
ttgacttatagtacatga

SEQ ID NO: 1037865 - DNA, 16 bp, Homo sapiens
ttgacttattttctct

SEQ ID NO: 1037866 - DNA, 13 bp, Homo sapiens
ttgacttcagatt

SEQ ID NO: 1037867 - DNA, 21 bp, Homo sapiens
ttgacttcttgcttcagtcat

SEQ ID NO: 1037868 - DNA, 22 bp, Homo sapiens
ttgacttcttggtttggggaga

SEQ ID NO: 1037869 - DNA, 13 bp, Homo sapiens
ttgactttataaa

SEQ ID NO: 1037870 - DNA, 16 bp, Homo sapiens
ttgactttcaaaatat

SEQ ID NO: 1037871 - DNA, 13 bp, Homo sapiens
ttgactttcaggt

SEQ ID NO: 1037872 - DNA, 14 bp, Homo sapiens
ttgactttcttaaa

SEQ ID NO: 1037873 - DNA, 18 bp, Homo sapiens
ttgactttcttaaaaata

SEQ ID NO: 1037874 - DNA, 13 bp, Homo sapiens
ttgacttttctgt

SEQ ID NO: 1037875 - DNA, 18 bp, Homo sapiens
ttgacttttctgtaattc

SEQ ID NO: 1037876 - DNA, 19 bp, Homo sapiens
ttgacttttctgtaattca

SEQ ID NO: 1037877 - DNA, 19 bp, Homo sapiens
ttgagaaaaatatatacta

SEQ ID NO: 1037878 - DNA, 21 bp, Homo sapiens
ttgagaaatatggacacttaa

SEQ ID NO: 1037879 - DNA, 16 bp, Homo sapiens
ttgagaaatgaataat

SEQ ID NO: 1037880 - DNA, 22 bp, Homo sapiens
ttgagaaatgaataatttccca

SEQ ID NO: 1037881 - DNA, 19 bp, Homo sapiens
ttgagaaccagtctcctca

SEQ ID NO: 1037882 - DNA, 22 bp, Homo sapiens
ttgagaaccttggaccactcct

SEQ ID NO: 1037883 - DNA, 21 bp, Homo sapiens
ttgagaagccttcagctccag

SEQ ID NO: 1037884 - DNA, 15 bp, Homo sapiens
ttgagaagcgttttt

SEQ ID NO: 1037885 - DNA, 17 bp, Homo sapiens
ttgagaataagaatttg

SEQ ID NO: 1037886 - DNA, 15 bp, Homo sapiens
ttgagaatgtgattc

SEQ ID NO: 1037887 - DNA, 13 bp, Homo sapiens
ttgagaattattc

SEQ ID NO: 1037888 - DNA, 13 bp, Homo sapiens
ttgagaattttaa

SEQ ID NO: 1037889 - DNA, 18 bp, Homo sapiens
ttgagaattttgtttcaa

SEQ ID NO: 1037890 - DNA, 14 bp, Homo sapiens
ttgagacaagccct

SEQ ID NO: 1037891 - DNA, 15 bp, Homo sapiens
ttgagacaagccctg

SEQ ID NO: 1037892 - DNA, 18 bp, Homo sapiens
ttgagacaagccctggca

SEQ ID NO: 1037893 - DNA, 20 bp, Homo sapiens
ttgagacaagccctggcaac

SEQ ID NO: 1037894 - DNA, 22 bp, Homo sapiens
ttgagacacggagcccagccct

SEQ ID NO: 1037895 - DNA, 22 bp, Homo sapiens
ttgagacactggtttacacttt

SEQ ID NO: 1037896 - DNA, 20 bp, Homo sapiens
ttgagaccaacttttcaatg

SEQ ID NO: 1037897 - DNA, 17 bp, Homo sapiens
ttgagacctcagccatg

SEQ ID NO: 1037898 - DNA, 21 bp, Homo sapiens
ttgagacgcaccatgtgggca

SEQ ID NO: 1037899 - DNA, 18 bp, Homo sapiens
ttgagactgaaatttagt

SEQ ID NO: 1037900 - DNA, 19 bp, Homo sapiens
ttgagactgaaatttagta

SEQ ID NO: 1037901 - DNA, 17 bp, Homo sapiens
ttgagagaagagacaaa

SEQ ID NO: 1037902 - DNA, 15 bp, Homo sapiens
ttgagataaagtcaa

SEQ ID NO: 1037903 - DNA, 16 bp, Homo sapiens
ttgagatactattttc

SEQ ID NO: 1037904 - DNA, 22 bp, Homo sapiens
ttgagatagttttcatccataa

SEQ ID NO: 1037905 - DNA, 18 bp, Homo sapiens
ttgagatgagtttctggg

SEQ ID NO: 1037906 - DNA, 14 bp, Homo sapiens
ttgagatgcctgtt

SEQ ID NO: 1037907 - DNA, 21 bp, Homo sapiens
ttgagatggagtttctctctt

SEQ ID NO: 1037908 - DNA, 23 bp, Homo sapiens
ttgagatggagtttctctcttgt

SEQ ID NO: 1037909 - DNA, 19 bp, Homo sapiens
ttgagatttttaagaactt

SEQ ID NO: 1037910 - DNA, 20 bp, Homo sapiens
ttgagatttttaagaacttc

SEQ ID NO: 1037911 - DNA, 19 bp, Homo sapiens
ttgagcatgacagcctgca

SEQ ID NO: 1037912 - DNA, 16 bp, Homo sapiens
ttgagcatttttaagg

SEQ ID NO: 1037913 - DNA, 17 bp, Homo sapiens
ttgagccagtaatcttt

SEQ ID NO: 1037914 - DNA, 19 bp, Homo sapiens
ttgagcccacaaagcctta

SEQ ID NO: 1037915 - DNA, 19 bp, Homo sapiens
ttgagccccaagtcctgaa

SEQ ID NO: 1037916 - DNA, 19 bp, Homo sapiens
ttgagccgggcccctgggc

SEQ ID NO: 1037917 - DNA, 14 bp, Homo sapiens
ttgagcctgggagg

SEQ ID NO: 1037918 - DNA, 14 bp, Homo sapiens
ttgagccttgaact

SEQ ID NO: 1037919 - DNA, 20 bp, Homo sapiens
ttgagcgtgaatctgtatct

SEQ ID NO: 1037920 - DNA, 20 bp, Homo sapiens
ttgagctactggattcttat

SEQ ID NO: 1037921 - DNA, 13 bp, Homo sapiens
ttgagctcagccc

SEQ ID NO: 1037922 - DNA, 13 bp, Homo sapiens
ttgagctctgtaa

SEQ ID NO: 1037923 - DNA, 15 bp, Homo sapiens
ttgagctgccttccc

SEQ ID NO: 1037924 - DNA, 15 bp, Homo sapiens
ttgagcttaatcttt

SEQ ID NO: 1037925 - DNA, 18 bp, Homo sapiens
ttgagcttagtgaaatta

SEQ ID NO: 1037926 - DNA, 23 bp, Homo sapiens
ttgaggaaaacaagcattcacaa

SEQ ID NO: 1037927 - DNA, 18 bp, Homo sapiens
ttgaggaaacaacagctt

SEQ ID NO: 1037928 - DNA, 23 bp, Homo sapiens
ttgaggagaagggggtctctgtt

SEQ ID NO: 1037929 - DNA, 19 bp, Homo sapiens
ttgaggagacgaagtgaaa

SEQ ID NO: 1037930 - DNA, 13 bp, Homo sapiens
ttgaggagtgtga

SEQ ID NO: 1037931 - DNA, 18 bp, Homo sapiens
ttgaggataaaaaggaag

SEQ ID NO: 1037932 - DNA, 23 bp, Homo sapiens
ttgaggataaaaaggaaggagag

SEQ ID NO: 1037933 - DNA, 21 bp, Homo sapiens
ttgaggattgtggaaaaccag

SEQ ID NO: 1037934 - DNA, 15 bp, Homo sapiens
ttgaggctgcagcag

SEQ ID NO: 1037935 - DNA, 14 bp, Homo sapiens
ttgaggctgcagcg

SEQ ID NO: 1037936 - DNA, 19 bp, Homo sapiens
ttgaggctgtcacagtcct

SEQ ID NO: 1037937 - DNA, 17 bp, Homo sapiens
ttgaggcttctccttct

SEQ ID NO: 1037938 - DNA, 16 bp, Homo sapiens
ttgagggaaagagctt

SEQ ID NO: 1037939 - DNA, 17 bp, Homo sapiens
ttgagggaaagagctta

SEQ ID NO: 1037940 - DNA, 14 bp, Homo sapiens
ttgagggaaggttc

SEQ ID NO: 1037941 - DNA, 20 bp, Homo sapiens
ttgagggacgctttgtctgt

SEQ ID NO: 1037942 - DNA, 17 bp, Homo sapiens
ttgagggcaagccacca

SEQ ID NO: 1037943 - DNA, 20 bp, Homo sapiens
ttgagggccagtgatgatgt

SEQ ID NO: 1037944 - DNA, 14 bp, Homo sapiens
ttgagggcccagag

SEQ ID NO: 1037945 - DNA, 15 bp, Homo sapiens
ttgagggcccagagc

SEQ ID NO: 1037946 - DNA, 16 bp, Homo sapiens
ttgagggcccagagca

SEQ ID NO: 1037947 - DNA, 21 bp, Homo sapiens
ttgagggcccagagcaggaag

SEQ ID NO: 1037948 - DNA, 23 bp, Homo sapiens
ttgagggcccagagcaggaagca

SEQ ID NO: 1037949 - DNA, 21 bp, Homo sapiens
ttgagggcccagccaggagca

SEQ ID NO: 1037950 - DNA, 15 bp, Homo sapiens
ttgagggctgcagtt

SEQ ID NO: 1037951 - DNA, 20 bp, Homo sapiens
ttgaggggccaggggcaggc

SEQ ID NO: 1037952 - DNA, 17 bp, Homo sapiens
ttgaggggccccagcgt

SEQ ID NO: 1037953 - DNA, 15 bp, Homo sapiens
ttgaggggcctggag

SEQ ID NO: 1037954 - DNA, 18 bp, Homo sapiens
ttgagggtgggccagcat

SEQ ID NO: 1037955 - DNA, 21 bp, Homo sapiens
ttgaggtagaggggaaggaaa

SEQ ID NO: 1037956 - DNA, 23 bp, Homo sapiens
ttgaggtaggagaggcgggagaa

SEQ ID NO: 1037957 - DNA, 16 bp, Homo sapiens
ttgaggtcaagtaaga

SEQ ID NO: 1037958 - DNA, 15 bp, Homo sapiens
ttgaggtctgttctt

SEQ ID NO: 1037959 - DNA, 17 bp, Homo sapiens
ttgaggtcttttgacat

SEQ ID NO: 1037960 - DNA, 19 bp, Homo sapiens
ttgaggtggaagccctcct

SEQ ID NO: 1037961 - DNA, 22 bp, Homo sapiens
ttgaggtggaagccctccttcc

SEQ ID NO: 1037962 - DNA, 21 bp, Homo sapiens
ttgaggtggtctgaatgttct

SEQ ID NO: 1037963 - DNA, 19 bp, Homo sapiens
ttgaggtggtgccttctca

SEQ ID NO: 1037964 - DNA, 15 bp, Homo sapiens
ttgagtaaaacacat

SEQ ID NO: 1037965 - DNA, 15 bp, Homo sapiens
ttgagtaagaacatc

SEQ ID NO: 1037966 - DNA, 19 bp, Homo sapiens
ttgagtacagtgaggaggg

SEQ ID NO: 1037967 - DNA, 23 bp, Homo sapiens
ttgagtaggtaccttgtagcagt

SEQ ID NO: 1037968 - DNA, 17 bp, Homo sapiens
ttgagtcctaggactta

SEQ ID NO: 1037969 - DNA, 22 bp, Homo sapiens
ttgagtctgtttttttatagtt

SEQ ID NO: 1037970 - DNA, 14 bp, Homo sapiens
ttgagtgacagctt

SEQ ID NO: 1037971 - DNA, 14 bp, Homo sapiens
ttgagtgactcgag

SEQ ID NO: 1037972 - DNA, 23 bp, Homo sapiens
ttgagtgagccgggaccgtgcca

SEQ ID NO: 1037973 - DNA, 16 bp, Homo sapiens
ttgagtgctgggggag

SEQ ID NO: 1037974 - DNA, 21 bp, Homo sapiens
ttgagtgctgtctccatgttt

SEQ ID NO: 1037975 - DNA, 17 bp, Homo sapiens
ttgagtggatgatgttt

SEQ ID NO: 1037976 - DNA, 20 bp, Homo sapiens
ttgagtgggccctgcccggg

SEQ ID NO: 1037977 - DNA, 23 bp, Homo sapiens
ttgagtggggttatctctgtgtt

SEQ ID NO: 1037978 - DNA, 14 bp, Homo sapiens
ttgagtgtactgtg

SEQ ID NO: 1037979 - DNA, 19 bp, Homo sapiens
ttgagtgtatacatgtgtg

SEQ ID NO: 1037980 - DNA, 15 bp, Homo sapiens
ttgagtgtgtgtgtg

SEQ ID NO: 1037981 - DNA, 18 bp, Homo sapiens
ttgagtgtgtgtgtgcat

SEQ ID NO: 1037982 - DNA, 23 bp, Homo sapiens
ttgagtgttcctttttaaatgtg

SEQ ID NO: 1037983 - DNA, 20 bp, Homo sapiens
ttgagttaagtctatctggt

SEQ ID NO: 1037984 - DNA, 15 bp, Homo sapiens
ttgagttcctctgca

SEQ ID NO: 1037985 - DNA, 22 bp, Homo sapiens
ttgagttctgattgtgttgaag

SEQ ID NO: 1037986 - DNA, 18 bp, Homo sapiens
ttgagttcttcctgtaat

SEQ ID NO: 1037987 - DNA, 16 bp, Homo sapiens
ttgagtttattctgat

SEQ ID NO: 1037988 - DNA, 14 bp, Homo sapiens
ttgagtttcatgtt

SEQ ID NO: 1037989 - DNA, 20 bp, Homo sapiens
ttgagttttatttattttat

SEQ ID NO: 1037990 - DNA, 12 bp, Homo sapiens
ttgagttttgtt

SEQ ID NO: 1037991 - DNA, 21 bp, Homo sapiens
ttgagttttgttttaaaatta

SEQ ID NO: 1037992 - DNA, 14 bp, Homo sapiens
ttgagtttttcctc

SEQ ID NO: 1037993 - DNA, 18 bp, Homo sapiens
ttgataaattccactgga

SEQ ID NO: 1037994 - DNA, 16 bp, Homo sapiens
ttgataatacttgacc

SEQ ID NO: 1037995 - DNA, 19 bp, Homo sapiens
ttgatacaaaccactgtga

SEQ ID NO: 1037996 - DNA, 19 bp, Homo sapiens
ttgatacagttttcagaaa

SEQ ID NO: 1037997 - DNA, 13 bp, Homo sapiens
ttgatacataata

SEQ ID NO: 1037998 - DNA, 17 bp, Homo sapiens
ttgatacataataaaaa

SEQ ID NO: 1037999 - DNA, 16 bp, Homo sapiens
ttgataccttcaatga

SEQ ID NO: 1038000 - DNA, 23 bp, Homo sapiens
ttgatacgtccgtgtgtcccaga

SEQ ID NO: 1038001 - DNA, 15 bp, Homo sapiens
ttgatactaagcatt

SEQ ID NO: 1038002 - DNA, 20 bp, Homo sapiens
ttgatacttcaggtgctttt

SEQ ID NO: 1038003 - DNA, 16 bp, Homo sapiens
ttgatacttgttcaaa

SEQ ID NO: 1038004 - DNA, 17 bp, Homo sapiens
ttgatacttgttcaaaa

SEQ ID NO: 1038005 - DNA, 18 bp, Homo sapiens
ttgatacttgttccagat

SEQ ID NO: 1038006 - DNA, 20 bp, Homo sapiens
ttgatagcatggggcccctg

SEQ ID NO: 1038007 - DNA, 22 bp, Homo sapiens
ttgataggaaggaaactggaat

SEQ ID NO: 1038008 - DNA, 19 bp, Homo sapiens
ttgatagggaactggggaa

SEQ ID NO: 1038009 - DNA, 16 bp, Homo sapiens
ttgatatacattgtgt

SEQ ID NO: 1038010 - DNA, 19 bp, Homo sapiens
ttgatataccaaattaaaa

SEQ ID NO: 1038011 - DNA, 16 bp, Homo sapiens
ttgatatgcttataca

SEQ ID NO: 1038012 - DNA, 17 bp, Homo sapiens
ttgatatgtaagtactt

SEQ ID NO: 1038013 - DNA, 21 bp, Homo sapiens
ttgatatgttttatttcattg

SEQ ID NO: 1038014 - DNA, 16 bp, Homo sapiens
ttgatattgtttgctg

SEQ ID NO: 1038015 - DNA, 17 bp, Homo sapiens
ttgatatttatttcctg

SEQ ID NO: 1038016 - DNA, 19 bp, Homo sapiens
ttgatatttatttcctgct

SEQ ID NO: 1038017 - DNA, 18 bp, Homo sapiens
ttgatattttcccttttt

SEQ ID NO: 1038018 - DNA, 14 bp, Homo sapiens
ttgatcaaatatag

SEQ ID NO: 1038019 - DNA, 17 bp, Homo sapiens
ttgatcaaatatagaaa

SEQ ID NO: 1038020 - DNA, 22 bp, Homo sapiens
ttgatcagatgctgaattgaga

SEQ ID NO: 1038021 - DNA, 21 bp, Homo sapiens
ttgatcagccccaccctggcc

SEQ ID NO: 1038022 - DNA, 12 bp, Homo sapiens
ttgatcagttaa

SEQ ID NO: 1038023 - DNA, 17 bp, Homo sapiens
ttgatcatccctttctc

SEQ ID NO: 1038024 - DNA, 13 bp, Homo sapiens
ttgatcatttctg

SEQ ID NO: 1038025 - DNA, 14 bp, Homo sapiens
ttgatcatttctgc

SEQ ID NO: 1038026 - DNA, 19 bp, Homo sapiens
ttgatccagaagagcccat

SEQ ID NO: 1038027 - DNA, 15 bp, Homo sapiens
ttgatcccacttcac

SEQ ID NO: 1038028 - DNA, 23 bp, Homo sapiens
ttgatcccacttcactgtgaggg

SEQ ID NO: 1038029 - DNA, 17 bp, Homo sapiens
ttgatccttaaccaata

SEQ ID NO: 1038030 - DNA, 23 bp, Homo sapiens
ttgatccttctgagctccacctc

SEQ ID NO: 1038031 - DNA, 17 bp, Homo sapiens
ttgatctacccgtgcct

SEQ ID NO: 1038032 - DNA, 12 bp, Homo sapiens
ttgatctgctct

SEQ ID NO: 1038033 - DNA, 19 bp, Homo sapiens
ttgatctgtgatttcttct

SEQ ID NO: 1038034 - DNA, 18 bp, Homo sapiens
ttgatcttacaagatatt

SEQ ID NO: 1038035 - DNA, 13 bp, Homo sapiens
ttgatctttgagc

SEQ ID NO: 1038036 - DNA, 16 bp, Homo sapiens
ttgatctttgagccca

SEQ ID NO: 1038037 - DNA, 12 bp, Homo sapiens
ttgatctttgtt

SEQ ID NO: 1038038 - DNA, 15 bp, Homo sapiens
ttgatctttgtttaa

SEQ ID NO: 1038039 - DNA, 21 bp, Homo sapiens
ttgatgaattcttcctctcct

SEQ ID NO: 1038040 - DNA, 20 bp, Homo sapiens
ttgatgaccaaagtcctttt

SEQ ID NO: 1038041 - DNA, 15 bp, Homo sapiens
ttgatgactgctgat

SEQ ID NO: 1038042 - DNA, 14 bp, Homo sapiens
ttgatgaggcctct

SEQ ID NO: 1038043 - DNA, 14 bp, Homo sapiens
ttgatgatgcagtt

SEQ ID NO: 1038044 - DNA, 19 bp, Homo sapiens
ttgatgatgtctacagaaa

SEQ ID NO: 1038045 - DNA, 22 bp, Homo sapiens
ttgatgatgtctacagaaaatg

SEQ ID NO: 1038046 - DNA, 14 bp, Homo sapiens
ttgatgcacagaga

SEQ ID NO: 1038047 - DNA, 19 bp, Homo sapiens
ttgatgcattaaaagaaaa

SEQ ID NO: 1038048 - DNA, 20 bp, Homo sapiens
ttgatgcattaaaagaaaat

SEQ ID NO: 1038049 - DNA, 23 bp, Homo sapiens
ttgatgcattaaaagaaaataaa

SEQ ID NO: 1038050 - DNA, 19 bp, Homo sapiens
ttgatgccaaaatgacttt

SEQ ID NO: 1038051 - DNA, 22 bp, Homo sapiens
ttgatgccaaaatgactttata

SEQ ID NO: 1038052 - DNA, 17 bp, Homo sapiens
ttgatgccagagggcca

SEQ ID NO: 1038053 - DNA, 13 bp, Homo sapiens
ttgatgctccctt

SEQ ID NO: 1038054 - DNA, 15 bp, Homo sapiens
ttgatgctggagagg

SEQ ID NO: 1038055 - DNA, 17 bp, Homo sapiens
ttgatgctggagaggtt

SEQ ID NO: 1038056 - DNA, 21 bp, Homo sapiens
ttgatggagtgtgagccacct

SEQ ID NO: 1038057 - DNA, 21 bp, Homo sapiens
ttgatggcaaaaaaaaaaaag

SEQ ID NO: 1038058 - DNA, 22 bp, Homo sapiens
ttgatggcaaaaaaaaaaaagc

SEQ ID NO: 1038059 - DNA, 23 bp, Homo sapiens
ttgatgggaaaagcccccagtta

SEQ ID NO: 1038060 - DNA, 18 bp, Homo sapiens
ttgatgggtgctgccctc

SEQ ID NO: 1038061 - DNA, 23 bp, Homo sapiens
ttgatgtaaagatgttctggata

SEQ ID NO: 1038062 - DNA, 18 bp, Homo sapiens
ttgatgtaaggactgtaa

SEQ ID NO: 1038063 - DNA, 18 bp, Homo sapiens
ttgatgtacagaacacaa

SEQ ID NO: 1038064 - DNA, 19 bp, Homo sapiens
ttgatgtacagtctgtcat

SEQ ID NO: 1038065 - DNA, 11 bp, Homo sapiens
ttgatgtacat

SEQ ID NO: 1038066 - DNA, 20 bp, Homo sapiens
ttgatgtatatgtttatata

SEQ ID NO: 1038067 - DNA, 12 bp, Homo sapiens
ttgatgtatctg

SEQ ID NO: 1038068 - DNA, 15 bp, Homo sapiens
ttgatgtatctgagt

SEQ ID NO: 1038069 - DNA, 20 bp, Homo sapiens
ttgatgtatctgagttgcca

SEQ ID NO: 1038070 - DNA, 13 bp, Homo sapiens
ttgatgtatgtgt

SEQ ID NO: 1038071 - DNA, 17 bp, Homo sapiens
ttgatgtatgtgtgaaa

SEQ ID NO: 1038072 - DNA, 23 bp, Homo sapiens
ttgatgtatgtgtgaaacaatgt

SEQ ID NO: 1038073 - DNA, 17 bp, Homo sapiens
ttgatgtgaagataatt

SEQ ID NO: 1038074 - DNA, 15 bp, Homo sapiens
ttgatgttacagatt

SEQ ID NO: 1038075 - DNA, 13 bp, Homo sapiens
ttgatgtttaagt

SEQ ID NO: 1038076 - DNA, 16 bp, Homo sapiens
ttgatgtttaagtgtt

SEQ ID NO: 1038077 - DNA, 13 bp, Homo sapiens
ttgatgtttgtgg

SEQ ID NO: 1038078 - DNA, 22 bp, Homo sapiens
ttgatgtttgtggcctcagaat

SEQ ID NO: 1038079 - DNA, 20 bp, Homo sapiens
ttgatgttttacgtgcaaac

SEQ ID NO: 1038080 - DNA, 11 bp, Homo sapiens
ttgatgttttt

SEQ ID NO: 1038081 - DNA, 13 bp, Homo sapiens
ttgattaaaatct

SEQ ID NO: 1038082 - DNA, 13 bp, Homo sapiens
ttgattaaagatg

SEQ ID NO: 1038083 - DNA, 14 bp, Homo sapiens
ttgattaaattctt

SEQ ID NO: 1038084 - DNA, 15 bp, Homo sapiens
ttgattaaattcttg

SEQ ID NO: 1038085 - DNA, 20 bp, Homo sapiens
ttgattaaattcttgcaaag

SEQ ID NO: 1038086 - DNA, 14 bp, Homo sapiens
ttgattagtataat

SEQ ID NO: 1038087 - DNA, 16 bp, Homo sapiens
ttgattattcaacaca

SEQ ID NO: 1038088 - DNA, 12 bp, Homo sapiens
ttgattattctg

SEQ ID NO: 1038089 - DNA, 12 bp, Homo sapiens
ttgattatttgc

SEQ ID NO: 1038090 - DNA, 13 bp, Homo sapiens
ttgattatttgca

SEQ ID NO: 1038091 - DNA, 15 bp, Homo sapiens
ttgattatttgcatg

SEQ ID NO: 1038092 - DNA, 23 bp, Homo sapiens
ttgattatttgcatgttatgttt

SEQ ID NO: 1038093 - DNA, 18 bp, Homo sapiens
ttgattcaaaatatttaa

SEQ ID NO: 1038094 - DNA, 22 bp, Homo sapiens
ttgattcacctcctaaaacaac

SEQ ID NO: 1038095 - DNA, 17 bp, Homo sapiens
ttgattcagcaaaaatc

SEQ ID NO: 1038096 - DNA, 14 bp, Homo sapiens
ttgattcagcctgt

SEQ ID NO: 1038097 - DNA, 13 bp, Homo sapiens
ttgattcagctca

SEQ ID NO: 1038098 - DNA, 20 bp, Homo sapiens
ttgattcagctcattatgaa

SEQ ID NO: 1038099 - DNA, 14 bp, Homo sapiens
ttgattcatctctg

SEQ ID NO: 1038100 - DNA, 15 bp, Homo sapiens
ttgattcatctctgg

SEQ ID NO: 1038101 - DNA, 17 bp, Homo sapiens
ttgattcattttcctgt

SEQ ID NO: 1038102 - DNA, 22 bp, Homo sapiens
ttgattcctcgcgacatcttct

SEQ ID NO: 1038103 - DNA, 12 bp, Homo sapiens
ttgattctgcag

SEQ ID NO: 1038104 - DNA, 20 bp, Homo sapiens
ttgattctgcagtaaatctt

SEQ ID NO: 1038105 - DNA, 13 bp, Homo sapiens
ttgattgatttga

SEQ ID NO: 1038106 - DNA, 12 bp, Homo sapiens
ttgattgtataa

SEQ ID NO: 1038107 - DNA, 19 bp, Homo sapiens
ttgattgtgttgagtgaag

SEQ ID NO: 1038108 - DNA, 22 bp, Homo sapiens
ttgatttacagcaagtagataa

SEQ ID NO: 1038109 - DNA, 20 bp, Homo sapiens
ttgatttataaataacaaaa

SEQ ID NO: 1038110 - DNA, 14 bp, Homo sapiens
ttgatttccatctt

SEQ ID NO: 1038111 - DNA, 18 bp, Homo sapiens
ttgatttccgttaaaata

SEQ ID NO: 1038112 - DNA, 16 bp, Homo sapiens
ttgatttcctgtgtgt

SEQ ID NO: 1038113 - DNA, 18 bp, Homo sapiens
ttgatttgatgtgacttt

SEQ ID NO: 1038114 - DNA, 12 bp, Homo sapiens
ttgatttgcatg

SEQ ID NO: 1038115 - DNA, 14 bp, Homo sapiens
ttgatttgcattga

SEQ ID NO: 1038116 - DNA, 19 bp, Homo sapiens
ttgatttggtggatgtgat

SEQ ID NO: 1038117 - DNA, 13 bp, Homo sapiens
ttgatttgtacca

SEQ ID NO: 1038118 - DNA, 16 bp, Homo sapiens
ttgatttgtaccattc

SEQ ID NO: 1038119 - DNA, 23 bp, Homo sapiens
ttgattttaatacattgatcagg

SEQ ID NO: 1038120 - DNA, 14 bp, Homo sapiens
ttgattttcaagct

SEQ ID NO: 1038121 - DNA, 17 bp, Homo sapiens
ttgatttttctataatc

SEQ ID NO: 1038122 - DNA, 14 bp, Homo sapiens
ttgatttttctctt

SEQ ID NO: 1038123 - DNA, 16 bp, Homo sapiens
ttgatttttctcttca

SEQ ID NO: 1038124 - DNA, 17 bp, Homo sapiens
ttgatttttctcttcat

SEQ ID NO: 1038125 - DNA, 20 bp, Homo sapiens
ttgatttttctcttcatttt

SEQ ID NO: 1038126 - DNA, 16 bp, Homo sapiens
ttgatttttttaaagt

SEQ ID NO: 1038127 - DNA, 19 bp, Homo sapiens
ttgatttttttaaagtagt

SEQ ID NO: 1038128 - DNA, 16 bp, Homo sapiens
ttgcaaaatacatgaa

SEQ ID NO: 1038129 - DNA, 17 bp, Homo sapiens
ttgcaaaatacatgaag

SEQ ID NO: 1038130 - DNA, 11 bp, Homo sapiens
ttgcaaaattt

SEQ ID NO: 1038131 - DNA, 23 bp, Homo sapiens
ttgcaaaatttccagtacctttg

SEQ ID NO: 1038132 - DNA, 13 bp, Homo sapiens
ttgcaaagaaaga

SEQ ID NO: 1038133 - DNA, 19 bp, Homo sapiens
ttgcaaagaccacctccaa

SEQ ID NO: 1038134 - DNA, 18 bp, Homo sapiens
ttgcaaagtattgtaaat

SEQ ID NO: 1038135 - DNA, 13 bp, Homo sapiens
ttgcaaatacctc

SEQ ID NO: 1038136 - DNA, 16 bp, Homo sapiens
ttgcaaatcttgaaat

SEQ ID NO: 1038137 - DNA, 18 bp, Homo sapiens
ttgcaaatgagggaagaa

SEQ ID NO: 1038138 - DNA, 19 bp, Homo sapiens
ttgcaaattatttattact

SEQ ID NO: 1038139 - DNA, 19 bp, Homo sapiens
ttgcaacaggggaggaaaa

SEQ ID NO: 1038140 - DNA, 22 bp, Homo sapiens
ttgcaacaggggaggaaaaaag

SEQ ID NO: 1038141 - DNA, 12 bp, Homo sapiens
ttgcaaccactg

SEQ ID NO: 1038142 - DNA, 13 bp, Homo sapiens
ttgcaaccaggca

SEQ ID NO: 1038143 - DNA, 16 bp, Homo sapiens
ttgcaaccaggcagct

SEQ ID NO: 1038144 - DNA, 14 bp, Homo sapiens
ttgcaacctcgctg

SEQ ID NO: 1038145 - DNA, 14 bp, Homo sapiens
ttgcaacgtttaca

SEQ ID NO: 1038146 - DNA, 19 bp, Homo sapiens
ttgcaactaaggacaaatt

SEQ ID NO: 1038147 - DNA, 20 bp, Homo sapiens
ttgcaactaaggacaaatta

SEQ ID NO: 1038148 - DNA, 15 bp, Homo sapiens
ttgcaacttcagttt

SEQ ID NO: 1038149 - DNA, 19 bp, Homo sapiens
ttgcaagatgtgaattatt

SEQ ID NO: 1038150 - DNA, 20 bp, Homo sapiens
ttgcaagatgtgaattattg

SEQ ID NO: 1038151 - DNA, 22 bp, Homo sapiens
ttgcaagcaaatcccatttctt

SEQ ID NO: 1038152 - DNA, 14 bp, Homo sapiens
ttgcaagccataac

SEQ ID NO: 1038153 - DNA, 22 bp, Homo sapiens
ttgcaagccataacgtgccccc

SEQ ID NO: 1038154 - DNA, 14 bp, Homo sapiens
ttgcaagcccctct

SEQ ID NO: 1038155 - DNA, 16 bp, Homo sapiens
ttgcaaggcaaatgtt

SEQ ID NO: 1038156 - DNA, 19 bp, Homo sapiens
ttgcaagggaaaagtctct

SEQ ID NO: 1038157 - DNA, 18 bp, Homo sapiens
ttgcaagtgaaggtttac

SEQ ID NO: 1038158 - DNA, 14 bp, Homo sapiens
ttgcaagtgctgga

SEQ ID NO: 1038159 - DNA, 18 bp, Homo sapiens
ttgcaatcccttaatatc

SEQ ID NO: 1038160 - DNA, 19 bp, Homo sapiens
ttgcaatggctatatggca

SEQ ID NO: 1038161 - DNA, 20 bp, Homo sapiens
ttgcaatggtgttgccctga

SEQ ID NO: 1038162 - DNA, 13 bp, Homo sapiens
ttgcaattgctct

SEQ ID NO: 1038163 - DNA, 17 bp, Homo sapiens
ttgcaattgctcttctc

SEQ ID NO: 1038164 - DNA, 17 bp, Homo sapiens
ttgcacaatatttcttt

SEQ ID NO: 1038165 - DNA, 18 bp, Homo sapiens
ttgcacaatatttctttt

SEQ ID NO: 1038166 - DNA, 18 bp, Homo sapiens
ttcttacccaaagcacat

SEQ ID NO: 1038167 - DNA, 17 bp, Homo sapiens
ttcttactcctcctctt

SEQ ID NO: 1038168 - DNA, 16 bp, Homo sapiens
ttcttactgataattt

SEQ ID NO: 1038169 - DNA, 20 bp, Homo sapiens
ttcttactgataattttgct

SEQ ID NO: 1038170 - DNA, 13 bp, Homo sapiens
ttcttagagtgta

SEQ ID NO: 1038171 - DNA, 16 bp, Homo sapiens
ttcttagctttgaaac

SEQ ID NO: 1038172 - DNA, 23 bp, Homo sapiens
ttcttagggcacatgaaaaattt

SEQ ID NO: 1038173 - DNA, 20 bp, Homo sapiens
ttcttagtgcttcagagttt

SEQ ID NO: 1038174 - DNA, 23 bp, Homo sapiens
ttcttagtgcttcagagtttgtg

SEQ ID NO: 1038175 - DNA, 24 bp, Homo sapiens
ttcttagttcatatatcaagaagt

SEQ ID NO: 1038176 - DNA, 13 bp, Homo sapiens
ttcttataatact

SEQ ID NO: 1038177 - DNA, 17 bp, Homo sapiens
ttcttataatactctgt

SEQ ID NO: 1038178 - DNA, 19 bp, Homo sapiens
ttcttataatactctgttg

SEQ ID NO: 1038179 - DNA, 17 bp, Homo sapiens
ttcttatacagataaaa

SEQ ID NO: 1038180 - DNA, 22 bp, Homo sapiens
ttcttataccttctgacagccc

SEQ ID NO: 1038181 - DNA, 17 bp, Homo sapiens
ttcttatacgcttttct

SEQ ID NO: 1038182 - DNA, 18 bp, Homo sapiens
ttcttatgaggaggggag

SEQ ID NO: 1038183 - DNA, 12 bp, Homo sapiens
ttcttatgctta

SEQ ID NO: 1038184 - DNA, 20 bp, Homo sapiens
ttcttattaatttcagtctt

SEQ ID NO: 1038185 - DNA, 19 bp, Homo sapiens
ttcttattgcgctgctacc

SEQ ID NO: 1038186 - DNA, 15 bp, Homo sapiens
ttcttattgctttta

SEQ ID NO: 1038187 - DNA, 21 bp, Homo sapiens
ttcttatttaatcttttctta

SEQ ID NO: 1038188 - DNA, 19 bp, Homo sapiens
ttcttatttttttctattt

SEQ ID NO: 1038189 - DNA, 16 bp, Homo sapiens
ttcttcaaatctcagc

SEQ ID NO: 1038190 - DNA, 17 bp, Homo sapiens
ttcttcaaatctcagca

SEQ ID NO: 1038191 - DNA, 21 bp, Homo sapiens
ttcttcaacatcaatgttcat

SEQ ID NO: 1038192 - DNA, 19 bp, Homo sapiens
ttcttcaagggaagaaaca

SEQ ID NO: 1038193 - DNA, 22 bp, Homo sapiens
ttcttcacctaagtctctgtga

SEQ ID NO: 1038194 - DNA, 16 bp, Homo sapiens
ttcttcacctcttcca

SEQ ID NO: 1038195 - DNA, 16 bp, Homo sapiens
ttcttcacctttgtaa

SEQ ID NO: 1038196 - DNA, 14 bp, Homo sapiens
ttcttcacttctgg

SEQ ID NO: 1038197 - DNA, 17 bp, Homo sapiens
ttcttcagaagacactg

SEQ ID NO: 1038198 - DNA, 12 bp, Homo sapiens
ttcttcagaatt

SEQ ID NO: 1038199 - DNA, 18 bp, Homo sapiens
ttcttcagaattatccat

SEQ ID NO: 1038200 - DNA, 22 bp, Homo sapiens
ttcttcagaattatccattacg

SEQ ID NO: 1038201 - DNA, 15 bp, Homo sapiens
ttcttcagagtgaag

SEQ ID NO: 1038202 - DNA, 21 bp, Homo sapiens
ttcttcataacaattttagga

SEQ ID NO: 1038203 - DNA, 14 bp, Homo sapiens
ttcttcatgcaatg

SEQ ID NO: 1038204 - DNA, 15 bp, Homo sapiens
ttcttcatgcaatga

SEQ ID NO: 1038205 - DNA, 23 bp, Homo sapiens
ttcttccaaacttttgcagaaaa

SEQ ID NO: 1038206 - DNA, 16 bp, Homo sapiens
ttcttccagaatgctg

SEQ ID NO: 1038207 - DNA, 20 bp, Homo sapiens
ttcttccaggatcaggggtt

SEQ ID NO: 1038208 - DNA, 19 bp, Homo sapiens
ttcttccatcatcactgta

SEQ ID NO: 1038209 - DNA, 22 bp, Homo sapiens
ttcttccatcatcactgtaaag

SEQ ID NO: 1038210 - DNA, 21 bp, Homo sapiens
ttcttccccaggtccttcctt

SEQ ID NO: 1038211 - DNA, 22 bp, Homo sapiens
ttcttcccgccccacctcccat

SEQ ID NO: 1038212 - DNA, 20 bp, Homo sapiens
ttcttcccgtgtgtatttct

SEQ ID NO: 1038213 - DNA, 15 bp, Homo sapiens
ttcttccctgtcagc

SEQ ID NO: 1038214 - DNA, 17 bp, Homo sapiens
ttcttcccttaactcca

SEQ ID NO: 1038215 - DNA, 17 bp, Homo sapiens
ttcttcctaggtccaag

SEQ ID NO: 1038216 - DNA, 20 bp, Homo sapiens
ttgcacaatatttcttttgt

SEQ ID NO: 1038217 - DNA, 21 bp, Homo sapiens
ttgcacaatatttcttttgtt

SEQ ID NO: 1038218 - DNA, 23 bp, Homo sapiens
ttgcacaatatttcttttgttgt

SEQ ID NO: 1038219 - DNA, 17 bp, Homo sapiens
ttgcacacttccccatc

SEQ ID NO: 1038220 - DNA, 18 bp, Homo sapiens
ttgcacagccaaatttaa

SEQ ID NO: 1038221 - DNA, 13 bp, Homo sapiens
ttgcacagggatt

SEQ ID NO: 1038222 - DNA, 19 bp, Homo sapiens
ttgcacagggattctcaca

SEQ ID NO: 1038223 - DNA, 14 bp, Homo sapiens
ttgcacatggattc

SEQ ID NO: 1038224 - DNA, 15 bp, Homo sapiens
ttgcacatgtgacca

SEQ ID NO: 1038225 - DNA, 12 bp, Homo sapiens
ttgcaccaaaga

SEQ ID NO: 1038226 - DNA, 21 bp, Homo sapiens
ttgcaccccaaagctttcctg

SEQ ID NO: 1038227 - DNA, 22 bp, Homo sapiens
ttgcacccctttcctccccata

SEQ ID NO: 1038228 - DNA, 17 bp, Homo sapiens
ttgcaccgcctgccctc

SEQ ID NO: 1038229 - DNA, 17 bp, Homo sapiens
ttgcacctacctcacag

SEQ ID NO: 1038230 - DNA, 20 bp, Homo sapiens
ttgcaccttttcatgtacag

SEQ ID NO: 1038231 - DNA, 16 bp, Homo sapiens
ttgcacgacgccctct

SEQ ID NO: 1038232 - DNA, 20 bp, Homo sapiens
ttgcacgacgccctctcccc

SEQ ID NO: 1038233 - DNA, 18 bp, Homo sapiens
ttgcacgcccatgtgtga

SEQ ID NO: 1038234 - DNA, 21 bp, Homo sapiens
ttgcacgcctcccccctcact

SEQ ID NO: 1038235 - DNA, 16 bp, Homo sapiens
ttgcacggctgctcgg

SEQ ID NO: 1038236 - DNA, 15 bp, Homo sapiens
ttgcacggtttgtga

SEQ ID NO: 1038237 - DNA, 19 bp, Homo sapiens
ttgcactaaagtatgtaaa

SEQ ID NO: 1038238 - DNA, 17 bp, Homo sapiens
ttgcactcatcatattt

SEQ ID NO: 1038239 - DNA, 15 bp, Homo sapiens
ttgcactccttccct

SEQ ID NO: 1038240 - DNA, 20 bp, Homo sapiens
ttgcactctagcctggcaac

SEQ ID NO: 1038241 - DNA, 17 bp, Homo sapiens
ttgcactctagcctggg

SEQ ID NO: 1038242 - DNA, 12 bp, Homo sapiens
ttgcactcttta

SEQ ID NO: 1038243 - DNA, 16 bp, Homo sapiens
ttgcactctttaacac

SEQ ID NO: 1038244 - DNA, 13 bp, Homo sapiens
ttgcactgaacag

SEQ ID NO: 1038245 - DNA, 13 bp, Homo sapiens
ttgcactgagggc

SEQ ID NO: 1038246 - DNA, 14 bp, Homo sapiens
ttgcactgcttata

SEQ ID NO: 1038247 - DNA, 15 bp, Homo sapiens
ttgcacttaatggct

SEQ ID NO: 1038248 - DNA, 18 bp, Homo sapiens
ttgcacttattgtcccct

SEQ ID NO: 1038249 - DNA, 17 bp, Homo sapiens
ttgcacttgtgattatt

SEQ ID NO: 1038250 - DNA, 19 bp, Homo sapiens
ttgcagaaaagcacctgcc

SEQ ID NO: 1038251 - DNA, 16 bp, Homo sapiens
ttgcagaaaattctgt

SEQ ID NO: 1038252 - DNA, 13 bp, Homo sapiens
ttgcagaaggaaa

SEQ ID NO: 1038253 - DNA, 16 bp, Homo sapiens
ttgcagaaggaaatga

SEQ ID NO: 1038254 - DNA, 19 bp, Homo sapiens
ttgcagagacaggacctga

SEQ ID NO: 1038255 - DNA, 12 bp, Homo sapiens
ttgcagagactc

SEQ ID NO: 1038256 - DNA, 18 bp, Homo sapiens
ttgcagaggagcccagtg

SEQ ID NO: 1038257 - DNA, 18 bp, Homo sapiens
ttgcagattcatttttct

SEQ ID NO: 1038258 - DNA, 17 bp, Homo sapiens
ttgcagcacagctgaga

SEQ ID NO: 1038259 - DNA, 13 bp, Homo sapiens
ttgcagcagggct

SEQ ID NO: 1038260 - DNA, 14 bp, Homo sapiens
ttgcagcagtgagt

SEQ ID NO: 1038261 - DNA, 17 bp, Homo sapiens
ttgcagcatgagacttt

SEQ ID NO: 1038262 - DNA, 20 bp, Homo sapiens
ttgcagcatgagactttctg

SEQ ID NO: 1038263 - DNA, 23 bp, Homo sapiens
ttgcagctaaggaggggaaaaaa

SEQ ID NO: 1038264 - DNA, 9 bp, Homo sapiens
ttgcagctg

SEQ ID NO: 1038265 - DNA, 13 bp, Homo sapiens
ttgcagctgtttt

SEQ ID NO: 1038266 - DNA, 21 bp, Homo sapiens
ttgcagctgttttcaaagccc

SEQ ID NO: 1038267 - DNA, 21 bp, Homo sapiens
ttgcagctttatgttcatttg

SEQ ID NO: 1038268 - DNA, 14 bp, Homo sapiens
ttgcaggattccct

SEQ ID NO: 1038269 - DNA, 14 bp, Homo sapiens
ttgcaggcggccct

SEQ ID NO: 1038270 - DNA, 22 bp, Homo sapiens
ttgcaggcggccctcagtgcat

SEQ ID NO: 1038271 - DNA, 17 bp, Homo sapiens
ttgcaggctctgggctc

SEQ ID NO: 1038272 - DNA, 21 bp, Homo sapiens
ttgcaggctctgggctcaggg

SEQ ID NO: 1038273 - DNA, 18 bp, Homo sapiens
ttgcagggagctcaagcc

SEQ ID NO: 1038274 - DNA, 21 bp, Homo sapiens
ttgcagggctaaggcccccaa

SEQ ID NO: 1038275 - DNA, 18 bp, Homo sapiens
ttgcaggggtccctgcta

SEQ ID NO: 1038276 - DNA, 19 bp, Homo sapiens
ttgcaggtctggtttatat

SEQ ID NO: 1038277 - DNA, 15 bp, Homo sapiens
ttgcagtaactgttt

SEQ ID NO: 1038278 - DNA, 14 bp, Homo sapiens
ttgcagtatgaact

SEQ ID NO: 1038279 - DNA, 14 bp, Homo sapiens
ttgcagtcactgtg

SEQ ID NO: 1038280 - DNA, 15 bp, Homo sapiens
ttgcagtcactgtga

SEQ ID NO: 1038281 - DNA, 16 bp, Homo sapiens
ttgcagtgagctgaga

SEQ ID NO: 1038282 - DNA, 20 bp, Homo sapiens
ttgcagttcaaatcctcacc

SEQ ID NO: 1038283 - DNA, 17 bp, Homo sapiens
ttgcagttgtgatataa

SEQ ID NO: 1038284 - DNA, 23 bp, Homo sapiens
ttgcagtttatcattcaagtgta

SEQ ID NO: 1038285 - DNA, 21 bp, Homo sapiens
ttgcagttttgtaagccctct

SEQ ID NO: 1038286 - DNA, 14 bp, Homo sapiens
ttgcagtttttata

SEQ ID NO: 1038287 - DNA, 21 bp, Homo sapiens
ttgcagtttttataatagatt

SEQ ID NO: 1038288 - DNA, 16 bp, Homo sapiens
ttgcataagattaaag

SEQ ID NO: 1038289 - DNA, 17 bp, Homo sapiens
ttgcataagattaaagg

SEQ ID NO: 1038290 - DNA, 18 bp, Homo sapiens
ttgcataagattaaagga

SEQ ID NO: 1038291 - DNA, 20 bp, Homo sapiens
ttgcataataagctaaagag

SEQ ID NO: 1038292 - DNA, 18 bp, Homo sapiens
ttgcatacaccactgcaa

SEQ ID NO: 1038293 - DNA, 14 bp, Homo sapiens
ttgcatactgaaaa

SEQ ID NO: 1038294 - DNA, 19 bp, Homo sapiens
ttgcataggctcttaagca

SEQ ID NO: 1038295 - DNA, 20 bp, Homo sapiens
ttgcataggctcttaagcag

SEQ ID NO: 1038296 - DNA, 14 bp, Homo sapiens
ttgcatataactta

SEQ ID NO: 1038297 - DNA, 23 bp, Homo sapiens
ttgcatataacttatattgtaag

SEQ ID NO: 1038298 - DNA, 19 bp, Homo sapiens
ttgcatatgagcctgccct

SEQ ID NO: 1038299 - DNA, 19 bp, Homo sapiens
ttgcatattataaaggata

SEQ ID NO: 1038300 - DNA, 16 bp, Homo sapiens
ttgcatattctattgt

SEQ ID NO: 1038301 - DNA, 20 bp, Homo sapiens
ttgcatatttttctaaagaa

SEQ ID NO: 1038302 - DNA, 23 bp, Homo sapiens
ttgcatcccaaaccacgcctctt

SEQ ID NO: 1038303 - DNA, 13 bp, Homo sapiens
ttgcatctaatga

SEQ ID NO: 1038304 - DNA, 14 bp, Homo sapiens
ttgcatctgtataa

SEQ ID NO: 1038305 - DNA, 21 bp, Homo sapiens
ttgcatgaagagaagcaattt

SEQ ID NO: 1038306 - DNA, 17 bp, Homo sapiens
ttgcatggattttggat

SEQ ID NO: 1038307 - DNA, 20 bp, Homo sapiens
ttgcatggctccagaaatgt

SEQ ID NO: 1038308 - DNA, 18 bp, Homo sapiens
ttgcatgggctaatgaag

SEQ ID NO: 1038309 - DNA, 15 bp, Homo sapiens
ttgcatgtacttgaa

SEQ ID NO: 1038310 - DNA, 13 bp, Homo sapiens
ttgcatgtagtaa

SEQ ID NO: 1038311 - DNA, 19 bp, Homo sapiens
ttgcatgtagtaacactaa

SEQ ID NO: 1038312 - DNA, 21 bp, Homo sapiens
ttgcatgttatgtttaataag

SEQ ID NO: 1038313 - DNA, 21 bp, Homo sapiens
ttgcattaaattcacaaactt

SEQ ID NO: 1038314 - DNA, 16 bp, Homo sapiens
ttgcattatgtattta

SEQ ID NO: 1038315 - DNA, 17 bp, Homo sapiens
ttgcattcctttgtctt

SEQ ID NO: 1038316 - DNA, 15 bp, Homo sapiens
ttgcattgaacacaa

SEQ ID NO: 1038317 - DNA, 18 bp, Homo sapiens
ttgcattgaacacaaact

SEQ ID NO: 1038318 - DNA, 22 bp, Homo sapiens
ttgcattgaacacaaactgtaa

SEQ ID NO: 1038319 - DNA, 15 bp, Homo sapiens
ttgcattgtatgaaa

SEQ ID NO: 1038320 - DNA, 13 bp, Homo sapiens
ttgcattgtctgt

SEQ ID NO: 1038321 - DNA, 15 bp, Homo sapiens
ttgcatttaaaacag

SEQ ID NO: 1038322 - DNA, 20 bp, Homo sapiens
ttgcatttaaaacagacact

SEQ ID NO: 1038323 - DNA, 20 bp, Homo sapiens
ttgcatttacttttaataaa

SEQ ID NO: 1038324 - DNA, 18 bp, Homo sapiens
ttgcatttagttttatgg

SEQ ID NO: 1038325 - DNA, 24 bp, Homo sapiens
ttgcatttagttttatggcatgat

SEQ ID NO: 1038326 - DNA, 13 bp, Homo sapiens
ttgcatttctgct

SEQ ID NO: 1038327 - DNA, 15 bp, Homo sapiens
ttgcatttgctcttt

SEQ ID NO: 1038328 - DNA, 12 bp, Homo sapiens
ttgcatttgtaa

SEQ ID NO: 1038329 - DNA, 13 bp, Homo sapiens
ttgcatttgtaaa

SEQ ID NO: 1038330 - DNA, 18 bp, Homo sapiens
ttgcattttctgatgtat

SEQ ID NO: 1038331 - DNA, 19 bp, Homo sapiens
ttgcatttttgttttgaaa

SEQ ID NO: 1038332 - DNA, 22 bp, Homo sapiens
ttgccaaaaatacaacacagac

SEQ ID NO: 1038333 - DNA, 16 bp, Homo sapiens
ttgccaaaaccaagat

SEQ ID NO: 1038334 - DNA, 13 bp, Homo sapiens
ttgccaaaattca

SEQ ID NO: 1038335 - DNA, 19 bp, Homo sapiens
ttgccaaaattcatttcta

SEQ ID NO: 1038336 - DNA, 16 bp, Homo sapiens
ttgccaaagtacagaa

SEQ ID NO: 1038337 - DNA, 20 bp, Homo sapiens
ttgccaacagttgtatgttt

SEQ ID NO: 1038338 - DNA, 22 bp, Homo sapiens
ttgccaactgaagccttcttct

SEQ ID NO: 1038339 - DNA, 15 bp, Homo sapiens
ttgccaagacaaatc

SEQ ID NO: 1038340 - DNA, 17 bp, Homo sapiens
ttgccaagacaaatcaa

SEQ ID NO: 1038341 - DNA, 16 bp, Homo sapiens
ttaattccatgtcaga

SEQ ID NO: 1038342 - DNA, 16 bp, Homo sapiens
ttaattcctttctcat

SEQ ID NO: 1038343 - DNA, 22 bp, Homo sapiens
ttaattctctgttccttttgca

SEQ ID NO: 1038344 - DNA, 13 bp, Homo sapiens
ttaattctgtctt

SEQ ID NO: 1038345 - DNA, 15 bp, Homo sapiens
ttaattctttgttct

SEQ ID NO: 1038346 - DNA, 14 bp, Homo sapiens
ttaattgaagaact

SEQ ID NO: 1038347 - DNA, 19 bp, Homo sapiens
ttaattgaagaactgcact

SEQ ID NO: 1038348 - DNA, 21 bp, Homo sapiens
ttaattgaagaactgcacttt

SEQ ID NO: 1038349 - DNA, 16 bp, Homo sapiens
ttaattgccagcaaat

SEQ ID NO: 1038350 - DNA, 13 bp, Homo sapiens
ttaattgggcact

SEQ ID NO: 1038351 - DNA, 21 bp, Homo sapiens
ttaattgggccagcttttcaa

SEQ ID NO: 1038352 - DNA, 14 bp, Homo sapiens
ttaattgtaaagta

SEQ ID NO: 1038353 - DNA, 12 bp, Homo sapiens
ttaattgtataa

SEQ ID NO: 1038354 - DNA, 16 bp, Homo sapiens
ttaattgtataagtca

SEQ ID NO: 1038355 - DNA, 17 bp, Homo sapiens
ttaattgtcctgtgtct

SEQ ID NO: 1038356 - DNA, 13 bp, Homo sapiens
ttaattgtttaaa

SEQ ID NO: 1038357 - DNA, 18 bp, Homo sapiens
ttaattgttttgcacttt

SEQ ID NO: 1038358 - DNA, 19 bp, Homo sapiens
ttaattgttttgcactttt

SEQ ID NO: 1038359 - DNA, 18 bp, Homo sapiens
ttaatttaaacacctcct

SEQ ID NO: 1038360 - DNA, 15 bp, Homo sapiens
ttaatttaattgctt

SEQ ID NO: 1038361 - DNA, 22 bp, Homo sapiens
ttaatttacaaaaatataaaat

SEQ ID NO: 1038362 - DNA, 18 bp, Homo sapiens
ttaatttactttctgcac

SEQ ID NO: 1038363 - DNA, 19 bp, Homo sapiens
ttaatttagtaaatgttat

SEQ ID NO: 1038364 - DNA, 15 bp, Homo sapiens
ttaatttataatgta

SEQ ID NO: 1038365 - DNA, 17 bp, Homo sapiens
ttaatttataatgtatt

SEQ ID NO: 1038366 - DNA, 19 bp, Homo sapiens
ttaatttataatgtatttg

SEQ ID NO: 1038367 - DNA, 14 bp, Homo sapiens
ttaatttatatgta

SEQ ID NO: 1038368 - DNA, 14 bp, Homo sapiens
ttaatttattatta

SEQ ID NO: 1038369 - DNA, 13 bp, Homo sapiens
ttaatttattggg

SEQ ID NO: 1038370 - DNA, 14 bp, Homo sapiens
ttaatttattttgc

SEQ ID NO: 1038371 - DNA, 20 bp, Homo sapiens
ttaatttattttgctccctc

SEQ ID NO: 1038372 - DNA, 14 bp, Homo sapiens
ttaatttcaggaaa

SEQ ID NO: 1038373 - DNA, 11 bp, Homo sapiens
ttaatttcctt

SEQ ID NO: 1038374 - DNA, 17 bp, Homo sapiens
ttaatttccttctgtta

SEQ ID NO: 1038375 - DNA, 21 bp, Homo sapiens
ttaatttccttctgttaagaa

SEQ ID NO: 1038376 - DNA, 21 bp, Homo sapiens
ttaatttcctttttgacactg

SEQ ID NO: 1038377 - DNA, 22 bp, Homo sapiens
ttaatttcctttttgacactga

SEQ ID NO: 1038378 - DNA, 21 bp, Homo sapiens
ttaatttctacaaaataacat

SEQ ID NO: 1038379 - DNA, 13 bp, Homo sapiens
ttaatttctgcca

SEQ ID NO: 1038380 - DNA, 13 bp, Homo sapiens
ttaatttggataa

SEQ ID NO: 1038381 - DNA, 21 bp, Homo sapiens
ttaatttgggaatttgttgtg

SEQ ID NO: 1038382 - DNA, 12 bp, Homo sapiens
ttaatttgtaaa

SEQ ID NO: 1038383 - DNA, 18 bp, Homo sapiens
ttaatttgtaaacttctg

SEQ ID NO: 1038384 - DNA, 21 bp, Homo sapiens
ttaatttgtaaacttctgaag

SEQ ID NO: 1038385 - DNA, 12 bp, Homo sapiens
ttaattttaaag

SEQ ID NO: 1038386 - DNA, 17 bp, Homo sapiens
ttaattttagtttttca

SEQ ID NO: 1038387 - DNA, 21 bp, Homo sapiens
ttaattttagtttttcattaa

SEQ ID NO: 1038388 - DNA, 17 bp, Homo sapiens
ttaattttattcaagaa

SEQ ID NO: 1038389 - DNA, 19 bp, Homo sapiens
ttaattttctttatggaaa

SEQ ID NO: 1038390 - DNA, 19 bp, Homo sapiens
ttaattttgacactgaaat

SEQ ID NO: 1038391 - DNA, 17 bp, Homo sapiens
ttaattttgatatacat

SEQ ID NO: 1038392 - DNA, 16 bp, Homo sapiens
ttaattttgtgcattc

SEQ ID NO: 1038393 - DNA, 18 bp, Homo sapiens
ttaatttttatttcttcc

SEQ ID NO: 1038394 - DNA, 13 bp, Homo sapiens
ttaatttttgata

SEQ ID NO: 1038395 - DNA, 22 bp, Homo sapiens
ttaatttttgcttttagaaaag

SEQ ID NO: 1038396 - DNA, 17 bp, Homo sapiens
ttaatttttttaaccaa

SEQ ID NO: 1038397 - DNA, 22 bp, Homo sapiens
ttaatttttttaaccaaaggtg

SEQ ID NO: 1038398 - DNA, 16 bp, Homo sapiens
ttaattttttttaatg

SEQ ID NO: 1038399 - DNA, 22 bp, Homo sapiens
ttacaaaaacaaaataaaataa

SEQ ID NO: 1038400 - DNA, 13 bp, Homo sapiens
ttacaaaatgcca

SEQ ID NO: 1038401 - DNA, 16 bp, Homo sapiens
ttacaaaatttattct

SEQ ID NO: 1038402 - DNA, 21 bp, Homo sapiens
ttacaaacaagtggatgtttt

SEQ ID NO: 1038403 - DNA, 22 bp, Homo sapiens
ttacaaacaagtggatgttttt

SEQ ID NO: 1038404 - DNA, 20 bp, Homo sapiens
ttacaaaccattacctgtac

SEQ ID NO: 1038405 - DNA, 15 bp, Homo sapiens
ttacaaactgcaata

SEQ ID NO: 1038406 - DNA, 13 bp, Homo sapiens
ttacaaagcatct

SEQ ID NO: 1038407 - DNA, 15 bp, Homo sapiens
ttacaaagtgtgtat

SEQ ID NO: 1038408 - DNA, 16 bp, Homo sapiens
ttacaaagtgtgtatt

SEQ ID NO: 1038409 - DNA, 16 bp, Homo sapiens
ttacaaatcagaagtc

SEQ ID NO: 1038410 - DNA, 17 bp, Homo sapiens
ttacaaatcagaagtca

SEQ ID NO: 1038411 - DNA, 17 bp, Homo sapiens
ttacaaatgcaaatttc

SEQ ID NO: 1038412 - DNA, 21 bp, Homo sapiens
ttacaaatgcaaatttctata

SEQ ID NO: 1038413 - DNA, 20 bp, Homo sapiens
ttacaacaactattttttaa

SEQ ID NO: 1038414 - DNA, 13 bp, Homo sapiens
ttacattcagttg

SEQ ID NO: 1038415 - DNA, 16 bp, Homo sapiens
ttacattcctaactag

SEQ ID NO: 1038416 - DNA, 18 bp, Homo sapiens
ttacattcctaactagaa

SEQ ID NO: 1038417 - DNA, 13 bp, Homo sapiens
ttacattctgtgt

SEQ ID NO: 1038418 - DNA, 21 bp, Homo sapiens
ttacattgtcctgtagcttta

SEQ ID NO: 1038419 - DNA, 13 bp, Homo sapiens
ttacattgttcaa

SEQ ID NO: 1038420 - DNA, 17 bp, Homo sapiens
ttacatttaaacctttt

SEQ ID NO: 1038421 - DNA, 17 bp, Homo sapiens
ttacatttacaaactga

SEQ ID NO: 1038422 - DNA, 10 bp, Homo sapiens
ttacatttca

SEQ ID NO: 1038423 - DNA, 20 bp, Homo sapiens
ttacatttcagacatatcca

SEQ ID NO: 1038424 - DNA, 20 bp, Homo sapiens
ttacattttattaagctttt

SEQ ID NO: 1038425 - DNA, 22 bp, Homo sapiens
ttacattttcgtcctgtagcac

SEQ ID NO: 1038426 - DNA, 12 bp, Homo sapiens
ttacatttttaa

SEQ ID NO: 1038427 - DNA, 15 bp, Homo sapiens
ttacatttttaagct

SEQ ID NO: 1038428 - DNA, 21 bp, Homo sapiens
ttacatttttaagtgctgcat

SEQ ID NO: 1038429 - DNA, 16 bp, Homo sapiens
ttaccaaaaattttgt

SEQ ID NO: 1038430 - DNA, 13 bp, Homo sapiens
ttaccaaaacagg

SEQ ID NO: 1038431 - DNA, 21 bp, Homo sapiens
ttaccaaaattcactaatctt

SEQ ID NO: 1038432 - DNA, 20 bp, Homo sapiens
ttaccaaagcatcaatacaa

SEQ ID NO: 1038433 - DNA, 23 bp, Homo sapiens
ttaccaaagtgtcttttgacatt

SEQ ID NO: 1038434 - DNA, 21 bp, Homo sapiens
ttaccaaattgcttgagcctg

SEQ ID NO: 1038435 - DNA, 12 bp, Homo sapiens
ttaccaacctgt

SEQ ID NO: 1038436 - DNA, 13 bp, Homo sapiens
ttaccaactttct

SEQ ID NO: 1038437 - DNA, 18 bp, Homo sapiens
ttaccaactttctgtaaa

SEQ ID NO: 1038438 - DNA, 13 bp, Homo sapiens
ttaccaagaagcc

SEQ ID NO: 1038439 - DNA, 14 bp, Homo sapiens
ttaccaagaagcct

SEQ ID NO: 1038440 - DNA, 14 bp, Homo sapiens
ttaccaagagtaac

SEQ ID NO: 1038441 - DNA, 20 bp, Homo sapiens
ttaccaaggatgaattcttt

SEQ ID NO: 1038442 - DNA, 19 bp, Homo sapiens
ttaccaataggcaaattaa

SEQ ID NO: 1038443 - DNA, 21 bp, Homo sapiens
ttaccaatttaactagtcctg

SEQ ID NO: 1038444 - DNA, 17 bp, Homo sapiens
ttaccacgccttgacct

SEQ ID NO: 1038445 - DNA, 19 bp, Homo sapiens
ttaccagcaagaataaaaa

SEQ ID NO: 1038446 - DNA, 16 bp, Homo sapiens
ttaccagcatttgtcc

SEQ ID NO: 1038447 - DNA, 17 bp, Homo sapiens
ttaccagcatttgtcct

SEQ ID NO: 1038448 - DNA, 24 bp, Homo sapiens
ttaccagtggcgttgttgcatgtt

SEQ ID NO: 1038449 - DNA, 18 bp, Homo sapiens
ttaccagttaattactca

SEQ ID NO: 1038450 - DNA, 14 bp, Homo sapiens
ttaccagttgcctt

SEQ ID NO: 1038451 - DNA, 20 bp, Homo sapiens
ttaccataaagcctttaaaa

SEQ ID NO: 1038452 - DNA, 23 bp, Homo sapiens
ttaccataaagcctttaaaacca

SEQ ID NO: 1038453 - DNA, 16 bp, Homo sapiens
ttaccatactgtctct

SEQ ID NO: 1038454 - DNA, 17 bp, Homo sapiens
ttaccatactgtctctg

SEQ ID NO: 1038455 - DNA, 19 bp, Homo sapiens
ttaccatggagttaacatc

SEQ ID NO: 1038456 - DNA, 21 bp, Homo sapiens
ttaccattaattacatacaga

SEQ ID NO: 1038457 - DNA, 21 bp, Homo sapiens
ttaccattacttgtataaata

SEQ ID NO: 1038458 - DNA, 21 bp, Homo sapiens
ttaccattcagttaattcaat

SEQ ID NO: 1038459 - DNA, 13 bp, Homo sapiens
ttaccatttgtaa

SEQ ID NO: 1038460 - DNA, 14 bp, Homo sapiens
ttaccatttgtaat

SEQ ID NO: 1038461 - DNA, 19 bp, Homo sapiens
ttaccatttgttaatatca

SEQ ID NO: 1038462 - DNA, 20 bp, Homo sapiens
ttaccattttaacgctgcct

SEQ ID NO: 1038463 - DNA, 21 bp, Homo sapiens
ttaccattttaacgctgccta

SEQ ID NO: 1038464 - DNA, 16 bp, Homo sapiens
ttacccacctagaaca

SEQ ID NO: 1038465 - DNA, 20 bp, Homo sapiens
ttacccagacaactctagaa

SEQ ID NO: 1038466 - DNA, 22 bp, Homo sapiens
ttacccagagaatatatacatt

SEQ ID NO: 1038467 - DNA, 21 bp, Homo sapiens
ttaccccagcctacccttcct

SEQ ID NO: 1038468 - DNA, 21 bp, Homo sapiens
ttaccccataccccttattgc

SEQ ID NO: 1038469 - DNA, 18 bp, Homo sapiens
ttacccgaaagcatcact

SEQ ID NO: 1038470 - DNA, 21 bp, Homo sapiens
tgtatagttttataaaactca

SEQ ID NO: 1038471 - DNA, 22 bp, Homo sapiens
tgtatagttttataaaactcag

SEQ ID NO: 1038472 - DNA, 14 bp, Homo sapiens
tgtatataaaaatg

SEQ ID NO: 1038473 - DNA, 16 bp, Homo sapiens
tgtatataaacatatt

SEQ ID NO: 1038474 - DNA, 23 bp, Homo sapiens
tgtatataatcatgctcatgtat

SEQ ID NO: 1038475 - DNA, 21 bp, Homo sapiens
tgtatataatggtgatgtcat

SEQ ID NO: 1038476 - DNA, 23 bp, Homo sapiens
tgtatatatatttatatatatga

SEQ ID NO: 1038477 - DNA, 16 bp, Homo sapiens
tgtatatatctattat

SEQ ID NO: 1038478 - DNA, 15 bp, Homo sapiens
tgtatatatcttata

SEQ ID NO: 1038479 - DNA, 13 bp, Homo sapiens
tgtatatatgtgt

SEQ ID NO: 1038480 - DNA, 18 bp, Homo sapiens
tgtatatatgtgtgttta

SEQ ID NO: 1038481 - DNA, 20 bp, Homo sapiens
tgtatatatgtgtgtttaaa

SEQ ID NO: 1038482 - DNA, 14 bp, Homo sapiens
tgtatatattatta

SEQ ID NO: 1038483 - DNA, 14 bp, Homo sapiens
tgtatatatttaaa

SEQ ID NO: 1038484 - DNA, 18 bp, Homo sapiens
tgtatatatttcctatat

SEQ ID NO: 1038485 - DNA, 22 bp, Homo sapiens
tgtatatattttatatgttcat

SEQ ID NO: 1038486 - DNA, 14 bp, Homo sapiens
tgtatatcagaaaa

SEQ ID NO: 1038487 - DNA, 18 bp, Homo sapiens
tgtatatcagaaaaggga

SEQ ID NO: 1038488 - DNA, 16 bp, Homo sapiens
tgtatatcattctaca

SEQ ID NO: 1038489 - DNA, 21 bp, Homo sapiens
tgtatatcattctacagaata

SEQ ID NO: 1038490 - DNA, 22 bp, Homo sapiens
tgtatatcattctacagaataa

SEQ ID NO: 1038491 - DNA, 20 bp, Homo sapiens
tgtatatccttccaaaaaat

SEQ ID NO: 1038492 - DNA, 19 bp, Homo sapiens
tgtatatcgttatcactgt

SEQ ID NO: 1038493 - DNA, 17 bp, Homo sapiens
tgtatatgattctctgt

SEQ ID NO: 1038494 - DNA, 18 bp, Homo sapiens
tgtatatgattctctgtg

SEQ ID NO: 1038495 - DNA, 19 bp, Homo sapiens
tgtatatgattctctgtgg

SEQ ID NO: 1038496 - DNA, 13 bp, Homo sapiens
tgtatatgtataa

SEQ ID NO: 1038497 - DNA, 14 bp, Homo sapiens
tgtatatgtataaa

SEQ ID NO: 1038498 - DNA, 18 bp, Homo sapiens
ttcacattaaaaaatgaa

SEQ ID NO: 1038499 - DNA, 23 bp, Homo sapiens
ttcacattaaaaaatgaaatatt

SEQ ID NO: 1038500 - DNA, 22 bp, Homo sapiens
ttcacattaatatttgctgaca

SEQ ID NO: 1038501 - DNA, 21 bp, Homo sapiens
ttcacattgttaagaaaaata

SEQ ID NO: 1038502 - DNA, 15 bp, Homo sapiens
ttcaccaaaattatc

SEQ ID NO: 1038503 - DNA, 22 bp, Homo sapiens
ttcaccaccccctgtcccattc

SEQ ID NO: 1038504 - DNA, 15 bp, Homo sapiens
ttcaccactcctctc

SEQ ID NO: 1038505 - DNA, 18 bp, Homo sapiens
ttcaccagatttgctaat

SEQ ID NO: 1038506 - DNA, 17 bp, Homo sapiens
ttcaccaggttaaaatt

SEQ ID NO: 1038507 - DNA, 15 bp, Homo sapiens
ttcaccagtctgtct

SEQ ID NO: 1038508 - DNA, 21 bp, Homo sapiens
ttcaccagtctgtctactgtg

SEQ ID NO: 1038509 - DNA, 15 bp, Homo sapiens
ttcaccagtgttcct

SEQ ID NO: 1038510 - DNA, 14 bp, Homo sapiens
ttcagaccccccca

SEQ ID NO: 1038511 - DNA, 18 bp, Homo sapiens
ttcagacccctgcctgga

SEQ ID NO: 1038512 - DNA, 15 bp, Homo sapiens
ttcagacgagatcct

SEQ ID NO: 1038513 - DNA, 15 bp, Homo sapiens
ttcagacttgtcaag

SEQ ID NO: 1038514 - DNA, 20 bp, Homo sapiens
ttcagagactgcccttctca

SEQ ID NO: 1038515 - DNA, 21 bp, Homo sapiens
ttcagagactgcccttctcac

SEQ ID NO: 1038516 - DNA, 19 bp, Homo sapiens
ttcagagagctaaattaca

SEQ ID NO: 1038517 - DNA, 21 bp, Homo sapiens
ttcagagagtcaatgtcatta

SEQ ID NO: 1038518 - DNA, 19 bp, Homo sapiens
ttcagtacttttttaaata

SEQ ID NO: 1038519 - DNA, 15 bp, Homo sapiens
ttcagtagaattacc

SEQ ID NO: 1038520 - DNA, 17 bp, Homo sapiens
ttcatcttcagttgtct

SEQ ID NO: 1038521 - DNA, 18 bp, Homo sapiens
ttcattttgttttgctct

SEQ ID NO: 1038522 - DNA, 21 bp, Homo sapiens
ttcatttttttctctctggag

SEQ ID NO: 1038523 - DNA, 14 bp, Homo sapiens
ttccaaaacaaaaa

SEQ ID NO: 1038524 - DNA, 20 bp, Homo sapiens
ttccaaaacctgcttccttc

SEQ ID NO: 1038525 - DNA, 20 bp, Homo sapiens
ttccaaaataatctatatta

SEQ ID NO: 1038526 - DNA, 14 bp, Homo sapiens
ttccaaaatattat

SEQ ID NO: 1038527 - DNA, 16 bp, Homo sapiens
ttccaaacctgacaga

SEQ ID NO: 1038528 - DNA, 20 bp, Homo sapiens
ttcctcattaatagctgcct

SEQ ID NO: 1038529 - DNA, 23 bp, Homo sapiens
ttcctcattaatagctgccttca

SEQ ID NO: 1038530 - DNA, 16 bp, Homo sapiens
ttcctcattcctgaaa

SEQ ID NO: 1038531 - DNA, 23 bp, Homo sapiens
ttcctccacatcctttctaaaca

SEQ ID NO: 1038532 - DNA, 16 bp, Homo sapiens
ttcctccactgcgctt

SEQ ID NO: 1038533 - DNA, 16 bp, Homo sapiens
ttcctccagcctcccc

SEQ ID NO: 1038534 - DNA, 16 bp, Homo sapiens
ttcctccagctgcacc

SEQ ID NO: 1038535 - DNA, 14 bp, Homo sapiens
ttcctccattttct

SEQ ID NO: 1038536 - DNA, 20 bp, Homo sapiens
ttcctccccacactccactc

SEQ ID NO: 1038537 - DNA, 12 bp, Homo sapiens
ttcctccccagc

SEQ ID NO: 1038538 - DNA, 19 bp, Homo sapiens
ttcctccccatacacacac

SEQ ID NO: 1038539 - DNA, 21 bp, Homo sapiens
ttcctccccattagagtcagc

SEQ ID NO: 1038540 - DNA, 11 bp, Homo sapiens
ttcctcccctc

SEQ ID NO: 1038541 - DNA, 12 bp, Homo sapiens
ttcctcccctca

SEQ ID NO: 1038542 - DNA, 19 bp, Homo sapiens
ttcctccctgggggcccca

SEQ ID NO: 1038543 - DNA, 15 bp, Homo sapiens
ttcctcccttacaga

SEQ ID NO: 1038544 - DNA, 11 bp, Homo sapiens
ttcctcccttc

SEQ ID NO: 1038545 - DNA, 12 bp, Homo sapiens
ttcctcccttct

SEQ ID NO: 1038546 - DNA, 15 bp, Homo sapiens
ttcctcccttctgct

SEQ ID NO: 1038547 - DNA, 13 bp, Homo sapiens
ttcctcctacctg

SEQ ID NO: 1038548 - DNA, 16 bp, Homo sapiens
ttcctcctacctgggg

SEQ ID NO: 1038549 - DNA, 13 bp, Homo sapiens
ttcctcctcaggc

SEQ ID NO: 1038550 - DNA, 16 bp, Homo sapiens
ttcctcctccacagtg

SEQ ID NO: 1038551 - DNA, 14 bp, Homo sapiens
ttcctcctccccac

SEQ ID NO: 1038552 - DNA, 16 bp, Homo sapiens
ttcctcctccccactt

SEQ ID NO: 1038553 - DNA, 23 bp, Homo sapiens
ttcctcctgaagcctctgccctg

SEQ ID NO: 1038554 - DNA, 15 bp, Homo sapiens
ttcctcctgcagaca

SEQ ID NO: 1038555 - DNA, 13 bp, Homo sapiens
ttcctcctgctca

SEQ ID NO: 1038556 - DNA, 13 bp, Homo sapiens
ttcctcctggaaa

SEQ ID NO: 1038557 - DNA, 14 bp, Homo sapiens
ttcctcctggaaat

SEQ ID NO: 1038558 - DNA, 11 bp, Homo sapiens
ttcctcctggg

SEQ ID NO: 1038559 - DNA, 21 bp, Homo sapiens
ttcctcctgggccctctctgc

SEQ ID NO: 1038560 - DNA, 23 bp, Homo sapiens
ttcctcctgggccctctctgctc

SEQ ID NO: 1038561 - DNA, 12 bp, Homo sapiens
ttcctccttccc

SEQ ID NO: 1038562 - DNA, 15 bp, Homo sapiens
ttcctccttcccccc

SEQ ID NO: 1038563 - DNA, 17 bp, Homo sapiens
ttcctcggtctcccttc

SEQ ID NO: 1038564 - DNA, 18 bp, Homo sapiens
ttcctcggtctcccttcc

SEQ ID NO: 1038565 - DNA, 15 bp, Homo sapiens
ttcctcggtggctct

SEQ ID NO: 1038566 - DNA, 20 bp, Homo sapiens
ttcctcggtgggccagagct

SEQ ID NO: 1038567 - DNA, 17 bp, Homo sapiens
ttcctctaacatttttg

SEQ ID NO: 1038568 - DNA, 19 bp, Homo sapiens
ttcctctagcttttctatt

SEQ ID NO: 1038569 - DNA, 19 bp, Homo sapiens
ttcctctagtgccctccac

SEQ ID NO: 1038570 - DNA, 17 bp, Homo sapiens
ttcctctatacatctct

SEQ ID NO: 1038571 - DNA, 21 bp, Homo sapiens
ttcctctattgatgtacagtc

SEQ ID NO: 1038572 - DNA, 18 bp, Homo sapiens
ttcctctcactaaacttt

SEQ ID NO: 1038573 - DNA, 15 bp, Homo sapiens
ttcctctcattgtct

SEQ ID NO: 1038574 - DNA, 13 bp, Homo sapiens
ttcctctccactg

SEQ ID NO: 1038575 - DNA, 15 bp, Homo sapiens
ttcctctccactgcc

SEQ ID NO: 1038576 - DNA, 18 bp, Homo sapiens
ttcctctccactgccttc

SEQ ID NO: 1038577 - DNA, 18 bp, Homo sapiens
ttcctctccactgctgga

SEQ ID NO: 1038578 - DNA, 21 bp, Homo sapiens
ttcctctccactgctggacat

SEQ ID NO: 1038579 - DNA, 10 bp, Homo sapiens
ttcctctccc

SEQ ID NO: 1038580 - DNA, 14 bp, Homo sapiens
ttcctctccctcag

SEQ ID NO: 1038581 - DNA, 23 bp, Homo sapiens
ttcctctcccttcccttccctca

SEQ ID NO: 1038582 - DNA, 15 bp, Homo sapiens
ttcctctccttccca

SEQ ID NO: 1038583 - DNA, 22 bp, Homo sapiens
ttcctctccttcccacaaaaga

SEQ ID NO: 1038584 - DNA, 16 bp, Homo sapiens
ttcctctcgcggccct

SEQ ID NO: 1038585 - DNA, 21 bp, Homo sapiens
ttcctctcgcggccctcagta

SEQ ID NO: 1038586 - DNA, 19 bp, Homo sapiens
ttcctctctaccccccacc

SEQ ID NO: 1038587 - DNA, 15 bp, Homo sapiens
ttcctctctccagat

SEQ ID NO: 1038588 - DNA, 12 bp, Homo sapiens
ttcctctctgtc

SEQ ID NO: 1038589 - DNA, 14 bp, Homo sapiens
ttcctctgagcctt

SEQ ID NO: 1038590 - DNA, 21 bp, Homo sapiens
ttcctctgaggctggatccta

SEQ ID NO: 1038591 - DNA, 17 bp, Homo sapiens
ttcctctgcagctgacc

SEQ ID NO: 1038592 - DNA, 11 bp, Homo sapiens
ttcctctgccc

SEQ ID NO: 1038593 - DNA, 14 bp, Homo sapiens
ttcctctgctcacc

SEQ ID NO: 1038594 - DNA, 11 bp, Homo sapiens
ttcctctggat

SEQ ID NO: 1038595 - DNA, 12 bp, Homo sapiens
ttcctctgggaa

SEQ ID NO: 1038596 - DNA, 13 bp, Homo sapiens
ttcctctggttcc

SEQ ID NO: 1038597 - DNA, 16 bp, Homo sapiens
ttcctctggttccttt

SEQ ID NO: 1038598 - DNA, 21 bp, Homo sapiens
ttcctctgtttctccttctga

SEQ ID NO: 1038599 - DNA, 19 bp, Homo sapiens
ttcctcttagaagaatatt

SEQ ID NO: 1038600 - DNA, 22 bp, Homo sapiens
ttcctcttagaagaatattgta

SEQ ID NO: 1038601 - DNA, 16 bp, Homo sapiens
ttcctcttccccttgc

SEQ ID NO: 1038602 - DNA, 19 bp, Homo sapiens
ttcctcttccgggcagaaa

SEQ ID NO: 1038603 - DNA, 18 bp, Homo sapiens
ttcctcttggcaagatgt

SEQ ID NO: 1038604 - DNA, 16 bp, Homo sapiens
ttcctcttgtcctggc

SEQ ID NO: 1038605 - DNA, 17 bp, Homo sapiens
ttcctcttgtcctggcc

SEQ ID NO: 1038606 - DNA, 20 bp, Homo sapiens
ttcctctttctgctctgcca

SEQ ID NO: 1038607 - DNA, 19 bp, Homo sapiens
ttcctctttgctccctcca

SEQ ID NO: 1038608 - DNA, 17 bp, Homo sapiens
ttcctgaaagaaacagt

SEQ ID NO: 1038609 - DNA, 14 bp, Homo sapiens
ttcctgaaccatgt

SEQ ID NO: 1038610 - DNA, 13 bp, Homo sapiens
ttcctgaagccag

SEQ ID NO: 1038611 - DNA, 13 bp, Homo sapiens
ttcctgaagctgc

SEQ ID NO: 1038612 - DNA, 16 bp, Homo sapiens
ttcctgaagctgctgt

SEQ ID NO: 1038613 - DNA, 18 bp, Homo sapiens
ttcctgaagctgctgtgt

SEQ ID NO: 1038614 - DNA, 19 bp, Homo sapiens
ttcctgaagctgctgtgtc

SEQ ID NO: 1038615 - DNA, 18 bp, Homo sapiens
ttcctgaatccaaactaa

SEQ ID NO: 1038616 - DNA, 22 bp, Homo sapiens
ttcctgacccaggccgcagctc

SEQ ID NO: 1038617 - DNA, 23 bp, Homo sapiens
ttcctgacgaaactggccccgga

SEQ ID NO: 1038618 - DNA, 18 bp, Homo sapiens
ttcctgactctcacctgt

SEQ ID NO: 1038619 - DNA, 18 bp, Homo sapiens
ttctaaacccaatccaaa

SEQ ID NO: 1038620 - DNA, 19 bp, Homo sapiens
ttctaaacccaatccaaat

SEQ ID NO: 1038621 - DNA, 15 bp, Homo sapiens
ttctaaagatggaaa

SEQ ID NO: 1038622 - DNA, 20 bp, Homo sapiens
ttctaaagccaagaagaatt

SEQ ID NO: 1038623 - DNA, 13 bp, Homo sapiens
ttctaaagctcaa

SEQ ID NO: 1038624 - DNA, 23 bp, Homo sapiens
ttctaaaggtaccaaacaaggaa

SEQ ID NO: 1038625 - DNA, 12 bp, Homo sapiens
ttctaaagtaaa

SEQ ID NO: 1038626 - DNA, 19 bp, Homo sapiens
ttctaaatctccaaaataa

SEQ ID NO: 1038627 - DNA, 20 bp, Homo sapiens
ttctaaatgcatatcctgag

SEQ ID NO: 1038628 - DNA, 22 bp, Homo sapiens
ttctaacagatcagaacatgaa

SEQ ID NO: 1038629 - DNA, 23 bp, Homo sapiens
ttctaacagatcagaacatgaaa

SEQ ID NO: 1038630 - DNA, 18 bp, Homo sapiens
ttctaaccccctctgctc

SEQ ID NO: 1038631 - DNA, 24 bp, Homo sapiens
ttctaaccttgaatgctgccagtg

SEQ ID NO: 1038632 - DNA, 15 bp, Homo sapiens
ttctaacctttacat

SEQ ID NO: 1038633 - DNA, 18 bp, Homo sapiens
ttctaactctattaatga

SEQ ID NO: 1038634 - DNA, 16 bp, Homo sapiens
ttctaagaaaagcatt

SEQ ID NO: 1038635 - DNA, 16 bp, Homo sapiens
ttctaagaagacattt

SEQ ID NO: 1038636 - DNA, 17 bp, Homo sapiens
ttctaagaagacatttt

SEQ ID NO: 1038637 - DNA, 19 bp, Homo sapiens
ttctaagaagacattttgt

SEQ ID NO: 1038638 - DNA, 19 bp, Homo sapiens
ttctaagaagttacttttt

SEQ ID NO: 1038639 - DNA, 18 bp, Homo sapiens
ttctaagagaagttattt

SEQ ID NO: 1038640 - DNA, 21 bp, Homo sapiens
ttctaagccagttttcatttt

SEQ ID NO: 1038641 - DNA, 21 bp, Homo sapiens
ttctaagcgcctattgtttgt

SEQ ID NO: 1038642 - DNA, 13 bp, Homo sapiens
ttctaaggaagac

SEQ ID NO: 1038643 - DNA, 16 bp, Homo sapiens
ttctaagtaaatacaa

SEQ ID NO: 1038644 - DNA, 18 bp, Homo sapiens
ttctaagtaaatacaatt

SEQ ID NO: 1038645 - DNA, 21 bp, Homo sapiens
ttctaagtaaatacaattttt

SEQ ID NO: 1038646 - DNA, 14 bp, Homo sapiens
ttctaatagaactc

SEQ ID NO: 1038647 - DNA, 14 bp, Homo sapiens
ttctaatagagaga

SEQ ID NO: 1038648 - DNA, 17 bp, Homo sapiens
ttctaatggaatggttt

SEQ ID NO: 1038649 - DNA, 18 bp, Homo sapiens
ttctaatgtagctatttt

SEQ ID NO: 1038650 - DNA, 22 bp, Homo sapiens
ttctaattaaccttactaatta

SEQ ID NO: 1038651 - DNA, 23 bp, Homo sapiens
ttctaattgtaagtgaaattaag

SEQ ID NO: 1038652 - DNA, 14 bp, Homo sapiens
ttctaatttatatt

SEQ ID NO: 1038653 - DNA, 15 bp, Homo sapiens
ttctacaaaataaca

SEQ ID NO: 1038654 - DNA, 14 bp, Homo sapiens
ttctacaaggactc

SEQ ID NO: 1038655 - DNA, 22 bp, Homo sapiens
ttctacaaggactccattggat

SEQ ID NO: 1038656 - DNA, 16 bp, Homo sapiens
ttctacaatgtgaact

SEQ ID NO: 1038657 - DNA, 12 bp, Homo sapiens
ttctacaattaa

SEQ ID NO: 1038658 - DNA, 23 bp, Homo sapiens
ttctatcccacccaacagctcag

SEQ ID NO: 1038659 - DNA, 21 bp, Homo sapiens
ttctatcccccttaaagaaaa

SEQ ID NO: 1038660 - DNA, 12 bp, Homo sapiens
ttctatcctttc

SEQ ID NO: 1038661 - DNA, 14 bp, Homo sapiens
ttctatgacaaatt

SEQ ID NO: 1038662 - DNA, 16 bp, Homo sapiens
ttctatgacaaattca

SEQ ID NO: 1038663 - DNA, 18 bp, Homo sapiens
ttctatgacaaattcaag

SEQ ID NO: 1038664 - DNA, 16 bp, Homo sapiens
ttctatgacacatgca

SEQ ID NO: 1038665 - DNA, 22 bp, Homo sapiens
ttctatgtaaattattgtaaac

SEQ ID NO: 1038666 - DNA, 12 bp, Homo sapiens
ttctatgtatta

SEQ ID NO: 1038667 - DNA, 16 bp, Homo sapiens
ttctatgttaaatact

SEQ ID NO: 1038668 - DNA, 18 bp, Homo sapiens
ttctatgttaaatactgt

SEQ ID NO: 1038669 - DNA, 19 bp, Homo sapiens
ttctatgttaaatactgtg

SEQ ID NO: 1038670 - DNA, 23 bp, Homo sapiens
ttctatgttaaatactgtgcaga

SEQ ID NO: 1038671 - DNA, 13 bp, Homo sapiens
ttctattatatat

SEQ ID NO: 1038672 - DNA, 15 bp, Homo sapiens
ttctattatggaaaa

SEQ ID NO: 1038673 - DNA, 18 bp, Homo sapiens
ttctattccatgtccata

SEQ ID NO: 1038674 - DNA, 17 bp, Homo sapiens
ttctattgacttcaatg

SEQ ID NO: 1038675 - DNA, 19 bp, Homo sapiens
ttctattgactttcttaaa

SEQ ID NO: 1038676 - DNA, 14 bp, Homo sapiens
ttctattgttactc

SEQ ID NO: 1038677 - DNA, 19 bp, Homo sapiens
ttctattgttactctggtt

SEQ ID NO: 1038678 - DNA, 17 bp, Homo sapiens
ttctatttaattgaaac

SEQ ID NO: 1038679 - DNA, 18 bp, Homo sapiens
ttctatttatatgtacat

SEQ ID NO: 1038680 - DNA, 13 bp, Homo sapiens
ttctatttcataa

SEQ ID NO: 1038681 - DNA, 16 bp, Homo sapiens
ttctattttactttgt

SEQ ID NO: 1038682 - DNA, 14 bp, Homo sapiens
ttctatttttatca

SEQ ID NO: 1038683 - DNA, 18 bp, Homo sapiens
ttctatttttatcatgaa

SEQ ID NO: 1038684 - DNA, 20 bp, Homo sapiens
ttctatttttatcatgaatt

SEQ ID NO: 1038685 - DNA, 16 bp, Homo sapiens
ttctatttttcaatca

SEQ ID NO: 1038686 - DNA, 23 bp, Homo sapiens
ttctcaaacacagttacacttgt

SEQ ID NO: 1038687 - DNA, 23 bp, Homo sapiens
ttctcaaagagggggctctgccc

SEQ ID NO: 1038688 - DNA, 18 bp, Homo sapiens
ttctcaaagatctgaatt

SEQ ID NO: 1038689 - DNA, 15 bp, Homo sapiens
ttctcaaagcaggaa

SEQ ID NO: 1038690 - DNA, 18 bp, Homo sapiens
ttctcaaagttaattcac

SEQ ID NO: 1038691 - DNA, 21 bp, Homo sapiens
ttctcaacaaagcacagtgtt

SEQ ID NO: 1038692 - DNA, 15 bp, Homo sapiens
ttctcaacctaccac

SEQ ID NO: 1038693 - DNA, 20 bp, Homo sapiens
ttctcaactccagagcccct

SEQ ID NO: 1038694 - DNA, 12 bp, Homo sapiens
ttctcaagaatc

SEQ ID NO: 1038695 - DNA, 14 bp, Homo sapiens
ttctcaagaatcta

SEQ ID NO: 1038696 - DNA, 17 bp, Homo sapiens
ttctcaagaatctagaa

SEQ ID NO: 1038697 - DNA, 23 bp, Homo sapiens
ttctcaagctggtggcctctgca

SEQ ID NO: 1038698 - DNA, 14 bp, Homo sapiens
ttctcaagtccctt

SEQ ID NO: 1038699 - DNA, 11 bp, Homo sapiens
ttctcaagtgc

SEQ ID NO: 1038700 - DNA, 19 bp, Homo sapiens
ttctcttaatcactactgt

SEQ ID NO: 1038701 - DNA, 23 bp, Homo sapiens
ttctcttacattttcgtcctgta

SEQ ID NO: 1038702 - DNA, 19 bp, Homo sapiens
ttctcttatcctctctctc

SEQ ID NO: 1038703 - DNA, 12 bp, Homo sapiens
ttctcttcattt

SEQ ID NO: 1038704 - DNA, 12 bp, Homo sapiens
ttctcttcccag

SEQ ID NO: 1038705 - DNA, 17 bp, Homo sapiens
ttctcttccccttcctg

SEQ ID NO: 1038706 - DNA, 22 bp, Homo sapiens
ttctcttccccttcctgtttca

SEQ ID NO: 1038707 - DNA, 13 bp, Homo sapiens
ttctcttccctga

SEQ ID NO: 1038708 - DNA, 23 bp, Homo sapiens
ttctcttccctgcgcctgtgatg

SEQ ID NO: 1038709 - DNA, 19 bp, Homo sapiens
ttctcttccgcagcccctt

SEQ ID NO: 1038710 - DNA, 14 bp, Homo sapiens
ttctcttctgtcca

SEQ ID NO: 1038711 - DNA, 18 bp, Homo sapiens
ttctcttctgttctgatt

SEQ ID NO: 1038712 - DNA, 24 bp, Homo sapiens
ttctcttctttattgcactaggaa

SEQ ID NO: 1038713 - DNA, 14 bp, Homo sapiens
ttctcttgagctgg

SEQ ID NO: 1038714 - DNA, 15 bp, Homo sapiens
ttctcttgagctggc

SEQ ID NO: 1038715 - DNA, 20 bp, Homo sapiens
ttctcttgagctggcctctc

SEQ ID NO: 1038716 - DNA, 22 bp, Homo sapiens
ttctcttgagctggcctctcta

SEQ ID NO: 1038717 - DNA, 18 bp, Homo sapiens
ttctcttgccttaaatat

SEQ ID NO: 1038718 - DNA, 14 bp, Homo sapiens
ttctcttgctttct

SEQ ID NO: 1038719 - DNA, 17 bp, Homo sapiens
ttctcttgggaactgaa

SEQ ID NO: 1038720 - DNA, 22 bp, Homo sapiens
ttctcttgggaactgaactcac

SEQ ID NO: 1038721 - DNA, 18 bp, Homo sapiens
ttctcttgggcaggcaga

SEQ ID NO: 1038722 - DNA, 19 bp, Homo sapiens
ttctcttggtgaaataata

SEQ ID NO: 1038723 - DNA, 23 bp, Homo sapiens
ttctcttggtgaaataataaaat

SEQ ID NO: 1038724 - DNA, 17 bp, Homo sapiens
ttctctttaccttctaa

SEQ ID NO: 1038725 - DNA, 13 bp, Homo sapiens
ttctctttccttg

SEQ ID NO: 1038726 - DNA, 20 bp, Homo sapiens
ttctctttgattatttgcat

SEQ ID NO: 1038727 - DNA, 15 bp, Homo sapiens
ttctctttgtttctg

SEQ ID NO: 1038728 - DNA, 18 bp, Homo sapiens
ttctctttgtttctgttt

SEQ ID NO: 1038729 - DNA, 15 bp, Homo sapiens
ttctcttttattctg

SEQ ID NO: 1038730 - DNA, 13 bp, Homo sapiens
ttctcttttcctc

SEQ ID NO: 1038731 - DNA, 22 bp, Homo sapiens
ttctcttttggtttctgcttct

SEQ ID NO: 1038732 - DNA, 12 bp, Homo sapiens
ttctgaaaacac

SEQ ID NO: 1038733 - DNA, 15 bp, Homo sapiens
ttctgaaaatataac

SEQ ID NO: 1038734 - DNA, 16 bp, Homo sapiens
ttctgaaaattccaga

SEQ ID NO: 1038735 - DNA, 23 bp, Homo sapiens
ttctgaaagtaaaacaatttatg

SEQ ID NO: 1038736 - DNA, 15 bp, Homo sapiens
ttctgaaatgttctt

SEQ ID NO: 1038737 - DNA, 13 bp, Homo sapiens
ttctgaactccat

SEQ ID NO: 1038738 - DNA, 15 bp, Homo sapiens
ttctgaactccattt

SEQ ID NO: 1038739 - DNA, 14 bp, Homo sapiens
ttctgaagactgag

SEQ ID NO: 1038740 - DNA, 13 bp, Homo sapiens
ttctgaagagcct

SEQ ID NO: 1038741 - DNA, 22 bp, Homo sapiens
ttctgaagccatgtagccaccc

SEQ ID NO: 1038742 - DNA, 18 bp, Homo sapiens
ttctgaagctttaccagc

SEQ ID NO: 1038743 - DNA, 22 bp, Homo sapiens
ttctgaagtgggaaaaaataga

SEQ ID NO: 1038744 - DNA, 19 bp, Homo sapiens
ttctgaagtgtgtccatcc

SEQ ID NO: 1038745 - DNA, 16 bp, Homo sapiens
ttctgccacctctgac

SEQ ID NO: 1038746 - DNA, 20 bp, Homo sapiens
ttctgccacttctgcgggct

SEQ ID NO: 1038747 - DNA, 15 bp, Homo sapiens
ttctgccagggagct

SEQ ID NO: 1038748 - DNA, 19 bp, Homo sapiens
ttctgccatctagccagcc

SEQ ID NO: 1038749 - DNA, 16 bp, Homo sapiens
ttctgccatttcatgt

SEQ ID NO: 1038750 - DNA, 19 bp, Homo sapiens
ttctgccctgcctgaggag

SEQ ID NO: 1038751 - DNA, 18 bp, Homo sapiens
ttctgccctggctgctgc

SEQ ID NO: 1038752 - DNA, 20 bp, Homo sapiens
ttctgccctggctgctgccc

SEQ ID NO: 1038753 - DNA, 22 bp, Homo sapiens
ttctgccctttcctaggcccag

SEQ ID NO: 1038754 - DNA, 15 bp, Homo sapiens
ttctgccgccccctc

SEQ ID NO: 1038755 - DNA, 20 bp, Homo sapiens
ttctgccgctgtcaaggccg

SEQ ID NO: 1038756 - DNA, 13 bp, Homo sapiens
ttctgcctctaag

SEQ ID NO: 1038757 - DNA, 16 bp, Homo sapiens
ttctgcctctccaggc

SEQ ID NO: 1038758 - DNA, 14 bp, Homo sapiens
ttctgcctctctgg

SEQ ID NO: 1038759 - DNA, 13 bp, Homo sapiens
ttctgcctgttat

SEQ ID NO: 1038760 - DNA, 15 bp, Homo sapiens
ttctgcctgttataa

SEQ ID NO: 1038761 - DNA, 21 bp, Homo sapiens
ttctgcctgttataactctgc

SEQ ID NO: 1038762 - DNA, 20 bp, Homo sapiens
ttctgccttggttctggcca

SEQ ID NO: 1038763 - DNA, 18 bp, Homo sapiens
ttctgcctttcccccctc

SEQ ID NO: 1038764 - DNA, 15 bp, Homo sapiens
ttctgcctttgatgt

SEQ ID NO: 1038765 - DNA, 20 bp, Homo sapiens
ttctgcgggctccctcctct

SEQ ID NO: 1038766 - DNA, 23 bp, Homo sapiens
ttctgcgggctccctcctctggc

SEQ ID NO: 1038767 - DNA, 13 bp, Homo sapiens
ttctgcgtccacc

SEQ ID NO: 1038768 - DNA, 16 bp, Homo sapiens
ttctgctacctcactg

SEQ ID NO: 1038769 - DNA, 21 bp, Homo sapiens
ttctgctactttgctgctatg

SEQ ID NO: 1038770 - DNA, 12 bp, Homo sapiens
ttctgctcagct

SEQ ID NO: 1038771 - DNA, 14 bp, Homo sapiens
ttctgctcagctct

SEQ ID NO: 1038772 - DNA, 21 bp, Homo sapiens
ttctgctcatcattctctgtc

SEQ ID NO: 1038773 - DNA, 16 bp, Homo sapiens
ttctgctcccacccca

SEQ ID NO: 1038774 - DNA, 23 bp, Homo sapiens
ttctgctcccaccccagaaatca

SEQ ID NO: 1038775 - DNA, 13 bp, Homo sapiens
ttctgctcctctc

SEQ ID NO: 1038776 - DNA, 16 bp, Homo sapiens
ttctgctcctctccag

SEQ ID NO: 1038777 - DNA, 13 bp, Homo sapiens
ttctgctcctgct

SEQ ID NO: 1038778 - DNA, 17 bp, Homo sapiens
ttctgctcctgcttttc

SEQ ID NO: 1038779 - DNA, 13 bp, Homo sapiens
ttctgctctgcca

SEQ ID NO: 1038780 - DNA, 15 bp, Homo sapiens
ttctgctctgccatc

SEQ ID NO: 1038781 - DNA, 13 bp, Homo sapiens
ttctgctctggaa

SEQ ID NO: 1038782 - DNA, 17 bp, Homo sapiens
ttctgctctggaataaa

SEQ ID NO: 1038783 - DNA, 23 bp, Homo sapiens
ttctgctctggaataaagttgca

SEQ ID NO: 1038784 - DNA, 21 bp, Homo sapiens
ttctgctctggttgtttctgt

SEQ ID NO: 1038785 - DNA, 14 bp, Homo sapiens
ttctgctgaccaaa

SEQ ID NO: 1038786 - DNA, 14 bp, Homo sapiens
ttctgctgccctct

SEQ ID NO: 1038787 - DNA, 19 bp, Homo sapiens
ttctgctggcctggatctc

SEQ ID NO: 1038788 - DNA, 19 bp, Homo sapiens
ttctgctgttcttcacttc

SEQ ID NO: 1038789 - DNA, 14 bp, Homo sapiens
ttctgctttcactt

SEQ ID NO: 1038790 - DNA, 18 bp, Homo sapiens
ttctgcttttctgccctg

SEQ ID NO: 1038791 - DNA, 19 bp, Homo sapiens
ttctggaaaaaaaatatat

SEQ ID NO: 1038792 - DNA, 12 bp, Homo sapiens
ttctgtaacaaa

SEQ ID NO: 1038793 - DNA, 13 bp, Homo sapiens
ttctgtaacaaat

SEQ ID NO: 1038794 - DNA, 16 bp, Homo sapiens
ttctgtaacaaattgg

SEQ ID NO: 1038795 - DNA, 23 bp, Homo sapiens
ttctgtaactattgggtgaatat

SEQ ID NO: 1038796 - DNA, 20 bp, Homo sapiens
ttctgtaatatttacaatgt

SEQ ID NO: 1038797 - DNA, 17 bp, Homo sapiens
ttctgtaatggaactga

SEQ ID NO: 1038798 - DNA, 16 bp, Homo sapiens
ttctgtaattcaggtt

SEQ ID NO: 1038799 - DNA, 21 bp, Homo sapiens
ttctgtaattcaggtttttcc

SEQ ID NO: 1038800 - DNA, 13 bp, Homo sapiens
ttctgtaattgtg

SEQ ID NO: 1038801 - DNA, 11 bp, Homo sapiens
ttctgtaccag

SEQ ID NO: 1038802 - DNA, 18 bp, Homo sapiens
ttctgtagcctaaaacga

SEQ ID NO: 1038803 - DNA, 17 bp, Homo sapiens
ttctgtagctttctgga

SEQ ID NO: 1038804 - DNA, 16 bp, Homo sapiens
ttctgtaggttctgtg

SEQ ID NO: 1038805 - DNA, 20 bp, Homo sapiens
ttctgtagtactccttaaga

SEQ ID NO: 1038806 - DNA, 14 bp, Homo sapiens
ttctgtagttttta

SEQ ID NO: 1038807 - DNA, 21 bp, Homo sapiens
ttctgtataaagcctgtattc

SEQ ID NO: 1038808 - DNA, 23 bp, Homo sapiens
ttctgtatacaaccctggcatta

SEQ ID NO: 1038809 - DNA, 21 bp, Homo sapiens
ttctgtatatgattctctgtg

SEQ ID NO: 1038810 - DNA, 22 bp, Homo sapiens
ttctgtatatgattctctgtgg

SEQ ID NO: 1038811 - DNA, 18 bp, Homo sapiens
ttctgtatatttgtcatg

SEQ ID NO: 1038812 - DNA, 19 bp, Homo sapiens
ttctgtcacagtaaaaata

SEQ ID NO: 1038813 - DNA, 16 bp, Homo sapiens
ttctgtcagtaaaact

SEQ ID NO: 1038814 - DNA, 12 bp, Homo sapiens
ttctgtccagga

SEQ ID NO: 1038815 - DNA, 12 bp, Homo sapiens
ttctgtccatca

SEQ ID NO: 1038816 - DNA, 14 bp, Homo sapiens
ttctgtccatcagt

SEQ ID NO: 1038817 - DNA, 15 bp, Homo sapiens
ttctgtccctgtccc

SEQ ID NO: 1038818 - DNA, 18 bp, Homo sapiens
ttctgtccctgtccctgc

SEQ ID NO: 1038819 - DNA, 17 bp, Homo sapiens
ttctgtcctagcaagta

SEQ ID NO: 1038820 - DNA, 14 bp, Homo sapiens
ttctgtcctgggca

SEQ ID NO: 1038821 - DNA, 15 bp, Homo sapiens
ttctgtctactaagt

SEQ ID NO: 1038822 - DNA, 21 bp, Homo sapiens
ttctgtctaggttaaagctaa

SEQ ID NO: 1038823 - DNA, 13 bp, Homo sapiens
ttctgtctctgcc

SEQ ID NO: 1038824 - DNA, 14 bp, Homo sapiens
ttctgtctctgcct

SEQ ID NO: 1038825 - DNA, 13 bp, Homo sapiens
ttctgtcttccca

SEQ ID NO: 1038826 - DNA, 21 bp, Homo sapiens
ttctgtcttgttcattttgag

SEQ ID NO: 1038827 - DNA, 20 bp, Homo sapiens
ttctgtgcactagcctgtga

SEQ ID NO: 1038828 - DNA, 19 bp, Homo sapiens
ttctgtgcctccccccaga

SEQ ID NO: 1038829 - DNA, 13 bp, Homo sapiens
ttctgtgcctgaa

SEQ ID NO: 1038830 - DNA, 17 bp, Homo sapiens
ttctgtgcctgaatatt

SEQ ID NO: 1038831 - DNA, 16 bp, Homo sapiens
ttctgtgcttggattt

SEQ ID NO: 1038832 - DNA, 17 bp, Homo sapiens
ttctgtggaggacagac

SEQ ID NO: 1038833 - DNA, 14 bp, Homo sapiens
ttctgtggagtaaa

SEQ ID NO: 1038834 - DNA, 21 bp, Homo sapiens
ttctgtggatacagtgcccac

SEQ ID NO: 1038835 - DNA, 22 bp, Homo sapiens
ttctgtggatacagtgcccacc

SEQ ID NO: 1038836 - DNA, 21 bp, Homo sapiens
ttctgtggccgccatctgcgc

SEQ ID NO: 1038837 - DNA, 16 bp, Homo sapiens
ttctgtggctcacaga

SEQ ID NO: 1038838 - DNA, 19 bp, Homo sapiens
ttctgtgggcttggccttg

SEQ ID NO: 1038839 - DNA, 21 bp, Homo sapiens
ttctgtgggcttggccttgtg

SEQ ID NO: 1038840 - DNA, 10 bp, Homo sapiens
ttctgtggtt

SEQ ID NO: 1038841 - DNA, 11 bp, Homo sapiens
tggagagaagt

SEQ ID NO: 1038842 - DNA, 13 bp, Homo sapiens
tggagagaagttt

SEQ ID NO: 1038843 - DNA, 23 bp, Homo sapiens
tggagagaagtttctggccctgg

SEQ ID NO: 1038844 - DNA, 23 bp, Homo sapiens
tggagagagaggctgcctcagcc

SEQ ID NO: 1038845 - DNA, 17 bp, Homo sapiens
tggagagcaaaggccca

SEQ ID NO: 1038846 - DNA, 18 bp, Homo sapiens
tggagagcaaaggcccat

SEQ ID NO: 1038847 - DNA, 21 bp, Homo sapiens
tggagagcacagcatgcctta

SEQ ID NO: 1038848 - DNA, 11 bp, Homo sapiens
tggagagctgg

SEQ ID NO: 1038849 - DNA, 14 bp, Homo sapiens
tggagagctggtgc

SEQ ID NO: 1038850 - DNA, 13 bp, Homo sapiens
tggagaggacaga

SEQ ID NO: 1038851 - DNA, 18 bp, Homo sapiens
tggagaggacagagcagg

SEQ ID NO: 1038852 - DNA, 21 bp, Homo sapiens
tggagaggacagagcaggggc

SEQ ID NO: 1038853 - DNA, 23 bp, Homo sapiens
tggagaggacggccctgcctgcc

SEQ ID NO: 1038854 - DNA, 21 bp, Homo sapiens
tggagaggagagtggcaggtg

SEQ ID NO: 1038855 - DNA, 16 bp, Homo sapiens
tggagagggggcctgg

SEQ ID NO: 1038856 - DNA, 16 bp, Homo sapiens
tggagaggtggctgcg

SEQ ID NO: 1038857 - DNA, 23 bp, Homo sapiens
tggagaggtggctgcgcccccag

SEQ ID NO: 1038858 - DNA, 18 bp, Homo sapiens
tggagagtgcactgacct

SEQ ID NO: 1038859 - DNA, 21 bp, Homo sapiens
tggagataaaagcaattctga

SEQ ID NO: 1038860 - DNA, 14 bp, Homo sapiens
tggagataataaaa

SEQ ID NO: 1038861 - DNA, 17 bp, Homo sapiens
tggagatagctggggct

SEQ ID NO: 1038862 - DNA, 20 bp, Homo sapiens
tggagatcagaaagtgacat

SEQ ID NO: 1038863 - DNA, 20 bp, Homo sapiens
tggagatcctcctgcagacc

SEQ ID NO: 1038864 - DNA, 18 bp, Homo sapiens
tggagatgaggccagacc

SEQ ID NO: 1038865 - DNA, 13 bp, Homo sapiens
tggagatgcagag

SEQ ID NO: 1038866 - DNA, 22 bp, Homo sapiens
tggagatgcatcgggaaagaag

SEQ ID NO: 1038867 - DNA, 14 bp, Homo sapiens
tggagatgggaagg

SEQ ID NO: 1038868 - DNA, 14 bp, Homo sapiens
tggagatgtaaaat

SEQ ID NO: 1038869 - DNA, 18 bp, Homo sapiens
tggagatgtaaaatgagt

SEQ ID NO: 1038870 - DNA, 22 bp, Homo sapiens
tggagatttttcatacttttct

SEQ ID NO: 1038871 - DNA, 18 bp, Homo sapiens
tggagcaaagaaggagct

SEQ ID NO: 1038872 - DNA, 15 bp, Homo sapiens
tggagcacatgttac

SEQ ID NO: 1038873 - DNA, 16 bp, Homo sapiens
tggagcacctgggccc

SEQ ID NO: 1038874 - DNA, 19 bp, Homo sapiens
tggagcacgtggagatagt

SEQ ID NO: 1038875 - DNA, 22 bp, Homo sapiens
tggagcactctgagtttaccat

SEQ ID NO: 1038876 - DNA, 21 bp, Homo sapiens
tggagcacttgttttaaaatg

SEQ ID NO: 1038877 - DNA, 18 bp, Homo sapiens
tggagcagaaagtgcctt

SEQ ID NO: 1038878 - DNA, 15 bp, Homo sapiens
tggagcagagctctc

SEQ ID NO: 1038879 - DNA, 16 bp, Homo sapiens
tggagcagaggggctg

SEQ ID NO: 1038880 - DNA, 18 bp, Homo sapiens
tggagcaggactctattt

SEQ ID NO: 1038881 - DNA, 13 bp, Homo sapiens
tggagcaggagcc

SEQ ID NO: 1038882 - DNA, 15 bp, Homo sapiens
tggagcatcaagcca

SEQ ID NO: 1038883 - DNA, 15 bp, Homo sapiens
tggagcatcccaggc

SEQ ID NO: 1038884 - DNA, 11 bp, Homo sapiens
tggagcatctg

SEQ ID NO: 1038885 - DNA, 17 bp, Homo sapiens
tggagccacaggcaggg

SEQ ID NO: 1038886 - DNA, 11 bp, Homo sapiens
tggagccagag

SEQ ID NO: 1038887 - DNA, 21 bp, Homo sapiens
tggagccagagagaacaacag

SEQ ID NO: 1038888 - DNA, 18 bp, Homo sapiens
tggagccagggcagagga

SEQ ID NO: 1038889 - DNA, 13 bp, Homo sapiens
tggagccagggcc

SEQ ID NO: 1038890 - DNA, 20 bp, Homo sapiens
tggagcccacagcgagcctg

SEQ ID NO: 1038891 - DNA, 21 bp, Homo sapiens
tggagcccacagcgagcctgt

SEQ ID NO: 1038892 - DNA, 22 bp, Homo sapiens
tggagcccagggcatcttgctg

SEQ ID NO: 1038893 - DNA, 13 bp, Homo sapiens
tggagccccaggg

SEQ ID NO: 1038894 - DNA, 17 bp, Homo sapiens
tggagccccatcggcca

SEQ ID NO: 1038895 - DNA, 15 bp, Homo sapiens
tggagcccctgggtg

SEQ ID NO: 1038896 - DNA, 17 bp, Homo sapiens
tggagcccgcttcaagc

SEQ ID NO: 1038897 - DNA, 20 bp, Homo sapiens
tggagcccgcttcaagctct

SEQ ID NO: 1038898 - DNA, 13 bp, Homo sapiens
tggagcccgtgca

SEQ ID NO: 1038899 - DNA, 11 bp, Homo sapiens
tggagccctgt

SEQ ID NO: 1038900 - DNA, 15 bp, Homo sapiens
tggagcccttgggtt

SEQ ID NO: 1038901 - DNA, 17 bp, Homo sapiens
tggagccgaggcctacc

SEQ ID NO: 1038902 - DNA, 18 bp, Homo sapiens
tggagcctacattccttg

SEQ ID NO: 1038903 - DNA, 23 bp, Homo sapiens
tggagcctgcagggtggtgctgg

SEQ ID NO: 1038904 - DNA, 14 bp, Homo sapiens
tggagcctgccaag

SEQ ID NO: 1038905 - DNA, 20 bp, Homo sapiens
tggagcctggaactgcatca

SEQ ID NO: 1038906 - DNA, 14 bp, Homo sapiens
tggagcctggggtg

SEQ ID NO: 1038907 - DNA, 22 bp, Homo sapiens
tggagcgcacctgccccctggt

SEQ ID NO: 1038908 - DNA, 23 bp, Homo sapiens
tggagcggaatttacctgatttc

SEQ ID NO: 1038909 - DNA, 22 bp, Homo sapiens
tggagcgtttgctgtgccagga

SEQ ID NO: 1038910 - DNA, 23 bp, Homo sapiens
tggagcgtttgctgtgccaggag

SEQ ID NO: 1038911 - DNA, 16 bp, Homo sapiens
tggagctactgatgaa

SEQ ID NO: 1038912 - DNA, 23 bp, Homo sapiens
tggagctcttggaagagctcttc

SEQ ID NO: 1038913 - DNA, 12 bp, Homo sapiens
tggagctcttgt

SEQ ID NO: 1038914 - DNA, 13 bp, Homo sapiens
tggagctgaagac

SEQ ID NO: 1038915 - DNA, 16 bp, Homo sapiens
tggagctgaatttgat

SEQ ID NO: 1038916 - DNA, 17 bp, Homo sapiens
tggagctgaatttgata

SEQ ID NO: 1038917 - DNA, 15 bp, Homo sapiens
tggagctgagaagag

SEQ ID NO: 1038918 - DNA, 15 bp, Homo sapiens
tggagctgagcctct

SEQ ID NO: 1038919 - DNA, 14 bp, Homo sapiens
tggagctgggaggt

SEQ ID NO: 1038920 - DNA, 14 bp, Homo sapiens
tggagctggtctgc

SEQ ID NO: 1038921 - DNA, 16 bp, Homo sapiens
tggagcttaagccact

SEQ ID NO: 1038922 - DNA, 16 bp, Homo sapiens
tggagctttggaatat

SEQ ID NO: 1038923 - DNA, 16 bp, Homo sapiens
tggagctttttcaaaa

SEQ ID NO: 1038924 - DNA, 23 bp, Homo sapiens
tggaggaaaaccaagccgtggct

SEQ ID NO: 1038925 - DNA, 17 bp, Homo sapiens
tggaggaacacagagaa

SEQ ID NO: 1038926 - DNA, 19 bp, Homo sapiens
tggaggaacacttgatgga

SEQ ID NO: 1038927 - DNA, 17 bp, Homo sapiens
tggaggaaccacatata

SEQ ID NO: 1038928 - DNA, 22 bp, Homo sapiens
tggaggaaccacatataacact

SEQ ID NO: 1038929 - DNA, 14 bp, Homo sapiens
tggaggaagagcca

SEQ ID NO: 1038930 - DNA, 23 bp, Homo sapiens
tggaggaagagccacctgcaaga

SEQ ID NO: 1038931 - DNA, 16 bp, Homo sapiens
tggaggaagcccacca

SEQ ID NO: 1038932 - DNA, 15 bp, Homo sapiens
tggaggaaggctctg

SEQ ID NO: 1038933 - DNA, 21 bp, Homo sapiens
tggaggaaggctctgtcactc

SEQ ID NO: 1038934 - DNA, 15 bp, Homo sapiens
tggaggaaggtgctg

SEQ ID NO: 1038935 - DNA, 16 bp, Homo sapiens
tggaggaaggtgctga

SEQ ID NO: 1038936 - DNA, 23 bp, Homo sapiens
tggaggaagtggggtctggcctg

SEQ ID NO: 1038937 - DNA, 17 bp, Homo sapiens
tggaggaatacatttta

SEQ ID NO: 1038938 - DNA, 18 bp, Homo sapiens
tggaggaatacattttat

SEQ ID NO: 1038939 - DNA, 15 bp, Homo sapiens
tggaggaatgctccc

SEQ ID NO: 1038940 - DNA, 18 bp, Homo sapiens
tggaggaattcagctcag

SEQ ID NO: 1038941 - DNA, 21 bp, Homo sapiens
tggaggaccccgagggctgag

SEQ ID NO: 1038942 - DNA, 19 bp, Homo sapiens
tgggcagcttctgttggca

SEQ ID NO: 1038943 - DNA, 23 bp, Homo sapiens
tgggcaggaagtgaagagatcct

SEQ ID NO: 1038944 - DNA, 20 bp, Homo sapiens
tgggcaggatctcaagccag

SEQ ID NO: 1038945 - DNA, 12 bp, Homo sapiens
tgggcaggcaga

SEQ ID NO: 1038946 - DNA, 14 bp, Homo sapiens
tgggcaggcagaga

SEQ ID NO: 1038947 - DNA, 12 bp, Homo sapiens
tgggcaggcggt

SEQ ID NO: 1038948 - DNA, 13 bp, Homo sapiens
tgggcagggagcg

SEQ ID NO: 1038949 - DNA, 16 bp, Homo sapiens
tgggcagggaggggct

SEQ ID NO: 1038950 - DNA, 18 bp, Homo sapiens
tgggcagggaggggctgg

SEQ ID NO: 1038951 - DNA, 21 bp, Homo sapiens
tgggcagggaggggctggggc

SEQ ID NO: 1038952 - DNA, 20 bp, Homo sapiens
tgggcaggtggccgcccctg

SEQ ID NO: 1038953 - DNA, 23 bp, Homo sapiens
tgggcaggtggccgcccctgagg

SEQ ID NO: 1038954 - DNA, 17 bp, Homo sapiens
tgggcaggtggtggcac

SEQ ID NO: 1038955 - DNA, 17 bp, Homo sapiens
tgggcaggttcctgggg

SEQ ID NO: 1038956 - DNA, 22 bp, Homo sapiens
tgggcaggttcctggggccgcc

SEQ ID NO: 1038957 - DNA, 17 bp, Homo sapiens
tgggcagtcaccaccca

SEQ ID NO: 1038958 - DNA, 18 bp, Homo sapiens
tgggcagtcaccacccag

SEQ ID NO: 1038959 - DNA, 22 bp, Homo sapiens
tgggcagtcaccacccagccct

SEQ ID NO: 1038960 - DNA, 13 bp, Homo sapiens
tgggcagtgccac

SEQ ID NO: 1038961 - DNA, 17 bp, Homo sapiens
tgggcagtgccacagcc

SEQ ID NO: 1038962 - DNA, 20 bp, Homo sapiens
tgggcagtgccacagcctgc

SEQ ID NO: 1038963 - DNA, 21 bp, Homo sapiens
tgggcagtgccacagcctgct

SEQ ID NO: 1038964 - DNA, 22 bp, Homo sapiens
tgggcagtgccacagcctgctg

SEQ ID NO: 1038965 - DNA, 17 bp, Homo sapiens
tgggcagtgccccaggg

SEQ ID NO: 1038966 - DNA, 16 bp, Homo sapiens
tgggcagttctcccag

SEQ ID NO: 1038967 - DNA, 19 bp, Homo sapiens
tgggcagttctcccaggga

SEQ ID NO: 1038968 - DNA, 20 bp, Homo sapiens
tgggcagttctcccagggag

SEQ ID NO: 1038969 - DNA, 21 bp, Homo sapiens
tgggcagttctcccagggagt

SEQ ID NO: 1038970 - DNA, 22 bp, Homo sapiens
tgggcagttctcccagggagtg

SEQ ID NO: 1038971 - DNA, 16 bp, Homo sapiens
tgggcagttttttgaa

SEQ ID NO: 1038972 - DNA, 14 bp, Homo sapiens
tgggcatcatttta

SEQ ID NO: 1038973 - DNA, 21 bp, Homo sapiens
tgggcatcccagcttgccccc

SEQ ID NO: 1038974 - DNA, 22 bp, Homo sapiens
tgggcatcccagcttgcccccg

SEQ ID NO: 1038975 - DNA, 16 bp, Homo sapiens
tgggcatcttctggct

SEQ ID NO: 1038976 - DNA, 13 bp, Homo sapiens
tgggcatcttttg

SEQ ID NO: 1038977 - DNA, 15 bp, Homo sapiens
tgggcatcttttgta

SEQ ID NO: 1038978 - DNA, 19 bp, Homo sapiens
tgggcatgagctgctgtgc

SEQ ID NO: 1038979 - DNA, 14 bp, Homo sapiens
tgggcatgccaccc

SEQ ID NO: 1038980 - DNA, 20 bp, Homo sapiens
tgggcatgccaccctcacac

SEQ ID NO: 1038981 - DNA, 17 bp, Homo sapiens
tgggcatggccgcttct

SEQ ID NO: 1038982 - DNA, 20 bp, Homo sapiens
tgggcatgggtccagggcct

SEQ ID NO: 1038983 - DNA, 20 bp, Homo sapiens
tgggcattagtgtcccccct

SEQ ID NO: 1038984 - DNA, 14 bp, Homo sapiens
tgggcattgcagcc

SEQ ID NO: 1038985 - DNA, 13 bp, Homo sapiens
tgggcattgcttt

SEQ ID NO: 1038986 - DNA, 19 bp, Homo sapiens
tgggcattgggctgacacc

SEQ ID NO: 1038987 - DNA, 19 bp, Homo sapiens
tgggcatttattttataac

SEQ ID NO: 1038988 - DNA, 17 bp, Homo sapiens
tgggcatttggtgagag

SEQ ID NO: 1038989 - DNA, 16 bp, Homo sapiens
tgggcatttgtgaggc

SEQ ID NO: 1038990 - DNA, 20 bp, Homo sapiens
tgggcattttcctcctctgc

SEQ ID NO: 1038991 - DNA, 19 bp, Homo sapiens
tgggccaagtccactgtcc

SEQ ID NO: 1038992 - DNA, 20 bp, Homo sapiens
tgggccacctcctacccctt

SEQ ID NO: 1038993 - DNA, 14 bp, Homo sapiens
tgggccactctccc

SEQ ID NO: 1038994 - DNA, 15 bp, Homo sapiens
tgggccactctcccc

SEQ ID NO: 1038995 - DNA, 22 bp, Homo sapiens
tgggccactggggactttattt

SEQ ID NO: 1038996 - DNA, 16 bp, Homo sapiens
tgggccagagctgaac

SEQ ID NO: 1038997 - DNA, 14 bp, Homo sapiens
tgggccagccacag

SEQ ID NO: 1038998 - DNA, 13 bp, Homo sapiens
tgggccagcccct

SEQ ID NO: 1038999 - DNA, 18 bp, Homo sapiens
tgggccagccctgcagcc

SEQ ID NO: 1039000 - DNA, 19 bp, Homo sapiens
tgggccagcggggctgctc

SEQ ID NO: 1039001 - DNA, 12 bp, Homo sapiens
tgggccaggcag

SEQ ID NO: 1039002 - DNA, 15 bp, Homo sapiens
tgggccaggcaggcg

SEQ ID NO: 1039003 - DNA, 13 bp, Homo sapiens
tgggccagggctg

SEQ ID NO: 1039004 - DNA, 19 bp, Homo sapiens
tgggccagggtctgtgtga

SEQ ID NO: 1039005 - DNA, 22 bp, Homo sapiens
tgggccagggtctgtgtgaatg

SEQ ID NO: 1039006 - DNA, 18 bp, Homo sapiens
tgggccagtccccgagga

SEQ ID NO: 1039007 - DNA, 20 bp, Homo sapiens
tgggccatgcgaggggccag

SEQ ID NO: 1039008 - DNA, 23 bp, Homo sapiens
tgggccatgtccaaagaggctgc

SEQ ID NO: 1039009 - DNA, 12 bp, Homo sapiens
tgggccattacc

SEQ ID NO: 1039010 - DNA, 15 bp, Homo sapiens
tgggccattacccca

SEQ ID NO: 1039011 - DNA, 22 bp, Homo sapiens
tgggcccaaaggcccagggagg

SEQ ID NO: 1039012 - DNA, 16 bp, Homo sapiens
tgggcccacagagcct

SEQ ID NO: 1039013 - DNA, 21 bp, Homo sapiens
tgggcccacagagcctggctt

SEQ ID NO: 1039014 - DNA, 22 bp, Homo sapiens
tgggcccagaccactgtctcca

SEQ ID NO: 1039015 - DNA, 13 bp, Homo sapiens
tgggcccagatct

SEQ ID NO: 1039016 - DNA, 12 bp, Homo sapiens
tgggcccagccc

SEQ ID NO: 1039017 - DNA, 14 bp, Homo sapiens
tgggcccagctggg

SEQ ID NO: 1039018 - DNA, 19 bp, Homo sapiens
tgggcccagctgggctctg

SEQ ID NO: 1039019 - DNA, 17 bp, Homo sapiens
tgggcccaggaccagct

SEQ ID NO: 1039020 - DNA, 18 bp, Homo sapiens
tgggcccaggaccagctg

SEQ ID NO: 1039021 - DNA, 23 bp, Homo sapiens
tgggcccaggaccagctggggcg

SEQ ID NO: 1039022 - DNA, 13 bp, Homo sapiens
tgggcccaggcag

SEQ ID NO: 1039023 - DNA, 14 bp, Homo sapiens
tgggcccaggcagg

SEQ ID NO: 1039024 - DNA, 16 bp, Homo sapiens
tgcgactttctgcctg

SEQ ID NO: 1039025 - DNA, 22 bp, Homo sapiens
tgcgagacgcacacagctgagc

SEQ ID NO: 1039026 - DNA, 15 bp, Homo sapiens
tgcgagcttggcctt

SEQ ID NO: 1039027 - DNA, 16 bp, Homo sapiens
tgcgagcttggccttg

SEQ ID NO: 1039028 - DNA, 20 bp, Homo sapiens
tgcgagcttggccttgggcc

SEQ ID NO: 1039029 - DNA, 14 bp, Homo sapiens
tgcgaggggccagc

SEQ ID NO: 1039030 - DNA, 20 bp, Homo sapiens
tgcgaggggccagcagaggg

SEQ ID NO: 1039031 - DNA, 20 bp, Homo sapiens
tgcgagtccaaggccagtcc

SEQ ID NO: 1039032 - DNA, 17 bp, Homo sapiens
tgcgagtgtgtgcatgt

SEQ ID NO: 1039033 - DNA, 17 bp, Homo sapiens
tgcgatcttcagagcag

SEQ ID NO: 1039034 - DNA, 23 bp, Homo sapiens
tgcgatgtggacgtcacgctccc

SEQ ID NO: 1039035 - DNA, 20 bp, Homo sapiens
tgcgcacagagggaagccat

SEQ ID NO: 1039036 - DNA, 14 bp, Homo sapiens
tgcgcagtgccttg

SEQ ID NO: 1039037 - DNA, 22 bp, Homo sapiens
tgcgccactgctccgtggagga

SEQ ID NO: 1039038 - DNA, 12 bp, Homo sapiens
tgcgccaggcag

SEQ ID NO: 1039039 - DNA, 13 bp, Homo sapiens
tgcgccaggcaga

SEQ ID NO: 1039040 - DNA, 14 bp, Homo sapiens
tgcgccaggcagag

SEQ ID NO: 1039041 - DNA, 15 bp, Homo sapiens
tgcgccagtcctgct

SEQ ID NO: 1039042 - DNA, 22 bp, Homo sapiens
tgcgcccagagctggcctcccc

SEQ ID NO: 1039043 - DNA, 19 bp, Homo sapiens
tgcgcccagggctgggagg

SEQ ID NO: 1039044 - DNA, 23 bp, Homo sapiens
tgcgcccagggctgggaggaagg

SEQ ID NO: 1039045 - DNA, 13 bp, Homo sapiens
tgcgcccccagct

SEQ ID NO: 1039046 - DNA, 14 bp, Homo sapiens
tgcgcccccagctt

SEQ ID NO: 1039047 - DNA, 21 bp, Homo sapiens
tgcgccccctccgccctgcca

SEQ ID NO: 1039048 - DNA, 17 bp, Homo sapiens
tgcgccctgacatgcta

SEQ ID NO: 1039049 - DNA, 19 bp, Homo sapiens
tgcgccctgacatgctaac

SEQ ID NO: 1039050 - DNA, 21 bp, Homo sapiens
tgcgccctggatcctcacact

SEQ ID NO: 1039051 - DNA, 21 bp, Homo sapiens
tgcgcccttaactgcatccag

SEQ ID NO: 1039052 - DNA, 15 bp, Homo sapiens
tgcgcccttaccttc

SEQ ID NO: 1039053 - DNA, 21 bp, Homo sapiens
tgcgcccttgaggggccccag

SEQ ID NO: 1039054 - DNA, 20 bp, Homo sapiens
tgcgccgagaccgcagaggg

SEQ ID NO: 1039055 - DNA, 12 bp, Homo sapiens
tgcgcctcacca

SEQ ID NO: 1039056 - DNA, 23 bp, Homo sapiens
tgcgcctccatccatctgtccgt

SEQ ID NO: 1039057 - DNA, 15 bp, Homo sapiens
tgcgcctgagtgagt

SEQ ID NO: 1039058 - DNA, 17 bp, Homo sapiens
tgcgcctgagtgagtgt

SEQ ID NO: 1039059 - DNA, 15 bp, Homo sapiens
tgcgcctgcaggcag

SEQ ID NO: 1039060 - DNA, 18 bp, Homo sapiens
tgcgcctgtgatgctggg

SEQ ID NO: 1039061 - DNA, 20 bp, Homo sapiens
tgcgcctttgtattataaaa

SEQ ID NO: 1039062 - DNA, 14 bp, Homo sapiens
tgcgcgtgtgcacg

SEQ ID NO: 1039063 - DNA, 14 bp, Homo sapiens
tgcgctagcagccc

SEQ ID NO: 1039064 - DNA, 22 bp, Homo sapiens
tgcgctcagggccatgctgagg

SEQ ID NO: 1039065 - DNA, 14 bp, Homo sapiens
tgcgctctcaagac

SEQ ID NO: 1039066 - DNA, 21 bp, Homo sapiens
tgcgctcttggtccctggtcc

SEQ ID NO: 1039067 - DNA, 17 bp, Homo sapiens
tgcgctgacaaccaccg

SEQ ID NO: 1039068 - DNA, 14 bp, Homo sapiens
tgcgcttatttgga

SEQ ID NO: 1039069 - DNA, 15 bp, Homo sapiens
tgggccgggcctggg

SEQ ID NO: 1039070 - DNA, 14 bp, Homo sapiens
tgggccgtcccctc

SEQ ID NO: 1039071 - DNA, 21 bp, Homo sapiens
tgggccgtcccctctcccctt

SEQ ID NO: 1039072 - DNA, 23 bp, Homo sapiens
tgggccgtcccctctccccttgg

SEQ ID NO: 1039073 - DNA, 18 bp, Homo sapiens
tgggccgtggcacagctg

SEQ ID NO: 1039074 - DNA, 23 bp, Homo sapiens
tgggcctcaaggacttgaaagca

SEQ ID NO: 1039075 - DNA, 17 bp, Homo sapiens
tgggcctcacctgcccc

SEQ ID NO: 1039076 - DNA, 19 bp, Homo sapiens
tgggcctcagtgtgcccat

SEQ ID NO: 1039077 - DNA, 16 bp, Homo sapiens
tgggcctcccctgggc

SEQ ID NO: 1039078 - DNA, 19 bp, Homo sapiens
tgggcctcccctgggcagg

SEQ ID NO: 1039079 - DNA, 20 bp, Homo sapiens
tgggcctcctctgtccaggg

SEQ ID NO: 1039080 - DNA, 24 bp, Homo sapiens
tgggcctccttcccatgcctgtct

SEQ ID NO: 1039081 - DNA, 16 bp, Homo sapiens
tgggcctctcctgccc

SEQ ID NO: 1039082 - DNA, 21 bp, Homo sapiens
tgggcctctcctgccctctgc

SEQ ID NO: 1039083 - DNA, 16 bp, Homo sapiens
tgggcctctctggggg

SEQ ID NO: 1039084 - DNA, 18 bp, Homo sapiens
tgggcctctctgggggag

SEQ ID NO: 1039085 - DNA, 23 bp, Homo sapiens
tgggcctctctgggggaggcagg

SEQ ID NO: 1039086 - DNA, 14 bp, Homo sapiens
tgggcctgcctgcc

SEQ ID NO: 1039087 - DNA, 17 bp, Homo sapiens
tgggcctgcgagaccca

SEQ ID NO: 1039088 - DNA, 22 bp, Homo sapiens
tgggcctgcttttccaggatcc

SEQ ID NO: 1039089 - DNA, 23 bp, Homo sapiens
tgggcctgcttttccaggatcct

SEQ ID NO: 1039090 - DNA, 12 bp, Homo sapiens
tgggcctggagc

SEQ ID NO: 1039091 - DNA, 12 bp, Homo sapiens
tgggcctggcat

SEQ ID NO: 1039092 - DNA, 17 bp, Homo sapiens
tgggcctggcattcttg

SEQ ID NO: 1039093 - DNA, 11 bp, Homo sapiens
tgggcctggcc

SEQ ID NO: 1039094 - DNA, 17 bp, Homo sapiens
tgggcctggcctgagct

SEQ ID NO: 1039095 - DNA, 16 bp, Homo sapiens
tgggcctggcggcctg

SEQ ID NO: 1039096 - DNA, 16 bp, Homo sapiens
tgggcctgggcctgct

SEQ ID NO: 1039097 - DNA, 16 bp, Homo sapiens
tgggcctgtcgtgcca

SEQ ID NO: 1039098 - DNA, 12 bp, Homo sapiens
tgggcctgtgca

SEQ ID NO: 1039099 - DNA, 13 bp, Homo sapiens
tgggcctgtgcac

SEQ ID NO: 1039100 - DNA, 19 bp, Homo sapiens
tgggcctgtgcactgggca

SEQ ID NO: 1039101 - DNA, 22 bp, Homo sapiens
tgggcctgtgcactgggcaggt

SEQ ID NO: 1039102 - DNA, 16 bp, Homo sapiens
tgggcctgtgcagcag

SEQ ID NO: 1039103 - DNA, 17 bp, Homo sapiens
tgggcctgtgcagcagc

SEQ ID NO: 1039104 - DNA, 18 bp, Homo sapiens
tgggcctgtgcagcagcc

SEQ ID NO: 1039105 - DNA, 15 bp, Homo sapiens
tgggcctgtgtgtgg

SEQ ID NO: 1039106 - DNA, 14 bp, Homo sapiens
tgggcctgttcctt

SEQ ID NO: 1039107 - DNA, 18 bp, Homo sapiens
tgggccttagtgggccag

SEQ ID NO: 1039108 - DNA, 14 bp, Homo sapiens
tgggccttgctttg

SEQ ID NO: 1039109 - DNA, 20 bp, Homo sapiens
tgggcgcaaaggtgcctcat

SEQ ID NO: 1039110 - DNA, 14 bp, Homo sapiens
tgggcgcaggccca

SEQ ID NO: 1039111 - DNA, 15 bp, Homo sapiens
tgggcgcaggcccag

SEQ ID NO: 1039112 - DNA, 14 bp, Homo sapiens
tgggcgcagtggct

SEQ ID NO: 1039113 - DNA, 16 bp, Homo sapiens
tgggcgccctggaagc

SEQ ID NO: 1039114 - DNA, 17 bp, Homo sapiens
tgggcgccctggaagcc

SEQ ID NO: 1039115 - DNA, 20 bp, Homo sapiens
tgggcgccctggaagccggc

SEQ ID NO: 1039116 - DNA, 18 bp, Homo sapiens
tgggcgccgtgctgggca

SEQ ID NO: 1039117 - DNA, 15 bp, Homo sapiens
tgggcgctcccgggc

SEQ ID NO: 1039118 - DNA, 16 bp, Homo sapiens
tgggcgctgcttccag

SEQ ID NO: 1039119 - DNA, 20 bp, Homo sapiens
tgggcggacaaaagggccag

SEQ ID NO: 1039120 - DNA, 21 bp, Homo sapiens
tgggcggacaaaagggccagg

SEQ ID NO: 1039121 - DNA, 22 bp, Homo sapiens
tgggcggacaaaagggccaggt

SEQ ID NO: 1039122 - DNA, 18 bp, Homo sapiens
tgggcggctgagagcccc

SEQ ID NO: 1039123 - DNA, 14 bp, Homo sapiens
tgggcggctgtgct

SEQ ID NO: 1039124 - DNA, 14 bp, Homo sapiens
tgggcgtccagctc

SEQ ID NO: 1039125 - DNA, 19 bp, Homo sapiens
tgggcgtccagctcagccc

SEQ ID NO: 1039126 - DNA, 12 bp, Homo sapiens
tgggctaagcag

SEQ ID NO: 1039127 - DNA, 22 bp, Homo sapiens
tgggctaccctaaagggagaag

SEQ ID NO: 1039128 - DNA, 17 bp, Homo sapiens
tgggctactgccactgt

SEQ ID NO: 1039129 - DNA, 18 bp, Homo sapiens
tgggctactgccactgtg

SEQ ID NO: 1039130 - DNA, 22 bp, Homo sapiens
tgggctagtgtgagtggcagcc

SEQ ID NO: 1039131 - DNA, 13 bp, Homo sapiens
tgggctatggaca

SEQ ID NO: 1039132 - DNA, 15 bp, Homo sapiens
tgggctatggacaca

SEQ ID NO: 1039133 - DNA, 19 bp, Homo sapiens
tgggctatggacacagggt

SEQ ID NO: 1039134 - DNA, 15 bp, Homo sapiens
tgggctcaaagccct

SEQ ID NO: 1039135 - DNA, 16 bp, Homo sapiens
tgggctcactgtgctg

SEQ ID NO: 1039136 - DNA, 23 bp, Homo sapiens
tgggctcagcctgagcctctgct

SEQ ID NO: 1039137 - DNA, 14 bp, Homo sapiens
tgggctcagggctg

SEQ ID NO: 1039138 - DNA, 16 bp, Homo sapiens
tgggctcagggctgga

SEQ ID NO: 1039139 - DNA, 20 bp, Homo sapiens
tgggctcagggctggagtgc

SEQ ID NO: 1039140 - DNA, 16 bp, Homo sapiens
tgggctcagggttggc

SEQ ID NO: 1039141 - DNA, 15 bp, Homo sapiens
tgggctccctgactg

SEQ ID NO: 1039142 - DNA, 19 bp, Homo sapiens
tgggctccctgactgggag

SEQ ID NO: 1039143 - DNA, 13 bp, Homo sapiens
tgggctcctccag

SEQ ID NO: 1039144 - DNA, 19 bp, Homo sapiens
tgggctcctggaaccaatc

SEQ ID NO: 1039145 - DNA, 14 bp, Homo sapiens
tgggctcctggctg

SEQ ID NO: 1039146 - DNA, 17 bp, Homo sapiens
tgggctcctggctgcca

SEQ ID NO: 1039147 - DNA, 15 bp, Homo sapiens
tgggctcgcactgcc

SEQ ID NO: 1039148 - DNA, 16 bp, Homo sapiens
tgggctcgcactgccc

SEQ ID NO: 1039149 - DNA, 18 bp, Homo sapiens
tgggctcgcactgcccac

SEQ ID NO: 1039150 - DNA, 17 bp, Homo sapiens
tgggctctacctctctt

SEQ ID NO: 1039151 - DNA, 19 bp, Homo sapiens
tgggctctacctctctttc

SEQ ID NO: 1039152 - DNA, 18 bp, Homo sapiens
tgggctctgccaccctac

SEQ ID NO: 1039153 - DNA, 23 bp, Homo sapiens
tgggctctgccccagctctggct

SEQ ID NO: 1039154 - DNA, 12 bp, Homo sapiens
tgggctctggac

SEQ ID NO: 1039155 - DNA, 21 bp, Homo sapiens
tgggctgaatgtatgtaaata

SEQ ID NO: 1039156 - DNA, 14 bp, Homo sapiens
tgggctgacccagc

SEQ ID NO: 1039157 - DNA, 18 bp, Homo sapiens
tgggctggtattctctct

SEQ ID NO: 1039158 - DNA, 19 bp, Homo sapiens
tgggctggtgccccacagc

SEQ ID NO: 1039159 - DNA, 11 bp, Homo sapiens
tgggctgtcca

SEQ ID NO: 1039160 - DNA, 14 bp, Homo sapiens
tgggctgtctgtca

SEQ ID NO: 1039161 - DNA, 15 bp, Homo sapiens
tgggctgtctgtcac

SEQ ID NO: 1039162 - DNA, 18 bp, Homo sapiens
tgggctgtctgtcaccag

SEQ ID NO: 1039163 - DNA, 12 bp, Homo sapiens
tgggctgtgagt

SEQ ID NO: 1039164 - DNA, 22 bp, Homo sapiens
tgggctgtgtcctaaggcccat

SEQ ID NO: 1039165 - DNA, 18 bp, Homo sapiens
tgggctgtgttgactgct

SEQ ID NO: 1039166 - DNA, 19 bp, Homo sapiens
tgggctgttggcactcaca

SEQ ID NO: 1039167 - DNA, 23 bp, Homo sapiens
tgggctgttggcactcacagacc

SEQ ID NO: 1039168 - DNA, 18 bp, Homo sapiens
tgggcttagtatttctca

SEQ ID NO: 1039169 - DNA, 13 bp, Homo sapiens
tgggcttcatctg

SEQ ID NO: 1039170 - DNA, 18 bp, Homo sapiens
tgggcttcattctggaaa

SEQ ID NO: 1039171 - DNA, 22 bp, Homo sapiens
tgggcttccccaggtggcctgg

SEQ ID NO: 1039172 - DNA, 14 bp, Homo sapiens
tgggcttcctgctg

SEQ ID NO: 1039173 - DNA, 18 bp, Homo sapiens
tgggcttcctgctgggac

SEQ ID NO: 1039174 - DNA, 14 bp, Homo sapiens
tgggcttctgcgtc

SEQ ID NO: 1039175 - DNA, 14 bp, Homo sapiens
tgggcttctgttct

SEQ ID NO: 1039176 - DNA, 21 bp, Homo sapiens
tgggcttctgttctctgctga

SEQ ID NO: 1039177 - DNA, 23 bp, Homo sapiens
tgggcttctgttctctgctgagg

SEQ ID NO: 1039178 - DNA, 22 bp, Homo sapiens
tgggcttgaccaggcttggcct

SEQ ID NO: 1039179 - DNA, 13 bp, Homo sapiens
tgggcttgattct

SEQ ID NO: 1039180 - DNA, 14 bp, Homo sapiens
tgggcttgattctg

SEQ ID NO: 1039181 - DNA, 17 bp, Homo sapiens
tgggcttggacttcctg

SEQ ID NO: 1039182 - DNA, 18 bp, Homo sapiens
tgggcttggcccgcggcc

SEQ ID NO: 1039183 - DNA, 13 bp, Homo sapiens
tgggcttggcctg

SEQ ID NO: 1039184 - DNA, 15 bp, Homo sapiens
tgggcttggcctgct

SEQ ID NO: 1039185 - DNA, 18 bp, Homo sapiens
tgggcttggcctgctgtg

SEQ ID NO: 1039186 - DNA, 19 bp, Homo sapiens
tgggcttggcctggagagg

SEQ ID NO: 1039187 - DNA, 14 bp, Homo sapiens
tgggcttggctctt

SEQ ID NO: 1039188 - DNA, 16 bp, Homo sapiens
tgggcttgtgctcggg

SEQ ID NO: 1039189 - DNA, 17 bp, Homo sapiens
tgggcttgtgctcggga

SEQ ID NO: 1039190 - DNA, 18 bp, Homo sapiens
tgggctttaaaagaaaaa

SEQ ID NO: 1039191 - DNA, 13 bp, Homo sapiens
tgggctttctcct

SEQ ID NO: 1039192 - DNA, 16 bp, Homo sapiens
tgggctttctcctgga

SEQ ID NO: 1039193 - DNA, 18 bp, Homo sapiens
tgggctttgcaggctctg

SEQ ID NO: 1039194 - DNA, 22 bp, Homo sapiens
tgggctttgcaggctctgggct

SEQ ID NO: 1039195 - DNA, 20 bp, Homo sapiens
tgggcttttgttctgagggg

SEQ ID NO: 1039196 - DNA, 22 bp, Homo sapiens
tgggctttttttttctctttct

SEQ ID NO: 1039197 - DNA, 17 bp, Homo sapiens
tggggaaagcagaactg

SEQ ID NO: 1039198 - DNA, 22 bp, Homo sapiens
tggggaaaggggtcggctgacc

SEQ ID NO: 1039199 - DNA, 20 bp, Homo sapiens
tggggaaaggggttggggtg

SEQ ID NO: 1039200 - DNA, 18 bp, Homo sapiens
tggggaaataaagtgcct

SEQ ID NO: 1039201 - DNA, 20 bp, Homo sapiens
tggggaaataaagtgcctta

SEQ ID NO: 1039202 - DNA, 24 bp, Homo sapiens
tggggaagactgtggctgctagca

SEQ ID NO: 1039203 - DNA, 21 bp, Homo sapiens
tggggaagaggatgagcagag

SEQ ID NO: 1039204 - DNA, 21 bp, Homo sapiens
tggggaagaggggctggggca

SEQ ID NO: 1039205 - DNA, 17 bp, Homo sapiens
tggggaagaggttttat

SEQ ID NO: 1039206 - DNA, 20 bp, Homo sapiens
tggggaagaggttttattta

SEQ ID NO: 1039207 - DNA, 23 bp, Homo sapiens
tggggaagaggttttatttacat

SEQ ID NO: 1039208 - DNA, 14 bp, Homo sapiens
tggggaaggaggga

SEQ ID NO: 1039209 - DNA, 17 bp, Homo sapiens
tggggaaggagggactt

SEQ ID NO: 1039210 - DNA, 22 bp, Homo sapiens
tggggaaggagtacaaaacaat

SEQ ID NO: 1039211 - DNA, 14 bp, Homo sapiens
tggggaaggcagag

SEQ ID NO: 1039212 - DNA, 19 bp, Homo sapiens
tggggaaggcagaggctgg

SEQ ID NO: 1039213 - DNA, 20 bp, Homo sapiens
tggggaaggcagaggctggc

SEQ ID NO: 1039214 - DNA, 17 bp, Homo sapiens
tggggaagggtggggag

SEQ ID NO: 1039215 - DNA, 22 bp, Homo sapiens
tggggaagggttttcttttctt

SEQ ID NO: 1039216 - DNA, 16 bp, Homo sapiens
tggggaagtgaggaag

SEQ ID NO: 1039217 - DNA, 18 bp, Homo sapiens
tggggaagtttatttgag

SEQ ID NO: 1039218 - DNA, 16 bp, Homo sapiens
tggggaatgctcccag

SEQ ID NO: 1039219 - DNA, 13 bp, Homo sapiens
tggggacagagcc

SEQ ID NO: 1039220 - DNA, 16 bp, Homo sapiens
tggggacagagccacc

SEQ ID NO: 1039221 - DNA, 18 bp, Homo sapiens
tggggacagagccacccc

SEQ ID NO: 1039222 - DNA, 15 bp, Homo sapiens
tggggacagcttcct

SEQ ID NO: 1039223 - DNA, 22 bp, Homo sapiens
tggggacagcttcctcacaccc

SEQ ID NO: 1039224 - DNA, 13 bp, Homo sapiens
tggggacaggccc

SEQ ID NO: 1039225 - DNA, 21 bp, Homo sapiens
tggggacagtgcgtgatttct

SEQ ID NO: 1039226 - DNA, 17 bp, Homo sapiens
tggggacagttggcaga

SEQ ID NO: 1039227 - DNA, 19 bp, Homo sapiens
tggggacagttggcagaga

SEQ ID NO: 1039228 - DNA, 15 bp, Homo sapiens
tggggacccacccag

SEQ ID NO: 1039229 - DNA, 20 bp, Homo sapiens
tggggacccacccagcccct

SEQ ID NO: 1039230 - DNA, 17 bp, Homo sapiens
tggggacgccaaggagg

SEQ ID NO: 1039231 - DNA, 17 bp, Homo sapiens
tggggacgtgtgtcctt

SEQ ID NO: 1039232 - DNA, 20 bp, Homo sapiens
tggggacgtgtgtcctttgg

SEQ ID NO: 1039233 - DNA, 14 bp, Homo sapiens
tggggactcaggga

SEQ ID NO: 1039234 - DNA, 20 bp, Homo sapiens
tggggactctgccgctgtgt

SEQ ID NO: 1039235 - DNA, 16 bp, Homo sapiens
tggggactctggcaca

SEQ ID NO: 1039236 - DNA, 15 bp, Homo sapiens
tggggagaaagtagt

SEQ ID NO: 1039237 - DNA, 23 bp, Homo sapiens
tggggagaaataaattttgtttc

SEQ ID NO: 1039238 - DNA, 21 bp, Homo sapiens
tggggagacagttgagagcgg

SEQ ID NO: 1039239 - DNA, 15 bp, Homo sapiens
tggggagatgcttct

SEQ ID NO: 1039240 - DNA, 15 bp, Homo sapiens
tggggagatgggggc

SEQ ID NO: 1039241 - DNA, 20 bp, Homo sapiens
tggggagcacttgcgtcctg

SEQ ID NO: 1039242 - DNA, 17 bp, Homo sapiens
tggggagcagagacact

SEQ ID NO: 1039243 - DNA, 19 bp, Homo sapiens
tggggagcagttttcccct

SEQ ID NO: 1039244 - DNA, 16 bp, Homo sapiens
tggggagccaacagaa

SEQ ID NO: 1039245 - DNA, 10 bp, Homo sapiens
tggggagccc

SEQ ID NO: 1039246 - DNA, 18 bp, Homo sapiens
tggggagcccgtctcagt

SEQ ID NO: 1039247 - DNA, 15 bp, Homo sapiens
tggggagccctcagg

SEQ ID NO: 1039248 - DNA, 20 bp, Homo sapiens
tgggtctttaataaaacaac

SEQ ID NO: 1039249 - DNA, 20 bp, Homo sapiens
tgggtctttttctcttctgt

SEQ ID NO: 1039250 - DNA, 15 bp, Homo sapiens
tgggtgaagacagag

SEQ ID NO: 1039251 - DNA, 14 bp, Homo sapiens
tgggtgacagagca

SEQ ID NO: 1039252 - DNA, 19 bp, Homo sapiens
tgggtgactagaacaactt

SEQ ID NO: 1039253 - DNA, 18 bp, Homo sapiens
tgggtgagaatcctgcct

SEQ ID NO: 1039254 - DNA, 13 bp, Homo sapiens
tgggtgagagagg

SEQ ID NO: 1039255 - DNA, 12 bp, Homo sapiens
tgggtgagccag

SEQ ID NO: 1039256 - DNA, 15 bp, Homo sapiens
tgggtgagctcttcc

SEQ ID NO: 1039257 - DNA, 22 bp, Homo sapiens
tgggtgatgcttttgctgctgc

SEQ ID NO: 1039258 - DNA, 19 bp, Homo sapiens
tgggtgccctggctccttg

SEQ ID NO: 1039259 - DNA, 15 bp, Homo sapiens
tgggtgctgccctgt

SEQ ID NO: 1039260 - DNA, 15 bp, Homo sapiens
tgggtgctggaggat

SEQ ID NO: 1039261 - DNA, 18 bp, Homo sapiens
tgggtggaaaacagggtg

SEQ ID NO: 1039262 - DNA, 22 bp, Homo sapiens
tgggtggaggaccgttctctgt

SEQ ID NO: 1039263 - DNA, 22 bp, Homo sapiens
tgggtggcaccagcagcctgga

SEQ ID NO: 1039264 - DNA, 16 bp, Homo sapiens
tgggtggcacctcctg

SEQ ID NO: 1039265 - DNA, 15 bp, Homo sapiens
tgggtggcctcggga

SEQ ID NO: 1039266 - DNA, 23 bp, Homo sapiens
tgggtgggagtgtgtctgctgag

SEQ ID NO: 1039267 - DNA, 15 bp, Homo sapiens
tgggtgggcctgact

SEQ ID NO: 1039268 - DNA, 13 bp, Homo sapiens
tgggtggggacag

SEQ ID NO: 1039269 - DNA, 14 bp, Homo sapiens
tgggtggggacagt

SEQ ID NO: 1039270 - DNA, 22 bp, Homo sapiens
tgggtggggaggccctgcctga

SEQ ID NO: 1039271 - DNA, 13 bp, Homo sapiens
tgggtgggggctg

SEQ ID NO: 1039272 - DNA, 15 bp, Homo sapiens
tgggtggggtgagga

SEQ ID NO: 1039273 - DNA, 16 bp, Homo sapiens
tgggtgggtgggcagg

SEQ ID NO: 1039274 - DNA, 16 bp, Homo sapiens
tgggtgggtgggccct

SEQ ID NO: 1039275 - DNA, 15 bp, Homo sapiens
tgggtgggtggtggg

SEQ ID NO: 1039276 - DNA, 15 bp, Homo sapiens
tgggtggtggatctg

SEQ ID NO: 1039277 - DNA, 14 bp, Homo sapiens
tgggtggtggggag

SEQ ID NO: 1039278 - DNA, 15 bp, Homo sapiens
tgggtgtaaacacat

SEQ ID NO: 1039279 - DNA, 17 bp, Homo sapiens
tgggtgtagatttctga

SEQ ID NO: 1039280 - DNA, 14 bp, Homo sapiens
tgggtgtagccagg

SEQ ID NO: 1039281 - DNA, 22 bp, Homo sapiens
tgggtgtatttattttcctccc

SEQ ID NO: 1039282 - DNA, 19 bp, Homo sapiens
tgggtgtcatttcattcca

SEQ ID NO: 1039283 - DNA, 13 bp, Homo sapiens
tgggtgtcctgcc

SEQ ID NO: 1039284 - DNA, 17 bp, Homo sapiens
tgggtgtcctgcctgtc

SEQ ID NO: 1039285 - DNA, 23 bp, Homo sapiens
tgggtgtcctgcctgtctgcccc

SEQ ID NO: 1039286 - DNA, 14 bp, Homo sapiens
tgggtgtctccctc

SEQ ID NO: 1039287 - DNA, 15 bp, Homo sapiens
tgggtgtctccctcg

SEQ ID NO: 1039288 - DNA, 16 bp, Homo sapiens
tgggtgtgtgcgcctg

SEQ ID NO: 1039289 - DNA, 15 bp, Homo sapiens
tgggtgtgtggcctc

SEQ ID NO: 1039290 - DNA, 18 bp, Homo sapiens
tgggtgtgtgtagccaag

SEQ ID NO: 1039291 - DNA, 15 bp, Homo sapiens
tgggtgttgatctta

SEQ ID NO: 1039292 - DNA, 23 bp, Homo sapiens
tgggttaggtggccgctcctccc

SEQ ID NO: 1039293 - DNA, 24 bp, Homo sapiens
tgggttaggtggccgctcctccct

SEQ ID NO: 1039294 - DNA, 21 bp, Homo sapiens
tgggttatttttattaaatgt

SEQ ID NO: 1039295 - DNA, 20 bp, Homo sapiens
tgggttcagaaatgctgcct

SEQ ID NO: 1039296 - DNA, 20 bp, Homo sapiens
tgggttccctttccttccat

SEQ ID NO: 1039297 - DNA, 20 bp, Homo sapiens
tgggttccgggaggcagaga

SEQ ID NO: 1039298 - DNA, 21 bp, Homo sapiens
tgggttccttcctctgagcct

SEQ ID NO: 1039299 - DNA, 22 bp, Homo sapiens
tgggttccttcctctgagcctt

SEQ ID NO: 1039300 - DNA, 17 bp, Homo sapiens
tgggttcgttggggaca

SEQ ID NO: 1039301 - DNA, 18 bp, Homo sapiens
tgggttcgttggggacat

SEQ ID NO: 1039302 - DNA, 13 bp, Homo sapiens
tgggttctggggc

SEQ ID NO: 1039303 - DNA, 14 bp, Homo sapiens
tgggttctggggca

SEQ ID NO: 1039304 - DNA, 21 bp, Homo sapiens
tgggttctggggcatcagcca

SEQ ID NO: 1039305 - DNA, 16 bp, Homo sapiens
tgggttctttggaagc

SEQ ID NO: 1039306 - DNA, 23 bp, Homo sapiens
tgggttctttggaaggagtgaga

SEQ ID NO: 1039307 - DNA, 14 bp, Homo sapiens
tgggttgactttca

SEQ ID NO: 1039308 - DNA, 16 bp, Homo sapiens
tgggttgagggatgct

SEQ ID NO: 1039309 - DNA, 16 bp, Homo sapiens
tgggttggccaggagg

SEQ ID NO: 1039310 - DNA, 19 bp, Homo sapiens
tgggttggccaggaggttc

SEQ ID NO: 1039311 - DNA, 14 bp, Homo sapiens
tgggttgtttccag

SEQ ID NO: 1039312 - DNA, 19 bp, Homo sapiens
tgggttgtttccaggagaa

SEQ ID NO: 1039313 - DNA, 15 bp, Homo sapiens
tgggtttctaagcag

SEQ ID NO: 1039314 - DNA, 20 bp, Homo sapiens
tgggtttgcccagtcctggg

SEQ ID NO: 1039315 - DNA, 21 bp, Homo sapiens
tgggtttgcccagtcctgggt

SEQ ID NO: 1039316 - DNA, 15 bp, Homo sapiens
tgggtttgctcatgt

SEQ ID NO: 1039317 - DNA, 23 bp, Homo sapiens
tgggtttgctcatgtaatgtggt

SEQ ID NO: 1039318 - DNA, 21 bp, Homo sapiens
tgggtttggaccccagctggg

SEQ ID NO: 1039319 - DNA, 17 bp, Homo sapiens
tgggtttggatctccaa

SEQ ID NO: 1039320 - DNA, 14 bp, Homo sapiens
tgggtttggccagg

SEQ ID NO: 1039321 - DNA, 17 bp, Homo sapiens
tgggtttggccagggag

SEQ ID NO: 1039322 - DNA, 13 bp, Homo sapiens
tgggtttggccca

SEQ ID NO: 1039323 - DNA, 14 bp, Homo sapiens
tgggtttggcccaa

SEQ ID NO: 1039324 - DNA, 20 bp, Homo sapiens
tgggtttggggccatggtgg

SEQ ID NO: 1039325 - DNA, 16 bp, Homo sapiens
tgggtttggttagagg

SEQ ID NO: 1039326 - DNA, 19 bp, Homo sapiens
tgggttttctatttgaaca

SEQ ID NO: 1039327 - DNA, 19 bp, Homo sapiens
tgggttttcttaaccatct

SEQ ID NO: 1039328 - DNA, 14 bp, Homo sapiens
tgggtttttccctg

SEQ ID NO: 1039329 - DNA, 21 bp, Homo sapiens
tgggtttttgtatccagagct

SEQ ID NO: 1039330 - DNA, 17 bp, Homo sapiens
tgggtttttttccttta

SEQ ID NO: 1039331 - DNA, 18 bp, Homo sapiens
tggtaaaaagatccaggg

SEQ ID NO: 1039332 - DNA, 12 bp, Homo sapiens
tggtaaaaatgc

SEQ ID NO: 1039333 - DNA, 21 bp, Homo sapiens
tggtaaacattcctccagcct

SEQ ID NO: 1039334 - DNA, 15 bp, Homo sapiens
tggtaaagccatgtt

SEQ ID NO: 1039335 - DNA, 20 bp, Homo sapiens
tggtaaatactgtgaaatac

SEQ ID NO: 1039336 - DNA, 22 bp, Homo sapiens
tggtaaatttttgaaaaatatt

SEQ ID NO: 1039337 - DNA, 23 bp, Homo sapiens
tggtaaatttttgaaaaatattg

SEQ ID NO: 1039338 - DNA, 18 bp, Homo sapiens
tggtaacaatagttctta

SEQ ID NO: 1039339 - DNA, 17 bp, Homo sapiens
tggtaacagttcatgtt

SEQ ID NO: 1039340 - DNA, 21 bp, Homo sapiens
tggtaacagttcatgtttgct

SEQ ID NO: 1039341 - DNA, 10 bp, Homo sapiens
tggtaacatt

SEQ ID NO: 1039342 - DNA, 22 bp, Homo sapiens
tggtaaccaaatattaaagatt

SEQ ID NO: 1039343 - DNA, 20 bp, Homo sapiens
tggtaactgcacctgggcag

SEQ ID NO: 1039344 - DNA, 14 bp, Homo sapiens
tggtaagagaaaag

SEQ ID NO: 1039345 - DNA, 15 bp, Homo sapiens
tggtaagagacagaa

SEQ ID NO: 1039346 - DNA, 19 bp, Homo sapiens
tggtaagattgttattaaa

SEQ ID NO: 1039347 - DNA, 14 bp, Homo sapiens
tggtaagcaaaact

SEQ ID NO: 1039348 - DNA, 13 bp, Homo sapiens
tggtaagcagagg

SEQ ID NO: 1039349 - DNA, 16 bp, Homo sapiens
tggtaagcgatttgaa

SEQ ID NO: 1039350 - DNA, 13 bp, Homo sapiens
tggtaagctctgg

SEQ ID NO: 1039351 - DNA, 16 bp, Homo sapiens
tggtaatcatatgtgt

SEQ ID NO: 1039352 - DNA, 23 bp, Homo sapiens
tggtaatctttacctgtatacag

SEQ ID NO: 1039353 - DNA, 22 bp, Homo sapiens
tggtaattattttggtactttt

SEQ ID NO: 1039354 - DNA, 19 bp, Homo sapiens
tggtaccttcagccctggc

SEQ ID NO: 1039355 - DNA, 13 bp, Homo sapiens
tggtactctccta

SEQ ID NO: 1039356 - DNA, 23 bp, Homo sapiens
tggtactctggcaaatgatgatg

SEQ ID NO: 1039357 - DNA, 17 bp, Homo sapiens
tggtactgactttgctt

SEQ ID NO: 1039358 - DNA, 22 bp, Homo sapiens
tggtactgctgaggtcccgggc

SEQ ID NO: 1039359 - DNA, 17 bp, Homo sapiens
tggtacttattactgct

SEQ ID NO: 1039360 - DNA, 16 bp, Homo sapiens
tggtactttattcttg

SEQ ID NO: 1039361 - DNA, 21 bp, Homo sapiens
tggtacttttatgatgtatat

SEQ ID NO: 1039362 - DNA, 22 bp, Homo sapiens
tggtacttttatgatgtatatt

SEQ ID NO: 1039363 - DNA, 18 bp, Homo sapiens
tggtacttttgagtgtgt

SEQ ID NO: 1039364 - DNA, 12 bp, Homo sapiens
tggtagaaacaa

SEQ ID NO: 1039365 - DNA, 16 bp, Homo sapiens
tggtagaagccagtac

SEQ ID NO: 1039366 - DNA, 20 bp, Homo sapiens
tggtagaattggagagtaaa

SEQ ID NO: 1039367 - DNA, 17 bp, Homo sapiens
tggtagaccaaaataaa

SEQ ID NO: 1039368 - DNA, 16 bp, Homo sapiens
tggtagagacccccag

SEQ ID NO: 1039369 - DNA, 19 bp, Homo sapiens
tggtagagacccccaggcc

SEQ ID NO: 1039370 - DNA, 12 bp, Homo sapiens
tggtagagagag

SEQ ID NO: 1039371 - DNA, 16 bp, Homo sapiens
tggtagagccctcaga

SEQ ID NO: 1039372 - DNA, 17 bp, Homo sapiens
tggtagatttttttcat

SEQ ID NO: 1039373 - DNA, 17 bp, Homo sapiens
tggtagcagcaggctca

SEQ ID NO: 1039374 - DNA, 15 bp, Homo sapiens
tggtagcataaataa

SEQ ID NO: 1039375 - DNA, 22 bp, Homo sapiens
tggtagcataaataaaactgaa

SEQ ID NO: 1039376 - DNA, 18 bp, Homo sapiens
tggtagcatattcatggt

SEQ ID NO: 1039377 - DNA, 19 bp, Homo sapiens
tggtagcattttaaacaaa

SEQ ID NO: 1039378 - DNA, 20 bp, Homo sapiens
tggtagctgggaaagcataa

SEQ ID NO: 1039379 - DNA, 17 bp, Homo sapiens
tggtagcttttcccttc

SEQ ID NO: 1039380 - DNA, 17 bp, Homo sapiens
tggtaggactgtagaaa

SEQ ID NO: 1039381 - DNA, 18 bp, Homo sapiens
tggtaggactgtagaaaa

SEQ ID NO: 1039382 - DNA, 22 bp, Homo sapiens
tggtaggagttttgttccagag

SEQ ID NO: 1039383 - DNA, 17 bp, Homo sapiens
tggtaggattgctgggg

SEQ ID NO: 1039384 - DNA, 17 bp, Homo sapiens
tggtagggacttaaaaa

SEQ ID NO: 1039385 - DNA, 23 bp, Homo sapiens
tggtagggatatggcaggactcc

SEQ ID NO: 1039386 - DNA, 16 bp, Homo sapiens
tggtaggggagggcag

SEQ ID NO: 1039387 - DNA, 21 bp, Homo sapiens
tggtaggggagggcaggcttg

SEQ ID NO: 1039388 - DNA, 15 bp, Homo sapiens
tggtaggggcaggga

SEQ ID NO: 1039389 - DNA, 19 bp, Homo sapiens
tggtagggggaaaatgtgt

SEQ ID NO: 1039390 - DNA, 19 bp, Homo sapiens
tggtagggtataatgtgtc

SEQ ID NO: 1039391 - DNA, 22 bp, Homo sapiens
tggtagggtataatgtgtctgt

SEQ ID NO: 1039392 - DNA, 21 bp, Homo sapiens
tggtaggttgggacaccaggg

SEQ ID NO: 1039393 - DNA, 16 bp, Homo sapiens
tggtagtaatttcctt

SEQ ID NO: 1039394 - DNA, 22 bp, Homo sapiens
tggtagtaatttcctttattat

SEQ ID NO: 1039395 - DNA, 22 bp, Homo sapiens
tggtagtactcctgcaaaattt

SEQ ID NO: 1039396 - DNA, 17 bp, Homo sapiens
tggtagttagtagcatg

SEQ ID NO: 1039397 - DNA, 18 bp, Homo sapiens
tggtagttagtagcatgt

SEQ ID NO: 1039398 - DNA, 17 bp, Homo sapiens
tggtagttttttcatct

SEQ ID NO: 1039399 - DNA, 16 bp, Homo sapiens
tggtataatgtttaaa

SEQ ID NO: 1039400 - DNA, 22 bp, Homo sapiens
tggtataatgtttaaatcatgt

SEQ ID NO: 1039401 - DNA, 13 bp, Homo sapiens
tggtatagaaatg

SEQ ID NO: 1039402 - DNA, 22 bp, Homo sapiens
tggtatagaaatgctggttttt

SEQ ID NO: 1039403 - DNA, 16 bp, Homo sapiens
tggtatatccaaaagc

SEQ ID NO: 1039404 - DNA, 14 bp, Homo sapiens
tggtatatgtcatt

SEQ ID NO: 1039405 - DNA, 15 bp, Homo sapiens
tggtatatgtcatta

SEQ ID NO: 1039406 - DNA, 14 bp, Homo sapiens
tggtatcaaaatta

SEQ ID NO: 1039407 - DNA, 18 bp, Homo sapiens
tggtatcaaaattacata

SEQ ID NO: 1039408 - DNA, 14 bp, Homo sapiens
tggtatcctactga

SEQ ID NO: 1039409 - DNA, 20 bp, Homo sapiens
tggtatcctactgagcattt

SEQ ID NO: 1039410 - DNA, 16 bp, Homo sapiens
tggtatctcagaaagt

SEQ ID NO: 1039411 - DNA, 20 bp, Homo sapiens
tggtatcttgttagagagct

SEQ ID NO: 1039412 - DNA, 16 bp, Homo sapiens
tggtatgagctgaggg

SEQ ID NO: 1039413 - DNA, 17 bp, Homo sapiens
tggtatgctggccagca

SEQ ID NO: 1039414 - DNA, 18 bp, Homo sapiens
tggtatgctggccagcac

SEQ ID NO: 1039415 - DNA, 13 bp, Homo sapiens
tggtatgtctctt

SEQ ID NO: 1039416 - DNA, 13 bp, Homo sapiens
tggtatgtgccag

SEQ ID NO: 1039417 - DNA, 19 bp, Homo sapiens
tggtatgttgggataagga

SEQ ID NO: 1039418 - DNA, 15 bp, Homo sapiens
tggtattaaatgcca

SEQ ID NO: 1039419 - DNA, 20 bp, Homo sapiens
tggtattacactgtatttgt

SEQ ID NO: 1039420 - DNA, 21 bp, Homo sapiens
tggtattctgttctggaggaa

SEQ ID NO: 1039421 - DNA, 16 bp, Homo sapiens
tggtattgtaaaacat

SEQ ID NO: 1039422 - DNA, 16 bp, Homo sapiens
tggtatttctttctcg

SEQ ID NO: 1039423 - DNA, 18 bp, Homo sapiens
tggtattttaagagaaaa

SEQ ID NO: 1039424 - DNA, 13 bp, Homo sapiens
tggtattttcaat

SEQ ID NO: 1039425 - DNA, 22 bp, Homo sapiens
tggtattttcaatagccactaa

SEQ ID NO: 1039426 - DNA, 17 bp, Homo sapiens
tggtcaaaagctggatt

SEQ ID NO: 1039427 - DNA, 16 bp, Homo sapiens
tggtcaaacaaactct

SEQ ID NO: 1039428 - DNA, 21 bp, Homo sapiens
tggtcaaaccgcactcaccca

SEQ ID NO: 1039429 - DNA, 21 bp, Homo sapiens
tggtcaaactttttccagcaa

SEQ ID NO: 1039430 - DNA, 15 bp, Homo sapiens
tggtcaagttcccaa

SEQ ID NO: 1039431 - DNA, 20 bp, Homo sapiens
tggtcaagttgagattttta

SEQ ID NO: 1039432 - DNA, 23 bp, Homo sapiens
tggtcaatacacataagaccgtg

SEQ ID NO: 1039433 - DNA, 20 bp, Homo sapiens
tggtcacagccatgaagtca

SEQ ID NO: 1039434 - DNA, 23 bp, Homo sapiens
tggtcacaggactctgcctcctc

SEQ ID NO: 1039435 - DNA, 21 bp, Homo sapiens
tggtcaccaaatcagctgcta

SEQ ID NO: 1039436 - DNA, 14 bp, Homo sapiens
tggtcaccaaggca

SEQ ID NO: 1039437 - DNA, 17 bp, Homo sapiens
tggtcaccaaggcagtg

SEQ ID NO: 1039438 - DNA, 22 bp, Homo sapiens
tggtcaccaaggcagtgcatgc

SEQ ID NO: 1039439 - DNA, 15 bp, Homo sapiens
tggtcaccttcgagt

SEQ ID NO: 1039440 - DNA, 16 bp, Homo sapiens
tggtcaccttcgagta

SEQ ID NO: 1039441 - DNA, 14 bp, Homo sapiens
tggtcactctgccc

SEQ ID NO: 1039442 - DNA, 16 bp, Homo sapiens
tggtcactctgccctc

SEQ ID NO: 1039443 - DNA, 17 bp, Homo sapiens
tggtcactctgccctct

SEQ ID NO: 1039444 - DNA, 16 bp, Homo sapiens
tggtcactggtcaggg

SEQ ID NO: 1039445 - DNA, 21 bp, Homo sapiens
tggtcactggtcagggcagtg

SEQ ID NO: 1039446 - DNA, 22 bp, Homo sapiens
tggtcagcagatgccagtgaag

SEQ ID NO: 1039447 - DNA, 15 bp, Homo sapiens
tggtcagccctaggg

SEQ ID NO: 1039448 - DNA, 22 bp, Homo sapiens
tggtcagccctagggtggagag

SEQ ID NO: 1039449 - DNA, 13 bp, Homo sapiens
tggtcagctccct

SEQ ID NO: 1039450 - DNA, 23 bp, Homo sapiens
tggtcaggagggtcaccctggcc

SEQ ID NO: 1039451 - DNA, 12 bp, Homo sapiens
tggtcaggctgg

SEQ ID NO: 1039452 - DNA, 15 bp, Homo sapiens
tggtcaggctggtct

SEQ ID NO: 1039453 - DNA, 15 bp, Homo sapiens
tggtcagggcagtgg

SEQ ID NO: 1039454 - DNA, 18 bp, Homo sapiens
tggtcagtcctcatctct

SEQ ID NO: 1039455 - DNA, 17 bp, Homo sapiens
tggtcagtgtggagagg

SEQ ID NO: 1039456 - DNA, 21 bp, Homo sapiens
tggtcatccttggtgctcttg

SEQ ID NO: 1039457 - DNA, 22 bp, Homo sapiens
tggtcatgtgggtcttccaggg

SEQ ID NO: 1039458 - DNA, 18 bp, Homo sapiens
tggtcattttatgttaag

SEQ ID NO: 1039459 - DNA, 18 bp, Homo sapiens
tggtccaaaaaaaggaaa

SEQ ID NO: 1039460 - DNA, 15 bp, Homo sapiens
tggtccaattagttt

SEQ ID NO: 1039461 - DNA, 19 bp, Homo sapiens
tggtccaattagtttcctt

SEQ ID NO: 1039462 - DNA, 23 bp, Homo sapiens
tggtccaattagtttccttttta

SEQ ID NO: 1039463 - DNA, 12 bp, Homo sapiens
tggtccaccctt

SEQ ID NO: 1039464 - DNA, 18 bp, Homo sapiens
tggtccagctctgacatc

SEQ ID NO: 1039465 - DNA, 17 bp, Homo sapiens
tggttataacttaatga

SEQ ID NO: 1039466 - DNA, 19 bp, Homo sapiens
tggttatgtttttctgtgt

SEQ ID NO: 1039467 - DNA, 17 bp, Homo sapiens
tggttattagcaaggct

SEQ ID NO: 1039468 - DNA, 14 bp, Homo sapiens
tggttattcattat

SEQ ID NO: 1039469 - DNA, 20 bp, Homo sapiens
tggttattcattattcctca

SEQ ID NO: 1039470 - DNA, 13 bp, Homo sapiens
tggttatttctct

SEQ ID NO: 1039471 - DNA, 22 bp, Homo sapiens
tggttattttaaatataaatag

SEQ ID NO: 1039472 - DNA, 20 bp, Homo sapiens
tggttcagaattaaactttt

SEQ ID NO: 1039473 - DNA, 16 bp, Homo sapiens
tggttcagacacagct

SEQ ID NO: 1039474 - DNA, 15 bp, Homo sapiens
tggttcataaatgaa

SEQ ID NO: 1039475 - DNA, 16 bp, Homo sapiens
tggttcatcagtgtta

SEQ ID NO: 1039476 - DNA, 18 bp, Homo sapiens
tggttcatcagtgttaaa

SEQ ID NO: 1039477 - DNA, 16 bp, Homo sapiens
tggttcattaattcta

SEQ ID NO: 1039478 - DNA, 15 bp, Homo sapiens
tggttccatgcctga

SEQ ID NO: 1039479 - DNA, 17 bp, Homo sapiens
tggttccatgcctgagg

SEQ ID NO: 1039480 - DNA, 19 bp, Homo sapiens
tggttccatgcctgagggt

SEQ ID NO: 1039481 - DNA, 20 bp, Homo sapiens
tggttcccaataaaagtgac

SEQ ID NO: 1039482 - DNA, 19 bp, Homo sapiens
tggttcccctgttcactct

SEQ ID NO: 1039483 - DNA, 18 bp, Homo sapiens
tggttcccgtttctccac

SEQ ID NO: 1039484 - DNA, 20 bp, Homo sapiens
tggttcccgtttctccacct

SEQ ID NO: 1039485 - DNA, 11 bp, Homo sapiens
tggttcctaag

SEQ ID NO: 1039486 - DNA, 20 bp, Homo sapiens
tggttcctgtttgaaactaa

SEQ ID NO: 1039487 - DNA, 14 bp, Homo sapiens
tggttccttccctg

SEQ ID NO: 1039488 - DNA, 14 bp, Homo sapiens
tggttctaaaggta

SEQ ID NO: 1039489 - DNA, 15 bp, Homo sapiens
tggttctaatagaac

SEQ ID NO: 1039490 - DNA, 14 bp, Homo sapiens
tggttctataataa

SEQ ID NO: 1039491 - DNA, 16 bp, Homo sapiens
tggttctatttaatgg

SEQ ID NO: 1039492 - DNA, 13 bp, Homo sapiens
tggttctatttta

SEQ ID NO: 1039493 - DNA, 12 bp, Homo sapiens
tggttctcaatg

SEQ ID NO: 1039494 - DNA, 14 bp, Homo sapiens
tggttctcaatgaa

SEQ ID NO: 1039495 - DNA, 16 bp, Homo sapiens
tggttctcaatgaaaa

SEQ ID NO: 1039496 - DNA, 20 bp, Homo sapiens
tggttctcagatcttgacag

SEQ ID NO: 1039497 - DNA, 22 bp, Homo sapiens
tggttctccttcctcagcctcc

SEQ ID NO: 1039498 - DNA, 20 bp, Homo sapiens
tggttctgctgcctctacac

SEQ ID NO: 1039499 - DNA, 12 bp, Homo sapiens
tggttctggcca

SEQ ID NO: 1039500 - DNA, 17 bp, Homo sapiens
tggttctggctgtttga

SEQ ID NO: 1039501 - DNA, 21 bp, Homo sapiens
tggttcttcctttccctggag

SEQ ID NO: 1039502 - DNA, 23 bp, Homo sapiens
tggttcttcctttccctggagct

SEQ ID NO: 1039503 - DNA, 23 bp, Homo sapiens
tggttgacccaaaaatgttccct

SEQ ID NO: 1039504 - DNA, 22 bp, Homo sapiens
tggttgaggtggaagccctcct

SEQ ID NO: 1039505 - DNA, 14 bp, Homo sapiens
tggttgatgccaaa

SEQ ID NO: 1039506 - DNA, 18 bp, Homo sapiens
tggttgatgccaaaaaaa

SEQ ID NO: 1039507 - DNA, 12 bp, Homo sapiens
tggttgatttgt

SEQ ID NO: 1039508 - DNA, 19 bp, Homo sapiens
tggttgatttgtaacacag

SEQ ID NO: 1039509 - DNA, 22 bp, Homo sapiens
tggttgcactttagacattttt

SEQ ID NO: 1039510 - DNA, 20 bp, Homo sapiens
tggttgcctctcttgcccct

SEQ ID NO: 1039511 - DNA, 19 bp, Homo sapiens
tggttgctgttttcctccc

SEQ ID NO: 1039512 - DNA, 17 bp, Homo sapiens
tggttggagagccctgg

SEQ ID NO: 1039513 - DNA, 19 bp, Homo sapiens
tggttggggccctgccctg

SEQ ID NO: 1039514 - DNA, 15 bp, Homo sapiens
tggttgggggaatgc

SEQ ID NO: 1039515 - DNA, 18 bp, Homo sapiens
tggttggtgtgaagaaag

SEQ ID NO: 1039516 - DNA, 18 bp, Homo sapiens
tggttgtaaatgctcgtg

SEQ ID NO: 1039517 - DNA, 14 bp, Homo sapiens
tggttgtatttcta

SEQ ID NO: 1039518 - DNA, 15 bp, Homo sapiens
tggttgtatttctat

SEQ ID NO: 1039519 - DNA, 16 bp, Homo sapiens
tggttgtctagtcatt

SEQ ID NO: 1039520 - DNA, 19 bp, Homo sapiens
tggttgtgaaatgtaacat

SEQ ID NO: 1039521 - DNA, 19 bp, Homo sapiens
tggttgtggtgtagactgt

SEQ ID NO: 1039522 - DNA, 15 bp, Homo sapiens
tggttgtgttgaggt

SEQ ID NO: 1039523 - DNA, 15 bp, Homo sapiens
tggttgttgccaact

SEQ ID NO: 1039524 - DNA, 20 bp, Homo sapiens
tggtttaaaaatacatgttc

SEQ ID NO: 1039525 - DNA, 15 bp, Homo sapiens
tggtttaaaagaaaa

SEQ ID NO: 1039526 - DNA, 18 bp, Homo sapiens
tggtttaaaagaaaaaat

SEQ ID NO: 1039527 - DNA, 22 bp, Homo sapiens
tggtttacaggccctgctcctg

SEQ ID NO: 1039528 - DNA, 14 bp, Homo sapiens
tggtttagtctttt

SEQ ID NO: 1039529 - DNA, 13 bp, Homo sapiens
tggtttatatttt

SEQ ID NO: 1039530 - DNA, 20 bp, Homo sapiens
tggtttatattttttcagtt

SEQ ID NO: 1039531 - DNA, 18 bp, Homo sapiens
tggtttatcagcaaaaaa

SEQ ID NO: 1039532 - DNA, 19 bp, Homo sapiens
tggtttatcagcaaaaaag

SEQ ID NO: 1039533 - DNA, 20 bp, Homo sapiens
tggtttattcccaagtatgc

SEQ ID NO: 1039534 - DNA, 15 bp, Homo sapiens
tggtttcaagaatat

SEQ ID NO: 1039535 - DNA, 14 bp, Homo sapiens
tggtttcaccttcc

SEQ ID NO: 1039536 - DNA, 17 bp, Homo sapiens
tggtttcagatgtgcaa

SEQ ID NO: 1039537 - DNA, 20 bp, Homo sapiens
tggtttcccctgcactcccg

SEQ ID NO: 1039538 - DNA, 17 bp, Homo sapiens
tggtttccctgcccctg

SEQ ID NO: 1039539 - DNA, 19 bp, Homo sapiens
tggtttcctcattcctgaa

SEQ ID NO: 1039540 - DNA, 22 bp, Homo sapiens
tggtttcctccatttgagaaaa

SEQ ID NO: 1039541 - DNA, 13 bp, Homo sapiens
tggtttcctctgg

SEQ ID NO: 1039542 - DNA, 14 bp, Homo sapiens
tggtttcctctgga

SEQ ID NO: 1039543 - DNA, 13 bp, Homo sapiens
tggtttcctttct

SEQ ID NO: 1039544 - DNA, 15 bp, Homo sapiens
tggtttcgaactcct

SEQ ID NO: 1039545 - DNA, 16 bp, Homo sapiens
tggtttctagacttgt

SEQ ID NO: 1039546 - DNA, 14 bp, Homo sapiens
tggtttctgaaaat

SEQ ID NO: 1039547 - DNA, 17 bp, Homo sapiens
tggtttctgaaaatgtt

SEQ ID NO: 1039548 - DNA, 16 bp, Homo sapiens
tggtttgaaagattat

SEQ ID NO: 1039549 - DNA, 22 bp, Homo sapiens
tggtttgcaaagaccacctcca

SEQ ID NO: 1039550 - DNA, 20 bp, Homo sapiens
tggtttggaatattaaaaaa

SEQ ID NO: 1039551 - DNA, 14 bp, Homo sapiens
tggtttggggagaa

SEQ ID NO: 1039552 - DNA, 15 bp, Homo sapiens
tggtttggggagaaa

SEQ ID NO: 1039553 - DNA, 16 bp, Homo sapiens
tggtttggggagaaat

SEQ ID NO: 1039554 - DNA, 22 bp, Homo sapiens
tggtttggtgctttttataaaa

SEQ ID NO: 1039555 - DNA, 13 bp, Homo sapiens
tggtttgtatgag

SEQ ID NO: 1039556 - DNA, 20 bp, Homo sapiens
tggtttgtgtcaaaactggt

SEQ ID NO: 1039557 - DNA, 22 bp, Homo sapiens
tggtttgttagagggtatttgt

SEQ ID NO: 1039558 - DNA, 16 bp, Homo sapiens
tggttttacacagaga

SEQ ID NO: 1039559 - DNA, 14 bp, Homo sapiens
tggttttcaaaata

SEQ ID NO: 1039560 - DNA, 17 bp, Homo sapiens
tggttttcaaaataaaa

SEQ ID NO: 1039561 - DNA, 14 bp, Homo sapiens
tggttttcccctcc

SEQ ID NO: 1039562 - DNA, 13 bp, Homo sapiens
tggttttctgcca

SEQ ID NO: 1039563 - DNA, 18 bp, Homo sapiens
tggttttctgccaatgac

SEQ ID NO: 1039564 - DNA, 21 bp, Homo sapiens
tggttttctgccaatgaccaa

SEQ ID NO: 1039565 - DNA, 19 bp, Homo sapiens
tggttttcttgccaccctc

SEQ ID NO: 1039566 - DNA, 19 bp, Homo sapiens
tggttttgtaagatgctgg

SEQ ID NO: 1039567 - DNA, 13 bp, Homo sapiens
tggttttgtaatt

SEQ ID NO: 1039568 - DNA, 20 bp, Homo sapiens
tggtttttaaattttgtaat

SEQ ID NO: 1039569 - DNA, 20 bp, Homo sapiens
tggtttttactgctctgaga

SEQ ID NO: 1039570 - DNA, 16 bp, Homo sapiens
tggtttttcagctccc

SEQ ID NO: 1039571 - DNA, 23 bp, Homo sapiens
tggttttttttttttttttggct

SEQ ID NO: 1039572 - DNA, 23 bp, Homo sapiens
tgtaaaaaaagcaaaaatgacaa

SEQ ID NO: 1039573 - DNA, 12 bp, Homo sapiens
tgtaaaaaatgg

SEQ ID NO: 1039574 - DNA, 15 bp, Homo sapiens
tgtaaaaaatggaaa

SEQ ID NO: 1039575 - DNA, 18 bp, Homo sapiens
tgtaaaaaatggaaaaaa

SEQ ID NO: 1039576 - DNA, 14 bp, Homo sapiens
tgtaaaaacactga

SEQ ID NO: 1039577 - DNA, 13 bp, Homo sapiens
tgtaaaaactgaa

SEQ ID NO: 1039578 - DNA, 22 bp, Homo sapiens
tgtaaaaactgaagaattttga

SEQ ID NO: 1039579 - DNA, 18 bp, Homo sapiens
tgtaaaaatccttttgaa

SEQ ID NO: 1039580 - DNA, 18 bp, Homo sapiens
tgtaaaacaagaaatgct

SEQ ID NO: 1039581 - DNA, 18 bp, Homo sapiens
tgtaaaacctgtcaatga

SEQ ID NO: 1039582 - DNA, 22 bp, Homo sapiens
tgtaaaacgagaatccacccat

SEQ ID NO: 1039583 - DNA, 18 bp, Homo sapiens
tgtaaaactccattcata

SEQ ID NO: 1039584 - DNA, 12 bp, Homo sapiens
tgtaaaacttta

SEQ ID NO: 1039585 - DNA, 16 bp, Homo sapiens
tgtaaaactttatttt

SEQ ID NO: 1039586 - DNA, 20 bp, Homo sapiens
tgtacttcttattgcaaggc

SEQ ID NO: 1039587 - DNA, 23 bp, Homo sapiens
tgtacttgaagtctaaaagcaga

SEQ ID NO: 1039588 - DNA, 23 bp, Homo sapiens
tgtacttgccctgaccatgcatt

SEQ ID NO: 1039589 - DNA, 22 bp, Homo sapiens
tgtacttgtgtttgcttaaaca

SEQ ID NO: 1039590 - DNA, 21 bp, Homo sapiens
tgtactttatcatgaatgctt

SEQ ID NO: 1039591 - DNA, 17 bp, Homo sapiens
tgtactttatttttgta

SEQ ID NO: 1039592 - DNA, 13 bp, Homo sapiens
tgtactttgccat

SEQ ID NO: 1039593 - DNA, 22 bp, Homo sapiens
tgtactttgccatttttctata

SEQ ID NO: 1039594 - DNA, 23 bp, Homo sapiens
tgtactttgccatttttctataa

SEQ ID NO: 1039595 - DNA, 15 bp, Homo sapiens
tgtactttgcttgct

SEQ ID NO: 1039596 - DNA, 18 bp, Homo sapiens
tgtacttttcattctctt

SEQ ID NO: 1039597 - DNA, 20 bp, Homo sapiens
tgtactttttagtaatttct

SEQ ID NO: 1039598 - DNA, 18 bp, Homo sapiens
tgtactttttagttgttc

SEQ ID NO: 1039599 - DNA, 16 bp, Homo sapiens
tgtagaaaagagactt

SEQ ID NO: 1039600 - DNA, 22 bp, Homo sapiens
tgtagaaaagagacttctctgt

SEQ ID NO: 1039601 - DNA, 20 bp, Homo sapiens
tgtagaaaagggaactgaac

SEQ ID NO: 1039602 - DNA, 23 bp, Homo sapiens
tgtagaaaagggaactgaacatt

SEQ ID NO: 1039603 - DNA, 23 bp, Homo sapiens
tgtagaaacacagttttgaaaga

SEQ ID NO: 1039604 - DNA, 15 bp, Homo sapiens
tgtagaaaggaagcc

SEQ ID NO: 1039605 - DNA, 15 bp, Homo sapiens
tgtagaacactaatt

SEQ ID NO: 1039606 - DNA, 18 bp, Homo sapiens
tgtagaacactaattcat

SEQ ID NO: 1039607 - DNA, 17 bp, Homo sapiens
tgtagaacctaattcaa

SEQ ID NO: 1039608 - DNA, 21 bp, Homo sapiens
tgtagaactcactctgggctg

SEQ ID NO: 1039609 - DNA, 17 bp, Homo sapiens
tgtagaactcagcagtt

SEQ ID NO: 1039610 - DNA, 15 bp, Homo sapiens
tgtagaactttatta

SEQ ID NO: 1039611 - DNA, 13 bp, Homo sapiens
tgtagaagatgga

SEQ ID NO: 1039612 - DNA, 17 bp, Homo sapiens
tgtagaagtctttcaga

SEQ ID NO: 1039613 - DNA, 15 bp, Homo sapiens
tgtagaataaatggt

SEQ ID NO: 1039614 - DNA, 21 bp, Homo sapiens
tgtagaataaatggtttctca

SEQ ID NO: 1039615 - DNA, 16 bp, Homo sapiens
tgtagaataggcaggg

SEQ ID NO: 1039616 - DNA, 22 bp, Homo sapiens
tgtagaatctcttcatgcttga

SEQ ID NO: 1039617 - DNA, 19 bp, Homo sapiens
tgtagacaaagtacattct

SEQ ID NO: 1039618 - DNA, 14 bp, Homo sapiens
tgtagactgtggct

SEQ ID NO: 1039619 - DNA, 17 bp, Homo sapiens
tgtagagacaatacagt

SEQ ID NO: 1039620 - DNA, 20 bp, Homo sapiens
tgtagagagagctgtattaa

SEQ ID NO: 1039621 - DNA, 14 bp, Homo sapiens
tgtagagcttctgg

SEQ ID NO: 1039622 - DNA, 17 bp, Homo sapiens
tgtagagtgtagactgt

SEQ ID NO: 1039623 - DNA, 14 bp, Homo sapiens
tgtagagttgctga

SEQ ID NO: 1039624 - DNA, 15 bp, Homo sapiens
tgtagagttgctgag

SEQ ID NO: 1039625 - DNA, 19 bp, Homo sapiens
tgtagatattgtgaagtac

SEQ ID NO: 1039626 - DNA, 21 bp, Homo sapiens
tgtagatattgttttctgtaa

SEQ ID NO: 1039627 - DNA, 15 bp, Homo sapiens
tgtagatcaggtttg

SEQ ID NO: 1039628 - DNA, 22 bp, Homo sapiens
tgtagatcccaagatgactggg

SEQ ID NO: 1039629 - DNA, 19 bp, Homo sapiens
tgtagatgctaacgtgtca

SEQ ID NO: 1039630 - DNA, 23 bp, Homo sapiens
tgtagatggaaaaacttgtgcta

SEQ ID NO: 1039631 - DNA, 16 bp, Homo sapiens
tgtagatggcgatgtg

SEQ ID NO: 1039632 - DNA, 15 bp, Homo sapiens
tgtagatgttgtctt

SEQ ID NO: 1039633 - DNA, 13 bp, Homo sapiens
tgtagatttctga

SEQ ID NO: 1039634 - DNA, 14 bp, Homo sapiens
tgtagatttctgac

SEQ ID NO: 1039635 - DNA, 15 bp, Homo sapiens
tgtagatttgaaaat

SEQ ID NO: 1039636 - DNA, 16 bp, Homo sapiens
tgtagatttgaaaatt

SEQ ID NO: 1039637 - DNA, 20 bp, Homo sapiens
tgtagcaagatgcaaatgca

SEQ ID NO: 1039638 - DNA, 21 bp, Homo sapiens
tgtagcaataagctggactag

SEQ ID NO: 1039639 - DNA, 11 bp, Homo sapiens
tgtagcaatgg

SEQ ID NO: 1039640 - DNA, 16 bp, Homo sapiens
tgtagcaatggccaga

SEQ ID NO: 1039641 - DNA, 22 bp, Homo sapiens
tgtagcacaatcctattactct

SEQ ID NO: 1039642 - DNA, 19 bp, Homo sapiens
tgtagcactactacagaaa

SEQ ID NO: 1039643 - DNA, 14 bp, Homo sapiens
tgtagcactgaggg

SEQ ID NO: 1039644 - DNA, 21 bp, Homo sapiens
tgtagcacttacgtaaaacat

SEQ ID NO: 1039645 - DNA, 19 bp, Homo sapiens
tgtagcacttactggtagg

SEQ ID NO: 1039646 - DNA, 13 bp, Homo sapiens
tgtagcagtgtgc

SEQ ID NO: 1039647 - DNA, 19 bp, Homo sapiens
tgtagcagtgtgctttgca

SEQ ID NO: 1039648 - DNA, 12 bp, Homo sapiens
tgtagcataact

SEQ ID NO: 1039649 - DNA, 17 bp, Homo sapiens
tgtagcattgttccaca

SEQ ID NO: 1039650 - DNA, 17 bp, Homo sapiens
tgtagcatttcttgatg

SEQ ID NO: 1039651 - DNA, 20 bp, Homo sapiens
tgtagcattttcctgtttac

SEQ ID NO: 1039652 - DNA, 18 bp, Homo sapiens
tgtagccacagctgctgt

SEQ ID NO: 1039653 - DNA, 19 bp, Homo sapiens
tgtagccacagctgctgtt

SEQ ID NO: 1039654 - DNA, 24 bp, Homo sapiens
tgtagccacagctgctgttctcag

SEQ ID NO: 1039655 - DNA, 15 bp, Homo sapiens
tgtagccagctgtgc

SEQ ID NO: 1039656 - DNA, 17 bp, Homo sapiens
tgtagccaggtatggct

SEQ ID NO: 1039657 - DNA, 20 bp, Homo sapiens
tgtagccaggtatggctctg

SEQ ID NO: 1039658 - DNA, 21 bp, Homo sapiens
tgtagccatggctcaggcaag

SEQ ID NO: 1039659 - DNA, 16 bp, Homo sapiens
tgtagcccacacttga

SEQ ID NO: 1039660 - DNA, 16 bp, Homo sapiens
tgtagccccagtgaca

SEQ ID NO: 1039661 - DNA, 17 bp, Homo sapiens
tgtagccccctggcctc

SEQ ID NO: 1039662 - DNA, 15 bp, Homo sapiens
tgtagccctcccact

SEQ ID NO: 1039663 - DNA, 21 bp, Homo sapiens
tgtagccctcccactttgctg

SEQ ID NO: 1039664 - DNA, 15 bp, Homo sapiens
tgtagcctaaagggc

SEQ ID NO: 1039665 - DNA, 15 bp, Homo sapiens
tgtagccttcctcca

SEQ ID NO: 1039666 - DNA, 17 bp, Homo sapiens
tgtagccttgcccggat

SEQ ID NO: 1039667 - DNA, 12 bp, Homo sapiens
tgtagccttttt

SEQ ID NO: 1039668 - DNA, 14 bp, Homo sapiens
tgtagcgaccccag

SEQ ID NO: 1039669 - DNA, 23 bp, Homo sapiens
tgtagcgaccccagactgtagag

SEQ ID NO: 1039670 - DNA, 17 bp, Homo sapiens
tgtagcgtcctgaggaa

SEQ ID NO: 1039671 - DNA, 18 bp, Homo sapiens
tgtagctatagaatgagt

SEQ ID NO: 1039672 - DNA, 22 bp, Homo sapiens
tgtagctcaaataggtcatcat

SEQ ID NO: 1039673 - DNA, 20 bp, Homo sapiens
tgtagctcccctgctgaggc

SEQ ID NO: 1039674 - DNA, 23 bp, Homo sapiens
tgtagctcccgagctactctctt

SEQ ID NO: 1039675 - DNA, 13 bp, Homo sapiens
tgtagctgatgaa

SEQ ID NO: 1039676 - DNA, 21 bp, Homo sapiens
tgtagctgatgaaactcctga

SEQ ID NO: 1039677 - DNA, 17 bp, Homo sapiens
tgtagctgccacattga

SEQ ID NO: 1039678 - DNA, 20 bp, Homo sapiens
tgtagctgtaagggcagtgc

SEQ ID NO: 1039679 - DNA, 18 bp, Homo sapiens
tgtagcttcagtcattaa

SEQ ID NO: 1039680 - DNA, 19 bp, Homo sapiens
tgtagcttcagtcattaaa

SEQ ID NO: 1039681 - DNA, 15 bp, Homo sapiens
tgtagcttccacctc

SEQ ID NO: 1039682 - DNA, 19 bp, Homo sapiens
tgtagcttccacctcatgg

SEQ ID NO: 1039683 - DNA, 12 bp, Homo sapiens
tgtagctttgct

SEQ ID NO: 1039684 - DNA, 15 bp, Homo sapiens
tgtagcttttgggga

SEQ ID NO: 1039685 - DNA, 16 bp, Homo sapiens
tgtagctttttattaa

SEQ ID NO: 1039686 - DNA, 22 bp, Homo sapiens
tgtaggaaccgtggtatgtctg

SEQ ID NO: 1039687 - DNA, 19 bp, Homo sapiens
tgtaggaatcctttgagaa

SEQ ID NO: 1039688 - DNA, 23 bp, Homo sapiens
tgtaggaattcttttggggaagt

SEQ ID NO: 1039689 - DNA, 14 bp, Homo sapiens
tgtaggactgtata

SEQ ID NO: 1039690 - DNA, 13 bp, Homo sapiens
tgtaggagcaagg

SEQ ID NO: 1039691 - DNA, 14 bp, Homo sapiens
tgtaggagcaaggg

SEQ ID NO: 1039692 - DNA, 22 bp, Homo sapiens
tgtaggagcaagggcacaaact

SEQ ID NO: 1039693 - DNA, 20 bp, Homo sapiens
tgtaggataatataaaaagc

SEQ ID NO: 1039694 - DNA, 18 bp, Homo sapiens
tgtaggatcgtaaaaaaa

SEQ ID NO: 1039695 - DNA, 18 bp, Homo sapiens
tgtaggatttttttcctc

SEQ ID NO: 1039696 - DNA, 21 bp, Homo sapiens
tgtaggcacttttattttcat

SEQ ID NO: 1039697 - DNA, 11 bp, Homo sapiens
tgtaggcagac

SEQ ID NO: 1039698 - DNA, 17 bp, Homo sapiens
tgtaggctgctgtggta

SEQ ID NO: 1039699 - DNA, 20 bp, Homo sapiens
tgtaggctgttccctttgcc

SEQ ID NO: 1039700 - DNA, 23 bp, Homo sapiens
tgtaggctgttccctttgcctta

SEQ ID NO: 1039701 - DNA, 21 bp, Homo sapiens
tgtagggaccagtgggatggg

SEQ ID NO: 1039702 - DNA, 22 bp, Homo sapiens
tgtagggagggcggcaggggcc

SEQ ID NO: 1039703 - DNA, 20 bp, Homo sapiens
tgtagggagtgaagccacag

SEQ ID NO: 1039704 - DNA, 23 bp, Homo sapiens
tgtagggcaagggtgcctcagga

SEQ ID NO: 1039705 - DNA, 12 bp, Homo sapiens
tgtagggctgga

SEQ ID NO: 1039706 - DNA, 22 bp, Homo sapiens
tgtagggggccttgcggaagcc

SEQ ID NO: 1039707 - DNA, 16 bp, Homo sapiens
tgtagggttataataa

SEQ ID NO: 1039708 - DNA, 17 bp, Homo sapiens
tgtaggtgagcctgggc

SEQ ID NO: 1039709 - DNA, 18 bp, Homo sapiens
tgtcagcaaaaagcaaaa

SEQ ID NO: 1039710 - DNA, 19 bp, Homo sapiens
tgtcagcaaaaagcaaaat

SEQ ID NO: 1039711 - DNA, 23 bp, Homo sapiens
tgtcagcacacacttacagagca

SEQ ID NO: 1039712 - DNA, 21 bp, Homo sapiens
tgtcagcaggcaggctgggga

SEQ ID NO: 1039713 - DNA, 16 bp, Homo sapiens
tgtcagcagggactgt

SEQ ID NO: 1039714 - DNA, 16 bp, Homo sapiens
tgtcagcatctggctg

SEQ ID NO: 1039715 - DNA, 17 bp, Homo sapiens
tgtcagcatctggctgt

SEQ ID NO: 1039716 - DNA, 21 bp, Homo sapiens
tgtcagcattggcctctgtgt

SEQ ID NO: 1039717 - DNA, 18 bp, Homo sapiens
tgtcagccacctccctct

SEQ ID NO: 1039718 - DNA, 11 bp, Homo sapiens
tgtcagccagc

SEQ ID NO: 1039719 - DNA, 22 bp, Homo sapiens
tgtcagcccctcttcccttcct

SEQ ID NO: 1039720 - DNA, 20 bp, Homo sapiens
tgtcagccgagccgggcctg

SEQ ID NO: 1039721 - DNA, 21 bp, Homo sapiens
tgtcagccgagccgggcctgg

SEQ ID NO: 1039722 - DNA, 23 bp, Homo sapiens
tgtcagccgagccgggcctgggg

SEQ ID NO: 1039723 - DNA, 15 bp, Homo sapiens
tgtcagccgggccct

SEQ ID NO: 1039724 - DNA, 16 bp, Homo sapiens
tgtcagccgggccctg

SEQ ID NO: 1039725 - DNA, 17 bp, Homo sapiens
tgtcagccgggccctga

SEQ ID NO: 1039726 - DNA, 12 bp, Homo sapiens
tgtcagccttgc

SEQ ID NO: 1039727 - DNA, 13 bp, Homo sapiens
tgtcagccttgca

SEQ ID NO: 1039728 - DNA, 23 bp, Homo sapiens
tgtcagcgcaggtttagtttact

SEQ ID NO: 1039729 - DNA, 21 bp, Homo sapiens
tgtcagctactaatgatgttt

SEQ ID NO: 1039730 - DNA, 16 bp, Homo sapiens
tgtcagctgaacctgg

SEQ ID NO: 1039731 - DNA, 14 bp, Homo sapiens
tgtcagctgaggct

SEQ ID NO: 1039732 - DNA, 16 bp, Homo sapiens
tgtcaggaacagaagg

SEQ ID NO: 1039733 - DNA, 18 bp, Homo sapiens
tgtcaggaacagaaggat

SEQ ID NO: 1039734 - DNA, 16 bp, Homo sapiens
tgtcaggccagcctgt

SEQ ID NO: 1039735 - DNA, 17 bp, Homo sapiens
tgtcaggccagcctgtc

SEQ ID NO: 1039736 - DNA, 17 bp, Homo sapiens
tgtcaggccctctgcct

SEQ ID NO: 1039737 - DNA, 14 bp, Homo sapiens
tgtcaggcctgtgt

SEQ ID NO: 1039738 - DNA, 14 bp, Homo sapiens
tgtcagggagggcc

SEQ ID NO: 1039739 - DNA, 18 bp, Homo sapiens
tgtcagggagggccaggg

SEQ ID NO: 1039740 - DNA, 21 bp, Homo sapiens
tgtcagggatgagttgaggtg

SEQ ID NO: 1039741 - DNA, 22 bp, Homo sapiens
tgtcagggccaggtgcagacct

SEQ ID NO: 1039742 - DNA, 15 bp, Homo sapiens
tgtcagggtccagga

SEQ ID NO: 1039743 - DNA, 16 bp, Homo sapiens
tgtcaggtcccagcga

SEQ ID NO: 1039744 - DNA, 15 bp, Homo sapiens
tgtcagtaatttata

SEQ ID NO: 1039745 - DNA, 20 bp, Homo sapiens
tgtcagtaccttcaaactag

SEQ ID NO: 1039746 - DNA, 16 bp, Homo sapiens
tgtcagtcacagccac

SEQ ID NO: 1039747 - DNA, 19 bp, Homo sapiens
tgtcagtctgcttagaaat

SEQ ID NO: 1039748 - DNA, 16 bp, Homo sapiens
tgtcagtctggtttat

SEQ ID NO: 1039749 - DNA, 22 bp, Homo sapiens
tgtcagtgttaaagattttgtt

SEQ ID NO: 1039750 - DNA, 20 bp, Homo sapiens
tgtcagttctctgggaagtg

SEQ ID NO: 1039751 - DNA, 19 bp, Homo sapiens
tgtcagttctgatatggaa

SEQ ID NO: 1039752 - DNA, 23 bp, Homo sapiens
tgtcagttcttggtgctctgtgt

SEQ ID NO: 1039753 - DNA, 13 bp, Homo sapiens
tgtcataaaatgc

SEQ ID NO: 1039754 - DNA, 23 bp, Homo sapiens
tgtcataaaatgcatactgttga

SEQ ID NO: 1039755 - DNA, 15 bp, Homo sapiens
tgtcataaactttct

SEQ ID NO: 1039756 - DNA, 20 bp, Homo sapiens
tgtcataaagtgagaaaact

SEQ ID NO: 1039757 - DNA, 16 bp, Homo sapiens
tgtcataataaagttg

SEQ ID NO: 1039758 - DNA, 23 bp, Homo sapiens
tgtcatagccaaagccaggcctg

SEQ ID NO: 1039759 - DNA, 22 bp, Homo sapiens
tgtcatagggattgtccctgtg

SEQ ID NO: 1039760 - DNA, 16 bp, Homo sapiens
tgtcatatgactgatt

SEQ ID NO: 1039761 - DNA, 19 bp, Homo sapiens
tgtcatatgactgattact

SEQ ID NO: 1039762 - DNA, 19 bp, Homo sapiens
tgtcatcagaagataactt

SEQ ID NO: 1039763 - DNA, 18 bp, Homo sapiens
tgtcatcagccaccatcc

SEQ ID NO: 1039764 - DNA, 18 bp, Homo sapiens
tgtcatcattgtatatat

SEQ ID NO: 1039765 - DNA, 19 bp, Homo sapiens
tgtcatcctcaaagaaagt

SEQ ID NO: 1039766 - DNA, 18 bp, Homo sapiens
tgtcatcgttccccaccc

SEQ ID NO: 1039767 - DNA, 20 bp, Homo sapiens
tgtcatcgttccccacccct

SEQ ID NO: 1039768 - DNA, 22 bp, Homo sapiens
tgtcatctctctggggccctgg

SEQ ID NO: 1039769 - DNA, 23 bp, Homo sapiens
tgtcatctctctggggccctggg

SEQ ID NO: 1039770 - DNA, 19 bp, Homo sapiens
tgtcatgaattcttatgct

SEQ ID NO: 1039771 - DNA, 21 bp, Homo sapiens
tgtcatgaattcttatgctta

SEQ ID NO: 1039772 - DNA, 19 bp, Homo sapiens
tgtcatgacagtgcttgca

SEQ ID NO: 1039773 - DNA, 23 bp, Homo sapiens
tgtcatgcccccctcaaacctcc

SEQ ID NO: 1039774 - DNA, 23 bp, Homo sapiens
tgtcatgcggtttccaaggtgca

SEQ ID NO: 1039775 - DNA, 16 bp, Homo sapiens
tgtcatgctgggattt

SEQ ID NO: 1039776 - DNA, 13 bp, Homo sapiens
tgtcatgctttgg

SEQ ID NO: 1039777 - DNA, 20 bp, Homo sapiens
tgtcatggccttgaaacagt

SEQ ID NO: 1039778 - DNA, 23 bp, Homo sapiens
tgtcatggtgaccaccccctgtt

SEQ ID NO: 1039779 - DNA, 18 bp, Homo sapiens
tgtcatgtggaaactatt

SEQ ID NO: 1039780 - DNA, 23 bp, Homo sapiens
tgtcattatttattgttaaatta

SEQ ID NO: 1039781 - DNA, 23 bp, Homo sapiens
tgtcattatttttgttagcaaag

SEQ ID NO: 1039782 - DNA, 19 bp, Homo sapiens
tgtcattcaagcctgtgaa

SEQ ID NO: 1039783 - DNA, 23 bp, Homo sapiens
tgtcattcaagcctgtgaataaa

SEQ ID NO: 1039784 - DNA, 18 bp, Homo sapiens
tgtcattgctgttgtccc

SEQ ID NO: 1039785 - DNA, 20 bp, Homo sapiens
tgtcattgtccagctgggac

SEQ ID NO: 1039786 - DNA, 21 bp, Homo sapiens
tgtcattgtctactcctagaa

SEQ ID NO: 1039787 - DNA, 16 bp, Homo sapiens
tgtcatttacacacgt

SEQ ID NO: 1039788 - DNA, 16 bp, Homo sapiens
tgtcatttcattccat

SEQ ID NO: 1039789 - DNA, 13 bp, Homo sapiens
tgtcatttgttaa

SEQ ID NO: 1039790 - DNA, 15 bp, Homo sapiens
tgtcattttaaaatc

SEQ ID NO: 1039791 - DNA, 14 bp, Homo sapiens
tgtcatttttaata

SEQ ID NO: 1039792 - DNA, 18 bp, Homo sapiens
tgtccaaaagcgccctca

SEQ ID NO: 1039793 - DNA, 19 bp, Homo sapiens
tgtccaaaagcgccctcac

SEQ ID NO: 1039794 - DNA, 23 bp, Homo sapiens
tgtccaaaccaaccgcacatgca

SEQ ID NO: 1039795 - DNA, 20 bp, Homo sapiens
tgtccaaagaggctgcccct

SEQ ID NO: 1039796 - DNA, 21 bp, Homo sapiens
tgtccaaagaggctgcccctc

SEQ ID NO: 1039797 - DNA, 14 bp, Homo sapiens
tgtccaacaataaa

SEQ ID NO: 1039798 - DNA, 21 bp, Homo sapiens
tgtccaacctaacccctttcc

SEQ ID NO: 1039799 - DNA, 22 bp, Homo sapiens
tgtccaacctaacccctttcct

SEQ ID NO: 1039800 - DNA, 19 bp, Homo sapiens
tgtccaactggccctattt

SEQ ID NO: 1039801 - DNA, 20 bp, Homo sapiens
tgtccaagggccgtgccctt

SEQ ID NO: 1039802 - DNA, 17 bp, Homo sapiens
tgtccaagttcttcacc

SEQ ID NO: 1039803 - DNA, 14 bp, Homo sapiens
tgtccaatcctatg

SEQ ID NO: 1039804 - DNA, 18 bp, Homo sapiens
tgtccacacccagctcag

SEQ ID NO: 1039805 - DNA, 20 bp, Homo sapiens
tgtccacatccccagagccc

SEQ ID NO: 1039806 - DNA, 17 bp, Homo sapiens
tgtccacatctgcctcc

SEQ ID NO: 1039807 - DNA, 19 bp, Homo sapiens
tgtccacatctgcctcctc

SEQ ID NO: 1039808 - DNA, 17 bp, Homo sapiens
tgtccacatgacctcca

SEQ ID NO: 1039809 - DNA, 21 bp, Homo sapiens
tgtccacattctacttcagct

SEQ ID NO: 1039810 - DNA, 14 bp, Homo sapiens
tgtccaccagaccc

SEQ ID NO: 1039811 - DNA, 19 bp, Homo sapiens
tgtccaccatccccagctg

SEQ ID NO: 1039812 - DNA, 11 bp, Homo sapiens
tgtccacctgg

SEQ ID NO: 1039813 - DNA, 15 bp, Homo sapiens
tgtccagaagaatat

SEQ ID NO: 1039814 - DNA, 16 bp, Homo sapiens
tgtccagaagaatatt

SEQ ID NO: 1039815 - DNA, 21 bp, Homo sapiens
tgtccagaagaatattcagga

SEQ ID NO: 1039816 - DNA, 11 bp, Homo sapiens
tgtccagagag

SEQ ID NO: 1039817 - DNA, 14 bp, Homo sapiens
tgtccagcagctgc

SEQ ID NO: 1039818 - DNA, 15 bp, Homo sapiens
tgtccagcagctgcg

SEQ ID NO: 1039819 - DNA, 14 bp, Homo sapiens
tgtccagccacccc

SEQ ID NO: 1039820 - DNA, 11 bp, Homo sapiens
tgtccagcccc

SEQ ID NO: 1039821 - DNA, 14 bp, Homo sapiens
tgtccagcctgggc

SEQ ID NO: 1039822 - DNA, 23 bp, Homo sapiens
tgtccagcctgggcagccaggct

SEQ ID NO: 1039823 - DNA, 17 bp, Homo sapiens
tgtccagccttaataga

SEQ ID NO: 1039824 - DNA, 14 bp, Homo sapiens
tgtccagcgcctag

SEQ ID NO: 1039825 - DNA, 17 bp, Homo sapiens
tgtccagctcccgctgt

SEQ ID NO: 1039826 - DNA, 13 bp, Homo sapiens
tgtccagcttcca

SEQ ID NO: 1039827 - DNA, 18 bp, Homo sapiens
tgtccagcttccaaagcc

SEQ ID NO: 1039828 - DNA, 18 bp, Homo sapiens
tgtccaggaactgcctgg

SEQ ID NO: 1039829 - DNA, 13 bp, Homo sapiens
tgtccaggcagct

SEQ ID NO: 1039830 - DNA, 18 bp, Homo sapiens
tgtccaggccactgtggc

SEQ ID NO: 1039831 - DNA, 19 bp, Homo sapiens
tgtccaggccactgtggcc

SEQ ID NO: 1039832 - DNA, 16 bp, Homo sapiens
tgtccaggctctgggc

SEQ ID NO: 1039833 - DNA, 13 bp, Homo sapiens
tgtccagggccct

SEQ ID NO: 1039834 - DNA, 13 bp, Homo sapiens
tgtccagggtcct

SEQ ID NO: 1039835 - DNA, 16 bp, Homo sapiens
tgtccaggtgagaaca

SEQ ID NO: 1039836 - DNA, 20 bp, Homo sapiens
tgtccaggtgagaacatcca

SEQ ID NO: 1039837 - DNA, 20 bp, Homo sapiens
tgtccagtcatcctgccctg

SEQ ID NO: 1039838 - DNA, 13 bp, Homo sapiens
tgtccatctgacc

SEQ ID NO: 1039839 - DNA, 18 bp, Homo sapiens
tgtccatctgtctgtcct

SEQ ID NO: 1039840 - DNA, 18 bp, Homo sapiens
tgtccatgcgctcagggc

SEQ ID NO: 1039841 - DNA, 13 bp, Homo sapiens
tgtccattgtaaa

SEQ ID NO: 1039842 - DNA, 19 bp, Homo sapiens
tgtccattgtaaatctgaa

SEQ ID NO: 1039843 - DNA, 20 bp, Homo sapiens
tgtccattgtaaatctgaag

SEQ ID NO: 1039844 - DNA, 21 bp, Homo sapiens
tgtccattgtaaatctgaaga

SEQ ID NO: 1039845 - DNA, 23 bp, Homo sapiens
tgtccattgtaaatctgaagaaa

SEQ ID NO: 1039846 - DNA, 17 bp, Homo sapiens
tgtccattgtccaatcc

SEQ ID NO: 1039847 - DNA, 12 bp, Homo sapiens
tgtccatttata

SEQ ID NO: 1039848 - DNA, 15 bp, Homo sapiens
tgtccattttgcaaa

SEQ ID NO: 1039849 - DNA, 16 bp, Homo sapiens
tgtccatttttacaag

SEQ ID NO: 1039850 - DNA, 17 bp, Homo sapiens
tgtcccaaaatcccctc

SEQ ID NO: 1039851 - DNA, 18 bp, Homo sapiens
tgtcccaaaatcccctca

SEQ ID NO: 1039852 - DNA, 21 bp, Homo sapiens
tgtcccaaaatcccctcagcc

SEQ ID NO: 1039853 - DNA, 20 bp, Homo sapiens
tgtcccaagagccataaggg

SEQ ID NO: 1039854 - DNA, 16 bp, Homo sapiens
tgtcccaattaaaata

SEQ ID NO: 1039855 - DNA, 20 bp, Homo sapiens
tgtcccaccaactctgcact

SEQ ID NO: 1039856 - DNA, 23 bp, Homo sapiens
tgtcccaccaactctgcactcca

SEQ ID NO: 1039857 - DNA, 23 bp, Homo sapiens
tgtcccaccatacgagcacctcc

SEQ ID NO: 1039858 - DNA, 17 bp, Homo sapiens
tgtcccacccccacccc

SEQ ID NO: 1039859 - DNA, 22 bp, Homo sapiens
tgtcccacccccacccccagct

SEQ ID NO: 1039860 - DNA, 23 bp, Homo sapiens
tgtcccacccccacccccagctc

SEQ ID NO: 1039861 - DNA, 20 bp, Homo sapiens
tgtcccacccccttccccca

SEQ ID NO: 1039862 - DNA, 18 bp, Homo sapiens
tgtcccaccgggagcctc

SEQ ID NO: 1039863 - DNA, 23 bp, Homo sapiens
tgtcccacctcttctcttcctgt

SEQ ID NO: 1039864 - DNA, 12 bp, Homo sapiens
tgtcccacctgg

SEQ ID NO: 1039865 - DNA, 15 bp, Homo sapiens
tgtcccacctggctc

SEQ ID NO: 1039866 - DNA, 17 bp, Homo sapiens
tgtcccacctggctccc

SEQ ID NO: 1039867 - DNA, 23 bp, Homo sapiens
tgtcccagagcttattggccact

SEQ ID NO: 1039868 - DNA, 24 bp, Homo sapiens
tgtcccagaggttatctgcctggc

SEQ ID NO: 1039869 - DNA, 18 bp, Homo sapiens
tgtcccagccagtgagga

SEQ ID NO: 1039870 - DNA, 22 bp, Homo sapiens
tgtcccagccccggcaagccac

SEQ ID NO: 1039871 - DNA, 16 bp, Homo sapiens
tgtcccagcctggggc

SEQ ID NO: 1039872 - DNA, 19 bp, Homo sapiens
tgtcccaggcatgcagctg

SEQ ID NO: 1039873 - DNA, 20 bp, Homo sapiens
tgtcccaggcatgcagctgc

SEQ ID NO: 1039874 - DNA, 20 bp, Homo sapiens
tgtcccagggccctcccagc

SEQ ID NO: 1039875 - DNA, 18 bp, Homo sapiens
tgtcccagggccctggat

SEQ ID NO: 1039876 - DNA, 14 bp, Homo sapiens
tgtcccaggtcctc

SEQ ID NO: 1039877 - DNA, 17 bp, Homo sapiens
tgtcccaggtcctcact

SEQ ID NO: 1039878 - DNA, 15 bp, Homo sapiens
tgtcccagtcagaaa

SEQ ID NO: 1039879 - DNA, 15 bp, Homo sapiens
tgtcccatctgccct

SEQ ID NO: 1039880 - DNA, 16 bp, Homo sapiens
tgtcccatgacccacc

SEQ ID NO: 1039881 - DNA, 17 bp, Homo sapiens
tgtcccatgacccaccc

SEQ ID NO: 1039882 - DNA, 20 bp, Homo sapiens
tgtcccatgacccacccctg

SEQ ID NO: 1039883 - DNA, 16 bp, Homo sapiens
tgtcccatgatccctg

SEQ ID NO: 1039884 - DNA, 19 bp, Homo sapiens
tgtcccatggacactccag

SEQ ID NO: 1039885 - DNA, 14 bp, Homo sapiens
tgtcccatggggaa

SEQ ID NO: 1039886 - DNA, 14 bp, Homo sapiens
tgtcccattccctg

SEQ ID NO: 1039887 - DNA, 18 bp, Homo sapiens
tgtcccattccctgggat

SEQ ID NO: 1039888 - DNA, 16 bp, Homo sapiens
tgtcccattctagatc

SEQ ID NO: 1039889 - DNA, 20 bp, Homo sapiens
tgtcccattttccccttcct

SEQ ID NO: 1039890 - DNA, 12 bp, Homo sapiens
tgtccccaaagt

SEQ ID NO: 1039891 - DNA, 21 bp, Homo sapiens
tgtccccaaagtaccacactg

SEQ ID NO: 1039892 - DNA, 22 bp, Homo sapiens
tgtccccaacgtcccctccgcc

SEQ ID NO: 1039893 - DNA, 13 bp, Homo sapiens
tgtccccactccc

SEQ ID NO: 1039894 - DNA, 14 bp, Homo sapiens
tgtccccactcccg

SEQ ID NO: 1039895 - DNA, 12 bp, Homo sapiens
tgtccccagacc

SEQ ID NO: 1039896 - DNA, 21 bp, Homo sapiens
tgtccccagaccaaccctggg

SEQ ID NO: 1039897 - DNA, 15 bp, Homo sapiens
tgtccccaggcccag

SEQ ID NO: 1039898 - DNA, 12 bp, Homo sapiens
tgtccccagggc

SEQ ID NO: 1039899 - DNA, 17 bp, Homo sapiens
tgtccccagggcccctc

SEQ ID NO: 1039900 - DNA, 13 bp, Homo sapiens
tgtccccaggtcc

SEQ ID NO: 1039901 - DNA, 14 bp, Homo sapiens
tgtccccaggtcct

SEQ ID NO: 1039902 - DNA, 17 bp, Homo sapiens
tgtccccagtccccagc

SEQ ID NO: 1039903 - DNA, 19 bp, Homo sapiens
tgtccccagtccccagccc

SEQ ID NO: 1039904 - DNA, 20 bp, Homo sapiens
tgtccccagtccccagccct

SEQ ID NO: 1039905 - DNA, 13 bp, Homo sapiens
tgtcccccaactt

SEQ ID NO: 1039906 - DNA, 14 bp, Homo sapiens
tgtcccccaacttg

SEQ ID NO: 1039907 - DNA, 14 bp, Homo sapiens
tgtcccccaggctg

SEQ ID NO: 1039908 - DNA, 21 bp, Homo sapiens
tgtccccccttgaagcaataa

SEQ ID NO: 1039909 - DNA, 23 bp, Homo sapiens
tgtccccccttgaagcaataact

SEQ ID NO: 1039910 - DNA, 19 bp, Homo sapiens
tgtccccgccttccctcac

SEQ ID NO: 1039911 - DNA, 22 bp, Homo sapiens
tgtccccgccttccctcactct

SEQ ID NO: 1039912 - DNA, 15 bp, Homo sapiens
tgtccccgctggctc

SEQ ID NO: 1039913 - DNA, 14 bp, Homo sapiens
tgtcccctatcctc

SEQ ID NO: 1039914 - DNA, 13 bp, Homo sapiens
tgtcccctctccc

SEQ ID NO: 1039915 - DNA, 13 bp, Homo sapiens
tgtcccctctgtc

SEQ ID NO: 1039916 - DNA, 14 bp, Homo sapiens
tgtcccctcttgac

SEQ ID NO: 1039917 - DNA, 15 bp, Homo sapiens
tgtcccctgacaggg

SEQ ID NO: 1039918 - DNA, 16 bp, Homo sapiens
tgtcccctgacagggc

SEQ ID NO: 1039919 - DNA, 18 bp, Homo sapiens
tgtcccctgacctgtcca

SEQ ID NO: 1039920 - DNA, 14 bp, Homo sapiens
tgtcccctgcgggc

SEQ ID NO: 1039921 - DNA, 13 bp, Homo sapiens
tgtcccctgggtc

SEQ ID NO: 1039922 - DNA, 14 bp, Homo sapiens
tgtccccttcccct

SEQ ID NO: 1039923 - DNA, 15 bp, Homo sapiens
tgtccccttcccctg

SEQ ID NO: 1039924 - DNA, 17 bp, Homo sapiens
tgtccccttcccctgct

SEQ ID NO: 1039925 - DNA, 17 bp, Homo sapiens
tgtcccggtaccttcca

SEQ ID NO: 1039926 - DNA, 21 bp, Homo sapiens
tgtccctaccgagtctcttct

SEQ ID NO: 1039927 - DNA, 22 bp, Homo sapiens
tgtccctaccgagtctcttctc

SEQ ID NO: 1039928 - DNA, 22 bp, Homo sapiens
tgtccctatacactagacaaaa

SEQ ID NO: 1039929 - DNA, 21 bp, Homo sapiens
tgtccctatctattaaagtga

SEQ ID NO: 1039930 - DNA, 17 bp, Homo sapiens
tgtccctatgcatatca

SEQ ID NO: 1039931 - DNA, 16 bp, Homo sapiens
tgtccctccaacacag

SEQ ID NO: 1039932 - DNA, 13 bp, Homo sapiens
tgtccctctaaag

SEQ ID NO: 1039933 - DNA, 16 bp, Homo sapiens
tgtccctctagtgcct

SEQ ID NO: 1039934 - DNA, 16 bp, Homo sapiens
tgtccctctgcctttt

SEQ ID NO: 1039935 - DNA, 15 bp, Homo sapiens
tgtccctgaaaccta

SEQ ID NO: 1039936 - DNA, 18 bp, Homo sapiens
tgtccctgcactgtgccc

SEQ ID NO: 1039937 - DNA, 20 bp, Homo sapiens
tgtccctgccaatgctccag

SEQ ID NO: 1039938 - DNA, 22 bp, Homo sapiens
tgtccctgccaatgctccagct

SEQ ID NO: 1039939 - DNA, 12 bp, Homo sapiens
tgtccctgcccc

SEQ ID NO: 1039940 - DNA, 23 bp, Homo sapiens
tgtccctgccccgccccccagag

SEQ ID NO: 1039941 - DNA, 12 bp, Homo sapiens
tgtccctggatg

SEQ ID NO: 1039942 - DNA, 20 bp, Homo sapiens
tgtccctgggccagggtctg

SEQ ID NO: 1039943 - DNA, 18 bp, Homo sapiens
tgtccctgtccccaggcc

SEQ ID NO: 1039944 - DNA, 13 bp, Homo sapiens
tgtccctgtccct

SEQ ID NO: 1039945 - DNA, 16 bp, Homo sapiens
tgtccctgtccctgcc

SEQ ID NO: 1039946 - DNA, 17 bp, Homo sapiens
tgtccctgtccttccct

SEQ ID NO: 1039947 - DNA, 16 bp, Homo sapiens
tgtccctgtccttcta

SEQ ID NO: 1039948 - DNA, 12 bp, Homo sapiens
tgtccctgtgtt

SEQ ID NO: 1039949 - DNA, 23 bp, Homo sapiens
tgtccctgtgttgtcccatctgc

SEQ ID NO: 1039950 - DNA, 18 bp, Homo sapiens
tgtccctgtttcaaactg

SEQ ID NO: 1039951 - DNA, 16 bp, Homo sapiens
tgtcccttccccttca

SEQ ID NO: 1039952 - DNA, 19 bp, Homo sapiens
tgtcccttcctttctcccc

SEQ ID NO: 1039953 - DNA, 17 bp, Homo sapiens
tgtccctttcttggcca

SEQ ID NO: 1039954 - DNA, 21 bp, Homo sapiens
tgtcccttttgcataagatta

SEQ ID NO: 1039955 - DNA, 22 bp, Homo sapiens
tgtccgacctacgttcctggcc

SEQ ID NO: 1039956 - DNA, 17 bp, Homo sapiens
tgtccgccatccagggt

SEQ ID NO: 1039957 - DNA, 20 bp, Homo sapiens
tgtccgccatccagggtctg

SEQ ID NO: 1039958 - DNA, 23 bp, Homo sapiens
tgtccggaccgccgatcccaggt

SEQ ID NO: 1039959 - DNA, 18 bp, Homo sapiens
tgtccggcccagtgccac

SEQ ID NO: 1039960 - DNA, 22 bp, Homo sapiens
tgtcctaaatgcaaagcacacc

SEQ ID NO: 1039961 - DNA, 14 bp, Homo sapiens
tgtcctaattcttc

SEQ ID NO: 1039962 - DNA, 20 bp, Homo sapiens
tgtcctaccagttgccctag

SEQ ID NO: 1039963 - DNA, 21 bp, Homo sapiens
tgtcctacccgcccgcgtcca

SEQ ID NO: 1039964 - DNA, 17 bp, Homo sapiens
tgtcctacttctgactt

SEQ ID NO: 1039965 - DNA, 19 bp, Homo sapiens
tgtcctatctatcttccaa

SEQ ID NO: 1039966 - DNA, 20 bp, Homo sapiens
tgtcctatctccagcggccc

SEQ ID NO: 1039967 - DNA, 21 bp, Homo sapiens
tgtcctatgtcaatttgtata

SEQ ID NO: 1039968 - DNA, 15 bp, Homo sapiens
tgtcctcaaataagt

SEQ ID NO: 1039969 - DNA, 13 bp, Homo sapiens
tgtcctcaccctg

SEQ ID NO: 1039970 - DNA, 20 bp, Homo sapiens
tgtcctcaccctgtgggacc

SEQ ID NO: 1039971 - DNA, 14 bp, Homo sapiens
tgtcctcacgcccc

SEQ ID NO: 1039972 - DNA, 22 bp, Homo sapiens
tgtcctcacggtgccttttttc

SEQ ID NO: 1039973 - DNA, 18 bp, Homo sapiens
tgtcctcagagcaggggc

SEQ ID NO: 1039974 - DNA, 19 bp, Homo sapiens
tgtcctcagggagcaggga

SEQ ID NO: 1039975 - DNA, 23 bp, Homo sapiens
tgtcctccaacaccaagcacagc

SEQ ID NO: 1039976 - DNA, 17 bp, Homo sapiens
tgtcctccaagccagcg

SEQ ID NO: 1039977 - DNA, 17 bp, Homo sapiens
tgtcctccagaagcctc

SEQ ID NO: 1039978 - DNA, 20 bp, Homo sapiens
tgtcctccagaagcctctgg

SEQ ID NO: 1039979 - DNA, 22 bp, Homo sapiens
tgtcctccagaagcctctggct

SEQ ID NO: 1039980 - DNA, 23 bp, Homo sapiens
tgtcctccagaagcctctggcta

SEQ ID NO: 1039981 - DNA, 21 bp, Homo sapiens
tgtcctcccacagacctgcag

SEQ ID NO: 1039982 - DNA, 22 bp, Homo sapiens
tgtcctcccatcccctggactg

SEQ ID NO: 1039983 - DNA, 21 bp, Homo sapiens
tgtcctccgccttaccaggag

SEQ ID NO: 1039984 - DNA, 11 bp, Homo sapiens
tgtcctcctcg

SEQ ID NO: 1039985 - DNA, 13 bp, Homo sapiens
tgtcctcctctga

SEQ ID NO: 1039986 - DNA, 16 bp, Homo sapiens
tgtcctcctctgagga

SEQ ID NO: 1039987 - DNA, 14 bp, Homo sapiens
tgtcctcctggaag

SEQ ID NO: 1039988 - DNA, 15 bp, Homo sapiens
tgtcctccttcctgg

SEQ ID NO: 1039989 - DNA, 19 bp, Homo sapiens
tgtcctccttcctgggacc

SEQ ID NO: 1039990 - DNA, 14 bp, Homo sapiens
tgtcctccttttca

SEQ ID NO: 1039991 - DNA, 16 bp, Homo sapiens
tgtcctccttttcact

SEQ ID NO: 1039992 - DNA, 16 bp, Homo sapiens
tgtcctctcccccttc

SEQ ID NO: 1039993 - DNA, 24 bp, Homo sapiens
tgtcctctcccccttcagctcctg

SEQ ID NO: 1039994 - DNA, 13 bp, Homo sapiens
tgtcctctcgagc

SEQ ID NO: 1039995 - DNA, 20 bp, Homo sapiens
tgtcctctcgagcccagatg

SEQ ID NO: 1039996 - DNA, 16 bp, Homo sapiens
tgtcctctgcctgggc

SEQ ID NO: 1039997 - DNA, 13 bp, Homo sapiens
tgtcctctgtagt

SEQ ID NO: 1039998 - DNA, 16 bp, Homo sapiens
tgtcctcttccctctc

SEQ ID NO: 1039999 - DNA, 19 bp, Homo sapiens
tgtcctcttctgcatcttg

SEQ ID NO: 1040000 - DNA, 15 bp, Homo sapiens
tgtcctcttgctcaa

SEQ ID NO: 1040001 - DNA, 20 bp, Homo sapiens
tgtcctgaaacatgaaccca

SEQ ID NO: 1040002 - DNA, 15 bp, Homo sapiens
tgtcctgaagcccag

SEQ ID NO: 1040003 - DNA, 15 bp, Homo sapiens
tgtcctgaccaccct

SEQ ID NO: 1040004 - DNA, 17 bp, Homo sapiens
tgtcctgaccaccctcc

SEQ ID NO: 1040005 - DNA, 23 bp, Homo sapiens
tgtcctgaccaccctcccctctc

SEQ ID NO: 1040006 - DNA, 18 bp, Homo sapiens
tgtcctgatgcttttgtc

SEQ ID NO: 1040007 - DNA, 19 bp, Homo sapiens
tgtcctgatggtcagctcc

SEQ ID NO: 1040008 - DNA, 21 bp, Homo sapiens
tgtcctgatggtcagctccct

SEQ ID NO: 1040009 - DNA, 15 bp, Homo sapiens
tgtcctgatttctac

SEQ ID NO: 1040010 - DNA, 15 bp, Homo sapiens
tgtcctgatttctta

SEQ ID NO: 1040011 - DNA, 16 bp, Homo sapiens
tgtcctgcagtgctca

SEQ ID NO: 1040012 - DNA, 13 bp, Homo sapiens
tgtcctgccagct

SEQ ID NO: 1040013 - DNA, 16 bp, Homo sapiens
tgtcctgccagctgcc

SEQ ID NO: 1040014 - DNA, 11 bp, Homo sapiens
tgtcctgccca

SEQ ID NO: 1040015 - DNA, 17 bp, Homo sapiens
tgtcctgcctcctcatc

SEQ ID NO: 1040016 - DNA, 14 bp, Homo sapiens
tgtcctgcctgtct

SEQ ID NO: 1040017 - DNA, 16 bp, Homo sapiens
tgtcctgcctgtctgc

SEQ ID NO: 1040018 - DNA, 17 bp, Homo sapiens
tgtcctgcctgtctgcc

SEQ ID NO: 1040019 - DNA, 19 bp, Homo sapiens
tgtcctgcctgtctgcccc

SEQ ID NO: 1040020 - DNA, 18 bp, Homo sapiens
tgtcctgcgttcagcccc

SEQ ID NO: 1040021 - DNA, 20 bp, Homo sapiens
tgtcctgcgttcagcccctg

SEQ ID NO: 1040022 - DNA, 17 bp, Homo sapiens
tgtcctgctctcttcag

SEQ ID NO: 1040023 - DNA, 12 bp, Homo sapiens
tgtcctggccct

SEQ ID NO: 1040024 - DNA, 18 bp, Homo sapiens
tgtcctggcccttcagtc

SEQ ID NO: 1040025 - DNA, 20 bp, Homo sapiens
tgtcctggcccttcagtctg

SEQ ID NO: 1040026 - DNA, 21 bp, Homo sapiens
tgtcctggcccttcagtctgc

SEQ ID NO: 1040027 - DNA, 17 bp, Homo sapiens
tgtcctgggcgccctgg

SEQ ID NO: 1040028 - DNA, 19 bp, Homo sapiens
tgtcctgggttctggggca

SEQ ID NO: 1040029 - DNA, 20 bp, Homo sapiens
tgtcctggtgctctctgcca

SEQ ID NO: 1040030 - DNA, 13 bp, Homo sapiens
tgtcctggtggta

SEQ ID NO: 1040031 - DNA, 19 bp, Homo sapiens
tgtcctggtggtattttca

SEQ ID NO: 1040032 - DNA, 22 bp, Homo sapiens
tgtcctgtaaaggttacaagcc

SEQ ID NO: 1040033 - DNA, 11 bp, Homo sapiens
tgtcctgtcct

SEQ ID NO: 1040034 - DNA, 13 bp, Homo sapiens
tgtcctgtcctgc

SEQ ID NO: 1040035 - DNA, 18 bp, Homo sapiens
tgtcctgtcctttcttgc

SEQ ID NO: 1040036 - DNA, 15 bp, Homo sapiens
tgtcctgtgagatgt

SEQ ID NO: 1040037 - DNA, 12 bp, Homo sapiens
tgtcctgtgtct

SEQ ID NO: 1040038 - DNA, 18 bp, Homo sapiens
tgtccttagaacatttta

SEQ ID NO: 1040039 - DNA, 15 bp, Homo sapiens
tgtccttagtgtata

SEQ ID NO: 1040040 - DNA, 20 bp, Homo sapiens
tgtccttagtgtataaaaac

SEQ ID NO: 1040041 - DNA, 16 bp, Homo sapiens
tgtccttcagagctct

SEQ ID NO: 1040042 - DNA, 12 bp, Homo sapiens
tgtccttcccct

SEQ ID NO: 1040043 - DNA, 12 bp, Homo sapiens
tgtccttccctg

SEQ ID NO: 1040044 - DNA, 16 bp, Homo sapiens
tgtccttccctgcatt

SEQ ID NO: 1040045 - DNA, 18 bp, Homo sapiens
tgtccttgaactgaggcc

SEQ ID NO: 1040046 - DNA, 13 bp, Homo sapiens
tgtccttgcacct

SEQ ID NO: 1040047 - DNA, 20 bp, Homo sapiens
tgtccttgccccactcctct

SEQ ID NO: 1040048 - DNA, 13 bp, Homo sapiens
tgtcctttccctt

SEQ ID NO: 1040049 - DNA, 14 bp, Homo sapiens
tgtcctttcccttc

SEQ ID NO: 1040050 - DNA, 21 bp, Homo sapiens
tgtcctttggtactatggtgt

SEQ ID NO: 1040051 - DNA, 20 bp, Homo sapiens
tgtccttttatttctccatc

SEQ ID NO: 1040052 - DNA, 22 bp, Homo sapiens
tgtccttttcataggtctgaaa

SEQ ID NO: 1040053 - DNA, 21 bp, Homo sapiens
tgtccttttcccctacagaat

SEQ ID NO: 1040054 - DNA, 20 bp, Homo sapiens
tgtcctttttatctgatctg

SEQ ID NO: 1040055 - DNA, 16 bp, Homo sapiens
tgtcctttttgttatt

SEQ ID NO: 1040056 - DNA, 15 bp, Homo sapiens
tgtcgacatgttttt

SEQ ID NO: 1040057 - DNA, 12 bp, Homo sapiens
tgtcgcacaatg

SEQ ID NO: 1040058 - DNA, 16 bp, Homo sapiens
tgtcgcccacccagct

SEQ ID NO: 1040059 - DNA, 22 bp, Homo sapiens
tgtcgcccacccagctggtcct

SEQ ID NO: 1040060 - DNA, 17 bp, Homo sapiens
tgtcgccccaggccctc

SEQ ID NO: 1040061 - DNA, 19 bp, Homo sapiens
tgtcgccccaggccctccc

SEQ ID NO: 1040062 - DNA, 13 bp, Homo sapiens
tgtcgcccttctc

SEQ ID NO: 1040063 - DNA, 15 bp, Homo sapiens
tgtcgcccttctccc

SEQ ID NO: 1040064 - DNA, 13 bp, Homo sapiens
tgtcgcctctgca

SEQ ID NO: 1040065 - DNA, 14 bp, Homo sapiens
tgtcgcctctgcat

SEQ ID NO: 1040066 - DNA, 18 bp, Homo sapiens
tgtcgctcaggctggagt

SEQ ID NO: 1040067 - DNA, 22 bp, Homo sapiens
tgtcgctcatgtgtgcaacagg

SEQ ID NO: 1040068 - DNA, 21 bp, Homo sapiens
tgtcgctgggtcagtgctgga

SEQ ID NO: 1040069 - DNA, 16 bp, Homo sapiens
tgtcggatcctgtgag

SEQ ID NO: 1040070 - DNA, 19 bp, Homo sapiens
tgtcgggcaccagccagcg

SEQ ID NO: 1040071 - DNA, 21 bp, Homo sapiens
tgtcgggcccttcttgctgcc

SEQ ID NO: 1040072 - DNA, 19 bp, Homo sapiens
tgtcggggttggggtggga

SEQ ID NO: 1040073 - DNA, 17 bp, Homo sapiens
tgtcggtggctgccttt

SEQ ID NO: 1040074 - DNA, 14 bp, Homo sapiens
tgtcgtgttttcaa

SEQ ID NO: 1040075 - DNA, 23 bp, Homo sapiens
tgtcgttaaaaagttgtttgttt

SEQ ID NO: 1040076 - DNA, 21 bp, Homo sapiens
tgtcgttttgacactgcctag

SEQ ID NO: 1040077 - DNA, 14 bp, Homo sapiens
tgtctaaaatgtca

SEQ ID NO: 1040078 - DNA, 16 bp, Homo sapiens
tgtctaaacaatgctg

SEQ ID NO: 1040079 - DNA, 20 bp, Homo sapiens
tgtctaaacaatgctgattt

SEQ ID NO: 1040080 - DNA, 22 bp, Homo sapiens
tgtctaaacaatgctgatttgg

SEQ ID NO: 1040081 - DNA, 13 bp, Homo sapiens
tgtctaaactgca

SEQ ID NO: 1040082 - DNA, 13 bp, Homo sapiens
tgtctaaagcctt

SEQ ID NO: 1040083 - DNA, 21 bp, Homo sapiens
tgtctaaagccttaactaaga

SEQ ID NO: 1040084 - DNA, 23 bp, Homo sapiens
tgtctaaagccttaactaagact

SEQ ID NO: 1040085 - DNA, 12 bp, Homo sapiens
tgtctaaagtgt

SEQ ID NO: 1040086 - DNA, 19 bp, Homo sapiens
tgtctaaagtgtattttca

SEQ ID NO: 1040087 - DNA, 13 bp, Homo sapiens
tgtctaattaaaa

SEQ ID NO: 1040088 - DNA, 14 bp, Homo sapiens
tgtctacagaaaat

SEQ ID NO: 1040089 - DNA, 15 bp, Homo sapiens
tgtctacagaaaatg

SEQ ID NO: 1040090 - DNA, 20 bp, Homo sapiens
tgtctacagaaaatgctggc

SEQ ID NO: 1040091 - DNA, 20 bp, Homo sapiens
tgtctacatatgatctgtct

SEQ ID NO: 1040092 - DNA, 18 bp, Homo sapiens
tgtctactcagcatttga

SEQ ID NO: 1040093 - DNA, 19 bp, Homo sapiens
tgtctactcagcatttgat

SEQ ID NO: 1040094 - DNA, 12 bp, Homo sapiens
tgtctactgtgg

SEQ ID NO: 1040095 - DNA, 13 bp, Homo sapiens
tgtctagaatgtg

SEQ ID NO: 1040096 - DNA, 14 bp, Homo sapiens
tgtctagacatatt

SEQ ID NO: 1040097 - DNA, 15 bp, Homo sapiens
tgtctagccactccc

SEQ ID NO: 1040098 - DNA, 18 bp, Homo sapiens
tgtctagccactccctcc

SEQ ID NO: 1040099 - DNA, 19 bp, Homo sapiens
tgtctaggcaggacctgtg

SEQ ID NO: 1040100 - DNA, 19 bp, Homo sapiens
tgtctaggtctcctcaggg

SEQ ID NO: 1040101 - DNA, 20 bp, Homo sapiens
tgtctaggtctcctcagggt

SEQ ID NO: 1040102 - DNA, 18 bp, Homo sapiens
tgtctaggttaaagctaa

SEQ ID NO: 1040103 - DNA, 17 bp, Homo sapiens
tgtctagtcattgtcat

SEQ ID NO: 1040104 - DNA, 16 bp, Homo sapiens
tgtctagtttctagtg

SEQ ID NO: 1040105 - DNA, 15 bp, Homo sapiens
tgtctataaaagaaa

SEQ ID NO: 1040106 - DNA, 12 bp, Homo sapiens
tgtctataaagc

SEQ ID NO: 1040107 - DNA, 21 bp, Homo sapiens
tgtctataatggaaacattta

SEQ ID NO: 1040108 - DNA, 12 bp, Homo sapiens
tgtctatgaagt

SEQ ID NO: 1040109 - DNA, 20 bp, Homo sapiens
tgtctatgaagttgctgttt

SEQ ID NO: 1040110 - DNA, 22 bp, Homo sapiens
tgtctatgaagttgctgtttat

SEQ ID NO: 1040111 - DNA, 14 bp, Homo sapiens
tgtctattcagctt

SEQ ID NO: 1040112 - DNA, 14 bp, Homo sapiens
tgtctattctgagc

SEQ ID NO: 1040113 - DNA, 17 bp, Homo sapiens
tgtctattctgagcctt

SEQ ID NO: 1040114 - DNA, 19 bp, Homo sapiens
tgtctattctgagccttga

SEQ ID NO: 1040115 - DNA, 12 bp, Homo sapiens
tgtctattgtcc

SEQ ID NO: 1040116 - DNA, 16 bp, Homo sapiens
tgtctattttaaaata

SEQ ID NO: 1040117 - DNA, 18 bp, Homo sapiens
tgtctcaagagggcactg

SEQ ID NO: 1040118 - DNA, 19 bp, Homo sapiens
tgtctcactgttctgcaaa

SEQ ID NO: 1040119 - DNA, 14 bp, Homo sapiens
tgtctcacttttta

SEQ ID NO: 1040120 - DNA, 15 bp, Homo sapiens
tgtctcagagccttc

SEQ ID NO: 1040121 - DNA, 13 bp, Homo sapiens
tgtctcagcctct

SEQ ID NO: 1040122 - DNA, 17 bp, Homo sapiens
tgtctcatccatcatca

SEQ ID NO: 1040123 - DNA, 15 bp, Homo sapiens
tgtctcatcctcctg

SEQ ID NO: 1040124 - DNA, 19 bp, Homo sapiens
tgtctcattttggtctgtt

SEQ ID NO: 1040125 - DNA, 20 bp, Homo sapiens
tgtctcattttggtctgttt

SEQ ID NO: 1040126 - DNA, 19 bp, Homo sapiens
tgtctccacttgtatatat

SEQ ID NO: 1040127 - DNA, 11 bp, Homo sapiens
tgtctccagac

SEQ ID NO: 1040128 - DNA, 14 bp, Homo sapiens
tgtctccagacccc

SEQ ID NO: 1040129 - DNA, 19 bp, Homo sapiens
tgtctccagacccccaccc

SEQ ID NO: 1040130 - DNA, 11 bp, Homo sapiens
tgtctccagct

SEQ ID NO: 1040131 - DNA, 20 bp, Homo sapiens
tgtctccagctgcctgggcc

SEQ ID NO: 1040132 - DNA, 23 bp, Homo sapiens
tgtctccatgaggtactggtccc

SEQ ID NO: 1040133 - DNA, 13 bp, Homo sapiens
tgtctccatgctg

SEQ ID NO: 1040134 - DNA, 10 bp, Homo sapiens
tgtctcccaa

SEQ ID NO: 1040135 - DNA, 17 bp, Homo sapiens
tgtctcccaacatggga

SEQ ID NO: 1040136 - DNA, 12 bp, Homo sapiens
tgtctcccacac

SEQ ID NO: 1040137 - DNA, 15 bp, Homo sapiens
tgtctcccacttccc

SEQ ID NO: 1040138 - DNA, 14 bp, Homo sapiens
tgtctcccaggctg

SEQ ID NO: 1040139 - DNA, 17 bp, Homo sapiens
tgtctccctcccctctc

SEQ ID NO: 1040140 - DNA, 17 bp, Homo sapiens
tgtctccctggttgcct

SEQ ID NO: 1040141 - DNA, 18 bp, Homo sapiens
tgtctcctatatatttct

SEQ ID NO: 1040142 - DNA, 12 bp, Homo sapiens
tgtctcctatcc

SEQ ID NO: 1040143 - DNA, 17 bp, Homo sapiens
tgtctcctccctgggct

SEQ ID NO: 1040144 - DNA, 17 bp, Homo sapiens
tgtctccttggttatat

SEQ ID NO: 1040145 - DNA, 15 bp, Homo sapiens
tgtctcgaactattt

SEQ ID NO: 1040146 - DNA, 14 bp, Homo sapiens
tgtctcgatgcctg

SEQ ID NO: 1040147 - DNA, 18 bp, Homo sapiens
tgtctcgtggtaggactg

SEQ ID NO: 1040148 - DNA, 20 bp, Homo sapiens
tgtctcgtggtaggactgta

SEQ ID NO: 1040149 - DNA, 15 bp, Homo sapiens
tgtctctaaccattc

SEQ ID NO: 1040150 - DNA, 21 bp, Homo sapiens
tgtctctagtagtgtggcctg

SEQ ID NO: 1040151 - DNA, 18 bp, Homo sapiens
tgtctctcctagcccctc

SEQ ID NO: 1040152 - DNA, 19 bp, Homo sapiens
tgtctctcctagcccctct

SEQ ID NO: 1040153 - DNA, 20 bp, Homo sapiens
tgtctctcctagcccctctc

SEQ ID NO: 1040154 - DNA, 22 bp, Homo sapiens
tgtctctctccatgttggcctg

SEQ ID NO: 1040155 - DNA, 18 bp, Homo sapiens
tgtctctcttctcagagt

SEQ ID NO: 1040156 - DNA, 20 bp, Homo sapiens
tgtctctcttctcagagtgg

SEQ ID NO: 1040157 - DNA, 14 bp, Homo sapiens
tgtctctgatgcag

SEQ ID NO: 1040158 - DNA, 13 bp, Homo sapiens
tgtctctgcctcc

SEQ ID NO: 1040159 - DNA, 11 bp, Homo sapiens
tgtctctgctt

SEQ ID NO: 1040160 - DNA, 14 bp, Homo sapiens
tgtctctgcttcca

SEQ ID NO: 1040161 - DNA, 15 bp, Homo sapiens
tgtctctgctttcct

SEQ ID NO: 1040162 - DNA, 19 bp, Homo sapiens
tgtctctggcgtgtgggta

SEQ ID NO: 1040163 - DNA, 16 bp, Homo sapiens
tgtctctgggccactt

SEQ ID NO: 1040164 - DNA, 15 bp, Homo sapiens
tgtctctgggctgag

SEQ ID NO: 1040165 - DNA, 11 bp, Homo sapiens
tgtctctgggg

SEQ ID NO: 1040166 - DNA, 12 bp, Homo sapiens
tgtctctggggc

SEQ ID NO: 1040167 - DNA, 14 bp, Homo sapiens
tgtctctgtactgt

SEQ ID NO: 1040168 - DNA, 21 bp, Homo sapiens
tgtctctgttggtccactgtg

SEQ ID NO: 1040169 - DNA, 15 bp, Homo sapiens
tgtctctgtttcctg

SEQ ID NO: 1040170 - DNA, 16 bp, Homo sapiens
tgtctctgtttcctga

SEQ ID NO: 1040171 - DNA, 20 bp, Homo sapiens
tgtctcttaaaaaaataaaa

SEQ ID NO: 1040172 - DNA, 16 bp, Homo sapiens
tgtctcttcctctgtt

SEQ ID NO: 1040173 - DNA, 20 bp, Homo sapiens
tgtctcttcctctgttctat

SEQ ID NO: 1040174 - DNA, 16 bp, Homo sapiens
tgtctcttctgagcta

SEQ ID NO: 1040175 - DNA, 15 bp, Homo sapiens
tgtctcttctgagga

SEQ ID NO: 1040176 - DNA, 13 bp, Homo sapiens
tgtctcttgagca

SEQ ID NO: 1040177 - DNA, 21 bp, Homo sapiens
tgtctcttgagcatcaatctt

SEQ ID NO: 1040178 - DNA, 17 bp, Homo sapiens
tgtctcttgagtttgtc

SEQ ID NO: 1040179 - DNA, 18 bp, Homo sapiens
tgtctctttccactttgt

SEQ ID NO: 1040180 - DNA, 14 bp, Homo sapiens
tgtctcttttctct

SEQ ID NO: 1040181 - DNA, 12 bp, Homo sapiens
tgtctgaaaaat

SEQ ID NO: 1040182 - DNA, 12 bp, Homo sapiens
tgtctgaacaaa

SEQ ID NO: 1040183 - DNA, 18 bp, Homo sapiens
tgtctgaacttgcattgt

SEQ ID NO: 1040184 - DNA, 18 bp, Homo sapiens
tgtctgaaggacacttcc

SEQ ID NO: 1040185 - DNA, 23 bp, Homo sapiens
tgtctgaaggacacttcctgcct

SEQ ID NO: 1040186 - DNA, 16 bp, Homo sapiens
tgtctgaagtcactgc

SEQ ID NO: 1040187 - DNA, 15 bp, Homo sapiens
tgtcttgtacttctg

SEQ ID NO: 1040188 - DNA, 18 bp, Homo sapiens
tgtcttgtacttctgtgt

SEQ ID NO: 1040189 - DNA, 15 bp, Homo sapiens
tgtcttgtgtttctt

SEQ ID NO: 1040190 - DNA, 14 bp, Homo sapiens
tgtctttaaaaact

SEQ ID NO: 1040191 - DNA, 14 bp, Homo sapiens
tgtctttaaataga

SEQ ID NO: 1040192 - DNA, 14 bp, Homo sapiens
tgtctttaaggaaa

SEQ ID NO: 1040193 - DNA, 15 bp, Homo sapiens
tgtctttagatagcc

SEQ ID NO: 1040194 - DNA, 18 bp, Homo sapiens
tgtctttatagatgtaca

SEQ ID NO: 1040195 - DNA, 22 bp, Homo sapiens
tgtctttcctgaaccatgtgga

SEQ ID NO: 1040196 - DNA, 16 bp, Homo sapiens
tgtctttctaagaaat

SEQ ID NO: 1040197 - DNA, 13 bp, Homo sapiens
tgtctttctagcc

SEQ ID NO: 1040198 - DNA, 15 bp, Homo sapiens
tgtctttctgagcac

SEQ ID NO: 1040199 - DNA, 19 bp, Homo sapiens
tgtctttgcagggcacaga

SEQ ID NO: 1040200 - DNA, 13 bp, Homo sapiens
tgtctttgtggac

SEQ ID NO: 1040201 - DNA, 20 bp, Homo sapiens
tgtctttgtggactgtgggt

SEQ ID NO: 1040202 - DNA, 15 bp, Homo sapiens
tgtcttttaaactgg

SEQ ID NO: 1040203 - DNA, 14 bp, Homo sapiens
tgtcttttaatgct

SEQ ID NO: 1040204 - DNA, 20 bp, Homo sapiens
tgtcttttaatgcttcattc

SEQ ID NO: 1040205 - DNA, 20 bp, Homo sapiens
tgtcttttcccatttatcta

SEQ ID NO: 1040206 - DNA, 12 bp, Homo sapiens
tgtctttttcat

SEQ ID NO: 1040207 - DNA, 22 bp, Homo sapiens
tgtctttttcatttttttctct

SEQ ID NO: 1040208 - DNA, 17 bp, Homo sapiens
tgtctttttctggactg

SEQ ID NO: 1040209 - DNA, 13 bp, Homo sapiens
tgtgaaaaatctg

SEQ ID NO: 1040210 - DNA, 14 bp, Homo sapiens
tgtgaaaaattaac

SEQ ID NO: 1040211 - DNA, 15 bp, Homo sapiens
tgtgaaaaattaact

SEQ ID NO: 1040212 - DNA, 17 bp, Homo sapiens
tgtgaaaagaaaaatga

SEQ ID NO: 1040213 - DNA, 18 bp, Homo sapiens
tgtgaaaagcttaataaa

SEQ ID NO: 1040214 - DNA, 20 bp, Homo sapiens
tgtgaaacaatgttgtccaa

SEQ ID NO: 1040215 - DNA, 23 bp, Homo sapiens
tgtgaaacaatgttgtccaacaa

SEQ ID NO: 1040216 - DNA, 20 bp, Homo sapiens
tgtgaaaggaagctccactg

SEQ ID NO: 1040217 - DNA, 20 bp, Homo sapiens
tgtgaaaggtaggaaactta

SEQ ID NO: 1040218 - DNA, 22 bp, Homo sapiens
tgtgaaagtcagatgcccagag

SEQ ID NO: 1040219 - DNA, 20 bp, Homo sapiens
tgtgaaataaaactggcttt

SEQ ID NO: 1040220 - DNA, 20 bp, Homo sapiens
tgtgaaataatttttaactt

SEQ ID NO: 1040221 - DNA, 23 bp, Homo sapiens
tgtgaaatcagtatcagaatact

SEQ ID NO: 1040222 - DNA, 18 bp, Homo sapiens
tgtgaaatctcagaattt

SEQ ID NO: 1040223 - DNA, 14 bp, Homo sapiens
tgtgaaatgctggc

SEQ ID NO: 1040224 - DNA, 22 bp, Homo sapiens
tgtgaaatgcttttatattcta

SEQ ID NO: 1040225 - DNA, 17 bp, Homo sapiens
tgtgaaatgtaacatga

SEQ ID NO: 1040226 - DNA, 18 bp, Homo sapiens
tgtgaaatgtaacatgaa

SEQ ID NO: 1040227 - DNA, 15 bp, Homo sapiens
tgtgaacagagagac

SEQ ID NO: 1040228 - DNA, 14 bp, Homo sapiens
tgtgaaccaatgca

SEQ ID NO: 1040229 - DNA, 18 bp, Homo sapiens
tgtgaaccctggggcctg

SEQ ID NO: 1040230 - DNA, 20 bp, Homo sapiens
tgtgaaccctggggcctgac

SEQ ID NO: 1040231 - DNA, 23 bp, Homo sapiens
tgtgaaccctggggcctgactgc

SEQ ID NO: 1040232 - DNA, 17 bp, Homo sapiens
tgtgaaccgaggggctc

SEQ ID NO: 1040233 - DNA, 14 bp, Homo sapiens
tgtgaacgctgtga

SEQ ID NO: 1040234 - DNA, 16 bp, Homo sapiens
tgtgaacgctgtgatg

SEQ ID NO: 1040235 - DNA, 17 bp, Homo sapiens
tgtgaacgctgtgatgc

SEQ ID NO: 1040236 - DNA, 17 bp, Homo sapiens
tgtgaactccatcattc

SEQ ID NO: 1040237 - DNA, 18 bp, Homo sapiens
tgtgaactgctttcaagt

SEQ ID NO: 1040238 - DNA, 15 bp, Homo sapiens
tgtgaagacattttt

SEQ ID NO: 1040239 - DNA, 19 bp, Homo sapiens
tgtgaagacattttttgct

SEQ ID NO: 1040240 - DNA, 21 bp, Homo sapiens
tgtgaagacattttttgctat

SEQ ID NO: 1040241 - DNA, 16 bp, Homo sapiens
tgtgaagaggaacagt

SEQ ID NO: 1040242 - DNA, 20 bp, Homo sapiens
tgtgaagcaaactctaaaat

SEQ ID NO: 1040243 - DNA, 15 bp, Homo sapiens
tgtgaagcatgcttt

SEQ ID NO: 1040244 - DNA, 19 bp, Homo sapiens
tgtgaagcatgctttgctg

SEQ ID NO: 1040245 - DNA, 23 bp, Homo sapiens
tgtgaagccatgagttccagaaa

SEQ ID NO: 1040246 - DNA, 17 bp, Homo sapiens
tgtgaagctcacactga

SEQ ID NO: 1040247 - DNA, 22 bp, Homo sapiens
tgtgaagttacacaattaattg

SEQ ID NO: 1040248 - DNA, 17 bp, Homo sapiens
tgtgaataataaataca

SEQ ID NO: 1040249 - DNA, 11 bp, Homo sapiens
tgtgaatacaa

SEQ ID NO: 1040250 - DNA, 18 bp, Homo sapiens
tgtgaatagcctggccac

SEQ ID NO: 1040251 - DNA, 18 bp, Homo sapiens
tgtgaatataaatgtgtg

SEQ ID NO: 1040252 - DNA, 14 bp, Homo sapiens
tgtgaatattcctt

SEQ ID NO: 1040253 - DNA, 23 bp, Homo sapiens
tgtgaatattcctttattttgct

SEQ ID NO: 1040254 - DNA, 21 bp, Homo sapiens
tgtgaatatttccatatggat

SEQ ID NO: 1040255 - DNA, 19 bp, Homo sapiens
tgtgaatctgaactgctct

SEQ ID NO: 1040256 - DNA, 14 bp, Homo sapiens
tgtgaatgaacact

SEQ ID NO: 1040257 - DNA, 22 bp, Homo sapiens
tgtgaatgattcatgttatatt

SEQ ID NO: 1040258 - DNA, 12 bp, Homo sapiens
tgtgaatgtagc

SEQ ID NO: 1040259 - DNA, 12 bp, Homo sapiens
tgtgaatgtggg

SEQ ID NO: 1040260 - DNA, 17 bp, Homo sapiens
tgtgaattattgacact

SEQ ID NO: 1040261 - DNA, 13 bp, Homo sapiens
tgtgaattcagat

SEQ ID NO: 1040262 - DNA, 14 bp, Homo sapiens
tgtgaattcagatt

SEQ ID NO: 1040263 - DNA, 14 bp, Homo sapiens
tgtgaattccttaa

SEQ ID NO: 1040264 - DNA, 18 bp, Homo sapiens
tgtgaatttgcaacagta

SEQ ID NO: 1040265 - DNA, 14 bp, Homo sapiens
tgtgaatttttaag

SEQ ID NO: 1040266 - DNA, 17 bp, Homo sapiens
tgtgaatttttaagctg

SEQ ID NO: 1040267 - DNA, 22 bp, Homo sapiens
tgtgaatttttaagctgcaaat

SEQ ID NO: 1040268 - DNA, 20 bp, Homo sapiens
tgtgaatttttgcctatctt

SEQ ID NO: 1040269 - DNA, 14 bp, Homo sapiens
tgtgacaaccctgg

SEQ ID NO: 1040270 - DNA, 15 bp, Homo sapiens
tgtgacaattctgtt

SEQ ID NO: 1040271 - DNA, 19 bp, Homo sapiens
tgtgacaattctgttttta

SEQ ID NO: 1040272 - DNA, 21 bp, Homo sapiens
tgtgacaattctgtttttaat

SEQ ID NO: 1040273 - DNA, 20 bp, Homo sapiens
tgtgacagaatcttgtattt

SEQ ID NO: 1040274 - DNA, 21 bp, Homo sapiens
tgtgacagcgatggcaggcct

SEQ ID NO: 1040275 - DNA, 23 bp, Homo sapiens
tgtgacaggaaagccctccccct

SEQ ID NO: 1040276 - DNA, 14 bp, Homo sapiens
tgtgacagtgcctc

SEQ ID NO: 1040277 - DNA, 16 bp, Homo sapiens
tgtgacagtttccaaa

SEQ ID NO: 1040278 - DNA, 12 bp, Homo sapiens
tgtgacatgccc

SEQ ID NO: 1040279 - DNA, 16 bp, Homo sapiens
tgtgacatggtgcctg

SEQ ID NO: 1040280 - DNA, 17 bp, Homo sapiens
tgtgacatggtgcctga

SEQ ID NO: 1040281 - DNA, 20 bp, Homo sapiens
tgtgacatggtgcctgagag

SEQ ID NO: 1040282 - DNA, 14 bp, Homo sapiens
tgtgacatgtaaca

SEQ ID NO: 1040283 - DNA, 13 bp, Homo sapiens
tgtgacattcctt

SEQ ID NO: 1040284 - DNA, 23 bp, Homo sapiens
tgtgacattgctggtcatccttg

SEQ ID NO: 1040285 - DNA, 22 bp, Homo sapiens
tgtgacatttggagagggggcc

SEQ ID NO: 1040286 - DNA, 18 bp, Homo sapiens
tgtgacattttacattaa

SEQ ID NO: 1040287 - DNA, 16 bp, Homo sapiens
tgtgacatttttccgg

SEQ ID NO: 1040288 - DNA, 19 bp, Homo sapiens
tgtgaccaactgtgttgta

SEQ ID NO: 1040289 - DNA, 22 bp, Homo sapiens
tgtgaccaactgtgttgtatta

SEQ ID NO: 1040290 - DNA, 14 bp, Homo sapiens
tgtgaccaactgtt

SEQ ID NO: 1040291 - DNA, 13 bp, Homo sapiens
tgtgaccaagtta

SEQ ID NO: 1040292 - DNA, 19 bp, Homo sapiens
tgtgaccacatacgtgtta

SEQ ID NO: 1040293 - DNA, 19 bp, Homo sapiens
tgtgaccagtctgaccctt

SEQ ID NO: 1040294 - DNA, 14 bp, Homo sapiens
tgtgaccatgttca

SEQ ID NO: 1040295 - DNA, 14 bp, Homo sapiens
tgtgaccattctgc

SEQ ID NO: 1040296 - DNA, 21 bp, Homo sapiens
tgtgacccagatcctcacaac

SEQ ID NO: 1040297 - DNA, 18 bp, Homo sapiens
tgtgacccgtgaatgtgc

SEQ ID NO: 1040298 - DNA, 20 bp, Homo sapiens
tgtgacccgtgaatgtgcct

SEQ ID NO: 1040299 - DNA, 13 bp, Homo sapiens
tgtgaccctccaa

SEQ ID NO: 1040300 - DNA, 17 bp, Homo sapiens
tgtgaccctccaaatgg

SEQ ID NO: 1040301 - DNA, 22 bp, Homo sapiens
tgtgaccctgggcaagtcactt

SEQ ID NO: 1040302 - DNA, 15 bp, Homo sapiens
tgtgacgcagacaga

SEQ ID NO: 1040303 - DNA, 21 bp, Homo sapiens
tgtgactaggcatacactgta

SEQ ID NO: 1040304 - DNA, 18 bp, Homo sapiens
tgtgactatatagagatg

SEQ ID NO: 1040305 - DNA, 20 bp, Homo sapiens
tgtgactatatagagatgtt

SEQ ID NO: 1040306 - DNA, 15 bp, Homo sapiens
tgtgactcagcagag

SEQ ID NO: 1040307 - DNA, 19 bp, Homo sapiens
tgtgactcgggagctgcac

SEQ ID NO: 1040308 - DNA, 12 bp, Homo sapiens
tgtgactctctt

SEQ ID NO: 1040309 - DNA, 14 bp, Homo sapiens
tgtgatatataagt

SEQ ID NO: 1040310 - DNA, 16 bp, Homo sapiens
tgtgatattctgttgc

SEQ ID NO: 1040311 - DNA, 19 bp, Homo sapiens
tgtgatcagcattgtgact

SEQ ID NO: 1040312 - DNA, 20 bp, Homo sapiens
tgtgatcagcattgtgactt

SEQ ID NO: 1040313 - DNA, 20 bp, Homo sapiens
tgtgatcaggctatgtatgg

SEQ ID NO: 1040314 - DNA, 15 bp, Homo sapiens
tgtgatccagccctg

SEQ ID NO: 1040315 - DNA, 22 bp, Homo sapiens
tgtgatccggtttctttttgct

SEQ ID NO: 1040316 - DNA, 15 bp, Homo sapiens
tgtgatgaactttct

SEQ ID NO: 1040317 - DNA, 14 bp, Homo sapiens
tgtgatgaatcaat

SEQ ID NO: 1040318 - DNA, 14 bp, Homo sapiens
tgtgatgagctgat

SEQ ID NO: 1040319 - DNA, 14 bp, Homo sapiens
tgtgatgaggggag

SEQ ID NO: 1040320 - DNA, 18 bp, Homo sapiens
tgtgatgatgctgtgaca

SEQ ID NO: 1040321 - DNA, 15 bp, Homo sapiens
tgtgatgccacacag

SEQ ID NO: 1040322 - DNA, 16 bp, Homo sapiens
tgtgatgtaaggcact

SEQ ID NO: 1040323 - DNA, 19 bp, Homo sapiens
tgtgattacatagatcagc

SEQ ID NO: 1040324 - DNA, 21 bp, Homo sapiens
tgtgattacctgctgcatgaa

SEQ ID NO: 1040325 - DNA, 21 bp, Homo sapiens
tgtgattacgtgtatgtttct

SEQ ID NO: 1040326 - DNA, 22 bp, Homo sapiens
tgtgattacgtgtatgtttctt

SEQ ID NO: 1040327 - DNA, 22 bp, Homo sapiens
tgtgattagacagaacacctat

SEQ ID NO: 1040328 - DNA, 23 bp, Homo sapiens
tgtgattagatcacatcttaaat

SEQ ID NO: 1040329 - DNA, 21 bp, Homo sapiens
tgtgattaggtgaagggatgg

SEQ ID NO: 1040330 - DNA, 15 bp, Homo sapiens
tgtgattatttcact

SEQ ID NO: 1040331 - DNA, 17 bp, Homo sapiens
tgtgattatttcacttt

SEQ ID NO: 1040332 - DNA, 20 bp, Homo sapiens
tgtgattcaatctgtaaact

SEQ ID NO: 1040333 - DNA, 22 bp, Homo sapiens
tgtgattccactacacctggct

SEQ ID NO: 1040334 - DNA, 19 bp, Homo sapiens
tgtgattcctacccctctt

SEQ ID NO: 1040335 - DNA, 15 bp, Homo sapiens
tgtgattccttttga

SEQ ID NO: 1040336 - DNA, 14 bp, Homo sapiens
tgtgattctaatgt

SEQ ID NO: 1040337 - DNA, 13 bp, Homo sapiens
tgtgattgaatct

SEQ ID NO: 1040338 - DNA, 15 bp, Homo sapiens
tgtgattgaatctga

SEQ ID NO: 1040339 - DNA, 22 bp, Homo sapiens
tgtgattgacagctttgctgct

SEQ ID NO: 1040340 - DNA, 13 bp, Homo sapiens
tgtgattgctgcc

SEQ ID NO: 1040341 - DNA, 14 bp, Homo sapiens
tgtgattgtggaat

SEQ ID NO: 1040342 - DNA, 17 bp, Homo sapiens
tgtgattgtggaatgga

SEQ ID NO: 1040343 - DNA, 20 bp, Homo sapiens
tgtgatttcctaaacataat

SEQ ID NO: 1040344 - DNA, 14 bp, Homo sapiens
tgtgatttcttctc

SEQ ID NO: 1040345 - DNA, 17 bp, Homo sapiens
tgtgatttcttctccct

SEQ ID NO: 1040346 - DNA, 22 bp, Homo sapiens
tgtgattttgccctcctgccca

SEQ ID NO: 1040347 - DNA, 19 bp, Homo sapiens
tgtgcaaaaccttttactg

SEQ ID NO: 1040348 - DNA, 20 bp, Homo sapiens
tgtgcaaaaccttttactgg

SEQ ID NO: 1040349 - DNA, 13 bp, Homo sapiens
tgtgcaaacataa

SEQ ID NO: 1040350 - DNA, 15 bp, Homo sapiens
tgtgcaaattttgca

SEQ ID NO: 1040351 - DNA, 15 bp, Homo sapiens
tgtgcaacagacaag

SEQ ID NO: 1040352 - DNA, 20 bp, Homo sapiens
tgtgcaacagggtatggact

SEQ ID NO: 1040353 - DNA, 16 bp, Homo sapiens
tgtgcaaccatgtttg

SEQ ID NO: 1040354 - DNA, 17 bp, Homo sapiens
tgtgcaacctgtggctc

SEQ ID NO: 1040355 - DNA, 20 bp, Homo sapiens
tgtgcaacctgtggctcagg

SEQ ID NO: 1040356 - DNA, 18 bp, Homo sapiens
tgtgcaactggccagcca

SEQ ID NO: 1040357 - DNA, 18 bp, Homo sapiens
tgtgcaactttttaaagt

SEQ ID NO: 1040358 - DNA, 22 bp, Homo sapiens
tgtgctacaattcattgtgtta

SEQ ID NO: 1040359 - DNA, 14 bp, Homo sapiens
tgtgctacagatga

SEQ ID NO: 1040360 - DNA, 21 bp, Homo sapiens
tgtgctaccagagttaaagca

SEQ ID NO: 1040361 - DNA, 21 bp, Homo sapiens
tgtgctacctgggtccttttc

SEQ ID NO: 1040362 - DNA, 17 bp, Homo sapiens
tgtgctagaaattttca

SEQ ID NO: 1040363 - DNA, 18 bp, Homo sapiens
tgtgctagaatacttttt

SEQ ID NO: 1040364 - DNA, 21 bp, Homo sapiens
tgtgctatactgcatactttt

SEQ ID NO: 1040365 - DNA, 13 bp, Homo sapiens
tgtgctatagtat

SEQ ID NO: 1040366 - DNA, 22 bp, Homo sapiens
tgtgctatataaatatgtcaga

SEQ ID NO: 1040367 - DNA, 15 bp, Homo sapiens
tgtgctatgaatttt

SEQ ID NO: 1040368 - DNA, 14 bp, Homo sapiens
tgtgctcacgctcc

SEQ ID NO: 1040369 - DNA, 18 bp, Homo sapiens
tgtgctcagaagaggaaa

SEQ ID NO: 1040370 - DNA, 15 bp, Homo sapiens
tgtgctcagagacac

SEQ ID NO: 1040371 - DNA, 13 bp, Homo sapiens
tgtgctcagccaa

SEQ ID NO: 1040372 - DNA, 15 bp, Homo sapiens
tgtgctcatttaagt

SEQ ID NO: 1040373 - DNA, 20 bp, Homo sapiens
tgtgctcccctgccacactg

SEQ ID NO: 1040374 - DNA, 16 bp, Homo sapiens
tgtgctccgtgcctcc

SEQ ID NO: 1040375 - DNA, 23 bp, Homo sapiens
tgtgctccgtgcctccaccacca

SEQ ID NO: 1040376 - DNA, 23 bp, Homo sapiens
tgtgctcctcttgattcctggtt

SEQ ID NO: 1040377 - DNA, 21 bp, Homo sapiens
tgtgctctccccggcaggcct

SEQ ID NO: 1040378 - DNA, 14 bp, Homo sapiens
tgtgctctctgtgg

SEQ ID NO: 1040379 - DNA, 19 bp, Homo sapiens
tgtgctcttgttttgtctt

SEQ ID NO: 1040380 - DNA, 15 bp, Homo sapiens
tgtgctctttgaaga

SEQ ID NO: 1040381 - DNA, 23 bp, Homo sapiens
tgtgctgacaacttagctcaggt

SEQ ID NO: 1040382 - DNA, 18 bp, Homo sapiens
tgtgctgatgtttcctgg

SEQ ID NO: 1040383 - DNA, 17 bp, Homo sapiens
tgtgctgccctgaagaa

SEQ ID NO: 1040384 - DNA, 13 bp, Homo sapiens
tgtgctgcttctc

SEQ ID NO: 1040385 - DNA, 10 bp, Homo sapiens
tgtgctggga

SEQ ID NO: 1040386 - DNA, 19 bp, Homo sapiens
tgtgctgggaaatgcagaa

SEQ ID NO: 1040387 - DNA, 16 bp, Homo sapiens
tgtgctgggggaatga

SEQ ID NO: 1040388 - DNA, 19 bp, Homo sapiens
tgtgctgggtcccagcctg

SEQ ID NO: 1040389 - DNA, 17 bp, Homo sapiens
tgtgctgggtgagctct

SEQ ID NO: 1040390 - DNA, 17 bp, Homo sapiens
tgtgctgggttattcag

SEQ ID NO: 1040391 - DNA, 17 bp, Homo sapiens
tgtgctgtatggcccag

SEQ ID NO: 1040392 - DNA, 20 bp, Homo sapiens
tgtgctgtatggcccaggca

SEQ ID NO: 1040393 - DNA, 21 bp, Homo sapiens
tgtgctgtatggcccaggcag

SEQ ID NO: 1040394 - DNA, 14 bp, Homo sapiens
tgtgctgtgcctgc

SEQ ID NO: 1040395 - DNA, 17 bp, Homo sapiens
tgtgctgtgcctgctag

SEQ ID NO: 1040396 - DNA, 18 bp, Homo sapiens
tgtgctgtgcctgctaga

SEQ ID NO: 1040397 - DNA, 14 bp, Homo sapiens
tgtgctgtgggcag

SEQ ID NO: 1040398 - DNA, 17 bp, Homo sapiens
tgtgctgtgggcagcac

SEQ ID NO: 1040399 - DNA, 19 bp, Homo sapiens
tgtgctgtgggcagcaccc

SEQ ID NO: 1040400 - DNA, 12 bp, Homo sapiens
tgtgctgtgtgt

SEQ ID NO: 1040401 - DNA, 15 bp, Homo sapiens
tgtgcttggtctgtt

SEQ ID NO: 1040402 - DNA, 14 bp, Homo sapiens
tgtgctttcaagat

SEQ ID NO: 1040403 - DNA, 12 bp, Homo sapiens
tgtgctttcctg

SEQ ID NO: 1040404 - DNA, 13 bp, Homo sapiens
tgtgctttcctga

SEQ ID NO: 1040405 - DNA, 19 bp, Homo sapiens
tgtgctttctgcatgctta

SEQ ID NO: 1040406 - DNA, 23 bp, Homo sapiens
tgtgctttgagatttttttttct

SEQ ID NO: 1040407 - DNA, 13 bp, Homo sapiens
tgtgctttgcatt

SEQ ID NO: 1040408 - DNA, 13 bp, Homo sapiens
tgtgctttgctct

SEQ ID NO: 1040409 - DNA, 14 bp, Homo sapiens
tgtgcttttcctat

SEQ ID NO: 1040410 - DNA, 14 bp, Homo sapiens
tgtgcttttcctga

SEQ ID NO: 1040411 - DNA, 20 bp, Homo sapiens
tgtggaaaagaaacacgcac

SEQ ID NO: 1040412 - DNA, 20 bp, Homo sapiens
tgtggaaaagccatctcagg

SEQ ID NO: 1040413 - DNA, 22 bp, Homo sapiens
tgtggaaaagccatctcaggtt

SEQ ID NO: 1040414 - DNA, 23 bp, Homo sapiens
tgtggaaagtgaatttgaatgaa

SEQ ID NO: 1040415 - DNA, 16 bp, Homo sapiens
tgtggaacataaaaag

SEQ ID NO: 1040416 - DNA, 19 bp, Homo sapiens
tgtggaacataaaaaggac

SEQ ID NO: 1040417 - DNA, 20 bp, Homo sapiens
tgtggaactaataaatacat

SEQ ID NO: 1040418 - DNA, 23 bp, Homo sapiens
tgtggaactaataaatacatacg

SEQ ID NO: 1040419 - DNA, 15 bp, Homo sapiens
tgtggaagcatggct

SEQ ID NO: 1040420 - DNA, 19 bp, Homo sapiens
tgtggaagcatggctgtct

SEQ ID NO: 1040421 - DNA, 17 bp, Homo sapiens
tgtggaagggaccaagc

SEQ ID NO: 1040422 - DNA, 19 bp, Homo sapiens
tgtggaagggaccaagcga

SEQ ID NO: 1040423 - DNA, 15 bp, Homo sapiens
tgtggaataaatcct

SEQ ID NO: 1040424 - DNA, 22 bp, Homo sapiens
tgtggaatgttgggtctcactc

SEQ ID NO: 1040425 - DNA, 17 bp, Homo sapiens
tgtggaatttattggca

SEQ ID NO: 1040426 - DNA, 20 bp, Homo sapiens
tgtggacatatgtatactta

SEQ ID NO: 1040427 - DNA, 21 bp, Homo sapiens
tgtggacggggaggctctccc

SEQ ID NO: 1040428 - DNA, 18 bp, Homo sapiens
tgtggactggctgtgccc

SEQ ID NO: 1040429 - DNA, 14 bp, Homo sapiens
tgtggactgtgatg

SEQ ID NO: 1040430 - DNA, 16 bp, Homo sapiens
tgtggacttggcaggt

SEQ ID NO: 1040431 - DNA, 21 bp, Homo sapiens
tgtggagaccctgccacagcc

SEQ ID NO: 1040432 - DNA, 16 bp, Homo sapiens
tgtggagagaagctga

SEQ ID NO: 1040433 - DNA, 21 bp, Homo sapiens
tgtggagagaagtgagcaagg

SEQ ID NO: 1040434 - DNA, 19 bp, Homo sapiens
tgtggagaggggtgcaccc

SEQ ID NO: 1040435 - DNA, 15 bp, Homo sapiens
tgtggagatggactc

SEQ ID NO: 1040436 - DNA, 15 bp, Homo sapiens
tgtggagcacgtgga

SEQ ID NO: 1040437 - DNA, 20 bp, Homo sapiens
tgtggagccgaggcctaccc

SEQ ID NO: 1040438 - DNA, 13 bp, Homo sapiens
tgtggagcgcccg

SEQ ID NO: 1040439 - DNA, 15 bp, Homo sapiens
tgtggagctcagccc

SEQ ID NO: 1040440 - DNA, 23 bp, Homo sapiens
tgtggaggaagagccacctgcaa

SEQ ID NO: 1040441 - DNA, 14 bp, Homo sapiens
tgtggaggacagac

SEQ ID NO: 1040442 - DNA, 12 bp, Homo sapiens
tgtggaggcctg

SEQ ID NO: 1040443 - DNA, 17 bp, Homo sapiens
tgtggagtccagctcta

SEQ ID NO: 1040444 - DNA, 14 bp, Homo sapiens
tgtggagttcctgc

SEQ ID NO: 1040445 - DNA, 19 bp, Homo sapiens
tgtggagttcctgctccgt

SEQ ID NO: 1040446 - DNA, 21 bp, Homo sapiens
tgtggataaaactgtgtaaac

SEQ ID NO: 1040447 - DNA, 15 bp, Homo sapiens
tgtggatacagtgcc

SEQ ID NO: 1040448 - DNA, 19 bp, Homo sapiens
tgtggatcaaccatcgctt

SEQ ID NO: 1040449 - DNA, 22 bp, Homo sapiens
tgtggatgccgatttctgtaaa

SEQ ID NO: 1040450 - DNA, 19 bp, Homo sapiens
tgtggatgctgagctgtga

SEQ ID NO: 1040451 - DNA, 15 bp, Homo sapiens
tgtggcaaagtgctg

SEQ ID NO: 1040452 - DNA, 16 bp, Homo sapiens
tgtggcaaagtgctgt

SEQ ID NO: 1040453 - DNA, 19 bp, Homo sapiens
tgtggcaaagtgctgtacc

SEQ ID NO: 1040454 - DNA, 14 bp, Homo sapiens
tgtggcaactgaga

SEQ ID NO: 1040455 - DNA, 17 bp, Homo sapiens
tgtggcaaggaaaaaca

SEQ ID NO: 1040456 - DNA, 17 bp, Homo sapiens
tgtggcaatctgtgggc

SEQ ID NO: 1040457 - DNA, 19 bp, Homo sapiens
tgtggcaattagtgtgaca

SEQ ID NO: 1040458 - DNA, 19 bp, Homo sapiens
tgtggcacagatgcccacg

SEQ ID NO: 1040459 - DNA, 16 bp, Homo sapiens
tgtggcacgcacctgt

SEQ ID NO: 1040460 - DNA, 15 bp, Homo sapiens
tgtggcagaaaagag

SEQ ID NO: 1040461 - DNA, 14 bp, Homo sapiens
tgtggcagagttac

SEQ ID NO: 1040462 - DNA, 19 bp, Homo sapiens
tgtggcagagttacagttc

SEQ ID NO: 1040463 - DNA, 12 bp, Homo sapiens
tgtggcagccca

SEQ ID NO: 1040464 - DNA, 20 bp, Homo sapiens
tgtggcagccgtcccaggcc

SEQ ID NO: 1040465 - DNA, 17 bp, Homo sapiens
tgtggcaggaggctttg

SEQ ID NO: 1040466 - DNA, 14 bp, Homo sapiens
tgtggcattggggg

SEQ ID NO: 1040467 - DNA, 20 bp, Homo sapiens
tgtggcatttccaaacatcc

SEQ ID NO: 1040468 - DNA, 13 bp, Homo sapiens
tgtggccaaccag

SEQ ID NO: 1040469 - DNA, 22 bp, Homo sapiens
tgtggccaaccaggacccaggg

SEQ ID NO: 1040470 - DNA, 14 bp, Homo sapiens
tgtggccaaggagc

SEQ ID NO: 1040471 - DNA, 19 bp, Homo sapiens
tgtggccaaggagctgcta

SEQ ID NO: 1040472 - DNA, 21 bp, Homo sapiens
tgtggccaaggagctgctata

SEQ ID NO: 1040473 - DNA, 14 bp, Homo sapiens
tgtggccagagctg

SEQ ID NO: 1040474 - DNA, 14 bp, Homo sapiens
tgtggccaggcctt

SEQ ID NO: 1040475 - DNA, 16 bp, Homo sapiens
tgtggccatatatgct

SEQ ID NO: 1040476 - DNA, 23 bp, Homo sapiens
tgtggccatatatgctgtatttc

SEQ ID NO: 1040477 - DNA, 18 bp, Homo sapiens
tgttataactctgcacta

SEQ ID NO: 1040478 - DNA, 19 bp, Homo sapiens
tgttatagaacttcatgga

SEQ ID NO: 1040479 - DNA, 17 bp, Homo sapiens
tgttatagattgtctta

SEQ ID NO: 1040480 - DNA, 20 bp, Homo sapiens
tgttatagattgtcttaatg

SEQ ID NO: 1040481 - DNA, 18 bp, Homo sapiens
tgttataggttgttggat

SEQ ID NO: 1040482 - DNA, 14 bp, Homo sapiens
tgttatatcaggga

SEQ ID NO: 1040483 - DNA, 12 bp, Homo sapiens
tgttatattata

SEQ ID NO: 1040484 - DNA, 19 bp, Homo sapiens
tgttatatttaatgcatta

SEQ ID NO: 1040485 - DNA, 13 bp, Homo sapiens
tgttatcaaaata

SEQ ID NO: 1040486 - DNA, 22 bp, Homo sapiens
tgttatcaaacaccaacataaa

SEQ ID NO: 1040487 - DNA, 19 bp, Homo sapiens
tgttatcaccgtgggctcc

SEQ ID NO: 1040488 - DNA, 16 bp, Homo sapiens
tgttatcatcctccct

SEQ ID NO: 1040489 - DNA, 19 bp, Homo sapiens
tgttatccttttttaaaag

SEQ ID NO: 1040490 - DNA, 12 bp, Homo sapiens
tgttatgaaaat

SEQ ID NO: 1040491 - DNA, 15 bp, Homo sapiens
tgttatgaacatcca

SEQ ID NO: 1040492 - DNA, 16 bp, Homo sapiens
tgttatgactatgtaa

SEQ ID NO: 1040493 - DNA, 14 bp, Homo sapiens
tgttatgagaaatt

SEQ ID NO: 1040494 - DNA, 21 bp, Homo sapiens
tgttatgatattgtttaaaat

SEQ ID NO: 1040495 - DNA, 23 bp, Homo sapiens
tgttatgcactgtggtttcagat

SEQ ID NO: 1040496 - DNA, 20 bp, Homo sapiens
tgttatgggatgtaaacaat

SEQ ID NO: 1040497 - DNA, 15 bp, Homo sapiens
tgttatggtagaaaa

SEQ ID NO: 1040498 - DNA, 17 bp, Homo sapiens
tgttatggtagaaaaat

SEQ ID NO: 1040499 - DNA, 17 bp, Homo sapiens
tgttatgtagataacaa

SEQ ID NO: 1040500 - DNA, 13 bp, Homo sapiens
tgttatgtatgaa

SEQ ID NO: 1040501 - DNA, 17 bp, Homo sapiens
tgttatgtatgaaggaa

SEQ ID NO: 1040502 - DNA, 17 bp, Homo sapiens
tgttatgtttaataagc

SEQ ID NO: 1040503 - DNA, 20 bp, Homo sapiens
tgttatgttttcgaaaatca

SEQ ID NO: 1040504 - DNA, 21 bp, Homo sapiens
tgttattaaacgtatgcatgt

SEQ ID NO: 1040505 - DNA, 18 bp, Homo sapiens
tgttattaatgtttcttc

SEQ ID NO: 1040506 - DNA, 20 bp, Homo sapiens
tgttattactgttttgggcc

SEQ ID NO: 1040507 - DNA, 19 bp, Homo sapiens
tgttattatatttgacatg

SEQ ID NO: 1040508 - DNA, 22 bp, Homo sapiens
tgttattattactctacactga

SEQ ID NO: 1040509 - DNA, 22 bp, Homo sapiens
tgttattattacttatttttga

SEQ ID NO: 1040510 - DNA, 23 bp, Homo sapiens
tgttattcctagtggatgactgt

SEQ ID NO: 1040511 - DNA, 24 bp, Homo sapiens
tgttattcctagtggatgactgtt

SEQ ID NO: 1040512 - DNA, 17 bp, Homo sapiens
tgttattcgtgaatagt

SEQ ID NO: 1040513 - DNA, 15 bp, Homo sapiens
tgttattgtgaatga

SEQ ID NO: 1040514 - DNA, 16 bp, Homo sapiens
tgttattgtgaatgat

SEQ ID NO: 1040515 - DNA, 19 bp, Homo sapiens
tgttattgtgaatgattca

SEQ ID NO: 1040516 - DNA, 14 bp, Homo sapiens
tgttattgttgaac

SEQ ID NO: 1040517 - DNA, 15 bp, Homo sapiens
tgttatttaaatgag

SEQ ID NO: 1040518 - DNA, 15 bp, Homo sapiens
tgttatttacactgg

SEQ ID NO: 1040519 - DNA, 19 bp, Homo sapiens
tgttatttacactggtcta

SEQ ID NO: 1040520 - DNA, 16 bp, Homo sapiens
tgttatttattattaa

SEQ ID NO: 1040521 - DNA, 18 bp, Homo sapiens
tgttattttctgttgaag

SEQ ID NO: 1040522 - DNA, 18 bp, Homo sapiens
tgttatttttaagctttt

SEQ ID NO: 1040523 - DNA, 20 bp, Homo sapiens
tgttatttttaagcttttat

SEQ ID NO: 1040524 - DNA, 22 bp, Homo sapiens
tgttatttttatatcagcctga

SEQ ID NO: 1040525 - DNA, 19 bp, Homo sapiens
tgttatttttcaaggaagg

SEQ ID NO: 1040526 - DNA, 14 bp, Homo sapiens
tgttcaaaatacta

SEQ ID NO: 1040527 - DNA, 16 bp, Homo sapiens
tgttcaaactactgta

SEQ ID NO: 1040528 - DNA, 18 bp, Homo sapiens
tgttcaaactactgtaca

SEQ ID NO: 1040529 - DNA, 19 bp, Homo sapiens
tgttcaaactactgtacat

SEQ ID NO: 1040530 - DNA, 15 bp, Homo sapiens
tgttcaaagactgtg

SEQ ID NO: 1040531 - DNA, 18 bp, Homo sapiens
tgttcaaagccacattat

SEQ ID NO: 1040532 - DNA, 18 bp, Homo sapiens
tgttcaagaaataaaaat

SEQ ID NO: 1040533 - DNA, 23 bp, Homo sapiens
tgttcaagaccagcctgaccaac

SEQ ID NO: 1040534 - DNA, 15 bp, Homo sapiens
tgttcaatattttct

SEQ ID NO: 1040535 - DNA, 13 bp, Homo sapiens
tgttcaatgaaat

SEQ ID NO: 1040536 - DNA, 14 bp, Homo sapiens
tgttcaatgttcca

SEQ ID NO: 1040537 - DNA, 16 bp, Homo sapiens
tgttcaatgttccatt

SEQ ID NO: 1040538 - DNA, 19 bp, Homo sapiens
tgttcacaaactacctctg

SEQ ID NO: 1040539 - DNA, 14 bp, Homo sapiens
tgttcacaaactgt

SEQ ID NO: 1040540 - DNA, 17 bp, Homo sapiens
tgttcaccaaaaccaaa

SEQ ID NO: 1040541 - DNA, 21 bp, Homo sapiens
tgttcaccttcaaaatgttct

SEQ ID NO: 1040542 - DNA, 19 bp, Homo sapiens
tgttcacggcagaccagaa

SEQ ID NO: 1040543 - DNA, 18 bp, Homo sapiens
tgttcactgctccttgct

SEQ ID NO: 1040544 - DNA, 13 bp, Homo sapiens
tgttcactgtccc

SEQ ID NO: 1040545 - DNA, 16 bp, Homo sapiens
tgttcacttttcctcc

SEQ ID NO: 1040546 - DNA, 16 bp, Homo sapiens
tgttcagagtggctca

SEQ ID NO: 1040547 - DNA, 17 bp, Homo sapiens
tgttcagatgtgcattt

SEQ ID NO: 1040548 - DNA, 14 bp, Homo sapiens
tgttcagcactgtc

SEQ ID NO: 1040549 - DNA, 15 bp, Homo sapiens
tgttcagcagaacct

SEQ ID NO: 1040550 - DNA, 16 bp, Homo sapiens
tgttcagcagaacctg

SEQ ID NO: 1040551 - DNA, 11 bp, Homo sapiens
tgttcagctgg

SEQ ID NO: 1040552 - DNA, 21 bp, Homo sapiens
tgttcaggaaaaggttgaata

SEQ ID NO: 1040553 - DNA, 17 bp, Homo sapiens
tgttcagtgcaatcaga

SEQ ID NO: 1040554 - DNA, 14 bp, Homo sapiens
tgttcagttcaaaa

SEQ ID NO: 1040555 - DNA, 15 bp, Homo sapiens
tgttcatagcccagt

SEQ ID NO: 1040556 - DNA, 22 bp, Homo sapiens
tgttcatcaacagtgagagact

SEQ ID NO: 1040557 - DNA, 19 bp, Homo sapiens
tgttcatcaccagtctgta

SEQ ID NO: 1040558 - DNA, 18 bp, Homo sapiens
tgttcatcatccagatgt

SEQ ID NO: 1040559 - DNA, 20 bp, Homo sapiens
tgttcatcatccagatgtgg

SEQ ID NO: 1040560 - DNA, 19 bp, Homo sapiens
tgttcatcccatgatgtag

SEQ ID NO: 1040561 - DNA, 14 bp, Homo sapiens
tgttcatctgtaac

SEQ ID NO: 1040562 - DNA, 15 bp, Homo sapiens
tgttcatggagagct

SEQ ID NO: 1040563 - DNA, 17 bp, Homo sapiens
tgttcattataatctca

SEQ ID NO: 1040564 - DNA, 18 bp, Homo sapiens
tgttcattcaagctattt

SEQ ID NO: 1040565 - DNA, 22 bp, Homo sapiens
tgttcattcaagctatttaata

SEQ ID NO: 1040566 - DNA, 22 bp, Homo sapiens
tgttcattgtaatgttactgat

SEQ ID NO: 1040567 - DNA, 19 bp, Homo sapiens
tgttcatttcacacagtga

SEQ ID NO: 1040568 - DNA, 22 bp, Homo sapiens
tgttcatttgaaagaggagtat

SEQ ID NO: 1040569 - DNA, 23 bp, Homo sapiens
tgttcatttggtgttcctggaag

SEQ ID NO: 1040570 - DNA, 17 bp, Homo sapiens
tgttcattttgagctga

SEQ ID NO: 1040571 - DNA, 15 bp, Homo sapiens
tgttcattttgagta

SEQ ID NO: 1040572 - DNA, 11 bp, Homo sapiens
tgttccaagac

SEQ ID NO: 1040573 - DNA, 18 bp, Homo sapiens
tgttccaagacattgtca

SEQ ID NO: 1040574 - DNA, 19 bp, Homo sapiens
tgttccaagacattgtcaa

SEQ ID NO: 1040575 - DNA, 21 bp, Homo sapiens
tgttccaagacattgtcaata

SEQ ID NO: 1040576 - DNA, 23 bp, Homo sapiens
tgttccactgcaaataaagcctt

SEQ ID NO: 1040577 - DNA, 12 bp, Homo sapiens
tgttccagacat

SEQ ID NO: 1040578 - DNA, 11 bp, Homo sapiens
tgttccagact

SEQ ID NO: 1040579 - DNA, 23 bp, Homo sapiens
tgttccagactcaggttccagaa

SEQ ID NO: 1040580 - DNA, 23 bp, Homo sapiens
tgttccagattcctatgatggat

SEQ ID NO: 1040581 - DNA, 18 bp, Homo sapiens
tgttccaggcatccatct

SEQ ID NO: 1040582 - DNA, 14 bp, Homo sapiens
tgttcccagaggca

SEQ ID NO: 1040583 - DNA, 16 bp, Homo sapiens
tgttcccattcttgca

SEQ ID NO: 1040584 - DNA, 14 bp, Homo sapiens
tgttgaaaatgttc

SEQ ID NO: 1040585 - DNA, 21 bp, Homo sapiens
tgttgaaaattattttaaaca

SEQ ID NO: 1040586 - DNA, 22 bp, Homo sapiens
tgttgaaaattattttaaacaa

SEQ ID NO: 1040587 - DNA, 11 bp, Homo sapiens
tgttgaaagat

SEQ ID NO: 1040588 - DNA, 18 bp, Homo sapiens
tgttgaaatatgcatact

SEQ ID NO: 1040589 - DNA, 21 bp, Homo sapiens
tgttgaaattatgtatgttta

SEQ ID NO: 1040590 - DNA, 20 bp, Homo sapiens
tgttgaacaggtgtttttcc

SEQ ID NO: 1040591 - DNA, 15 bp, Homo sapiens
tgttgaacatacttc

SEQ ID NO: 1040592 - DNA, 20 bp, Homo sapiens
tgttgaagaaaaaagcttat

SEQ ID NO: 1040593 - DNA, 14 bp, Homo sapiens
tgttgaaggaactt

SEQ ID NO: 1040594 - DNA, 23 bp, Homo sapiens
tgttgaaggaacttgtctcttca

SEQ ID NO: 1040595 - DNA, 18 bp, Homo sapiens
tgttgaatactttttaca

SEQ ID NO: 1040596 - DNA, 15 bp, Homo sapiens
tgttgacaactgtga

SEQ ID NO: 1040597 - DNA, 22 bp, Homo sapiens
tgttgacacaccagttttgagt

SEQ ID NO: 1040598 - DNA, 17 bp, Homo sapiens
tgttgacacatatgaac

SEQ ID NO: 1040599 - DNA, 16 bp, Homo sapiens
tgttgacagttctgaa

SEQ ID NO: 1040600 - DNA, 15 bp, Homo sapiens
tgttgacatatttaa

SEQ ID NO: 1040601 - DNA, 18 bp, Homo sapiens
tgttgacatatttaatgt

SEQ ID NO: 1040602 - DNA, 23 bp, Homo sapiens
tgttgacatatttaatgttttaa

SEQ ID NO: 1040603 - DNA, 18 bp, Homo sapiens
tgttgacattctgaatgc

SEQ ID NO: 1040604 - DNA, 18 bp, Homo sapiens
tgttgaccactccagaga

SEQ ID NO: 1040605 - DNA, 19 bp, Homo sapiens
tgttgaccactccagagaa

SEQ ID NO: 1040606 - DNA, 14 bp, Homo sapiens
tgttgaccttccca

SEQ ID NO: 1040607 - DNA, 16 bp, Homo sapiens
tgttgactgctgctcc

SEQ ID NO: 1040608 - DNA, 20 bp, Homo sapiens
tgttgactgctgctccccac

SEQ ID NO: 1040609 - DNA, 21 bp, Homo sapiens
tgttgacttattttctctgtg

SEQ ID NO: 1040610 - DNA, 13 bp, Homo sapiens
tgttgagaagaat

SEQ ID NO: 1040611 - DNA, 22 bp, Homo sapiens
tgttgagaagcgtttttaacct

SEQ ID NO: 1040612 - DNA, 18 bp, Homo sapiens
tgttgagccccagtgctg

SEQ ID NO: 1040613 - DNA, 16 bp, Homo sapiens
tgttgagccttttccc

SEQ ID NO: 1040614 - DNA, 13 bp, Homo sapiens
tgttgagctgttt

SEQ ID NO: 1040615 - DNA, 18 bp, Homo sapiens
tgttgaggcatcaaaaaa

SEQ ID NO: 1040616 - DNA, 18 bp, Homo sapiens
tgttgagggccacttttt

SEQ ID NO: 1040617 - DNA, 19 bp, Homo sapiens
tgttgagtgcactgactgt

SEQ ID NO: 1040618 - DNA, 22 bp, Homo sapiens
tgttgagttagttaagttgggt

SEQ ID NO: 1040619 - DNA, 21 bp, Homo sapiens
tgttgatacctctgctgggat

SEQ ID NO: 1040620 - DNA, 13 bp, Homo sapiens
tgttgatcagcaa

SEQ ID NO: 1040621 - DNA, 20 bp, Homo sapiens
tgttgatcatgtacttttta

SEQ ID NO: 1040622 - DNA, 22 bp, Homo sapiens
tgttgatcatgtactttttagt

SEQ ID NO: 1040623 - DNA, 23 bp, Homo sapiens
tgttgatcatgtactttttagta

SEQ ID NO: 1040624 - DNA, 13 bp, Homo sapiens
tgttgatctgcat

SEQ ID NO: 1040625 - DNA, 21 bp, Homo sapiens
tgttgatctgcatatttctgt

SEQ ID NO: 1040626 - DNA, 14 bp, Homo sapiens
tgttgatcttacaa

SEQ ID NO: 1040627 - DNA, 16 bp, Homo sapiens
tgttgatgctttcgtc

SEQ ID NO: 1040628 - DNA, 22 bp, Homo sapiens
tgttgatgtatctgagttgcca

SEQ ID NO: 1040629 - DNA, 15 bp, Homo sapiens
tgttgattaaagatg

SEQ ID NO: 1040630 - DNA, 16 bp, Homo sapiens
tgttgattaaagatga

SEQ ID NO: 1040631 - DNA, 16 bp, Homo sapiens
tgttgattatcttcag

SEQ ID NO: 1040632 - DNA, 11 bp, Homo sapiens
tgttgattatt

SEQ ID NO: 1040633 - DNA, 16 bp, Homo sapiens
tgttgattattagcca

SEQ ID NO: 1040634 - DNA, 15 bp, Homo sapiens
tgttgcaagatgtga

SEQ ID NO: 1040635 - DNA, 21 bp, Homo sapiens
tgttgcacagcagcaattgtt

SEQ ID NO: 1040636 - DNA, 19 bp, Homo sapiens
tgttgcaccatctgcttgg

SEQ ID NO: 1040637 - DNA, 15 bp, Homo sapiens
tgttgcactgaacag

SEQ ID NO: 1040638 - DNA, 11 bp, Homo sapiens
tgttgcactgc

SEQ ID NO: 1040639 - DNA, 13 bp, Homo sapiens
tgttgcactgccc

SEQ ID NO: 1040640 - DNA, 17 bp, Homo sapiens
tgttgcagagatttcct

SEQ ID NO: 1040641 - DNA, 17 bp, Homo sapiens
tgttgcaggttcatgga

SEQ ID NO: 1040642 - DNA, 17 bp, Homo sapiens
tgttgcatggatgtttt

SEQ ID NO: 1040643 - DNA, 14 bp, Homo sapiens
tgttgcatgggcta

SEQ ID NO: 1040644 - DNA, 20 bp, Homo sapiens
tgttgcatgggctaatgaag

SEQ ID NO: 1040645 - DNA, 18 bp, Homo sapiens
tgttgccaaagctggtct

SEQ ID NO: 1040646 - DNA, 20 bp, Homo sapiens
tgttgccaaatatgtcctgg

SEQ ID NO: 1040647 - DNA, 18 bp, Homo sapiens
tgttgccaagctccaagc

SEQ ID NO: 1040648 - DNA, 16 bp, Homo sapiens
tgttgccaatttttgt

SEQ ID NO: 1040649 - DNA, 17 bp, Homo sapiens
tgttgccacctgttaaa

SEQ ID NO: 1040650 - DNA, 21 bp, Homo sapiens
tgttgccacctgttaaaatgt

SEQ ID NO: 1040651 - DNA, 14 bp, Homo sapiens
tgttgccatagccc

SEQ ID NO: 1040652 - DNA, 17 bp, Homo sapiens
tgttgccatttctctgc

SEQ ID NO: 1040653 - DNA, 15 bp, Homo sapiens
tgttgcccaggctgg

SEQ ID NO: 1040654 - DNA, 18 bp, Homo sapiens
tgttgcccaggctggagt

SEQ ID NO: 1040655 - DNA, 11 bp, Homo sapiens
tgttgccccag

SEQ ID NO: 1040656 - DNA, 19 bp, Homo sapiens
tgttgccccattcctaaga

SEQ ID NO: 1040657 - DNA, 16 bp, Homo sapiens
tgttgcccctttctct

SEQ ID NO: 1040658 - DNA, 20 bp, Homo sapiens
tgttgcccctttctcttttc

SEQ ID NO: 1040659 - DNA, 21 bp, Homo sapiens
tgttgcccctttctcttttcc

SEQ ID NO: 1040660 - DNA, 16 bp, Homo sapiens
tgttgccctcgtgccc

SEQ ID NO: 1040661 - DNA, 14 bp, Homo sapiens
tgttgcctcctccc

SEQ ID NO: 1040662 - DNA, 15 bp, Homo sapiens
tgttgcctcctccca

SEQ ID NO: 1040663 - DNA, 13 bp, Homo sapiens
tgttgctagggag

SEQ ID NO: 1040664 - DNA, 21 bp, Homo sapiens
tgttgctagttttttgcttct

SEQ ID NO: 1040665 - DNA, 15 bp, Homo sapiens
tgttgctcttggaaa

SEQ ID NO: 1040666 - DNA, 18 bp, Homo sapiens
tgttgctgctactgtctt

SEQ ID NO: 1040667 - DNA, 15 bp, Homo sapiens
tgttgctggaggggc

SEQ ID NO: 1040668 - DNA, 16 bp, Homo sapiens
tgttgctggatcagga

SEQ ID NO: 1040669 - DNA, 18 bp, Homo sapiens
tgttgcttagatgagggt

SEQ ID NO: 1040670 - DNA, 14 bp, Homo sapiens
tgttgcttcaaatt

SEQ ID NO: 1040671 - DNA, 16 bp, Homo sapiens
tgttgcttctgaatca

SEQ ID NO: 1040672 - DNA, 13 bp, Homo sapiens
tgttgcttttcaa

SEQ ID NO: 1040673 - DNA, 21 bp, Homo sapiens
tgttgcttttgtgaacttttt

SEQ ID NO: 1040674 - DNA, 20 bp, Homo sapiens
tgttggaaactgtaaaatga

SEQ ID NO: 1040675 - DNA, 14 bp, Homo sapiens
tgttggagcaaacc

SEQ ID NO: 1040676 - DNA, 17 bp, Homo sapiens
tgttggagcaaaccatt

SEQ ID NO: 1040677 - DNA, 18 bp, Homo sapiens
tgttggagcaaaccatta

SEQ ID NO: 1040678 - DNA, 14 bp, Homo sapiens
tgttggatcttcaa

SEQ ID NO: 1040679 - DNA, 17 bp, Homo sapiens
tgttggatttttgtctt

SEQ ID NO: 1040680 - DNA, 20 bp, Homo sapiens
tgttggatttttgtcttgtg

SEQ ID NO: 1040681 - DNA, 18 bp, Homo sapiens
tgttggcacatgcctgta

SEQ ID NO: 1040682 - DNA, 21 bp, Homo sapiens
tgttggcaggctggccagtcc

SEQ ID NO: 1040683 - DNA, 17 bp, Homo sapiens
tgttggcctccggcctc

SEQ ID NO: 1040684 - DNA, 13 bp, Homo sapiens
tgttggcctgtgg

SEQ ID NO: 1040685 - DNA, 18 bp, Homo sapiens
tgttgggaaggggtcctg

SEQ ID NO: 1040686 - DNA, 21 bp, Homo sapiens
tgttgggaaggggtcctgcag

SEQ ID NO: 1040687 - DNA, 15 bp, Homo sapiens
tgttgggattcctga

SEQ ID NO: 1040688 - DNA, 17 bp, Homo sapiens
tgttgggattcctgacc

SEQ ID NO: 1040689 - DNA, 16 bp, Homo sapiens
tgttgggcctttttcc

SEQ ID NO: 1040690 - DNA, 21 bp, Homo sapiens
tgttggtaattattttggtac

SEQ ID NO: 1040691 - DNA, 14 bp, Homo sapiens
tgttggtcatttta

SEQ ID NO: 1040692 - DNA, 18 bp, Homo sapiens
tgttggtcctctctctgt

SEQ ID NO: 1040693 - DNA, 23 bp, Homo sapiens
tgttggtctttctaatgtagcta

SEQ ID NO: 1040694 - DNA, 23 bp, Homo sapiens
tgttggtgaattttcaaggcctt

SEQ ID NO: 1040695 - DNA, 11 bp, Homo sapiens
tgttggtgcac

SEQ ID NO: 1040696 - DNA, 20 bp, Homo sapiens
tgttggtgctttagcgattg

SEQ ID NO: 1040697 - DNA, 19 bp, Homo sapiens
tgttggttgttttttcctt

SEQ ID NO: 1040698 - DNA, 16 bp, Homo sapiens
tgttggtttcagtggc

SEQ ID NO: 1040699 - DNA, 22 bp, Homo sapiens
tgttggtttcagtggctggaat

SEQ ID NO: 1040700 - DNA, 16 bp, Homo sapiens
tgtttgtctcatccca

SEQ ID NO: 1040701 - DNA, 17 bp, Homo sapiens
tgtttgtctgtcttcat

SEQ ID NO: 1040702 - DNA, 15 bp, Homo sapiens
tgtttgtggcctcag

SEQ ID NO: 1040703 - DNA, 19 bp, Homo sapiens
tgtttgttatttacactgg

SEQ ID NO: 1040704 - DNA, 13 bp, Homo sapiens
tgtttgtttaatt

SEQ ID NO: 1040705 - DNA, 13 bp, Homo sapiens
tgtttgtttcttc

SEQ ID NO: 1040706 - DNA, 14 bp, Homo sapiens
tgtttgtttcttct

SEQ ID NO: 1040707 - DNA, 21 bp, Homo sapiens
tgtttgtttcttcttttcctt

SEQ ID NO: 1040708 - DNA, 18 bp, Homo sapiens
tgttttaaaaaaactgaa

SEQ ID NO: 1040709 - DNA, 14 bp, Homo sapiens
tgttttaaaataag

SEQ ID NO: 1040710 - DNA, 20 bp, Homo sapiens
tgttttaaacatagaaagtt

SEQ ID NO: 1040711 - DNA, 22 bp, Homo sapiens
tgttttaaactacatcttgaaa

SEQ ID NO: 1040712 - DNA, 21 bp, Homo sapiens
tgttttaaactctcctagtca

SEQ ID NO: 1040713 - DNA, 19 bp, Homo sapiens
tgttttaaagaatatgact

SEQ ID NO: 1040714 - DNA, 16 bp, Homo sapiens
tgttttaagactgaat

SEQ ID NO: 1040715 - DNA, 18 bp, Homo sapiens
tgttttaaggatgcttgt

SEQ ID NO: 1040716 - DNA, 19 bp, Homo sapiens
tgttttaaggatgcttgta

SEQ ID NO: 1040717 - DNA, 22 bp, Homo sapiens
tgttttaaggatgcttgtacat

SEQ ID NO: 1040718 - DNA, 23 bp, Homo sapiens
tgttttaaggatgcttgtacata

SEQ ID NO: 1040719 - DNA, 17 bp, Homo sapiens
tgttttaataaacagta

SEQ ID NO: 1040720 - DNA, 13 bp, Homo sapiens
tgttttacaatag

SEQ ID NO: 1040721 - DNA, 16 bp, Homo sapiens
tgttttaccagctccc

SEQ ID NO: 1040722 - DNA, 22 bp, Homo sapiens
tgttttacgcaaggaaggactt

SEQ ID NO: 1040723 - DNA, 21 bp, Homo sapiens
tgttttactaaagaaagatta

SEQ ID NO: 1040724 - DNA, 16 bp, Homo sapiens
tgttttactctttttc

SEQ ID NO: 1040725 - DNA, 16 bp, Homo sapiens
tgttttagatgttact

SEQ ID NO: 1040726 - DNA, 22 bp, Homo sapiens
tgttttagatgttactacctta

SEQ ID NO: 1040727 - DNA, 16 bp, Homo sapiens
tgttttagctgaggga

SEQ ID NO: 1040728 - DNA, 23 bp, Homo sapiens
tgttttagggagtggttcctgtg

SEQ ID NO: 1040729 - DNA, 14 bp, Homo sapiens
tgttttatatcaaa

SEQ ID NO: 1040730 - DNA, 21 bp, Homo sapiens
tgttttatgttgatctgcata

SEQ ID NO: 1040731 - DNA, 16 bp, Homo sapiens
tgttttatttcattgg

SEQ ID NO: 1040732 - DNA, 14 bp, Homo sapiens
tgttttcaagatgg

SEQ ID NO: 1040733 - DNA, 20 bp, Homo sapiens
tgttttcaaggaagaaaacg

SEQ ID NO: 1040734 - DNA, 22 bp, Homo sapiens
tgttttcaaggaagaaaacgga

SEQ ID NO: 1040735 - DNA, 22 bp, Homo sapiens
tgttttcaataacaaagcacat

SEQ ID NO: 1040736 - DNA, 21 bp, Homo sapiens
tgttttcaatgtgttggaaac

SEQ ID NO: 1040737 - DNA, 16 bp, Homo sapiens
tgttttcacttgtatt

SEQ ID NO: 1040738 - DNA, 13 bp, Homo sapiens
tgttttcagcact

SEQ ID NO: 1040739 - DNA, 13 bp, Homo sapiens
tgttttcatcatt

SEQ ID NO: 1040740 - DNA, 20 bp, Homo sapiens
tgttttcatggtgaaaatgt

SEQ ID NO: 1040741 - DNA, 17 bp, Homo sapiens
tgttttccactgtgcta

SEQ ID NO: 1040742 - DNA, 18 bp, Homo sapiens
tgttttccctttaaagcc

SEQ ID NO: 1040743 - DNA, 14 bp, Homo sapiens
tgttttcctccctt

SEQ ID NO: 1040744 - DNA, 17 bp, Homo sapiens
tgttttcctgctttaca

SEQ ID NO: 1040745 - DNA, 22 bp, Homo sapiens
tgttttcctgctttacaaaatt

SEQ ID NO: 1040746 - DNA, 18 bp, Homo sapiens
tgttttcgtaccttccca

SEQ ID NO: 1040747 - DNA, 15 bp, Homo sapiens
tgttttctccctctc

SEQ ID NO: 1040748 - DNA, 12 bp, Homo sapiens
tgttttctctga

SEQ ID NO: 1040749 - DNA, 22 bp, Homo sapiens
tgttttctgaaacacacgagca

SEQ ID NO: 1040750 - DNA, 12 bp, Homo sapiens
tgttttctgaat

SEQ ID NO: 1040751 - DNA, 16 bp, Homo sapiens
tgttttctgactaatt

SEQ ID NO: 1040752 - DNA, 18 bp, Homo sapiens
tgttttctgatggccaaa

SEQ ID NO: 1040753 - DNA, 16 bp, Homo sapiens
tgttttctgtaaataa

SEQ ID NO: 1040754 - DNA, 17 bp, Homo sapiens
tgttttctgtaaataac

SEQ ID NO: 1040755 - DNA, 21 bp, Homo sapiens
tgttttcttgtaaatgtttct

SEQ ID NO: 1040756 - DNA, 16 bp, Homo sapiens
tgttttcttgtctgtg

SEQ ID NO: 1040757 - DNA, 17 bp, Homo sapiens
tgttttcttgtctgtgt

SEQ ID NO: 1040758 - DNA, 21 bp, Homo sapiens
tgttttctttaaagatgtaat

SEQ ID NO: 1040759 - DNA, 15 bp, Homo sapiens
tgttttctttgagga

SEQ ID NO: 1040760 - DNA, 17 bp, Homo sapiens
tgttttgaaactcagta

SEQ ID NO: 1040761 - DNA, 19 bp, Homo sapiens
tgttttgaaagtttaacaa

SEQ ID NO: 1040762 - DNA, 17 bp, Homo sapiens
tgttttgaaggcaaaat

SEQ ID NO: 1040763 - DNA, 17 bp, Homo sapiens
tgttttgacggatgatt

SEQ ID NO: 1040764 - DNA, 16 bp, Homo sapiens
tgttttgagctttcca

SEQ ID NO: 1040765 - DNA, 19 bp, Homo sapiens
tgttttgagctttccatgt

SEQ ID NO: 1040766 - DNA, 20 bp, Homo sapiens
tgttttgcacgtcttgctat

SEQ ID NO: 1040767 - DNA, 20 bp, Homo sapiens
tgttttgccaaagactgtaa

SEQ ID NO: 1040768 - DNA, 13 bp, Homo sapiens
tgttttggagaaa

SEQ ID NO: 1040769 - DNA, 15 bp, Homo sapiens
tgttttggagaaaaa

SEQ ID NO: 1040770 - DNA, 18 bp, Homo sapiens
tgttttggctgaaattct

SEQ ID NO: 1040771 - DNA, 23 bp, Homo sapiens
tgttttggctgaaattctcctgg

SEQ ID NO: 1040772 - DNA, 20 bp, Homo sapiens
tgttttggtcccctccctcg

SEQ ID NO: 1040773 - DNA, 17 bp, Homo sapiens
tgttttgtaaacattta

SEQ ID NO: 1040774 - DNA, 17 bp, Homo sapiens
tgttttgtacaattact

SEQ ID NO: 1040775 - DNA, 13 bp, Homo sapiens
tgttttgtagatg

SEQ ID NO: 1040776 - DNA, 15 bp, Homo sapiens
tgttttgtatatgat

SEQ ID NO: 1040777 - DNA, 18 bp, Homo sapiens
tgttttgtatatgatcta

SEQ ID NO: 1040778 - DNA, 13 bp, Homo sapiens
tgttttgtatgag

SEQ ID NO: 1040779 - DNA, 17 bp, Homo sapiens
tgttttgtcctgcctct

SEQ ID NO: 1040780 - DNA, 17 bp, Homo sapiens
tgttttgtcttacaaag

SEQ ID NO: 1040781 - DNA, 15 bp, Homo sapiens
tgttttgtgttgtgt

SEQ ID NO: 1040782 - DNA, 12 bp, Homo sapiens
tgttttgttaat

SEQ ID NO: 1040783 - DNA, 15 bp, Homo sapiens
tgttttgttaatata

SEQ ID NO: 1040784 - DNA, 12 bp, Homo sapiens
tgttttgttgac

SEQ ID NO: 1040785 - DNA, 13 bp, Homo sapiens
tgttttgttgaca

SEQ ID NO: 1040786 - DNA, 15 bp, Homo sapiens
tgttttgttgacatt

SEQ ID NO: 1040787 - DNA, 21 bp, Homo sapiens
tgttttgttgacattctgaat

SEQ ID NO: 1040788 - DNA, 10 bp, Homo sapiens
tgtttttaaa

SEQ ID NO: 1040789 - DNA, 12 bp, Homo sapiens
tgtttttaaaag

SEQ ID NO: 1040790 - DNA, 23 bp, Homo sapiens
tgtttttaaactgtacagtgtct

SEQ ID NO: 1040791 - DNA, 13 bp, Homo sapiens
tgtttttaacaga

SEQ ID NO: 1040792 - DNA, 17 bp, Homo sapiens
tgtttttaagctgtttc

SEQ ID NO: 1040793 - DNA, 16 bp, Homo sapiens
tgtttttaatctcctg

SEQ ID NO: 1040794 - DNA, 13 bp, Homo sapiens
tgtttttaatgac

SEQ ID NO: 1040795 - DNA, 13 bp, Homo sapiens
tgtttttacatta

SEQ ID NO: 1040796 - DNA, 21 bp, Homo sapiens
tgtttttagagcttccaaatg

SEQ ID NO: 1040797 - DNA, 22 bp, Homo sapiens
tgtttttagagcttccaaatgt

SEQ ID NO: 1040798 - DNA, 16 bp, Homo sapiens
tgtttttatcttttta

SEQ ID NO: 1040799 - DNA, 18 bp, Homo sapiens
tgtttttattaatttata

SEQ ID NO: 1040800 - DNA, 13 bp, Homo sapiens
tgtttttcacatt

SEQ ID NO: 1040801 - DNA, 14 bp, Homo sapiens
tgtttttcatgaaa

SEQ ID NO: 1040802 - DNA, 20 bp, Homo sapiens
tgtttttccttgtatttaaa

SEQ ID NO: 1040803 - DNA, 12 bp, Homo sapiens
tgtttttctcac

SEQ ID NO: 1040804 - DNA, 12 bp, Homo sapiens
tgtttttctggg

SEQ ID NO: 1040805 - DNA, 16 bp, Homo sapiens
tgtttttgaaggcaga

SEQ ID NO: 1040806 - DNA, 20 bp, Homo sapiens
tgtttttgaaggcagaaagc

SEQ ID NO: 1040807 - DNA, 13 bp, Homo sapiens
tgtttttgaattt

SEQ ID NO: 1040808 - DNA, 14 bp, Homo sapiens
tgtttttgcatttt

SEQ ID NO: 1040809 - DNA, 15 bp, Homo sapiens
tgtttttgcattttt

SEQ ID NO: 1040810 - DNA, 13 bp, Homo sapiens
tgtttttgccaaa

SEQ ID NO: 1040811 - DNA, 20 bp, Homo sapiens
tgtttttgcttgttatatta

SEQ ID NO: 1040812 - DNA, 16 bp, Homo sapiens
tgtttttggaaagaaa

SEQ ID NO: 1040813 - DNA, 16 bp, Homo sapiens
tgtttttgtatcttta

SEQ ID NO: 1040814 - DNA, 13 bp, Homo sapiens
tgtttttgtctta

SEQ ID NO: 1040815 - DNA, 15 bp, Homo sapiens
tgtttttgttgtgtg

SEQ ID NO: 1040816 - DNA, 12 bp, Homo sapiens
tgttttttaaga

SEQ ID NO: 1040817 - DNA, 14 bp, Homo sapiens
ttaaaagtaggaaa

SEQ ID NO: 1040818 - DNA, 23 bp, Homo sapiens
ttaaaagtgttgattacataatc

SEQ ID NO: 1040819 - DNA, 17 bp, Homo sapiens
ttaaaagtttcaatgtg

SEQ ID NO: 1040820 - DNA, 22 bp, Homo sapiens
ttaaaagtttcaatgtgattct

SEQ ID NO: 1040821 - DNA, 14 bp, Homo sapiens
ttaaaataaaacaa

SEQ ID NO: 1040822 - DNA, 15 bp, Homo sapiens
ttaaaataaaacaag

SEQ ID NO: 1040823 - DNA, 17 bp, Homo sapiens
ttaaaataaaacaagcc

SEQ ID NO: 1040824 - DNA, 18 bp, Homo sapiens
ttaaaataaaacaagcct

SEQ ID NO: 1040825 - DNA, 19 bp, Homo sapiens
ttaaaataaaacaagcctt

SEQ ID NO: 1040826 - DNA, 21 bp, Homo sapiens
ttaaaataaaatgaaaattgt

SEQ ID NO: 1040827 - DNA, 14 bp, Homo sapiens
ttaaaataaatatt

SEQ ID NO: 1040828 - DNA, 14 bp, Homo sapiens
ttaaaataaatggt

SEQ ID NO: 1040829 - DNA, 11 bp, Homo sapiens
ttaaaatacaa

SEQ ID NO: 1040830 - DNA, 17 bp, Homo sapiens
tgcctcaagttccatgc

SEQ ID NO: 1040831 - DNA, 19 bp, Homo sapiens
tgcctcaagttccatgctt

SEQ ID NO: 1040832 - DNA, 13 bp, Homo sapiens
tgcctcaatgcca

SEQ ID NO: 1040833 - DNA, 24 bp, Homo sapiens
tgcctcaatgtgaatcagacccta

SEQ ID NO: 1040834 - DNA, 19 bp, Homo sapiens
tgcctcaatgtgaccaggg

SEQ ID NO: 1040835 - DNA, 23 bp, Homo sapiens
tgcctcaatgtgaccaggggtga

SEQ ID NO: 1040836 - DNA, 18 bp, Homo sapiens
tgcctcaccacacccagg

SEQ ID NO: 1040837 - DNA, 21 bp, Homo sapiens
tgcctcaccacacccaggtct

SEQ ID NO: 1040838 - DNA, 15 bp, Homo sapiens
tgcctcactttcttc

SEQ ID NO: 1040839 - DNA, 18 bp, Homo sapiens
tgcctcagagaccagggc

SEQ ID NO: 1040840 - DNA, 19 bp, Homo sapiens
tgcctcagagaccagggct

SEQ ID NO: 1040841 - DNA, 15 bp, Homo sapiens
tgcctcagagcaggc

SEQ ID NO: 1040842 - DNA, 23 bp, Homo sapiens
tgcctcagccacttgcctgtgct

SEQ ID NO: 1040843 - DNA, 14 bp, Homo sapiens
tgcctcagccaggc

SEQ ID NO: 1040844 - DNA, 19 bp, Homo sapiens
tgcctcagccctgaccctg

SEQ ID NO: 1040845 - DNA, 19 bp, Homo sapiens
tgcctcagccttctgagta

SEQ ID NO: 1040846 - DNA, 13 bp, Homo sapiens
tgcctcagctatg

SEQ ID NO: 1040847 - DNA, 20 bp, Homo sapiens
tgcctcaggccagggctcac

SEQ ID NO: 1040848 - DNA, 18 bp, Homo sapiens
tgcctcagtaaaatgaac

SEQ ID NO: 1040849 - DNA, 15 bp, Homo sapiens
tgcctcagtgtattt

SEQ ID NO: 1040850 - DNA, 17 bp, Homo sapiens
tgcctcagttttccttc

SEQ ID NO: 1040851 - DNA, 23 bp, Homo sapiens
tgcctcagttttccttctgttaa

SEQ ID NO: 1040852 - DNA, 18 bp, Homo sapiens
tgcctcatagcatagcca

SEQ ID NO: 1040853 - DNA, 22 bp, Homo sapiens
tgcctcatagcatagccagcat

SEQ ID NO: 1040854 - DNA, 20 bp, Homo sapiens
tgcctcatctataacatgca

SEQ ID NO: 1040855 - DNA, 15 bp, Homo sapiens
tgcctccacatgctg

SEQ ID NO: 1040856 - DNA, 16 bp, Homo sapiens
tgcctccacatgctgc

SEQ ID NO: 1040857 - DNA, 22 bp, Homo sapiens
tgcctccacatgctgcctggca

SEQ ID NO: 1040858 - DNA, 12 bp, Homo sapiens
tgcctccaccac

SEQ ID NO: 1040859 - DNA, 22 bp, Homo sapiens
tgcctccaccaccactggccac

SEQ ID NO: 1040860 - DNA, 16 bp, Homo sapiens
tgcctccacccgtcct

SEQ ID NO: 1040861 - DNA, 20 bp, Homo sapiens
tgcctccacccgtcctccct

SEQ ID NO: 1040862 - DNA, 20 bp, Homo sapiens
tgcctccaccgctgcctaag

SEQ ID NO: 1040863 - DNA, 14 bp, Homo sapiens
tgcctccaggaacc

SEQ ID NO: 1040864 - DNA, 14 bp, Homo sapiens
tgcctccaggacca

SEQ ID NO: 1040865 - DNA, 15 bp, Homo sapiens
tgcctccaggaccag

SEQ ID NO: 1040866 - DNA, 13 bp, Homo sapiens
tgcctccaggtgt

SEQ ID NO: 1040867 - DNA, 17 bp, Homo sapiens
tgcctccaggtgtgcac

SEQ ID NO: 1040868 - DNA, 14 bp, Homo sapiens
tgcctcccaggcaa

SEQ ID NO: 1040869 - DNA, 21 bp, Homo sapiens
tgcctcccaggcaagcagctg

SEQ ID NO: 1040870 - DNA, 16 bp, Homo sapiens
tgcctcccaggttcca

SEQ ID NO: 1040871 - DNA, 17 bp, Homo sapiens
tgcctcccattctgcac

SEQ ID NO: 1040872 - DNA, 19 bp, Homo sapiens
tgcctcccattctgcacca

SEQ ID NO: 1040873 - DNA, 15 bp, Homo sapiens
tgcctccccaaccct

SEQ ID NO: 1040874 - DNA, 17 bp, Homo sapiens
tgcctccccatttccca

SEQ ID NO: 1040875 - DNA, 20 bp, Homo sapiens
tgcctccccatttcccatct

SEQ ID NO: 1040876 - DNA, 16 bp, Homo sapiens
tgcctccccccagacc

SEQ ID NO: 1040877 - DNA, 22 bp, Homo sapiens
tgcctccccccagaccccgccc

SEQ ID NO: 1040878 - DNA, 18 bp, Homo sapiens
tgcctcccctctccttcc

SEQ ID NO: 1040879 - DNA, 16 bp, Homo sapiens
tgcctccctcaccctg

SEQ ID NO: 1040880 - DNA, 14 bp, Homo sapiens
tgcctccctctctt

SEQ ID NO: 1040881 - DNA, 20 bp, Homo sapiens
tgcctccctctcttccggga

SEQ ID NO: 1040882 - DNA, 12 bp, Homo sapiens
tgcctcccttga

SEQ ID NO: 1040883 - DNA, 14 bp, Homo sapiens
tgcctccctttctg

SEQ ID NO: 1040884 - DNA, 22 bp, Homo sapiens
tgcctcctaggctggaagccat

SEQ ID NO: 1040885 - DNA, 19 bp, Homo sapiens
tgcctcctcaaacccagtc

SEQ ID NO: 1040886 - DNA, 22 bp, Homo sapiens
tgcctcctcaaacccagtctca

SEQ ID NO: 1040887 - DNA, 16 bp, Homo sapiens
tgcctcctcaggagcc

SEQ ID NO: 1040888 - DNA, 19 bp, Homo sapiens
tgcctcctccctcccagct

SEQ ID NO: 1040889 - DNA, 16 bp, Homo sapiens
tgcctcctcgttcctt

SEQ ID NO: 1040890 - DNA, 13 bp, Homo sapiens
tgcctcctgcagt

SEQ ID NO: 1040891 - DNA, 15 bp, Homo sapiens
tgcctcctgcagttt

SEQ ID NO: 1040892 - DNA, 15 bp, Homo sapiens
tgccctagctgaccc

SEQ ID NO: 1040893 - DNA, 15 bp, Homo sapiens
tgccctatgctgtgc

SEQ ID NO: 1040894 - DNA, 16 bp, Homo sapiens
tgccctatggatttga

SEQ ID NO: 1040895 - DNA, 16 bp, Homo sapiens
tgccctatgggcctgc

SEQ ID NO: 1040896 - DNA, 19 bp, Homo sapiens
tgccctcaagagcaaagta

SEQ ID NO: 1040897 - DNA, 14 bp, Homo sapiens
tgccctcactccct

SEQ ID NO: 1040898 - DNA, 19 bp, Homo sapiens
tgccctcactccctctgca

SEQ ID NO: 1040899 - DNA, 21 bp, Homo sapiens
tgccctcagcctgttgcccct

SEQ ID NO: 1040900 - DNA, 17 bp, Homo sapiens
tgccctcatggcccctc

SEQ ID NO: 1040901 - DNA, 19 bp, Homo sapiens
tgccctcatggcccctctg

SEQ ID NO: 1040902 - DNA, 18 bp, Homo sapiens
tgccctccaaagagcctt

SEQ ID NO: 1040903 - DNA, 17 bp, Homo sapiens
tgccctccatcccgaca

SEQ ID NO: 1040904 - DNA, 20 bp, Homo sapiens
tgccctccatcccgacatgg

SEQ ID NO: 1040905 - DNA, 13 bp, Homo sapiens
tgccctcccagga

SEQ ID NO: 1040906 - DNA, 16 bp, Homo sapiens
tgccctcccctcagcg

SEQ ID NO: 1040907 - DNA, 21 bp, Homo sapiens
tgccctcccctcagcgcaggc

SEQ ID NO: 1040908 - DNA, 16 bp, Homo sapiens
tgccctcccctgtccc

SEQ ID NO: 1040909 - DNA, 14 bp, Homo sapiens
tgccctcccttctc

SEQ ID NO: 1040910 - DNA, 17 bp, Homo sapiens
tgccctccgcctgggat

SEQ ID NO: 1040911 - DNA, 14 bp, Homo sapiens
tgccctccggagga

SEQ ID NO: 1040912 - DNA, 21 bp, Homo sapiens
tgccctccggaggagcagcct

SEQ ID NO: 1040913 - DNA, 14 bp, Homo sapiens
tgccctcctctccc

SEQ ID NO: 1040914 - DNA, 18 bp, Homo sapiens
tgccctcctgagcctccg

SEQ ID NO: 1040915 - DNA, 13 bp, Homo sapiens
tgccctcctgccc

SEQ ID NO: 1040916 - DNA, 11 bp, Homo sapiens
tgccctcctgg

SEQ ID NO: 1040917 - DNA, 12 bp, Homo sapiens
tgccctcctgga

SEQ ID NO: 1040918 - DNA, 14 bp, Homo sapiens
tgccctcgctgctt

SEQ ID NO: 1040919 - DNA, 17 bp, Homo sapiens
tgccctcgctgcttctg

SEQ ID NO: 1040920 - DNA, 22 bp, Homo sapiens
tgccctctccctgtgttctggg

SEQ ID NO: 1040921 - DNA, 23 bp, Homo sapiens
tgccctctccctgtgttctgggc

SEQ ID NO: 1040922 - DNA, 19 bp, Homo sapiens
tgccctctgctcaggcctc

SEQ ID NO: 1040923 - DNA, 19 bp, Homo sapiens
tgccctctgctctgcctgg

SEQ ID NO: 1040924 - DNA, 21 bp, Homo sapiens
tgccctcttaagatctgactg

SEQ ID NO: 1040925 - DNA, 15 bp, Homo sapiens
tgccctgacctccca

SEQ ID NO: 1040926 - DNA, 18 bp, Homo sapiens
tgccctgacctcccagcc

SEQ ID NO: 1040927 - DNA, 21 bp, Homo sapiens
tgccctgacctcccagcccta

SEQ ID NO: 1040928 - DNA, 13 bp, Homo sapiens
tgccctgaggggc

SEQ ID NO: 1040929 - DNA, 21 bp, Homo sapiens
tgccctgaggggctggggagg

SEQ ID NO: 1040930 - DNA, 22 bp, Homo sapiens
tgccctgagtggatctccaagg

SEQ ID NO: 1040931 - DNA, 13 bp, Homo sapiens
tgccctgcagagc

SEQ ID NO: 1040932 - DNA, 15 bp, Homo sapiens
tgccctgcagagcaa

SEQ ID NO: 1040933 - DNA, 19 bp, Homo sapiens
tgccctgcagagcaataac

SEQ ID NO: 1040934 - DNA, 21 bp, Homo sapiens
tgccctgcagagcaataacac

SEQ ID NO: 1040935 - DNA, 22 bp, Homo sapiens
tgccctgcagagcaataacact

SEQ ID NO: 1040936 - DNA, 14 bp, Homo sapiens
tgccctgcagcacg

SEQ ID NO: 1040937 - DNA, 13 bp, Homo sapiens
tgccctgcaggca

SEQ ID NO: 1040938 - DNA, 16 bp, Homo sapiens
tgcctgacacactaac

SEQ ID NO: 1040939 - DNA, 15 bp, Homo sapiens
tgcctgacactgagc

SEQ ID NO: 1040940 - DNA, 19 bp, Homo sapiens
tgcctgacactgagcccca

SEQ ID NO: 1040941 - DNA, 17 bp, Homo sapiens
tgcctgaccccttgctc

SEQ ID NO: 1040942 - DNA, 16 bp, Homo sapiens
tgcctgactaattttt

SEQ ID NO: 1040943 - DNA, 20 bp, Homo sapiens
tgcctgactaatttttgtat

SEQ ID NO: 1040944 - DNA, 14 bp, Homo sapiens
tgcctgagaagaag

SEQ ID NO: 1040945 - DNA, 23 bp, Homo sapiens
tgcctgagaagaagtggctgcca

SEQ ID NO: 1040946 - DNA, 13 bp, Homo sapiens
tgcctgagaggca

SEQ ID NO: 1040947 - DNA, 16 bp, Homo sapiens
tgcctgagaggcaggc

SEQ ID NO: 1040948 - DNA, 11 bp, Homo sapiens
tgcctgagctg

SEQ ID NO: 1040949 - DNA, 17 bp, Homo sapiens
tgcctgagctggggaag

SEQ ID NO: 1040950 - DNA, 23 bp, Homo sapiens
tgcctgaggaggaggacacagca

SEQ ID NO: 1040951 - DNA, 20 bp, Homo sapiens
tgcctgagggcccctctgcc

SEQ ID NO: 1040952 - DNA, 21 bp, Homo sapiens
tgcctgagggcccctctgccc

SEQ ID NO: 1040953 - DNA, 22 bp, Homo sapiens
tgcctgagggcccctctgccca

SEQ ID NO: 1040954 - DNA, 14 bp, Homo sapiens
tgcctgagggtgga

SEQ ID NO: 1040955 - DNA, 15 bp, Homo sapiens
tgcctgagtttccag

SEQ ID NO: 1040956 - DNA, 15 bp, Homo sapiens
tgcctgatataaatg

SEQ ID NO: 1040957 - DNA, 17 bp, Homo sapiens
tgcctgatccctgaacc

SEQ ID NO: 1040958 - DNA, 22 bp, Homo sapiens
tgcctgatccctgaacccctgg

SEQ ID NO: 1040959 - DNA, 23 bp, Homo sapiens
tgcctgatccctgaacccctggc

SEQ ID NO: 1040960 - DNA, 20 bp, Homo sapiens
tgcctgattcggacggccaa

SEQ ID NO: 1040961 - DNA, 15 bp, Homo sapiens
tgcctgcactccctg

SEQ ID NO: 1040962 - DNA, 15 bp, Homo sapiens
tgcctgcactgggaa

SEQ ID NO: 1040963 - DNA, 14 bp, Homo sapiens
tgcctgcagagaga

SEQ ID NO: 1040964 - DNA, 16 bp, Homo sapiens
tgcctgcagagagaag

SEQ ID NO: 1040965 - DNA, 21 bp, Homo sapiens
tgcctgcagaggtctgtgctg

SEQ ID NO: 1040966 - DNA, 13 bp, Homo sapiens
tgcctgcagcaca

SEQ ID NO: 1040967 - DNA, 15 bp, Homo sapiens
tgcctgcagcacatg

SEQ ID NO: 1040968 - DNA, 20 bp, Homo sapiens
tgcctgcagcacatgcgggc

SEQ ID NO: 1040969 - DNA, 14 bp, Homo sapiens
tgcctgcagcgcct

SEQ ID NO: 1040970 - DNA, 16 bp, Homo sapiens
tgcctgcagtttcttg

SEQ ID NO: 1040971 - DNA, 14 bp, Homo sapiens
tgcctgccaccgcg

SEQ ID NO: 1040972 - DNA, 16 bp, Homo sapiens
tgcctgcccacccgtg

SEQ ID NO: 1040973 - DNA, 20 bp, Homo sapiens
tgcctgccccaaacaaatat

SEQ ID NO: 1040974 - DNA, 15 bp, Homo sapiens
tgcctgccccacacg

SEQ ID NO: 1040975 - DNA, 20 bp, Homo sapiens
tgcctgccccccagtctccc

SEQ ID NO: 1040976 - DNA, 21 bp, Homo sapiens
tgcctgcccctaccctggact

SEQ ID NO: 1040977 - DNA, 22 bp, Homo sapiens
tgcctgccctctgtctgtcttc

SEQ ID NO: 1040978 - DNA, 12 bp, Homo sapiens
tgcctgccctgg

SEQ ID NO: 1040979 - DNA, 14 bp, Homo sapiens
tgcctgccctggag

SEQ ID NO: 1040980 - DNA, 15 bp, Homo sapiens
tgcctgccgctgcag

SEQ ID NO: 1040981 - DNA, 20 bp, Homo sapiens
tgcctgccgctgcaggaaac

SEQ ID NO: 1040982 - DNA, 23 bp, Homo sapiens
tgcctgcctcctaggctggaagc

SEQ ID NO: 1040983 - DNA, 21 bp, Homo sapiens
tgcctgcctgtctgtctctcc

SEQ ID NO: 1040984 - DNA, 15 bp, Homo sapiens
tgcctgcgcctgctg

SEQ ID NO: 1040985 - DNA, 14 bp, Homo sapiens
tgcctgctagagca

SEQ ID NO: 1040986 - DNA, 17 bp, Homo sapiens
tgcctgctcagcagcca

SEQ ID NO: 1040987 - DNA, 24 bp, Homo sapiens
tgcctgctcctgcttaaacacaag

SEQ ID NO: 1040988 - DNA, 15 bp, Homo sapiens
tgcctgctcctgtac

SEQ ID NO: 1040989 - DNA, 10 bp, Homo sapiens
tgcctgctga

SEQ ID NO: 1040990 - DNA, 14 bp, Homo sapiens
tgcctgctgtattt

SEQ ID NO: 1040991 - DNA, 21 bp, Homo sapiens
tgcctgctgtgttaagaggac

SEQ ID NO: 1040992 - DNA, 13 bp, Homo sapiens
tgcctgcttttga

SEQ ID NO: 1040993 - DNA, 16 bp, Homo sapiens
tgcctgcttttgatga

SEQ ID NO: 1040994 - DNA, 19 bp, Homo sapiens
tgcctgcttttgatgatgt

SEQ ID NO: 1040995 - DNA, 17 bp, Homo sapiens
tgcgtgtgtccatgtgt

SEQ ID NO: 1040996 - DNA, 21 bp, Homo sapiens
tgcgtgtgtctctgtctctcc

SEQ ID NO: 1040997 - DNA, 18 bp, Homo sapiens
tgcgtgttcagcagaacc

SEQ ID NO: 1040998 - DNA, 20 bp, Homo sapiens
tgcgtgttcagcagaacctg

SEQ ID NO: 1040999 - DNA, 15 bp, Homo sapiens
tgcgttaggcagggc

SEQ ID NO: 1041000 - DNA, 13 bp, Homo sapiens
tgcgttcaaagag

SEQ ID NO: 1041001 - DNA, 12 bp, Homo sapiens
tgcgttctccca

SEQ ID NO: 1041002 - DNA, 14 bp, Homo sapiens
tgcgttctcccagc

SEQ ID NO: 1041003 - DNA, 13 bp, Homo sapiens
tgcgttggagcca

SEQ ID NO: 1041004 - DNA, 16 bp, Homo sapiens
tgcgttggagccactc

SEQ ID NO: 1041005 - DNA, 13 bp, Homo sapiens
tgcgtttgcctcc

SEQ ID NO: 1041006 - DNA, 15 bp, Homo sapiens
tgcgtttgcctcctg

SEQ ID NO: 1041007 - DNA, 19 bp, Homo sapiens
tgctaaaaaataaataaaa

SEQ ID NO: 1041008 - DNA, 15 bp, Homo sapiens
tgctaaaagaagaga

SEQ ID NO: 1041009 - DNA, 18 bp, Homo sapiens
tgctaaacaagtaagaaa

SEQ ID NO: 1041010 - DNA, 21 bp, Homo sapiens
tgctaaacaagtaagaaaaat

SEQ ID NO: 1041011 - DNA, 19 bp, Homo sapiens
tgctaaagcactttgcact

SEQ ID NO: 1041012 - DNA, 13 bp, Homo sapiens
tgctaaagccagg

SEQ ID NO: 1041013 - DNA, 14 bp, Homo sapiens
tgctaaagccagga

SEQ ID NO: 1041014 - DNA, 21 bp, Homo sapiens
tgctaaataaaatttgttgca

SEQ ID NO: 1041015 - DNA, 17 bp, Homo sapiens
tgctaaatgcactgacc

SEQ ID NO: 1041016 - DNA, 20 bp, Homo sapiens
tgctaaatggtcgcccagga

SEQ ID NO: 1041017 - DNA, 22 bp, Homo sapiens
tgctaaatggtcgcccaggaga

SEQ ID NO: 1041018 - DNA, 22 bp, Homo sapiens
tgctaacaaagacaaaagtctg

SEQ ID NO: 1041019 - DNA, 16 bp, Homo sapiens
tgctaacatctaaaaa

SEQ ID NO: 1041020 - DNA, 14 bp, Homo sapiens
tgctaacctggaaa

SEQ ID NO: 1041021 - DNA, 18 bp, Homo sapiens
tgctaagaagctaaagtc

SEQ ID NO: 1041022 - DNA, 13 bp, Homo sapiens
tgctaagactaac

SEQ ID NO: 1041023 - DNA, 13 bp, Homo sapiens
tgctaagagaagt

SEQ ID NO: 1041024 - DNA, 19 bp, Homo sapiens
tgctaaggctcctccttgc

SEQ ID NO: 1041025 - DNA, 12 bp, Homo sapiens
tgctaaggctgc

SEQ ID NO: 1041026 - DNA, 17 bp, Homo sapiens
tgctaagtaatttagaa

SEQ ID NO: 1041027 - DNA, 17 bp, Homo sapiens
tgctaagtatttcccag

SEQ ID NO: 1041028 - DNA, 16 bp, Homo sapiens
tgctaagtctttccca

SEQ ID NO: 1041029 - DNA, 12 bp, Homo sapiens
tgctaataaaac

SEQ ID NO: 1041030 - DNA, 21 bp, Homo sapiens
tgctaatatactttttttgtt

SEQ ID NO: 1041031 - DNA, 16 bp, Homo sapiens
tgctaatcaaagccag

SEQ ID NO: 1041032 - DNA, 20 bp, Homo sapiens
tgctaatcaaagccagggtc

SEQ ID NO: 1041033 - DNA, 23 bp, Homo sapiens
tgctaatcatgtgggtgagccag

SEQ ID NO: 1041034 - DNA, 20 bp, Homo sapiens
tgctaatcttcttatgcaat

SEQ ID NO: 1041035 - DNA, 13 bp, Homo sapiens
tgctaatcttgtc

SEQ ID NO: 1041036 - DNA, 16 bp, Homo sapiens
tgctaatttaaagaga

SEQ ID NO: 1041037 - DNA, 15 bp, Homo sapiens
tgctacaacatgtga

SEQ ID NO: 1041038 - DNA, 15 bp, Homo sapiens
tgctacaagtgtttt

SEQ ID NO: 1041039 - DNA, 17 bp, Homo sapiens
tgctacacagaatgcaa

SEQ ID NO: 1041040 - DNA, 17 bp, Homo sapiens
tgctacaccccttttcc

SEQ ID NO: 1041041 - DNA, 13 bp, Homo sapiens
tgctacagtaata

SEQ ID NO: 1041042 - DNA, 16 bp, Homo sapiens
tgctacagttagtctt

SEQ ID NO: 1041043 - DNA, 18 bp, Homo sapiens
tgctaccaggatgctaaa

SEQ ID NO: 1041044 - DNA, 18 bp, Homo sapiens
tgctaccagtatttagaa

SEQ ID NO: 1041045 - DNA, 20 bp, Homo sapiens
tgctaccgccctgggctgga

SEQ ID NO: 1041046 - DNA, 23 bp, Homo sapiens
tgctaccgccctgggctggactg

SEQ ID NO: 1041047 - DNA, 15 bp, Homo sapiens
tgctaccgttgactt

SEQ ID NO: 1041048 - DNA, 16 bp, Homo sapiens
tgctacctcactgggg

SEQ ID NO: 1041049 - DNA, 18 bp, Homo sapiens
tgctactaagttcacatt

SEQ ID NO: 1041050 - DNA, 12 bp, Homo sapiens
tgctactcctgt

SEQ ID NO: 1041051 - DNA, 15 bp, Homo sapiens
tgctactctgttcct

SEQ ID NO: 1041052 - DNA, 16 bp, Homo sapiens
tgctactctgttcctt

SEQ ID NO: 1041053 - DNA, 14 bp, Homo sapiens
tgctactgattgtt

SEQ ID NO: 1041054 - DNA, 21 bp, Homo sapiens
tgctactgcactccagcctgg

SEQ ID NO: 1041055 - DNA, 16 bp, Homo sapiens
tgctactgcccctctc

SEQ ID NO: 1041056 - DNA, 16 bp, Homo sapiens
tgctactgtcttacta

SEQ ID NO: 1041057 - DNA, 23 bp, Homo sapiens
tgctacttttttttagttcaata

SEQ ID NO: 1041058 - DNA, 23 bp, Homo sapiens
tgctagaaagttagggggttctt

SEQ ID NO: 1041059 - DNA, 16 bp, Homo sapiens
tgctagaatacttttt

SEQ ID NO: 1041060 - DNA, 21 bp, Homo sapiens
tgctagacagaaaccaagcca

SEQ ID NO: 1041061 - DNA, 22 bp, Homo sapiens
tgctagacagaaaccaagccat

SEQ ID NO: 1041062 - DNA, 20 bp, Homo sapiens
tgctagactttctggagtga

SEQ ID NO: 1041063 - DNA, 22 bp, Homo sapiens
tgctagagcaacccctgtaccc

SEQ ID NO: 1041064 - DNA, 14 bp, Homo sapiens
tgctagataaaagc

SEQ ID NO: 1041065 - DNA, 19 bp, Homo sapiens
tgctagatgtgcaaatgca

SEQ ID NO: 1041066 - DNA, 17 bp, Homo sapiens
tgctagattttaattta

SEQ ID NO: 1041067 - DNA, 23 bp, Homo sapiens
tgctagattttaatttatttgtt

SEQ ID NO: 1041068 - DNA, 14 bp, Homo sapiens
tgctagcaggcccc

SEQ ID NO: 1041069 - DNA, 18 bp, Homo sapiens
tgctagcagtaaaagatg

SEQ ID NO: 1041070 - DNA, 20 bp, Homo sapiens
tgctagcccttcaagtgcac

SEQ ID NO: 1041071 - DNA, 20 bp, Homo sapiens
tgctagccggccactttgga

SEQ ID NO: 1041072 - DNA, 12 bp, Homo sapiens
tgctaggaagag

SEQ ID NO: 1041073 - DNA, 18 bp, Homo sapiens
tgctaggaagaggagtgg

SEQ ID NO: 1041074 - DNA, 21 bp, Homo sapiens
tgctaggacgcaataaattta

SEQ ID NO: 1041075 - DNA, 20 bp, Homo sapiens
tgctaggatgcggaaatccc

SEQ ID NO: 1041076 - DNA, 19 bp, Homo sapiens
tgctagggagagggaagag

SEQ ID NO: 1041077 - DNA, 19 bp, Homo sapiens
tgctaggggatgaggggct

SEQ ID NO: 1041078 - DNA, 15 bp, Homo sapiens
tgctaggtgggccag

SEQ ID NO: 1041079 - DNA, 17 bp, Homo sapiens
tgctaggtgggccagcc

SEQ ID NO: 1041080 - DNA, 19 bp, Homo sapiens
tgctagtatcttgggtgta

SEQ ID NO: 1041081 - DNA, 22 bp, Homo sapiens
tgctagtctgccctatggattt

SEQ ID NO: 1041082 - DNA, 22 bp, Homo sapiens
tgctagtgggccctctctctgg

SEQ ID NO: 1041083 - DNA, 19 bp, Homo sapiens
tgctagttctgctgccctc

SEQ ID NO: 1041084 - DNA, 18 bp, Homo sapiens
tgctagtttattggaagt

SEQ ID NO: 1041085 - DNA, 16 bp, Homo sapiens
tgctagttttacagat

SEQ ID NO: 1041086 - DNA, 22 bp, Homo sapiens
tgctagttttttgcttctcttt

SEQ ID NO: 1041087 - DNA, 22 bp, Homo sapiens
tgctataatcattagttttaga

SEQ ID NO: 1041088 - DNA, 13 bp, Homo sapiens
tgctataatctgt

SEQ ID NO: 1041089 - DNA, 13 bp, Homo sapiens
tgctatacatgtt

SEQ ID NO: 1041090 - DNA, 13 bp, Homo sapiens
tgctatactgcat

SEQ ID NO: 1041091 - DNA, 19 bp, Homo sapiens
tgctatactggaaatgtaa

SEQ ID NO: 1041092 - DNA, 19 bp, Homo sapiens
tgctataggctggagaagc

SEQ ID NO: 1041093 - DNA, 23 bp, Homo sapiens
tgctataggctggagaagctcac

SEQ ID NO: 1041094 - DNA, 21 bp, Homo sapiens
tgctatagtatttgattcaaa

SEQ ID NO: 1041095 - DNA, 22 bp, Homo sapiens
tgctatagtatttgattcaaaa

SEQ ID NO: 1041096 - DNA, 21 bp, Homo sapiens
tgctatagtgtataccacctg

SEQ ID NO: 1041097 - DNA, 22 bp, Homo sapiens
tgctatagtgtataccacctgt

SEQ ID NO: 1041098 - DNA, 23 bp, Homo sapiens
tgctatagtgtataccacctgta

SEQ ID NO: 1041099 - DNA, 13 bp, Homo sapiens
tgctatataattg

SEQ ID NO: 1041100 - DNA, 19 bp, Homo sapiens
tgctatatccagttcctgc

SEQ ID NO: 1041101 - DNA, 20 bp, Homo sapiens
tgctatatccagttcctgct

SEQ ID NO: 1041102 - DNA, 20 bp, Homo sapiens
tgctatattaacatcatctt

SEQ ID NO: 1041103 - DNA, 12 bp, Homo sapiens
tgctatcacatg

SEQ ID NO: 1041104 - DNA, 22 bp, Homo sapiens
tgctatccatttctcatgtttt

SEQ ID NO: 1041105 - DNA, 19 bp, Homo sapiens
tgctatccccatctccctg

SEQ ID NO: 1041106 - DNA, 12 bp, Homo sapiens
tgctatgaaaat

SEQ ID NO: 1041107 - DNA, 20 bp, Homo sapiens
tgctatgaaaatgagcatca

SEQ ID NO: 1041108 - DNA, 22 bp, Homo sapiens
tgctatgaaaatgagcatcaga

SEQ ID NO: 1041109 - DNA, 17 bp, Homo sapiens
tgctatgctgaagacat

SEQ ID NO: 1041110 - DNA, 17 bp, Homo sapiens
tgctatggttttctcca

SEQ ID NO: 1041111 - DNA, 17 bp, Homo sapiens
tgctatgtaagggtctt

SEQ ID NO: 1041112 - DNA, 15 bp, Homo sapiens
tgctatgtcccaaga

SEQ ID NO: 1041113 - DNA, 18 bp, Homo sapiens
tgctatgtcccaagagcc

SEQ ID NO: 1041114 - DNA, 19 bp, Homo sapiens
tgctatgttactattttct

SEQ ID NO: 1041115 - DNA, 14 bp, Homo sapiens
tgctatgttctgtc

SEQ ID NO: 1041116 - DNA, 16 bp, Homo sapiens
tgctattaatatttgt

SEQ ID NO: 1041117 - DNA, 23 bp, Homo sapiens
tgctattatgtaacatccagaag

SEQ ID NO: 1041118 - DNA, 13 bp, Homo sapiens
tgctattgctgtc

SEQ ID NO: 1041119 - DNA, 17 bp, Homo sapiens
tcctgtcccttgacctt

SEQ ID NO: 1041120 - DNA, 11 bp, Homo sapiens
tcctgtcctcc

SEQ ID NO: 1041121 - DNA, 13 bp, Homo sapiens
tcctgtcctgcct

SEQ ID NO: 1041122 - DNA, 19 bp, Homo sapiens
tcctgtcctgcctcctcat

SEQ ID NO: 1041123 - DNA, 15 bp, Homo sapiens
tcctgtcctttcttg

SEQ ID NO: 1041124 - DNA, 14 bp, Homo sapiens
tcctgtctgaacct

SEQ ID NO: 1041125 - DNA, 12 bp, Homo sapiens
tcctgtctgagg

SEQ ID NO: 1041126 - DNA, 17 bp, Homo sapiens
tcctgtctgccagccag

SEQ ID NO: 1041127 - DNA, 13 bp, Homo sapiens
tcctgtctgtcct

SEQ ID NO: 1041128 - DNA, 23 bp, Homo sapiens
tcctgtcttatggtccagaaact

SEQ ID NO: 1041129 - DNA, 18 bp, Homo sapiens
tcctgtgaaatattctta

SEQ ID NO: 1041130 - DNA, 20 bp, Homo sapiens
tcctgtgaatgccactgcct

SEQ ID NO: 1041131 - DNA, 14 bp, Homo sapiens
tcctgtgacatgta

SEQ ID NO: 1041132 - DNA, 15 bp, Homo sapiens
tcctgtgacatgtaa

SEQ ID NO: 1041133 - DNA, 21 bp, Homo sapiens
tcctgtgaccccaccttgacg

SEQ ID NO: 1041134 - DNA, 23 bp, Homo sapiens
tcctgtgaccccaccttgacggt

SEQ ID NO: 1041135 - DNA, 18 bp, Homo sapiens
tcctgtgatacatttctg

SEQ ID NO: 1041136 - DNA, 20 bp, Homo sapiens
tcctgtgatacatttctgaa

SEQ ID NO: 1041137 - DNA, 20 bp, Homo sapiens
tcctgtgcatgggtgaaggg

SEQ ID NO: 1041138 - DNA, 23 bp, Homo sapiens
tcctgtgcccacccgtcttcaat

SEQ ID NO: 1041139 - DNA, 23 bp, Homo sapiens
tcctgtgccctagatgcacgtgg

SEQ ID NO: 1041140 - DNA, 24 bp, Homo sapiens
tcctgtgccctagatgcacgtggg

SEQ ID NO: 1041141 - DNA, 21 bp, Homo sapiens
tcctgtgccctcaccccaatc

SEQ ID NO: 1041142 - DNA, 16 bp, Homo sapiens
tcctgtgcctttccta

SEQ ID NO: 1041143 - DNA, 19 bp, Homo sapiens
tcctgtgctaagtctttcc

SEQ ID NO: 1041144 - DNA, 13 bp, Homo sapiens
tcctgtgctctgg

SEQ ID NO: 1041145 - DNA, 12 bp, Homo sapiens
tcctgtgctggg

SEQ ID NO: 1041146 - DNA, 14 bp, Homo sapiens
tcctgtggctccct

SEQ ID NO: 1041147 - DNA, 13 bp, Homo sapiens
tcctgtggggaaa

SEQ ID NO: 1041148 - DNA, 18 bp, Homo sapiens
tcctgtggttttattaca

SEQ ID NO: 1041149 - DNA, 22 bp, Homo sapiens
tcctgtgtaatcatttcttggg

SEQ ID NO: 1041150 - DNA, 15 bp, Homo sapiens
tcctgtgtgcagtga

SEQ ID NO: 1041151 - DNA, 18 bp, Homo sapiens
tcctgtgtgtactctgtc

SEQ ID NO: 1041152 - DNA, 22 bp, Homo sapiens
tcctgtgtgtccaaaactgcct

SEQ ID NO: 1041153 - DNA, 22 bp, Homo sapiens
tcctgttaggtattagaaagtg

SEQ ID NO: 1041154 - DNA, 22 bp, Homo sapiens
tcctgttcaaatttttttttaa

SEQ ID NO: 1041155 - DNA, 23 bp, Homo sapiens
tcctgttcagaaaggggctcttc

SEQ ID NO: 1041156 - DNA, 18 bp, Homo sapiens
tcctgttcagtaataaaa

SEQ ID NO: 1041157 - DNA, 13 bp, Homo sapiens
tcctgttcagtga

SEQ ID NO: 1041158 - DNA, 15 bp, Homo sapiens
tcctgttccctcctg

SEQ ID NO: 1041159 - DNA, 18 bp, Homo sapiens
tcctgttccctcctggtc

SEQ ID NO: 1041160 - DNA, 23 bp, Homo sapiens
tcctgttccctcctggtcctgga

SEQ ID NO: 1041161 - DNA, 22 bp, Homo sapiens
tcctgttctgaaaccttagttt

SEQ ID NO: 1041162 - DNA, 14 bp, Homo sapiens
tcctgttctgccca

SEQ ID NO: 1041163 - DNA, 17 bp, Homo sapiens
tcctgttgtcaagaata

SEQ ID NO: 1041164 - DNA, 19 bp, Homo sapiens
tcctgtttataatctgaag

SEQ ID NO: 1041165 - DNA, 14 bp, Homo sapiens
tcctgtttgaaact

SEQ ID NO: 1041166 - DNA, 12 bp, Homo sapiens
tcctgtttggaa

SEQ ID NO: 1041167 - DNA, 18 bp, Homo sapiens
tcctgtttgggcccctct

SEQ ID NO: 1041168 - DNA, 22 bp, Homo sapiens
tcctgtttgggcccctctccca

SEQ ID NO: 1041169 - DNA, 17 bp, Homo sapiens
tcctgtttgtctacata

SEQ ID NO: 1041170 - DNA, 18 bp, Homo sapiens
tcctgtttgtctgatgtg

SEQ ID NO: 1041171 - DNA, 13 bp, Homo sapiens
tcctgtttgtttt

SEQ ID NO: 1041172 - DNA, 14 bp, Homo sapiens
tcctgttttctccc

SEQ ID NO: 1041173 - DNA, 14 bp, Homo sapiens
tcctgtttttcaca

SEQ ID NO: 1041174 - DNA, 17 bp, Homo sapiens
tcctgtttttctgggtg

SEQ ID NO: 1041175 - DNA, 23 bp, Homo sapiens
tgcacgtggcatgtggcctgtgg

SEQ ID NO: 1041176 - DNA, 14 bp, Homo sapiens
tgcacgtggcctct

SEQ ID NO: 1041177 - DNA, 15 bp, Homo sapiens
tgcacgttgcttcag

SEQ ID NO: 1041178 - DNA, 14 bp, Homo sapiens
tgcacgtttgtaat

SEQ ID NO: 1041179 - DNA, 17 bp, Homo sapiens
tgcactaaagccagcct

SEQ ID NO: 1041180 - DNA, 20 bp, Homo sapiens
tgcactaaagccagcctgac

SEQ ID NO: 1041181 - DNA, 18 bp, Homo sapiens
tgcactaaagtatgtaaa

SEQ ID NO: 1041182 - DNA, 17 bp, Homo sapiens
tgcactaacagagtggc

SEQ ID NO: 1041183 - DNA, 20 bp, Homo sapiens
tgcactaatgtgttatgaga

SEQ ID NO: 1041184 - DNA, 19 bp, Homo sapiens
tgcactactcctctgcagt

SEQ ID NO: 1041185 - DNA, 17 bp, Homo sapiens
tgcactagcctgtgatt

SEQ ID NO: 1041186 - DNA, 18 bp, Homo sapiens
tgcactagcctgtgatta

SEQ ID NO: 1041187 - DNA, 20 bp, Homo sapiens
tgcactaggaattctttgca

SEQ ID NO: 1041188 - DNA, 21 bp, Homo sapiens
tgcactagtgcaattccaaga

SEQ ID NO: 1041189 - DNA, 14 bp, Homo sapiens
tgcactatatacat

SEQ ID NO: 1041190 - DNA, 21 bp, Homo sapiens
tgcactatatgtttacacaat

SEQ ID NO: 1041191 - DNA, 14 bp, Homo sapiens
tgcactatatttgt

SEQ ID NO: 1041192 - DNA, 15 bp, Homo sapiens
tgcactatatttgta

SEQ ID NO: 1041193 - DNA, 17 bp, Homo sapiens
tgcactatatttgtata

SEQ ID NO: 1041194 - DNA, 18 bp, Homo sapiens
tgcactcatagggtgctc

SEQ ID NO: 1041195 - DNA, 13 bp, Homo sapiens
tgcactccagcct

SEQ ID NO: 1041196 - DNA, 14 bp, Homo sapiens
tgcactccagcctg

SEQ ID NO: 1041197 - DNA, 19 bp, Homo sapiens
tgcactccagcctgggcga

SEQ ID NO: 1041198 - DNA, 14 bp, Homo sapiens
tgcactccatggcc

SEQ ID NO: 1041199 - DNA, 19 bp, Homo sapiens
tgcactccatggccacccc

SEQ ID NO: 1041200 - DNA, 21 bp, Homo sapiens
tgcactccctggccttgcccg

SEQ ID NO: 1041201 - DNA, 14 bp, Homo sapiens
tgcactcctcacac

SEQ ID NO: 1041202 - DNA, 15 bp, Homo sapiens
tgcactcctcacaca

SEQ ID NO: 1041203 - DNA, 23 bp, Homo sapiens
tgcactcgccatttcctcacgtg

SEQ ID NO: 1041204 - DNA, 15 bp, Homo sapiens
tgcactctaaactgc

SEQ ID NO: 1041205 - DNA, 16 bp, Homo sapiens
tgcactctaaactgca

SEQ ID NO: 1041206 - DNA, 14 bp, Homo sapiens
tgcactctgctaat

SEQ ID NO: 1041207 - DNA, 14 bp, Homo sapiens
tgcactgaaacctg

SEQ ID NO: 1041208 - DNA, 13 bp, Homo sapiens
tgcactgaacagg

SEQ ID NO: 1041209 - DNA, 22 bp, Homo sapiens
tgcactgaatatataaacactc

SEQ ID NO: 1041210 - DNA, 16 bp, Homo sapiens
tgcactgagggccaca

SEQ ID NO: 1041211 - DNA, 17 bp, Homo sapiens
tgcactgagggccacac

SEQ ID NO: 1041212 - DNA, 15 bp, Homo sapiens
tgcactgatgttgtg

SEQ ID NO: 1041213 - DNA, 15 bp, Homo sapiens
tgcactgccccctgc

SEQ ID NO: 1041214 - DNA, 15 bp, Homo sapiens
tgcactgctcacgga

SEQ ID NO: 1041215 - DNA, 16 bp, Homo sapiens
tgcactggccttctga

SEQ ID NO: 1041216 - DNA, 15 bp, Homo sapiens
tgcactgggaaggaa

SEQ ID NO: 1041217 - DNA, 23 bp, Homo sapiens
tgccatagcataatatgaagcct

SEQ ID NO: 1041218 - DNA, 19 bp, Homo sapiens
tgccatagggtctgcagcc

SEQ ID NO: 1041219 - DNA, 18 bp, Homo sapiens
tgccatatggaggactgt

SEQ ID NO: 1041220 - DNA, 23 bp, Homo sapiens
tgccatattaaattttttgttga

SEQ ID NO: 1041221 - DNA, 13 bp, Homo sapiens
tgccatcaaatga

SEQ ID NO: 1041222 - DNA, 16 bp, Homo sapiens
tgccatcaccgctggg

SEQ ID NO: 1041223 - DNA, 17 bp, Homo sapiens
tgccatcaccgctgggt

SEQ ID NO: 1041224 - DNA, 15 bp, Homo sapiens
tgccatcacgcttgt

SEQ ID NO: 1041225 - DNA, 13 bp, Homo sapiens
tgccatcactggt

SEQ ID NO: 1041226 - DNA, 17 bp, Homo sapiens
tgccatcagcccctggg

SEQ ID NO: 1041227 - DNA, 15 bp, Homo sapiens
tgccatcatctcctg

SEQ ID NO: 1041228 - DNA, 16 bp, Homo sapiens
tgccatccccctctca

SEQ ID NO: 1041229 - DNA, 13 bp, Homo sapiens
tgccatcctgatg

SEQ ID NO: 1041230 - DNA, 14 bp, Homo sapiens
tgccatcctgatgg

SEQ ID NO: 1041231 - DNA, 23 bp, Homo sapiens
tgccatccttgctgcagcttcta

SEQ ID NO: 1041232 - DNA, 16 bp, Homo sapiens
tgccatctagccagcc

SEQ ID NO: 1041233 - DNA, 14 bp, Homo sapiens
tgccatctgtacat

SEQ ID NO: 1041234 - DNA, 16 bp, Homo sapiens
tgccatctgttttcaa

SEQ ID NO: 1041235 - DNA, 16 bp, Homo sapiens
tgccatcttcccagca

SEQ ID NO: 1041236 - DNA, 14 bp, Homo sapiens
tgccatcttctccc

SEQ ID NO: 1041237 - DNA, 22 bp, Homo sapiens
tgccatcttctccccgaggctg

SEQ ID NO: 1041238 - DNA, 20 bp, Homo sapiens
tgccatgaagggaccctttg

SEQ ID NO: 1041239 - DNA, 23 bp, Homo sapiens
tgccatgagtattagcttaccca

SEQ ID NO: 1041240 - DNA, 15 bp, Homo sapiens
tgccatgatctgtat

SEQ ID NO: 1041241 - DNA, 21 bp, Homo sapiens
tgccatgatgtttacaagatg

SEQ ID NO: 1041242 - DNA, 13 bp, Homo sapiens
tgccatgcaggaa

SEQ ID NO: 1041243 - DNA, 19 bp, Homo sapiens
tgccatgcaggaagaggcc

SEQ ID NO: 1041244 - DNA, 13 bp, Homo sapiens
tgccatgccactg

SEQ ID NO: 1041245 - DNA, 20 bp, Homo sapiens
tgccatgccactgccaggca

SEQ ID NO: 1041246 - DNA, 22 bp, Homo sapiens
tgccatgccactgccaggcacc

SEQ ID NO: 1041247 - DNA, 13 bp, Homo sapiens
tgccatgctgggc

SEQ ID NO: 1041248 - DNA, 22 bp, Homo sapiens
tgccatgctgggccactgggga

SEQ ID NO: 1041249 - DNA, 23 bp, Homo sapiens
tgccatgctgggccactggggac

SEQ ID NO: 1041250 - DNA, 17 bp, Homo sapiens
tgccatggatctgatct

SEQ ID NO: 1041251 - DNA, 15 bp, Homo sapiens
tgccatggcccccca

SEQ ID NO: 1041252 - DNA, 18 bp, Homo sapiens
tgccatggccccccactc

SEQ ID NO: 1041253 - DNA, 15 bp, Homo sapiens
tgccatgggcctgct

SEQ ID NO: 1041254 - DNA, 18 bp, Homo sapiens
tgccatgtaaatccccac

SEQ ID NO: 1041255 - DNA, 23 bp, Homo sapiens
tgccatgtaaggttgtgcagggt

SEQ ID NO: 1041256 - DNA, 12 bp, Homo sapiens
tgccatgtacct

SEQ ID NO: 1041257 - DNA, 14 bp, Homo sapiens
tgccatgtacctcc

SEQ ID NO: 1041258 - DNA, 21 bp, Homo sapiens
tgccatgtacctcccctgcct

SEQ ID NO: 1041259 - DNA, 22 bp, Homo sapiens
tgccatgtagaccccttgaaga

SEQ ID NO: 1041260 - DNA, 18 bp, Homo sapiens
tgccatgtcaaacaaata

SEQ ID NO: 1041261 - DNA, 14 bp, Homo sapiens
tgccatgtcacagc

SEQ ID NO: 1041262 - DNA, 15 bp, Homo sapiens
tgccatgtgaagagg

SEQ ID NO: 1041263 - DNA, 21 bp, Homo sapiens
tgccatgttggccaggctggt

SEQ ID NO: 1041264 - DNA, 23 bp, Homo sapiens
tgccatgtttttcccctgctccc

SEQ ID NO: 1041265 - DNA, 18 bp, Homo sapiens
tgccatgtttttgccaaa

SEQ ID NO: 1041266 - DNA, 22 bp, Homo sapiens
tgccattaaatccgcaaacagc

SEQ ID NO: 1041267 - DNA, 14 bp, Homo sapiens
tgccattaacaaat

SEQ ID NO: 1041268 - DNA, 14 bp, Homo sapiens
tgccattactactg

SEQ ID NO: 1041269 - DNA, 16 bp, Homo sapiens
tgccattactactgta

SEQ ID NO: 1041270 - DNA, 16 bp, Homo sapiens
tgccattatatttgca

SEQ ID NO: 1041271 - DNA, 17 bp, Homo sapiens
tgccattatatttgcat

SEQ ID NO: 1041272 - DNA, 21 bp, Homo sapiens
tgccattatgcaaatggagat

SEQ ID NO: 1041273 - DNA, 18 bp, Homo sapiens
tgccattattttctgtca

SEQ ID NO: 1041274 - DNA, 19 bp, Homo sapiens
tgccattattttctgtcag

SEQ ID NO: 1041275 - DNA, 20 bp, Homo sapiens
tgccattattttctgtcaga

SEQ ID NO: 1041276 - DNA, 17 bp, Homo sapiens
tgccattccactccact

SEQ ID NO: 1041277 - DNA, 12 bp, Homo sapiens
tgccattggcct

SEQ ID NO: 1041278 - DNA, 13 bp, Homo sapiens
tgccattggcctc

SEQ ID NO: 1041279 - DNA, 16 bp, Homo sapiens
tgccattggcctcttg

SEQ ID NO: 1041280 - DNA, 19 bp, Homo sapiens
tgccattggtccacccttt

SEQ ID NO: 1041281 - DNA, 17 bp, Homo sapiens
tgccattgtactccagc

SEQ ID NO: 1041282 - DNA, 17 bp, Homo sapiens
tgccatttaaaaagttg

SEQ ID NO: 1041283 - DNA, 15 bp, Homo sapiens
tgccatttcatgtcc

SEQ ID NO: 1041284 - DNA, 14 bp, Homo sapiens
tgccatttcccttc

SEQ ID NO: 1041285 - DNA, 15 bp, Homo sapiens
tgccatttcttctct

SEQ ID NO: 1041286 - DNA, 17 bp, Homo sapiens
tgccatttcttctctct

SEQ ID NO: 1041287 - DNA, 20 bp, Homo sapiens
tgccatttcttctctctgtt

SEQ ID NO: 1041288 - DNA, 22 bp, Homo sapiens
tgccatttcttctctctgttcc

SEQ ID NO: 1041289 - DNA, 23 bp, Homo sapiens
tgccatttcttctctctgttccc

SEQ ID NO: 1041290 - DNA, 16 bp, Homo sapiens
tgccatttgcaccctc

SEQ ID NO: 1041291 - DNA, 22 bp, Homo sapiens
tgccatttggtgtggattttct

SEQ ID NO: 1041292 - DNA, 22 bp, Homo sapiens
tgcccaaaagaggtgtcatgct

SEQ ID NO: 1041293 - DNA, 20 bp, Homo sapiens
tgcccaaacagctgtattta

SEQ ID NO: 1041294 - DNA, 18 bp, Homo sapiens
tgcccaaacccttaactg

SEQ ID NO: 1041295 - DNA, 22 bp, Homo sapiens
tgcccaaacccttaactgacat

SEQ ID NO: 1041296 - DNA, 12 bp, Homo sapiens
tgcccaaactcc

SEQ ID NO: 1041297 - DNA, 22 bp, Homo sapiens
tgcccaaactccccttccctgg

SEQ ID NO: 1041298 - DNA, 24 bp, Homo sapiens
tgcccaacctgctctcctcttgcc

SEQ ID NO: 1041299 - DNA, 14 bp, Homo sapiens
tgcccaactgttat

SEQ ID NO: 1041300 - DNA, 11 bp, Homo sapiens
tgcccaagcca

SEQ ID NO: 1041301 - DNA, 15 bp, Homo sapiens
tgcccaagccagagg

SEQ ID NO: 1041302 - DNA, 16 bp, Homo sapiens
tgcccaagccagaggc

SEQ ID NO: 1041303 - DNA, 22 bp, Homo sapiens
tgcccaagccagaggctgggtt

SEQ ID NO: 1041304 - DNA, 16 bp, Homo sapiens
tgcccaagccctgaga

SEQ ID NO: 1041305 - DNA, 18 bp, Homo sapiens
tgcccaagccctgagagt

SEQ ID NO: 1041306 - DNA, 15 bp, Homo sapiens
tgcccaagtgaccag

SEQ ID NO: 1041307 - DNA, 20 bp, Homo sapiens
tgcccaatgaataatggaaa

SEQ ID NO: 1041308 - DNA, 12 bp, Homo sapiens
tgcccacagcag

SEQ ID NO: 1041309 - DNA, 14 bp, Homo sapiens
tgcccacaggccgc

SEQ ID NO: 1041310 - DNA, 17 bp, Homo sapiens
tgcccacattaagcact

SEQ ID NO: 1041311 - DNA, 13 bp, Homo sapiens
tgcccaccaaagg

SEQ ID NO: 1041312 - DNA, 17 bp, Homo sapiens
tgcccaccaacatccca

SEQ ID NO: 1041313 - DNA, 15 bp, Homo sapiens
tgcccacccccggga

SEQ ID NO: 1041314 - DNA, 13 bp, Homo sapiens
tgcccaccccctg

SEQ ID NO: 1041315 - DNA, 18 bp, Homo sapiens
tgcccacccgtcttcaat

SEQ ID NO: 1041316 - DNA, 20 bp, Homo sapiens
tgcccacccgtggagatggg

SEQ ID NO: 1041317 - DNA, 19 bp, Homo sapiens
tgcccaccctaccagctcc

SEQ ID NO: 1041318 - DNA, 20 bp, Homo sapiens
tgcccaccctaccagctcct

SEQ ID NO: 1041319 - DNA, 13 bp, Homo sapiens
tgcccaccctcct

SEQ ID NO: 1041320 - DNA, 20 bp, Homo sapiens
tgcccaccgccctcctccac

SEQ ID NO: 1041321 - DNA, 22 bp, Homo sapiens
tgcccacctccttccagcactg

SEQ ID NO: 1041322 - DNA, 23 bp, Homo sapiens
tgcccacctggggtctctctccc

SEQ ID NO: 1041323 - DNA, 20 bp, Homo sapiens
tgcccacgagggtctcccct

SEQ ID NO: 1041324 - DNA, 19 bp, Homo sapiens
tgcccacgatcccctcccc

SEQ ID NO: 1041325 - DNA, 23 bp, Homo sapiens
tgcccacgatcccctcccccaag

SEQ ID NO: 1041326 - DNA, 14 bp, Homo sapiens
tgcccacgggagga

SEQ ID NO: 1041327 - DNA, 21 bp, Homo sapiens
tgcccacggtctgagctagct

SEQ ID NO: 1041328 - DNA, 12 bp, Homo sapiens
tgcccactgttt

SEQ ID NO: 1041329 - DNA, 22 bp, Homo sapiens
tgcccccaggcagccaccagtg

SEQ ID NO: 1041330 - DNA, 19 bp, Homo sapiens
tgcccccatctccccaggc

SEQ ID NO: 1041331 - DNA, 21 bp, Homo sapiens
tgcccccatggggtccttgga

SEQ ID NO: 1041332 - DNA, 14 bp, Homo sapiens
tgccccccacccca

SEQ ID NO: 1041333 - DNA, 18 bp, Homo sapiens
tgccccccaccccagcct

SEQ ID NO: 1041334 - DNA, 20 bp, Homo sapiens
tgcccccctcaaacctcctc

SEQ ID NO: 1041335 - DNA, 16 bp, Homo sapiens
tgcccccctcctccag

SEQ ID NO: 1041336 - DNA, 18 bp, Homo sapiens
tgccccccttgccagaca

SEQ ID NO: 1041337 - DNA, 18 bp, Homo sapiens
tgcccccgacggctgtga

SEQ ID NO: 1041338 - DNA, 13 bp, Homo sapiens
tgcccccgcctgc

SEQ ID NO: 1041339 - DNA, 19 bp, Homo sapiens
tgcccccgcgggttctaga

SEQ ID NO: 1041340 - DNA, 19 bp, Homo sapiens
tgccccctatcttgtcctg

SEQ ID NO: 1041341 - DNA, 22 bp, Homo sapiens
tgccccctcgggggcctgtggt

SEQ ID NO: 1041342 - DNA, 14 bp, Homo sapiens
tgccccctgcagac

SEQ ID NO: 1041343 - DNA, 11 bp, Homo sapiens
tgccccctgcc

SEQ ID NO: 1041344 - DNA, 20 bp, Homo sapiens
tgccccctgcttggccagga

SEQ ID NO: 1041345 - DNA, 18 bp, Homo sapiens
tgccccctgggctggggc

SEQ ID NO: 1041346 - DNA, 12 bp, Homo sapiens
tgcccccttccc

SEQ ID NO: 1041347 - DNA, 16 bp, Homo sapiens
tgcccccttccccagc

SEQ ID NO: 1041348 - DNA, 18 bp, Homo sapiens
tgcccccttccccagccc

SEQ ID NO: 1041349 - DNA, 12 bp, Homo sapiens
tgcccccttctc

SEQ ID NO: 1041350 - DNA, 18 bp, Homo sapiens
tgcccccttctcccacac

SEQ ID NO: 1041351 - DNA, 17 bp, Homo sapiens
tgcccccttgcccatca

SEQ ID NO: 1041352 - DNA, 18 bp, Homo sapiens
tgccccctttcagatgtc

SEQ ID NO: 1041353 - DNA, 21 bp, Homo sapiens
tgccccctttgaccttcccca

SEQ ID NO: 1041354 - DNA, 20 bp, Homo sapiens
tgccccgagcccaggcagct

SEQ ID NO: 1041355 - DNA, 23 bp, Homo sapiens
tgccccgcagacggtctgtgtgc

SEQ ID NO: 1041356 - DNA, 13 bp, Homo sapiens
tgccccgcccagc

SEQ ID NO: 1041357 - DNA, 15 bp, Homo sapiens
tgccccgccccccag

SEQ ID NO: 1041358 - DNA, 18 bp, Homo sapiens
tgccccgccccccagagc

SEQ ID NO: 1041359 - DNA, 18 bp, Homo sapiens
tgccccgccttcgtgtgc

SEQ ID NO: 1041360 - DNA, 22 bp, Homo sapiens
tgccccgccttcgtgtgctgct

SEQ ID NO: 1041361 - DNA, 23 bp, Homo sapiens
tgccccgccttcgtgtgctgctg

SEQ ID NO: 1041362 - DNA, 22 bp, Homo sapiens
tgccccgcgggctttgttgctg

SEQ ID NO: 1041363 - DNA, 22 bp, Homo sapiens
tgccccggccccggccccagcc

SEQ ID NO: 1041364 - DNA, 23 bp, Homo sapiens
tgccccggccccggccccagcca

SEQ ID NO: 1041365 - DNA, 21 bp, Homo sapiens
tgccccggcgaggccggagag

SEQ ID NO: 1041366 - DNA, 19 bp, Homo sapiens
tgccccgggatattataga

SEQ ID NO: 1041367 - DNA, 15 bp, Homo sapiens
tgccccgtagagaat

SEQ ID NO: 1041368 - DNA, 19 bp, Homo sapiens
tgccccgtcaccatctcag

SEQ ID NO: 1041369 - DNA, 16 bp, Homo sapiens
tgccccgtccccctct

SEQ ID NO: 1041370 - DNA, 15 bp, Homo sapiens
tgctattgctgtctg

SEQ ID NO: 1041371 - DNA, 17 bp, Homo sapiens
tgctattgctgtctggt

SEQ ID NO: 1041372 - DNA, 20 bp, Homo sapiens
tgctattggaggatcagttt

SEQ ID NO: 1041373 - DNA, 13 bp, Homo sapiens
tgctattgtaaat

SEQ ID NO: 1041374 - DNA, 17 bp, Homo sapiens
tgctattgtaaggtctt

SEQ ID NO: 1041375 - DNA, 22 bp, Homo sapiens
tgctattgtaaggtctttgtaa

SEQ ID NO: 1041376 - DNA, 16 bp, Homo sapiens
tgctatttattttcct

SEQ ID NO: 1041377 - DNA, 18 bp, Homo sapiens
tgctatttattttcctaa

SEQ ID NO: 1041378 - DNA, 20 bp, Homo sapiens
tgctatttatttttacaaga

SEQ ID NO: 1041379 - DNA, 15 bp, Homo sapiens
tgctatttctattcc

SEQ ID NO: 1041380 - DNA, 19 bp, Homo sapiens
tgctatttctattccttat

SEQ ID NO: 1041381 - DNA, 17 bp, Homo sapiens
tgctatttgaacaagtg

SEQ ID NO: 1041382 - DNA, 14 bp, Homo sapiens
tgctatttgaagaa

SEQ ID NO: 1041383 - DNA, 15 bp, Homo sapiens
tgctatttgaagaaa

SEQ ID NO: 1041384 - DNA, 19 bp, Homo sapiens
tgctcaaaataaaaagcct

SEQ ID NO: 1041385 - DNA, 20 bp, Homo sapiens
tgctcaaaattttaaaaata

SEQ ID NO: 1041386 - DNA, 23 bp, Homo sapiens
tgctcaaaattttaaaaatacca

SEQ ID NO: 1041387 - DNA, 14 bp, Homo sapiens
tgctcaaagaaatc

SEQ ID NO: 1041388 - DNA, 23 bp, Homo sapiens
tgctcaacaatttatccattcaa

SEQ ID NO: 1041389 - DNA, 14 bp, Homo sapiens
tgctcaacccccct

SEQ ID NO: 1041390 - DNA, 23 bp, Homo sapiens
tgctcaacccccctcccagacag

SEQ ID NO: 1041391 - DNA, 15 bp, Homo sapiens
tgctcaagaagacat

SEQ ID NO: 1041392 - DNA, 15 bp, Homo sapiens
tgctcaagaatgtag

SEQ ID NO: 1041393 - DNA, 21 bp, Homo sapiens
tgctcaataaatgattcttag

SEQ ID NO: 1041394 - DNA, 13 bp, Homo sapiens
tgctcaatttcag

SEQ ID NO: 1041395 - DNA, 16 bp, Homo sapiens
tgctcaatttcagcac

SEQ ID NO: 1041396 - DNA, 14 bp, Homo sapiens
tgctcacaccccat

SEQ ID NO: 1041397 - DNA, 14 bp, Homo sapiens
tgctcacagctgta

SEQ ID NO: 1041398 - DNA, 15 bp, Homo sapiens
tgctcacagggatgc

SEQ ID NO: 1041399 - DNA, 14 bp, Homo sapiens
tgctcaccagccct

SEQ ID NO: 1041400 - DNA, 18 bp, Homo sapiens
tgctcaccagccctgcag

SEQ ID NO: 1041401 - DNA, 15 bp, Homo sapiens
tgctcacgactcttc

SEQ ID NO: 1041402 - DNA, 18 bp, Homo sapiens
tgctcacgactcttcctg

SEQ ID NO: 1041403 - DNA, 19 bp, Homo sapiens
tgctcacgactcttcctgc

SEQ ID NO: 1041404 - DNA, 16 bp, Homo sapiens
tgctcacgctcccccg

SEQ ID NO: 1041405 - DNA, 14 bp, Homo sapiens
tgctcactcactca

SEQ ID NO: 1041406 - DNA, 22 bp, Homo sapiens
tgctcactcactcactccaaga

SEQ ID NO: 1041407 - DNA, 17 bp, Homo sapiens
tgctcagaacttgctgc

SEQ ID NO: 1041408 - DNA, 21 bp, Homo sapiens
tgctcagaacttgctgctgtc

SEQ ID NO: 1041409 - DNA, 16 bp, Homo sapiens
tgctcagagctttaaa

SEQ ID NO: 1041410 - DNA, 20 bp, Homo sapiens
tgctcagagctttaaaagta

SEQ ID NO: 1041411 - DNA, 18 bp, Homo sapiens
tgctcagccaaatttcct

SEQ ID NO: 1041412 - DNA, 19 bp, Homo sapiens
tgctcagccaaatttcctg

SEQ ID NO: 1041413 - DNA, 17 bp, Homo sapiens
tgctcagccctgactgg

SEQ ID NO: 1041414 - DNA, 17 bp, Homo sapiens
tgctcagctctgggcca

SEQ ID NO: 1041415 - DNA, 18 bp, Homo sapiens
tgctcagctctgggccat

SEQ ID NO: 1041416 - DNA, 19 bp, Homo sapiens
tgctcaggctgcagctgga

SEQ ID NO: 1041417 - DNA, 20 bp, Homo sapiens
tgctcaggctgcagctggac

SEQ ID NO: 1041418 - DNA, 21 bp, Homo sapiens
tgctcagggaaaagcagctct

SEQ ID NO: 1041419 - DNA, 22 bp, Homo sapiens
tgctcagggaaaagcagctctc

SEQ ID NO: 1041420 - DNA, 12 bp, Homo sapiens
tgctcaggtgct

SEQ ID NO: 1041421 - DNA, 16 bp, Homo sapiens
tgctcaggtgctatgt

SEQ ID NO: 1041422 - DNA, 17 bp, Homo sapiens
tgctcagtaatttgagg

SEQ ID NO: 1041423 - DNA, 16 bp, Homo sapiens
tgctcagtctcccttt

SEQ ID NO: 1041424 - DNA, 14 bp, Homo sapiens
tgctcagtgcctcc

SEQ ID NO: 1041425 - DNA, 16 bp, Homo sapiens
tgctcagtgcctcctg

SEQ ID NO: 1041426 - DNA, 16 bp, Homo sapiens
tgctcagtgccttttg

SEQ ID NO: 1041427 - DNA, 18 bp, Homo sapiens
tgctcagtgtccagcttc

SEQ ID NO: 1041428 - DNA, 19 bp, Homo sapiens
tgctcagtgtccagcttcc

SEQ ID NO: 1041429 - DNA, 17 bp, Homo sapiens
tgctcatcattctctgt

SEQ ID NO: 1041430 - DNA, 19 bp, Homo sapiens
tgctcatcattctctgtct

SEQ ID NO: 1041431 - DNA, 21 bp, Homo sapiens
tgctcatcattctctgtctca

SEQ ID NO: 1041432 - DNA, 15 bp, Homo sapiens
tgctcatctgctggt

SEQ ID NO: 1041433 - DNA, 15 bp, Homo sapiens
tgctcatgggaagaa

SEQ ID NO: 1041434 - DNA, 18 bp, Homo sapiens
tgctcattacagttcttt

SEQ ID NO: 1041435 - DNA, 21 bp, Homo sapiens
tgctcattacagttctttcct

SEQ ID NO: 1041436 - DNA, 14 bp, Homo sapiens
tgctcattcttgag

SEQ ID NO: 1041437 - DNA, 12 bp, Homo sapiens
tgctcatttaag

SEQ ID NO: 1041438 - DNA, 15 bp, Homo sapiens
tgctcattttctggt

SEQ ID NO: 1041439 - DNA, 16 bp, Homo sapiens
tgctcattttctggtt

SEQ ID NO: 1041440 - DNA, 21 bp, Homo sapiens
tgctcattttctggtttggca

SEQ ID NO: 1041441 - DNA, 17 bp, Homo sapiens
tgctcattttctttagg

SEQ ID NO: 1041442 - DNA, 22 bp, Homo sapiens
tgctcattttttttttatcaga

SEQ ID NO: 1041443 - DNA, 23 bp, Homo sapiens
tgctccaacctcccggggggacg

SEQ ID NO: 1041444 - DNA, 20 bp, Homo sapiens
tgctccaagatgttctcctg

SEQ ID NO: 1041445 - DNA, 15 bp, Homo sapiens
tgctccaccacatcc

SEQ ID NO: 1041446 - DNA, 23 bp, Homo sapiens
tgctccacccttggcctgtctca

SEQ ID NO: 1041447 - DNA, 16 bp, Homo sapiens
tgctccacgaagcctt

SEQ ID NO: 1041448 - DNA, 21 bp, Homo sapiens
tgctccacgaagccttaagcc

SEQ ID NO: 1041449 - DNA, 16 bp, Homo sapiens
tgctccagaagatgcc

SEQ ID NO: 1041450 - DNA, 22 bp, Homo sapiens
tgctccagaatttggaaatcct

SEQ ID NO: 1041451 - DNA, 13 bp, Homo sapiens
tgctccagattct

SEQ ID NO: 1041452 - DNA, 16 bp, Homo sapiens
tgctccagattctgat

SEQ ID NO: 1041453 - DNA, 23 bp, Homo sapiens
tgctccagcaactgcccttccag

SEQ ID NO: 1041454 - DNA, 17 bp, Homo sapiens
tgctccagccaacccct

SEQ ID NO: 1041455 - DNA, 18 bp, Homo sapiens
tgctccagccaacccctg

SEQ ID NO: 1041456 - DNA, 11 bp, Homo sapiens
tgctccagccc

SEQ ID NO: 1041457 - DNA, 12 bp, Homo sapiens
tgctccagcccc

SEQ ID NO: 1041458 - DNA, 21 bp, Homo sapiens
tgctccagcccctttgcctct

SEQ ID NO: 1041459 - DNA, 22 bp, Homo sapiens
tgctccagcccctttgcctctg

SEQ ID NO: 1041460 - DNA, 19 bp, Homo sapiens
tgctccagctgttcagctg

SEQ ID NO: 1041461 - DNA, 14 bp, Homo sapiens
tgctccaggcctgc

SEQ ID NO: 1041462 - DNA, 13 bp, Homo sapiens
tgctccagggtct

SEQ ID NO: 1041463 - DNA, 19 bp, Homo sapiens
tgctccagggtcttgggct

SEQ ID NO: 1041464 - DNA, 23 bp, Homo sapiens
tgctccagggtcttgggctactg

SEQ ID NO: 1041465 - DNA, 18 bp, Homo sapiens
tgctccatagacatcagt

SEQ ID NO: 1041466 - DNA, 17 bp, Homo sapiens
tgctccatccccctgcc

SEQ ID NO: 1041467 - DNA, 23 bp, Homo sapiens
tgctcccacacttgtgccagccc

SEQ ID NO: 1041468 - DNA, 12 bp, Homo sapiens
tgctcccacccc

SEQ ID NO: 1041469 - DNA, 14 bp, Homo sapiens
tgctcccaccccag

SEQ ID NO: 1041470 - DNA, 21 bp, Homo sapiens
tgctcccaccccagaaatcac

SEQ ID NO: 1041471 - DNA, 17 bp, Homo sapiens
tgctcccagatgccttc

SEQ ID NO: 1041472 - DNA, 17 bp, Homo sapiens
tgctcccagcagcccta

SEQ ID NO: 1041473 - DNA, 12 bp, Homo sapiens
tgctcccagcct

SEQ ID NO: 1041474 - DNA, 14 bp, Homo sapiens
tgctcccagcctgc

SEQ ID NO: 1041475 - DNA, 16 bp, Homo sapiens
tgctcccagcctgctg

SEQ ID NO: 1041476 - DNA, 13 bp, Homo sapiens
tgctcccagctgt

SEQ ID NO: 1041477 - DNA, 16 bp, Homo sapiens
tgctcccagctgtgct

SEQ ID NO: 1041478 - DNA, 15 bp, Homo sapiens
tgctcccatcctcac

SEQ ID NO: 1041479 - DNA, 20 bp, Homo sapiens
tgctcccatcctcacccaga

SEQ ID NO: 1041480 - DNA, 21 bp, Homo sapiens
tgctcccatctcctgatttct

SEQ ID NO: 1041481 - DNA, 22 bp, Homo sapiens
tgctccccacagcgtccctggc

SEQ ID NO: 1041482 - DNA, 23 bp, Homo sapiens
tgctccccacagcgtccctggcg

SEQ ID NO: 1041483 - DNA, 18 bp, Homo sapiens
tgctccccacccctaccg

SEQ ID NO: 1041484 - DNA, 16 bp, Homo sapiens
tgctccccagccctgg

SEQ ID NO: 1041485 - DNA, 22 bp, Homo sapiens
tgctccccagccctggctctgc

SEQ ID NO: 1041486 - DNA, 23 bp, Homo sapiens
tgctcccccatcctccccttccc

SEQ ID NO: 1041487 - DNA, 21 bp, Homo sapiens
tgctcccctgagaccaccccc

SEQ ID NO: 1041488 - DNA, 16 bp, Homo sapiens
tgctcccctgccacac

SEQ ID NO: 1041489 - DNA, 15 bp, Homo sapiens
tgctcccctgccacg

SEQ ID NO: 1041490 - DNA, 14 bp, Homo sapiens
tgctcccctttggg

SEQ ID NO: 1041491 - DNA, 16 bp, Homo sapiens
tgctcccggcccgcct

SEQ ID NO: 1041492 - DNA, 17 bp, Homo sapiens
tgctcccggcccgcctg

SEQ ID NO: 1041493 - DNA, 20 bp, Homo sapiens
tgctccctaagccagcctgg

SEQ ID NO: 1041494 - DNA, 21 bp, Homo sapiens
tgctccctaagccagcctggt

SEQ ID NO: 1041495 - DNA, 21 bp, Homo sapiens
tgctccctcccatcctccagc

SEQ ID NO: 1041496 - DNA, 21 bp, Homo sapiens
tgctccctcctctcctaccca

SEQ ID NO: 1041497 - DNA, 12 bp, Homo sapiens
tgctccctctgt

SEQ ID NO: 1041498 - DNA, 23 bp, Homo sapiens
tgctccctgtgtccacctgtggg

SEQ ID NO: 1041499 - DNA, 12 bp, Homo sapiens
tgctcccttcaa

SEQ ID NO: 1041500 - DNA, 16 bp, Homo sapiens
tgctcccttgatgggg

SEQ ID NO: 1041501 - DNA, 18 bp, Homo sapiens
tgctccgaggacccagga

SEQ ID NO: 1041502 - DNA, 13 bp, Homo sapiens
tgctccgccagga

SEQ ID NO: 1041503 - DNA, 20 bp, Homo sapiens
tgctccgccatggtgtcccg

SEQ ID NO: 1041504 - DNA, 14 bp, Homo sapiens
tgctccgcctggcc

SEQ ID NO: 1041505 - DNA, 14 bp, Homo sapiens
tgctccgctcccac

SEQ ID NO: 1041506 - DNA, 16 bp, Homo sapiens
tgctccgctcccaccg

SEQ ID NO: 1041507 - DNA, 23 bp, Homo sapiens
tgctccgctcccaccgcccccac

SEQ ID NO: 1041508 - DNA, 18 bp, Homo sapiens
tgctccgctgctccttgg

SEQ ID NO: 1041509 - DNA, 17 bp, Homo sapiens
tgctccgtgcctccacc

SEQ ID NO: 1041510 - DNA, 18 bp, Homo sapiens
tgctccgtgcctccacca

SEQ ID NO: 1041511 - DNA, 20 bp, Homo sapiens
tgctccgtgcctccaccacc

SEQ ID NO: 1041512 - DNA, 20 bp, Homo sapiens
tgctcctacatccagctcct

SEQ ID NO: 1041513 - DNA, 17 bp, Homo sapiens
tgctcctagcagacaga

SEQ ID NO: 1041514 - DNA, 18 bp, Homo sapiens
tgctcctagcagacagaa

SEQ ID NO: 1041515 - DNA, 12 bp, Homo sapiens
tgctcctcaccc

SEQ ID NO: 1041516 - DNA, 19 bp, Homo sapiens
tgctcctcacccctgtagg

SEQ ID NO: 1041517 - DNA, 16 bp, Homo sapiens
tgctcctcacctgtct

SEQ ID NO: 1041518 - DNA, 13 bp, Homo sapiens
tgctcctcatggg

SEQ ID NO: 1041519 - DNA, 11 bp, Homo sapiens
tgctcctccag

SEQ ID NO: 1041520 - DNA, 16 bp, Homo sapiens
tgctcctccagccctt

SEQ ID NO: 1041521 - DNA, 23 bp, Homo sapiens
tgctcctccagcccttcagacga

SEQ ID NO: 1041522 - DNA, 22 bp, Homo sapiens
tgctcctccagggccacgtgcc

SEQ ID NO: 1041523 - DNA, 22 bp, Homo sapiens
tgctcctccctggctgccctgg

SEQ ID NO: 1041524 - DNA, 20 bp, Homo sapiens
tgctcctccgtgtggactgt

SEQ ID NO: 1041525 - DNA, 16 bp, Homo sapiens
tgctcctcctgccctg

SEQ ID NO: 1041526 - DNA, 19 bp, Homo sapiens
tgctgttttgttatataat

SEQ ID NO: 1041527 - DNA, 16 bp, Homo sapiens
tgctgtttttcttgtc

SEQ ID NO: 1041528 - DNA, 18 bp, Homo sapiens
tgcttaaaaatcattgat

SEQ ID NO: 1041529 - DNA, 15 bp, Homo sapiens
tgcttaaaataagca

SEQ ID NO: 1041530 - DNA, 15 bp, Homo sapiens
tgcttaaaatatata

SEQ ID NO: 1041531 - DNA, 13 bp, Homo sapiens
tgcttaaacaaag

SEQ ID NO: 1041532 - DNA, 16 bp, Homo sapiens
tgcttaaacaaagtga

SEQ ID NO: 1041533 - DNA, 17 bp, Homo sapiens
tgcttaaagttgtaaca

SEQ ID NO: 1041534 - DNA, 20 bp, Homo sapiens
tgcttaaagttgtaacaaat

SEQ ID NO: 1041535 - DNA, 16 bp, Homo sapiens
tgcttaaatttcttat

SEQ ID NO: 1041536 - DNA, 21 bp, Homo sapiens
tgcttaacattagatgtcatg

SEQ ID NO: 1041537 - DNA, 15 bp, Homo sapiens
tgcttaataaaagaa

SEQ ID NO: 1041538 - DNA, 17 bp, Homo sapiens
tgcttaataaaagaaca

SEQ ID NO: 1041539 - DNA, 14 bp, Homo sapiens
tgcttaataaacat

SEQ ID NO: 1041540 - DNA, 15 bp, Homo sapiens
tgcttaataaacatg

SEQ ID NO: 1041541 - DNA, 15 bp, Homo sapiens
tgcttaataaattgt

SEQ ID NO: 1041542 - DNA, 19 bp, Homo sapiens
tgcttaatttccttctgtt

SEQ ID NO: 1041543 - DNA, 15 bp, Homo sapiens
tgcttaatttctgcc

SEQ ID NO: 1041544 - DNA, 13 bp, Homo sapiens
tgcttaattttga

SEQ ID NO: 1041545 - DNA, 20 bp, Homo sapiens
tgcttacaattccctgctgt

SEQ ID NO: 1041546 - DNA, 15 bp, Homo sapiens
tgcttacacatctca

SEQ ID NO: 1041547 - DNA, 21 bp, Homo sapiens
tgcttacagtaactaattttg

SEQ ID NO: 1041548 - DNA, 12 bp, Homo sapiens
tgcttacatttt

SEQ ID NO: 1041549 - DNA, 15 bp, Homo sapiens
tgcttacatttttac

SEQ ID NO: 1041550 - DNA, 17 bp, Homo sapiens
tgcttacatttttacaa

SEQ ID NO: 1041551 - DNA, 22 bp, Homo sapiens
tgcttacctctcagccttagct

SEQ ID NO: 1041552 - DNA, 15 bp, Homo sapiens
tgcttaccttttcct

SEQ ID NO: 1041553 - DNA, 22 bp, Homo sapiens
tgcttaccttttcctattctgt

SEQ ID NO: 1041554 - DNA, 16 bp, Homo sapiens
tgcttactcattaaaa

SEQ ID NO: 1041555 - DNA, 14 bp, Homo sapiens
tgcttactttttaa

SEQ ID NO: 1041556 - DNA, 15 bp, Homo sapiens
tgcttactttttaat

SEQ ID NO: 1041557 - DNA, 20 bp, Homo sapiens
tgcttactttttaattttta

SEQ ID NO: 1041558 - DNA, 20 bp, Homo sapiens
tgcttactttttatatagca

SEQ ID NO: 1041559 - DNA, 14 bp, Homo sapiens
tgcttagaaaagaa

SEQ ID NO: 1041560 - DNA, 21 bp, Homo sapiens
tgcttagagtgcccagcagag

SEQ ID NO: 1041561 - DNA, 13 bp, Homo sapiens
tgcttagcctgtg

SEQ ID NO: 1041562 - DNA, 14 bp, Homo sapiens
tgcttagcttatct

SEQ ID NO: 1041563 - DNA, 19 bp, Homo sapiens
tgcttaggaaacctcacga

SEQ ID NO: 1041564 - DNA, 22 bp, Homo sapiens
tgcttaggagacagatcactcc

SEQ ID NO: 1041565 - DNA, 16 bp, Homo sapiens
tgcttaggatgtgtgc

SEQ ID NO: 1041566 - DNA, 16 bp, Homo sapiens
tgcttagtcactgcct

SEQ ID NO: 1041567 - DNA, 19 bp, Homo sapiens
tgcttagtcactgcctgca

SEQ ID NO: 1041568 - DNA, 20 bp, Homo sapiens
tgcttagtgtacttggagta

SEQ ID NO: 1041569 - DNA, 16 bp, Homo sapiens
tgcttataatgtgtgt

SEQ ID NO: 1041570 - DNA, 17 bp, Homo sapiens
tgcttatacactgttgg

SEQ ID NO: 1041571 - DNA, 20 bp, Homo sapiens
tgcttatgaatatttataac

SEQ ID NO: 1041572 - DNA, 15 bp, Homo sapiens
tgcttattgtgtgtt

SEQ ID NO: 1041573 - DNA, 16 bp, Homo sapiens
tgcttattgttccaag

SEQ ID NO: 1041574 - DNA, 17 bp, Homo sapiens
tgcttattgttccaaga

SEQ ID NO: 1041575 - DNA, 23 bp, Homo sapiens
tgcttattgttccaagacattgt

SEQ ID NO: 1041576 - DNA, 20 bp, Homo sapiens
tgcttatttttataattaaa

SEQ ID NO: 1041577 - DNA, 16 bp, Homo sapiens
tgcttcaaggcttcca

SEQ ID NO: 1041578 - DNA, 14 bp, Homo sapiens
tgcttcaattaaaa

SEQ ID NO: 1041579 - DNA, 14 bp, Homo sapiens
tgcttcacaatgtt

SEQ ID NO: 1041580 - DNA, 13 bp, Homo sapiens
tgcttcacagtag

SEQ ID NO: 1041581 - DNA, 20 bp, Homo sapiens
tgcttcacagtagagccagc

SEQ ID NO: 1041582 - DNA, 21 bp, Homo sapiens
tgcttcacagtagagccagct

SEQ ID NO: 1041583 - DNA, 20 bp, Homo sapiens
tgcttcactcatgcaaactg

SEQ ID NO: 1041584 - DNA, 22 bp, Homo sapiens
tgcttcactcatgcaaactgct

SEQ ID NO: 1041585 - DNA, 18 bp, Homo sapiens
tgcttcagacctgacacc

SEQ ID NO: 1041586 - DNA, 18 bp, Homo sapiens
tgcttcagagtttgtgtg

SEQ ID NO: 1041587 - DNA, 20 bp, Homo sapiens
tgcttcagagtttgtgtgta

SEQ ID NO: 1041588 - DNA, 22 bp, Homo sapiens
tgcttcagccctggcccctgtg

SEQ ID NO: 1041589 - DNA, 12 bp, Homo sapiens
tgcttcagcctg

SEQ ID NO: 1041590 - DNA, 18 bp, Homo sapiens
tgcttcagtggagaatta

SEQ ID NO: 1041591 - DNA, 18 bp, Homo sapiens
tgcttcataaatgaagca

SEQ ID NO: 1041592 - DNA, 23 bp, Homo sapiens
tgcttcatcattccctctcatct

SEQ ID NO: 1041593 - DNA, 15 bp, Homo sapiens
tgcttcatgtgaaca

SEQ ID NO: 1041594 - DNA, 12 bp, Homo sapiens
tgcttcattatt

SEQ ID NO: 1041595 - DNA, 19 bp, Homo sapiens
tgcttcattattcaagaat

SEQ ID NO: 1041596 - DNA, 23 bp, Homo sapiens
tgcttcattattcaagaatgaaa

SEQ ID NO: 1041597 - DNA, 17 bp, Homo sapiens
tgcttccaacaaggaca

SEQ ID NO: 1041598 - DNA, 11 bp, Homo sapiens
tgcttccagga

SEQ ID NO: 1041599 - DNA, 15 bp, Homo sapiens
tgcttccaggctggg

SEQ ID NO: 1041600 - DNA, 16 bp, Homo sapiens
tgcttcccccacccct

SEQ ID NO: 1041601 - DNA, 19 bp, Homo sapiens
tgcttcccccacccctcca

SEQ ID NO: 1041602 - DNA, 15 bp, Homo sapiens
tgcttcccctcccta

SEQ ID NO: 1041603 - DNA, 17 bp, Homo sapiens
tgcttccccttcctaag

SEQ ID NO: 1041604 - DNA, 19 bp, Homo sapiens
tgcttccccttcctaagtc

SEQ ID NO: 1041605 - DNA, 20 bp, Homo sapiens
tgcttccctctgcctgtccc

SEQ ID NO: 1041606 - DNA, 18 bp, Homo sapiens
tgcttccgagacaccaca

SEQ ID NO: 1041607 - DNA, 12 bp, Homo sapiens
tgcttcctcctg

SEQ ID NO: 1041608 - DNA, 13 bp, Homo sapiens
tgcttccttcagt

SEQ ID NO: 1041609 - DNA, 16 bp, Homo sapiens
tgcttcctttctctcc

SEQ ID NO: 1041610 - DNA, 16 bp, Homo sapiens
tgcttcgaagtattca

SEQ ID NO: 1041611 - DNA, 20 bp, Homo sapiens
tgcttctaagtaaatacaat

SEQ ID NO: 1041612 - DNA, 19 bp, Homo sapiens
tgcttctagaaactctggc

SEQ ID NO: 1041613 - DNA, 14 bp, Homo sapiens
tgcttctagagctt

SEQ ID NO: 1041614 - DNA, 12 bp, Homo sapiens
tgcttctcactg

SEQ ID NO: 1041615 - DNA, 13 bp, Homo sapiens
tgcttctccaaca

SEQ ID NO: 1041616 - DNA, 10 bp, Homo sapiens
tgcttctccc

SEQ ID NO: 1041617 - DNA, 18 bp, Homo sapiens
tgcttctcccatttcctg

SEQ ID NO: 1041618 - DNA, 23 bp, Homo sapiens
tgcttctccccccatcccagggt

SEQ ID NO: 1041619 - DNA, 16 bp, Homo sapiens
tgcttctcccggggac

SEQ ID NO: 1041620 - DNA, 18 bp, Homo sapiens
tgcttctcggccagcccg

SEQ ID NO: 1041621 - DNA, 17 bp, Homo sapiens
tgcttctcggggtccag

SEQ ID NO: 1041622 - DNA, 21 bp, Homo sapiens
tgcttctcggggtccagtgca

SEQ ID NO: 1041623 - DNA, 14 bp, Homo sapiens
tgcttctctacaga

SEQ ID NO: 1041624 - DNA, 14 bp, Homo sapiens
tgcttctctccttg

SEQ ID NO: 1041625 - DNA, 14 bp, Homo sapiens
tgcttctctgactt

SEQ ID NO: 1041626 - DNA, 21 bp, Homo sapiens
tgcttctctgacttctgcctg

SEQ ID NO: 1041627 - DNA, 14 bp, Homo sapiens
tgcttctcttcttt

SEQ ID NO: 1041628 - DNA, 15 bp, Homo sapiens
tgcttctcttcttta

SEQ ID NO: 1041629 - DNA, 22 bp, Homo sapiens
tgcttctcttgggaactccact

SEQ ID NO: 1041630 - DNA, 13 bp, Homo sapiens
tgcttctctttgt

SEQ ID NO: 1041631 - DNA, 16 bp, Homo sapiens
tgcttctgaatacaaa

SEQ ID NO: 1041632 - DNA, 15 bp, Homo sapiens
tgcttctgaatcact

SEQ ID NO: 1041633 - DNA, 20 bp, Homo sapiens
tgcttctgagtggtgttttt

SEQ ID NO: 1041634 - DNA, 19 bp, Homo sapiens
tgcttctgctccagcccct

SEQ ID NO: 1041635 - DNA, 13 bp, Homo sapiens
tgcttctgggaga

SEQ ID NO: 1041636 - DNA, 17 bp, Homo sapiens
tgcttctgtagtactcc

SEQ ID NO: 1041637 - DNA, 15 bp, Homo sapiens
tgcttcttcagctga

SEQ ID NO: 1041638 - DNA, 23 bp, Homo sapiens
tgcttcttctcctatgtgtaagg

SEQ ID NO: 1041639 - DNA, 17 bp, Homo sapiens
tgcttcttctctccaca

SEQ ID NO: 1041640 - DNA, 14 bp, Homo sapiens
tgcttcttggagct

SEQ ID NO: 1041641 - DNA, 20 bp, Homo sapiens
tgcttcttggagctttggaa

SEQ ID NO: 1041642 - DNA, 17 bp, Homo sapiens
tgcttgaacccaggaga

SEQ ID NO: 1041643 - DNA, 16 bp, Homo sapiens
tgcttgaaggccctgc

SEQ ID NO: 1041644 - DNA, 14 bp, Homo sapiens
tgcttgacatacct

SEQ ID NO: 1041645 - DNA, 20 bp, Homo sapiens
tgcttgacatacctaccagt

SEQ ID NO: 1041646 - DNA, 15 bp, Homo sapiens
tgcttgagcctggct

SEQ ID NO: 1041647 - DNA, 21 bp, Homo sapiens
tgcttgagcctggctgtccaa

SEQ ID NO: 1041648 - DNA, 15 bp, Homo sapiens
tgcttgagctcagga

SEQ ID NO: 1041649 - DNA, 13 bp, Homo sapiens
tgcttgatccaga

SEQ ID NO: 1041650 - DNA, 22 bp, Homo sapiens
tgcttgatccagaagagcccat

SEQ ID NO: 1041651 - DNA, 16 bp, Homo sapiens
tgcttgcacacttccc

SEQ ID NO: 1041652 - DNA, 17 bp, Homo sapiens
tgcttgcacacttcccc

SEQ ID NO: 1041653 - DNA, 15 bp, Homo sapiens
tgcttgcagccagga

SEQ ID NO: 1041654 - DNA, 18 bp, Homo sapiens
tgcttgcatcctatttgg

SEQ ID NO: 1041655 - DNA, 21 bp, Homo sapiens
tgcttgcccagggtgcagtgt

SEQ ID NO: 1041656 - DNA, 18 bp, Homo sapiens
tgcttgcccgctcccaca

SEQ ID NO: 1041657 - DNA, 22 bp, Homo sapiens
tgcttgcctagggcctggtcca

SEQ ID NO: 1041658 - DNA, 14 bp, Homo sapiens
tgcttgcctgaagc

SEQ ID NO: 1041659 - DNA, 17 bp, Homo sapiens
tgcttgcggcaaaagga

SEQ ID NO: 1041660 - DNA, 21 bp, Homo sapiens
tgcttgcggcaaaaggaaagc

SEQ ID NO: 1041661 - DNA, 22 bp, Homo sapiens
tgcttggatgcgagcttggcct

SEQ ID NO: 1041662 - DNA, 21 bp, Homo sapiens
tgcttgggacgtgtacagcac

SEQ ID NO: 1041663 - DNA, 12 bp, Homo sapiens
tgcttgggctga

SEQ ID NO: 1041664 - DNA, 15 bp, Homo sapiens
tgcttggggctattt

SEQ ID NO: 1041665 - DNA, 13 bp, Homo sapiens
tgcttggtctgtt

SEQ ID NO: 1041666 - DNA, 15 bp, Homo sapiens
tgcttggtctgtttg

SEQ ID NO: 1041667 - DNA, 20 bp, Homo sapiens
tgcttggtggggctcgtggc

SEQ ID NO: 1041668 - DNA, 23 bp, Homo sapiens
tgcttgtaacaagaaaacataag

SEQ ID NO: 1041669 - DNA, 18 bp, Homo sapiens
tgcttgtaatcaagcctt

SEQ ID NO: 1041670 - DNA, 21 bp, Homo sapiens
tgcttgtaatcaagcctttat

SEQ ID NO: 1041671 - DNA, 22 bp, Homo sapiens
tgcttgtaatttaaacatttgt

SEQ ID NO: 1041672 - DNA, 22 bp, Homo sapiens
tgcttgtacataatgcgtgcat

SEQ ID NO: 1041673 - DNA, 19 bp, Homo sapiens
tgcttgtactaagccagga

SEQ ID NO: 1041674 - DNA, 13 bp, Homo sapiens
tgcttgtagaagt

SEQ ID NO: 1041675 - DNA, 14 bp, Homo sapiens
tgcttgtattgtaa

SEQ ID NO: 1041676 - DNA, 16 bp, Homo sapiens
tgcttgtattgtaaat

SEQ ID NO: 1041677 - DNA, 18 bp, Homo sapiens
tgcttgtattgtaaatgt

SEQ ID NO: 1041678 - DNA, 17 bp, Homo sapiens
tgcttgtcattccagag

SEQ ID NO: 1041679 - DNA, 20 bp, Homo sapiens
tgcttgtcattccagagtgc

SEQ ID NO: 1041680 - DNA, 12 bp, Homo sapiens
tgcttgtgttat

SEQ ID NO: 1041681 - DNA, 20 bp, Homo sapiens
tgcttgttaatgctttctga

SEQ ID NO: 1041682 - DNA, 19 bp, Homo sapiens
tgcttgttgggattcctga

SEQ ID NO: 1041683 - DNA, 14 bp, Homo sapiens
tgcttgtttacagc

SEQ ID NO: 1041684 - DNA, 14 bp, Homo sapiens
tgctttaaaacaag

SEQ ID NO: 1041685 - DNA, 17 bp, Homo sapiens
tgctttaaagtacctgt

SEQ ID NO: 1041686 - DNA, 11 bp, Homo sapiens
tgctttaatat

SEQ ID NO: 1041687 - DNA, 20 bp, Homo sapiens
tgctttaatatgagcttcaa

SEQ ID NO: 1041688 - DNA, 23 bp, Homo sapiens
tgctttaatatgagcttcaatat

SEQ ID NO: 1041689 - DNA, 20 bp, Homo sapiens
tgctttaattaattaagtat

SEQ ID NO: 1041690 - DNA, 20 bp, Homo sapiens
tgctttacatgctgtgctct

SEQ ID NO: 1041691 - DNA, 18 bp, Homo sapiens
tgctttaccttttcaggg

SEQ ID NO: 1041692 - DNA, 18 bp, Homo sapiens
tgctttagagaatgccac

SEQ ID NO: 1041693 - DNA, 22 bp, Homo sapiens
tgctttagcttgaaaaggtgac

SEQ ID NO: 1041694 - DNA, 15 bp, Homo sapiens
tgctttatgccttct

SEQ ID NO: 1041695 - DNA, 17 bp, Homo sapiens
tgctttattccagaatg

SEQ ID NO: 1041696 - DNA, 14 bp, Homo sapiens
tgctttattgaatt

SEQ ID NO: 1041697 - DNA, 22 bp, Homo sapiens
tgctttattgaattagaaaatt

SEQ ID NO: 1041698 - DNA, 16 bp, Homo sapiens
tgctttatttgtaaat

SEQ ID NO: 1041699 - DNA, 23 bp, Homo sapiens
tgctttatttgtaaatttagtgt

SEQ ID NO: 1041700 - DNA, 19 bp, Homo sapiens
tgctttcaattacaaagca

SEQ ID NO: 1041701 - DNA, 12 bp, Homo sapiens
tgctttcaattg

SEQ ID NO: 1041702 - DNA, 23 bp, Homo sapiens
tgctttcaccagaatttctaaga

SEQ ID NO: 1041703 - DNA, 20 bp, Homo sapiens
tgctttccccgggggaggaa

SEQ ID NO: 1041704 - DNA, 16 bp, Homo sapiens
tgctttccctgaggaa

SEQ ID NO: 1041705 - DNA, 21 bp, Homo sapiens
tgctttccgtggcactgcata

SEQ ID NO: 1041706 - DNA, 19 bp, Homo sapiens
tgctttcgtgtaaattatg

SEQ ID NO: 1041707 - DNA, 19 bp, Homo sapiens
tgctttctatgctgtttgt

SEQ ID NO: 1041708 - DNA, 20 bp, Homo sapiens
tgctttctcctttaattgta

SEQ ID NO: 1041709 - DNA, 15 bp, Homo sapiens
tgctttctgaagctt

SEQ ID NO: 1041710 - DNA, 14 bp, Homo sapiens
tgctttctgttcca

SEQ ID NO: 1041711 - DNA, 20 bp, Homo sapiens
tgctttctttagaattttta

SEQ ID NO: 1041712 - DNA, 22 bp, Homo sapiens
tgctttctttcgtttgtttgtt

SEQ ID NO: 1041713 - DNA, 20 bp, Homo sapiens
tgctttctttggcctacatt

SEQ ID NO: 1041714 - DNA, 20 bp, Homo sapiens
tgctttcttttttaaaatca

SEQ ID NO: 1041715 - DNA, 21 bp, Homo sapiens
tgctttgaaaatatttgtcca

SEQ ID NO: 1041716 - DNA, 22 bp, Homo sapiens
tgctttgaaaatatttgtccaa

SEQ ID NO: 1041717 - DNA, 13 bp, Homo sapiens
tgctttgaacttt

SEQ ID NO: 1041718 - DNA, 19 bp, Homo sapiens
tgctttgaagcagttgtgt

SEQ ID NO: 1041719 - DNA, 16 bp, Homo sapiens
tgctttgaagtagctc

SEQ ID NO: 1041720 - DNA, 20 bp, Homo sapiens
tgctttgaagtagctctttt

SEQ ID NO: 1041721 - DNA, 18 bp, Homo sapiens
tgctttgactcacctgtt

SEQ ID NO: 1041722 - DNA, 17 bp, Homo sapiens
tgctttgagaaaacatt

SEQ ID NO: 1041723 - DNA, 17 bp, Homo sapiens
tgctttgatttacagca

SEQ ID NO: 1041724 - DNA, 18 bp, Homo sapiens
tgctttgatttacagcaa

SEQ ID NO: 1041725 - DNA, 16 bp, Homo sapiens
tgctttgcattttctg

SEQ ID NO: 1041726 - DNA, 14 bp, Homo sapiens
tgctttgccagagc

SEQ ID NO: 1041727 - DNA, 17 bp, Homo sapiens
tgctttgcccacatgcc

SEQ ID NO: 1041728 - DNA, 18 bp, Homo sapiens
tgctttgctgcacagcag

SEQ ID NO: 1041729 - DNA, 13 bp, Homo sapiens
tgctttgctgcta

SEQ ID NO: 1041730 - DNA, 13 bp, Homo sapiens
tgctttgctttct

SEQ ID NO: 1041731 - DNA, 20 bp, Homo sapiens
tgctttgggaggccaaggca

SEQ ID NO: 1041732 - DNA, 14 bp, Homo sapiens
tgctttgggctgcc

SEQ ID NO: 1041733 - DNA, 21 bp, Homo sapiens
tgctttgggctgccctggtgc

SEQ ID NO: 1041734 - DNA, 12 bp, Homo sapiens
tgctttgggctt

SEQ ID NO: 1041735 - DNA, 15 bp, Homo sapiens
tgctttgggctttgc

SEQ ID NO: 1041736 - DNA, 22 bp, Homo sapiens
tgctttggggggtgtgctgaca

SEQ ID NO: 1041737 - DNA, 17 bp, Homo sapiens
tgctttggtcttgcccc

SEQ ID NO: 1041738 - DNA, 22 bp, Homo sapiens
tgctttgtgatttttgtaattt

SEQ ID NO: 1041739 - DNA, 16 bp, Homo sapiens
tgctttgtgcatatgt

SEQ ID NO: 1041740 - DNA, 19 bp, Homo sapiens
tgctttgtgcatatgttaa

SEQ ID NO: 1041741 - DNA, 20 bp, Homo sapiens
tgcttttaatgaatttaagg

SEQ ID NO: 1041742 - DNA, 12 bp, Homo sapiens
tgcttttaatta

SEQ ID NO: 1041743 - DNA, 13 bp, Homo sapiens
tgcttttaattaa

SEQ ID NO: 1041744 - DNA, 17 bp, Homo sapiens
tgcttttaccatgcccc

SEQ ID NO: 1041745 - DNA, 13 bp, Homo sapiens
tgcttttagaaaa

SEQ ID NO: 1041746 - DNA, 23 bp, Homo sapiens
tgcttttaggagaattcacagaa

SEQ ID NO: 1041747 - DNA, 19 bp, Homo sapiens
tgcttttagttcatatata

SEQ ID NO: 1041748 - DNA, 22 bp, Homo sapiens
tgcttttatatggcccagcctt

SEQ ID NO: 1041749 - DNA, 13 bp, Homo sapiens
tgcttttcatcac

SEQ ID NO: 1041750 - DNA, 14 bp, Homo sapiens
tgcttttcatgtag

SEQ ID NO: 1041751 - DNA, 19 bp, Homo sapiens
tgcttttcatgtagaactc

SEQ ID NO: 1041752 - DNA, 14 bp, Homo sapiens
tgcttttccctctt

SEQ ID NO: 1041753 - DNA, 19 bp, Homo sapiens
tgcttttccctcttttctt

SEQ ID NO: 1041754 - DNA, 23 bp, Homo sapiens
tgcttttctccaatatcagtgct

SEQ ID NO: 1041755 - DNA, 16 bp, Homo sapiens
tgcttttctgccctgg

SEQ ID NO: 1041756 - DNA, 13 bp, Homo sapiens
tgcttttctgttt

SEQ ID NO: 1041757 - DNA, 14 bp, Homo sapiens
tgcttttgatgtga

SEQ ID NO: 1041758 - DNA, 14 bp, Homo sapiens
tgcttttgcccatt

SEQ ID NO: 1041759 - DNA, 15 bp, Homo sapiens
tgcttttgcctctgc

SEQ ID NO: 1041760 - DNA, 19 bp, Homo sapiens
tgcttttgctgctgcttaa

SEQ ID NO: 1041761 - DNA, 21 bp, Homo sapiens
tgcttttgtttgctcttttaa

SEQ ID NO: 1041762 - DNA, 13 bp, Homo sapiens
tgctttttaccta

SEQ ID NO: 1041763 - DNA, 15 bp, Homo sapiens
tgctttttataaaaa

SEQ ID NO: 1041764 - DNA, 18 bp, Homo sapiens
tgctttttatttctgcat

SEQ ID NO: 1041765 - DNA, 20 bp, Homo sapiens
tgctttttgcgtacacagag

SEQ ID NO: 1041766 - DNA, 21 bp, Homo sapiens
tgctttttgcgtacacagaga

SEQ ID NO: 1041767 - DNA, 14 bp, Homo sapiens
tgctttttggaaag

SEQ ID NO: 1041768 - DNA, 22 bp, Homo sapiens
tgcttttttttttccagcaagt

SEQ ID NO: 1041769 - DNA, 19 bp, Homo sapiens
tggaaaaaaaaaaaaacta

SEQ ID NO: 1041770 - DNA, 19 bp, Homo sapiens
tggaaaaaaaatatatata

SEQ ID NO: 1041771 - DNA, 13 bp, Homo sapiens
tggaaaaaactct

SEQ ID NO: 1041772 - DNA, 12 bp, Homo sapiens
tggaaaaataaa

SEQ ID NO: 1041773 - DNA, 17 bp, Homo sapiens
tggaaaaatagcctgcc

SEQ ID NO: 1041774 - DNA, 19 bp, Homo sapiens
tggaaaaatgccatcaaat

SEQ ID NO: 1041775 - DNA, 15 bp, Homo sapiens
tggaaaaatgcccat

SEQ ID NO: 1041776 - DNA, 16 bp, Homo sapiens
tggaaaacaaaagttt

SEQ ID NO: 1041777 - DNA, 16 bp, Homo sapiens
tggaaaacagaacact

SEQ ID NO: 1041778 - DNA, 17 bp, Homo sapiens
tggaaaacagaacactt

SEQ ID NO: 1041779 - DNA, 20 bp, Homo sapiens
tggaaaacagaacacttatg

SEQ ID NO: 1041780 - DNA, 20 bp, Homo sapiens
tggaaaactattgagccttg

SEQ ID NO: 1041781 - DNA, 15 bp, Homo sapiens
tggaaaactgtgttg

SEQ ID NO: 1041782 - DNA, 22 bp, Homo sapiens
tggaaaagcttaaaaaaattac

SEQ ID NO: 1041783 - DNA, 20 bp, Homo sapiens
tggaaaaggaagactagagg

SEQ ID NO: 1041784 - DNA, 22 bp, Homo sapiens
tggaaaagggtcttgggaaata

SEQ ID NO: 1041785 - DNA, 21 bp, Homo sapiens
tggaaaagtgatgtattttca

SEQ ID NO: 1041786 - DNA, 16 bp, Homo sapiens
tggaaaagtgtccttc

SEQ ID NO: 1041787 - DNA, 13 bp, Homo sapiens
tggaaaataaaca

SEQ ID NO: 1041788 - DNA, 15 bp, Homo sapiens
tggaaaataaattat

SEQ ID NO: 1041789 - DNA, 21 bp, Homo sapiens
tggaaaatacctaattgtgga

SEQ ID NO: 1041790 - DNA, 18 bp, Homo sapiens
tggaaaatgccatgaatt

SEQ ID NO: 1041791 - DNA, 16 bp, Homo sapiens
tggaaaatgtcctgtg

SEQ ID NO: 1041792 - DNA, 18 bp, Homo sapiens
tggaaacattacagttca

SEQ ID NO: 1041793 - DNA, 18 bp, Homo sapiens
tggaaacattttttaaaa

SEQ ID NO: 1041794 - DNA, 22 bp, Homo sapiens
tggaaaccaagtcaggccaggt

SEQ ID NO: 1041795 - DNA, 15 bp, Homo sapiens
tggaaaccacacttc

SEQ ID NO: 1041796 - DNA, 19 bp, Homo sapiens
tggaaaccacacttcttga

SEQ ID NO: 1041797 - DNA, 16 bp, Homo sapiens
tggaaacctgccctgc

SEQ ID NO: 1041798 - DNA, 19 bp, Homo sapiens
tggaaacctgccctgcctg

SEQ ID NO: 1041799 - DNA, 20 bp, Homo sapiens
tggaaacctgccctgcctga

SEQ ID NO: 1041800 - DNA, 21 bp, Homo sapiens
tggaaacctgccctgcctgag

SEQ ID NO: 1041801 - DNA, 22 bp, Homo sapiens
tggaaacggtatcctccctgcc

SEQ ID NO: 1041802 - DNA, 18 bp, Homo sapiens
tggaaactatgtgttttt

SEQ ID NO: 1041803 - DNA, 19 bp, Homo sapiens
tggaaactctttaacttct

SEQ ID NO: 1041804 - DNA, 17 bp, Homo sapiens
tggaaactgctaaattc

SEQ ID NO: 1041805 - DNA, 22 bp, Homo sapiens
tggaaactgctaaattctatgt

SEQ ID NO: 1041806 - DNA, 21 bp, Homo sapiens
tggaaagacaactgttttaat

SEQ ID NO: 1041807 - DNA, 12 bp, Homo sapiens
tggaaagacagg

SEQ ID NO: 1041808 - DNA, 13 bp, Homo sapiens
tggaaagactggg

SEQ ID NO: 1041809 - DNA, 14 bp, Homo sapiens
tggaaagaggctct

SEQ ID NO: 1041810 - DNA, 19 bp, Homo sapiens
tggaaagatgttaagcatt

SEQ ID NO: 1041811 - DNA, 21 bp, Homo sapiens
tggaaagatgttaagcattta

SEQ ID NO: 1041812 - DNA, 22 bp, Homo sapiens
tggaaagatgttaagcatttat

SEQ ID NO: 1041813 - DNA, 19 bp, Homo sapiens
tggaaagcagagcctcctg

SEQ ID NO: 1041814 - DNA, 16 bp, Homo sapiens
tggaaagcaggatgta

SEQ ID NO: 1041815 - DNA, 16 bp, Homo sapiens
tggaaagcatcacctc

SEQ ID NO: 1041816 - DNA, 19 bp, Homo sapiens
tggaaagcatcacctcagg

SEQ ID NO: 1041817 - DNA, 14 bp, Homo sapiens
tggaaagcctctgc

SEQ ID NO: 1041818 - DNA, 15 bp, Homo sapiens
tggaaagcctctgct

SEQ ID NO: 1041819 - DNA, 14 bp, Homo sapiens
tggaaagcgcccct

SEQ ID NO: 1041820 - DNA, 16 bp, Homo sapiens
tggaaaggaaacattg

SEQ ID NO: 1041821 - DNA, 13 bp, Homo sapiens
tggaaaggctcag

SEQ ID NO: 1041822 - DNA, 20 bp, Homo sapiens
tggaaaggctcagtctcagg

SEQ ID NO: 1041823 - DNA, 17 bp, Homo sapiens
tggaaaggggagttgag

SEQ ID NO: 1041824 - DNA, 18 bp, Homo sapiens
tggaaaggggggagctgg

SEQ ID NO: 1041825 - DNA, 23 bp, Homo sapiens
tggaaagggtgctgcttccctct

SEQ ID NO: 1041826 - DNA, 12 bp, Homo sapiens
tggaaagtcaga

SEQ ID NO: 1041827 - DNA, 14 bp, Homo sapiens
tggaaagtgaattt

SEQ ID NO: 1041828 - DNA, 16 bp, Homo sapiens
tggaaagtgaatttga

SEQ ID NO: 1041829 - DNA, 17 bp, Homo sapiens
tggaaagtgattttatt

SEQ ID NO: 1041830 - DNA, 13 bp, Homo sapiens
tggaaataaatgt

SEQ ID NO: 1041831 - DNA, 16 bp, Homo sapiens
tggaaataatttgaat

SEQ ID NO: 1041832 - DNA, 19 bp, Homo sapiens
tggaaataatttgaatgta

SEQ ID NO: 1041833 - DNA, 22 bp, Homo sapiens
tggaaatacagttgttggcctc

SEQ ID NO: 1041834 - DNA, 21 bp, Homo sapiens
tggaaatagaaatttccagag

SEQ ID NO: 1041835 - DNA, 15 bp, Homo sapiens
tggaaatattaagaa

SEQ ID NO: 1041836 - DNA, 16 bp, Homo sapiens
tggaaatcagccaagt

SEQ ID NO: 1041837 - DNA, 11 bp, Homo sapiens
tggaaatgtag

SEQ ID NO: 1041838 - DNA, 12 bp, Homo sapiens
tggaaatgtctg

SEQ ID NO: 1041839 - DNA, 15 bp, Homo sapiens
tggaaatgtctgctg

SEQ ID NO: 1041840 - DNA, 16 bp, Homo sapiens
tggaaatgtgagaaat

SEQ ID NO: 1041841 - DNA, 21 bp, Homo sapiens
tggaaatgtgagaaatgtcta

SEQ ID NO: 1041842 - DNA, 21 bp, Homo sapiens
tggaaattaggttgaaacata

SEQ ID NO: 1041843 - DNA, 23 bp, Homo sapiens
tggaaatttgttataatgaatga

SEQ ID NO: 1041844 - DNA, 13 bp, Homo sapiens
tggaaattttgtc

SEQ ID NO: 1041845 - DNA, 16 bp, Homo sapiens
tggaaattttgtccat

SEQ ID NO: 1041846 - DNA, 14 bp, Homo sapiens
tggaaatttttacc

SEQ ID NO: 1041847 - DNA, 21 bp, Homo sapiens
tggaacaagacagccttcact

SEQ ID NO: 1041848 - DNA, 20 bp, Homo sapiens
tggaacacaaatgaaaatga

SEQ ID NO: 1041849 - DNA, 22 bp, Homo sapiens
tggaacacctaccaaaaaataa

SEQ ID NO: 1041850 - DNA, 15 bp, Homo sapiens
tggaacacggccaca

SEQ ID NO: 1041851 - DNA, 13 bp, Homo sapiens
tggaacacttcga

SEQ ID NO: 1041852 - DNA, 16 bp, Homo sapiens
tggaacagaatgtttt

SEQ ID NO: 1041853 - DNA, 21 bp, Homo sapiens
tggaacagaatgttttactgt

SEQ ID NO: 1041854 - DNA, 18 bp, Homo sapiens
tggaacagtcacccttct

SEQ ID NO: 1041855 - DNA, 14 bp, Homo sapiens
tggaacatactgtt

SEQ ID NO: 1041856 - DNA, 17 bp, Homo sapiens
tggaacatatgcacagg

SEQ ID NO: 1041857 - DNA, 21 bp, Homo sapiens
tggaacatggctagcctttct

SEQ ID NO: 1041858 - DNA, 17 bp, Homo sapiens
tggaacattggaatgtt

SEQ ID NO: 1041859 - DNA, 16 bp, Homo sapiens
tggaacatttgatatt

SEQ ID NO: 1041860 - DNA, 18 bp, Homo sapiens
tggaaccaaagtctaaac

SEQ ID NO: 1041861 - DNA, 11 bp, Homo sapiens
tggaaccaatc

SEQ ID NO: 1041862 - DNA, 19 bp, Homo sapiens
tggaaccacattgaagaat

SEQ ID NO: 1041863 - DNA, 15 bp, Homo sapiens
tggaacccaggaggt

SEQ ID NO: 1041864 - DNA, 16 bp, Homo sapiens
tggaaccccccaggcc

SEQ ID NO: 1041865 - DNA, 23 bp, Homo sapiens
tggaacctgtctccattgtgtga

SEQ ID NO: 1041866 - DNA, 14 bp, Homo sapiens
tggaaccttccctc

SEQ ID NO: 1041867 - DNA, 16 bp, Homo sapiens
tggaaccttgctgtcc

SEQ ID NO: 1041868 - DNA, 22 bp, Homo sapiens
tggaaccttgctgtcctgatct

SEQ ID NO: 1041869 - DNA, 19 bp, Homo sapiens
tggaacgggcatgggcctc

SEQ ID NO: 1041870 - DNA, 24 bp, Homo sapiens
tggaacgggcatgggcctctctgg

SEQ ID NO: 1041871 - DNA, 14 bp, Homo sapiens
tggaactactgtac

SEQ ID NO: 1041872 - DNA, 18 bp, Homo sapiens
tggaactactgtactttg

SEQ ID NO: 1041873 - DNA, 15 bp, Homo sapiens
tggaactctaaacct

SEQ ID NO: 1041874 - DNA, 21 bp, Homo sapiens
tggaactgcgttatgaagagc

SEQ ID NO: 1041875 - DNA, 21 bp, Homo sapiens
tggaactgtgtatttatttaa

SEQ ID NO: 1041876 - DNA, 21 bp, Homo sapiens
tggaacttagccatttttcaa

SEQ ID NO: 1041877 - DNA, 13 bp, Homo sapiens
tggaacttctaat

SEQ ID NO: 1041878 - DNA, 18 bp, Homo sapiens
tggaacttctaatatatt

SEQ ID NO: 1041879 - DNA, 15 bp, Homo sapiens
tggaacttgaactga

SEQ ID NO: 1041880 - DNA, 18 bp, Homo sapiens
tggaactttagggggtgg

SEQ ID NO: 1041881 - DNA, 23 bp, Homo sapiens
tggaactttagggggtgggaggg

SEQ ID NO: 1041882 - DNA, 21 bp, Homo sapiens
tggaactttagtgaaacataa

SEQ ID NO: 1041883 - DNA, 13 bp, Homo sapiens
tggaagaaagtaa

SEQ ID NO: 1041884 - DNA, 14 bp, Homo sapiens
tggaagaaagtaag

SEQ ID NO: 1041885 - DNA, 17 bp, Homo sapiens
tggaagaacatcaagat

SEQ ID NO: 1041886 - DNA, 15 bp, Homo sapiens
tggaagaagggagaa

SEQ ID NO: 1041887 - DNA, 17 bp, Homo sapiens
tggaagaagggagaaga

SEQ ID NO: 1041888 - DNA, 15 bp, Homo sapiens
tggaagaagtttttt

SEQ ID NO: 1041889 - DNA, 18 bp, Homo sapiens
tggaagaagttttttact

SEQ ID NO: 1041890 - DNA, 22 bp, Homo sapiens
tggaagaagttttttactttgg

SEQ ID NO: 1041891 - DNA, 15 bp, Homo sapiens
tggaagaccccaccc

SEQ ID NO: 1041892 - DNA, 14 bp, Homo sapiens
tggaagacttgggt

SEQ ID NO: 1041893 - DNA, 16 bp, Homo sapiens
tggaagagagaaagca

SEQ ID NO: 1041894 - DNA, 19 bp, Homo sapiens
tggaagagagaaagcatat

SEQ ID NO: 1041895 - DNA, 23 bp, Homo sapiens
tggaagagagaaagcatattgac

SEQ ID NO: 1041896 - DNA, 22 bp, Homo sapiens
tggaagagagagccatgaagca

SEQ ID NO: 1041897 - DNA, 13 bp, Homo sapiens
tggaagagaggca

SEQ ID NO: 1041898 - DNA, 14 bp, Homo sapiens
tggaagagaggcac

SEQ ID NO: 1041899 - DNA, 19 bp, Homo sapiens
tggaagagaggcacctgct

SEQ ID NO: 1041900 - DNA, 20 bp, Homo sapiens
tggaagagaggcacctgctg

SEQ ID NO: 1041901 - DNA, 14 bp, Homo sapiens
tggaagagcagcct

SEQ ID NO: 1041902 - DNA, 17 bp, Homo sapiens
tggaagagcccagtctg

SEQ ID NO: 1041903 - DNA, 21 bp, Homo sapiens
tggaagagcccagtctgttga

SEQ ID NO: 1041904 - DNA, 12 bp, Homo sapiens
tggaagagcccg

SEQ ID NO: 1041905 - DNA, 22 bp, Homo sapiens
tggaagcaaagacaaaagaaac

SEQ ID NO: 1041906 - DNA, 17 bp, Homo sapiens
tggaagcatggctgtct

SEQ ID NO: 1041907 - DNA, 19 bp, Homo sapiens
tggaagcatggctgtctgc

SEQ ID NO: 1041908 - DNA, 21 bp, Homo sapiens
tggaagcatggctgtctgcac

SEQ ID NO: 1041909 - DNA, 23 bp, Homo sapiens
tggaagcatgtttattctgttcc

SEQ ID NO: 1041910 - DNA, 15 bp, Homo sapiens
tggaagccagctttc

SEQ ID NO: 1041911 - DNA, 18 bp, Homo sapiens
tggaagccagctttccct

SEQ ID NO: 1041912 - DNA, 16 bp, Homo sapiens
tggaagcccctgggcc

SEQ ID NO: 1041913 - DNA, 12 bp, Homo sapiens
tggaagccctcc

SEQ ID NO: 1041914 - DNA, 17 bp, Homo sapiens
tggaagccctccttcca

SEQ ID NO: 1041915 - DNA, 16 bp, Homo sapiens
tggaagccctggagac

SEQ ID NO: 1041916 - DNA, 17 bp, Homo sapiens
tggaagccctgtctgtt

SEQ ID NO: 1041917 - DNA, 20 bp, Homo sapiens
tggaagcctgaactgaggcc

SEQ ID NO: 1041918 - DNA, 17 bp, Homo sapiens
tggaagcctgagcaggg

SEQ ID NO: 1041919 - DNA, 16 bp, Homo sapiens
tggaagctaccagagc

SEQ ID NO: 1041920 - DNA, 14 bp, Homo sapiens
tggaagctcttctt

SEQ ID NO: 1041921 - DNA, 19 bp, Homo sapiens
tggaagctgtcaggctggg

SEQ ID NO: 1041922 - DNA, 20 bp, Homo sapiens
tggaagctgtcaggctggga

SEQ ID NO: 1041923 - DNA, 23 bp, Homo sapiens
tggaagctgtcaggctgggacag

SEQ ID NO: 1041924 - DNA, 19 bp, Homo sapiens
tggaagctgtttggaaaag

SEQ ID NO: 1041925 - DNA, 18 bp, Homo sapiens
tggaagcttgttttccag

SEQ ID NO: 1041926 - DNA, 20 bp, Homo sapiens
tggaagcttgttttccagtc

SEQ ID NO: 1041927 - DNA, 22 bp, Homo sapiens
tggaaggaccacattttatatt

SEQ ID NO: 1041928 - DNA, 13 bp, Homo sapiens
tggaaggagcaga

SEQ ID NO: 1041929 - DNA, 20 bp, Homo sapiens
tggaaggatctgctgaggcc

SEQ ID NO: 1041930 - DNA, 14 bp, Homo sapiens
tggaaggcagacag

SEQ ID NO: 1041931 - DNA, 23 bp, Homo sapiens
tggaaggcagacagcaggcagcg

SEQ ID NO: 1041932 - DNA, 15 bp, Homo sapiens
tggaaggcagggcag

SEQ ID NO: 1041933 - DNA, 17 bp, Homo sapiens
tggaaggcagggcagag

SEQ ID NO: 1041934 - DNA, 14 bp, Homo sapiens
tggaaggctggctg

SEQ ID NO: 1041935 - DNA, 20 bp, Homo sapiens
tggaagggaggaaggccttt

SEQ ID NO: 1041936 - DNA, 16 bp, Homo sapiens
tggaagggaggagcag

SEQ ID NO: 1041937 - DNA, 18 bp, Homo sapiens
tggaagggcgttctaggt

SEQ ID NO: 1041938 - DNA, 17 bp, Homo sapiens
tggaaggggcagcagga

SEQ ID NO: 1041939 - DNA, 16 bp, Homo sapiens
tggaaggggcagccct

SEQ ID NO: 1041940 - DNA, 17 bp, Homo sapiens
tggaaggggcagccctg

SEQ ID NO: 1041941 - DNA, 14 bp, Homo sapiens
tggaagggggagga

SEQ ID NO: 1041942 - DNA, 23 bp, Homo sapiens
tggaagggggtgtgcgtgcgtgt

SEQ ID NO: 1041943 - DNA, 19 bp, Homo sapiens
tggaaggtctattggccaa

SEQ ID NO: 1041944 - DNA, 14 bp, Homo sapiens
tggaaggtgccaga

SEQ ID NO: 1041945 - DNA, 20 bp, Homo sapiens
tggaaggtttggtgtgtgga

SEQ ID NO: 1041946 - DNA, 21 bp, Homo sapiens
tggaaggtttgtatattgtca

SEQ ID NO: 1041947 - DNA, 13 bp, Homo sapiens
tggaagtatacct

SEQ ID NO: 1041948 - DNA, 17 bp, Homo sapiens
tggaagtatacctggct

SEQ ID NO: 1041949 - DNA, 18 bp, Homo sapiens
tggaagtatacctggctt

SEQ ID NO: 1041950 - DNA, 16 bp, Homo sapiens
tggaagtcacctttct

SEQ ID NO: 1041951 - DNA, 19 bp, Homo sapiens
tggaagtgaaaactttgta

SEQ ID NO: 1041952 - DNA, 13 bp, Homo sapiens
tggaagtgttcag

SEQ ID NO: 1041953 - DNA, 18 bp, Homo sapiens
tggaagttattaacttta

SEQ ID NO: 1041954 - DNA, 20 bp, Homo sapiens
tggaagttctgaattaaaag

SEQ ID NO: 1041955 - DNA, 20 bp, Homo sapiens
tggaagttcttcaagaggaa

SEQ ID NO: 1041956 - DNA, 21 bp, Homo sapiens
tggaagttcttcaagaggaaa

SEQ ID NO: 1041957 - DNA, 21 bp, Homo sapiens
tggaagttggggcactgggcg

SEQ ID NO: 1041958 - DNA, 23 bp, Homo sapiens
tggaagttggggcactgggcgtc

SEQ ID NO: 1041959 - DNA, 19 bp, Homo sapiens
tggaagtttgtgttctgtt

SEQ ID NO: 1041960 - DNA, 13 bp, Homo sapiens
tggaataaacatt

SEQ ID NO: 1041961 - DNA, 18 bp, Homo sapiens
tggaataaacattaattt

SEQ ID NO: 1041962 - DNA, 21 bp, Homo sapiens
tggaataaacattaattttgt

SEQ ID NO: 1041963 - DNA, 23 bp, Homo sapiens
tggaataaattatggcatttcta

SEQ ID NO: 1041964 - DNA, 19 bp, Homo sapiens
tggaataacatgtaattaa

SEQ ID NO: 1041965 - DNA, 12 bp, Homo sapiens
tggaataactct

SEQ ID NO: 1041966 - DNA, 14 bp, Homo sapiens
tggaataatttcta

SEQ ID NO: 1041967 - DNA, 18 bp, Homo sapiens
tggaataatttgtaaatg

SEQ ID NO: 1041968 - DNA, 14 bp, Homo sapiens
tggaatacagtgtt

SEQ ID NO: 1041969 - DNA, 18 bp, Homo sapiens
tggaatactttttgttat

SEQ ID NO: 1041970 - DNA, 14 bp, Homo sapiens
tggaataggaataa

SEQ ID NO: 1041971 - DNA, 16 bp, Homo sapiens
tggaatagtgaatact

SEQ ID NO: 1041972 - DNA, 13 bp, Homo sapiens
tggaatataaaac

SEQ ID NO: 1041973 - DNA, 15 bp, Homo sapiens
tggaatataaatagc

SEQ ID NO: 1041974 - DNA, 16 bp, Homo sapiens
tggaatataaatagct

SEQ ID NO: 1041975 - DNA, 23 bp, Homo sapiens
tggaatataaatagctgaaaact

SEQ ID NO: 1041976 - DNA, 18 bp, Homo sapiens
tggaatataaggaaagca

SEQ ID NO: 1041977 - DNA, 14 bp, Homo sapiens
tggaatataattgt

SEQ ID NO: 1041978 - DNA, 12 bp, Homo sapiens
tggaatattaaa

SEQ ID NO: 1041979 - DNA, 12 bp, Homo sapiens
tggaatattcat

SEQ ID NO: 1041980 - DNA, 13 bp, Homo sapiens
tggaatattgttt

SEQ ID NO: 1041981 - DNA, 14 bp, Homo sapiens
tggaatattgtttc

SEQ ID NO: 1041982 - DNA, 14 bp, Homo sapiens
tggaatattttatc

SEQ ID NO: 1041983 - DNA, 17 bp, Homo sapiens
tggaatattttatcctg

SEQ ID NO: 1041984 - DNA, 21 bp, Homo sapiens
tggaatattttatcctgtatt

SEQ ID NO: 1041985 - DNA, 20 bp, Homo sapiens
tggaatcaaggtaagctcag

SEQ ID NO: 1041986 - DNA, 22 bp, Homo sapiens
tggaatcactgtttagaacaca

SEQ ID NO: 1041987 - DNA, 23 bp, Homo sapiens
tggaatcaggaatattttccaaa

SEQ ID NO: 1041988 - DNA, 18 bp, Homo sapiens
tggaatcagtatttcctt

SEQ ID NO: 1041989 - DNA, 23 bp, Homo sapiens
tggaatcgatttcctcccacctc

SEQ ID NO: 1041990 - DNA, 18 bp, Homo sapiens
tggaatctagccgatgga

SEQ ID NO: 1041991 - DNA, 22 bp, Homo sapiens
tggaatctagccgatggaaaat

SEQ ID NO: 1041992 - DNA, 17 bp, Homo sapiens
tggaatcttcacctcag

SEQ ID NO: 1041993 - DNA, 21 bp, Homo sapiens
tggaatcttcacctcagagtg

SEQ ID NO: 1041994 - DNA, 13 bp, Homo sapiens
tggaatcttctcc

SEQ ID NO: 1041995 - DNA, 13 bp, Homo sapiens
tggaatcttttat

SEQ ID NO: 1041996 - DNA, 18 bp, Homo sapiens
tggaatgaaattcctcct

SEQ ID NO: 1041997 - DNA, 17 bp, Homo sapiens
tggaatgaattaaataa

SEQ ID NO: 1041998 - DNA, 13 bp, Homo sapiens
tggaatgagggag

SEQ ID NO: 1041999 - DNA, 14 bp, Homo sapiens
tggaatgagggagg

SEQ ID NO: 1042000 - DNA, 19 bp, Homo sapiens
tggaatgagtgtgcatgga

SEQ ID NO: 1042001 - DNA, 21 bp, Homo sapiens
tggaatgagtgtgcatggagg

SEQ ID NO: 1042002 - DNA, 18 bp, Homo sapiens
tggaatggaactactgta

SEQ ID NO: 1042003 - DNA, 20 bp, Homo sapiens
tggaatggaactactgtact

SEQ ID NO: 1042004 - DNA, 15 bp, Homo sapiens
tggaatggatttttc

SEQ ID NO: 1042005 - DNA, 20 bp, Homo sapiens
tggaatggtgttttgtcaga

SEQ ID NO: 1042006 - DNA, 20 bp, Homo sapiens
tggaatgtgcccctggccca

SEQ ID NO: 1042007 - DNA, 23 bp, Homo sapiens
tggaatgtggcccctgaacaaga

SEQ ID NO: 1042008 - DNA, 21 bp, Homo sapiens
tggaatgttgggtctcactct

SEQ ID NO: 1042009 - DNA, 23 bp, Homo sapiens
tggaatgtttttccctccccaga

SEQ ID NO: 1042010 - DNA, 14 bp, Homo sapiens
tggaattaaaacaa

SEQ ID NO: 1042011 - DNA, 16 bp, Homo sapiens
tggaattaaaacaaaa

SEQ ID NO: 1042012 - DNA, 19 bp, Homo sapiens
tggaattaaccatttaata

SEQ ID NO: 1042013 - DNA, 21 bp, Homo sapiens
tggaattaaccatttaataaa

SEQ ID NO: 1042014 - DNA, 19 bp, Homo sapiens
tggaattaacctggtgctg

SEQ ID NO: 1042015 - DNA, 18 bp, Homo sapiens
tggaattacaagccctgg

SEQ ID NO: 1042016 - DNA, 15 bp, Homo sapiens
tggaattagagggcc

SEQ ID NO: 1042017 - DNA, 21 bp, Homo sapiens
tggaattagagggccttgctt

SEQ ID NO: 1042018 - DNA, 18 bp, Homo sapiens
tggaattattgtagacat

SEQ ID NO: 1042019 - DNA, 22 bp, Homo sapiens
tggaattattttgaatgtcaca

SEQ ID NO: 1042020 - DNA, 14 bp, Homo sapiens
tggaattcacaaag

SEQ ID NO: 1042021 - DNA, 20 bp, Homo sapiens
tggaattccaacttgaagga

SEQ ID NO: 1042022 - DNA, 21 bp, Homo sapiens
tggaattccaacttgaaggat

SEQ ID NO: 1042023 - DNA, 23 bp, Homo sapiens
tggaattccaacttgaaggattg

SEQ ID NO: 1042024 - DNA, 20 bp, Homo sapiens
tggaattctactggaaaaaa

SEQ ID NO: 1042025 - DNA, 12 bp, Homo sapiens
tggaattgattt

SEQ ID NO: 1042026 - DNA, 17 bp, Homo sapiens
tggaattgatttgcatt

SEQ ID NO: 1042027 - DNA, 23 bp, Homo sapiens
tggaattgcttaccaaaggatag

SEQ ID NO: 1042028 - DNA, 13 bp, Homo sapiens
tggaattggtgta

SEQ ID NO: 1042029 - DNA, 18 bp, Homo sapiens
tggaattggtgtatatca

SEQ ID NO: 1042030 - DNA, 14 bp, Homo sapiens
tggaattgtggcta

SEQ ID NO: 1042031 - DNA, 20 bp, Homo sapiens
tggaattgtggctatcctga

SEQ ID NO: 1042032 - DNA, 14 bp, Homo sapiens
tggaatttctgctg

SEQ ID NO: 1042033 - DNA, 14 bp, Homo sapiens
tggaatttctggcc

SEQ ID NO: 1042034 - DNA, 16 bp, Homo sapiens
tggaatttctggcctc

SEQ ID NO: 1042035 - DNA, 16 bp, Homo sapiens
tggaatttgcctgctg

SEQ ID NO: 1042036 - DNA, 16 bp, Homo sapiens
tggaatttgtaacctc

SEQ ID NO: 1042037 - DNA, 18 bp, Homo sapiens
tggaatttgtaacctcag

SEQ ID NO: 1042038 - DNA, 12 bp, Homo sapiens
tggaatttttct

SEQ ID NO: 1042039 - DNA, 19 bp, Homo sapiens
tggacaaaattaatacatt

SEQ ID NO: 1042040 - DNA, 19 bp, Homo sapiens
tggacaaacccttctttta

SEQ ID NO: 1042041 - DNA, 14 bp, Homo sapiens
tggacaaagaaaac

SEQ ID NO: 1042042 - DNA, 23 bp, Homo sapiens
tggacaaagaattccaaagcaaa

SEQ ID NO: 1042043 - DNA, 14 bp, Homo sapiens
tggacaaaggcctg

SEQ ID NO: 1042044 - DNA, 22 bp, Homo sapiens
tggacaacactgattcctggag

SEQ ID NO: 1042045 - DNA, 18 bp, Homo sapiens
tggacaacagctctcgtt

SEQ ID NO: 1042046 - DNA, 16 bp, Homo sapiens
tggacaacttatttaa

SEQ ID NO: 1042047 - DNA, 21 bp, Homo sapiens
tggacaatcttatgtttccaa

SEQ ID NO: 1042048 - DNA, 19 bp, Homo sapiens
tggacacaaattttcaagt

SEQ ID NO: 1042049 - DNA, 14 bp, Homo sapiens
tggacacaaggcac

SEQ ID NO: 1042050 - DNA, 22 bp, Homo sapiens
tggacacacactcaccagtggc

SEQ ID NO: 1042051 - DNA, 21 bp, Homo sapiens
tggacacactaaactctgggg

SEQ ID NO: 1042052 - DNA, 23 bp, Homo sapiens
tggacacagatcccactggaaga

SEQ ID NO: 1042053 - DNA, 16 bp, Homo sapiens
tggacacattggaatg

SEQ ID NO: 1042054 - DNA, 21 bp, Homo sapiens
tggacacattggaatgccttg

SEQ ID NO: 1042055 - DNA, 22 bp, Homo sapiens
tggacacattggaatgccttgg

SEQ ID NO: 1042056 - DNA, 18 bp, Homo sapiens
tggacaccaggagtccct

SEQ ID NO: 1042057 - DNA, 17 bp, Homo sapiens
tggacaccccagacctg

SEQ ID NO: 1042058 - DNA, 13 bp, Homo sapiens
tggacacccccag

SEQ ID NO: 1042059 - DNA, 13 bp, Homo sapiens
tggacacccctgc

SEQ ID NO: 1042060 - DNA, 21 bp, Homo sapiens
tggacaccccttatccaggac

SEQ ID NO: 1042061 - DNA, 13 bp, Homo sapiens
tggacacctccca

SEQ ID NO: 1042062 - DNA, 15 bp, Homo sapiens
tggacacctcccagg

SEQ ID NO: 1042063 - DNA, 14 bp, Homo sapiens
tggacacgagccac

SEQ ID NO: 1042064 - DNA, 15 bp, Homo sapiens
tggacacgagccaca

SEQ ID NO: 1042065 - DNA, 23 bp, Homo sapiens
tggacacgagccacaagctgcac

SEQ ID NO: 1042066 - DNA, 19 bp, Homo sapiens
tggacactacacccagcaa

SEQ ID NO: 1042067 - DNA, 15 bp, Homo sapiens
tggacactcagacct

SEQ ID NO: 1042068 - DNA, 14 bp, Homo sapiens
tggacactccaggg

SEQ ID NO: 1042069 - DNA, 18 bp, Homo sapiens
tggacactccagggacac

SEQ ID NO: 1042070 - DNA, 24 bp, Homo sapiens
tggacactccagggacacacagcc

SEQ ID NO: 1042071 - DNA, 19 bp, Homo sapiens
tggacactccagtgccagc

SEQ ID NO: 1042072 - DNA, 12 bp, Homo sapiens
tggacactgcct

SEQ ID NO: 1042073 - DNA, 13 bp, Homo sapiens
tggacactgcctt

SEQ ID NO: 1042074 - DNA, 14 bp, Homo sapiens
tggacactttgaaa

SEQ ID NO: 1042075 - DNA, 22 bp, Homo sapiens
tggacactttgaaatgtgtttc

SEQ ID NO: 1042076 - DNA, 12 bp, Homo sapiens
tggacagacacc

SEQ ID NO: 1042077 - DNA, 12 bp, Homo sapiens
tggacagagggg

SEQ ID NO: 1042078 - DNA, 16 bp, Homo sapiens
tggacagatggacgca

SEQ ID NO: 1042079 - DNA, 22 bp, Homo sapiens
tggacagatggacgcaggccct

SEQ ID NO: 1042080 - DNA, 18 bp, Homo sapiens
tggacagatggcccaagg

SEQ ID NO: 1042081 - DNA, 21 bp, Homo sapiens
tggacagatggcccaagggat

SEQ ID NO: 1042082 - DNA, 15 bp, Homo sapiens
tggacagatttcagt

SEQ ID NO: 1042083 - DNA, 21 bp, Homo sapiens
tggacagatttcagtaatgtc

SEQ ID NO: 1042084 - DNA, 22 bp, Homo sapiens
tggacagatttcagtaatgtct

SEQ ID NO: 1042085 - DNA, 15 bp, Homo sapiens
tggacagcaaaacca

SEQ ID NO: 1042086 - DNA, 20 bp, Homo sapiens
tggacagcaaaaccattgct

SEQ ID NO: 1042087 - DNA, 12 bp, Homo sapiens
tggacagcagaa

SEQ ID NO: 1042088 - DNA, 16 bp, Homo sapiens
tggacagcagaagcct

SEQ ID NO: 1042089 - DNA, 17 bp, Homo sapiens
tggacagcggcagtggg

SEQ ID NO: 1042090 - DNA, 15 bp, Homo sapiens
tggacagctgcttgt

SEQ ID NO: 1042091 - DNA, 18 bp, Homo sapiens
tggacaggagatcagcag

SEQ ID NO: 1042092 - DNA, 19 bp, Homo sapiens
tggacaggagatcagcagc

SEQ ID NO: 1042093 - DNA, 16 bp, Homo sapiens
tggacaggcagcctcc

SEQ ID NO: 1042094 - DNA, 15 bp, Homo sapiens
tggacagggccaggg

SEQ ID NO: 1042095 - DNA, 18 bp, Homo sapiens
tggacagtacctgattgt

SEQ ID NO: 1042096 - DNA, 15 bp, Homo sapiens
tggacagtagaattt

SEQ ID NO: 1042097 - DNA, 17 bp, Homo sapiens
tggacagtcctgggaga

SEQ ID NO: 1042098 - DNA, 15 bp, Homo sapiens
tggacagtggcctct

SEQ ID NO: 1042099 - DNA, 15 bp, Homo sapiens
tggacatactgctgg

SEQ ID NO: 1042100 - DNA, 14 bp, Homo sapiens
tggacatcctcctc

SEQ ID NO: 1042101 - DNA, 18 bp, Homo sapiens
tggacatcctcctcccac

SEQ ID NO: 1042102 - DNA, 21 bp, Homo sapiens
tggacatctctctggcttctg

SEQ ID NO: 1042103 - DNA, 18 bp, Homo sapiens
tggacatgaagattcttt

SEQ ID NO: 1042104 - DNA, 22 bp, Homo sapiens
tggacatggcaggccgatttgg

SEQ ID NO: 1042105 - DNA, 18 bp, Homo sapiens
tggacatggcccattgga

SEQ ID NO: 1042106 - DNA, 15 bp, Homo sapiens
tggacatggtcacag

SEQ ID NO: 1042107 - DNA, 16 bp, Homo sapiens
tggacatggtcacagt

SEQ ID NO: 1042108 - DNA, 15 bp, Homo sapiens
tggacattgtctgcg

SEQ ID NO: 1042109 - DNA, 17 bp, Homo sapiens
tggacatttagaagaaa

SEQ ID NO: 1042110 - DNA, 16 bp, Homo sapiens
tggaccaacctgctct

SEQ ID NO: 1042111 - DNA, 21 bp, Homo sapiens
tggaccaacctgctctgtccc

SEQ ID NO: 1042112 - DNA, 20 bp, Homo sapiens
tggaccaatagggctgagct

SEQ ID NO: 1042113 - DNA, 19 bp, Homo sapiens
tggaccaccagccccagca

SEQ ID NO: 1042114 - DNA, 20 bp, Homo sapiens
tggaccacgccgccctccat

SEQ ID NO: 1042115 - DNA, 22 bp, Homo sapiens
tggaccacgccgccctccatcc

SEQ ID NO: 1042116 - DNA, 18 bp, Homo sapiens
tggaccactcctgtccct

SEQ ID NO: 1042117 - DNA, 12 bp, Homo sapiens
tggaccactgca

SEQ ID NO: 1042118 - DNA, 13 bp, Homo sapiens
tggaccaggacag

SEQ ID NO: 1042119 - DNA, 20 bp, Homo sapiens
tggaccaggcctggagggca

SEQ ID NO: 1042120 - DNA, 20 bp, Homo sapiens
tggaccagtcccgtcgtgca

SEQ ID NO: 1042121 - DNA, 14 bp, Homo sapiens
tggaccatctctgt

SEQ ID NO: 1042122 - DNA, 15 bp, Homo sapiens
tggaccatgccagat

SEQ ID NO: 1042123 - DNA, 21 bp, Homo sapiens
tggaccatttgattgttttat

SEQ ID NO: 1042124 - DNA, 14 bp, Homo sapiens
tggacccagacaca

SEQ ID NO: 1042125 - DNA, 15 bp, Homo sapiens
tggacccagggcctg

SEQ ID NO: 1042126 - DNA, 18 bp, Homo sapiens
tggacccagggcctgact

SEQ ID NO: 1042127 - DNA, 19 bp, Homo sapiens
tggacccagggcctgactt

SEQ ID NO: 1042128 - DNA, 13 bp, Homo sapiens
tggaccccagctg

SEQ ID NO: 1042129 - DNA, 15 bp, Homo sapiens
tggacccctcccttg

SEQ ID NO: 1042130 - DNA, 20 bp, Homo sapiens
tggacccctggggtggccag

SEQ ID NO: 1042131 - DNA, 21 bp, Homo sapiens
tggacccctggggtggccagg

SEQ ID NO: 1042132 - DNA, 14 bp, Homo sapiens
tggaccctggtgac

SEQ ID NO: 1042133 - DNA, 23 bp, Homo sapiens
tggaccctgtggatgataaaaca

SEQ ID NO: 1042134 - DNA, 15 bp, Homo sapiens
tggaccctgtggcca

SEQ ID NO: 1042135 - DNA, 16 bp, Homo sapiens
tggaccgagatgtgag

SEQ ID NO: 1042136 - DNA, 16 bp, Homo sapiens
tggaccgggtgggcct

SEQ ID NO: 1042137 - DNA, 17 bp, Homo sapiens
tggaccgggtgggcctg

SEQ ID NO: 1042138 - DNA, 13 bp, Homo sapiens
tggacctaacatt

SEQ ID NO: 1042139 - DNA, 15 bp, Homo sapiens
tggacctaacattcg

SEQ ID NO: 1042140 - DNA, 17 bp, Homo sapiens
tggacctaacattcgat

SEQ ID NO: 1042141 - DNA, 14 bp, Homo sapiens
tggacctaatccaa

SEQ ID NO: 1042142 - DNA, 22 bp, Homo sapiens
tggacctaatccaagcatccct

SEQ ID NO: 1042143 - DNA, 22 bp, Homo sapiens
tggacctagcctggatggcccc

SEQ ID NO: 1042144 - DNA, 21 bp, Homo sapiens
tggacctatgcagggaggcca

SEQ ID NO: 1042145 - DNA, 22 bp, Homo sapiens
tggacctatgcagggaggccac

SEQ ID NO: 1042146 - DNA, 19 bp, Homo sapiens
tggacctatgtcctaagga

SEQ ID NO: 1042147 - DNA, 15 bp, Homo sapiens
tggacctcaggaggg

SEQ ID NO: 1042148 - DNA, 18 bp, Homo sapiens
tggacctcaggagggcag

SEQ ID NO: 1042149 - DNA, 19 bp, Homo sapiens
tggacctcaggagggcagg

SEQ ID NO: 1042150 - DNA, 17 bp, Homo sapiens
tggacctccaggggctc

SEQ ID NO: 1042151 - DNA, 21 bp, Homo sapiens
tggacctccaggggctcctgg

SEQ ID NO: 1042152 - DNA, 19 bp, Homo sapiens
tggacctccatccctgctc

SEQ ID NO: 1042153 - DNA, 15 bp, Homo sapiens
tggacctctgctctg

SEQ ID NO: 1042154 - DNA, 18 bp, Homo sapiens
tggacctgccccggacct

SEQ ID NO: 1042155 - DNA, 14 bp, Homo sapiens
tggacctgcctgca

SEQ ID NO: 1042156 - DNA, 15 bp, Homo sapiens
tggacctgcctgcat

SEQ ID NO: 1042157 - DNA, 17 bp, Homo sapiens
tggacctgggggtagcc

SEQ ID NO: 1042158 - DNA, 21 bp, Homo sapiens
tggaccttaggccttcctctc

SEQ ID NO: 1042159 - DNA, 12 bp, Homo sapiens
tggaccttcctg

SEQ ID NO: 1042160 - DNA, 13 bp, Homo sapiens
tggaccttcctgc

SEQ ID NO: 1042161 - DNA, 21 bp, Homo sapiens
tggacctttgggttctttctg

SEQ ID NO: 1042162 - DNA, 17 bp, Homo sapiens
tggacgaatatgaatgt

SEQ ID NO: 1042163 - DNA, 14 bp, Homo sapiens
tggacgagaaggtg

SEQ ID NO: 1042164 - DNA, 16 bp, Homo sapiens
tggacgcaggccctgt

SEQ ID NO: 1042165 - DNA, 20 bp, Homo sapiens
tggacgcaggccctgtccag

SEQ ID NO: 1042166 - DNA, 13 bp, Homo sapiens
tggacggcaggct

SEQ ID NO: 1042167 - DNA, 15 bp, Homo sapiens
tggacggctgggcac

SEQ ID NO: 1042168 - DNA, 21 bp, Homo sapiens
tggacggggtcggacggggca

SEQ ID NO: 1042169 - DNA, 18 bp, Homo sapiens
tggacggtttctagcctc

SEQ ID NO: 1042170 - DNA, 19 bp, Homo sapiens
tggacgtcacgctccctga

SEQ ID NO: 1042171 - DNA, 19 bp, Homo sapiens
tggactaaatatctgtcat

SEQ ID NO: 1042172 - DNA, 23 bp, Homo sapiens
tggactaagatgaaatgcactgt

SEQ ID NO: 1042173 - DNA, 14 bp, Homo sapiens
tggactacaaaata

SEQ ID NO: 1042174 - DNA, 20 bp, Homo sapiens
tggactacacccaagcctga

SEQ ID NO: 1042175 - DNA, 24 bp, Homo sapiens
tggactacccacgttctcacaccc

SEQ ID NO: 1042176 - DNA, 19 bp, Homo sapiens
tggactagcaaaggaaaat

SEQ ID NO: 1042177 - DNA, 15 bp, Homo sapiens
tggactatctgtctg

SEQ ID NO: 1042178 - DNA, 23 bp, Homo sapiens
tggactatctgtctggtggcccc

SEQ ID NO: 1042179 - DNA, 17 bp, Homo sapiens
tggactcaggatccagt

SEQ ID NO: 1042180 - DNA, 15 bp, Homo sapiens
tggactcagggcagc

SEQ ID NO: 1042181 - DNA, 22 bp, Homo sapiens
tggactccagcctgcctggcag

SEQ ID NO: 1042182 - DNA, 18 bp, Homo sapiens
tggactccggaggactga

SEQ ID NO: 1042183 - DNA, 21 bp, Homo sapiens
tggactccggaggactgagcc

SEQ ID NO: 1042184 - DNA, 13 bp, Homo sapiens
tggactcctctgt

SEQ ID NO: 1042185 - DNA, 19 bp, Homo sapiens
tggactcctgccaccagca

SEQ ID NO: 1042186 - DNA, 14 bp, Homo sapiens
tggactctaaagtc

SEQ ID NO: 1042187 - DNA, 19 bp, Homo sapiens
tggactctaagctggagct

SEQ ID NO: 1042188 - DNA, 17 bp, Homo sapiens
tggactctacactgtga

SEQ ID NO: 1042189 - DNA, 12 bp, Homo sapiens
tggactctcagg

SEQ ID NO: 1042190 - DNA, 13 bp, Homo sapiens
tggactctcaggg

SEQ ID NO: 1042191 - DNA, 20 bp, Homo sapiens
tggactctcagtctctgagc

SEQ ID NO: 1042192 - DNA, 22 bp, Homo sapiens
tggactctcagtctctgagcag

SEQ ID NO: 1042193 - DNA, 18 bp, Homo sapiens
tggactctgcatcccagc

SEQ ID NO: 1042194 - DNA, 17 bp, Homo sapiens
tggactctgccccaatc

SEQ ID NO: 1042195 - DNA, 12 bp, Homo sapiens
tggactctggga

SEQ ID NO: 1042196 - DNA, 14 bp, Homo sapiens
tggactcttgctct

SEQ ID NO: 1042197 - DNA, 15 bp, Homo sapiens
tggactcttgctctt

SEQ ID NO: 1042198 - DNA, 18 bp, Homo sapiens
tggactcttgctctttct

SEQ ID NO: 1042199 - DNA, 23 bp, Homo sapiens
tggactgacagcatgtgccctcc

SEQ ID NO: 1042200 - DNA, 23 bp, Homo sapiens
tggactgcatggggaggcagcag

SEQ ID NO: 1042201 - DNA, 12 bp, Homo sapiens
tggactgcattt

SEQ ID NO: 1042202 - DNA, 13 bp, Homo sapiens
tggactgcattta

SEQ ID NO: 1042203 - DNA, 17 bp, Homo sapiens
tggactggaggcccctg

SEQ ID NO: 1042204 - DNA, 21 bp, Homo sapiens
tggactggaggcccctggagc

SEQ ID NO: 1042205 - DNA, 12 bp, Homo sapiens
tggactggcctg

SEQ ID NO: 1042206 - DNA, 13 bp, Homo sapiens
tggactggctaga

SEQ ID NO: 1042207 - DNA, 19 bp, Homo sapiens
tggactggctagagtcctc

SEQ ID NO: 1042208 - DNA, 22 bp, Homo sapiens
tggactggctagagtcctcact

SEQ ID NO: 1042209 - DNA, 17 bp, Homo sapiens
tggactggggagcacag

SEQ ID NO: 1042210 - DNA, 21 bp, Homo sapiens
tggactgggttgcgtcctgac

SEQ ID NO: 1042211 - DNA, 15 bp, Homo sapiens
tggactgtcatagaa

SEQ ID NO: 1042212 - DNA, 21 bp, Homo sapiens
tggactgtcatagaaattaca

SEQ ID NO: 1042213 - DNA, 12 bp, Homo sapiens
tggactgtcctg

SEQ ID NO: 1042214 - DNA, 22 bp, Homo sapiens
tggactgtcctgaggagccctg

SEQ ID NO: 1042215 - DNA, 20 bp, Homo sapiens
tggactgtgatgccacacag

SEQ ID NO: 1042216 - DNA, 21 bp, Homo sapiens
tggactgtgatgccacacaga

SEQ ID NO: 1042217 - DNA, 20 bp, Homo sapiens
tggactgtgcctcaggccag

SEQ ID NO: 1042218 - DNA, 22 bp, Homo sapiens
tggactgtgcctcaggccaggg

SEQ ID NO: 1042219 - DNA, 18 bp, Homo sapiens
tggactgttcaagcaaaa

SEQ ID NO: 1042220 - DNA, 15 bp, Homo sapiens
tggactgttccaggc

SEQ ID NO: 1042221 - DNA, 14 bp, Homo sapiens
tggactgttttcaa

SEQ ID NO: 1042222 - DNA, 16 bp, Homo sapiens
tggactgttttcaata

SEQ ID NO: 1042223 - DNA, 15 bp, Homo sapiens
tggacttaaagaaaa

SEQ ID NO: 1042224 - DNA, 17 bp, Homo sapiens
tggacttaaccggagtt

SEQ ID NO: 1042225 - DNA, 14 bp, Homo sapiens
tggacttacaaaat

SEQ ID NO: 1042226 - DNA, 19 bp, Homo sapiens
tggacttacaaaatgccaa

SEQ ID NO: 1042227 - DNA, 14 bp, Homo sapiens
tggacttcctgggg

SEQ ID NO: 1042228 - DNA, 18 bp, Homo sapiens
tggacttctacctgccct

SEQ ID NO: 1042229 - DNA, 11 bp, Homo sapiens
tggacttctgg

SEQ ID NO: 1042230 - DNA, 20 bp, Homo sapiens
tggacttcttttactcatga

SEQ ID NO: 1042231 - DNA, 13 bp, Homo sapiens
tggacttgagaaa

SEQ ID NO: 1042232 - DNA, 17 bp, Homo sapiens
tggacttgagcttggca

SEQ ID NO: 1042233 - DNA, 20 bp, Homo sapiens
tggacttggtcaccagctcc

SEQ ID NO: 1042234 - DNA, 15 bp, Homo sapiens
tggacttgtatattt

SEQ ID NO: 1042235 - DNA, 20 bp, Homo sapiens
tggacttgtatatttgtaca

SEQ ID NO: 1042236 - DNA, 18 bp, Homo sapiens
tggactttctctaataat

SEQ ID NO: 1042237 - DNA, 20 bp, Homo sapiens
tggactttctctaataataa

SEQ ID NO: 1042238 - DNA, 22 bp, Homo sapiens
tggacttttcgttaacattgac

SEQ ID NO: 1042239 - DNA, 18 bp, Homo sapiens
tggacttttttttttctt

SEQ ID NO: 1042240 - DNA, 18 bp, Homo sapiens
tggagaaaaagatatgct

SEQ ID NO: 1042241 - DNA, 22 bp, Homo sapiens
tggagaaaatgggtttattcac

SEQ ID NO: 1042242 - DNA, 18 bp, Homo sapiens
tggagaaaattggaactc

SEQ ID NO: 1042243 - DNA, 19 bp, Homo sapiens
tggagaaaattggaactct

SEQ ID NO: 1042244 - DNA, 19 bp, Homo sapiens
tggagaaagaagtggagac

SEQ ID NO: 1042245 - DNA, 15 bp, Homo sapiens
tggagaaagctcatg

SEQ ID NO: 1042246 - DNA, 15 bp, Homo sapiens
tggagaaaggagtga

SEQ ID NO: 1042247 - DNA, 18 bp, Homo sapiens
tggagaaagtaagtcttt

SEQ ID NO: 1042248 - DNA, 21 bp, Homo sapiens
tggagaaattatttaataaaa

SEQ ID NO: 1042249 - DNA, 23 bp, Homo sapiens
tggagaaccagggctcttctcag

SEQ ID NO: 1042250 - DNA, 22 bp, Homo sapiens
tggagaacccaggggacagctg

SEQ ID NO: 1042251 - DNA, 18 bp, Homo sapiens
tggagaacgccagtctcc

SEQ ID NO: 1042252 - DNA, 14 bp, Homo sapiens
tggagaactagaga

SEQ ID NO: 1042253 - DNA, 14 bp, Homo sapiens
tggagaactcggtt

SEQ ID NO: 1042254 - DNA, 14 bp, Homo sapiens
tggagaagctgcag

SEQ ID NO: 1042255 - DNA, 22 bp, Homo sapiens
tggagaagtgtcgttttcataa

SEQ ID NO: 1042256 - DNA, 19 bp, Homo sapiens
tggagaatactttgcttca

SEQ ID NO: 1042257 - DNA, 14 bp, Homo sapiens
tggagaattatata

SEQ ID NO: 1042258 - DNA, 16 bp, Homo sapiens
tggagacaaggtgcta

SEQ ID NO: 1042259 - DNA, 18 bp, Homo sapiens
tggagacaaggtgctaac

SEQ ID NO: 1042260 - DNA, 23 bp, Homo sapiens
tggagacactcctataaggagag

SEQ ID NO: 1042261 - DNA, 16 bp, Homo sapiens
tggagaccctgccaca

SEQ ID NO: 1042262 - DNA, 19 bp, Homo sapiens
tggagaccctgccacagcc

SEQ ID NO: 1042263 - DNA, 21 bp, Homo sapiens
tggagaccctgccacagccag

SEQ ID NO: 1042264 - DNA, 21 bp, Homo sapiens
tggagaccgcttcacccctgc

SEQ ID NO: 1042265 - DNA, 18 bp, Homo sapiens
tggagactaagccctgtc

SEQ ID NO: 1042266 - DNA, 19 bp, Homo sapiens
tggagactcctgccctgtt

SEQ ID NO: 1042267 - DNA, 19 bp, Homo sapiens
tggagactgcttcccatcc

SEQ ID NO: 1042268 - DNA, 14 bp, Homo sapiens
tggagactgtctca

SEQ ID NO: 1042269 - DNA, 21 bp, Homo sapiens
tggagacttagggcaccaggg

SEQ ID NO: 1042270 - DNA, 13 bp, Homo sapiens
tggagagaagctg

SEQ ID NO: 1042271 - DNA, 15 bp, Homo sapiens
tggagagaaggcctc

SEQ ID NO: 1042272 - DNA, 18 bp, Homo sapiens
tgatgtttttaaaggttt

SEQ ID NO: 1042273 - DNA, 16 bp, Homo sapiens
tgattaaaatgtttga

SEQ ID NO: 1042274 - DNA, 15 bp, Homo sapiens
tgattaaagatgagc

SEQ ID NO: 1042275 - DNA, 19 bp, Homo sapiens
tgattaaatatttgaagag

SEQ ID NO: 1042276 - DNA, 13 bp, Homo sapiens
tgattaaattctt

SEQ ID NO: 1042277 - DNA, 16 bp, Homo sapiens
tgattaaattcttgca

SEQ ID NO: 1042278 - DNA, 20 bp, Homo sapiens
tgattaagaaaacattgctt

SEQ ID NO: 1042279 - DNA, 17 bp, Homo sapiens
tgattaatggaaatgtt

SEQ ID NO: 1042280 - DNA, 15 bp, Homo sapiens
tgattaatgtttctt

SEQ ID NO: 1042281 - DNA, 16 bp, Homo sapiens
tgattaatgttttcat

SEQ ID NO: 1042282 - DNA, 21 bp, Homo sapiens
tgattaattcaccttccagtg

SEQ ID NO: 1042283 - DNA, 21 bp, Homo sapiens
tgattaatttctgccatttca

SEQ ID NO: 1042284 - DNA, 21 bp, Homo sapiens
tgattacaaataaacagttgt

SEQ ID NO: 1042285 - DNA, 15 bp, Homo sapiens
tgattacatagatca

SEQ ID NO: 1042286 - DNA, 20 bp, Homo sapiens
tgattactggcctttttcat

SEQ ID NO: 1042287 - DNA, 23 bp, Homo sapiens
tgattactggcctttttcattta

SEQ ID NO: 1042288 - DNA, 24 bp, Homo sapiens
tgattactgtcaaggctgcttaga

SEQ ID NO: 1042289 - DNA, 16 bp, Homo sapiens
tgattactgtcaataa

SEQ ID NO: 1042290 - DNA, 23 bp, Homo sapiens
tgattactgtcaataaacagctt

SEQ ID NO: 1042291 - DNA, 23 bp, Homo sapiens
tgattagaaattacctgtggata

SEQ ID NO: 1042292 - DNA, 17 bp, Homo sapiens
tgattagacagaacacc

SEQ ID NO: 1042293 - DNA, 14 bp, Homo sapiens
tgattagatcacat

SEQ ID NO: 1042294 - DNA, 13 bp, Homo sapiens
tgattagcaagtt

SEQ ID NO: 1042295 - DNA, 18 bp, Homo sapiens
tgattagcaagttacagt

SEQ ID NO: 1042296 - DNA, 20 bp, Homo sapiens
tgattataaatgtttggaaa

SEQ ID NO: 1042297 - DNA, 21 bp, Homo sapiens
tgattataaatgtttggaaag

SEQ ID NO: 1042298 - DNA, 18 bp, Homo sapiens
tgattatagcaactaatg

SEQ ID NO: 1042299 - DNA, 15 bp, Homo sapiens
tgattatcttcagcc

SEQ ID NO: 1042300 - DNA, 19 bp, Homo sapiens
tgattatcttcagcccagg

SEQ ID NO: 1042301 - DNA, 18 bp, Homo sapiens
tgattatggagccttaga

SEQ ID NO: 1042302 - DNA, 16 bp, Homo sapiens
tgacccttctctcact

SEQ ID NO: 1042303 - DNA, 23 bp, Homo sapiens
tgacccttgagcttaaacagaag

SEQ ID NO: 1042304 - DNA, 15 bp, Homo sapiens
tgacccttgctgtga

SEQ ID NO: 1042305 - DNA, 17 bp, Homo sapiens
tgacccttttctgatcg

SEQ ID NO: 1042306 - DNA, 18 bp, Homo sapiens
tgaccgactaccccagtc

SEQ ID NO: 1042307 - DNA, 19 bp, Homo sapiens
tgaccgatgtgtctcccag

SEQ ID NO: 1042308 - DNA, 21 bp, Homo sapiens
tgaccgcacgttctctgcccc

SEQ ID NO: 1042309 - DNA, 17 bp, Homo sapiens
tgaccgcccagctctcc

SEQ ID NO: 1042310 - DNA, 22 bp, Homo sapiens
tgaccgcccagctctcccacat

SEQ ID NO: 1042311 - DNA, 19 bp, Homo sapiens
tgaccgcgactaatttcaa

SEQ ID NO: 1042312 - DNA, 14 bp, Homo sapiens
tgaccgctctccct

SEQ ID NO: 1042313 - DNA, 15 bp, Homo sapiens
tgaccgctctccctt

SEQ ID NO: 1042314 - DNA, 16 bp, Homo sapiens
tgaccgctctcccttt

SEQ ID NO: 1042315 - DNA, 18 bp, Homo sapiens
tgaccgggggctgctggg

SEQ ID NO: 1042316 - DNA, 19 bp, Homo sapiens
tgaccgggggctgctgggc

SEQ ID NO: 1042317 - DNA, 20 bp, Homo sapiens
tgaccgggggctgctgggcg

SEQ ID NO: 1042318 - DNA, 15 bp, Homo sapiens
tgaccgtactctcac

SEQ ID NO: 1042319 - DNA, 17 bp, Homo sapiens
tgaccgttttcatcctg

SEQ ID NO: 1042320 - DNA, 19 bp, Homo sapiens
tgacctacctcaaagggca

SEQ ID NO: 1042321 - DNA, 21 bp, Homo sapiens
tgacctagaccagtttgcatg

SEQ ID NO: 1042322 - DNA, 23 bp, Homo sapiens
tgacctagctctttgggcctctc

SEQ ID NO: 1042323 - DNA, 17 bp, Homo sapiens
tgacctagttttccatg

SEQ ID NO: 1042324 - DNA, 13 bp, Homo sapiens
tgacctattcacc

SEQ ID NO: 1042325 - DNA, 20 bp, Homo sapiens
tgacctattcaccctccact

SEQ ID NO: 1042326 - DNA, 22 bp, Homo sapiens
tgacctattcaccctccacttc

SEQ ID NO: 1042327 - DNA, 14 bp, Homo sapiens
tgacctcactgtga

SEQ ID NO: 1042328 - DNA, 21 bp, Homo sapiens
tgacctcagctgcacattcct

SEQ ID NO: 1042329 - DNA, 22 bp, Homo sapiens
tgacctcagctgcacattcctg

SEQ ID NO: 1042330 - DNA, 20 bp, Homo sapiens
tgacctcaggtgatctgccc

SEQ ID NO: 1042331 - DNA, 15 bp, Homo sapiens
tgacctcccaactct

SEQ ID NO: 1042332 - DNA, 17 bp, Homo sapiens
tgacctcccctccccag

SEQ ID NO: 1042333 - DNA, 22 bp, Homo sapiens
tgacctccctctaatttatctt

SEQ ID NO: 1042334 - DNA, 17 bp, Homo sapiens
tgacctccgccatccac

SEQ ID NO: 1042335 - DNA, 18 bp, Homo sapiens
tgacctccgcccctgccc

SEQ ID NO: 1042336 - DNA, 19 bp, Homo sapiens
tgacctccgcccctgcccc

SEQ ID NO: 1042337 - DNA, 23 bp, Homo sapiens
tgacctccgcccctgcccccgct

SEQ ID NO: 1042338 - DNA, 23 bp, Homo sapiens
tgacctcctgtcactcactgagg

SEQ ID NO: 1042339 - DNA, 18 bp, Homo sapiens
tgacctcgtgatccaccc

SEQ ID NO: 1042340 - DNA, 19 bp, Homo sapiens
tgacctctctacttcccct

SEQ ID NO: 1042341 - DNA, 23 bp, Homo sapiens
tgacctctgcagcaataaagcag

SEQ ID NO: 1042342 - DNA, 12 bp, Homo sapiens
tgacctctgctg

SEQ ID NO: 1042343 - DNA, 18 bp, Homo sapiens
tgacctctgctgagtgct

SEQ ID NO: 1042344 - DNA, 12 bp, Homo sapiens
tgacctcttgct

SEQ ID NO: 1042345 - DNA, 19 bp, Homo sapiens
tgactgaacgatccttcaa

SEQ ID NO: 1042346 - DNA, 18 bp, Homo sapiens
tgactgaaggggcacacc

SEQ ID NO: 1042347 - DNA, 20 bp, Homo sapiens
tgactgaatttgggcctctt

SEQ ID NO: 1042348 - DNA, 21 bp, Homo sapiens
tgactgaatttgggcctcttg

SEQ ID NO: 1042349 - DNA, 14 bp, Homo sapiens
tgactgaccatgca

SEQ ID NO: 1042350 - DNA, 20 bp, Homo sapiens
tgactgagagcccactgcag

SEQ ID NO: 1042351 - DNA, 22 bp, Homo sapiens
tgactgagcaagaccctgtctc

SEQ ID NO: 1042352 - DNA, 20 bp, Homo sapiens
tgactgatagcttacactga

SEQ ID NO: 1042353 - DNA, 22 bp, Homo sapiens
tgactgatagcttacactgagg

SEQ ID NO: 1042354 - DNA, 16 bp, Homo sapiens
tgactgcacccagctc

SEQ ID NO: 1042355 - DNA, 21 bp, Homo sapiens
tgactgcattttactgtacag

SEQ ID NO: 1042356 - DNA, 21 bp, Homo sapiens
tgactgccaggataaagcttc

SEQ ID NO: 1042357 - DNA, 20 bp, Homo sapiens
tgactgccccaactcctgga

SEQ ID NO: 1042358 - DNA, 20 bp, Homo sapiens
tgactgcccgctcctcggga

SEQ ID NO: 1042359 - DNA, 17 bp, Homo sapiens
tgactgcgatcttcaga

SEQ ID NO: 1042360 - DNA, 21 bp, Homo sapiens
tgactgctccccagccctggc

SEQ ID NO: 1042361 - DNA, 22 bp, Homo sapiens
tgactgctccccagccctggct

SEQ ID NO: 1042362 - DNA, 18 bp, Homo sapiens
tgactggaagttgtggat

SEQ ID NO: 1042363 - DNA, 11 bp, Homo sapiens
tgactggcagg

SEQ ID NO: 1042364 - DNA, 12 bp, Homo sapiens
tgactggcaggt

SEQ ID NO: 1042365 - DNA, 14 bp, Homo sapiens
tgactggcaggtgc

SEQ ID NO: 1042366 - DNA, 21 bp, Homo sapiens
tgactggcaggtgcagatggg

SEQ ID NO: 1042367 - DNA, 24 bp, Homo sapiens
tgactggcaggtgcagatgggctg

SEQ ID NO: 1042368 - DNA, 20 bp, Homo sapiens
tgactggccaaacccttgct

SEQ ID NO: 1042369 - DNA, 22 bp, Homo sapiens
tgactggctgtctgcctgtatt

SEQ ID NO: 1042370 - DNA, 17 bp, Homo sapiens
tgactggcttcagcaag

SEQ ID NO: 1042371 - DNA, 21 bp, Homo sapiens
tgactgggcaacactgcagga

SEQ ID NO: 1042372 - DNA, 23 bp, Homo sapiens
tgactgggcaacactgcaggaca

SEQ ID NO: 1042373 - DNA, 11 bp, Homo sapiens
tgactgggcca

SEQ ID NO: 1042374 - DNA, 14 bp, Homo sapiens
tgactgggcctccc

SEQ ID NO: 1042375 - DNA, 17 bp, Homo sapiens
tgactgggcctcccttg

SEQ ID NO: 1042376 - DNA, 17 bp, Homo sapiens
tgactggttgtcagaat

SEQ ID NO: 1042377 - DNA, 20 bp, Homo sapiens
tgactggttgtcagaatgga

SEQ ID NO: 1042378 - DNA, 23 bp, Homo sapiens
tgactggtttacaggccctgctc

SEQ ID NO: 1042379 - DNA, 14 bp, Homo sapiens
tgactgtacagaga

SEQ ID NO: 1042380 - DNA, 19 bp, Homo sapiens
tgactgtagccacagctgc

SEQ ID NO: 1042381 - DNA, 20 bp, Homo sapiens
tgactgtagccacagctgct

SEQ ID NO: 1042382 - DNA, 12 bp, Homo sapiens
tgactgtatggc

SEQ ID NO: 1042383 - DNA, 16 bp, Homo sapiens
tgactgtatggcactc

SEQ ID NO: 1042384 - DNA, 16 bp, Homo sapiens
tgactgtccctgccaa

SEQ ID NO: 1042385 - DNA, 14 bp, Homo sapiens
tgactgtgaactgg

SEQ ID NO: 1042386 - DNA, 16 bp, Homo sapiens
tgactgtgaccacctt

SEQ ID NO: 1042387 - DNA, 17 bp, Homo sapiens
tgactgtgaccaccttc

SEQ ID NO: 1042388 - DNA, 17 bp, Homo sapiens
tgactgtgattagatca

SEQ ID NO: 1042389 - DNA, 11 bp, Homo sapiens
tgactgtgtgt

SEQ ID NO: 1042390 - DNA, 14 bp, Homo sapiens
tgactgttgatgaa

SEQ ID NO: 1042391 - DNA, 22 bp, Homo sapiens
tgactgttgatgaagtatactt

SEQ ID NO: 1042392 - DNA, 18 bp, Homo sapiens
tgactgttggctctctga

SEQ ID NO: 1042393 - DNA, 23 bp, Homo sapiens
tgactgttgtagcattttcctgt

SEQ ID NO: 1042394 - DNA, 21 bp, Homo sapiens
tgactgttttctcttgagagg

SEQ ID NO: 1042395 - DNA, 19 bp, Homo sapiens
tgactgtttttcggacagt

SEQ ID NO: 1042396 - DNA, 21 bp, Homo sapiens
tgacttaactttaacttttga

SEQ ID NO: 1042397 - DNA, 19 bp, Homo sapiens
tgacttacaatttgcacaa

SEQ ID NO: 1042398 - DNA, 17 bp, Homo sapiens
tgacttacctgttcagt

SEQ ID NO: 1042399 - DNA, 19 bp, Homo sapiens
tgacttactgtacatgaaa

SEQ ID NO: 1042400 - DNA, 14 bp, Homo sapiens
tgacttagaaactg

SEQ ID NO: 1042401 - DNA, 19 bp, Homo sapiens
tgacttagcgtcaagacat

SEQ ID NO: 1042402 - DNA, 21 bp, Homo sapiens
tgacttagcgtcaagacattt

SEQ ID NO: 1042403 - DNA, 15 bp, Homo sapiens
tgacttaggttttta

SEQ ID NO: 1042404 - DNA, 13 bp, Homo sapiens
tgacttatagtac

SEQ ID NO: 1042405 - DNA, 19 bp, Homo sapiens
tgacttatagtacatgata

SEQ ID NO: 1042406 - DNA, 18 bp, Homo sapiens
tgacttattatgcataaa

SEQ ID NO: 1042407 - DNA, 21 bp, Homo sapiens
tgacttatttatataaatttt

SEQ ID NO: 1042408 - DNA, 18 bp, Homo sapiens
tgacttattttctctgtg

SEQ ID NO: 1042409 - DNA, 19 bp, Homo sapiens
tgacttattttctctgtgt

SEQ ID NO: 1042410 - DNA, 21 bp, Homo sapiens
tgacttattttgtcttattct

SEQ ID NO: 1042411 - DNA, 14 bp, Homo sapiens
tgacttcactgtat

SEQ ID NO: 1042412 - DNA, 17 bp, Homo sapiens
tgacttcactgtatata

SEQ ID NO: 1042413 - DNA, 19 bp, Homo sapiens
tgacttcagctgcctgaaa

SEQ ID NO: 1042414 - DNA, 24 bp, Homo sapiens
tgacttcaggtggagagcactaga

SEQ ID NO: 1042415 - DNA, 17 bp, Homo sapiens
tgacttcatttgtgcca

SEQ ID NO: 1042416 - DNA, 18 bp, Homo sapiens
tgacttcatttgtgccac

SEQ ID NO: 1042417 - DNA, 17 bp, Homo sapiens
tgacttccctggtcacc

SEQ ID NO: 1042418 - DNA, 17 bp, Homo sapiens
tgacttcctggtgaggc

SEQ ID NO: 1042419 - DNA, 15 bp, Homo sapiens
tgacttctccaggtc

SEQ ID NO: 1042420 - DNA, 23 bp, Homo sapiens
tgacttctccaggtctcacgggc

SEQ ID NO: 1042421 - DNA, 22 bp, Homo sapiens
tgacttctcccccgccctgccc

SEQ ID NO: 1042422 - DNA, 17 bp, Homo sapiens
tgacttctctgaatcag

SEQ ID NO: 1042423 - DNA, 18 bp, Homo sapiens
tgacttctctgaatcaga

SEQ ID NO: 1042424 - DNA, 13 bp, Homo sapiens
tgacttctgagat

SEQ ID NO: 1042425 - DNA, 13 bp, Homo sapiens
tgacttctgcctg

SEQ ID NO: 1042426 - DNA, 13 bp, Homo sapiens
tgacttctgctga

SEQ ID NO: 1042427 - DNA, 16 bp, Homo sapiens
tgacttcttgcttcag

SEQ ID NO: 1042428 - DNA, 18 bp, Homo sapiens
tgacttgagccactcctt

SEQ ID NO: 1042429 - DNA, 23 bp, Homo sapiens
tgacttgcacagggattctcaca

SEQ ID NO: 1042430 - DNA, 19 bp, Homo sapiens
tgacttgcatgaagagaag

SEQ ID NO: 1042431 - DNA, 17 bp, Homo sapiens
tgagcctggctgtccaa

SEQ ID NO: 1042432 - DNA, 22 bp, Homo sapiens
tgagcctgggaggtcaaggctg

SEQ ID NO: 1042433 - DNA, 13 bp, Homo sapiens
tgagccttcagtc

SEQ ID NO: 1042434 - DNA, 15 bp, Homo sapiens
tgagccttgagagaa

SEQ ID NO: 1042435 - DNA, 22 bp, Homo sapiens
tgagccttgcagatatctgcat

SEQ ID NO: 1042436 - DNA, 21 bp, Homo sapiens
tgagccttgcatgtacttgaa

SEQ ID NO: 1042437 - DNA, 23 bp, Homo sapiens
tgagcgaggagatgctccttggg

SEQ ID NO: 1042438 - DNA, 14 bp, Homo sapiens
tgagcgccacctct

SEQ ID NO: 1042439 - DNA, 19 bp, Homo sapiens
tgagcgcccccgagccctg

SEQ ID NO: 1042440 - DNA, 20 bp, Homo sapiens
tgagcgcctccatccaaggc

SEQ ID NO: 1042441 - DNA, 13 bp, Homo sapiens
tgagcggaggctc

SEQ ID NO: 1042442 - DNA, 15 bp, Homo sapiens
tgagcggcaccctgg

SEQ ID NO: 1042443 - DNA, 15 bp, Homo sapiens
tgagcgggaggcaga

SEQ ID NO: 1042444 - DNA, 16 bp, Homo sapiens
tgagcgggaggcagag

SEQ ID NO: 1042445 - DNA, 21 bp, Homo sapiens
tgagcgtcactgcccaccaaa

SEQ ID NO: 1042446 - DNA, 15 bp, Homo sapiens
tgagcgtggaagggg

SEQ ID NO: 1042447 - DNA, 20 bp, Homo sapiens
tgagcgtggaagggggagga

SEQ ID NO: 1042448 - DNA, 17 bp, Homo sapiens
tgagcgtggccttggga

SEQ ID NO: 1042449 - DNA, 19 bp, Homo sapiens
tgagctacaacaaaaggac

SEQ ID NO: 1042450 - DNA, 18 bp, Homo sapiens
tgagctactggattctta

SEQ ID NO: 1042451 - DNA, 13 bp, Homo sapiens
tgagctagcctcc

SEQ ID NO: 1042452 - DNA, 14 bp, Homo sapiens
tgagctagtgtctt

SEQ ID NO: 1042453 - DNA, 15 bp, Homo sapiens
tgagctattcacctc

SEQ ID NO: 1042454 - DNA, 16 bp, Homo sapiens
tgagctattttcctct

SEQ ID NO: 1042455 - DNA, 18 bp, Homo sapiens
tgagctcacatgggactg

SEQ ID NO: 1042456 - DNA, 16 bp, Homo sapiens
tgagctcagaccccca

SEQ ID NO: 1042457 - DNA, 19 bp, Homo sapiens
tgagctcagacccccactc

SEQ ID NO: 1042458 - DNA, 20 bp, Homo sapiens
tgagctcagacccccactct

SEQ ID NO: 1042459 - DNA, 11 bp, Homo sapiens
tgagctcagcc

SEQ ID NO: 1042460 - DNA, 16 bp, Homo sapiens
tgagctccacctctgg

SEQ ID NO: 1042461 - DNA, 14 bp, Homo sapiens
tgagctccagaccc

SEQ ID NO: 1042462 - DNA, 15 bp, Homo sapiens
tgagctccagacccc

SEQ ID NO: 1042463 - DNA, 18 bp, Homo sapiens
tgagctccagacccccag

SEQ ID NO: 1042464 - DNA, 20 bp, Homo sapiens
tgagctccagacccccagca

SEQ ID NO: 1042465 - DNA, 16 bp, Homo sapiens
tgagctcccacctccc

SEQ ID NO: 1042466 - DNA, 17 bp, Homo sapiens
tgagctcccacctccct

SEQ ID NO: 1042467 - DNA, 21 bp, Homo sapiens
tgagctcccacctcccttccc

SEQ ID NO: 1042468 - DNA, 20 bp, Homo sapiens
tgagctccccagatctccca

SEQ ID NO: 1042469 - DNA, 15 bp, Homo sapiens
tgagctcctctgggc

SEQ ID NO: 1042470 - DNA, 16 bp, Homo sapiens
tgagctcctctgggca

SEQ ID NO: 1042471 - DNA, 19 bp, Homo sapiens
tgagctcctctgggcagga

SEQ ID NO: 1042472 - DNA, 20 bp, Homo sapiens
tgagctcggggtccaccagt

SEQ ID NO: 1042473 - DNA, 20 bp, Homo sapiens
tgagctcggtggacccaggg

SEQ ID NO: 1042474 - DNA, 21 bp, Homo sapiens
tgagctcggtggacccaggga

SEQ ID NO: 1042475 - DNA, 18 bp, Homo sapiens
tgagctctccaggccagg

SEQ ID NO: 1042476 - DNA, 20 bp, Homo sapiens
tgagctctccaggccaggtg

SEQ ID NO: 1042477 - DNA, 22 bp, Homo sapiens
tgagctctggttatttttctct

SEQ ID NO: 1042478 - DNA, 14 bp, Homo sapiens
tgagctctgtaact

SEQ ID NO: 1042479 - DNA, 13 bp, Homo sapiens
tgagctcttccag

SEQ ID NO: 1042480 - DNA, 20 bp, Homo sapiens
tgagctgaaatgctgcattt

SEQ ID NO: 1042481 - DNA, 17 bp, Homo sapiens
tgagctgagatcgtgcc

SEQ ID NO: 1042482 - DNA, 17 bp, Homo sapiens
tgagctgagtggccagc

SEQ ID NO: 1042483 - DNA, 16 bp, Homo sapiens
tgagctgatctgcgga

SEQ ID NO: 1042484 - DNA, 14 bp, Homo sapiens
tgagctgcagaaac

SEQ ID NO: 1042485 - DNA, 21 bp, Homo sapiens
tgagctgcccggcgcctgccc

SEQ ID NO: 1042486 - DNA, 11 bp, Homo sapiens
tgagctgcctt

SEQ ID NO: 1042487 - DNA, 15 bp, Homo sapiens
tgagctgccttccct

SEQ ID NO: 1042488 - DNA, 16 bp, Homo sapiens
tgagctgccttcccta

SEQ ID NO: 1042489 - DNA, 21 bp, Homo sapiens
tgagctgctcattacagttct

SEQ ID NO: 1042490 - DNA, 21 bp, Homo sapiens
tgagctggcctctctagcaca

SEQ ID NO: 1042491 - DNA, 12 bp, Homo sapiens
tgagctgggccc

SEQ ID NO: 1042492 - DNA, 22 bp, Homo sapiens
tgagctggggacctggtaccct

SEQ ID NO: 1042493 - DNA, 21 bp, Homo sapiens
tgagctggggactcagggacc

SEQ ID NO: 1042494 - DNA, 18 bp, Homo sapiens
tgagctgtatcttgatgt

SEQ ID NO: 1042495 - DNA, 20 bp, Homo sapiens
tgagctgtgacattgctggt

SEQ ID NO: 1042496 - DNA, 23 bp, Homo sapiens
tgagctgtgacattgctggtcat

SEQ ID NO: 1042497 - DNA, 17 bp, Homo sapiens
tgagcttaaaatacaag

SEQ ID NO: 1042498 - DNA, 21 bp, Homo sapiens
tgagcttaaaatacaagactg

SEQ ID NO: 1042499 - DNA, 20 bp, Homo sapiens
tgagcttagccttgtgccct

SEQ ID NO: 1042500 - DNA, 14 bp, Homo sapiens
tgagcttcaatata

SEQ ID NO: 1042501 - DNA, 13 bp, Homo sapiens
tgagcttggccag

SEQ ID NO: 1042502 - DNA, 19 bp, Homo sapiens
tgagcttggccagaagggg

SEQ ID NO: 1042503 - DNA, 16 bp, Homo sapiens
tgagctttagacagca

SEQ ID NO: 1042504 - DNA, 20 bp, Homo sapiens
tgagctttccatgttgctgc

SEQ ID NO: 1042505 - DNA, 22 bp, Homo sapiens
tgagctttccatgttgctgcca

SEQ ID NO: 1042506 - DNA, 17 bp, Homo sapiens
tgagctttgctgctaca

SEQ ID NO: 1042507 - DNA, 23 bp, Homo sapiens
tgagctttggggacagttggcag

SEQ ID NO: 1042508 - DNA, 18 bp, Homo sapiens
tgagcttttcatggaagt

SEQ ID NO: 1042509 - DNA, 16 bp, Homo sapiens
tgaggaaaataatgta

SEQ ID NO: 1042510 - DNA, 15 bp, Homo sapiens
tgaggaaactactga

SEQ ID NO: 1042511 - DNA, 23 bp, Homo sapiens
tgaggaaagtgcgttctcccagc

SEQ ID NO: 1042512 - DNA, 23 bp, Homo sapiens
tgaggaaatccattgtttaaaga

SEQ ID NO: 1042513 - DNA, 19 bp, Homo sapiens
tgaggaactcacatactga

SEQ ID NO: 1042514 - DNA, 15 bp, Homo sapiens
tgaggaagcagttgg

SEQ ID NO: 1042515 - DNA, 19 bp, Homo sapiens
tgaggaagtggctgtccct

SEQ ID NO: 1042516 - DNA, 18 bp, Homo sapiens
tgaggaagtgtggaaaaa

SEQ ID NO: 1042517 - DNA, 16 bp, Homo sapiens
tgaggaagttttgtct

SEQ ID NO: 1042518 - DNA, 18 bp, Homo sapiens
tgaggaagttttgtctaa

SEQ ID NO: 1042519 - DNA, 19 bp, Homo sapiens
tgaggaataattatttatt

SEQ ID NO: 1042520 - DNA, 21 bp, Homo sapiens
tgaggaattcttctgttctct

SEQ ID NO: 1042521 - DNA, 13 bp, Homo sapiens
tgaggaattttct

SEQ ID NO: 1042522 - DNA, 18 bp, Homo sapiens
tgaggaattttctttgtg

SEQ ID NO: 1042523 - DNA, 13 bp, Homo sapiens
tgaggacaagaga

SEQ ID NO: 1042524 - DNA, 22 bp, Homo sapiens
tgaggacaagagaaaaaagcca

SEQ ID NO: 1042525 - DNA, 20 bp, Homo sapiens
tgaggacacaccccacaccc

SEQ ID NO: 1042526 - DNA, 15 bp, Homo sapiens
tgaggacagaggccg

SEQ ID NO: 1042527 - DNA, 14 bp, Homo sapiens
tgaggacagagtgg

SEQ ID NO: 1042528 - DNA, 15 bp, Homo sapiens
tgaggacagctgtcc

SEQ ID NO: 1042529 - DNA, 22 bp, Homo sapiens
tgaggacaggctctagagagag

SEQ ID NO: 1042530 - DNA, 23 bp, Homo sapiens
tgaggacaggctctagagagagg

SEQ ID NO: 1042531 - DNA, 16 bp, Homo sapiens
tgaggaccgctgataa

SEQ ID NO: 1042532 - DNA, 21 bp, Homo sapiens
tgaggaccgctgataagcatt

SEQ ID NO: 1042533 - DNA, 15 bp, Homo sapiens
tgaggacctccctgt

SEQ ID NO: 1042534 - DNA, 14 bp, Homo sapiens
tgaggacgtgtctg

SEQ ID NO: 1042535 - DNA, 17 bp, Homo sapiens
tgaggactcggccactg

SEQ ID NO: 1042536 - DNA, 18 bp, Homo sapiens
tgaggactcggccactgt

SEQ ID NO: 1042537 - DNA, 20 bp, Homo sapiens
tgaggactcggccactgtgt

SEQ ID NO: 1042538 - DNA, 14 bp, Homo sapiens
tgaggactgtcctc

SEQ ID NO: 1042539 - DNA, 15 bp, Homo sapiens
tgaggacttcaagcc

SEQ ID NO: 1042540 - DNA, 18 bp, Homo sapiens
tgaggactttgcccagga

SEQ ID NO: 1042541 - DNA, 21 bp, Homo sapiens
tgaggactttgcccaggatga

SEQ ID NO: 1042542 - DNA, 14 bp, Homo sapiens
tgaggagacatcta

SEQ ID NO: 1042543 - DNA, 21 bp, Homo sapiens
tgaggagagaaaatatatgta

SEQ ID NO: 1042544 - DNA, 16 bp, Homo sapiens
tgagtcctgttgaaga

SEQ ID NO: 1042545 - DNA, 23 bp, Homo sapiens
tgagtcctgttgaagacttcctc

SEQ ID NO: 1042546 - DNA, 15 bp, Homo sapiens
tgagtccttgaaaat

SEQ ID NO: 1042547 - DNA, 16 bp, Homo sapiens
tgagtccttgaaaata

SEQ ID NO: 1042548 - DNA, 18 bp, Homo sapiens
tgagtccttgaaaatatt

SEQ ID NO: 1042549 - DNA, 21 bp, Homo sapiens
tgatcattttccccccactct

SEQ ID NO: 1042550 - DNA, 20 bp, Homo sapiens
tgatccacccacctcggcct

SEQ ID NO: 1042551 - DNA, 17 bp, Homo sapiens
tgatccagaagagccca

SEQ ID NO: 1042552 - DNA, 15 bp, Homo sapiens
tgatccagagcagag

SEQ ID NO: 1042553 - DNA, 11 bp, Homo sapiens
tgatccagccc

SEQ ID NO: 1042554 - DNA, 18 bp, Homo sapiens
tgatccagccctggttct

SEQ ID NO: 1042555 - DNA, 22 bp, Homo sapiens
tgatccagccctggttctggct

SEQ ID NO: 1042556 - DNA, 16 bp, Homo sapiens
tgatcccaccccctcc

SEQ ID NO: 1042557 - DNA, 23 bp, Homo sapiens
tgatcccaccccctcctccccca

SEQ ID NO: 1042558 - DNA, 15 bp, Homo sapiens
tgatcccacttcact

SEQ ID NO: 1042559 - DNA, 16 bp, Homo sapiens
tgatcccagtcactcc

SEQ ID NO: 1042560 - DNA, 15 bp, Homo sapiens
tgatcccattttcct

SEQ ID NO: 1042561 - DNA, 19 bp, Homo sapiens
tgatccctgaacccctggc

SEQ ID NO: 1042562 - DNA, 19 bp, Homo sapiens
tgatcctccaatgtctaat

SEQ ID NO: 1042563 - DNA, 19 bp, Homo sapiens
tgatccttctgagctccac

SEQ ID NO: 1042564 - DNA, 21 bp, Homo sapiens
tgatccttctgagctccacct

SEQ ID NO: 1042565 - DNA, 20 bp, Homo sapiens
tgatctaagaagctacagat

SEQ ID NO: 1042566 - DNA, 19 bp, Homo sapiens
tgatctacccgtgcctggg

SEQ ID NO: 1042567 - DNA, 16 bp, Homo sapiens
tgatctccctgccgcc

SEQ ID NO: 1042568 - DNA, 23 bp, Homo sapiens
tgatctcggatgaccaaaccagc

SEQ ID NO: 1042569 - DNA, 17 bp, Homo sapiens
tgatctctaatgagcta

SEQ ID NO: 1042570 - DNA, 18 bp, Homo sapiens
tgatctctactaccacaa

SEQ ID NO: 1042571 - DNA, 22 bp, Homo sapiens
tgatctctactaccacaaggaa

SEQ ID NO: 1042572 - DNA, 16 bp, Homo sapiens
tgatctctgacctctg

SEQ ID NO: 1042573 - DNA, 13 bp, Homo sapiens
tgatctcttagaa

SEQ ID NO: 1042574 - DNA, 18 bp, Homo sapiens
tgatctcttagaagccat

SEQ ID NO: 1042575 - DNA, 14 bp, Homo sapiens
tgatctcttcctgt

SEQ ID NO: 1042576 - DNA, 14 bp, Homo sapiens
tgatctgaaaaata

SEQ ID NO: 1042577 - DNA, 12 bp, Homo sapiens
tgatctgcatat

SEQ ID NO: 1042578 - DNA, 22 bp, Homo sapiens
tgatctgcatatttctgtatat

SEQ ID NO: 1042579 - DNA, 14 bp, Homo sapiens
tgatctggacagaa

SEQ ID NO: 1042580 - DNA, 15 bp, Homo sapiens
tgatctgtactttgt

SEQ ID NO: 1042581 - DNA, 17 bp, Homo sapiens
tgatctgtactttgtgt

SEQ ID NO: 1042582 - DNA, 19 bp, Homo sapiens
tgatctgtatatacaataa

SEQ ID NO: 1042583 - DNA, 14 bp, Homo sapiens
tgatctgtccacct

SEQ ID NO: 1042584 - DNA, 17 bp, Homo sapiens
tgatctgtctgtggcaa

SEQ ID NO: 1042585 - DNA, 19 bp, Homo sapiens
tgatctgtctgtggcaaaa

SEQ ID NO: 1042586 - DNA, 19 bp, Homo sapiens
tgatctgtgaattgagctg

SEQ ID NO: 1042587 - DNA, 20 bp, Homo sapiens
tgatctgtgatagttcaccc

SEQ ID NO: 1042588 - DNA, 13 bp, Homo sapiens
tgatctgttgcaa

SEQ ID NO: 1042589 - DNA, 18 bp, Homo sapiens
tgatcttaatatatttga

SEQ ID NO: 1042590 - DNA, 23 bp, Homo sapiens
tgatcttacaagatattgatgat

SEQ ID NO: 1042591 - DNA, 15 bp, Homo sapiens
tgatcttaggtttgt

SEQ ID NO: 1042592 - DNA, 23 bp, Homo sapiens
tgatcttaggtttgttttttcat

SEQ ID NO: 1042593 - DNA, 19 bp, Homo sapiens
tgatcttgtgctcagcatg

SEQ ID NO: 1042594 - DNA, 18 bp, Homo sapiens
tgatcttgttactgtgat

SEQ ID NO: 1042595 - DNA, 14 bp, Homo sapiens
tgatctttgagccc

SEQ ID NO: 1042596 - DNA, 18 bp, Homo sapiens
tgatctttgtttaaatgc

SEQ ID NO: 1042597 - DNA, 20 bp, Homo sapiens
tgatctttgtttaaatgcca

SEQ ID NO: 1042598 - DNA, 13 bp, Homo sapiens
tgatcttttaaaa

SEQ ID NO: 1042599 - DNA, 18 bp, Homo sapiens
tgatcttttaaagtgtta

SEQ ID NO: 1042600 - DNA, 15 bp, Homo sapiens
tgatgaaaaggtcag

SEQ ID NO: 1042601 - DNA, 20 bp, Homo sapiens
tgatgaaaataattttccaa

SEQ ID NO: 1042602 - DNA, 11 bp, Homo sapiens
tgatgaaagct

SEQ ID NO: 1042603 - DNA, 15 bp, Homo sapiens
tgatgaaagctgatt

SEQ ID NO: 1042604 - DNA, 22 bp, Homo sapiens
tgatgaaatctgctagaaagtt

SEQ ID NO: 1042605 - DNA, 16 bp, Homo sapiens
tgatgaaatctttctt

SEQ ID NO: 1042606 - DNA, 17 bp, Homo sapiens
tgatgaaattcttgaag

SEQ ID NO: 1042607 - DNA, 17 bp, Homo sapiens
tgatgaacttattctgt

SEQ ID NO: 1042608 - DNA, 15 bp, Homo sapiens
tgatgaagcaaggaa

SEQ ID NO: 1042609 - DNA, 19 bp, Homo sapiens
tgatgaatcaatgaaaaat

SEQ ID NO: 1042610 - DNA, 24 bp, Homo sapiens
tgatgaattcttcctctccttccc

SEQ ID NO: 1042611 - DNA, 20 bp, Homo sapiens
tgatgacaaaaaatgtttta

SEQ ID NO: 1042612 - DNA, 14 bp, Homo sapiens
tgatgaccaatggg

SEQ ID NO: 1042613 - DNA, 15 bp, Homo sapiens
tgatgacgcctgtct

SEQ ID NO: 1042614 - DNA, 17 bp, Homo sapiens
tgatgactcgaaactga

SEQ ID NO: 1042615 - DNA, 19 bp, Homo sapiens
tgatgactcgaaactgaca

SEQ ID NO: 1042616 - DNA, 23 bp, Homo sapiens
tgatgacttagcgtcaagacatt

SEQ ID NO: 1042617 - DNA, 18 bp, Homo sapiens
tgatgacttgctgtccag

SEQ ID NO: 1042618 - DNA, 15 bp, Homo sapiens
tgatgagaggccagc

SEQ ID NO: 1042619 - DNA, 14 bp, Homo sapiens
tgatgagattttta

SEQ ID NO: 1042620 - DNA, 16 bp, Homo sapiens
tgatgagcatttagca

SEQ ID NO: 1042621 - DNA, 18 bp, Homo sapiens
tgatgagcatttagcaca

SEQ ID NO: 1042622 - DNA, 16 bp, Homo sapiens
tgatgaggctggtgac

SEQ ID NO: 1042623 - DNA, 14 bp, Homo sapiens
tgatgataatgatg

SEQ ID NO: 1042624 - DNA, 17 bp, Homo sapiens
tgatgatccagaacagt

SEQ ID NO: 1042625 - DNA, 18 bp, Homo sapiens
tgatgatccagaacagtg

SEQ ID NO: 1042626 - DNA, 14 bp, Homo sapiens
tgatgatcctaggc

SEQ ID NO: 1042627 - DNA, 13 bp, Homo sapiens
tgatgatgatgaa

SEQ ID NO: 1042628 - DNA, 16 bp, Homo sapiens
tgatgatgtctacaga

SEQ ID NO: 1042629 - DNA, 14 bp, Homo sapiens
tgatgatgtctctt

SEQ ID NO: 1042630 - DNA, 19 bp, Homo sapiens
tgatgatgtctcttgtaga

SEQ ID NO: 1042631 - DNA, 17 bp, Homo sapiens
tgatgatgtcttctggt

SEQ ID NO: 1042632 - DNA, 14 bp, Homo sapiens
tgatgatgttaacc

SEQ ID NO: 1042633 - DNA, 14 bp, Homo sapiens
tgatgatttggggg

SEQ ID NO: 1042634 - DNA, 14 bp, Homo sapiens
tgatgattttgtaa

SEQ ID NO: 1042635 - DNA, 19 bp, Homo sapiens
tgatgattttgtaattctt

SEQ ID NO: 1042636 - DNA, 20 bp, Homo sapiens
tgatgcaaatgctcaaaacc

SEQ ID NO: 1042637 - DNA, 11 bp, Homo sapiens
tgatgcaatat

SEQ ID NO: 1042638 - DNA, 22 bp, Homo sapiens
tgatgcaatcttggctcactgc

SEQ ID NO: 1042639 - DNA, 19 bp, Homo sapiens
tgatgcagctgttgagaaa

SEQ ID NO: 1042640 - DNA, 20 bp, Homo sapiens
tgatgcagctgttgagaaaa

SEQ ID NO: 1042641 - DNA, 14 bp, Homo sapiens
tgatgcatacagtt

SEQ ID NO: 1042642 - DNA, 18 bp, Homo sapiens
tgatgcatgatgccctcc

SEQ ID NO: 1042643 - DNA, 17 bp, Homo sapiens
tgatgcatgcactgttc

SEQ ID NO: 1042644 - DNA, 14 bp, Homo sapiens
tgatgccaaaaaaa

SEQ ID NO: 1042645 - DNA, 18 bp, Homo sapiens
tgatgccaaaatgacttt

SEQ ID NO: 1042646 - DNA, 20 bp, Homo sapiens
tgatgccaaaatgactttat

SEQ ID NO: 1042647 - DNA, 18 bp, Homo sapiens
tgatgccacacagagtgg

SEQ ID NO: 1042648 - DNA, 12 bp, Homo sapiens
tgatgccagagg

SEQ ID NO: 1042649 - DNA, 16 bp, Homo sapiens
tgatgccagagggcca

SEQ ID NO: 1042650 - DNA, 14 bp, Homo sapiens
tgatgccaggacac

SEQ ID NO: 1042651 - DNA, 18 bp, Homo sapiens
tgatgccataaatacaag

SEQ ID NO: 1042652 - DNA, 19 bp, Homo sapiens
tgatgccattacagaacca

SEQ ID NO: 1042653 - DNA, 14 bp, Homo sapiens
tgatgccccttccc

SEQ ID NO: 1042654 - DNA, 18 bp, Homo sapiens
tgatgccctcccctcagc

SEQ ID NO: 1042655 - DNA, 19 bp, Homo sapiens
tgatgccctcccctcagcg

SEQ ID NO: 1042656 - DNA, 20 bp, Homo sapiens
tgatgccctcccctcagcgc

SEQ ID NO: 1042657 - DNA, 14 bp, Homo sapiens
tgatgccctcttct

SEQ ID NO: 1042658 - DNA, 18 bp, Homo sapiens
tgatgccgtcctgctgga

SEQ ID NO: 1042659 - DNA, 11 bp, Homo sapiens
tgatgctaaat

SEQ ID NO: 1042660 - DNA, 16 bp, Homo sapiens
tgatgctaaataggag

SEQ ID NO: 1042661 - DNA, 14 bp, Homo sapiens
tgatgctcaggctt

SEQ ID NO: 1042662 - DNA, 16 bp, Homo sapiens
tgatgctccctcccct

SEQ ID NO: 1042663 - DNA, 20 bp, Homo sapiens
tgatgctccctcccctgccc

SEQ ID NO: 1042664 - DNA, 22 bp, Homo sapiens
tgatgctccctcccctgccctg

SEQ ID NO: 1042665 - DNA, 19 bp, Homo sapiens
tgatgctgaggatgattga

SEQ ID NO: 1042666 - DNA, 13 bp, Homo sapiens
tgatgctgccccg

SEQ ID NO: 1042667 - DNA, 13 bp, Homo sapiens
tgatgctgggacc

SEQ ID NO: 1042668 - DNA, 20 bp, Homo sapiens
tgatgctgtgctatgaattt

SEQ ID NO: 1042669 - DNA, 22 bp, Homo sapiens
tgatgcttgtaacaagaaaaca

SEQ ID NO: 1042670 - DNA, 23 bp, Homo sapiens
tgatgcttgtaacaagaaaacat

SEQ ID NO: 1042671 - DNA, 11 bp, Homo sapiens
tgatgcttttg

SEQ ID NO: 1042672 - DNA, 15 bp, Homo sapiens
tgatgcttttgctgc

SEQ ID NO: 1042673 - DNA, 21 bp, Homo sapiens
tgatggaaaataccagtgttg

SEQ ID NO: 1042674 - DNA, 21 bp, Homo sapiens
tccttccccccatctctgagt

SEQ ID NO: 1042675 - DNA, 14 bp, Homo sapiens
tccttcccctgcac

SEQ ID NO: 1042676 - DNA, 21 bp, Homo sapiens
tccttcccctgcacctggcct

SEQ ID NO: 1042677 - DNA, 16 bp, Homo sapiens
tccttccctgatggcc

SEQ ID NO: 1042678 - DNA, 14 bp, Homo sapiens
tccttccctggctt

SEQ ID NO: 1042679 - DNA, 14 bp, Homo sapiens
tccttccctgggaa

SEQ ID NO: 1042680 - DNA, 14 bp, Homo sapiens
tccttccctgttct

SEQ ID NO: 1042681 - DNA, 21 bp, Homo sapiens
tccttccctgttctccctttc

SEQ ID NO: 1042682 - DNA, 17 bp, Homo sapiens
tccttcccttttctgtt

SEQ ID NO: 1042683 - DNA, 17 bp, Homo sapiens
tccttcctatgcccagg

SEQ ID NO: 1042684 - DNA, 13 bp, Homo sapiens
tccttcctccaca

SEQ ID NO: 1042685 - DNA, 13 bp, Homo sapiens
tccttcctccact

SEQ ID NO: 1042686 - DNA, 14 bp, Homo sapiens
tccttcctctcaag

SEQ ID NO: 1042687 - DNA, 15 bp, Homo sapiens
tccttcctgattgtt

SEQ ID NO: 1042688 - DNA, 14 bp, Homo sapiens
tccttcctggcctg

SEQ ID NO: 1042689 - DNA, 18 bp, Homo sapiens
tccttcctgggaccccct

SEQ ID NO: 1042690 - DNA, 16 bp, Homo sapiens
tccttcctgtgccctg

SEQ ID NO: 1042691 - DNA, 21 bp, Homo sapiens
tccttcctgttagtggttgtg

SEQ ID NO: 1042692 - DNA, 18 bp, Homo sapiens
tccttccttcaggactct

SEQ ID NO: 1042693 - DNA, 15 bp, Homo sapiens
tccttccttcccacc

SEQ ID NO: 1042694 - DNA, 14 bp, Homo sapiens
tccttccttccctg

SEQ ID NO: 1042695 - DNA, 15 bp, Homo sapiens
tccttccttccctgg

SEQ ID NO: 1042696 - DNA, 16 bp, Homo sapiens
tccttccttgactgtc

SEQ ID NO: 1042697 - DNA, 15 bp, Homo sapiens
tccttcgaaaggcct

SEQ ID NO: 1042698 - DNA, 16 bp, Homo sapiens
tccttcgggtgctgga

SEQ ID NO: 1042699 - DNA, 23 bp, Homo sapiens
tccttcgtatcccgagtctggga

SEQ ID NO: 1042700 - DNA, 18 bp, Homo sapiens
tccttcgtgtctctccca

SEQ ID NO: 1042701 - DNA, 16 bp, Homo sapiens
tccttctaccccaagg

SEQ ID NO: 1042702 - DNA, 17 bp, Homo sapiens
tccttctaccccaaggc

SEQ ID NO: 1042703 - DNA, 15 bp, Homo sapiens
tccttctcactgcca

SEQ ID NO: 1042704 - DNA, 17 bp, Homo sapiens
tccttctcactgccatg

SEQ ID NO: 1042705 - DNA, 14 bp, Homo sapiens
tccttctcccatct

SEQ ID NO: 1042706 - DNA, 13 bp, Homo sapiens
tccttctccccaa

SEQ ID NO: 1042707 - DNA, 23 bp, Homo sapiens
tccttctccgaggggctggagcg

SEQ ID NO: 1042708 - DNA, 12 bp, Homo sapiens
tccttctctggg

SEQ ID NO: 1042709 - DNA, 15 bp, Homo sapiens
tccttctgagctcca

SEQ ID NO: 1042710 - DNA, 18 bp, Homo sapiens
tccttctgagctccacct

SEQ ID NO: 1042711 - DNA, 23 bp, Homo sapiens
tccttctgagctccacctctggt

SEQ ID NO: 1042712 - DNA, 16 bp, Homo sapiens
tccttctgtagtgtat

SEQ ID NO: 1042713 - DNA, 12 bp, Homo sapiens
tccttctgttaa

SEQ ID NO: 1042714 - DNA, 16 bp, Homo sapiens
tccttcttcagcagga

SEQ ID NO: 1042715 - DNA, 19 bp, Homo sapiens
tccttcttcagcaggaagg

SEQ ID NO: 1042716 - DNA, 22 bp, Homo sapiens
tccttctttctagttcagctgc

SEQ ID NO: 1042717 - DNA, 22 bp, Homo sapiens
tccttgaacccaacagtccctt

SEQ ID NO: 1042718 - DNA, 20 bp, Homo sapiens
tccttgaagaactgcaggcc

SEQ ID NO: 1042719 - DNA, 21 bp, Homo sapiens
tccttgaaggactaatagaaa

SEQ ID NO: 1042720 - DNA, 19 bp, Homo sapiens
tccttgaatatctttcgat

SEQ ID NO: 1042721 - DNA, 19 bp, Homo sapiens
tccttgacctctataaact

SEQ ID NO: 1042722 - DNA, 21 bp, Homo sapiens
tccttgagacacggagcccag

SEQ ID NO: 1042723 - DNA, 13 bp, Homo sapiens
tccttgaggacag

SEQ ID NO: 1042724 - DNA, 21 bp, Homo sapiens
tgaacttatttacacatagtt

SEQ ID NO: 1042725 - DNA, 18 bp, Homo sapiens
tgaacttctctcagactt

SEQ ID NO: 1042726 - DNA, 17 bp, Homo sapiens
tgaacttgagctctgta

SEQ ID NO: 1042727 - DNA, 19 bp, Homo sapiens
tgaacttgattgcctatgg

SEQ ID NO: 1042728 - DNA, 15 bp, Homo sapiens
tgaacttggagaggg

SEQ ID NO: 1042729 - DNA, 21 bp, Homo sapiens
tgaactttctcttcatacttt

SEQ ID NO: 1042730 - DNA, 17 bp, Homo sapiens
tgaactttgacctctgc

SEQ ID NO: 1042731 - DNA, 22 bp, Homo sapiens
tgaactttgacctctgcagcaa

SEQ ID NO: 1042732 - DNA, 19 bp, Homo sapiens
tgaactttgtcattatgat

SEQ ID NO: 1042733 - DNA, 14 bp, Homo sapiens
tgaacttttacaga

SEQ ID NO: 1042734 - DNA, 15 bp, Homo sapiens
tgaacttttacagaa

SEQ ID NO: 1042735 - DNA, 16 bp, Homo sapiens
tgaacttttacagaat

SEQ ID NO: 1042736 - DNA, 12 bp, Homo sapiens
tgaacttttcat

SEQ ID NO: 1042737 - DNA, 17 bp, Homo sapiens
tgaacttttgtaatttg

SEQ ID NO: 1042738 - DNA, 23 bp, Homo sapiens
tgaacttttgtaatttgaattgg

SEQ ID NO: 1042739 - DNA, 19 bp, Homo sapiens
tgaactttttatttgagga

SEQ ID NO: 1042740 - DNA, 22 bp, Homo sapiens
tgaagaaaaagacctgcatttg

SEQ ID NO: 1042741 - DNA, 15 bp, Homo sapiens
tgaagaaaagtgggc

SEQ ID NO: 1042742 - DNA, 14 bp, Homo sapiens
tgaagaaaatgact

SEQ ID NO: 1042743 - DNA, 15 bp, Homo sapiens
tgaagaaaatgactt

SEQ ID NO: 1042744 - DNA, 21 bp, Homo sapiens
tgaagaaaccttcagatttgt

SEQ ID NO: 1042745 - DNA, 21 bp, Homo sapiens
tgaagaaagcctgttgtttaa

SEQ ID NO: 1042746 - DNA, 20 bp, Homo sapiens
tgaagaaagggaggcccagc

SEQ ID NO: 1042747 - DNA, 20 bp, Homo sapiens
tgaagaaagggtgtttttct

SEQ ID NO: 1042748 - DNA, 13 bp, Homo sapiens
tgaagaaagttat

SEQ ID NO: 1042749 - DNA, 14 bp, Homo sapiens
tgaagaaataaatg

SEQ ID NO: 1042750 - DNA, 14 bp, Homo sapiens
tgaagaaatgatgg

SEQ ID NO: 1042751 - DNA, 21 bp, Homo sapiens
tgaagaacacagcatgtgcca

SEQ ID NO: 1042752 - DNA, 20 bp, Homo sapiens
tgaagaacagtaactgccat

SEQ ID NO: 1042753 - DNA, 13 bp, Homo sapiens
tgaagaacatgtg

SEQ ID NO: 1042754 - DNA, 14 bp, Homo sapiens
tgaagaactgcagg

SEQ ID NO: 1042755 - DNA, 23 bp, Homo sapiens
tgaagaactgcaggccctggcct

SEQ ID NO: 1042756 - DNA, 19 bp, Homo sapiens
tgaagaactgcatgtggct

SEQ ID NO: 1042757 - DNA, 18 bp, Homo sapiens
tgaagaagaaccagccca

SEQ ID NO: 1042758 - DNA, 18 bp, Homo sapiens
tgaacagctatcacgttg

SEQ ID NO: 1042759 - DNA, 15 bp, Homo sapiens
tgaacagctctgaga

SEQ ID NO: 1042760 - DNA, 12 bp, Homo sapiens
tgaacagctgtg

SEQ ID NO: 1042761 - DNA, 17 bp, Homo sapiens
tgaacagctgtgagcca

SEQ ID NO: 1042762 - DNA, 22 bp, Homo sapiens
tgaacagctgtgagccatgcct

SEQ ID NO: 1042763 - DNA, 15 bp, Homo sapiens
tgaacagctgtgtct

SEQ ID NO: 1042764 - DNA, 16 bp, Homo sapiens
tgaacaggctggggcc

SEQ ID NO: 1042765 - DNA, 15 bp, Homo sapiens
tgaacagggcccagg

SEQ ID NO: 1042766 - DNA, 21 bp, Homo sapiens
tgaacagggcccaggcctgga

SEQ ID NO: 1042767 - DNA, 18 bp, Homo sapiens
tgaacatacttcaaaaat

SEQ ID NO: 1042768 - DNA, 12 bp, Homo sapiens
tgaacatattca

SEQ ID NO: 1042769 - DNA, 15 bp, Homo sapiens
tgaacatattcatga

SEQ ID NO: 1042770 - DNA, 21 bp, Homo sapiens
tgaacatattcatgaaatgtg

SEQ ID NO: 1042771 - DNA, 17 bp, Homo sapiens
tgaacatattgttgaaa

SEQ ID NO: 1042772 - DNA, 22 bp, Homo sapiens
tgaacatccaagtctttcttct

SEQ ID NO: 1042773 - DNA, 20 bp, Homo sapiens
tgaacatccctttttcaatg

SEQ ID NO: 1042774 - DNA, 17 bp, Homo sapiens
tgaacatccttccttcc

SEQ ID NO: 1042775 - DNA, 18 bp, Homo sapiens
tgaacatctcttgaaacc

SEQ ID NO: 1042776 - DNA, 14 bp, Homo sapiens
tgaacatgtttaca

SEQ ID NO: 1042777 - DNA, 13 bp, Homo sapiens
tgaacattcccag

SEQ ID NO: 1042778 - DNA, 19 bp, Homo sapiens
tgaacattgtactgttgct

SEQ ID NO: 1042779 - DNA, 17 bp, Homo sapiens
tgaacatttcatggtgt

SEQ ID NO: 1042780 - DNA, 15 bp, Homo sapiens
tgaaccacaactttg

SEQ ID NO: 1042781 - DNA, 16 bp, Homo sapiens
tgaaccacagaaatca

SEQ ID NO: 1042782 - DNA, 15 bp, Homo sapiens
tgaaccacgaggctg

SEQ ID NO: 1042783 - DNA, 21 bp, Homo sapiens
tgaaccacgaggctgccccca

SEQ ID NO: 1042784 - DNA, 16 bp, Homo sapiens
tgaaccacgcgggggc

SEQ ID NO: 1042785 - DNA, 23 bp, Homo sapiens
tgaatgatgatcctaggcatttg

SEQ ID NO: 1042786 - DNA, 16 bp, Homo sapiens
tgaatgattcagtgtt

SEQ ID NO: 1042787 - DNA, 19 bp, Homo sapiens
tgaatgatttccaaagaga

SEQ ID NO: 1042788 - DNA, 17 bp, Homo sapiens
tgaatgatttttcattg

SEQ ID NO: 1042789 - DNA, 20 bp, Homo sapiens
tgaatgatttttctttacaa

SEQ ID NO: 1042790 - DNA, 15 bp, Homo sapiens
tgaatgcaaaagaaa

SEQ ID NO: 1042791 - DNA, 19 bp, Homo sapiens
tgaatgcctatggtggatc

SEQ ID NO: 1042792 - DNA, 20 bp, Homo sapiens
tgaatgctaagaatgcatta

SEQ ID NO: 1042793 - DNA, 14 bp, Homo sapiens
tgaatgctgccagt

SEQ ID NO: 1042794 - DNA, 23 bp, Homo sapiens
tgaatgcttctaagtaaatacaa

SEQ ID NO: 1042795 - DNA, 12 bp, Homo sapiens
tgaatgcttttt

SEQ ID NO: 1042796 - DNA, 19 bp, Homo sapiens
tgaatggaggacttttctg

SEQ ID NO: 1042797 - DNA, 18 bp, Homo sapiens
tgaatggccctagaactg

SEQ ID NO: 1042798 - DNA, 18 bp, Homo sapiens
tgaatgggacagagttga

SEQ ID NO: 1042799 - DNA, 22 bp, Homo sapiens
tgaatgggcaattccagaaatc

SEQ ID NO: 1042800 - DNA, 14 bp, Homo sapiens
tgaatgggttgtta

SEQ ID NO: 1042801 - DNA, 15 bp, Homo sapiens
tgaatggtgttgtat

SEQ ID NO: 1042802 - DNA, 22 bp, Homo sapiens
tgaatggttccatgcctgaggg

SEQ ID NO: 1042803 - DNA, 20 bp, Homo sapiens
tgaatggttttcaaaataaa

SEQ ID NO: 1042804 - DNA, 19 bp, Homo sapiens
tgaatgtagcttccacctc

SEQ ID NO: 1042805 - DNA, 13 bp, Homo sapiens
tgaatgtatgtaa

SEQ ID NO: 1042806 - DNA, 14 bp, Homo sapiens
tgaatgtatgtaaa

SEQ ID NO: 1042807 - DNA, 17 bp, Homo sapiens
tgaatgtatttatttgg

SEQ ID NO: 1042808 - DNA, 23 bp, Homo sapiens
tgaatgtatttatttgggagacc

SEQ ID NO: 1042809 - DNA, 21 bp, Homo sapiens
tgaatgtattttggttgctga

SEQ ID NO: 1042810 - DNA, 23 bp, Homo sapiens
tgaatgtcttttgaatattccca

SEQ ID NO: 1042811 - DNA, 14 bp, Homo sapiens
tgaatgtgctggtg

SEQ ID NO: 1042812 - DNA, 16 bp, Homo sapiens
tgaatgtgggcactgg

SEQ ID NO: 1042813 - DNA, 16 bp, Homo sapiens
tgaatgtggtctcagg

SEQ ID NO: 1042814 - DNA, 17 bp, Homo sapiens
tgaatgtggttacttcc

SEQ ID NO: 1042815 - DNA, 14 bp, Homo sapiens
tgaatgttaagaat

SEQ ID NO: 1042816 - DNA, 14 bp, Homo sapiens
tgaatgttatttgt

SEQ ID NO: 1042817 - DNA, 23 bp, Homo sapiens
tgaatgttatttgttattttcag

SEQ ID NO: 1042818 - DNA, 18 bp, Homo sapiens
tgaatgttctgacattaa

SEQ ID NO: 1042819 - DNA, 20 bp, Homo sapiens
tgaatgttctgacattaaca

SEQ ID NO: 1042820 - DNA, 19 bp, Homo sapiens
tgaatgtttacactctttg

SEQ ID NO: 1042821 - DNA, 14 bp, Homo sapiens
tgaatgttttattt

SEQ ID NO: 1042822 - DNA, 18 bp, Homo sapiens
tgaatgttttatttatca

SEQ ID NO: 1042823 - DNA, 19 bp, Homo sapiens
tgaatgttttatttatcaa

SEQ ID NO: 1042824 - DNA, 16 bp, Homo sapiens
tgaattaaaaaagctc

SEQ ID NO: 1042825 - DNA, 17 bp, Homo sapiens
tgaattaaataaaccct

SEQ ID NO: 1042826 - DNA, 12 bp, Homo sapiens
tgaattaacaca

SEQ ID NO: 1042827 - DNA, 21 bp, Homo sapiens
tgaattaacacagtgtttcaa

SEQ ID NO: 1042828 - DNA, 19 bp, Homo sapiens
tgaattaatatccctacat

SEQ ID NO: 1042829 - DNA, 14 bp, Homo sapiens
tgaattaattcaga

SEQ ID NO: 1042830 - DNA, 13 bp, Homo sapiens
tgaattacagtga

SEQ ID NO: 1042831 - DNA, 14 bp, Homo sapiens
tgaattacagtgaa

SEQ ID NO: 1042832 - DNA, 11 bp, Homo sapiens
tgaattagaaa

SEQ ID NO: 1042833 - DNA, 16 bp, Homo sapiens
tgaattagaaaattag

SEQ ID NO: 1042834 - DNA, 22 bp, Homo sapiens
tgaattagacctttatttttct

SEQ ID NO: 1042835 - DNA, 17 bp, Homo sapiens
tgaattagattatttct

SEQ ID NO: 1042836 - DNA, 13 bp, Homo sapiens
tgaattaggctaa

SEQ ID NO: 1042837 - DNA, 17 bp, Homo sapiens
tgaattaggctgtaact

SEQ ID NO: 1042838 - DNA, 21 bp, Homo sapiens
tgacattccttgtcaccagca

SEQ ID NO: 1042839 - DNA, 16 bp, Homo sapiens
tgacattctgaatgct

SEQ ID NO: 1042840 - DNA, 18 bp, Homo sapiens
tgacattctgaatgcttc

SEQ ID NO: 1042841 - DNA, 20 bp, Homo sapiens
tgacattctgaatgcttcta

SEQ ID NO: 1042842 - DNA, 14 bp, Homo sapiens
tgacattcttagct

SEQ ID NO: 1042843 - DNA, 14 bp, Homo sapiens
tgacattgccaaaa

SEQ ID NO: 1042844 - DNA, 22 bp, Homo sapiens
tgacattgctggtcatccttgg

SEQ ID NO: 1042845 - DNA, 18 bp, Homo sapiens
tgacattgtagagcttct

SEQ ID NO: 1042846 - DNA, 19 bp, Homo sapiens
tgacatttagaactttaag

SEQ ID NO: 1042847 - DNA, 15 bp, Homo sapiens
tgacatttatatatt

SEQ ID NO: 1042848 - DNA, 19 bp, Homo sapiens
tgacatttatatattgaat

SEQ ID NO: 1042849 - DNA, 20 bp, Homo sapiens
tgacatttatatattgaatt

SEQ ID NO: 1042850 - DNA, 21 bp, Homo sapiens
tgacatttatatttgtgtatt

SEQ ID NO: 1042851 - DNA, 18 bp, Homo sapiens
tgacatttatttttcatt

SEQ ID NO: 1042852 - DNA, 13 bp, Homo sapiens
tgacatttgcttt

SEQ ID NO: 1042853 - DNA, 24 bp, Homo sapiens
tgacatttgggagacatgtgacat

SEQ ID NO: 1042854 - DNA, 17 bp, Homo sapiens
tgacatttgtagttgag

SEQ ID NO: 1042855 - DNA, 16 bp, Homo sapiens
tgacattttacattaa

SEQ ID NO: 1042856 - DNA, 13 bp, Homo sapiens
tgacatttttccg

SEQ ID NO: 1042857 - DNA, 23 bp, Homo sapiens
tgacatttttttctgatttgtcc

SEQ ID NO: 1042858 - DNA, 13 bp, Homo sapiens
tgaccaaaatcag

SEQ ID NO: 1042859 - DNA, 13 bp, Homo sapiens
tgaccaaaccagc

SEQ ID NO: 1042860 - DNA, 15 bp, Homo sapiens
tgaccaaaccagcct

SEQ ID NO: 1042861 - DNA, 22 bp, Homo sapiens
tgaccaaatggccagttttctg

SEQ ID NO: 1042862 - DNA, 16 bp, Homo sapiens
tgaccaacatggagaa

SEQ ID NO: 1042863 - DNA, 18 bp, Homo sapiens
tgaccaacatggagaaac

SEQ ID NO: 1042864 - DNA, 18 bp, Homo sapiens
tgaccaactgtgttgtat

SEQ ID NO: 1042865 - DNA, 23 bp, Homo sapiens
tgaccaactgtgttgtattaaca

SEQ ID NO: 1042866 - DNA, 18 bp, Homo sapiens
tgaccaactgttggattc

SEQ ID NO: 1042867 - DNA, 14 bp, Homo sapiens
tgaccaagaactgc

SEQ ID NO: 1042868 - DNA, 17 bp, Homo sapiens
tgaccaatattgtacag

SEQ ID NO: 1042869 - DNA, 19 bp, Homo sapiens
tgaccaatattgtacagtt

SEQ ID NO: 1042870 - DNA, 19 bp, Homo sapiens
tgaccaatgggatgaggtc

SEQ ID NO: 1042871 - DNA, 14 bp, Homo sapiens
tgaccaatgtcttg

SEQ ID NO: 1042872 - DNA, 15 bp, Homo sapiens
tgaccaatgtcttga

SEQ ID NO: 1042873 - DNA, 19 bp, Homo sapiens
tgaccaattgagtaagaac

SEQ ID NO: 1042874 - DNA, 15 bp, Homo sapiens
tgaccaattgtgctg

SEQ ID NO: 1042875 - DNA, 20 bp, Homo sapiens
tgaccacacccgaagtcctg

SEQ ID NO: 1042876 - DNA, 22 bp, Homo sapiens
tgaccacacccgaagtcctgtc

SEQ ID NO: 1042877 - DNA, 21 bp, Homo sapiens
tgaccacaccttggccttctg

SEQ ID NO: 1042878 - DNA, 15 bp, Homo sapiens
tgaccacagcacagc

SEQ ID NO: 1042879 - DNA, 17 bp, Homo sapiens
tgaccacagcacagcca

SEQ ID NO: 1042880 - DNA, 19 bp, Homo sapiens
tgaccacagcacagccaac

SEQ ID NO: 1042881 - DNA, 15 bp, Homo sapiens
tgaccacagcccgct

SEQ ID NO: 1042882 - DNA, 21 bp, Homo sapiens
tgaccacagcccgctctctgg

SEQ ID NO: 1042883 - DNA, 17 bp, Homo sapiens
tgaccacatacgtgtta

SEQ ID NO: 1042884 - DNA, 21 bp, Homo sapiens
tgaccaccccctgttccctgt

SEQ ID NO: 1042885 - DNA, 19 bp, Homo sapiens
tgaccaccctcccctctct

SEQ ID NO: 1042886 - DNA, 17 bp, Homo sapiens
tgaccactccagagaag

SEQ ID NO: 1042887 - DNA, 15 bp, Homo sapiens
tgaccactctgtctt

SEQ ID NO: 1042888 - DNA, 13 bp, Homo sapiens
tcgtctttacttc

SEQ ID NO: 1042889 - DNA, 15 bp, Homo sapiens
tcgtctttcccatgg

SEQ ID NO: 1042890 - DNA, 14 bp, Homo sapiens
tcgtgaaaccctgt

SEQ ID NO: 1042891 - DNA, 19 bp, Homo sapiens
tcgtgaagtatactgtatt

SEQ ID NO: 1042892 - DNA, 16 bp, Homo sapiens
tcgtgatcactgagcc

SEQ ID NO: 1042893 - DNA, 11 bp, Homo sapiens
tcgtgatgtgg

SEQ ID NO: 1042894 - DNA, 20 bp, Homo sapiens
tcgtgcactctgctaatcat

SEQ ID NO: 1042895 - DNA, 20 bp, Homo sapiens
tcgtgcattggaagacccca

SEQ ID NO: 1042896 - DNA, 18 bp, Homo sapiens
tcgtgcatttgaggggcc

SEQ ID NO: 1042897 - DNA, 20 bp, Homo sapiens
tcgtgcccccccttccccct

SEQ ID NO: 1042898 - DNA, 20 bp, Homo sapiens
tcgtgcctccttccacctcc

SEQ ID NO: 1042899 - DNA, 23 bp, Homo sapiens
tcgtgcctccttccacctccctc

SEQ ID NO: 1042900 - DNA, 13 bp, Homo sapiens
tcgtgcctgtgtc

SEQ ID NO: 1042901 - DNA, 21 bp, Homo sapiens
tcgtgcctgtgtccatgcgct

SEQ ID NO: 1042902 - DNA, 18 bp, Homo sapiens
tcgtgctaaattttcagt

SEQ ID NO: 1042903 - DNA, 16 bp, Homo sapiens
tcgtgctactgcactc

SEQ ID NO: 1042904 - DNA, 13 bp, Homo sapiens
tcgtgctggagga

SEQ ID NO: 1042905 - DNA, 20 bp, Homo sapiens
tcgtggctttggcagtgttt

SEQ ID NO: 1042906 - DNA, 12 bp, Homo sapiens
tcgtggggaggt

SEQ ID NO: 1042907 - DNA, 18 bp, Homo sapiens
tcgtggggtgtgctggga

SEQ ID NO: 1042908 - DNA, 22 bp, Homo sapiens
tcgtgggtgtgtgtagccaagg

SEQ ID NO: 1042909 - DNA, 13 bp, Homo sapiens
tcgtggtatgtat

SEQ ID NO: 1042910 - DNA, 15 bp, Homo sapiens
tcgtgtaaattatgt

SEQ ID NO: 1042911 - DNA, 23 bp, Homo sapiens
tcgtgtacagctcccttccctgc

SEQ ID NO: 1042912 - DNA, 19 bp, Homo sapiens
tcgtgtgcaacagacaagt

SEQ ID NO: 1042913 - DNA, 15 bp, Homo sapiens
tcgtgttatgaatct

SEQ ID NO: 1042914 - DNA, 17 bp, Homo sapiens
tcgtgtttgattccatt

SEQ ID NO: 1042915 - DNA, 16 bp, Homo sapiens
tcgttaaaaagttgtt

SEQ ID NO: 1042916 - DNA, 17 bp, Homo sapiens
tcgttacatcttgtagg

SEQ ID NO: 1042917 - DNA, 14 bp, Homo sapiens
tctttgccttgggc

SEQ ID NO: 1042918 - DNA, 23 bp, Homo sapiens
tctttgctcagtgtccagcttcc

SEQ ID NO: 1042919 - DNA, 11 bp, Homo sapiens
tctttgctttg

SEQ ID NO: 1042920 - DNA, 13 bp, Homo sapiens
tctttgctttgct

SEQ ID NO: 1042921 - DNA, 18 bp, Homo sapiens
tctttgctttgctttctg

SEQ ID NO: 1042922 - DNA, 16 bp, Homo sapiens
tctttggaaagtacac

SEQ ID NO: 1042923 - DNA, 19 bp, Homo sapiens
tctttggaaagtacactct

SEQ ID NO: 1042924 - DNA, 12 bp, Homo sapiens
tctttggaaata

SEQ ID NO: 1042925 - DNA, 18 bp, Homo sapiens
tctttggaaggagtgaga

SEQ ID NO: 1042926 - DNA, 22 bp, Homo sapiens
tctttggaatgaaattcctcct

SEQ ID NO: 1042927 - DNA, 23 bp, Homo sapiens
tctttggaatgaaattcctcctt

SEQ ID NO: 1042928 - DNA, 20 bp, Homo sapiens
tctttggagttaaaatgcac

SEQ ID NO: 1042929 - DNA, 17 bp, Homo sapiens
tctttggcctacattct

SEQ ID NO: 1042930 - DNA, 18 bp, Homo sapiens
tctttgggaatgtttgtc

SEQ ID NO: 1042931 - DNA, 17 bp, Homo sapiens
tctttgggcctctcctg

SEQ ID NO: 1042932 - DNA, 16 bp, Homo sapiens
tctttggtctattttc

SEQ ID NO: 1042933 - DNA, 19 bp, Homo sapiens
tctttggtttaatttaaag

SEQ ID NO: 1042934 - DNA, 19 bp, Homo sapiens
tctttgtaccaaaatttta

SEQ ID NO: 1042935 - DNA, 21 bp, Homo sapiens
tctttgtaccaaaattttaaa

SEQ ID NO: 1042936 - DNA, 23 bp, Homo sapiens
tctttgtaccaaaattttaaaaa

SEQ ID NO: 1042937 - DNA, 13 bp, Homo sapiens
tctttgtataaat

SEQ ID NO: 1042938 - DNA, 21 bp, Homo sapiens
tctttgtatataggcttctca

SEQ ID NO: 1042939 - DNA, 14 bp, Homo sapiens
tctttgtctgcctt

SEQ ID NO: 1042940 - DNA, 20 bp, Homo sapiens
tctttgtcttatctggccct

SEQ ID NO: 1042941 - DNA, 16 bp, Homo sapiens
tctttgtctttttcct

SEQ ID NO: 1042942 - DNA, 14 bp, Homo sapiens
tctttgtgacagga

SEQ ID NO: 1042943 - DNA, 16 bp, Homo sapiens
tctttgtgacaggaaa

SEQ ID NO: 1042944 - DNA, 20 bp, Homo sapiens
tctttgtgacaggaaagccc

SEQ ID NO: 1042945 - DNA, 23 bp, Homo sapiens
tctttgtgacaggaaagccctcc

SEQ ID NO: 1042946 - DNA, 22 bp, Homo sapiens
tctttgtggccaaggagctgct

SEQ ID NO: 1042947 - DNA, 19 bp, Homo sapiens
tctttgtgggagggtaaga

SEQ ID NO: 1042948 - DNA, 16 bp, Homo sapiens
tctttgtggggaagag

SEQ ID NO: 1042949 - DNA, 14 bp, Homo sapiens
tctttgtggtttct

SEQ ID NO: 1042950 - DNA, 19 bp, Homo sapiens
tctttgtggtttcttgttt

SEQ ID NO: 1042951 - DNA, 14 bp, Homo sapiens
tctttgttcaagat

SEQ ID NO: 1042952 - DNA, 14 bp, Homo sapiens
tctttgttctgttt

SEQ ID NO: 1042953 - DNA, 16 bp, Homo sapiens
tctttgttgaagtttg

SEQ ID NO: 1042954 - DNA, 15 bp, Homo sapiens
tctttgtttaacaaa

SEQ ID NO: 1042955 - DNA, 22 bp, Homo sapiens
tctttgtttctgtttcttgctc

SEQ ID NO: 1042956 - DNA, 16 bp, Homo sapiens
tctttgtttctttctt

SEQ ID NO: 1042957 - DNA, 18 bp, Homo sapiens
tctttgtttctttttaca

SEQ ID NO: 1042958 - DNA, 12 bp, Homo sapiens
tctttgttttta

SEQ ID NO: 1042959 - DNA, 18 bp, Homo sapiens
tcttttaaaaattcaaat

SEQ ID NO: 1042960 - DNA, 13 bp, Homo sapiens
tcttttaaactgg

SEQ ID NO: 1042961 - DNA, 21 bp, Homo sapiens
tcttttaaagtatttataaaa

SEQ ID NO: 1042962 - DNA, 21 bp, Homo sapiens
tcttttaaagtgttacttttt

SEQ ID NO: 1042963 - DNA, 22 bp, Homo sapiens
tcttttaaagttttatatgcat

SEQ ID NO: 1042964 - DNA, 19 bp, Homo sapiens
tcttttaaattagaaaata

SEQ ID NO: 1042965 - DNA, 21 bp, Homo sapiens
tcttttaaattagaaaatatt

SEQ ID NO: 1042966 - DNA, 12 bp, Homo sapiens
tcttttaagaat

SEQ ID NO: 1042967 - DNA, 11 bp, Homo sapiens
tcttttaagca

SEQ ID NO: 1042968 - DNA, 23 bp, Homo sapiens
tcttttaagcatttgtatattaa

SEQ ID NO: 1042969 - DNA, 18 bp, Homo sapiens
tcttttaatggcatttct

SEQ ID NO: 1042970 - DNA, 14 bp, Homo sapiens
tcttttacattttt

SEQ ID NO: 1042971 - DNA, 18 bp, Homo sapiens
tcttttaccctgtgtcag

SEQ ID NO: 1042972 - DNA, 18 bp, Homo sapiens
tcttttactcatgatctt

SEQ ID NO: 1042973 - DNA, 16 bp, Homo sapiens
tcttttactctgtgta

SEQ ID NO: 1042974 - DNA, 20 bp, Homo sapiens
tcttttactgttatagaata

SEQ ID NO: 1042975 - DNA, 13 bp, Homo sapiens
tcttttagacaac

SEQ ID NO: 1042976 - DNA, 14 bp, Homo sapiens
tcttttagacaact

SEQ ID NO: 1042977 - DNA, 17 bp, Homo sapiens
tcttttagacaactaga

SEQ ID NO: 1042978 - DNA, 20 bp, Homo sapiens
tcttttagacaactagattt

SEQ ID NO: 1042979 - DNA, 18 bp, Homo sapiens
tcttttagatcctaagtc

SEQ ID NO: 1042980 - DNA, 13 bp, Homo sapiens
tcttttataaata

SEQ ID NO: 1042981 - DNA, 14 bp, Homo sapiens
tcttttataaatat

SEQ ID NO: 1042982 - DNA, 13 bp, Homo sapiens
tcttttataattc

SEQ ID NO: 1042983 - DNA, 12 bp, Homo sapiens
tcttttattctt

SEQ ID NO: 1042984 - DNA, 19 bp, Homo sapiens
tcttttattcttctttctt

SEQ ID NO: 1042985 - DNA, 17 bp, Homo sapiens
tcttttatttagggcct

SEQ ID NO: 1042986 - DNA, 22 bp, Homo sapiens
tcttttcacatagctgtctaga

SEQ ID NO: 1042987 - DNA, 21 bp, Homo sapiens
tcttttcataaagggttgaaa

SEQ ID NO: 1042988 - DNA, 18 bp, Homo sapiens
tcttttcatatctcttgc

SEQ ID NO: 1042989 - DNA, 22 bp, Homo sapiens
tcttttcatctgggaaagacat

SEQ ID NO: 1042990 - DNA, 21 bp, Homo sapiens
tcttttcccatttatctaaat

SEQ ID NO: 1042991 - DNA, 17 bp, Homo sapiens
tcttttcccctttcctg

SEQ ID NO: 1042992 - DNA, 15 bp, Homo sapiens
tcttttcctctctgt

SEQ ID NO: 1042993 - DNA, 17 bp, Homo sapiens
tcttttcctctctgtct

SEQ ID NO: 1042994 - DNA, 18 bp, Homo sapiens
tcttttcctctctgtctg

SEQ ID NO: 1042995 - DNA, 20 bp, Homo sapiens
tcttttccttcattcatagg

SEQ ID NO: 1042996 - DNA, 14 bp, Homo sapiens
tcttttcctttatc

SEQ ID NO: 1042997 - DNA, 12 bp, Homo sapiens
tcttttctaccc

SEQ ID NO: 1042998 - DNA, 17 bp, Homo sapiens
tcttttctaccctagcc

SEQ ID NO: 1042999 - DNA, 18 bp, Homo sapiens
tcttttctaccctagcca

SEQ ID NO: 1043000 - DNA, 18 bp, Homo sapiens
tcttttctagtctgagct

SEQ ID NO: 1043001 - DNA, 16 bp, Homo sapiens
tcttttctgttattgt

SEQ ID NO: 1043002 - DNA, 19 bp, Homo sapiens
tcttttcttactcctcctc

SEQ ID NO: 1043003 - DNA, 17 bp, Homo sapiens
tcttttgaattgttaca

SEQ ID NO: 1043004 - DNA, 23 bp, Homo sapiens
tcttttgagttaggttaataaat

SEQ ID NO: 1043005 - DNA, 14 bp, Homo sapiens
tcttttgattttgt

SEQ ID NO: 1043006 - DNA, 18 bp, Homo sapiens
tcttttgcatgtcgcaca

SEQ ID NO: 1043007 - DNA, 20 bp, Homo sapiens
tcttttgcatgtcgcacaat

SEQ ID NO: 1043008 - DNA, 21 bp, Homo sapiens
tcttttgcatgtcgcacaatg

SEQ ID NO: 1043009 - DNA, 20 bp, Homo sapiens
tcttttgcattttgccgctg

SEQ ID NO: 1043010 - DNA, 17 bp, Homo sapiens
tcttttgctactaagtt

SEQ ID NO: 1043011 - DNA, 13 bp, Homo sapiens
tcttttgcttttg

SEQ ID NO: 1043012 - DNA, 12 bp, Homo sapiens
tcttttgtaatt

SEQ ID NO: 1043013 - DNA, 21 bp, Homo sapiens
tcttttgtaattgtgtaaaaa

SEQ ID NO: 1043014 - DNA, 15 bp, Homo sapiens
tcttttgtatgtaaa

SEQ ID NO: 1043015 - DNA, 17 bp, Homo sapiens
tcttttgtatgtaaatg

SEQ ID NO: 1043016 - DNA, 12 bp, Homo sapiens
tcttttgtatta

SEQ ID NO: 1043017 - DNA, 14 bp, Homo sapiens
tcttttgtctccca

SEQ ID NO: 1043018 - DNA, 18 bp, Homo sapiens
tcttttgtggacttgtct

SEQ ID NO: 1043019 - DNA, 22 bp, Homo sapiens
tcttttgtgtcctgctctgttt

SEQ ID NO: 1043020 - DNA, 22 bp, Homo sapiens
tcttttgttaaataatatggct

SEQ ID NO: 1043021 - DNA, 13 bp, Homo sapiens
tcttttgtttcca

SEQ ID NO: 1043022 - DNA, 15 bp, Homo sapiens
tcttttgtttccatg

SEQ ID NO: 1043023 - DNA, 16 bp, Homo sapiens
tctttttaaaaactct

SEQ ID NO: 1043024 - DNA, 18 bp, Homo sapiens
tctttttaaaaactcttc

SEQ ID NO: 1043025 - DNA, 20 bp, Homo sapiens
tctttttaaaaattgttatt

SEQ ID NO: 1043026 - DNA, 13 bp, Homo sapiens
tctttttaattat

SEQ ID NO: 1043027 - DNA, 21 bp, Homo sapiens
tctttttaattattttaaaat

SEQ ID NO: 1043028 - DNA, 17 bp, Homo sapiens
tctttttacagcattgt

SEQ ID NO: 1043029 - DNA, 13 bp, Homo sapiens
tctttttacagtt

SEQ ID NO: 1043030 - DNA, 15 bp, Homo sapiens
tctttttatacacaa

SEQ ID NO: 1043031 - DNA, 16 bp, Homo sapiens
tctttttatactatta

SEQ ID NO: 1043032 - DNA, 15 bp, Homo sapiens
tctttttcaataaat

SEQ ID NO: 1043033 - DNA, 12 bp, Homo sapiens
tctttttcctcc

SEQ ID NO: 1043034 - DNA, 16 bp, Homo sapiens
tcttttttaagttgtc

SEQ ID NO: 1043035 - DNA, 17 bp, Homo sapiens
tcttttttaataaacta

SEQ ID NO: 1043036 - DNA, 22 bp, Homo sapiens
tcttttttgtttgtttctttgt

SEQ ID NO: 1043037 - DNA, 23 bp, Homo sapiens
tcttttttgtttgtttctttgtg

SEQ ID NO: 1043038 - DNA, 12 bp, Homo sapiens
tctttttttatg

SEQ ID NO: 1043039 - DNA, 20 bp, Homo sapiens
tctttttttctgtcagtaaa

SEQ ID NO: 1043040 - DNA, 15 bp, Homo sapiens
tctttttttctttgg

SEQ ID NO: 1043041 - DNA, 19 bp, Homo sapiens
tctttttttgagtgacagc

SEQ ID NO: 1043042 - DNA, 16 bp, Homo sapiens
tcttttttttatataa

SEQ ID NO: 1043043 - DNA, 16 bp, Homo sapiens
tctttttttttaagtt

SEQ ID NO: 1043044 - DNA, 16 bp, Homo sapiens
tcttttttttttccaa

SEQ ID NO: 1043045 - DNA, 17 bp, Homo sapiens
tcttttttttttccaaa

SEQ ID NO: 1043046 - DNA, 23 bp, Homo sapiens
tcttttttttttttttacagtat

SEQ ID NO: 1043047 - DNA, 21 bp, Homo sapiens
tgaaaaaaaaaatgctgaaca

SEQ ID NO: 1043048 - DNA, 18 bp, Homo sapiens
tgaaaaaaaaaatgttga

SEQ ID NO: 1043049 - DNA, 16 bp, Homo sapiens
tgaaaaaaaacagtgg

SEQ ID NO: 1043050 - DNA, 11 bp, Homo sapiens
tgaaaaaaaga

SEQ ID NO: 1043051 - DNA, 18 bp, Homo sapiens
tgaaaaaaagcatggtat

SEQ ID NO: 1043052 - DNA, 21 bp, Homo sapiens
tgaaaaaaattttagaacagt

SEQ ID NO: 1043053 - DNA, 17 bp, Homo sapiens
tgaaaaaatactaccta

SEQ ID NO: 1043054 - DNA, 22 bp, Homo sapiens
tgaaaaaatagagcctgaggga

SEQ ID NO: 1043055 - DNA, 19 bp, Homo sapiens
tgaaaaaatattaaatcaa

SEQ ID NO: 1043056 - DNA, 17 bp, Homo sapiens
tgaaaaacaaaaagcta

SEQ ID NO: 1043057 - DNA, 18 bp, Homo sapiens
tgaaaaacattccaggaa

SEQ ID NO: 1043058 - DNA, 21 bp, Homo sapiens
tgaaaaacttacctactgggg

SEQ ID NO: 1043059 - DNA, 15 bp, Homo sapiens
tgaaaaagatgccaa

SEQ ID NO: 1043060 - DNA, 13 bp, Homo sapiens
tgaaaaagatggc

SEQ ID NO: 1043061 - DNA, 14 bp, Homo sapiens
tgaaaaagatggct

SEQ ID NO: 1043062 - DNA, 21 bp, Homo sapiens
tgaaaaagatggcttatgtca

SEQ ID NO: 1043063 - DNA, 13 bp, Homo sapiens
tgaaaaagcgaaa

SEQ ID NO: 1043064 - DNA, 17 bp, Homo sapiens
tgaaaaatacgttttgt

SEQ ID NO: 1043065 - DNA, 14 bp, Homo sapiens
tgaaaaatattgct

SEQ ID NO: 1043066 - DNA, 23 bp, Homo sapiens
tgaaaaatattgctaaaagtgca

SEQ ID NO: 1043067 - DNA, 15 bp, Homo sapiens
tgaaaaatcttaagt

SEQ ID NO: 1043068 - DNA, 14 bp, Homo sapiens
tgaaaaatgtaaat

SEQ ID NO: 1043069 - DNA, 15 bp, Homo sapiens
tgaaaaatgtcacta

SEQ ID NO: 1043070 - DNA, 21 bp, Homo sapiens
tgaaaaatgtcactatatctt

SEQ ID NO: 1043071 - DNA, 17 bp, Homo sapiens
tgaaaaattaacttttt

SEQ ID NO: 1043072 - DNA, 20 bp, Homo sapiens
tgaaaaatttaagcattgtt

SEQ ID NO: 1043073 - DNA, 18 bp, Homo sapiens
tgaaaacaaaaaaaatgt

SEQ ID NO: 1043074 - DNA, 13 bp, Homo sapiens
tgaaaacaaatct

SEQ ID NO: 1043075 - DNA, 14 bp, Homo sapiens
tgaaaacaaatcta

SEQ ID NO: 1043076 - DNA, 14 bp, Homo sapiens
tgaaaacaattcag

SEQ ID NO: 1043077 - DNA, 15 bp, Homo sapiens
tgaaaacaattcagt

SEQ ID NO: 1043078 - DNA, 16 bp, Homo sapiens
tgaaaacaattcagtg

SEQ ID NO: 1043079 - DNA, 14 bp, Homo sapiens
tgaaaacacatttt

SEQ ID NO: 1043080 - DNA, 19 bp, Homo sapiens
tgaaaacacatttttctta

SEQ ID NO: 1043081 - DNA, 16 bp, Homo sapiens
tgaaaacactgtgcac

SEQ ID NO: 1043082 - DNA, 18 bp, Homo sapiens
tgaaaacacttgatgatg

SEQ ID NO: 1043083 - DNA, 15 bp, Homo sapiens
tgaaaacagaatcag

SEQ ID NO: 1043084 - DNA, 17 bp, Homo sapiens
tgaaaacatctggaagg

SEQ ID NO: 1043085 - DNA, 14 bp, Homo sapiens
tgaaaacatgtaat

SEQ ID NO: 1043086 - DNA, 14 bp, Homo sapiens
tgaaaacccagaga

SEQ ID NO: 1043087 - DNA, 16 bp, Homo sapiens
tgaaaacccagagagg

SEQ ID NO: 1043088 - DNA, 23 bp, Homo sapiens
tgaaaacccagagaggaatcaga

SEQ ID NO: 1043089 - DNA, 18 bp, Homo sapiens
tgaaaacctaccagccag

SEQ ID NO: 1043090 - DNA, 20 bp, Homo sapiens
tgaaaacggagctgaacaat

SEQ ID NO: 1043091 - DNA, 19 bp, Homo sapiens
tgaaaacgttttattgtgt

SEQ ID NO: 1043092 - DNA, 17 bp, Homo sapiens
tgaaaactaaggatttt

SEQ ID NO: 1043093 - DNA, 18 bp, Homo sapiens
tgaaaactaatgtactgt

SEQ ID NO: 1043094 - DNA, 22 bp, Homo sapiens
tgaaaactaatgtactgtacat

SEQ ID NO: 1043095 - DNA, 23 bp, Homo sapiens
tgaaaactaatgtactgtacata

SEQ ID NO: 1043096 - DNA, 14 bp, Homo sapiens
tgaaaactagcatt

SEQ ID NO: 1043097 - DNA, 13 bp, Homo sapiens
tgaaaactctttg

SEQ ID NO: 1043098 - DNA, 18 bp, Homo sapiens
tgaaaactctttgctgct

SEQ ID NO: 1043099 - DNA, 12 bp, Homo sapiens
tgaaaactgaat

SEQ ID NO: 1043100 - DNA, 16 bp, Homo sapiens
tgaaaacttagccaga

SEQ ID NO: 1043101 - DNA, 13 bp, Homo sapiens
tgaaaacttcaaa

SEQ ID NO: 1043102 - DNA, 16 bp, Homo sapiens
tgaaaacttcaaagct

SEQ ID NO: 1043103 - DNA, 19 bp, Homo sapiens
tgaaaacttcaaagctgaa

SEQ ID NO: 1043104 - DNA, 16 bp, Homo sapiens
tgaaaactttgtagta

SEQ ID NO: 1043105 - DNA, 13 bp, Homo sapiens
tgaaaacttttgt

SEQ ID NO: 1043106 - DNA, 15 bp, Homo sapiens
tgaaaacttttgtaa

SEQ ID NO: 1043107 - DNA, 19 bp, Homo sapiens
tgaaaacttttgtaaatta

SEQ ID NO: 1043108 - DNA, 23 bp, Homo sapiens
tgaaaacttttgtaaattattga

SEQ ID NO: 1043109 - DNA, 20 bp, Homo sapiens
tgaaaagaaaaatgagcctg

SEQ ID NO: 1043110 - DNA, 15 bp, Homo sapiens
tgaaaagaaggaaag

SEQ ID NO: 1043111 - DNA, 18 bp, Homo sapiens
tgaaaagaccaagacttt

SEQ ID NO: 1043112 - DNA, 15 bp, Homo sapiens
tgaaaagagaagcaa

SEQ ID NO: 1043113 - DNA, 22 bp, Homo sapiens
tgaaaagagtatgtagtggctt

SEQ ID NO: 1043114 - DNA, 14 bp, Homo sapiens
tgaaaagcaataca

SEQ ID NO: 1043115 - DNA, 16 bp, Homo sapiens
tgaaaagcaatacaac

SEQ ID NO: 1043116 - DNA, 21 bp, Homo sapiens
tgaaaagcttaataaattcca

SEQ ID NO: 1043117 - DNA, 20 bp, Homo sapiens
tgaaaagggtgttgggaggg

SEQ ID NO: 1043118 - DNA, 23 bp, Homo sapiens
tgaaaagtattggttactggtga

SEQ ID NO: 1043119 - DNA, 12 bp, Homo sapiens
tgaaaagtcaaa

SEQ ID NO: 1043120 - DNA, 14 bp, Homo sapiens
tgaaaagtgcatgg

SEQ ID NO: 1043121 - DNA, 20 bp, Homo sapiens
tgaaaagttactacctgtca

SEQ ID NO: 1043122 - DNA, 23 bp, Homo sapiens
tgaaaagttcagggaccgtccag

SEQ ID NO: 1043123 - DNA, 22 bp, Homo sapiens
tgaaaagttggaaggatctgct

SEQ ID NO: 1043124 - DNA, 20 bp, Homo sapiens
tgaaaataaaacacacctcg

SEQ ID NO: 1043125 - DNA, 18 bp, Homo sapiens
tgaaaataactgaatttg

SEQ ID NO: 1043126 - DNA, 21 bp, Homo sapiens
tgaaaataactgaatttggag

SEQ ID NO: 1043127 - DNA, 18 bp, Homo sapiens
tgaaaataatctctgatt

SEQ ID NO: 1043128 - DNA, 14 bp, Homo sapiens
tgaaaataattttc

SEQ ID NO: 1043129 - DNA, 12 bp, Homo sapiens
tgaaaatacaac

SEQ ID NO: 1043130 - DNA, 19 bp, Homo sapiens
tgaaaatacaacttaaata

SEQ ID NO: 1043131 - DNA, 21 bp, Homo sapiens
tgaaaataccataggaagaca

SEQ ID NO: 1043132 - DNA, 17 bp, Homo sapiens
tgaaaatagtgtaagaa

SEQ ID NO: 1043133 - DNA, 15 bp, Homo sapiens
tgaaaatagtgttcc

SEQ ID NO: 1043134 - DNA, 14 bp, Homo sapiens
tgaaaatataacca

SEQ ID NO: 1043135 - DNA, 21 bp, Homo sapiens
tgaaaatatagacattctcac

SEQ ID NO: 1043136 - DNA, 17 bp, Homo sapiens
tgaaaatatatgatggc

SEQ ID NO: 1043137 - DNA, 20 bp, Homo sapiens
tgaaaatatgtctgcaggtt

SEQ ID NO: 1043138 - DNA, 22 bp, Homo sapiens
tgaaaatatttctatgtaaatt

SEQ ID NO: 1043139 - DNA, 16 bp, Homo sapiens
tgaaaatatttgtcca

SEQ ID NO: 1043140 - DNA, 17 bp, Homo sapiens
tgaaaatcaaagtaaaa

SEQ ID NO: 1043141 - DNA, 19 bp, Homo sapiens
tgaaaatcctatatctgtt

SEQ ID NO: 1043142 - DNA, 20 bp, Homo sapiens
tgaaaatcctatatctgttt

SEQ ID NO: 1043143 - DNA, 17 bp, Homo sapiens
tgaaaatcctgaataaa

SEQ ID NO: 1043144 - DNA, 21 bp, Homo sapiens
tgaaaatctaatattaaaaat

SEQ ID NO: 1043145 - DNA, 16 bp, Homo sapiens
tgaaaatgtccaggaa

SEQ ID NO: 1043146 - DNA, 15 bp, Homo sapiens
tgaaaatgtcttgtg

SEQ ID NO: 1043147 - DNA, 17 bp, Homo sapiens
tgaaaatgtgctatact

SEQ ID NO: 1043148 - DNA, 12 bp, Homo sapiens
tgaaaatgttta

SEQ ID NO: 1043149 - DNA, 13 bp, Homo sapiens
tgaaaatgtttta

SEQ ID NO: 1043150 - DNA, 15 bp, Homo sapiens
tgaaaatgttttatt

SEQ ID NO: 1043151 - DNA, 17 bp, Homo sapiens
tgaaaattacatgtttt

SEQ ID NO: 1043152 - DNA, 16 bp, Homo sapiens
tgaaaattatgcaaaa

SEQ ID NO: 1043153 - DNA, 17 bp, Homo sapiens
tgaaaattatttaaacc

SEQ ID NO: 1043154 - DNA, 15 bp, Homo sapiens
tgaaaattattttaa

SEQ ID NO: 1043155 - DNA, 17 bp, Homo sapiens
tgaaaattcaaaaagtg

SEQ ID NO: 1043156 - DNA, 19 bp, Homo sapiens
tgaaaattcaaaaagtgtt

SEQ ID NO: 1043157 - DNA, 13 bp, Homo sapiens
tgaaaattctgga

SEQ ID NO: 1043158 - DNA, 13 bp, Homo sapiens
tgaaaattctgtt

SEQ ID NO: 1043159 - DNA, 13 bp, Homo sapiens
tgaaaattgaaaa

SEQ ID NO: 1043160 - DNA, 19 bp, Homo sapiens
tgaaaattttaaaaataca

SEQ ID NO: 1043161 - DNA, 22 bp, Homo sapiens
tgaaaattttaaaaatacatat

SEQ ID NO: 1043162 - DNA, 15 bp, Homo sapiens
tgaaaattttacttc

SEQ ID NO: 1043163 - DNA, 18 bp, Homo sapiens
tgaaacaaagtactcttt

SEQ ID NO: 1043164 - DNA, 22 bp, Homo sapiens
tgaaacaaagtactctttaaca

SEQ ID NO: 1043165 - DNA, 18 bp, Homo sapiens
tgaaacaaataatcacat

SEQ ID NO: 1043166 - DNA, 22 bp, Homo sapiens
tgaaacaaataatcacattgac

SEQ ID NO: 1043167 - DNA, 21 bp, Homo sapiens
tgaaacaagtctagtcttctg

SEQ ID NO: 1043168 - DNA, 22 bp, Homo sapiens
tgaaacaatgttgtccaacaat

SEQ ID NO: 1043169 - DNA, 19 bp, Homo sapiens
tgaaacaccttctctggag

SEQ ID NO: 1043170 - DNA, 20 bp, Homo sapiens
tgaaacacgaaacttgttat

SEQ ID NO: 1043171 - DNA, 13 bp, Homo sapiens
tgaaacactggac

SEQ ID NO: 1043172 - DNA, 15 bp, Homo sapiens
tgaaacactggacct

SEQ ID NO: 1043173 - DNA, 13 bp, Homo sapiens
tgaaacagaaaca

SEQ ID NO: 1043174 - DNA, 22 bp, Homo sapiens
tgaaacagagaaagaaaaggca

SEQ ID NO: 1043175 - DNA, 16 bp, Homo sapiens
tgaaacagatgataaa

SEQ ID NO: 1043176 - DNA, 23 bp, Homo sapiens
tgaaacagattcaggccagccca

SEQ ID NO: 1043177 - DNA, 18 bp, Homo sapiens
tgaaacagttgctgtgaa

SEQ ID NO: 1043178 - DNA, 20 bp, Homo sapiens
tgaaacataataataatggg

SEQ ID NO: 1043179 - DNA, 23 bp, Homo sapiens
tgaaacattcacacagggctctt

SEQ ID NO: 1043180 - DNA, 12 bp, Homo sapiens
tgaaaccaaaac

SEQ ID NO: 1043181 - DNA, 23 bp, Homo sapiens
tgaaaccaaaacataaaaaccaa

SEQ ID NO: 1043182 - DNA, 20 bp, Homo sapiens
tgaaaccaccgtgaaccaga

SEQ ID NO: 1043183 - DNA, 21 bp, Homo sapiens
tgaaaccaccgtgaaccagag

SEQ ID NO: 1043184 - DNA, 14 bp, Homo sapiens
tgaaaccattttcc

SEQ ID NO: 1043185 - DNA, 23 bp, Homo sapiens
tgaaaccctgtctctactaaaaa

SEQ ID NO: 1043186 - DNA, 22 bp, Homo sapiens
tgaaacctcagggctgtcccag

SEQ ID NO: 1043187 - DNA, 20 bp, Homo sapiens
tgaaaccttattttttccca

SEQ ID NO: 1043188 - DNA, 22 bp, Homo sapiens
tgaaacctttagggcagcttgc

SEQ ID NO: 1043189 - DNA, 16 bp, Homo sapiens
tgaaacgactcaaaat

SEQ ID NO: 1043190 - DNA, 20 bp, Homo sapiens
tgaaacgcaattttacctag

SEQ ID NO: 1043191 - DNA, 21 bp, Homo sapiens
tgaaacgcaattttacctagt

SEQ ID NO: 1043192 - DNA, 20 bp, Homo sapiens
tgaaacgctcctttgtgtgt

SEQ ID NO: 1043193 - DNA, 16 bp, Homo sapiens
tgaaacgtattcagag

SEQ ID NO: 1043194 - DNA, 19 bp, Homo sapiens
tgaaactcatagacactga

SEQ ID NO: 1043195 - DNA, 19 bp, Homo sapiens
tgaaactccagatgccaca

SEQ ID NO: 1043196 - DNA, 21 bp, Homo sapiens
tgaaactcgcgagtgtaactt

SEQ ID NO: 1043197 - DNA, 11 bp, Homo sapiens
tgaaactctct

SEQ ID NO: 1043198 - DNA, 16 bp, Homo sapiens
tgaaactgcatttgtg

SEQ ID NO: 1043199 - DNA, 15 bp, Homo sapiens
tgaaactgctgtttt

SEQ ID NO: 1043200 - DNA, 18 bp, Homo sapiens
tgaaactggattaaactt

SEQ ID NO: 1043201 - DNA, 14 bp, Homo sapiens
tgaaactttcattc

SEQ ID NO: 1043202 - DNA, 23 bp, Homo sapiens
tgaaactttcattccttcagatt

SEQ ID NO: 1043203 - DNA, 16 bp, Homo sapiens
tgaaacttttctaaag

SEQ ID NO: 1043204 - DNA, 12 bp, Homo sapiens
tgaaagaaaata

SEQ ID NO: 1043205 - DNA, 14 bp, Homo sapiens
tgaaagaacataca

SEQ ID NO: 1043206 - DNA, 17 bp, Homo sapiens
tgaaagacagaatgtca

SEQ ID NO: 1043207 - DNA, 19 bp, Homo sapiens
tgaaagaccttctccaaat

SEQ ID NO: 1043208 - DNA, 16 bp, Homo sapiens
tgaaagactgtacaaa

SEQ ID NO: 1043209 - DNA, 14 bp, Homo sapiens
tgaaagagagctct

SEQ ID NO: 1043210 - DNA, 16 bp, Homo sapiens
tgaaagagttaagaat

SEQ ID NO: 1043211 - DNA, 14 bp, Homo sapiens
tgaaagatctctgt

SEQ ID NO: 1043212 - DNA, 23 bp, Homo sapiens
tgaaagatggctgtgcctctgcc

SEQ ID NO: 1043213 - DNA, 15 bp, Homo sapiens
tgaaagcatccatgt

SEQ ID NO: 1043214 - DNA, 17 bp, Homo sapiens
tgaaagccaacaactct

SEQ ID NO: 1043215 - DNA, 22 bp, Homo sapiens
tgaaagccaacaactctgcctt

SEQ ID NO: 1043216 - DNA, 23 bp, Homo sapiens
tgaaagccaaggagtcactgaga

SEQ ID NO: 1043217 - DNA, 17 bp, Homo sapiens
tgaaagccttagggaag

SEQ ID NO: 1043218 - DNA, 21 bp, Homo sapiens
tgaaagctgattactgtcaat

SEQ ID NO: 1043219 - DNA, 15 bp, Homo sapiens
tgaaaggaacatttt

SEQ ID NO: 1043220 - DNA, 22 bp, Homo sapiens
tgaaaggaagagctaataaatc

SEQ ID NO: 1043221 - DNA, 18 bp, Homo sapiens
tgaaaggaagctccactg

SEQ ID NO: 1043222 - DNA, 15 bp, Homo sapiens
tgaaaggaccctgtg

SEQ ID NO: 1043223 - DNA, 19 bp, Homo sapiens
tgaaaggagtttaaaaaca

SEQ ID NO: 1043224 - DNA, 20 bp, Homo sapiens
tgaaaggcaggaagggaagc

SEQ ID NO: 1043225 - DNA, 22 bp, Homo sapiens
tgaaaggcaggaagggaagcgt

SEQ ID NO: 1043226 - DNA, 23 bp, Homo sapiens
tgaaaggcaggcctatttcatca

SEQ ID NO: 1043227 - DNA, 19 bp, Homo sapiens
tgaaaggcctcaagaacaa

SEQ ID NO: 1043228 - DNA, 21 bp, Homo sapiens
tgaaagggcacttaatttgta

SEQ ID NO: 1043229 - DNA, 20 bp, Homo sapiens
tgaaaggggacacctgtaca

SEQ ID NO: 1043230 - DNA, 21 bp, Homo sapiens
tgaaaggggacacctgtacat

SEQ ID NO: 1043231 - DNA, 22 bp, Homo sapiens
tgaaagggtttgtaatacttta

SEQ ID NO: 1043232 - DNA, 13 bp, Homo sapiens
tgaaaggtactat

SEQ ID NO: 1043233 - DNA, 15 bp, Homo sapiens
tgaaaggtactatat

SEQ ID NO: 1043234 - DNA, 18 bp, Homo sapiens
tgaaaggtactatatttg

SEQ ID NO: 1043235 - DNA, 17 bp, Homo sapiens
tgaaaggttttttttca

SEQ ID NO: 1043236 - DNA, 18 bp, Homo sapiens
tgaaaggttttttttcag

SEQ ID NO: 1043237 - DNA, 13 bp, Homo sapiens
tgaaagtattcag

SEQ ID NO: 1043238 - DNA, 17 bp, Homo sapiens
tgaaagtattcagaaat

SEQ ID NO: 1043239 - DNA, 19 bp, Homo sapiens
tgaaagtattcagaaatta

SEQ ID NO: 1043240 - DNA, 22 bp, Homo sapiens
tgaaagtattcagaaattaaaa

SEQ ID NO: 1043241 - DNA, 18 bp, Homo sapiens
tgaaagtcagatgcccag

SEQ ID NO: 1043242 - DNA, 12 bp, Homo sapiens
tgaaagtctgtc

SEQ ID NO: 1043243 - DNA, 16 bp, Homo sapiens
tgaaagtgactttaaa

SEQ ID NO: 1043244 - DNA, 13 bp, Homo sapiens
tgaaagttgcttt

SEQ ID NO: 1043245 - DNA, 16 bp, Homo sapiens
tgaaagttgcttttat

SEQ ID NO: 1043246 - DNA, 20 bp, Homo sapiens
tgaaagttttcagaacctct

SEQ ID NO: 1043247 - DNA, 15 bp, Homo sapiens
tgaaagttttccagt

SEQ ID NO: 1043248 - DNA, 18 bp, Homo sapiens
tgaaagttttccagtatt

SEQ ID NO: 1043249 - DNA, 20 bp, Homo sapiens
tgaaagttttccagtattga

SEQ ID NO: 1043250 - DNA, 13 bp, Homo sapiens
tgaaagttttgta

SEQ ID NO: 1043251 - DNA, 14 bp, Homo sapiens
tgaaagttttgtaa

SEQ ID NO: 1043252 - DNA, 23 bp, Homo sapiens
tgaaataaaaaaaaaaggatgaa

SEQ ID NO: 1043253 - DNA, 12 bp, Homo sapiens
tgaaataaaata

SEQ ID NO: 1043254 - DNA, 17 bp, Homo sapiens
tgaaataaaatgccata

SEQ ID NO: 1043255 - DNA, 17 bp, Homo sapiens
tgaaataaacctgcact

SEQ ID NO: 1043256 - DNA, 18 bp, Homo sapiens
tgaaataaatgtttcaaa

SEQ ID NO: 1043257 - DNA, 19 bp, Homo sapiens
tgaaataaatgtttcaaat

SEQ ID NO: 1043258 - DNA, 18 bp, Homo sapiens
tgaaataaccgtaaaggt

SEQ ID NO: 1043259 - DNA, 23 bp, Homo sapiens
tgaaataaccgtaaaggtttatt

SEQ ID NO: 1043260 - DNA, 14 bp, Homo sapiens
tgaaataactggaa

SEQ ID NO: 1043261 - DNA, 20 bp, Homo sapiens
tgaaataagaattcagacat

SEQ ID NO: 1043262 - DNA, 12 bp, Homo sapiens
tgaaataataaa

SEQ ID NO: 1043263 - DNA, 18 bp, Homo sapiens
tgaaataataaaatgcaa

SEQ ID NO: 1043264 - DNA, 12 bp, Homo sapiens
tgaaataataga

SEQ ID NO: 1043265 - DNA, 14 bp, Homo sapiens
tgaaataatatatt

SEQ ID NO: 1043266 - DNA, 12 bp, Homo sapiens
tgaaataatcag

SEQ ID NO: 1043267 - DNA, 17 bp, Homo sapiens
tgaaataatgttctgtc

SEQ ID NO: 1043268 - DNA, 22 bp, Homo sapiens
tgaaataatttgtgtctgtgtt

SEQ ID NO: 1043269 - DNA, 20 bp, Homo sapiens
tcctttcctactgtcctgga

SEQ ID NO: 1043270 - DNA, 18 bp, Homo sapiens
tcctttcctcagacctgg

SEQ ID NO: 1043271 - DNA, 15 bp, Homo sapiens
tcctttctaaacaag

SEQ ID NO: 1043272 - DNA, 23 bp, Homo sapiens
tcctttctcagccgcttctgact

SEQ ID NO: 1043273 - DNA, 13 bp, Homo sapiens
tcctttctccagg

SEQ ID NO: 1043274 - DNA, 23 bp, Homo sapiens
tcctttctcccctattttttggt

SEQ ID NO: 1043275 - DNA, 14 bp, Homo sapiens
tcctttctccctgc

SEQ ID NO: 1043276 - DNA, 17 bp, Homo sapiens
tcctttctccctgcagc

SEQ ID NO: 1043277 - DNA, 16 bp, Homo sapiens
tcctttctcctgtgaa

SEQ ID NO: 1043278 - DNA, 18 bp, Homo sapiens
tcctttctgactgtccct

SEQ ID NO: 1043279 - DNA, 21 bp, Homo sapiens
tcctttctgactgtccctgcc

SEQ ID NO: 1043280 - DNA, 13 bp, Homo sapiens
tcctttctgcccc

SEQ ID NO: 1043281 - DNA, 14 bp, Homo sapiens
tcctttctgccccc

SEQ ID NO: 1043282 - DNA, 21 bp, Homo sapiens
tcctttctgccccccagggct

SEQ ID NO: 1043283 - DNA, 22 bp, Homo sapiens
tcctttctgggtaacaagccct

SEQ ID NO: 1043284 - DNA, 16 bp, Homo sapiens
tcctttctgtgaagct

SEQ ID NO: 1043285 - DNA, 17 bp, Homo sapiens
tcctttctgtgccctac

SEQ ID NO: 1043286 - DNA, 15 bp, Homo sapiens
tcctttcttgtcttt

SEQ ID NO: 1043287 - DNA, 21 bp, Homo sapiens
tcctttcttgtgccctgggcc

SEQ ID NO: 1043288 - DNA, 19 bp, Homo sapiens
tcctttgacaaaagtaaat

SEQ ID NO: 1043289 - DNA, 18 bp, Homo sapiens
tcctttgagaatgtgatt

SEQ ID NO: 1043290 - DNA, 20 bp, Homo sapiens
tcctttgcaattgctcttct

SEQ ID NO: 1043291 - DNA, 21 bp, Homo sapiens
tcctttgcaattgctcttctc

SEQ ID NO: 1043292 - DNA, 14 bp, Homo sapiens
tcctttgcactgag

SEQ ID NO: 1043293 - DNA, 22 bp, Homo sapiens
tcctttggagcttttttcttta

SEQ ID NO: 1043294 - DNA, 13 bp, Homo sapiens
tcctttgggaaag

SEQ ID NO: 1043295 - DNA, 17 bp, Homo sapiens
tcctttgtgtgtgtgtc

SEQ ID NO: 1043296 - DNA, 15 bp, Homo sapiens
tcctttgtgtttcta

SEQ ID NO: 1043297 - DNA, 24 bp, Homo sapiens
tcctttgttcttacctgtatgtct

SEQ ID NO: 1043298 - DNA, 18 bp, Homo sapiens
tcctttgttttctgacta

SEQ ID NO: 1043299 - DNA, 22 bp, Homo sapiens
tcctttgttttctgactaatta

SEQ ID NO: 1043300 - DNA, 19 bp, Homo sapiens
tccttttaaaacacttcca

SEQ ID NO: 1043301 - DNA, 13 bp, Homo sapiens
tccttttaaagaa

SEQ ID NO: 1043302 - DNA, 13 bp, Homo sapiens
tccttttatataa

SEQ ID NO: 1043303 - DNA, 14 bp, Homo sapiens
tccttttatttctc

SEQ ID NO: 1043304 - DNA, 12 bp, Homo sapiens
tccttttcacat

SEQ ID NO: 1043305 - DNA, 14 bp, Homo sapiens
tccttttcagaagt

SEQ ID NO: 1043306 - DNA, 20 bp, Homo sapiens
tccttttcccctacagaatt

SEQ ID NO: 1043307 - DNA, 12 bp, Homo sapiens
tccttttctccc

SEQ ID NO: 1043308 - DNA, 23 bp, Homo sapiens
tccttttctcccatttcttgcta

SEQ ID NO: 1043309 - DNA, 16 bp, Homo sapiens
tccttttctctcctgt

SEQ ID NO: 1043310 - DNA, 17 bp, Homo sapiens
tccttttctctcctgtg

SEQ ID NO: 1043311 - DNA, 19 bp, Homo sapiens
tccttttcttcaccctccc

SEQ ID NO: 1043312 - DNA, 22 bp, Homo sapiens
tcgagtgcccctgtcccacctg

SEQ ID NO: 1043313 - DNA, 17 bp, Homo sapiens
tcgagtgtagctgtgaa

SEQ ID NO: 1043314 - DNA, 19 bp, Homo sapiens
tcgagtgtagctgtgaaat

SEQ ID NO: 1043315 - DNA, 21 bp, Homo sapiens
tcgatacccaggaccaagcca

SEQ ID NO: 1043316 - DNA, 14 bp, Homo sapiens
tcgatactgcgact

SEQ ID NO: 1043317 - DNA, 19 bp, Homo sapiens
tcgatactgcgactttctg

SEQ ID NO: 1043318 - DNA, 17 bp, Homo sapiens
tcgatcaagagaatcaa

SEQ ID NO: 1043319 - DNA, 19 bp, Homo sapiens
tcgatcctggattcactca

SEQ ID NO: 1043320 - DNA, 13 bp, Homo sapiens
tcgatgaatgtaa

SEQ ID NO: 1043321 - DNA, 15 bp, Homo sapiens
tcgatgcgtattctg

SEQ ID NO: 1043322 - DNA, 19 bp, Homo sapiens
tcgatgcgtattctgtggc

SEQ ID NO: 1043323 - DNA, 23 bp, Homo sapiens
tcgatgcgtattctgtggccgcc

SEQ ID NO: 1043324 - DNA, 17 bp, Homo sapiens
tcgatgggggatgcttc

SEQ ID NO: 1043325 - DNA, 22 bp, Homo sapiens
tcgatggtggcgctttctcctg

SEQ ID NO: 1043326 - DNA, 21 bp, Homo sapiens
tcgattagactggacagcttg

SEQ ID NO: 1043327 - DNA, 12 bp, Homo sapiens
tcgcaaccctgc

SEQ ID NO: 1043328 - DNA, 13 bp, Homo sapiens
tcgcaaccctgcc

SEQ ID NO: 1043329 - DNA, 18 bp, Homo sapiens
tcgcaaccctgcctgtca

SEQ ID NO: 1043330 - DNA, 20 bp, Homo sapiens
tcgcacaatgcatgtgctgt

SEQ ID NO: 1043331 - DNA, 13 bp, Homo sapiens
tcgcacaggccct

SEQ ID NO: 1043332 - DNA, 21 bp, Homo sapiens
tcgcaccactgtgtatttaac

SEQ ID NO: 1043333 - DNA, 14 bp, Homo sapiens
tcgcagaccagagc

SEQ ID NO: 1043334 - DNA, 15 bp, Homo sapiens
tcgcagatgataaaa

SEQ ID NO: 1043335 - DNA, 11 bp, Homo sapiens
tcgcagcctga

SEQ ID NO: 1043336 - DNA, 17 bp, Homo sapiens
tcgcagcctgaagcctg

SEQ ID NO: 1043337 - DNA, 19 bp, Homo sapiens
tcgcagcctgaagcctgga

SEQ ID NO: 1043338 - DNA, 12 bp, Homo sapiens
tcgcagctgtgg

SEQ ID NO: 1043339 - DNA, 21 bp, Homo sapiens
tcgcaggaccaagggggcggg

SEQ ID NO: 1043340 - DNA, 19 bp, Homo sapiens
tcgcaggagtctctgccac

SEQ ID NO: 1043341 - DNA, 21 bp, Homo sapiens
tcgcaggagtctctgccaccc

SEQ ID NO: 1043342 - DNA, 23 bp, Homo sapiens
tcgcaggagtctctgccacccac

SEQ ID NO: 1043343 - DNA, 18 bp, Homo sapiens
tcgcaggatccgctgcca

SEQ ID NO: 1043344 - DNA, 14 bp, Homo sapiens
tcgcagtcgcagga

SEQ ID NO: 1043345 - DNA, 20 bp, Homo sapiens
tcgcatccgtcctgggcgtg

SEQ ID NO: 1043346 - DNA, 15 bp, Homo sapiens
tcgcattaagcacac

SEQ ID NO: 1043347 - DNA, 17 bp, Homo sapiens
tcgcattaagcacacac

SEQ ID NO: 1043348 - DNA, 22 bp, Homo sapiens
tcgcattaagcacacacatctg

SEQ ID NO: 1043349 - DNA, 18 bp, Homo sapiens
tcgccacctttcaccctc

SEQ ID NO: 1043350 - DNA, 19 bp, Homo sapiens
tcgccacctttcaccctca

SEQ ID NO: 1043351 - DNA, 15 bp, Homo sapiens
tcgccacgctcagtg

SEQ ID NO: 1043352 - DNA, 23 bp, Homo sapiens
tcgccagtcactgctgcaaggtg

SEQ ID NO: 1043353 - DNA, 13 bp, Homo sapiens
tcgccatcaaggt

SEQ ID NO: 1043354 - DNA, 18 bp, Homo sapiens
tcgcccaaagccagacag

SEQ ID NO: 1043355 - DNA, 18 bp, Homo sapiens
tcgcccagacaccatgtg

SEQ ID NO: 1043356 - DNA, 12 bp, Homo sapiens
tcgcccaggaga

SEQ ID NO: 1043357 - DNA, 22 bp, Homo sapiens
tcgcccatacccgtgacagtgg

SEQ ID NO: 1043358 - DNA, 18 bp, Homo sapiens
tcgccccagatcaccagc

SEQ ID NO: 1043359 - DNA, 14 bp, Homo sapiens
tcgccccagcaggt

SEQ ID NO: 1043360 - DNA, 20 bp, Homo sapiens
tcgccccaggccctccctga

SEQ ID NO: 1043361 - DNA, 13 bp, Homo sapiens
tcgccccatccct

SEQ ID NO: 1043362 - DNA, 12 bp, Homo sapiens
tcgcccccacca

SEQ ID NO: 1043363 - DNA, 16 bp, Homo sapiens
tcgcccctccagtgtt

SEQ ID NO: 1043364 - DNA, 14 bp, Homo sapiens
tcgcccctcccctc

SEQ ID NO: 1043365 - DNA, 20 bp, Homo sapiens
tcgcccctcccctcagcctg

SEQ ID NO: 1043366 - DNA, 22 bp, Homo sapiens
tcgcccctcccctcagcctgcc

SEQ ID NO: 1043367 - DNA, 17 bp, Homo sapiens
tcgcccgcccactgtcc

SEQ ID NO: 1043368 - DNA, 18 bp, Homo sapiens
tcgcccgcccactgtcct

SEQ ID NO: 1043369 - DNA, 23 bp, Homo sapiens
tcgcccgcccactgtcctgggcg

SEQ ID NO: 1043370 - DNA, 13 bp, Homo sapiens
tcgccctcccagg

SEQ ID NO: 1043371 - DNA, 18 bp, Homo sapiens
tcgccctcctttccctta

SEQ ID NO: 1043372 - DNA, 15 bp, Homo sapiens
tcgccctctgaaatt

SEQ ID NO: 1043373 - DNA, 12 bp, Homo sapiens
tcgcccttctcc

SEQ ID NO: 1043374 - DNA, 14 bp, Homo sapiens
tcgcctaggcctgt

SEQ ID NO: 1043375 - DNA, 12 bp, Homo sapiens
tcgcctcagcct

SEQ ID NO: 1043376 - DNA, 11 bp, Homo sapiens
tcgcctgacaa

SEQ ID NO: 1043377 - DNA, 18 bp, Homo sapiens
tcgcctgtaatgccagcg

SEQ ID NO: 1043378 - DNA, 18 bp, Homo sapiens
tcgcctgtggagctcagc

SEQ ID NO: 1043379 - DNA, 15 bp, Homo sapiens
tcgccttccctcctg

SEQ ID NO: 1043380 - DNA, 23 bp, Homo sapiens
tcgcctttgtcttgtacttctgt

SEQ ID NO: 1043381 - DNA, 22 bp, Homo sapiens
tcgcgccagcgacctctctgcc

SEQ ID NO: 1043382 - DNA, 20 bp, Homo sapiens
tcgcgccccccgcgcccctc

SEQ ID NO: 1043383 - DNA, 15 bp, Homo sapiens
tcgcgctcagtaaac

SEQ ID NO: 1043384 - DNA, 16 bp, Homo sapiens
tcgcggcggagctggc

SEQ ID NO: 1043385 - DNA, 20 bp, Homo sapiens
tcgcggctgggagcctcgcc

SEQ ID NO: 1043386 - DNA, 16 bp, Homo sapiens
tcgcggtcttgggcac

SEQ ID NO: 1043387 - DNA, 21 bp, Homo sapiens
tcgcggtgtgtcctctgtgcc

SEQ ID NO: 1043388 - DNA, 18 bp, Homo sapiens
tcgcgtgccctcgctgct

SEQ ID NO: 1043389 - DNA, 17 bp, Homo sapiens
tcgctaagctggctctg

SEQ ID NO: 1043390 - DNA, 13 bp, Homo sapiens
tcgctagcactca

SEQ ID NO: 1043391 - DNA, 16 bp, Homo sapiens
tcgctagggccaaggt

SEQ ID NO: 1043392 - DNA, 19 bp, Homo sapiens
tcgctagtcagtaaagata

SEQ ID NO: 1043393 - DNA, 18 bp, Homo sapiens
tcgctcaatcaagaaaat

SEQ ID NO: 1043394 - DNA, 21 bp, Homo sapiens
tcgctcaccgctggcccttag

SEQ ID NO: 1043395 - DNA, 12 bp, Homo sapiens
tcgctcaggctg

SEQ ID NO: 1043396 - DNA, 23 bp, Homo sapiens
tcgctcaggctggagtgcagtga

SEQ ID NO: 1043397 - DNA, 18 bp, Homo sapiens
tcgctcagtctgttcact

SEQ ID NO: 1043398 - DNA, 16 bp, Homo sapiens
tcgctccctgtagctc

SEQ ID NO: 1043399 - DNA, 19 bp, Homo sapiens
tcgctccctgtagctctgc

SEQ ID NO: 1043400 - DNA, 21 bp, Homo sapiens
tcgctccctgtagctctgcct

SEQ ID NO: 1043401 - DNA, 22 bp, Homo sapiens
tcgctccctgtagctctgcctc

SEQ ID NO: 1043402 - DNA, 15 bp, Homo sapiens
tcgctcctattgaaa

SEQ ID NO: 1043403 - DNA, 16 bp, Homo sapiens
tcgctcctcccagatg

SEQ ID NO: 1043404 - DNA, 18 bp, Homo sapiens
tcgctcctcccagatggc

SEQ ID NO: 1043405 - DNA, 15 bp, Homo sapiens
tcgctcctccttccc

SEQ ID NO: 1043406 - DNA, 18 bp, Homo sapiens
tcgctcctccttcccagg

SEQ ID NO: 1043407 - DNA, 17 bp, Homo sapiens
tcgctctgctggcctgg

SEQ ID NO: 1043408 - DNA, 20 bp, Homo sapiens
tcgctctgctggcctggccg

SEQ ID NO: 1043409 - DNA, 23 bp, Homo sapiens
tcgctctgctggcctggccggca

SEQ ID NO: 1043410 - DNA, 18 bp, Homo sapiens
tcgctgacttcatggaat

SEQ ID NO: 1043411 - DNA, 22 bp, Homo sapiens
tcgctgagggcagactggggca

SEQ ID NO: 1043412 - DNA, 22 bp, Homo sapiens
tcgctgatatatgtgtttttca

SEQ ID NO: 1043413 - DNA, 21 bp, Homo sapiens
tcgctgccatcaccgctgggt

SEQ ID NO: 1043414 - DNA, 22 bp, Homo sapiens
tcgctgccatcaccgctgggtg

SEQ ID NO: 1043415 - DNA, 23 bp, Homo sapiens
tcgctgccatcaccgctgggtgg

SEQ ID NO: 1043416 - DNA, 18 bp, Homo sapiens
tcgctgctctagctggca

SEQ ID NO: 1043417 - DNA, 19 bp, Homo sapiens
tcgctgctctagctggcag

SEQ ID NO: 1043418 - DNA, 18 bp, Homo sapiens
tcgctgtaccctttaaga

SEQ ID NO: 1043419 - DNA, 20 bp, Homo sapiens
tcgctgtaccctttaagata

SEQ ID NO: 1043420 - DNA, 16 bp, Homo sapiens
tcgctgtgccacaggc

SEQ ID NO: 1043421 - DNA, 19 bp, Homo sapiens
tcgcttccctgaaagactg

SEQ ID NO: 1043422 - DNA, 14 bp, Homo sapiens
tcgcttcttgcctc

SEQ ID NO: 1043423 - DNA, 15 bp, Homo sapiens
tcgcttgaacctggg

SEQ ID NO: 1043424 - DNA, 11 bp, Homo sapiens
tcggaaaaaaa

SEQ ID NO: 1043425 - DNA, 17 bp, Homo sapiens
tcggaaaaaaaaaaaga

SEQ ID NO: 1043426 - DNA, 19 bp, Homo sapiens
tcggaaccgctcacctaga

SEQ ID NO: 1043427 - DNA, 22 bp, Homo sapiens
tcggaaccgctcacctagagcc

SEQ ID NO: 1043428 - DNA, 22 bp, Homo sapiens
tcggaagcagtgccttccataa

SEQ ID NO: 1043429 - DNA, 17 bp, Homo sapiens
tcggaagcctgtcctca

SEQ ID NO: 1043430 - DNA, 19 bp, Homo sapiens
tcggaagcctgtcctcacc

SEQ ID NO: 1043431 - DNA, 19 bp, Homo sapiens
tcggacaagacccccagca

SEQ ID NO: 1043432 - DNA, 21 bp, Homo sapiens
tcggacatgcttttctgccac

SEQ ID NO: 1043433 - DNA, 23 bp, Homo sapiens
tcggacggccaatggtgcttccc

SEQ ID NO: 1043434 - DNA, 21 bp, Homo sapiens
tcggagaagagcgcagtgttt

SEQ ID NO: 1043435 - DNA, 15 bp, Homo sapiens
tcggagacagtgatc

SEQ ID NO: 1043436 - DNA, 16 bp, Homo sapiens
tcggagagcagcagca

SEQ ID NO: 1043437 - DNA, 20 bp, Homo sapiens
tcggagaggctgtctggggc

SEQ ID NO: 1043438 - DNA, 14 bp, Homo sapiens
tcggagccctcaga

SEQ ID NO: 1043439 - DNA, 23 bp, Homo sapiens
tcggagcctgtgttagtgtctgt

SEQ ID NO: 1043440 - DNA, 15 bp, Homo sapiens
tcggagctgccagcc

SEQ ID NO: 1043441 - DNA, 12 bp, Homo sapiens
tcggagctgcct

SEQ ID NO: 1043442 - DNA, 16 bp, Homo sapiens
tcggagctgcctgcag

SEQ ID NO: 1043443 - DNA, 21 bp, Homo sapiens
tcggagctgcctgcagcacat

SEQ ID NO: 1043444 - DNA, 13 bp, Homo sapiens
tcggagctggctg

SEQ ID NO: 1043445 - DNA, 16 bp, Homo sapiens
tcggagctggctgtgc

SEQ ID NO: 1043446 - DNA, 21 bp, Homo sapiens
tcggaggaccctggaaaacag

SEQ ID NO: 1043447 - DNA, 13 bp, Homo sapiens
tcggaggctgggc

SEQ ID NO: 1043448 - DNA, 14 bp, Homo sapiens
tcggaggctgggcc

SEQ ID NO: 1043449 - DNA, 18 bp, Homo sapiens
tcggaggctgggcccctg

SEQ ID NO: 1043450 - DNA, 19 bp, Homo sapiens
tcggaggctgggcccctgg

SEQ ID NO: 1043451 - DNA, 22 bp, Homo sapiens
tcggagggaattgaggtctgct

SEQ ID NO: 1043452 - DNA, 15 bp, Homo sapiens
tcggagggccgcagg

SEQ ID NO: 1043453 - DNA, 14 bp, Homo sapiens
tcggagtggacacc

SEQ ID NO: 1043454 - DNA, 13 bp, Homo sapiens
tcggatcctgtga

SEQ ID NO: 1043455 - DNA, 18 bp, Homo sapiens
tcggatctcacaggctga

SEQ ID NO: 1043456 - DNA, 21 bp, Homo sapiens
tcggatgacaccctggcctga

SEQ ID NO: 1043457 - DNA, 16 bp, Homo sapiens
tcggatggaccaacct

SEQ ID NO: 1043458 - DNA, 17 bp, Homo sapiens
tcggatgggtgtgggag

SEQ ID NO: 1043459 - DNA, 14 bp, Homo sapiens
tcggattttttcca

SEQ ID NO: 1043460 - DNA, 16 bp, Homo sapiens
tcggattttttccaaa

SEQ ID NO: 1043461 - DNA, 11 bp, Homo sapiens
tcggcacacac

SEQ ID NO: 1043462 - DNA, 18 bp, Homo sapiens
tcggcacacactgtgccc

SEQ ID NO: 1043463 - DNA, 16 bp, Homo sapiens
tcggcagaactctctg

SEQ ID NO: 1043464 - DNA, 14 bp, Homo sapiens
tcggcatgccagga

SEQ ID NO: 1043465 - DNA, 16 bp, Homo sapiens
tcggcatttcaaatgt

SEQ ID NO: 1043466 - DNA, 22 bp, Homo sapiens
tcggccaagaatacttgaagaa

SEQ ID NO: 1043467 - DNA, 12 bp, Homo sapiens
tcggcccacagc

SEQ ID NO: 1043468 - DNA, 16 bp, Homo sapiens
tcggcccacagctccc

SEQ ID NO: 1043469 - DNA, 24 bp, Homo sapiens
tcggccccacccaccctctggtcc

SEQ ID NO: 1043470 - DNA, 13 bp, Homo sapiens
tcggccctgaacc

SEQ ID NO: 1043471 - DNA, 18 bp, Homo sapiens
tcggccctgaaccacgag

SEQ ID NO: 1043472 - DNA, 13 bp, Homo sapiens
tcctggatttata

SEQ ID NO: 1043473 - DNA, 23 bp, Homo sapiens
tcctggatttatagtatgtgact

SEQ ID NO: 1043474 - DNA, 23 bp, Homo sapiens
tcctggcacgccctactccactg

SEQ ID NO: 1043475 - DNA, 14 bp, Homo sapiens
tcctggcagcccag

SEQ ID NO: 1043476 - DNA, 17 bp, Homo sapiens
tcctggcagcccagaga

SEQ ID NO: 1043477 - DNA, 19 bp, Homo sapiens
tcctggcagggccacctgc

SEQ ID NO: 1043478 - DNA, 22 bp, Homo sapiens
tcctggcagggccacctgcagg

SEQ ID NO: 1043479 - DNA, 16 bp, Homo sapiens
tcctggcatgacactc

SEQ ID NO: 1043480 - DNA, 17 bp, Homo sapiens
tcctggcatttgctgat

SEQ ID NO: 1043481 - DNA, 14 bp, Homo sapiens
tcctggccatccca

SEQ ID NO: 1043482 - DNA, 15 bp, Homo sapiens
tcctggccatcccac

SEQ ID NO: 1043483 - DNA, 16 bp, Homo sapiens
tcctggccatcccaca

SEQ ID NO: 1043484 - DNA, 13 bp, Homo sapiens
tcctggcccaggc

SEQ ID NO: 1043485 - DNA, 17 bp, Homo sapiens
tcctggcccaggccttg

SEQ ID NO: 1043486 - DNA, 20 bp, Homo sapiens
tcctggcccaggccttgctg

SEQ ID NO: 1043487 - DNA, 20 bp, Homo sapiens
tcctggccccgggctctggc

SEQ ID NO: 1043488 - DNA, 23 bp, Homo sapiens
tcctggcccgccctcacctctga

SEQ ID NO: 1043489 - DNA, 18 bp, Homo sapiens
tcctggcctcactggctg

SEQ ID NO: 1043490 - DNA, 20 bp, Homo sapiens
tcctggcctcactggctggg

SEQ ID NO: 1043491 - DNA, 23 bp, Homo sapiens
tcctggcctcactggctggggca

SEQ ID NO: 1043492 - DNA, 18 bp, Homo sapiens
tcctggcctcgtgatctg

SEQ ID NO: 1043493 - DNA, 16 bp, Homo sapiens
tcctggccttcctcgt

SEQ ID NO: 1043494 - DNA, 21 bp, Homo sapiens
tcctggccttcctcgttgggc

SEQ ID NO: 1043495 - DNA, 14 bp, Homo sapiens
tcctggccttctga

SEQ ID NO: 1043496 - DNA, 22 bp, Homo sapiens
tcctggccttgtgtcactggct

SEQ ID NO: 1043497 - DNA, 20 bp, Homo sapiens
tcctggcgcctggcagtccg

SEQ ID NO: 1043498 - DNA, 14 bp, Homo sapiens
tcctggctacatcc

SEQ ID NO: 1043499 - DNA, 16 bp, Homo sapiens
tcctggctccgcaggg

SEQ ID NO: 1043500 - DNA, 18 bp, Homo sapiens
tcctggctccgcaggggt

SEQ ID NO: 1043501 - DNA, 13 bp, Homo sapiens
tcctggctcctga

SEQ ID NO: 1043502 - DNA, 20 bp, Homo sapiens
tcctggctccttcactgaac

SEQ ID NO: 1043503 - DNA, 21 bp, Homo sapiens
tcctggctcggggtaaaaagt

SEQ ID NO: 1043504 - DNA, 19 bp, Homo sapiens
tcctggctctaccctgtct

SEQ ID NO: 1043505 - DNA, 14 bp, Homo sapiens
tcctggctctgggg

SEQ ID NO: 1043506 - DNA, 24 bp, Homo sapiens
tcctggctgatgatccagaacagt

SEQ ID NO: 1043507 - DNA, 13 bp, Homo sapiens
tcctggctgcact

SEQ ID NO: 1043508 - DNA, 15 bp, Homo sapiens
tcctggctgccaggc

SEQ ID NO: 1043509 - DNA, 14 bp, Homo sapiens
tcctggctgtgccc

SEQ ID NO: 1043510 - DNA, 17 bp, Homo sapiens
tcctggctgtgcccagc

SEQ ID NO: 1043511 - DNA, 23 bp, Homo sapiens
tcctggctgtgcccagcaggccc

SEQ ID NO: 1043512 - DNA, 18 bp, Homo sapiens
tcctgggaaacctgcctt

SEQ ID NO: 1043513 - DNA, 14 bp, Homo sapiens
tcctgggaaatatt

SEQ ID NO: 1043514 - DNA, 21 bp, Homo sapiens
tcctgggaatggaataactat

SEQ ID NO: 1043515 - DNA, 16 bp, Homo sapiens
tcctgggaccccctcg

SEQ ID NO: 1043516 - DNA, 19 bp, Homo sapiens
tcctgggaccccctcgcca

SEQ ID NO: 1043517 - DNA, 21 bp, Homo sapiens
tcctgggaccccctcgccagc

SEQ ID NO: 1043518 - DNA, 17 bp, Homo sapiens
tcctgggagaacctcag

SEQ ID NO: 1043519 - DNA, 23 bp, Homo sapiens
tcctgggagaacctcaggcttcc

SEQ ID NO: 1043520 - DNA, 19 bp, Homo sapiens
tcctgggaggacaggcagg

SEQ ID NO: 1043521 - DNA, 22 bp, Homo sapiens
tcctgggcagccgttttcctca

SEQ ID NO: 1043522 - DNA, 16 bp, Homo sapiens
tcctgggccctctctg

SEQ ID NO: 1043523 - DNA, 13 bp, Homo sapiens
tcctgggcctttg

SEQ ID NO: 1043524 - DNA, 13 bp, Homo sapiens
tcctgggcgccct

SEQ ID NO: 1043525 - DNA, 19 bp, Homo sapiens
tcctgggcgccctggaagc

SEQ ID NO: 1043526 - DNA, 19 bp, Homo sapiens
tcctgggcgtgacccgtcc

SEQ ID NO: 1043527 - DNA, 18 bp, Homo sapiens
tcctgggctctgaacaca

SEQ ID NO: 1043528 - DNA, 20 bp, Homo sapiens
tcctgggctgggtggcccct

SEQ ID NO: 1043529 - DNA, 17 bp, Homo sapiens
tcctggggagctcctgg

SEQ ID NO: 1043530 - DNA, 23 bp, Homo sapiens
tcctggggagctcctgggaccct

SEQ ID NO: 1043531 - DNA, 16 bp, Homo sapiens
tcctggggcagcactc

SEQ ID NO: 1043532 - DNA, 24 bp, Homo sapiens
tcctgagaaaaaaggttccgcttg

SEQ ID NO: 1043533 - DNA, 18 bp, Homo sapiens
tcctgagaaagcccacct

SEQ ID NO: 1043534 - DNA, 20 bp, Homo sapiens
tcctgagaaagcccacctgg

SEQ ID NO: 1043535 - DNA, 15 bp, Homo sapiens
tcctgagaaagctca

SEQ ID NO: 1043536 - DNA, 16 bp, Homo sapiens
tcctgagaaagctcaa

SEQ ID NO: 1043537 - DNA, 13 bp, Homo sapiens
tcctgagcccaac

SEQ ID NO: 1043538 - DNA, 20 bp, Homo sapiens
tcctgagcccaaccaggccc

SEQ ID NO: 1043539 - DNA, 22 bp, Homo sapiens
tcctgagcccaaccaggccctg

SEQ ID NO: 1043540 - DNA, 19 bp, Homo sapiens
tcctgagcctgtgggtccc

SEQ ID NO: 1043541 - DNA, 14 bp, Homo sapiens
tcctgagctgctgt

SEQ ID NO: 1043542 - DNA, 16 bp, Homo sapiens
tcctgagctggcctgt

SEQ ID NO: 1043543 - DNA, 15 bp, Homo sapiens
tcctgagcttggcca

SEQ ID NO: 1043544 - DNA, 16 bp, Homo sapiens
tcctgagcttggccag

SEQ ID NO: 1043545 - DNA, 15 bp, Homo sapiens
tcctgaggccagtgg

SEQ ID NO: 1043546 - DNA, 19 bp, Homo sapiens
tcctgaggccagtggcccc

SEQ ID NO: 1043547 - DNA, 16 bp, Homo sapiens
tcctgaggctttggat

SEQ ID NO: 1043548 - DNA, 23 bp, Homo sapiens
tcctgagggaggacctggggcac

SEQ ID NO: 1043549 - DNA, 24 bp, Homo sapiens
tcctgagggctaattctgggaagg

SEQ ID NO: 1043550 - DNA, 19 bp, Homo sapiens
tcctgaggggcatctgccc

SEQ ID NO: 1043551 - DNA, 21 bp, Homo sapiens
tcctgaggggcatctgcccct

SEQ ID NO: 1043552 - DNA, 19 bp, Homo sapiens
tcctgagggtccccacctg

SEQ ID NO: 1043553 - DNA, 20 bp, Homo sapiens
tcctgagtagctgggcctgt

SEQ ID NO: 1043554 - DNA, 22 bp, Homo sapiens
tcctgagtagctgggcctgtgc

SEQ ID NO: 1043555 - DNA, 15 bp, Homo sapiens
tcctgataaagcaca

SEQ ID NO: 1043556 - DNA, 18 bp, Homo sapiens
tcctgataaagcacagct

SEQ ID NO: 1043557 - DNA, 21 bp, Homo sapiens
tcctgataaagcacagctgta

SEQ ID NO: 1043558 - DNA, 22 bp, Homo sapiens
tcctgatcccagacccattcct

SEQ ID NO: 1043559 - DNA, 20 bp, Homo sapiens
tcctgatccctccaccccca

SEQ ID NO: 1043560 - DNA, 14 bp, Homo sapiens
tcctgatctgtgat

SEQ ID NO: 1043561 - DNA, 14 bp, Homo sapiens
tcctgatcttccca

SEQ ID NO: 1043562 - DNA, 19 bp, Homo sapiens
tcctgatgaccaatgggat

SEQ ID NO: 1043563 - DNA, 21 bp, Homo sapiens
tcctgatgccctcttctcctt

SEQ ID NO: 1043564 - DNA, 19 bp, Homo sapiens
tcctgatggacctgccccg

SEQ ID NO: 1043565 - DNA, 22 bp, Homo sapiens
tcctgatggagtgtgcagacag

SEQ ID NO: 1043566 - DNA, 17 bp, Homo sapiens
tcctgatggccaagagc

SEQ ID NO: 1043567 - DNA, 18 bp, Homo sapiens
tcctgatggtcagctccc

SEQ ID NO: 1043568 - DNA, 19 bp, Homo sapiens
tcctgatggtcagctccct

SEQ ID NO: 1043569 - DNA, 22 bp, Homo sapiens
tcctgatggtgtcattctgcct

SEQ ID NO: 1043570 - DNA, 24 bp, Homo sapiens
tcctgatggtgtcattctgcctgc

SEQ ID NO: 1043571 - DNA, 23 bp, Homo sapiens
tcctgattaaatgtctgacacat

SEQ ID NO: 1043572 - DNA, 13 bp, Homo sapiens
tcctgattttgta

SEQ ID NO: 1043573 - DNA, 16 bp, Homo sapiens
tcctgcaaaggccctt

SEQ ID NO: 1043574 - DNA, 12 bp, Homo sapiens
tcctgcacacag

SEQ ID NO: 1043575 - DNA, 22 bp, Homo sapiens
tcctgcacacagaatgctcagg

SEQ ID NO: 1043576 - DNA, 21 bp, Homo sapiens
tcctgcagacacctggactga

SEQ ID NO: 1043577 - DNA, 12 bp, Homo sapiens
tcctgcagcatg

SEQ ID NO: 1043578 - DNA, 17 bp, Homo sapiens
tcctgcagcatggtccc

SEQ ID NO: 1043579 - DNA, 22 bp, Homo sapiens
tcctgcagcatggtccctgcct

SEQ ID NO: 1043580 - DNA, 13 bp, Homo sapiens
tcctgcagcccca

SEQ ID NO: 1043581 - DNA, 16 bp, Homo sapiens
tcctgcagcctcctcc

SEQ ID NO: 1043582 - DNA, 17 bp, Homo sapiens
tcctgcaggaacgagca

SEQ ID NO: 1043583 - DNA, 17 bp, Homo sapiens
tcctgcaggcaggaaca

SEQ ID NO: 1043584 - DNA, 14 bp, Homo sapiens
tcctgcaggccagg

SEQ ID NO: 1043585 - DNA, 20 bp, Homo sapiens
tcctgcaggccaggccagct

SEQ ID NO: 1043586 - DNA, 17 bp, Homo sapiens
tcctgcagtcccacact

SEQ ID NO: 1043587 - DNA, 15 bp, Homo sapiens
tcctgcatggggcag

SEQ ID NO: 1043588 - DNA, 14 bp, Homo sapiens
tcctgcatttctct

SEQ ID NO: 1043589 - DNA, 15 bp, Homo sapiens
tcctgcatttctctt

SEQ ID NO: 1043590 - DNA, 11 bp, Homo sapiens
tcctgccaaaa

SEQ ID NO: 1043591 - DNA, 13 bp, Homo sapiens
tcctgccaccagc

SEQ ID NO: 1043592 - DNA, 12 bp, Homo sapiens
tcctgccacccc

SEQ ID NO: 1043593 - DNA, 10 bp, Homo sapiens
tcctgccagc

SEQ ID NO: 1043594 - DNA, 14 bp, Homo sapiens
tcctgccagctgcc

SEQ ID NO: 1043595 - DNA, 16 bp, Homo sapiens
tcctgccagctgcctt

SEQ ID NO: 1043596 - DNA, 20 bp, Homo sapiens
tcctgccagctgccttcctc

SEQ ID NO: 1043597 - DNA, 21 bp, Homo sapiens
tcctgccaggcacacacagcc

SEQ ID NO: 1043598 - DNA, 15 bp, Homo sapiens
tcctgccagggtgag

SEQ ID NO: 1043599 - DNA, 14 bp, Homo sapiens
tcctgccatcctca

SEQ ID NO: 1043600 - DNA, 23 bp, Homo sapiens
tcctgcccaaacagctgtattta

SEQ ID NO: 1043601 - DNA, 18 bp, Homo sapiens
tcctgcccaccctaccag

SEQ ID NO: 1043602 - DNA, 22 bp, Homo sapiens
tcctgcccaccctaccagctcc

SEQ ID NO: 1043603 - DNA, 11 bp, Homo sapiens
tcctgcccacg

SEQ ID NO: 1043604 - DNA, 19 bp, Homo sapiens
tcctgcccacgcagacctg

SEQ ID NO: 1043605 - DNA, 12 bp, Homo sapiens
tcctgcccagat

SEQ ID NO: 1043606 - DNA, 15 bp, Homo sapiens
tcctgcccagccacc

SEQ ID NO: 1043607 - DNA, 16 bp, Homo sapiens
tcctgcccagctcctc

SEQ ID NO: 1043608 - DNA, 12 bp, Homo sapiens
tcctgcccagga

SEQ ID NO: 1043609 - DNA, 23 bp, Homo sapiens
tcctgcccaggagagccagccct

SEQ ID NO: 1043610 - DNA, 14 bp, Homo sapiens
tcctgccccaggcc

SEQ ID NO: 1043611 - DNA, 15 bp, Homo sapiens
tcctgccccaggcct

SEQ ID NO: 1043612 - DNA, 12 bp, Homo sapiens
tcctgccccctg

SEQ ID NO: 1043613 - DNA, 16 bp, Homo sapiens
tcctgccccctgccag

SEQ ID NO: 1043614 - DNA, 21 bp, Homo sapiens
tcctgccccctgccagtgaag

SEQ ID NO: 1043615 - DNA, 15 bp, Homo sapiens
tcctgcccctctttc

SEQ ID NO: 1043616 - DNA, 16 bp, Homo sapiens
tcctgcccctctttct

SEQ ID NO: 1043617 - DNA, 19 bp, Homo sapiens
tcctgcccctctttctctt

SEQ ID NO: 1043618 - DNA, 14 bp, Homo sapiens
tcctgccctccgga

SEQ ID NO: 1043619 - DNA, 21 bp, Homo sapiens
tcctgccctccggaggagcag

SEQ ID NO: 1043620 - DNA, 17 bp, Homo sapiens
tcctgccctctgctctg

SEQ ID NO: 1043621 - DNA, 15 bp, Homo sapiens
tcctgccctgcagca

SEQ ID NO: 1043622 - DNA, 18 bp, Homo sapiens
tcctgccctgcagcacgc

SEQ ID NO: 1043623 - DNA, 12 bp, Homo sapiens
tcctgccctgcc

SEQ ID NO: 1043624 - DNA, 14 bp, Homo sapiens
tcctgccctgcccc

SEQ ID NO: 1043625 - DNA, 15 bp, Homo sapiens
tcctgcccttccctc

SEQ ID NO: 1043626 - DNA, 15 bp, Homo sapiens
tcctgcccttcctca

SEQ ID NO: 1043627 - DNA, 16 bp, Homo sapiens
tcctgcccttcctcag

SEQ ID NO: 1043628 - DNA, 16 bp, Homo sapiens
tcctgccgactcctgg

SEQ ID NO: 1043629 - DNA, 11 bp, Homo sapiens
tcctgcctact

SEQ ID NO: 1043630 - DNA, 14 bp, Homo sapiens
tcctgcctcagcct

SEQ ID NO: 1043631 - DNA, 11 bp, Homo sapiens
tcctgcctctc

SEQ ID NO: 1043632 - DNA, 22 bp, Homo sapiens
tcctgcctcttgtttctgtgcc

SEQ ID NO: 1043633 - DNA, 23 bp, Homo sapiens
tcctgccttcctcctgggccctc

SEQ ID NO: 1043634 - DNA, 16 bp, Homo sapiens
tcctgcctttaagcca

SEQ ID NO: 1043635 - DNA, 17 bp, Homo sapiens
tcctgcctttaagccaa

SEQ ID NO: 1043636 - DNA, 14 bp, Homo sapiens
tcctgcggctcagc

SEQ ID NO: 1043637 - DNA, 20 bp, Homo sapiens
tcctgcggctcagccttgca

SEQ ID NO: 1043638 - DNA, 14 bp, Homo sapiens
tcctgcgggtgggg

SEQ ID NO: 1043639 - DNA, 13 bp, Homo sapiens
tcctgcgtcctcc

SEQ ID NO: 1043640 - DNA, 15 bp, Homo sapiens
tcctgcgtcctcctc

SEQ ID NO: 1043641 - DNA, 16 bp, Homo sapiens
tcctgcgttcagcccc

SEQ ID NO: 1043642 - DNA, 17 bp, Homo sapiens
tcctgcgttcagcccct

SEQ ID NO: 1043643 - DNA, 18 bp, Homo sapiens
tcctgcgttcagcccctg

SEQ ID NO: 1043644 - DNA, 20 bp, Homo sapiens
tcctgctacaacttcagcag

SEQ ID NO: 1043645 - DNA, 19 bp, Homo sapiens
tcctgctacaagtgtttta

SEQ ID NO: 1043646 - DNA, 14 bp, Homo sapiens
tcctgctactctgt

SEQ ID NO: 1043647 - DNA, 22 bp, Homo sapiens
tcctgctagcaggccccctagg

SEQ ID NO: 1043648 - DNA, 16 bp, Homo sapiens
tcctgctagctgtaga

SEQ ID NO: 1043649 - DNA, 18 bp, Homo sapiens
tcctgctagctgtagaaa

SEQ ID NO: 1043650 - DNA, 22 bp, Homo sapiens
tcctgctagctgtagaaatgta

SEQ ID NO: 1043651 - DNA, 13 bp, Homo sapiens
tcctgctccagaa

SEQ ID NO: 1043652 - DNA, 19 bp, Homo sapiens
tcctgctccatgactggct

SEQ ID NO: 1043653 - DNA, 18 bp, Homo sapiens
tcctgctccgtggactgc

SEQ ID NO: 1043654 - DNA, 22 bp, Homo sapiens
tcctgctcctcacccctgtagg

SEQ ID NO: 1043655 - DNA, 17 bp, Homo sapiens
tcctgctcctccctgcc

SEQ ID NO: 1043656 - DNA, 20 bp, Homo sapiens
tcctgctcctccctgccccc

SEQ ID NO: 1043657 - DNA, 14 bp, Homo sapiens
tcctgctctctgct

SEQ ID NO: 1043658 - DNA, 21 bp, Homo sapiens
tcctgctctcttcaggaggcc

SEQ ID NO: 1043659 - DNA, 17 bp, Homo sapiens
tcctgctcttttgtgat

SEQ ID NO: 1043660 - DNA, 21 bp, Homo sapiens
tcctgctgaaagtcctgcttt

SEQ ID NO: 1043661 - DNA, 20 bp, Homo sapiens
tcctgctgagcctcacagca

SEQ ID NO: 1043662 - DNA, 20 bp, Homo sapiens
tcctgctgccttttctggag

SEQ ID NO: 1043663 - DNA, 15 bp, Homo sapiens
tcctgctgctcctgt

SEQ ID NO: 1043664 - DNA, 13 bp, Homo sapiens
tcctgctgctgta

SEQ ID NO: 1043665 - DNA, 15 bp, Homo sapiens
tcctgctgctgtgtt

SEQ ID NO: 1043666 - DNA, 14 bp, Homo sapiens
tcctgctgggactg

SEQ ID NO: 1043667 - DNA, 19 bp, Homo sapiens
tcctgctgggactgagaag

SEQ ID NO: 1043668 - DNA, 12 bp, Homo sapiens
tcctgctgtccc

SEQ ID NO: 1043669 - DNA, 17 bp, Homo sapiens
tcctgctgtccctgtca

SEQ ID NO: 1043670 - DNA, 23 bp, Homo sapiens
tcctgctgtccctgtcaggacac

SEQ ID NO: 1043671 - DNA, 14 bp, Homo sapiens
tcctgcttcccctc

SEQ ID NO: 1043672 - DNA, 22 bp, Homo sapiens
tcctgcttcccctccctaccct

SEQ ID NO: 1043673 - DNA, 19 bp, Homo sapiens
tcctgcttgtactaagcca

SEQ ID NO: 1043674 - DNA, 12 bp, Homo sapiens
tcctgctttcca

SEQ ID NO: 1043675 - DNA, 13 bp, Homo sapiens
tcctgcttttctg

SEQ ID NO: 1043676 - DNA, 19 bp, Homo sapiens
tcctgcttttctgtcctgg

SEQ ID NO: 1043677 - DNA, 22 bp, Homo sapiens
tcctgcttttctgtcctgggca

SEQ ID NO: 1043678 - DNA, 16 bp, Homo sapiens
tcctggaaacagcatg

SEQ ID NO: 1043679 - DNA, 18 bp, Homo sapiens
tcctggaaacagcatgaa

SEQ ID NO: 1043680 - DNA, 15 bp, Homo sapiens
tcctggaaatattaa

SEQ ID NO: 1043681 - DNA, 20 bp, Homo sapiens
tcctggaacaatattttatg

SEQ ID NO: 1043682 - DNA, 18 bp, Homo sapiens
tcctggaacctgtctcca

SEQ ID NO: 1043683 - DNA, 13 bp, Homo sapiens
tcctggaagcagg

SEQ ID NO: 1043684 - DNA, 17 bp, Homo sapiens
tcctggaagcaggtgct

SEQ ID NO: 1043685 - DNA, 18 bp, Homo sapiens
tcctggaagcaggtgcta

SEQ ID NO: 1043686 - DNA, 14 bp, Homo sapiens
tcctggaagccagc

SEQ ID NO: 1043687 - DNA, 15 bp, Homo sapiens
tcctggaaggacaca

SEQ ID NO: 1043688 - DNA, 16 bp, Homo sapiens
tcctggaaggacacag

SEQ ID NO: 1043689 - DNA, 19 bp, Homo sapiens
tcctggaaggacacagtga

SEQ ID NO: 1043690 - DNA, 23 bp, Homo sapiens
tcctggaaggacacagtgatgaa

SEQ ID NO: 1043691 - DNA, 13 bp, Homo sapiens
tcctggacacact

SEQ ID NO: 1043692 - DNA, 15 bp, Homo sapiens
tcctggacacactct

SEQ ID NO: 1043693 - DNA, 15 bp, Homo sapiens
tcctggacacctccc

SEQ ID NO: 1043694 - DNA, 18 bp, Homo sapiens
tcctggacacctcccagg

SEQ ID NO: 1043695 - DNA, 17 bp, Homo sapiens
tcctggacactcagacc

SEQ ID NO: 1043696 - DNA, 14 bp, Homo sapiens
tcctggacatcacc

SEQ ID NO: 1043697 - DNA, 15 bp, Homo sapiens
tcctggacatcacca

SEQ ID NO: 1043698 - DNA, 21 bp, Homo sapiens
tcctggacatcctcttctgct

SEQ ID NO: 1043699 - DNA, 22 bp, Homo sapiens
tcctggacatcctcttctgctt

SEQ ID NO: 1043700 - DNA, 23 bp, Homo sapiens
tcctggactccggaggactgagc

SEQ ID NO: 1043701 - DNA, 16 bp, Homo sapiens
tcctggagatagctgg

SEQ ID NO: 1043702 - DNA, 19 bp, Homo sapiens
tcctggagatagctggggc

SEQ ID NO: 1043703 - DNA, 20 bp, Homo sapiens
tcctggagcagaaagtgcct

SEQ ID NO: 1043704 - DNA, 15 bp, Homo sapiens
tcctggagctctgtg

SEQ ID NO: 1043705 - DNA, 18 bp, Homo sapiens
tcctggagctctgtgggt

SEQ ID NO: 1043706 - DNA, 22 bp, Homo sapiens
tcctggaggcaggggctgctgc

SEQ ID NO: 1043707 - DNA, 19 bp, Homo sapiens
tcctggaggctggggatgg

SEQ ID NO: 1043708 - DNA, 15 bp, Homo sapiens
tcctggagtgccctg

SEQ ID NO: 1043709 - DNA, 20 bp, Homo sapiens
tcctggagtgccctgcaggc

SEQ ID NO: 1043710 - DNA, 22 bp, Homo sapiens
tcctggatgatactaataaact

SEQ ID NO: 1043711 - DNA, 17 bp, Homo sapiens
tcctggatgtttggaaa

SEQ ID NO: 1043712 - DNA, 19 bp, Homo sapiens
tccctgaaacactgcttct

SEQ ID NO: 1043713 - DNA, 20 bp, Homo sapiens
tccctgaaacactgcttctc

SEQ ID NO: 1043714 - DNA, 24 bp, Homo sapiens
tccctgaacccctggccagctctg

SEQ ID NO: 1043715 - DNA, 19 bp, Homo sapiens
tccctgaagagacaggcac

SEQ ID NO: 1043716 - DNA, 14 bp, Homo sapiens
tccctgacccgtct

SEQ ID NO: 1043717 - DNA, 16 bp, Homo sapiens
tccctgaccctgtata

SEQ ID NO: 1043718 - DNA, 17 bp, Homo sapiens
tccctgacctccctcta

SEQ ID NO: 1043719 - DNA, 16 bp, Homo sapiens
tccctgactcattctg

SEQ ID NO: 1043720 - DNA, 19 bp, Homo sapiens
tccctgactcattctgaag

SEQ ID NO: 1043721 - DNA, 20 bp, Homo sapiens
tcccttggggaagggtgggg

SEQ ID NO: 1043722 - DNA, 18 bp, Homo sapiens
tcccttgtattttgttaa

SEQ ID NO: 1043723 - DNA, 23 bp, Homo sapiens
tcccttgtattttgttaaagctg

SEQ ID NO: 1043724 - DNA, 22 bp, Homo sapiens
tcccttgtggcttgggacatgg

SEQ ID NO: 1043725 - DNA, 14 bp, Homo sapiens
tcccttgttctcta

SEQ ID NO: 1043726 - DNA, 18 bp, Homo sapiens
tcccttgttctctaagtt

SEQ ID NO: 1043727 - DNA, 18 bp, Homo sapiens
tccctttaaaattaaaaa

SEQ ID NO: 1043728 - DNA, 13 bp, Homo sapiens
tccctttaaagag

SEQ ID NO: 1043729 - DNA, 16 bp, Homo sapiens
tccctttaaagccttt

SEQ ID NO: 1043730 - DNA, 21 bp, Homo sapiens
tccctttcacaaaattttatt

SEQ ID NO: 1043731 - DNA, 15 bp, Homo sapiens
tccctttcccttctt

SEQ ID NO: 1043732 - DNA, 14 bp, Homo sapiens
tccctttccttcca

SEQ ID NO: 1043733 - DNA, 17 bp, Homo sapiens
tccctttccttccatcc

SEQ ID NO: 1043734 - DNA, 21 bp, Homo sapiens
tccctttctctctcctctctg

SEQ ID NO: 1043735 - DNA, 22 bp, Homo sapiens
tccctttctctctcctctctgc

SEQ ID NO: 1043736 - DNA, 15 bp, Homo sapiens
tccctttctgggagg

SEQ ID NO: 1043737 - DNA, 21 bp, Homo sapiens
tccctttcttggccagttatc

SEQ ID NO: 1043738 - DNA, 13 bp, Homo sapiens
tccctttgacttc

SEQ ID NO: 1043739 - DNA, 18 bp, Homo sapiens
tccctttgcacctgagac

SEQ ID NO: 1043740 - DNA, 17 bp, Homo sapiens
tccctttgcccagaaag

SEQ ID NO: 1043741 - DNA, 12 bp, Homo sapiens
tccctttgcctt

SEQ ID NO: 1043742 - DNA, 13 bp, Homo sapiens
tccctttgcctta

SEQ ID NO: 1043743 - DNA, 18 bp, Homo sapiens
tccctttgccttaaacct

SEQ ID NO: 1043744 - DNA, 13 bp, Homo sapiens
tcccttttacata

SEQ ID NO: 1043745 - DNA, 17 bp, Homo sapiens
tcccttttacatactgc

SEQ ID NO: 1043746 - DNA, 20 bp, Homo sapiens
tcccttttacatactgctgt

SEQ ID NO: 1043747 - DNA, 20 bp, Homo sapiens
tcccttttacattctgtgtg

SEQ ID NO: 1043748 - DNA, 20 bp, Homo sapiens
tcccttttcaccttttcagg

SEQ ID NO: 1043749 - DNA, 15 bp, Homo sapiens
tcccttttcctttct

SEQ ID NO: 1043750 - DNA, 14 bp, Homo sapiens
tcccttttctgttc

SEQ ID NO: 1043751 - DNA, 20 bp, Homo sapiens
tcccttttgcataagattaa

SEQ ID NO: 1043752 - DNA, 18 bp, Homo sapiens
tccctttttaaaaaatac

SEQ ID NO: 1043753 - DNA, 19 bp, Homo sapiens
tccctttttaaaaaatacc

SEQ ID NO: 1043754 - DNA, 15 bp, Homo sapiens
tccctttttatgtgg

SEQ ID NO: 1043755 - DNA, 15 bp, Homo sapiens
tccctttttgaagtg

SEQ ID NO: 1043756 - DNA, 16 bp, Homo sapiens
tccctttttgaagtgt

SEQ ID NO: 1043757 - DNA, 23 bp, Homo sapiens
tccgaaaaatcctcttcctctga

SEQ ID NO: 1043758 - DNA, 18 bp, Homo sapiens
tccgaaaccaaagaagaa

SEQ ID NO: 1043759 - DNA, 19 bp, Homo sapiens
tccgaaaccaaagaagaaa

SEQ ID NO: 1043760 - DNA, 20 bp, Homo sapiens
tccgaaagaagacacagaac

SEQ ID NO: 1043761 - DNA, 15 bp, Homo sapiens
tccgaagaaaagaat

SEQ ID NO: 1043762 - DNA, 16 bp, Homo sapiens
tccgaagaaaagaatt

SEQ ID NO: 1043763 - DNA, 22 bp, Homo sapiens
tccgaaggtgtctctggtcttc

SEQ ID NO: 1043764 - DNA, 22 bp, Homo sapiens
tccgacaaccgatgctccagcc

SEQ ID NO: 1043765 - DNA, 17 bp, Homo sapiens
tccgaccctctgggaac

SEQ ID NO: 1043766 - DNA, 21 bp, Homo sapiens
tccgaccctctgggaacctcc

SEQ ID NO: 1043767 - DNA, 20 bp, Homo sapiens
tccgacctacgttcctggcc

SEQ ID NO: 1043768 - DNA, 15 bp, Homo sapiens
tccgacctccatgat

SEQ ID NO: 1043769 - DNA, 14 bp, Homo sapiens
tccgacctctctcg

SEQ ID NO: 1043770 - DNA, 20 bp, Homo sapiens
tccgacctctctcggccccc

SEQ ID NO: 1043771 - DNA, 15 bp, Homo sapiens
tccgactgctttgga

SEQ ID NO: 1043772 - DNA, 18 bp, Homo sapiens
tccgacttcccctgggca

SEQ ID NO: 1043773 - DNA, 20 bp, Homo sapiens
tccgagacaccacaaggcag

SEQ ID NO: 1043774 - DNA, 17 bp, Homo sapiens
tccgagaggcagccaga

SEQ ID NO: 1043775 - DNA, 14 bp, Homo sapiens
tccgagagggagag

SEQ ID NO: 1043776 - DNA, 15 bp, Homo sapiens
tccgagcattccagt

SEQ ID NO: 1043777 - DNA, 23 bp, Homo sapiens
tccgagcttgggataaagcaagg

SEQ ID NO: 1043778 - DNA, 16 bp, Homo sapiens
tccgaggactggactg

SEQ ID NO: 1043779 - DNA, 14 bp, Homo sapiens
tccgaggctccccg

SEQ ID NO: 1043780 - DNA, 19 bp, Homo sapiens
tccgaggctccccgcctcc

SEQ ID NO: 1043781 - DNA, 16 bp, Homo sapiens
tccgagggcggccagg

SEQ ID NO: 1043782 - DNA, 18 bp, Homo sapiens
tccgagggcggccaggga

SEQ ID NO: 1043783 - DNA, 19 bp, Homo sapiens
tccgagggcggccagggac

SEQ ID NO: 1043784 - DNA, 12 bp, Homo sapiens
tccgagtggtga

SEQ ID NO: 1043785 - DNA, 14 bp, Homo sapiens
tccgatccttcctc

SEQ ID NO: 1043786 - DNA, 15 bp, Homo sapiens
tccgatgaattctta

SEQ ID NO: 1043787 - DNA, 20 bp, Homo sapiens
tccgcaagagtaaaggaaat

SEQ ID NO: 1043788 - DNA, 23 bp, Homo sapiens
tccgcaatgtggagcagcagcca

SEQ ID NO: 1043789 - DNA, 15 bp, Homo sapiens
tccgcaccagctgct

SEQ ID NO: 1043790 - DNA, 21 bp, Homo sapiens
tccgcagactgcttggccaga

SEQ ID NO: 1043791 - DNA, 18 bp, Homo sapiens
tccgcaggtgctggtccc

SEQ ID NO: 1043792 - DNA, 15 bp, Homo sapiens
tccgcatcacctcac

SEQ ID NO: 1043793 - DNA, 19 bp, Homo sapiens
tccgccagaccccgtggct

SEQ ID NO: 1043794 - DNA, 14 bp, Homo sapiens
tccgccagcctcct

SEQ ID NO: 1043795 - DNA, 17 bp, Homo sapiens
tccgccatccagggtct

SEQ ID NO: 1043796 - DNA, 22 bp, Homo sapiens
tccgccatccagggtctggcag

SEQ ID NO: 1043797 - DNA, 23 bp, Homo sapiens
tccgccatccagggtctggcaga

SEQ ID NO: 1043798 - DNA, 20 bp, Homo sapiens
tccgccatggtgtcccggta

SEQ ID NO: 1043799 - DNA, 21 bp, Homo sapiens
tccgcccacaggaagcctgca

SEQ ID NO: 1043800 - DNA, 13 bp, Homo sapiens
tccgcccccagcc

SEQ ID NO: 1043801 - DNA, 15 bp, Homo sapiens
tccgcccccagccta

SEQ ID NO: 1043802 - DNA, 18 bp, Homo sapiens
tccgcccccgccccacag

SEQ ID NO: 1043803 - DNA, 14 bp, Homo sapiens
tccgcccctgcctg

SEQ ID NO: 1043804 - DNA, 15 bp, Homo sapiens
tccgcccctgcctgc

SEQ ID NO: 1043805 - DNA, 19 bp, Homo sapiens
tccgcccctgcctgccatg

SEQ ID NO: 1043806 - DNA, 13 bp, Homo sapiens
tccgccctgccac

SEQ ID NO: 1043807 - DNA, 17 bp, Homo sapiens
tccgccctgctcctccc

SEQ ID NO: 1043808 - DNA, 22 bp, Homo sapiens
tccgccctgctcctccctggct

SEQ ID NO: 1043809 - DNA, 18 bp, Homo sapiens
tccgcctacctcagcctc

SEQ ID NO: 1043810 - DNA, 15 bp, Homo sapiens
tccgcctgcgcctcc

SEQ ID NO: 1043811 - DNA, 16 bp, Homo sapiens
tccgcctggcctggcc

SEQ ID NO: 1043812 - DNA, 17 bp, Homo sapiens
tccgcctgtgtccatct

SEQ ID NO: 1043813 - DNA, 19 bp, Homo sapiens
tccgcgccctccgacctct

SEQ ID NO: 1043814 - DNA, 18 bp, Homo sapiens
tccgcgccgatgccaccg

SEQ ID NO: 1043815 - DNA, 20 bp, Homo sapiens
tccgcgcggagacctcctga

SEQ ID NO: 1043816 - DNA, 17 bp, Homo sapiens
tccgcgggagacccctt

SEQ ID NO: 1043817 - DNA, 22 bp, Homo sapiens
tccggctgctcctccagccctt

SEQ ID NO: 1043818 - DNA, 21 bp, Homo sapiens
tccgggagctggtgacagcct

SEQ ID NO: 1043819 - DNA, 13 bp, Homo sapiens
tccgggaggcaga

SEQ ID NO: 1043820 - DNA, 18 bp, Homo sapiens
tccgggcaaatgccaggg

SEQ ID NO: 1043821 - DNA, 17 bp, Homo sapiens
tccgggcaggggagcca

SEQ ID NO: 1043822 - DNA, 16 bp, Homo sapiens
tccggggagcgcccgc

SEQ ID NO: 1043823 - DNA, 19 bp, Homo sapiens
tccgggtctcgcagcctga

SEQ ID NO: 1043824 - DNA, 23 bp, Homo sapiens
tccgggtctcgcagcctgaagcc

SEQ ID NO: 1043825 - DNA, 20 bp, Homo sapiens
tccgggtgtggcctcagccc

SEQ ID NO: 1043826 - DNA, 15 bp, Homo sapiens
tccggtccccacaga

SEQ ID NO: 1043827 - DNA, 17 bp, Homo sapiens
tccggtccctgtcccag

SEQ ID NO: 1043828 - DNA, 18 bp, Homo sapiens
tccggtggcctattccag

SEQ ID NO: 1043829 - DNA, 18 bp, Homo sapiens
tccggtgtgcctgcagcc

SEQ ID NO: 1043830 - DNA, 18 bp, Homo sapiens
tccggtttctttttgctc

SEQ ID NO: 1043831 - DNA, 20 bp, Homo sapiens
tccgtactcggcttcctgtg

SEQ ID NO: 1043832 - DNA, 21 bp, Homo sapiens
tccgtactcggcttcctgtgg

SEQ ID NO: 1043833 - DNA, 20 bp, Homo sapiens
tccgtatctccctggagaag

SEQ ID NO: 1043834 - DNA, 16 bp, Homo sapiens
tccgtatttaaagttg

SEQ ID NO: 1043835 - DNA, 14 bp, Homo sapiens
tccgtcaccctggg

SEQ ID NO: 1043836 - DNA, 16 bp, Homo sapiens
tccgtcatccatgccc

SEQ ID NO: 1043837 - DNA, 14 bp, Homo sapiens
tccgtccacccagg

SEQ ID NO: 1043838 - DNA, 20 bp, Homo sapiens
tccgtccacccaggctgcac

SEQ ID NO: 1043839 - DNA, 21 bp, Homo sapiens
tccgtccacccttccatcagc

SEQ ID NO: 1043840 - DNA, 17 bp, Homo sapiens
tccgtcctgtcactgat

SEQ ID NO: 1043841 - DNA, 16 bp, Homo sapiens
tccgtctgtctcgatg

SEQ ID NO: 1043842 - DNA, 14 bp, Homo sapiens
tccgtctgtgtggg

SEQ ID NO: 1043843 - DNA, 21 bp, Homo sapiens
tccgtgctgacagctgctcct

SEQ ID NO: 1043844 - DNA, 14 bp, Homo sapiens
tccgtggaacattc

SEQ ID NO: 1043845 - DNA, 20 bp, Homo sapiens
tccgtggaacattctggatc

SEQ ID NO: 1043846 - DNA, 16 bp, Homo sapiens
tccgtggttgccctag

SEQ ID NO: 1043847 - DNA, 18 bp, Homo sapiens
tccgtgtgcctggggttc

SEQ ID NO: 1043848 - DNA, 14 bp, Homo sapiens
tccgtgtggagcac

SEQ ID NO: 1043849 - DNA, 17 bp, Homo sapiens
tccgtgtgtcccagatg

SEQ ID NO: 1043850 - DNA, 19 bp, Homo sapiens
tccgttaacctttttgtaa

SEQ ID NO: 1043851 - DNA, 17 bp, Homo sapiens
tccgttagctcctgtgg

SEQ ID NO: 1043852 - DNA, 17 bp, Homo sapiens
tcctaaaacacctggta

SEQ ID NO: 1043853 - DNA, 18 bp, Homo sapiens
tcctaaaacttggatgga

SEQ ID NO: 1043854 - DNA, 21 bp, Homo sapiens
tcctaaaacttggatggactt

SEQ ID NO: 1043855 - DNA, 22 bp, Homo sapiens
tcctaaaattatggaaacagat

SEQ ID NO: 1043856 - DNA, 10 bp, Homo sapiens
tcctaaactc

SEQ ID NO: 1043857 - DNA, 23 bp, Homo sapiens
tcctaaagaaaaatatcttggcc

SEQ ID NO: 1043858 - DNA, 19 bp, Homo sapiens
tcctaaatattttcaagaa

SEQ ID NO: 1043859 - DNA, 21 bp, Homo sapiens
tcctaaatattttcaagaaaa

SEQ ID NO: 1043860 - DNA, 22 bp, Homo sapiens
tcctaaatattttcaagaaaag

SEQ ID NO: 1043861 - DNA, 17 bp, Homo sapiens
tcctaaatgtcagctgt

SEQ ID NO: 1043862 - DNA, 14 bp, Homo sapiens
tcctaacaggatga

SEQ ID NO: 1043863 - DNA, 12 bp, Homo sapiens
tcctaactagaa

SEQ ID NO: 1043864 - DNA, 19 bp, Homo sapiens
tcctaactagaattagtat

SEQ ID NO: 1043865 - DNA, 15 bp, Homo sapiens
tcctaacttccttta

SEQ ID NO: 1043866 - DNA, 16 bp, Homo sapiens
tcctaagaccttttct

SEQ ID NO: 1043867 - DNA, 16 bp, Homo sapiens
tcctaagagtgctggg

SEQ ID NO: 1043868 - DNA, 23 bp, Homo sapiens
tcctaagatgtgttcttattttt

SEQ ID NO: 1043869 - DNA, 13 bp, Homo sapiens
tcctaagcctgtt

SEQ ID NO: 1043870 - DNA, 18 bp, Homo sapiens
tcctaagctattcagtaa

SEQ ID NO: 1043871 - DNA, 21 bp, Homo sapiens
tcctaagctattcagtaataa

SEQ ID NO: 1043872 - DNA, 20 bp, Homo sapiens
tcctaaggagttaaatcttc

SEQ ID NO: 1043873 - DNA, 12 bp, Homo sapiens
tcctaaggcatg

SEQ ID NO: 1043874 - DNA, 19 bp, Homo sapiens
tcctaaggctccccacccc

SEQ ID NO: 1043875 - DNA, 19 bp, Homo sapiens
tcctaagtcccttcctatt

SEQ ID NO: 1043876 - DNA, 19 bp, Homo sapiens
tcctaataatatcccactg

SEQ ID NO: 1043877 - DNA, 14 bp, Homo sapiens
tcctaatatcaaat

SEQ ID NO: 1043878 - DNA, 19 bp, Homo sapiens
tcctaatgtgatcatatga

SEQ ID NO: 1043879 - DNA, 23 bp, Homo sapiens
tcctaattcacacaaagactcct

SEQ ID NO: 1043880 - DNA, 16 bp, Homo sapiens
tcctaattccacagct

SEQ ID NO: 1043881 - DNA, 18 bp, Homo sapiens
tcctaattccacagctgc

SEQ ID NO: 1043882 - DNA, 18 bp, Homo sapiens
tcctaattcttctgtcct

SEQ ID NO: 1043883 - DNA, 16 bp, Homo sapiens
tcctaatttctcctcc

SEQ ID NO: 1043884 - DNA, 14 bp, Homo sapiens
tcctacaaagatgt

SEQ ID NO: 1043885 - DNA, 21 bp, Homo sapiens
tcctacaactaaaaataaatt

SEQ ID NO: 1043886 - DNA, 14 bp, Homo sapiens
tcctacaacttaat

SEQ ID NO: 1043887 - DNA, 18 bp, Homo sapiens
tcctacaacttaatggaa

SEQ ID NO: 1043888 - DNA, 19 bp, Homo sapiens
tcctacaacttaatggaaa

SEQ ID NO: 1043889 - DNA, 20 bp, Homo sapiens
tcctacaagagcagcctgtg

SEQ ID NO: 1043890 - DNA, 20 bp, Homo sapiens
tcctacaagatttagaaaaa

SEQ ID NO: 1043891 - DNA, 21 bp, Homo sapiens
tcctacaagatttagaaaaaa

SEQ ID NO: 1043892 - DNA, 20 bp, Homo sapiens
tcctacagcactactgggtg

SEQ ID NO: 1043893 - DNA, 16 bp, Homo sapiens
tcctaccaatgcatgc

SEQ ID NO: 1043894 - DNA, 20 bp, Homo sapiens
tcctaccagcaaacagctga

SEQ ID NO: 1043895 - DNA, 14 bp, Homo sapiens
tcctacccatcccc

SEQ ID NO: 1043896 - DNA, 12 bp, Homo sapiens
tcctacccctct

SEQ ID NO: 1043897 - DNA, 20 bp, Homo sapiens
tcctacccctcttccagctt

SEQ ID NO: 1043898 - DNA, 12 bp, Homo sapiens
tcctaccccttc

SEQ ID NO: 1043899 - DNA, 14 bp, Homo sapiens
tcctaccccttcct

SEQ ID NO: 1043900 - DNA, 17 bp, Homo sapiens
tcctaccctcccaccag

SEQ ID NO: 1043901 - DNA, 17 bp, Homo sapiens
tcctaccctccttccac

SEQ ID NO: 1043902 - DNA, 21 bp, Homo sapiens
tcctaccctcgggcccacctg

SEQ ID NO: 1043903 - DNA, 14 bp, Homo sapiens
tcctaccctggtga

SEQ ID NO: 1043904 - DNA, 13 bp, Homo sapiens
tcctacctcagcc

SEQ ID NO: 1043905 - DNA, 16 bp, Homo sapiens
tcctacctcagcctag

SEQ ID NO: 1043906 - DNA, 17 bp, Homo sapiens
tcctacctcagcctaga

SEQ ID NO: 1043907 - DNA, 17 bp, Homo sapiens
tcctacctccactctct

SEQ ID NO: 1043908 - DNA, 17 bp, Homo sapiens
tcctctgaggaagaagg

SEQ ID NO: 1043909 - DNA, 22 bp, Homo sapiens
tcctctgaggaagcagttgggg

SEQ ID NO: 1043910 - DNA, 23 bp, Homo sapiens
tcctctgaggaagcagttggggc

SEQ ID NO: 1043911 - DNA, 14 bp, Homo sapiens
tcctctgaggacag

SEQ ID NO: 1043912 - DNA, 22 bp, Homo sapiens
tcctctgatagctgtttcaaat

SEQ ID NO: 1043913 - DNA, 12 bp, Homo sapiens
tcctctgcactc

SEQ ID NO: 1043914 - DNA, 16 bp, Homo sapiens
tcctctgcactcccac

SEQ ID NO: 1043915 - DNA, 17 bp, Homo sapiens
tcctctgcagctgacct

SEQ ID NO: 1043916 - DNA, 18 bp, Homo sapiens
tcctctgcagctgacctc

SEQ ID NO: 1043917 - DNA, 13 bp, Homo sapiens
tcctctgcagtgc

SEQ ID NO: 1043918 - DNA, 15 bp, Homo sapiens
tcctctgccacctcc

SEQ ID NO: 1043919 - DNA, 15 bp, Homo sapiens
tcctctgccatgttt

SEQ ID NO: 1043920 - DNA, 19 bp, Homo sapiens
tcctctgcctacagccagg

SEQ ID NO: 1043921 - DNA, 12 bp, Homo sapiens
tcctctgcctgc

SEQ ID NO: 1043922 - DNA, 13 bp, Homo sapiens
tcctctgcctgcc

SEQ ID NO: 1043923 - DNA, 14 bp, Homo sapiens
tcctctgcctgccc

SEQ ID NO: 1043924 - DNA, 13 bp, Homo sapiens
tcctctgccttgg

SEQ ID NO: 1043925 - DNA, 20 bp, Homo sapiens
tcctctgctcaccgcccatc

SEQ ID NO: 1043926 - DNA, 12 bp, Homo sapiens
tcctctgctcca

SEQ ID NO: 1043927 - DNA, 13 bp, Homo sapiens
tcctctgctccag

SEQ ID NO: 1043928 - DNA, 15 bp, Homo sapiens
tcctctgctccagca

SEQ ID NO: 1043929 - DNA, 20 bp, Homo sapiens
tcctctgctccagcaactgc

SEQ ID NO: 1043930 - DNA, 19 bp, Homo sapiens
tcctctgcttgcctggaga

SEQ ID NO: 1043931 - DNA, 15 bp, Homo sapiens
tcctctggacggcag

SEQ ID NO: 1043932 - DNA, 18 bp, Homo sapiens
tcctctggacggcaggct

SEQ ID NO: 1043933 - DNA, 19 bp, Homo sapiens
tcctctggatggcaccaga

SEQ ID NO: 1043934 - DNA, 20 bp, Homo sapiens
tcctctggcaggcttccccc

SEQ ID NO: 1043935 - DNA, 23 bp, Homo sapiens
tcctctggctggctaactggaag

SEQ ID NO: 1043936 - DNA, 15 bp, Homo sapiens
tcctctggctttccc

SEQ ID NO: 1043937 - DNA, 15 bp, Homo sapiens
tcctctgggcctggg

SEQ ID NO: 1043938 - DNA, 20 bp, Homo sapiens
tcctctgggtttctaagcag

SEQ ID NO: 1043939 - DNA, 24 bp, Homo sapiens
tcctctggtaaacattcctccagc

SEQ ID NO: 1043940 - DNA, 15 bp, Homo sapiens
tcctctggttccttt

SEQ ID NO: 1043941 - DNA, 22 bp, Homo sapiens
tcctctggttcctttcatctct

SEQ ID NO: 1043942 - DNA, 19 bp, Homo sapiens
tcctctgtagtatttttta

SEQ ID NO: 1043943 - DNA, 22 bp, Homo sapiens
tcctctgtcagtcacagccacc

SEQ ID NO: 1043944 - DNA, 14 bp, Homo sapiens
tcctctgtccaggg

SEQ ID NO: 1043945 - DNA, 16 bp, Homo sapiens
tcctctgtccagggcc

SEQ ID NO: 1043946 - DNA, 19 bp, Homo sapiens
tcctctgtgaccaatgtct

SEQ ID NO: 1043947 - DNA, 20 bp, Homo sapiens
tcctctgtgaccaatgtctt

SEQ ID NO: 1043948 - DNA, 13 bp, Homo sapiens
tcctctgttcaca

SEQ ID NO: 1043949 - DNA, 22 bp, Homo sapiens
tcctctgtttctccttctgaaa

SEQ ID NO: 1043950 - DNA, 20 bp, Homo sapiens
tcctcttaaaaaataaaaac

SEQ ID NO: 1043951 - DNA, 20 bp, Homo sapiens
tcctcttaccgtagcctccg

SEQ ID NO: 1043952 - DNA, 11 bp, Homo sapiens
tcctcttcaga

SEQ ID NO: 1043953 - DNA, 18 bp, Homo sapiens
tcctcttccctctctgca

SEQ ID NO: 1043954 - DNA, 20 bp, Homo sapiens
tcctcttcccttagcctctc

SEQ ID NO: 1043955 - DNA, 18 bp, Homo sapiens
tcctcttccgagctgctt

SEQ ID NO: 1043956 - DNA, 15 bp, Homo sapiens
tcccattgccctggt

SEQ ID NO: 1043957 - DNA, 17 bp, Homo sapiens
tcccatttatctaaata

SEQ ID NO: 1043958 - DNA, 13 bp, Homo sapiens
tcccatttcagct

SEQ ID NO: 1043959 - DNA, 14 bp, Homo sapiens
tcccatttcaggaa

SEQ ID NO: 1043960 - DNA, 16 bp, Homo sapiens
tcccatttcaggaatt

SEQ ID NO: 1043961 - DNA, 14 bp, Homo sapiens
tcccatttcctgat

SEQ ID NO: 1043962 - DNA, 17 bp, Homo sapiens
tcccatttcctgatcta

SEQ ID NO: 1043963 - DNA, 23 bp, Homo sapiens
tcccatttctacctaagtcagct

SEQ ID NO: 1043964 - DNA, 15 bp, Homo sapiens
tcccatttcttgcta

SEQ ID NO: 1043965 - DNA, 16 bp, Homo sapiens
tcccatttgtgccaga

SEQ ID NO: 1043966 - DNA, 17 bp, Homo sapiens
tcccatttgtgccagag

SEQ ID NO: 1043967 - DNA, 19 bp, Homo sapiens
tcccatttgtgccagagga

SEQ ID NO: 1043968 - DNA, 21 bp, Homo sapiens
tcccattttgcaaaatttcca

SEQ ID NO: 1043969 - DNA, 19 bp, Homo sapiens
tcccattttggaagttttc

SEQ ID NO: 1043970 - DNA, 17 bp, Homo sapiens
tccccaggggtcccagc

SEQ ID NO: 1043971 - DNA, 23 bp, Homo sapiens
tccccaggggtcccagccacccc

SEQ ID NO: 1043972 - DNA, 15 bp, Homo sapiens
tccccaggtccagct

SEQ ID NO: 1043973 - DNA, 17 bp, Homo sapiens
tccccaggtccagctct

SEQ ID NO: 1043974 - DNA, 17 bp, Homo sapiens
tccccagtccccagccc

SEQ ID NO: 1043975 - DNA, 18 bp, Homo sapiens
tccccagtccccagccct

SEQ ID NO: 1043976 - DNA, 19 bp, Homo sapiens
tccccagtccccagccctg

SEQ ID NO: 1043977 - DNA, 22 bp, Homo sapiens
tccccagtctctcttaaagttg

SEQ ID NO: 1043978 - DNA, 17 bp, Homo sapiens
tccccagtgcctgccac

SEQ ID NO: 1043979 - DNA, 17 bp, Homo sapiens
tccctcagcccccagga

SEQ ID NO: 1043980 - DNA, 16 bp, Homo sapiens
tccctcagcctcccct

SEQ ID NO: 1043981 - DNA, 17 bp, Homo sapiens
tccctcagcggaggggt

SEQ ID NO: 1043982 - DNA, 14 bp, Homo sapiens
tccctcagggagcg

SEQ ID NO: 1043983 - DNA, 16 bp, Homo sapiens
tccctgactctctgtg

SEQ ID NO: 1043984 - DNA, 17 bp, Homo sapiens
tccctgactctctgtga

SEQ ID NO: 1043985 - DNA, 18 bp, Homo sapiens
tccctgactctctgtgac

SEQ ID NO: 1043986 - DNA, 20 bp, Homo sapiens
tccctgactctctgtgacct

SEQ ID NO: 1043987 - DNA, 14 bp, Homo sapiens
tccctgactggcca

SEQ ID NO: 1043988 - DNA, 15 bp, Homo sapiens
tccctgacttctccc

SEQ ID NO: 1043989 - DNA, 16 bp, Homo sapiens
tccctgacttctcccc

SEQ ID NO: 1043990 - DNA, 17 bp, Homo sapiens
tccctgacttctccccc

SEQ ID NO: 1043991 - DNA, 14 bp, Homo sapiens
tccctgacttgctt

SEQ ID NO: 1043992 - DNA, 15 bp, Homo sapiens
tccctgacttgcttt

SEQ ID NO: 1043993 - DNA, 16 bp, Homo sapiens
tccctgagcaggaaag

SEQ ID NO: 1043994 - DNA, 20 bp, Homo sapiens
tccctgaggactgatttcag

SEQ ID NO: 1043995 - DNA, 14 bp, Homo sapiens
tccctgaggatggg

SEQ ID NO: 1043996 - DNA, 15 bp, Homo sapiens
tccctgaggatgggt

SEQ ID NO: 1043997 - DNA, 22 bp, Homo sapiens
tccctgaggatgggtcagagct

SEQ ID NO: 1043998 - DNA, 14 bp, Homo sapiens
tccctgagtcacca

SEQ ID NO: 1043999 - DNA, 16 bp, Homo sapiens
tccctgagtcaccagg

SEQ ID NO: 1044000 - DNA, 14 bp, Homo sapiens
tccctgagtctgga

SEQ ID NO: 1044001 - DNA, 15 bp, Homo sapiens
tccctgagtctggac

SEQ ID NO: 1044002 - DNA, 16 bp, Homo sapiens
tccctgatcccacccc

SEQ ID NO: 1044003 - DNA, 19 bp, Homo sapiens
tccctgatggaccctcagt

SEQ ID NO: 1044004 - DNA, 22 bp, Homo sapiens
tccctgattctctctccatttg

SEQ ID NO: 1044005 - DNA, 17 bp, Homo sapiens
tccctgcacagtgactt

SEQ ID NO: 1044006 - DNA, 22 bp, Homo sapiens
tccctgcacagtgacttctgag

SEQ ID NO: 1044007 - DNA, 13 bp, Homo sapiens
tccctgcaccctg

SEQ ID NO: 1044008 - DNA, 17 bp, Homo sapiens
tccctgcaccctggaaa

SEQ ID NO: 1044009 - DNA, 11 bp, Homo sapiens
tccctgcaccg

SEQ ID NO: 1044010 - DNA, 20 bp, Homo sapiens
tccctgcactaaagccagcc

SEQ ID NO: 1044011 - DNA, 21 bp, Homo sapiens
tccctgcactaaagccagcct

SEQ ID NO: 1044012 - DNA, 20 bp, Homo sapiens
tccctgcactccctcctgga

SEQ ID NO: 1044013 - DNA, 15 bp, Homo sapiens
tccctgcactgtgcc

SEQ ID NO: 1044014 - DNA, 20 bp, Homo sapiens
tccctgcagaagccagaagg

SEQ ID NO: 1044015 - DNA, 15 bp, Homo sapiens
tccctgcagacctca

SEQ ID NO: 1044016 - DNA, 16 bp, Homo sapiens
tccctgcagatgccac

SEQ ID NO: 1044017 - DNA, 22 bp, Homo sapiens
tccctgcagggcgcccctggga

SEQ ID NO: 1044018 - DNA, 13 bp, Homo sapiens
tccctgcaggggc

SEQ ID NO: 1044019 - DNA, 17 bp, Homo sapiens
tccctgcatcctgaggc

SEQ ID NO: 1044020 - DNA, 22 bp, Homo sapiens
tccctgcatctgaccagcagcg

SEQ ID NO: 1044021 - DNA, 17 bp, Homo sapiens
tccctgcatttctgagt

SEQ ID NO: 1044022 - DNA, 20 bp, Homo sapiens
tccctgccaatgctccagct

SEQ ID NO: 1044023 - DNA, 18 bp, Homo sapiens
tccctgccacatccagct

SEQ ID NO: 1044024 - DNA, 14 bp, Homo sapiens
tccctgccactggg

SEQ ID NO: 1044025 - DNA, 21 bp, Homo sapiens
tccctgccactgggctctgga

SEQ ID NO: 1044026 - DNA, 23 bp, Homo sapiens
tccctgccatccccctctcacgc

SEQ ID NO: 1044027 - DNA, 16 bp, Homo sapiens
tccctgccatttttta

SEQ ID NO: 1044028 - DNA, 11 bp, Homo sapiens
tccctgcccaa

SEQ ID NO: 1044029 - DNA, 16 bp, Homo sapiens
tccctgcccaaaccct

SEQ ID NO: 1044030 - DNA, 20 bp, Homo sapiens
tccctgcccaaactcccctt

SEQ ID NO: 1044031 - DNA, 23 bp, Homo sapiens
tccctgcccaaactccccttccc

SEQ ID NO: 1044032 - DNA, 13 bp, Homo sapiens
tccctgcccatcc

SEQ ID NO: 1044033 - DNA, 14 bp, Homo sapiens
tccctgcccatccg

SEQ ID NO: 1044034 - DNA, 13 bp, Homo sapiens
tccctgcccccca

SEQ ID NO: 1044035 - DNA, 16 bp, Homo sapiens
tccctgccccccagcc

SEQ ID NO: 1044036 - DNA, 19 bp, Homo sapiens
tccctgccccgccccccag

SEQ ID NO: 1044037 - DNA, 21 bp, Homo sapiens
tccctgccccgccccccagag

SEQ ID NO: 1044038 - DNA, 23 bp, Homo sapiens
tccctgccccgccccccagagcc

SEQ ID NO: 1044039 - DNA, 14 bp, Homo sapiens
tccctgcccctccc

SEQ ID NO: 1044040 - DNA, 19 bp, Homo sapiens
tccctgcccctcccttcaa

SEQ ID NO: 1044041 - DNA, 12 bp, Homo sapiens
tccctgcccctg

SEQ ID NO: 1044042 - DNA, 13 bp, Homo sapiens
tccctgcccctgt

SEQ ID NO: 1044043 - DNA, 15 bp, Homo sapiens
tccctgcccctgtcc

SEQ ID NO: 1044044 - DNA, 16 bp, Homo sapiens
tccctgccctcccctg

SEQ ID NO: 1044045 - DNA, 17 bp, Homo sapiens
tccctgcctctcatcaa

SEQ ID NO: 1044046 - DNA, 12 bp, Homo sapiens
tccctgcctggc

SEQ ID NO: 1044047 - DNA, 15 bp, Homo sapiens
tccctgcctggcccc

SEQ ID NO: 1044048 - DNA, 19 bp, Homo sapiens
tccctgcgagacgcacaca

SEQ ID NO: 1044049 - DNA, 16 bp, Homo sapiens
tccctgcgcctgtgat

SEQ ID NO: 1044050 - DNA, 17 bp, Homo sapiens
tccctgcgcctgtgatg

SEQ ID NO: 1044051 - DNA, 16 bp, Homo sapiens
tccctgcgcttcatct

SEQ ID NO: 1044052 - DNA, 14 bp, Homo sapiens
tccctgctcctcat

SEQ ID NO: 1044053 - DNA, 17 bp, Homo sapiens
tccctgctcctcatggg

SEQ ID NO: 1044054 - DNA, 23 bp, Homo sapiens
tccctgctctggtcccctctctt

SEQ ID NO: 1044055 - DNA, 22 bp, Homo sapiens
tccctgctcttgcagttgctct

SEQ ID NO: 1044056 - DNA, 17 bp, Homo sapiens
tccctgctgctgccagg

SEQ ID NO: 1044057 - DNA, 14 bp, Homo sapiens
tccctgctgtgcca

SEQ ID NO: 1044058 - DNA, 21 bp, Homo sapiens
tccctgctgtgccatgctggg

SEQ ID NO: 1044059 - DNA, 14 bp, Homo sapiens
tccctgcttccagg

SEQ ID NO: 1044060 - DNA, 20 bp, Homo sapiens
tccctgcttgcacacttccc

SEQ ID NO: 1044061 - DNA, 20 bp, Homo sapiens
tccctgcttgcccgctccca

SEQ ID NO: 1044062 - DNA, 18 bp, Homo sapiens
tccctggaaggacatcca

SEQ ID NO: 1044063 - DNA, 15 bp, Homo sapiens
tccctggacaggcag

SEQ ID NO: 1044064 - DNA, 15 bp, Homo sapiens
tccctggagaagcac

SEQ ID NO: 1044065 - DNA, 16 bp, Homo sapiens
tccctggagcaggagc

SEQ ID NO: 1044066 - DNA, 18 bp, Homo sapiens
tccctggagcaggagccc

SEQ ID NO: 1044067 - DNA, 19 bp, Homo sapiens
tccctggagcaggagcccc

SEQ ID NO: 1044068 - DNA, 23 bp, Homo sapiens
tccctggagcaggagccccgcca

SEQ ID NO: 1044069 - DNA, 22 bp, Homo sapiens
tccctggagccagactctggtc

SEQ ID NO: 1044070 - DNA, 12 bp, Homo sapiens
tccctggagccc

SEQ ID NO: 1044071 - DNA, 17 bp, Homo sapiens
tccctggagccctgttg

SEQ ID NO: 1044072 - DNA, 21 bp, Homo sapiens
tccctggagcctccactgcct

SEQ ID NO: 1044073 - DNA, 14 bp, Homo sapiens
tccctggagtcagg

SEQ ID NO: 1044074 - DNA, 21 bp, Homo sapiens
tccctggatgtgtggggcatg

SEQ ID NO: 1044075 - DNA, 22 bp, Homo sapiens
tccctggatgtgtggggcatgg

SEQ ID NO: 1044076 - DNA, 14 bp, Homo sapiens
tccctggcctgttc

SEQ ID NO: 1044077 - DNA, 14 bp, Homo sapiens
tccctggccttgcc

SEQ ID NO: 1044078 - DNA, 17 bp, Homo sapiens
tccctggctccctcctc

SEQ ID NO: 1044079 - DNA, 16 bp, Homo sapiens
tccctggctcctccgt

SEQ ID NO: 1044080 - DNA, 19 bp, Homo sapiens
tccctggctctcagaaggt

SEQ ID NO: 1044081 - DNA, 19 bp, Homo sapiens
tccctggctgccctggccc

SEQ ID NO: 1044082 - DNA, 22 bp, Homo sapiens
tccctggctgccctggccctga

SEQ ID NO: 1044083 - DNA, 11 bp, Homo sapiens
tccctggcttg

SEQ ID NO: 1044084 - DNA, 18 bp, Homo sapiens
tccctggcttgtaactcc

SEQ ID NO: 1044085 - DNA, 19 bp, Homo sapiens
tccctggcttgtaactcca

SEQ ID NO: 1044086 - DNA, 19 bp, Homo sapiens
tccctgggacacagaccca

SEQ ID NO: 1044087 - DNA, 17 bp, Homo sapiens
tccctgggatctggtgg

SEQ ID NO: 1044088 - DNA, 16 bp, Homo sapiens
tccctgggcagaaagt

SEQ ID NO: 1044089 - DNA, 12 bp, Homo sapiens
tccctgggcatt

SEQ ID NO: 1044090 - DNA, 17 bp, Homo sapiens
tccctgggcattgcttt

SEQ ID NO: 1044091 - DNA, 18 bp, Homo sapiens
tccctgggcattgctttc

SEQ ID NO: 1044092 - DNA, 16 bp, Homo sapiens
tccctgggccaacaga

SEQ ID NO: 1044093 - DNA, 20 bp, Homo sapiens
tccctgggccacctcctacc

SEQ ID NO: 1044094 - DNA, 21 bp, Homo sapiens
tccctgggccacctcctaccc

SEQ ID NO: 1044095 - DNA, 16 bp, Homo sapiens
tccctgggccagggtc

SEQ ID NO: 1044096 - DNA, 24 bp, Homo sapiens
tccctgggccagggtctgtgtgaa

SEQ ID NO: 1044097 - DNA, 22 bp, Homo sapiens
tccctgggcctcaacaaggatc

SEQ ID NO: 1044098 - DNA, 15 bp, Homo sapiens
tccctgggctgtgct

SEQ ID NO: 1044099 - DNA, 19 bp, Homo sapiens
tccctggggagccctcagg

SEQ ID NO: 1044100 - DNA, 21 bp, Homo sapiens
tccctggggagccctcaggct

SEQ ID NO: 1044101 - DNA, 18 bp, Homo sapiens
tccctgggggaagccctg

SEQ ID NO: 1044102 - DNA, 19 bp, Homo sapiens
tccctgggggaagccctgg

SEQ ID NO: 1044103 - DNA, 17 bp, Homo sapiens
tccctgggggccttggg

SEQ ID NO: 1044104 - DNA, 17 bp, Homo sapiens
tccctggggttctctac

SEQ ID NO: 1044105 - DNA, 19 bp, Homo sapiens
tccctggggttctctacag

SEQ ID NO: 1044106 - DNA, 11 bp, Homo sapiens
tccctggtcac

SEQ ID NO: 1044107 - DNA, 21 bp, Homo sapiens
tccctggtcaccaaggcagtg

SEQ ID NO: 1044108 - DNA, 22 bp, Homo sapiens
tccctggtcccctcccccatcc

SEQ ID NO: 1044109 - DNA, 13 bp, Homo sapiens
tccctggtccctt

SEQ ID NO: 1044110 - DNA, 16 bp, Homo sapiens
tccctggtgcctctgt

SEQ ID NO: 1044111 - DNA, 16 bp, Homo sapiens
tccctggttgcctctc

SEQ ID NO: 1044112 - DNA, 18 bp, Homo sapiens
tccctgtaacctcttcag

SEQ ID NO: 1044113 - DNA, 15 bp, Homo sapiens
tccctgtagctcagt

SEQ ID NO: 1044114 - DNA, 21 bp, Homo sapiens
tccctgtagttgacaattctg

SEQ ID NO: 1044115 - DNA, 13 bp, Homo sapiens
tccctgtcacaca

SEQ ID NO: 1044116 - DNA, 15 bp, Homo sapiens
tccctgtcacacact

SEQ ID NO: 1044117 - DNA, 17 bp, Homo sapiens
tccctgtcacacactgg

SEQ ID NO: 1044118 - DNA, 14 bp, Homo sapiens
tccctgtcaccaag

SEQ ID NO: 1044119 - DNA, 14 bp, Homo sapiens
tccctgtcccaggg

SEQ ID NO: 1044120 - DNA, 19 bp, Homo sapiens
tccctgtccccaggcccag

SEQ ID NO: 1044121 - DNA, 16 bp, Homo sapiens
tccctgtcccccagca

SEQ ID NO: 1044122 - DNA, 14 bp, Homo sapiens
tccctgtccccctc

SEQ ID NO: 1044123 - DNA, 17 bp, Homo sapiens
tccctgtccctgccccg

SEQ ID NO: 1044124 - DNA, 15 bp, Homo sapiens
tccctgtccttccct

SEQ ID NO: 1044125 - DNA, 21 bp, Homo sapiens
tccctgtccttccctgttctc

SEQ ID NO: 1044126 - DNA, 15 bp, Homo sapiens
tccctgtctccagct

SEQ ID NO: 1044127 - DNA, 16 bp, Homo sapiens
tccctgtctccagctg

SEQ ID NO: 1044128 - DNA, 21 bp, Homo sapiens
tccctgtctccagctgcctgg

SEQ ID NO: 1044129 - DNA, 23 bp, Homo sapiens
tccctgtctccagctgcctgggc

SEQ ID NO: 1044130 - DNA, 17 bp, Homo sapiens
tccctgtgcccccagcc

SEQ ID NO: 1044131 - DNA, 21 bp, Homo sapiens
tccctgtgcccccagcctcag

SEQ ID NO: 1044132 - DNA, 11 bp, Homo sapiens
tccctgtgggg

SEQ ID NO: 1044133 - DNA, 15 bp, Homo sapiens
tccctgtggggcagg

SEQ ID NO: 1044134 - DNA, 20 bp, Homo sapiens
tccctgtggggcaggagtgc

SEQ ID NO: 1044135 - DNA, 16 bp, Homo sapiens
tccctgtgggggtggc

SEQ ID NO: 1044136 - DNA, 20 bp, Homo sapiens
tccctgtgggggtggccatc

SEQ ID NO: 1044137 - DNA, 21 bp, Homo sapiens
tccctgtgggggtggccatcc

SEQ ID NO: 1044138 - DNA, 23 bp, Homo sapiens
tccctgtgtggatgctgagctgt

SEQ ID NO: 1044139 - DNA, 16 bp, Homo sapiens
tccctgtgttctgggc

SEQ ID NO: 1044140 - DNA, 22 bp, Homo sapiens
tccctgtgttctgggctggggc

SEQ ID NO: 1044141 - DNA, 22 bp, Homo sapiens
tccctgtgttgtcccatctgcc

SEQ ID NO: 1044142 - DNA, 17 bp, Homo sapiens
tccctgtgttgtctcta

SEQ ID NO: 1044143 - DNA, 17 bp, Homo sapiens
tccctgttagaaatgtt

SEQ ID NO: 1044144 - DNA, 23 bp, Homo sapiens
tccctgttagaaatgttagtgcc

SEQ ID NO: 1044145 - DNA, 16 bp, Homo sapiens
tccctgttctcccttt

SEQ ID NO: 1044146 - DNA, 17 bp, Homo sapiens
tccctgttcttcctcca

SEQ ID NO: 1044147 - DNA, 18 bp, Homo sapiens
tccctgttcttcctccag

SEQ ID NO: 1044148 - DNA, 18 bp, Homo sapiens
tccctgttggtcggtggg

SEQ ID NO: 1044149 - DNA, 15 bp, Homo sapiens
tccctgtttaatatt

SEQ ID NO: 1044150 - DNA, 18 bp, Homo sapiens
tccctgtttaatatttaa

SEQ ID NO: 1044151 - DNA, 22 bp, Homo sapiens
tcccttaaacaaaaattaaaat

SEQ ID NO: 1044152 - DNA, 19 bp, Homo sapiens
tcccttaaatacagataat

SEQ ID NO: 1044153 - DNA, 20 bp, Homo sapiens
tcccttaacagttgtattta

SEQ ID NO: 1044154 - DNA, 17 bp, Homo sapiens
tcccttaacttttcctt

SEQ ID NO: 1044155 - DNA, 13 bp, Homo sapiens
tcccttaataaaa

SEQ ID NO: 1044156 - DNA, 22 bp, Homo sapiens
tcccttaatattgaggctgcag

SEQ ID NO: 1044157 - DNA, 17 bp, Homo sapiens
tcccttagcctctccca

SEQ ID NO: 1044158 - DNA, 21 bp, Homo sapiens
tcccttcaagagtcctgaaga

SEQ ID NO: 1044159 - DNA, 17 bp, Homo sapiens
tcccttcaaggcctccc

SEQ ID NO: 1044160 - DNA, 22 bp, Homo sapiens
tcccttcagggattccctgtcc

SEQ ID NO: 1044161 - DNA, 16 bp, Homo sapiens
tcccttcagtaccctc

SEQ ID NO: 1044162 - DNA, 18 bp, Homo sapiens
tcccttcagtaccctctc

SEQ ID NO: 1044163 - DNA, 13 bp, Homo sapiens
tcccttcatctcc

SEQ ID NO: 1044164 - DNA, 14 bp, Homo sapiens
tcccttcatttaaa

SEQ ID NO: 1044165 - DNA, 22 bp, Homo sapiens
tcccttccaggaatgctgggcc

SEQ ID NO: 1044166 - DNA, 23 bp, Homo sapiens
tcccttccaggaatgctgggccc

SEQ ID NO: 1044167 - DNA, 13 bp, Homo sapiens
tcccttcccacct

SEQ ID NO: 1044168 - DNA, 15 bp, Homo sapiens
tcccttcccagtggg

SEQ ID NO: 1044169 - DNA, 17 bp, Homo sapiens
tcccttcccccataagc

SEQ ID NO: 1044170 - DNA, 21 bp, Homo sapiens
tcccttcccctccctggctcc

SEQ ID NO: 1044171 - DNA, 22 bp, Homo sapiens
tcccttccccttcaccgctccc

SEQ ID NO: 1044172 - DNA, 14 bp, Homo sapiens
tcccttcccgaccc

SEQ ID NO: 1044173 - DNA, 23 bp, Homo sapiens
tcccttcccgacccagccagctg

SEQ ID NO: 1044174 - DNA, 11 bp, Homo sapiens
tcccttccctc

SEQ ID NO: 1044175 - DNA, 16 bp, Homo sapiens
tcccttccgaccctct

SEQ ID NO: 1044176 - DNA, 20 bp, Homo sapiens
tcccttccgaccctctggga

SEQ ID NO: 1044177 - DNA, 14 bp, Homo sapiens
tcccttccgtccat

SEQ ID NO: 1044178 - DNA, 20 bp, Homo sapiens
tcccttccgtccatccccct

SEQ ID NO: 1044179 - DNA, 15 bp, Homo sapiens
tcccttcctcacccc

SEQ ID NO: 1044180 - DNA, 15 bp, Homo sapiens
tcccttcctgccact

SEQ ID NO: 1044181 - DNA, 17 bp, Homo sapiens
tcccttcctgcttcctg

SEQ ID NO: 1044182 - DNA, 12 bp, Homo sapiens
tcccttcctgga

SEQ ID NO: 1044183 - DNA, 14 bp, Homo sapiens
tcccttcctggaaa

SEQ ID NO: 1044184 - DNA, 15 bp, Homo sapiens
tcccttcctggaaac

SEQ ID NO: 1044185 - DNA, 21 bp, Homo sapiens
tcccttcctggaaacagcatg

SEQ ID NO: 1044186 - DNA, 23 bp, Homo sapiens
tcccttcctggaaacagcatgaa

SEQ ID NO: 1044187 - DNA, 11 bp, Homo sapiens
tcccttcctgt

SEQ ID NO: 1044188 - DNA, 17 bp, Homo sapiens
tcccttccttgggcaga

SEQ ID NO: 1044189 - DNA, 16 bp, Homo sapiens
tcccttcctttctccc

SEQ ID NO: 1044190 - DNA, 19 bp, Homo sapiens
tcccttccttttccctgct

SEQ ID NO: 1044191 - DNA, 22 bp, Homo sapiens
tcccttctagggttattgcatt

SEQ ID NO: 1044192 - DNA, 15 bp, Homo sapiens
tcccttctccccctt

SEQ ID NO: 1044193 - DNA, 15 bp, Homo sapiens
tcccttctccctgga

SEQ ID NO: 1044194 - DNA, 15 bp, Homo sapiens
tcccttctcctgccc

SEQ ID NO: 1044195 - DNA, 18 bp, Homo sapiens
tcccttctcgtgtttgct

SEQ ID NO: 1044196 - DNA, 19 bp, Homo sapiens
tcccttctcgtgtttgctt

SEQ ID NO: 1044197 - DNA, 20 bp, Homo sapiens
tcccttctcgtgtttgctta

SEQ ID NO: 1044198 - DNA, 15 bp, Homo sapiens
tcccttctgctactg

SEQ ID NO: 1044199 - DNA, 13 bp, Homo sapiens
tcccttctgtagt

SEQ ID NO: 1044200 - DNA, 19 bp, Homo sapiens
tcccttctgtagtttttaa

SEQ ID NO: 1044201 - DNA, 16 bp, Homo sapiens
tcccttcttgggtctg

SEQ ID NO: 1044202 - DNA, 20 bp, Homo sapiens
tcccttcttgggtctgccct

SEQ ID NO: 1044203 - DNA, 23 bp, Homo sapiens
tcccttcttgggtctgccctgcc

SEQ ID NO: 1044204 - DNA, 17 bp, Homo sapiens
tcccttctttttcttct

SEQ ID NO: 1044205 - DNA, 19 bp, Homo sapiens
tcccttgaccattggctgc

SEQ ID NO: 1044206 - DNA, 22 bp, Homo sapiens
tcccttgaccattggctgcgct

SEQ ID NO: 1044207 - DNA, 14 bp, Homo sapiens
tcccttgaccttaa

SEQ ID NO: 1044208 - DNA, 16 bp, Homo sapiens
tcccttgagacctcag

SEQ ID NO: 1044209 - DNA, 18 bp, Homo sapiens
tcccttgagacctcagcc

SEQ ID NO: 1044210 - DNA, 19 bp, Homo sapiens
tcccttgagatgagtttct

SEQ ID NO: 1044211 - DNA, 15 bp, Homo sapiens
tcccttgagggctgc

SEQ ID NO: 1044212 - DNA, 17 bp, Homo sapiens
tcccttgatggggtcca

SEQ ID NO: 1044213 - DNA, 15 bp, Homo sapiens
tcccttgcaggggtc

SEQ ID NO: 1044214 - DNA, 17 bp, Homo sapiens
tcccttgccactttgca

SEQ ID NO: 1044215 - DNA, 16 bp, Homo sapiens
tcccttgccccaggcc

SEQ ID NO: 1044216 - DNA, 17 bp, Homo sapiens
tcccttgccccaggcca

SEQ ID NO: 1044217 - DNA, 19 bp, Homo sapiens
tcccttgccccaggccagg

SEQ ID NO: 1044218 - DNA, 23 bp, Homo sapiens
tcccttgccccaggccaggtagc

SEQ ID NO: 1044219 - DNA, 21 bp, Homo sapiens
tcccttgcctttcgaggcctg

SEQ ID NO: 1044220 - DNA, 19 bp, Homo sapiens
tcccttgctggccccagcc

SEQ ID NO: 1044221 - DNA, 15 bp, Homo sapiens
tcccttgcttagcct

SEQ ID NO: 1044222 - DNA, 15 bp, Homo sapiens
tcccttgctttgttt

SEQ ID NO: 1044223 - DNA, 18 bp, Homo sapiens
tcccttgcttttccctct

SEQ ID NO: 1044224 - DNA, 22 bp, Homo sapiens
tcccttgcttttccctcttttc

SEQ ID NO: 1044225 - DNA, 19 bp, Homo sapiens
tcccttggaaacctgccct

SEQ ID NO: 1044226 - DNA, 13 bp, Homo sapiens
tcccttggaggga

SEQ ID NO: 1044227 - DNA, 14 bp, Homo sapiens
tcccttggagggag

SEQ ID NO: 1044228 - DNA, 22 bp, Homo sapiens
tcccttggatgtagtctgaggc

SEQ ID NO: 1044229 - DNA, 12 bp, Homo sapiens
tcccttggcctc

SEQ ID NO: 1044230 - DNA, 16 bp, Homo sapiens
tcccttgggaaggaca

SEQ ID NO: 1044231 - DNA, 18 bp, Homo sapiens
tcccttgggaaggacaca

SEQ ID NO: 1044232 - DNA, 16 bp, Homo sapiens
tgagacctcagccatg

SEQ ID NO: 1044233 - DNA, 17 bp, Homo sapiens
tgagacctggaaccaga

SEQ ID NO: 1044234 - DNA, 19 bp, Homo sapiens
tgagacctgggatttgaga

SEQ ID NO: 1044235 - DNA, 22 bp, Homo sapiens
tgagactaatcttattcatttt

SEQ ID NO: 1044236 - DNA, 19 bp, Homo sapiens
tgagactcaaaaaaacaaa

SEQ ID NO: 1044237 - DNA, 16 bp, Homo sapiens
tgagactccactcagg

SEQ ID NO: 1044238 - DNA, 21 bp, Homo sapiens
tgagactctagggtccagtgg

SEQ ID NO: 1044239 - DNA, 15 bp, Homo sapiens
tgagactgaaattta

SEQ ID NO: 1044240 - DNA, 21 bp, Homo sapiens
tgagactgatccctggccact

SEQ ID NO: 1044241 - DNA, 22 bp, Homo sapiens
tgagactgatccctggccactg

SEQ ID NO: 1044242 - DNA, 14 bp, Homo sapiens
tgagactgccccac

SEQ ID NO: 1044243 - DNA, 22 bp, Homo sapiens
tgagactgccccacggagacag

SEQ ID NO: 1044244 - DNA, 23 bp, Homo sapiens
tgagactgcgggatggtcctggg

SEQ ID NO: 1044245 - DNA, 21 bp, Homo sapiens
tgagactggatactgcccggg

SEQ ID NO: 1044246 - DNA, 13 bp, Homo sapiens
tgagactggcact

SEQ ID NO: 1044247 - DNA, 18 bp, Homo sapiens
tgagactgggtctcgctt

SEQ ID NO: 1044248 - DNA, 17 bp, Homo sapiens
tgagactgtcaggaagt

SEQ ID NO: 1044249 - DNA, 15 bp, Homo sapiens
tgagacttactgggt

SEQ ID NO: 1044250 - DNA, 17 bp, Homo sapiens
tgagacttgttcttggt

SEQ ID NO: 1044251 - DNA, 12 bp, Homo sapiens
tgagactttaaa

SEQ ID NO: 1044252 - DNA, 18 bp, Homo sapiens
tgagactttaaaagcatt

SEQ ID NO: 1044253 - DNA, 17 bp, Homo sapiens
tgagactttctaaatca

SEQ ID NO: 1044254 - DNA, 14 bp, Homo sapiens
tgagactttctgct

SEQ ID NO: 1044255 - DNA, 22 bp, Homo sapiens
tgagactttcttctagtgcttt

SEQ ID NO: 1044256 - DNA, 22 bp, Homo sapiens
tgagagaaatatggaacttaca

SEQ ID NO: 1044257 - DNA, 17 bp, Homo sapiens
tgagagaagccacgctg

SEQ ID NO: 1044258 - DNA, 21 bp, Homo sapiens
tgagagaatcacacaagtttg

SEQ ID NO: 1044259 - DNA, 15 bp, Homo sapiens
tgagagaatggagac

SEQ ID NO: 1044260 - DNA, 14 bp, Homo sapiens
tgagagacacgctg

SEQ ID NO: 1044261 - DNA, 17 bp, Homo sapiens
tgagagaccctggcctc

SEQ ID NO: 1044262 - DNA, 18 bp, Homo sapiens
tgagagaccctggcctca

SEQ ID NO: 1044263 - DNA, 16 bp, Homo sapiens
tgagagacctctgcct

SEQ ID NO: 1044264 - DNA, 21 bp, Homo sapiens
tgagagacgccactccctggg

SEQ ID NO: 1044265 - DNA, 20 bp, Homo sapiens
tgagagagaatagagctgcc

SEQ ID NO: 1044266 - DNA, 18 bp, Homo sapiens
tgagagagaatgaggaag

SEQ ID NO: 1044267 - DNA, 19 bp, Homo sapiens
tgagagagaatgaggaagc

SEQ ID NO: 1044268 - DNA, 14 bp, Homo sapiens
tgagagagacaaga

SEQ ID NO: 1044269 - DNA, 20 bp, Homo sapiens
tgagagaggaggcctggacc

SEQ ID NO: 1044270 - DNA, 14 bp, Homo sapiens
tgagagatgctgta

SEQ ID NO: 1044271 - DNA, 15 bp, Homo sapiens
tgagagccagcagca

SEQ ID NO: 1044272 - DNA, 12 bp, Homo sapiens
tgagagccagtg

SEQ ID NO: 1044273 - DNA, 20 bp, Homo sapiens
tgagagcccagtcattgtac

SEQ ID NO: 1044274 - DNA, 23 bp, Homo sapiens
tgagagcccattcccaccattct

SEQ ID NO: 1044275 - DNA, 19 bp, Homo sapiens
tgagagccccagctgacat

SEQ ID NO: 1044276 - DNA, 20 bp, Homo sapiens
tgagagccctgaggcctaga

SEQ ID NO: 1044277 - DNA, 22 bp, Homo sapiens
tgagagccctgctgtgggagag

SEQ ID NO: 1044278 - DNA, 16 bp, Homo sapiens
tgagagctgcatgtgt

SEQ ID NO: 1044279 - DNA, 16 bp, Homo sapiens
tgagagctgcctcctg

SEQ ID NO: 1044280 - DNA, 16 bp, Homo sapiens
tgagagctttctgcct

SEQ ID NO: 1044281 - DNA, 15 bp, Homo sapiens
tgagagctttgctta

SEQ ID NO: 1044282 - DNA, 23 bp, Homo sapiens
tgagagctttgcttataaactgg

SEQ ID NO: 1044283 - DNA, 15 bp, Homo sapiens
tgagaggatgaatgt

SEQ ID NO: 1044284 - DNA, 22 bp, Homo sapiens
tgagaggatgaatgtatgtgca

SEQ ID NO: 1044285 - DNA, 14 bp, Homo sapiens
tgagaggcaggaat

SEQ ID NO: 1044286 - DNA, 16 bp, Homo sapiens
tgagaggcaggaatgg

SEQ ID NO: 1044287 - DNA, 13 bp, Homo sapiens
tgagaggcctgga

SEQ ID NO: 1044288 - DNA, 18 bp, Homo sapiens
tgagagggcaaggaagtg

SEQ ID NO: 1044289 - DNA, 22 bp, Homo sapiens
tgagagggcatgcgcacaaggc

SEQ ID NO: 1044290 - DNA, 16 bp, Homo sapiens
tgagaggggaagcggc

SEQ ID NO: 1044291 - DNA, 14 bp, Homo sapiens
tgagaggggagggc

SEQ ID NO: 1044292 - DNA, 16 bp, Homo sapiens
tgagaggggagggctc

SEQ ID NO: 1044293 - DNA, 21 bp, Homo sapiens
tgagaggggagggctcctggg

SEQ ID NO: 1044294 - DNA, 23 bp, Homo sapiens
tgagaggggagggctcctggggc

SEQ ID NO: 1044295 - DNA, 20 bp, Homo sapiens
tgagaggggcgccttttcag

SEQ ID NO: 1044296 - DNA, 19 bp, Homo sapiens
tgagagtatcaggtctccc

SEQ ID NO: 1044297 - DNA, 14 bp, Homo sapiens
tgagagtcaaagct

SEQ ID NO: 1044298 - DNA, 16 bp, Homo sapiens
tgagagtcagctctct

SEQ ID NO: 1044299 - DNA, 15 bp, Homo sapiens
tccattctcccaggt

SEQ ID NO: 1044300 - DNA, 20 bp, Homo sapiens
tccattcttcagtgtctctg

SEQ ID NO: 1044301 - DNA, 15 bp, Homo sapiens
tccattcttcttgct

SEQ ID NO: 1044302 - DNA, 19 bp, Homo sapiens
tccattcttcttgctacac

SEQ ID NO: 1044303 - DNA, 13 bp, Homo sapiens
tccattctttcag

SEQ ID NO: 1044304 - DNA, 16 bp, Homo sapiens
tccattctttcagctg

SEQ ID NO: 1044305 - DNA, 21 bp, Homo sapiens
tccattgaagccgactctggc

SEQ ID NO: 1044306 - DNA, 22 bp, Homo sapiens
tccattggtttacctgtgaaat

SEQ ID NO: 1044307 - DNA, 22 bp, Homo sapiens
tccattgtagtggcctgtgctt

SEQ ID NO: 1044308 - DNA, 22 bp, Homo sapiens
tccattgtgtgatccagccctg

SEQ ID NO: 1044309 - DNA, 14 bp, Homo sapiens
tccattgtttgaaa

SEQ ID NO: 1044310 - DNA, 21 bp, Homo sapiens
tccattgtttgaaacaaagaa

SEQ ID NO: 1044311 - DNA, 18 bp, Homo sapiens
tccatttacagtctcttt

SEQ ID NO: 1044312 - DNA, 23 bp, Homo sapiens
tccatttacagtctctttcttcc

SEQ ID NO: 1044313 - DNA, 15 bp, Homo sapiens
tccatttattgtttg

SEQ ID NO: 1044314 - DNA, 21 bp, Homo sapiens
tccatttattgtttgaaatgt

SEQ ID NO: 1044315 - DNA, 23 bp, Homo sapiens
tccatttcatctatttctgagaa

SEQ ID NO: 1044316 - DNA, 21 bp, Homo sapiens
tccatttcccaaagtcctctg

SEQ ID NO: 1044317 - DNA, 22 bp, Homo sapiens
tccatttcccaaagtcctctgc

SEQ ID NO: 1044318 - DNA, 18 bp, Homo sapiens
tccatttcccctccttcc

SEQ ID NO: 1044319 - DNA, 22 bp, Homo sapiens
tccatttctcaatcagtgcagt

SEQ ID NO: 1044320 - DNA, 24 bp, Homo sapiens
tccatttctcaatcagtgcagtga

SEQ ID NO: 1044321 - DNA, 12 bp, Homo sapiens
tccatttctgtc

SEQ ID NO: 1044322 - DNA, 12 bp, Homo sapiens
tccatttgagaa

SEQ ID NO: 1044323 - DNA, 14 bp, Homo sapiens
tccatttgagaaaa

SEQ ID NO: 1044324 - DNA, 16 bp, Homo sapiens
tccatttgcatttgtt

SEQ ID NO: 1044325 - DNA, 16 bp, Homo sapiens
tccatttggtcctttc

SEQ ID NO: 1044326 - DNA, 23 bp, Homo sapiens
tccattttaggtgataaaatttt

SEQ ID NO: 1044327 - DNA, 17 bp, Homo sapiens
tccattttcccccacta

SEQ ID NO: 1044328 - DNA, 22 bp, Homo sapiens
tccatttttacaagttatagta

SEQ ID NO: 1044329 - DNA, 14 bp, Homo sapiens
tccatttttcctct

SEQ ID NO: 1044330 - DNA, 16 bp, Homo sapiens
tccatttttcctctgt

SEQ ID NO: 1044331 - DNA, 21 bp, Homo sapiens
tcccaaaatactgggattaca

SEQ ID NO: 1044332 - DNA, 22 bp, Homo sapiens
tcccaaaattgttttgagcttt

SEQ ID NO: 1044333 - DNA, 20 bp, Homo sapiens
tcccaccccacccccttcag

SEQ ID NO: 1044334 - DNA, 15 bp, Homo sapiens
tcccaccccacctct

SEQ ID NO: 1044335 - DNA, 17 bp, Homo sapiens
tcccaccccacctcttg

SEQ ID NO: 1044336 - DNA, 18 bp, Homo sapiens
tcccaccccacctcttgt

SEQ ID NO: 1044337 - DNA, 13 bp, Homo sapiens
tcccaccccactc

SEQ ID NO: 1044338 - DNA, 21 bp, Homo sapiens
tcccaccccagaaatcactgt

SEQ ID NO: 1044339 - DNA, 15 bp, Homo sapiens
tcccacccccaaccc

SEQ ID NO: 1044340 - DNA, 20 bp, Homo sapiens
tcccacccccacccccagct

SEQ ID NO: 1044341 - DNA, 23 bp, Homo sapiens
tcccacccccacccccagctcaa

SEQ ID NO: 1044342 - DNA, 23 bp, Homo sapiens
tcccacccccagccccgactcca

SEQ ID NO: 1044343 - DNA, 14 bp, Homo sapiens
tcccaccccctcct

SEQ ID NO: 1044344 - DNA, 19 bp, Homo sapiens
tcccaccccctcctccccc

SEQ ID NO: 1044345 - DNA, 20 bp, Homo sapiens
tcccaccccctcctccccca

SEQ ID NO: 1044346 - DNA, 17 bp, Homo sapiens
tcccacccccttctctg

SEQ ID NO: 1044347 - DNA, 21 bp, Homo sapiens
tcccaccccgccgttccctgc

SEQ ID NO: 1044348 - DNA, 17 bp, Homo sapiens
tcccaccccggcctcca

SEQ ID NO: 1044349 - DNA, 19 bp, Homo sapiens
tcccaccccggcctccact

SEQ ID NO: 1044350 - DNA, 21 bp, Homo sapiens
tcccaccccttggcccctcac

SEQ ID NO: 1044351 - DNA, 15 bp, Homo sapiens
tcccacccgatgctg

SEQ ID NO: 1044352 - DNA, 16 bp, Homo sapiens
tcccacccggccacag

SEQ ID NO: 1044353 - DNA, 19 bp, Homo sapiens
tcccacccggccacagctg

SEQ ID NO: 1044354 - DNA, 21 bp, Homo sapiens
tcccacccggccacagctgct

SEQ ID NO: 1044355 - DNA, 19 bp, Homo sapiens
tcccaccctaagggcagcc

SEQ ID NO: 1044356 - DNA, 14 bp, Homo sapiens
tcccaccctcccct

SEQ ID NO: 1044357 - DNA, 22 bp, Homo sapiens
tcccaccctgcgggccagggtc

SEQ ID NO: 1044358 - DNA, 19 bp, Homo sapiens
tcccaccgcccccacccct

SEQ ID NO: 1044359 - DNA, 22 bp, Homo sapiens
tcccaccgcccccaccccttcc

SEQ ID NO: 1044360 - DNA, 18 bp, Homo sapiens
tcccaccgggagcctccc

SEQ ID NO: 1044361 - DNA, 16 bp, Homo sapiens
tcccacctagcagcac

SEQ ID NO: 1044362 - DNA, 15 bp, Homo sapiens
tcccacctccagccc

SEQ ID NO: 1044363 - DNA, 18 bp, Homo sapiens
tcccagggagtgagcagc

SEQ ID NO: 1044364 - DNA, 22 bp, Homo sapiens
tcccagggagtgagcagctact

SEQ ID NO: 1044365 - DNA, 20 bp, Homo sapiens
tcccagggccagggccctgc

SEQ ID NO: 1044366 - DNA, 13 bp, Homo sapiens
tcccagggccctc

SEQ ID NO: 1044367 - DNA, 17 bp, Homo sapiens
tcccagggccctggatg

SEQ ID NO: 1044368 - DNA, 17 bp, Homo sapiens
tcccagggctctgcagg

SEQ ID NO: 1044369 - DNA, 23 bp, Homo sapiens
tcccagggctctgcaggccactg

SEQ ID NO: 1044370 - DNA, 13 bp, Homo sapiens
tcccagggctgca

SEQ ID NO: 1044371 - DNA, 17 bp, Homo sapiens
tcccaggggactgttcc

SEQ ID NO: 1044372 - DNA, 23 bp, Homo sapiens
tcccaggggagccagctgcttga

SEQ ID NO: 1044373 - DNA, 19 bp, Homo sapiens
tcccaggggtctccctggc

SEQ ID NO: 1044374 - DNA, 18 bp, Homo sapiens
tcccagggtcccaccccc

SEQ ID NO: 1044375 - DNA, 21 bp, Homo sapiens
tcccaggtaccagctgcgctt

SEQ ID NO: 1044376 - DNA, 15 bp, Homo sapiens
tcccaggtagctggg

SEQ ID NO: 1044377 - DNA, 17 bp, Homo sapiens
tcccagtcactcctctc

SEQ ID NO: 1044378 - DNA, 23 bp, Homo sapiens
tcccagtccatttccaaatgtgg

SEQ ID NO: 1044379 - DNA, 17 bp, Homo sapiens
tcccagtctcatctcct

SEQ ID NO: 1044380 - DNA, 19 bp, Homo sapiens
tcccagtgaactcctgcca

SEQ ID NO: 1044381 - DNA, 20 bp, Homo sapiens
tcccagtgaactcctgccag

SEQ ID NO: 1044382 - DNA, 22 bp, Homo sapiens
tcccagtgaactcctgccaggc

SEQ ID NO: 1044383 - DNA, 18 bp, Homo sapiens
tcccagtgaatccctggg

SEQ ID NO: 1044384 - DNA, 20 bp, Homo sapiens
tcccagtgacacttcagaga

SEQ ID NO: 1044385 - DNA, 22 bp, Homo sapiens
tcccagtgctcaccagccctgc

SEQ ID NO: 1044386 - DNA, 18 bp, Homo sapiens
tcccagtggcctcaaccc

SEQ ID NO: 1044387 - DNA, 19 bp, Homo sapiens
tcccagtggcctcaaccct

SEQ ID NO: 1044388 - DNA, 14 bp, Homo sapiens
tcccagtgggaggg

SEQ ID NO: 1044389 - DNA, 17 bp, Homo sapiens
tcccagtgggaggggca

SEQ ID NO: 1044390 - DNA, 23 bp, Homo sapiens
tcccagtgtgtgtttaacattca

SEQ ID NO: 1044391 - DNA, 15 bp, Homo sapiens
tcccagttcaggagt

SEQ ID NO: 1044392 - DNA, 18 bp, Homo sapiens
tcccagttctacaagcat

SEQ ID NO: 1044393 - DNA, 20 bp, Homo sapiens
tcccagttctacaagcatat

SEQ ID NO: 1044394 - DNA, 21 bp, Homo sapiens
tcccagttctacaagcatatt

SEQ ID NO: 1044395 - DNA, 20 bp, Homo sapiens
tcccataaaatgtaagaaaa

SEQ ID NO: 1044396 - DNA, 12 bp, Homo sapiens
tcccataagcta

SEQ ID NO: 1044397 - DNA, 14 bp, Homo sapiens
tcccataagctaag

SEQ ID NO: 1044398 - DNA, 17 bp, Homo sapiens
tcccatagccaggaaac

SEQ ID NO: 1044399 - DNA, 17 bp, Homo sapiens
tcccatagcccttacct

SEQ ID NO: 1044400 - DNA, 22 bp, Homo sapiens
tcccatagtggggcctgggagg

SEQ ID NO: 1044401 - DNA, 22 bp, Homo sapiens
tcccatatatttaatatgtcaa

SEQ ID NO: 1044402 - DNA, 18 bp, Homo sapiens
tcccatatcctgcctcag

SEQ ID NO: 1044403 - DNA, 14 bp, Homo sapiens
tcccatcactggag

SEQ ID NO: 1044404 - DNA, 15 bp, Homo sapiens
tcccatccagcgtct

SEQ ID NO: 1044405 - DNA, 18 bp, Homo sapiens
tcccatccagtgtctcac

SEQ ID NO: 1044406 - DNA, 14 bp, Homo sapiens
tcccatccccctgc

SEQ ID NO: 1044407 - DNA, 18 bp, Homo sapiens
tcccatccccctgccctc

SEQ ID NO: 1044408 - DNA, 19 bp, Homo sapiens
tcccatccccctgccctcg

SEQ ID NO: 1044409 - DNA, 13 bp, Homo sapiens
tcccatcccctca

SEQ ID NO: 1044410 - DNA, 15 bp, Homo sapiens
tcccatcccctcaac

SEQ ID NO: 1044411 - DNA, 15 bp, Homo sapiens
tcccatcccctggac

SEQ ID NO: 1044412 - DNA, 14 bp, Homo sapiens
tcccatcctaccct

SEQ ID NO: 1044413 - DNA, 16 bp, Homo sapiens
tcccatcctcacccag

SEQ ID NO: 1044414 - DNA, 21 bp, Homo sapiens
tcccatcctcacccagatcag

SEQ ID NO: 1044415 - DNA, 22 bp, Homo sapiens
tcccatcctgatcccagaccca

SEQ ID NO: 1044416 - DNA, 14 bp, Homo sapiens
tcccatctccaggg

SEQ ID NO: 1044417 - DNA, 12 bp, Homo sapiens
tcccatctcctt

SEQ ID NO: 1044418 - DNA, 21 bp, Homo sapiens
tcccatctccttacctctgga

SEQ ID NO: 1044419 - DNA, 14 bp, Homo sapiens
tcccatctctacaa

SEQ ID NO: 1044420 - DNA, 15 bp, Homo sapiens
tcccatctctcccac

SEQ ID NO: 1044421 - DNA, 20 bp, Homo sapiens
tcccatctctcccacttcct

SEQ ID NO: 1044422 - DNA, 23 bp, Homo sapiens
tcccatctctcccacttcctcct

SEQ ID NO: 1044423 - DNA, 16 bp, Homo sapiens
tcccatctcttccttg

SEQ ID NO: 1044424 - DNA, 13 bp, Homo sapiens
tcccatctgcacc

SEQ ID NO: 1044425 - DNA, 14 bp, Homo sapiens
tcccatctggctca

SEQ ID NO: 1044426 - DNA, 13 bp, Homo sapiens
tcccatctgggag

SEQ ID NO: 1044427 - DNA, 15 bp, Homo sapiens
tcccatctggtcatt

SEQ ID NO: 1044428 - DNA, 17 bp, Homo sapiens
tcccatctggtcatttg

SEQ ID NO: 1044429 - DNA, 16 bp, Homo sapiens
tcccatcttcactctt

SEQ ID NO: 1044430 - DNA, 14 bp, Homo sapiens
tcccatgaacacac

SEQ ID NO: 1044431 - DNA, 16 bp, Homo sapiens
tcccatgaacacactg

SEQ ID NO: 1044432 - DNA, 14 bp, Homo sapiens
tcccatgacccacc

SEQ ID NO: 1044433 - DNA, 21 bp, Homo sapiens
tcccatgacccacccctgtgc

SEQ ID NO: 1044434 - DNA, 14 bp, Homo sapiens
tcccatgactgcac

SEQ ID NO: 1044435 - DNA, 21 bp, Homo sapiens
tcccatgactgcccagctctg

SEQ ID NO: 1044436 - DNA, 19 bp, Homo sapiens
tcccatgatccctgtgttg

SEQ ID NO: 1044437 - DNA, 12 bp, Homo sapiens
tcccatgatgta

SEQ ID NO: 1044438 - DNA, 16 bp, Homo sapiens
tcccatgcaggccctt

SEQ ID NO: 1044439 - DNA, 15 bp, Homo sapiens
tcccatgcctggtcc

SEQ ID NO: 1044440 - DNA, 12 bp, Homo sapiens
tcccatgcctgt

SEQ ID NO: 1044441 - DNA, 15 bp, Homo sapiens
tcccatgcctgtctc

SEQ ID NO: 1044442 - DNA, 14 bp, Homo sapiens
tcccatggacactc

SEQ ID NO: 1044443 - DNA, 20 bp, Homo sapiens
tcccatggacactccagtgc

SEQ ID NO: 1044444 - DNA, 15 bp, Homo sapiens
tcccatggctgaagc

SEQ ID NO: 1044445 - DNA, 17 bp, Homo sapiens
tcccatggctgaagctg

SEQ ID NO: 1044446 - DNA, 20 bp, Homo sapiens
tcccatggctgaagctggag

SEQ ID NO: 1044447 - DNA, 14 bp, Homo sapiens
tcccatggggaggg

SEQ ID NO: 1044448 - DNA, 15 bp, Homo sapiens
tcccatggtggcctc

SEQ ID NO: 1044449 - DNA, 16 bp, Homo sapiens
tcccatggtgtatgtg

SEQ ID NO: 1044450 - DNA, 21 bp, Homo sapiens
tcccatggtgtatgtggtttt

SEQ ID NO: 1044451 - DNA, 15 bp, Homo sapiens
tcccatgtagccccc

SEQ ID NO: 1044452 - DNA, 22 bp, Homo sapiens
tcccatgtagccccctggcctc

SEQ ID NO: 1044453 - DNA, 18 bp, Homo sapiens
tcccatgtcacctcagct

SEQ ID NO: 1044454 - DNA, 20 bp, Homo sapiens
tcccatgtcacctcagctga

SEQ ID NO: 1044455 - DNA, 17 bp, Homo sapiens
tcccatgttgcatgcct

SEQ ID NO: 1044456 - DNA, 20 bp, Homo sapiens
tcccattaatcatttcccca

SEQ ID NO: 1044457 - DNA, 21 bp, Homo sapiens
tcccattaatcatttccccat

SEQ ID NO: 1044458 - DNA, 15 bp, Homo sapiens
tcccattcctccctc

SEQ ID NO: 1044459 - DNA, 17 bp, Homo sapiens
tcccattctagatcctg

SEQ ID NO: 1044460 - DNA, 15 bp, Homo sapiens
tcccattctgcacca

SEQ ID NO: 1044461 - DNA, 13 bp, Homo sapiens
tcccattgccctg

SEQ ID NO: 1044462 - DNA, 23 bp, Homo sapiens
tccacagtcccccacccacctcc

SEQ ID NO: 1044463 - DNA, 15 bp, Homo sapiens
tccacagtgctgctt

SEQ ID NO: 1044464 - DNA, 22 bp, Homo sapiens
tccacagtgctgcttctcttgg

SEQ ID NO: 1044465 - DNA, 19 bp, Homo sapiens
tccacagtgttcatttgaa

SEQ ID NO: 1044466 - DNA, 17 bp, Homo sapiens
tccacagtgttgtgccc

SEQ ID NO: 1044467 - DNA, 21 bp, Homo sapiens
tccacagtgttgtgccccttc

SEQ ID NO: 1044468 - DNA, 24 bp, Homo sapiens
tccacagtgttgtgccccttcact

SEQ ID NO: 1044469 - DNA, 12 bp, Homo sapiens
tccacagttgcc

SEQ ID NO: 1044470 - DNA, 14 bp, Homo sapiens
tccacagttgccac

SEQ ID NO: 1044471 - DNA, 16 bp, Homo sapiens
tccacagttgccacca

SEQ ID NO: 1044472 - DNA, 19 bp, Homo sapiens
tccacagttgccaccacct

SEQ ID NO: 1044473 - DNA, 18 bp, Homo sapiens
tccacatcccagcagccc

SEQ ID NO: 1044474 - DNA, 13 bp, Homo sapiens
tccacatcctcca

SEQ ID NO: 1044475 - DNA, 22 bp, Homo sapiens
tccacatctgcctcctctcctc

SEQ ID NO: 1044476 - DNA, 15 bp, Homo sapiens
tccacatctgcctta

SEQ ID NO: 1044477 - DNA, 13 bp, Homo sapiens
tccacatgacctc

SEQ ID NO: 1044478 - DNA, 15 bp, Homo sapiens
tccacatgacctcca

SEQ ID NO: 1044479 - DNA, 16 bp, Homo sapiens
tccacatgacctccat

SEQ ID NO: 1044480 - DNA, 14 bp, Homo sapiens
tccacatgttactg

SEQ ID NO: 1044481 - DNA, 14 bp, Homo sapiens
tccacattctactt

SEQ ID NO: 1044482 - DNA, 19 bp, Homo sapiens
tccaccaaatgtgctttga

SEQ ID NO: 1044483 - DNA, 23 bp, Homo sapiens
tccaccaaccccgcggcccagac

SEQ ID NO: 1044484 - DNA, 17 bp, Homo sapiens
tccaccacatctgccag

SEQ ID NO: 1044485 - DNA, 19 bp, Homo sapiens
tccaccaccactggccacc

SEQ ID NO: 1044486 - DNA, 14 bp, Homo sapiens
tccaccacctccct

SEQ ID NO: 1044487 - DNA, 16 bp, Homo sapiens
tccaccacctccctca

SEQ ID NO: 1044488 - DNA, 13 bp, Homo sapiens
tccaccagcagca

SEQ ID NO: 1044489 - DNA, 22 bp, Homo sapiens
tccaccagtgtgtgggggagat

SEQ ID NO: 1044490 - DNA, 13 bp, Homo sapiens
tccaccagtttat

SEQ ID NO: 1044491 - DNA, 14 bp, Homo sapiens
tccaccagtttata

SEQ ID NO: 1044492 - DNA, 16 bp, Homo sapiens
tccaccatccccaccc

SEQ ID NO: 1044493 - DNA, 15 bp, Homo sapiens
tccacccaaccctat

SEQ ID NO: 1044494 - DNA, 17 bp, Homo sapiens
tccacccaccttggcct

SEQ ID NO: 1044495 - DNA, 12 bp, Homo sapiens
tccacccactgt

SEQ ID NO: 1044496 - DNA, 12 bp, Homo sapiens
tccacccagcaa

SEQ ID NO: 1044497 - DNA, 17 bp, Homo sapiens
tccacccagcaggcaga

SEQ ID NO: 1044498 - DNA, 17 bp, Homo sapiens
tccacccagcccattct

SEQ ID NO: 1044499 - DNA, 15 bp, Homo sapiens
tccacccagcccctg

SEQ ID NO: 1044500 - DNA, 12 bp, Homo sapiens
tccacccaggct

SEQ ID NO: 1044501 - DNA, 14 bp, Homo sapiens
tccacccaggctgc

SEQ ID NO: 1044502 - DNA, 18 bp, Homo sapiens
tccacccaggctgcactg

SEQ ID NO: 1044503 - DNA, 12 bp, Homo sapiens
tccacccagtgc

SEQ ID NO: 1044504 - DNA, 14 bp, Homo sapiens
tccacccagtgctg

SEQ ID NO: 1044505 - DNA, 16 bp, Homo sapiens
tccacccagtgctgcc

SEQ ID NO: 1044506 - DNA, 20 bp, Homo sapiens
tccacccagtgctgccatgc

SEQ ID NO: 1044507 - DNA, 21 bp, Homo sapiens
tccacccagtgctgccatgcc

SEQ ID NO: 1044508 - DNA, 24 bp, Homo sapiens
tccaccccataataaccctgccag

SEQ ID NO: 1044509 - DNA, 22 bp, Homo sapiens
tccacccccgccacggccaccc

SEQ ID NO: 1044510 - DNA, 15 bp, Homo sapiens
tccaccccctccctg

SEQ ID NO: 1044511 - DNA, 21 bp, Homo sapiens
tccaccccctccctggcctgt

SEQ ID NO: 1044512 - DNA, 16 bp, Homo sapiens
tccacccgctgcccct

SEQ ID NO: 1044513 - DNA, 19 bp, Homo sapiens
tccacccgctgcccctccc

SEQ ID NO: 1044514 - DNA, 18 bp, Homo sapiens
tccacccgggggagccca

SEQ ID NO: 1044515 - DNA, 20 bp, Homo sapiens
tccacccgggggagcccagt

SEQ ID NO: 1044516 - DNA, 15 bp, Homo sapiens
ttttcgaaaatcaaa

SEQ ID NO: 1044517 - DNA, 19 bp, Homo sapiens
ttttcggccccatgtatct

SEQ ID NO: 1044518 - DNA, 17 bp, Homo sapiens
ttttcgtaccttcccac

SEQ ID NO: 1044519 - DNA, 20 bp, Homo sapiens
ttttctaaaaagctatgtat

SEQ ID NO: 1044520 - DNA, 23 bp, Homo sapiens
ttttctaaaaagctatgtatcgc

SEQ ID NO: 1044521 - DNA, 24 bp, Homo sapiens
ttttctaaaaagctatgtatcgct

SEQ ID NO: 1044522 - DNA, 16 bp, Homo sapiens
ttttctaaataaaaat

SEQ ID NO: 1044523 - DNA, 13 bp, Homo sapiens
ttttctaaccttg

SEQ ID NO: 1044524 - DNA, 13 bp, Homo sapiens
ttttctaagaaaa

SEQ ID NO: 1044525 - DNA, 14 bp, Homo sapiens
ttttctaagacagt

SEQ ID NO: 1044526 - DNA, 18 bp, Homo sapiens
ttttctaatcacagtgtt

SEQ ID NO: 1044527 - DNA, 21 bp, Homo sapiens
ttttctaatgtggttatttct

SEQ ID NO: 1044528 - DNA, 13 bp, Homo sapiens
ttttctacagtgg

SEQ ID NO: 1044529 - DNA, 13 bp, Homo sapiens
ttttctacagtta

SEQ ID NO: 1044530 - DNA, 15 bp, Homo sapiens
ttttctagaattatt

SEQ ID NO: 1044531 - DNA, 22 bp, Homo sapiens
ttttctagaattatttttcact

SEQ ID NO: 1044532 - DNA, 14 bp, Homo sapiens
ttttctagactttc

SEQ ID NO: 1044533 - DNA, 18 bp, Homo sapiens
ttttctagactttctgtt

SEQ ID NO: 1044534 - DNA, 21 bp, Homo sapiens
ttttctaggccaaaaatggtg

SEQ ID NO: 1044535 - DNA, 22 bp, Homo sapiens
ttttctatcatggaatatttat

SEQ ID NO: 1044536 - DNA, 21 bp, Homo sapiens
ttttctatgaaataatgtgaa

SEQ ID NO: 1044537 - DNA, 17 bp, Homo sapiens
ttttctatttctctgtg

SEQ ID NO: 1044538 - DNA, 20 bp, Homo sapiens
ttttctatttctctgtgtat

SEQ ID NO: 1044539 - DNA, 14 bp, Homo sapiens
ttttctcacaaaaa

SEQ ID NO: 1044540 - DNA, 17 bp, Homo sapiens
ttttctcactccttttg

SEQ ID NO: 1044541 - DNA, 17 bp, Homo sapiens
ttttctccactttgttg

SEQ ID NO: 1044542 - DNA, 20 bp, Homo sapiens
ttttctccctttatgtatct

SEQ ID NO: 1044543 - DNA, 21 bp, Homo sapiens
ttttctccctttatgtatctc

SEQ ID NO: 1044544 - DNA, 13 bp, Homo sapiens
ttttctcctccca

SEQ ID NO: 1044545 - DNA, 14 bp, Homo sapiens
ttttctcctccgcc

SEQ ID NO: 1044546 - DNA, 21 bp, Homo sapiens
ttttctcctccgcctgtgtcc

SEQ ID NO: 1044547 - DNA, 18 bp, Homo sapiens
ttttctcgtccccctccc

SEQ ID NO: 1044548 - DNA, 17 bp, Homo sapiens
ttttctctaactcagaa

SEQ ID NO: 1044549 - DNA, 11 bp, Homo sapiens
ttttctctgga

SEQ ID NO: 1044550 - DNA, 21 bp, Homo sapiens
ttttctctggtaatattgact

SEQ ID NO: 1044551 - DNA, 18 bp, Homo sapiens
ttttctctgtacttttca

SEQ ID NO: 1044552 - DNA, 22 bp, Homo sapiens
ttttctcttgggctgagactgg

SEQ ID NO: 1044553 - DNA, 13 bp, Homo sapiens
ttttctcttgtac

SEQ ID NO: 1044554 - DNA, 14 bp, Homo sapiens
ttttctctttctcc

SEQ ID NO: 1044555 - DNA, 17 bp, Homo sapiens
ttttctgaactccattt

SEQ ID NO: 1044556 - DNA, 11 bp, Homo sapiens
ttttctgaata

SEQ ID NO: 1044557 - DNA, 22 bp, Homo sapiens
ttttctgaataaaaaagattct

SEQ ID NO: 1044558 - DNA, 13 bp, Homo sapiens
ttttctgactaat

SEQ ID NO: 1044559 - DNA, 14 bp, Homo sapiens
ttttctgactagtt

SEQ ID NO: 1044560 - DNA, 22 bp, Homo sapiens
ttttctgagatgctcactttat

SEQ ID NO: 1044561 - DNA, 22 bp, Homo sapiens
ttttctgaggatagtagttaaa

SEQ ID NO: 1044562 - DNA, 11 bp, Homo sapiens
ttttctgattc

SEQ ID NO: 1044563 - DNA, 11 bp, Homo sapiens
ttttctggaaa

SEQ ID NO: 1044564 - DNA, 17 bp, Homo sapiens
ttttctggaatacatga

SEQ ID NO: 1044565 - DNA, 18 bp, Homo sapiens
ttttctggaatgtaatca

SEQ ID NO: 1044566 - DNA, 13 bp, Homo sapiens
ttttctggattct

SEQ ID NO: 1044567 - DNA, 20 bp, Homo sapiens
ttttctggccagtgtttaaa

SEQ ID NO: 1044568 - DNA, 23 bp, Homo sapiens
ttttctggggaattactttcctc

SEQ ID NO: 1044569 - DNA, 20 bp, Homo sapiens
ttttctggtagatagaaata

SEQ ID NO: 1044570 - DNA, 14 bp, Homo sapiens
ttttctgtaccagt

SEQ ID NO: 1044571 - DNA, 20 bp, Homo sapiens
ttttctgtcagatgagaaca

SEQ ID NO: 1044572 - DNA, 13 bp, Homo sapiens
ttttctgtcctgg

SEQ ID NO: 1044573 - DNA, 22 bp, Homo sapiens
ttttctgtttgtaaattatttg

SEQ ID NO: 1044574 - DNA, 16 bp, Homo sapiens
ttttcttactcctcct

SEQ ID NO: 1044575 - DNA, 16 bp, Homo sapiens
ttttcttatttatatc

SEQ ID NO: 1044576 - DNA, 13 bp, Homo sapiens
ttttcttcacagt

SEQ ID NO: 1044577 - DNA, 15 bp, Homo sapiens
ttttcttcactgtcc

SEQ ID NO: 1044578 - DNA, 16 bp, Homo sapiens
ttttcttcatgcaatg

SEQ ID NO: 1044579 - DNA, 20 bp, Homo sapiens
ttttcttcattttgttctga

SEQ ID NO: 1044580 - DNA, 18 bp, Homo sapiens
ttttcttcttccctccct

SEQ ID NO: 1044581 - DNA, 20 bp, Homo sapiens
ttttcttgccaccctctggg

SEQ ID NO: 1044582 - DNA, 17 bp, Homo sapiens
ttttcttggttctttca

SEQ ID NO: 1044583 - DNA, 11 bp, Homo sapiens
ttttcttgtat

SEQ ID NO: 1044584 - DNA, 19 bp, Homo sapiens
ttttctttaggacataaag

SEQ ID NO: 1044585 - DNA, 17 bp, Homo sapiens
ttttctttcaagaacta

SEQ ID NO: 1044586 - DNA, 12 bp, Homo sapiens
ttttctttgcaa

SEQ ID NO: 1044587 - DNA, 12 bp, Homo sapiens
ttttctttgtgt

SEQ ID NO: 1044588 - DNA, 19 bp, Homo sapiens
ttttctttgtgtagctttg

SEQ ID NO: 1044589 - DNA, 22 bp, Homo sapiens
ttttcttttgcttcctcttctt

SEQ ID NO: 1044590 - DNA, 20 bp, Homo sapiens
ttttctttttaaagtttgtt

SEQ ID NO: 1044591 - DNA, 21 bp, Homo sapiens
ttttcttttttaaattaatat

SEQ ID NO: 1044592 - DNA, 23 bp, Homo sapiens
ttttcttttttaaattaatatct

SEQ ID NO: 1044593 - DNA, 22 bp, Homo sapiens
ttttctttttttttaagttctt

SEQ ID NO: 1044594 - DNA, 14 bp, Homo sapiens
ttttgaaaaatatt

SEQ ID NO: 1044595 - DNA, 12 bp, Homo sapiens
ttttgaaaaggc

SEQ ID NO: 1044596 - DNA, 14 bp, Homo sapiens
ttttgaaaagtatt

SEQ ID NO: 1044597 - DNA, 18 bp, Homo sapiens
ttttgaaaattatgcaaa

SEQ ID NO: 1044598 - DNA, 22 bp, Homo sapiens
ttttgaaaattatgcaaaagca

SEQ ID NO: 1044599 - DNA, 13 bp, Homo sapiens
ttttgaaacaaac

SEQ ID NO: 1044600 - DNA, 19 bp, Homo sapiens
ttttgaaacaaacatggat

SEQ ID NO: 1044601 - DNA, 14 bp, Homo sapiens
ttttgaaacagcag

SEQ ID NO: 1044602 - DNA, 23 bp, Homo sapiens
ttttgaaagtcagctgaaggatg

SEQ ID NO: 1044603 - DNA, 17 bp, Homo sapiens
ttttgaaagtctgtcct

SEQ ID NO: 1044604 - DNA, 22 bp, Homo sapiens
ttttgaaatattaaaccctgga

SEQ ID NO: 1044605 - DNA, 20 bp, Homo sapiens
ttttgaaattatgtgacatt

SEQ ID NO: 1044606 - DNA, 20 bp, Homo sapiens
ttttgaagtcttccctcaga

SEQ ID NO: 1044607 - DNA, 11 bp, Homo sapiens
ttttgaagtgt

SEQ ID NO: 1044608 - DNA, 15 bp, Homo sapiens
ttttgaataaaaagt

SEQ ID NO: 1044609 - DNA, 16 bp, Homo sapiens
ttttgaataaaaagtg

SEQ ID NO: 1044610 - DNA, 21 bp, Homo sapiens
ttttgaataccattaaaactg

SEQ ID NO: 1044611 - DNA, 16 bp, Homo sapiens
ttttgaatccatgctt

SEQ ID NO: 1044612 - DNA, 15 bp, Homo sapiens
ttttgaatgtggata

SEQ ID NO: 1044613 - DNA, 22 bp, Homo sapiens
ttttgaatgtggataaaactgt

SEQ ID NO: 1044614 - DNA, 14 bp, Homo sapiens
ttttgaattgttac

SEQ ID NO: 1044615 - DNA, 19 bp, Homo sapiens
ttttgaatttaaataaagt

SEQ ID NO: 1044616 - DNA, 14 bp, Homo sapiens
ttttgacactgaaa

SEQ ID NO: 1044617 - DNA, 15 bp, Homo sapiens
ttttgacaggtgcct

SEQ ID NO: 1044618 - DNA, 15 bp, Homo sapiens
ttttgacataaagtt

SEQ ID NO: 1044619 - DNA, 19 bp, Homo sapiens
ttttgacatttacaggagg

SEQ ID NO: 1044620 - DNA, 23 bp, Homo sapiens
ttttgactaagaattttgtttta

SEQ ID NO: 1044621 - DNA, 15 bp, Homo sapiens
ttttgactcttccgt

SEQ ID NO: 1044622 - DNA, 18 bp, Homo sapiens
ttttgactgtagccacag

SEQ ID NO: 1044623 - DNA, 14 bp, Homo sapiens
ttttgacttaatgt

SEQ ID NO: 1044624 - DNA, 20 bp, Homo sapiens
ttttgaggatgggatgtatt

SEQ ID NO: 1044625 - DNA, 17 bp, Homo sapiens
ttttgaggggttcttct

SEQ ID NO: 1044626 - DNA, 21 bp, Homo sapiens
ttttgagtgtatacatgtgtg

SEQ ID NO: 1044627 - DNA, 18 bp, Homo sapiens
tgaacacaattgatactt

SEQ ID NO: 1044628 - DNA, 22 bp, Homo sapiens
tgaacacacacgccagctcctc

SEQ ID NO: 1044629 - DNA, 14 bp, Homo sapiens
tgaacacactgtgt

SEQ ID NO: 1044630 - DNA, 15 bp, Homo sapiens
tgaacacactgtgtc

SEQ ID NO: 1044631 - DNA, 13 bp, Homo sapiens
tgaacacatgtgt

SEQ ID NO: 1044632 - DNA, 19 bp, Homo sapiens
tgaacacattattaagcac

SEQ ID NO: 1044633 - DNA, 18 bp, Homo sapiens
tgaacactagtctgtgta

SEQ ID NO: 1044634 - DNA, 22 bp, Homo sapiens
tgaacactagtctgtgtaactt

SEQ ID NO: 1044635 - DNA, 16 bp, Homo sapiens
tgaacactgggggagg

SEQ ID NO: 1044636 - DNA, 14 bp, Homo sapiens
tgaacactgtgacc

SEQ ID NO: 1044637 - DNA, 14 bp, Homo sapiens
tgaacacttaaatt

SEQ ID NO: 1044638 - DNA, 17 bp, Homo sapiens
tgaacacttaaattatg

SEQ ID NO: 1044639 - DNA, 23 bp, Homo sapiens
tgaacagaaactacatttctact

SEQ ID NO: 1044640 - DNA, 22 bp, Homo sapiens
tgaacagatgaaaaggagcctg

SEQ ID NO: 1044641 - DNA, 15 bp, Homo sapiens
tgaacagctggtgcc

SEQ ID NO: 1044642 - DNA, 16 bp, Homo sapiens
tgaacagctggtgcca

SEQ ID NO: 1044643 - DNA, 14 bp, Homo sapiens
tgaacagctgtgag

SEQ ID NO: 1044644 - DNA, 23 bp, Homo sapiens
tgaacagctgtgagccatgcctc

SEQ ID NO: 1044645 - DNA, 13 bp, Homo sapiens
tgaacagctgtgt

SEQ ID NO: 1044646 - DNA, 15 bp, Homo sapiens
tgaacagcttgctgt

SEQ ID NO: 1044647 - DNA, 19 bp, Homo sapiens
tgaacaggctggggccttt

SEQ ID NO: 1044648 - DNA, 12 bp, Homo sapiens
tgaacagtggag

SEQ ID NO: 1044649 - DNA, 16 bp, Homo sapiens
tgaacatacttcaaaa

SEQ ID NO: 1044650 - DNA, 23 bp, Homo sapiens
tgaacatacttcaaaaataatgt

SEQ ID NO: 1044651 - DNA, 16 bp, Homo sapiens
tgaacatattcatgaa

SEQ ID NO: 1044652 - DNA, 16 bp, Homo sapiens
tgaacatccaagtctt

SEQ ID NO: 1044653 - DNA, 22 bp, Homo sapiens
tgaacatccccactaggttctt

SEQ ID NO: 1044654 - DNA, 18 bp, Homo sapiens
tgaacatgcctagtccaa

SEQ ID NO: 1044655 - DNA, 14 bp, Homo sapiens
tgaacatgcctgcc

SEQ ID NO: 1044656 - DNA, 18 bp, Homo sapiens
tgaacatgcctgccaaag

SEQ ID NO: 1044657 - DNA, 21 bp, Homo sapiens
tgaacatgcctgccaaagacg

SEQ ID NO: 1044658 - DNA, 21 bp, Homo sapiens
tgaacatgtgccttttctgaa

SEQ ID NO: 1044659 - DNA, 23 bp, Homo sapiens
tgaacattaaaatatagagacag

SEQ ID NO: 1044660 - DNA, 22 bp, Homo sapiens
tgaacattaatccacatgtttc

SEQ ID NO: 1044661 - DNA, 17 bp, Homo sapiens
tgaacattcccagccca

SEQ ID NO: 1044662 - DNA, 19 bp, Homo sapiens
tgaacattctcctgtggaa

SEQ ID NO: 1044663 - DNA, 12 bp, Homo sapiens
tgaacattgtac

SEQ ID NO: 1044664 - DNA, 20 bp, Homo sapiens
tgaacattgtactgttgctt

SEQ ID NO: 1044665 - DNA, 12 bp, Homo sapiens
tgaacatttcaa

SEQ ID NO: 1044666 - DNA, 17 bp, Homo sapiens
tgaacatttcttatgat

SEQ ID NO: 1044667 - DNA, 16 bp, Homo sapiens
tgaacattttgtggag

SEQ ID NO: 1044668 - DNA, 15 bp, Homo sapiens
tgaaccaatctggat

SEQ ID NO: 1044669 - DNA, 14 bp, Homo sapiens
tgaaccacaacttt

SEQ ID NO: 1044670 - DNA, 23 bp, Homo sapiens
tgaaccacaagtgaatctttctc

SEQ ID NO: 1044671 - DNA, 18 bp, Homo sapiens
tgaaccacgaggctgccc

SEQ ID NO: 1044672 - DNA, 20 bp, Homo sapiens
tgaaccacgaggctgccccc

SEQ ID NO: 1044673 - DNA, 20 bp, Homo sapiens
tgaaccacgtgaaactgctg

SEQ ID NO: 1044674 - DNA, 22 bp, Homo sapiens
tgaaccagagggtgtggctttc

SEQ ID NO: 1044675 - DNA, 12 bp, Homo sapiens
tgaaccagccac

SEQ ID NO: 1044676 - DNA, 22 bp, Homo sapiens
tgaaccagctcatctccaagga

SEQ ID NO: 1044677 - DNA, 13 bp, Homo sapiens
tgaacccaggagg

SEQ ID NO: 1044678 - DNA, 14 bp, Homo sapiens
tgaacccaggaggt

SEQ ID NO: 1044679 - DNA, 21 bp, Homo sapiens
tgaaccccatgggcttggact

SEQ ID NO: 1044680 - DNA, 22 bp, Homo sapiens
tgaaccccctttccccacacct

SEQ ID NO: 1044681 - DNA, 14 bp, Homo sapiens
tgaacccctgtgtc

SEQ ID NO: 1044682 - DNA, 15 bp, Homo sapiens
tgaaccctcctcctt

SEQ ID NO: 1044683 - DNA, 18 bp, Homo sapiens
tgaaccctcttgccatcc

SEQ ID NO: 1044684 - DNA, 15 bp, Homo sapiens
tgaaccctggggcct

SEQ ID NO: 1044685 - DNA, 14 bp, Homo sapiens
tgaaccctgtgctg

SEQ ID NO: 1044686 - DNA, 17 bp, Homo sapiens
tgaacccttgtgcttgg

SEQ ID NO: 1044687 - DNA, 21 bp, Homo sapiens
tgaaccgactgaccctgagga

SEQ ID NO: 1044688 - DNA, 22 bp, Homo sapiens
tgaaccgaggggctcaggaaaa

SEQ ID NO: 1044689 - DNA, 14 bp, Homo sapiens
tgaacctattttca

SEQ ID NO: 1044690 - DNA, 20 bp, Homo sapiens
tgaacctattttcatttgta

SEQ ID NO: 1044691 - DNA, 12 bp, Homo sapiens
tgaacctgaata

SEQ ID NO: 1044692 - DNA, 15 bp, Homo sapiens
tgaaccttgagcaaa

SEQ ID NO: 1044693 - DNA, 17 bp, Homo sapiens
tgaaccttgagcaaatt

SEQ ID NO: 1044694 - DNA, 17 bp, Homo sapiens
tgaacgaccttacaaat

SEQ ID NO: 1044695 - DNA, 21 bp, Homo sapiens
tgaacgactgtatattgctaa

SEQ ID NO: 1044696 - DNA, 14 bp, Homo sapiens
tgaacggataagaa

SEQ ID NO: 1044697 - DNA, 13 bp, Homo sapiens
tgaacggggagaa

SEQ ID NO: 1044698 - DNA, 16 bp, Homo sapiens
tgaacgtccacatgaa

SEQ ID NO: 1044699 - DNA, 19 bp, Homo sapiens
tgaacgtccttccttgact

SEQ ID NO: 1044700 - DNA, 15 bp, Homo sapiens
tgaacgttttcttct

SEQ ID NO: 1044701 - DNA, 16 bp, Homo sapiens
tgaacgttttcttctt

SEQ ID NO: 1044702 - DNA, 17 bp, Homo sapiens
tgaacgttttcttcttt

SEQ ID NO: 1044703 - DNA, 21 bp, Homo sapiens
tgaactaagttttgtgtgtat

SEQ ID NO: 1044704 - DNA, 23 bp, Homo sapiens
tgaactaagttttgtgtgtatat

SEQ ID NO: 1044705 - DNA, 16 bp, Homo sapiens
tgaactaataaaagca

SEQ ID NO: 1044706 - DNA, 18 bp, Homo sapiens
tgaactaggctgagcaat

SEQ ID NO: 1044707 - DNA, 23 bp, Homo sapiens
tgaactattccccagcagggtct

SEQ ID NO: 1044708 - DNA, 19 bp, Homo sapiens
tgaactcaccctgggagcc

SEQ ID NO: 1044709 - DNA, 18 bp, Homo sapiens
tgaactcactttcctcct

SEQ ID NO: 1044710 - DNA, 11 bp, Homo sapiens
tgaactccaga

SEQ ID NO: 1044711 - DNA, 13 bp, Homo sapiens
tgaactccagagg

SEQ ID NO: 1044712 - DNA, 20 bp, Homo sapiens
tgaactccatacagcctcta

SEQ ID NO: 1044713 - DNA, 14 bp, Homo sapiens
tgaactccatcatt

SEQ ID NO: 1044714 - DNA, 12 bp, Homo sapiens
tgaactccattt

SEQ ID NO: 1044715 - DNA, 17 bp, Homo sapiens
tgaactccttccccact

SEQ ID NO: 1044716 - DNA, 18 bp, Homo sapiens
tgaactccttccccactt

SEQ ID NO: 1044717 - DNA, 14 bp, Homo sapiens
tgaactcgcaggga

SEQ ID NO: 1044718 - DNA, 14 bp, Homo sapiens
tgaactcttaatca

SEQ ID NO: 1044719 - DNA, 15 bp, Homo sapiens
tgaactcttaatcaa

SEQ ID NO: 1044720 - DNA, 21 bp, Homo sapiens
tgaactcttaatcaaatagca

SEQ ID NO: 1044721 - DNA, 23 bp, Homo sapiens
tgaactctttctggcctgccttc

SEQ ID NO: 1044722 - DNA, 20 bp, Homo sapiens
tgaactgaaacttttctaaa

SEQ ID NO: 1044723 - DNA, 22 bp, Homo sapiens
tgaactgaaacttttctaaagt

SEQ ID NO: 1044724 - DNA, 12 bp, Homo sapiens
tgaactgaacac

SEQ ID NO: 1044725 - DNA, 13 bp, Homo sapiens
tgaactgaacacc

SEQ ID NO: 1044726 - DNA, 23 bp, Homo sapiens
tgaactgacaggcagcctggaca

SEQ ID NO: 1044727 - DNA, 13 bp, Homo sapiens
tgaactgaggccc

SEQ ID NO: 1044728 - DNA, 18 bp, Homo sapiens
tgaactgaggccctgtga

SEQ ID NO: 1044729 - DNA, 22 bp, Homo sapiens
tgaactgaggccttgtgtgtca

SEQ ID NO: 1044730 - DNA, 15 bp, Homo sapiens
tgaactgataaagat

SEQ ID NO: 1044731 - DNA, 20 bp, Homo sapiens
tgaactgatcatgtttatga

SEQ ID NO: 1044732 - DNA, 20 bp, Homo sapiens
tgaactgattcacatctcat

SEQ ID NO: 1044733 - DNA, 16 bp, Homo sapiens
tgaactgcaaagcttt

SEQ ID NO: 1044734 - DNA, 16 bp, Homo sapiens
tgaactgctttcaagt

SEQ ID NO: 1044735 - DNA, 15 bp, Homo sapiens
tgaactgcttttcct

SEQ ID NO: 1044736 - DNA, 22 bp, Homo sapiens
tgaactgggcacagattgaaga

SEQ ID NO: 1044737 - DNA, 23 bp, Homo sapiens
tgaactgggcacagattgaagaa

SEQ ID NO: 1044738 - DNA, 13 bp, Homo sapiens
tgaactggttcat

SEQ ID NO: 1044739 - DNA, 21 bp, Homo sapiens
tgaactgtattctagtggctg

SEQ ID NO: 1044740 - DNA, 22 bp, Homo sapiens
tgaactgtattctagtggctgt

SEQ ID NO: 1044741 - DNA, 12 bp, Homo sapiens
tgaactgtggaa

SEQ ID NO: 1044742 - DNA, 22 bp, Homo sapiens
tgaactgtgtgtaattgttcct

SEQ ID NO: 1044743 - DNA, 17 bp, Homo sapiens
tgaactgttagatgctg

SEQ ID NO: 1044744 - DNA, 18 bp, Homo sapiens
tgaacttaaaatgaaagt

SEQ ID NO: 1044745 - DNA, 18 bp, Homo sapiens
tgaacttaataactgtgt

SEQ ID NO: 1044746 - DNA, 20 bp, Homo sapiens
tgaacttactgtagcctcag

SEQ ID NO: 1044747 - DNA, 16 bp, Homo sapiens
tgaacttccaagctcc

SEQ ID NO: 1044748 - DNA, 15 bp, Homo sapiens
tgaacttctctcaga

SEQ ID NO: 1044749 - DNA, 17 bp, Homo sapiens
tgaacttgactgggtga

SEQ ID NO: 1044750 - DNA, 15 bp, Homo sapiens
tgaacttgagatctg

SEQ ID NO: 1044751 - DNA, 20 bp, Homo sapiens
tgaacttgagatctgtataa

SEQ ID NO: 1044752 - DNA, 18 bp, Homo sapiens
tcatgggcaccaacctgc

SEQ ID NO: 1044753 - DNA, 19 bp, Homo sapiens
tcatgggccactgcttttc

SEQ ID NO: 1044754 - DNA, 14 bp, Homo sapiens
tcatgggctgtgtg

SEQ ID NO: 1044755 - DNA, 14 bp, Homo sapiens
tcatggggagtaat

SEQ ID NO: 1044756 - DNA, 17 bp, Homo sapiens
tcatggggatcaatttt

SEQ ID NO: 1044757 - DNA, 21 bp, Homo sapiens
tcatgggtcctagcccttccc

SEQ ID NO: 1044758 - DNA, 20 bp, Homo sapiens
tcatggtaatgacagatgca

SEQ ID NO: 1044759 - DNA, 17 bp, Homo sapiens
tcatggtactaccccag

SEQ ID NO: 1044760 - DNA, 19 bp, Homo sapiens
tcatggtagatttttttca

SEQ ID NO: 1044761 - DNA, 20 bp, Homo sapiens
tcatggtagatttttttcat

SEQ ID NO: 1044762 - DNA, 14 bp, Homo sapiens
tcatggtatttgac

SEQ ID NO: 1044763 - DNA, 20 bp, Homo sapiens
tcatggtcaagttcccaact

SEQ ID NO: 1044764 - DNA, 20 bp, Homo sapiens
tcatggtgaccaccccctgt

SEQ ID NO: 1044765 - DNA, 18 bp, Homo sapiens
tcatggtttgcatttaaa

SEQ ID NO: 1044766 - DNA, 13 bp, Homo sapiens
tcatgtaaaacag

SEQ ID NO: 1044767 - DNA, 13 bp, Homo sapiens
tcatgtaaactgt

SEQ ID NO: 1044768 - DNA, 14 bp, Homo sapiens
tcatgtaaactgtg

SEQ ID NO: 1044769 - DNA, 15 bp, Homo sapiens
tcatgtaaataaata

SEQ ID NO: 1044770 - DNA, 16 bp, Homo sapiens
tcatgtaaattttgta

SEQ ID NO: 1044771 - DNA, 17 bp, Homo sapiens
tcatgtaaattttgtat

SEQ ID NO: 1044772 - DNA, 15 bp, Homo sapiens
tcatgtaacagttgt

SEQ ID NO: 1044773 - DNA, 15 bp, Homo sapiens
tcatgtaacattggt

SEQ ID NO: 1044774 - DNA, 21 bp, Homo sapiens
tcatgtaactctccagccatt

SEQ ID NO: 1044775 - DNA, 15 bp, Homo sapiens
tcatgtaatcctcaa

SEQ ID NO: 1044776 - DNA, 22 bp, Homo sapiens
tcatgtacttcctgtgtactct

SEQ ID NO: 1044777 - DNA, 16 bp, Homo sapiens
tcatgtagagaaaagc

SEQ ID NO: 1044778 - DNA, 19 bp, Homo sapiens
tcatgtagagaaaagcaca

SEQ ID NO: 1044779 - DNA, 16 bp, Homo sapiens
tcatgtatgtatataa

SEQ ID NO: 1044780 - DNA, 14 bp, Homo sapiens
tcatgtatgtttct

SEQ ID NO: 1044781 - DNA, 16 bp, Homo sapiens
tcatgtcaacttctgg

SEQ ID NO: 1044782 - DNA, 15 bp, Homo sapiens
tcatgtcaatgacca

SEQ ID NO: 1044783 - DNA, 16 bp, Homo sapiens
tcatgtcaggcctgtg

SEQ ID NO: 1044784 - DNA, 17 bp, Homo sapiens
tcatgtcaggcctgtgt

SEQ ID NO: 1044785 - DNA, 13 bp, Homo sapiens
tcatgtccccttc

SEQ ID NO: 1044786 - DNA, 14 bp, Homo sapiens
tcatgtccccttcc

SEQ ID NO: 1044787 - DNA, 17 bp, Homo sapiens
tcatgtccctccaggga

SEQ ID NO: 1044788 - DNA, 16 bp, Homo sapiens
tcatgtcgtaggtaaa

SEQ ID NO: 1044789 - DNA, 20 bp, Homo sapiens
tcatgtctattgtccaaagt

SEQ ID NO: 1044790 - DNA, 11 bp, Homo sapiens
tcatgtctgta

SEQ ID NO: 1044791 - DNA, 20 bp, Homo sapiens
tcatgtctgtatactcctgt

SEQ ID NO: 1044792 - DNA, 16 bp, Homo sapiens
tcatgtcttgtgcata

SEQ ID NO: 1044793 - DNA, 14 bp, Homo sapiens
tcatgtctttccac

SEQ ID NO: 1044794 - DNA, 17 bp, Homo sapiens
tcatgtgagaaagctaa

SEQ ID NO: 1044795 - DNA, 17 bp, Homo sapiens
tcatgtgggtgagccag

SEQ ID NO: 1044796 - DNA, 14 bp, Homo sapiens
tcatgtgtgcatgt

SEQ ID NO: 1044797 - DNA, 12 bp, Homo sapiens
tcatgtgtgtcc

SEQ ID NO: 1044798 - DNA, 16 bp, Homo sapiens
tcatgtgtgtccacga

SEQ ID NO: 1044799 - DNA, 21 bp, Homo sapiens
tcatgtgtgtccacgactgtc

SEQ ID NO: 1044800 - DNA, 15 bp, Homo sapiens
tcatgttaacctctg

SEQ ID NO: 1044801 - DNA, 14 bp, Homo sapiens
tcatgttattttat

SEQ ID NO: 1044802 - DNA, 13 bp, Homo sapiens
tcatgttcctcaa

SEQ ID NO: 1044803 - DNA, 21 bp, Homo sapiens
tcatgttctcttcccaggcct

SEQ ID NO: 1044804 - DNA, 22 bp, Homo sapiens
tcatgttctcttcccaggcctt

SEQ ID NO: 1044805 - DNA, 11 bp, Homo sapiens
tcatgttctta

SEQ ID NO: 1044806 - DNA, 13 bp, Homo sapiens
tcatgttggtcaa

SEQ ID NO: 1044807 - DNA, 19 bp, Homo sapiens
tcatgttggtttattttca

SEQ ID NO: 1044808 - DNA, 21 bp, Homo sapiens
tcatgttgttgtgtgtatatg

SEQ ID NO: 1044809 - DNA, 14 bp, Homo sapiens
tcatgtttaacgtt

SEQ ID NO: 1044810 - DNA, 15 bp, Homo sapiens
tcatgtttattttga

SEQ ID NO: 1044811 - DNA, 15 bp, Homo sapiens
tcatgtttgctctcc

SEQ ID NO: 1044812 - DNA, 14 bp, Homo sapiens
tcatgtttgcttca

SEQ ID NO: 1044813 - DNA, 16 bp, Homo sapiens
tcatgttttgatgaga

SEQ ID NO: 1044814 - DNA, 15 bp, Homo sapiens
tcatgttttgtgact

SEQ ID NO: 1044815 - DNA, 13 bp, Homo sapiens
tcattaaaaatta

SEQ ID NO: 1044816 - DNA, 16 bp, Homo sapiens
tcattaaaaattacct

SEQ ID NO: 1044817 - DNA, 19 bp, Homo sapiens
tcattaaaatatatgttct

SEQ ID NO: 1044818 - DNA, 19 bp, Homo sapiens
tcattaaactctaaagatt

SEQ ID NO: 1044819 - DNA, 15 bp, Homo sapiens
tcattaaagacagga

SEQ ID NO: 1044820 - DNA, 12 bp, Homo sapiens
tcattaaataaa

SEQ ID NO: 1044821 - DNA, 15 bp, Homo sapiens
tcattaaatggggct

SEQ ID NO: 1044822 - DNA, 14 bp, Homo sapiens
tcattaaattacct

SEQ ID NO: 1044823 - DNA, 15 bp, Homo sapiens
tcattaaattactat

SEQ ID NO: 1044824 - DNA, 19 bp, Homo sapiens
tcattaacaactcattctg

SEQ ID NO: 1044825 - DNA, 22 bp, Homo sapiens
tcattaagctttttttttttga

SEQ ID NO: 1044826 - DNA, 17 bp, Homo sapiens
tcattaatagctgcctt

SEQ ID NO: 1044827 - DNA, 22 bp, Homo sapiens
tcattaatagctgccttcaagg

SEQ ID NO: 1044828 - DNA, 21 bp, Homo sapiens
tcattactgttccagattcct

SEQ ID NO: 1044829 - DNA, 15 bp, Homo sapiens
tcattacttgggaaa

SEQ ID NO: 1044830 - DNA, 15 bp, Homo sapiens
tcattagaaatattt

SEQ ID NO: 1044831 - DNA, 15 bp, Homo sapiens
tcattagagcttaaa

SEQ ID NO: 1044832 - DNA, 18 bp, Homo sapiens
tcattaggtgtgactgaa

SEQ ID NO: 1044833 - DNA, 22 bp, Homo sapiens
tcattaggtgtgactgaatttc

SEQ ID NO: 1044834 - DNA, 15 bp, Homo sapiens
tcattaggttttgct

SEQ ID NO: 1044835 - DNA, 22 bp, Homo sapiens
tcattagtcatgtttatctgct

SEQ ID NO: 1044836 - DNA, 16 bp, Homo sapiens
tcattataatctcaaa

SEQ ID NO: 1044837 - DNA, 18 bp, Homo sapiens
tcattatgcacttttaga

SEQ ID NO: 1044838 - DNA, 23 bp, Homo sapiens
tcattatgcacttttagaaatgc

SEQ ID NO: 1044839 - DNA, 16 bp, Homo sapiens
tcattatgctttgaac

SEQ ID NO: 1044840 - DNA, 19 bp, Homo sapiens
tcattatgctttgaacttt

SEQ ID NO: 1044841 - DNA, 22 bp, Homo sapiens
tcattatgctttgaactttagt

SEQ ID NO: 1044842 - DNA, 13 bp, Homo sapiens
tcattatgtcaac

SEQ ID NO: 1044843 - DNA, 14 bp, Homo sapiens
tcattatgttcatg

SEQ ID NO: 1044844 - DNA, 21 bp, Homo sapiens
tcattatgttcatgtaagaag

SEQ ID NO: 1044845 - DNA, 22 bp, Homo sapiens
tcattattcaagaatgaaaaat

SEQ ID NO: 1044846 - DNA, 14 bp, Homo sapiens
tcattattggaatt

SEQ ID NO: 1044847 - DNA, 17 bp, Homo sapiens
tcattatttattgttaa

SEQ ID NO: 1044848 - DNA, 16 bp, Homo sapiens
tcattatttgcagaga

SEQ ID NO: 1044849 - DNA, 15 bp, Homo sapiens
tcattatttgtcaaa

SEQ ID NO: 1044850 - DNA, 22 bp, Homo sapiens
tcattcaaaagttgaaattaac

SEQ ID NO: 1044851 - DNA, 15 bp, Homo sapiens
tcattcaaatcagtg

SEQ ID NO: 1044852 - DNA, 16 bp, Homo sapiens
tcattcaaatcagtga

SEQ ID NO: 1044853 - DNA, 19 bp, Homo sapiens
tcattcaaatcagtgatct

SEQ ID NO: 1044854 - DNA, 20 bp, Homo sapiens
tcattcaaatgaactttaaa

SEQ ID NO: 1044855 - DNA, 23 bp, Homo sapiens
tcattcaactctccaatgttcta

SEQ ID NO: 1044856 - DNA, 15 bp, Homo sapiens
tcattcaagctattt

SEQ ID NO: 1044857 - DNA, 13 bp, Homo sapiens
tcattcactgtgc

SEQ ID NO: 1044858 - DNA, 15 bp, Homo sapiens
tcattcactgtgcac

SEQ ID NO: 1044859 - DNA, 14 bp, Homo sapiens
tcattcagaaaaaa

SEQ ID NO: 1044860 - DNA, 15 bp, Homo sapiens
tcattcagagactgc

SEQ ID NO: 1044861 - DNA, 21 bp, Homo sapiens
tcattcagcagcaaattttca

SEQ ID NO: 1044862 - DNA, 20 bp, Homo sapiens
tcattcagcatctactctaa

SEQ ID NO: 1044863 - DNA, 19 bp, Homo sapiens
tcattcatatttgtctttg

SEQ ID NO: 1044864 - DNA, 21 bp, Homo sapiens
tcattcatatttgtctttgaa

SEQ ID NO: 1044865 - DNA, 12 bp, Homo sapiens
tcattcatcctg

SEQ ID NO: 1044866 - DNA, 11 bp, Homo sapiens
tcattcatctt

SEQ ID NO: 1044867 - DNA, 23 bp, Homo sapiens
tcattccaattctaaatccgact

SEQ ID NO: 1044868 - DNA, 11 bp, Homo sapiens
tcattccagag

SEQ ID NO: 1044869 - DNA, 17 bp, Homo sapiens
tcattccagcagctgca

SEQ ID NO: 1044870 - DNA, 18 bp, Homo sapiens
tcattccagcagctgcac

SEQ ID NO: 1044871 - DNA, 14 bp, Homo sapiens
tcattccccaggtg

SEQ ID NO: 1044872 - DNA, 15 bp, Homo sapiens
tcattcccctgccca

SEQ ID NO: 1044873 - DNA, 20 bp, Homo sapiens
tcattccttagataccttga

SEQ ID NO: 1044874 - DNA, 20 bp, Homo sapiens
tcattccttcactcatccag

SEQ ID NO: 1044875 - DNA, 23 bp, Homo sapiens
tcattccttgagaaaaacaatga

SEQ ID NO: 1044876 - DNA, 14 bp, Homo sapiens
tcattcgcctttgt

SEQ ID NO: 1044877 - DNA, 16 bp, Homo sapiens
tcattcgcctttgtct

SEQ ID NO: 1044878 - DNA, 17 bp, Homo sapiens
tcattttagtgactgta

SEQ ID NO: 1044879 - DNA, 18 bp, Homo sapiens
tcattttatatgtcaaag

SEQ ID NO: 1044880 - DNA, 22 bp, Homo sapiens
tcattttatgaatatcattgat

SEQ ID NO: 1044881 - DNA, 15 bp, Homo sapiens
tcattttcatcactg

SEQ ID NO: 1044882 - DNA, 16 bp, Homo sapiens
tcattttcatcactgg

SEQ ID NO: 1044883 - DNA, 13 bp, Homo sapiens
tcattttcatgtg

SEQ ID NO: 1044884 - DNA, 13 bp, Homo sapiens
tcattttcctgtt

SEQ ID NO: 1044885 - DNA, 15 bp, Homo sapiens
tcattttcctgttca

SEQ ID NO: 1044886 - DNA, 16 bp, Homo sapiens
tcattttcctgttcag

SEQ ID NO: 1044887 - DNA, 21 bp, Homo sapiens
tcattttctagatacaataaa

SEQ ID NO: 1044888 - DNA, 10 bp, Homo sapiens
tcattttctc

SEQ ID NO: 1044889 - DNA, 12 bp, Homo sapiens
tcattttctcta

SEQ ID NO: 1044890 - DNA, 11 bp, Homo sapiens
tcattttgtaa

SEQ ID NO: 1044891 - DNA, 20 bp, Homo sapiens
tcattttgtaacaaatgaac

SEQ ID NO: 1044892 - DNA, 16 bp, Homo sapiens
tcattttgtaatattt

SEQ ID NO: 1044893 - DNA, 17 bp, Homo sapiens
tcatttttaaagcctgg

SEQ ID NO: 1044894 - DNA, 18 bp, Homo sapiens
tcatttttaaagcctggc

SEQ ID NO: 1044895 - DNA, 20 bp, Homo sapiens
tcatttttaaagcctggctt

SEQ ID NO: 1044896 - DNA, 22 bp, Homo sapiens
tcatttttaaagcctggcttct

SEQ ID NO: 1044897 - DNA, 15 bp, Homo sapiens
tcatttttaaatgtg

SEQ ID NO: 1044898 - DNA, 15 bp, Homo sapiens
tcatttttaacagca

SEQ ID NO: 1044899 - DNA, 11 bp, Homo sapiens
tcatttttaat

SEQ ID NO: 1044900 - DNA, 21 bp, Homo sapiens
tcatttttatagcaacaacaa

SEQ ID NO: 1044901 - DNA, 16 bp, Homo sapiens
tcatttttccaggact

SEQ ID NO: 1044902 - DNA, 21 bp, Homo sapiens
tcatttttgaaactgcatttg

SEQ ID NO: 1044903 - DNA, 14 bp, Homo sapiens
tcatttttgtataa

SEQ ID NO: 1044904 - DNA, 17 bp, Homo sapiens
tcatttttgtataaaaa

SEQ ID NO: 1044905 - DNA, 23 bp, Homo sapiens
tcatttttgtataaaaaggaaat

SEQ ID NO: 1044906 - DNA, 15 bp, Homo sapiens
tcatttttgtgcaca

SEQ ID NO: 1044907 - DNA, 17 bp, Homo sapiens
tcatttttttctctctg

SEQ ID NO: 1044908 - DNA, 17 bp, Homo sapiens
tcattttttttaattga

SEQ ID NO: 1044909 - DNA, 23 bp, Homo sapiens
tccaaaaaaaggaaaaataatca

SEQ ID NO: 1044910 - DNA, 19 bp, Homo sapiens
tccaaaaaagcaaacacaa

SEQ ID NO: 1044911 - DNA, 17 bp, Homo sapiens
tccaaaaagctctgaaa

SEQ ID NO: 1044912 - DNA, 22 bp, Homo sapiens
tccaaaaagctctgaaaacaag

SEQ ID NO: 1044913 - DNA, 15 bp, Homo sapiens
tccaaaacacaaact

SEQ ID NO: 1044914 - DNA, 14 bp, Homo sapiens
tccaaaacatttct

SEQ ID NO: 1044915 - DNA, 22 bp, Homo sapiens
tccaaaacctgcttccttcagt

SEQ ID NO: 1044916 - DNA, 13 bp, Homo sapiens
tccaaaactgcct

SEQ ID NO: 1044917 - DNA, 16 bp, Homo sapiens
tccaaaacttctcttg

SEQ ID NO: 1044918 - DNA, 16 bp, Homo sapiens
tccaaaagattgctga

SEQ ID NO: 1044919 - DNA, 20 bp, Homo sapiens
tccaaaagattgctgaaatt

SEQ ID NO: 1044920 - DNA, 16 bp, Homo sapiens
tccaaaataaaacttt

SEQ ID NO: 1044921 - DNA, 21 bp, Homo sapiens
tccaaaataatctatattaaa

SEQ ID NO: 1044922 - DNA, 22 bp, Homo sapiens
tccaaaataatctatattaaat

SEQ ID NO: 1044923 - DNA, 18 bp, Homo sapiens
tccaaaatattttttgca

SEQ ID NO: 1044924 - DNA, 18 bp, Homo sapiens
tccaaaatcttgatcagt

SEQ ID NO: 1044925 - DNA, 13 bp, Homo sapiens
tccaaaatgcttg

SEQ ID NO: 1044926 - DNA, 18 bp, Homo sapiens
tccaaacagtgtgttggt

SEQ ID NO: 1044927 - DNA, 21 bp, Homo sapiens
tccaaaccagtttattctgtg

SEQ ID NO: 1044928 - DNA, 22 bp, Homo sapiens
tccaaaccagtttattctgtgg

SEQ ID NO: 1044929 - DNA, 13 bp, Homo sapiens
tccaaacctccag

SEQ ID NO: 1044930 - DNA, 15 bp, Homo sapiens
tccaaacctccagcc

SEQ ID NO: 1044931 - DNA, 22 bp, Homo sapiens
tccaaacctccagcctccctgt

SEQ ID NO: 1044932 - DNA, 16 bp, Homo sapiens
tccaaactaattttta

SEQ ID NO: 1044933 - DNA, 19 bp, Homo sapiens
tccaaactcttccctctct

SEQ ID NO: 1044934 - DNA, 23 bp, Homo sapiens
tccaaagaaaagtattgtttgga

SEQ ID NO: 1044935 - DNA, 13 bp, Homo sapiens
tccaaagactgta

SEQ ID NO: 1044936 - DNA, 13 bp, Homo sapiens
tccaaagagaaaa

SEQ ID NO: 1044937 - DNA, 17 bp, Homo sapiens
tccaaagagccttcaga

SEQ ID NO: 1044938 - DNA, 16 bp, Homo sapiens
tccaaagaggctgccc

SEQ ID NO: 1044939 - DNA, 19 bp, Homo sapiens
tccaaagaggctgcccctc

SEQ ID NO: 1044940 - DNA, 23 bp, Homo sapiens
tccaaagagtagaattgcattga

SEQ ID NO: 1044941 - DNA, 19 bp, Homo sapiens
tccaatgtctgctgaggag

SEQ ID NO: 1044942 - DNA, 14 bp, Homo sapiens
tccaatgtcttttg

SEQ ID NO: 1044943 - DNA, 11 bp, Homo sapiens
tccaatgtgtt

SEQ ID NO: 1044944 - DNA, 14 bp, Homo sapiens
tccaatgtttcaag

SEQ ID NO: 1044945 - DNA, 15 bp, Homo sapiens
tccaatgtttcaagc

SEQ ID NO: 1044946 - DNA, 19 bp, Homo sapiens
tccaattagtttccttttt

SEQ ID NO: 1044947 - DNA, 20 bp, Homo sapiens
tccaattagtttccttttta

SEQ ID NO: 1044948 - DNA, 21 bp, Homo sapiens
tccaattcaaaaataaattag

SEQ ID NO: 1044949 - DNA, 15 bp, Homo sapiens
tccaattccccctta

SEQ ID NO: 1044950 - DNA, 13 bp, Homo sapiens
tccaattctaaat

SEQ ID NO: 1044951 - DNA, 19 bp, Homo sapiens
tccaattctgaaatacttt

SEQ ID NO: 1044952 - DNA, 16 bp, Homo sapiens
tccaattgatgtatat

SEQ ID NO: 1044953 - DNA, 17 bp, Homo sapiens
tccaattggtgcttcag

SEQ ID NO: 1044954 - DNA, 23 bp, Homo sapiens
tccaattggtgcttcagccctgg

SEQ ID NO: 1044955 - DNA, 16 bp, Homo sapiens
tccaattgttgacagt

SEQ ID NO: 1044956 - DNA, 22 bp, Homo sapiens
tccaattgttgacagttctgaa

SEQ ID NO: 1044957 - DNA, 12 bp, Homo sapiens
tccaatttaagg

SEQ ID NO: 1044958 - DNA, 13 bp, Homo sapiens
tccaatttaagga

SEQ ID NO: 1044959 - DNA, 15 bp, Homo sapiens
tccaattttaattta

SEQ ID NO: 1044960 - DNA, 23 bp, Homo sapiens
tccaattttaatttagtaaatgt

SEQ ID NO: 1044961 - DNA, 14 bp, Homo sapiens
tccaattttctgga

SEQ ID NO: 1044962 - DNA, 18 bp, Homo sapiens
tccaattttctggaatac

SEQ ID NO: 1044963 - DNA, 20 bp, Homo sapiens
tccacaaaataaccaatcct

SEQ ID NO: 1044964 - DNA, 16 bp, Homo sapiens
tccacaaaattagaaa

SEQ ID NO: 1044965 - DNA, 20 bp, Homo sapiens
tccacaaagaaaattcctat

SEQ ID NO: 1044966 - DNA, 21 bp, Homo sapiens
tccacaaagaaaattcctata

SEQ ID NO: 1044967 - DNA, 15 bp, Homo sapiens
tccacaacagcctgg

SEQ ID NO: 1044968 - DNA, 17 bp, Homo sapiens
tccacaacagcctgggg

SEQ ID NO: 1044969 - DNA, 17 bp, Homo sapiens
tccacaagattcccaga

SEQ ID NO: 1044970 - DNA, 18 bp, Homo sapiens
tccacaagattcccagag

SEQ ID NO: 1044971 - DNA, 19 bp, Homo sapiens
tccacaagattcccagaga

SEQ ID NO: 1044972 - DNA, 20 bp, Homo sapiens
tccacaagattcccagagac

SEQ ID NO: 1044973 - DNA, 19 bp, Homo sapiens
tccacaaggtccccccacc

SEQ ID NO: 1044974 - DNA, 24 bp, Homo sapiens
tccacaaggtccccccaccgctca

SEQ ID NO: 1044975 - DNA, 21 bp, Homo sapiens
tccacaagtgccgcaaattgt

SEQ ID NO: 1044976 - DNA, 17 bp, Homo sapiens
tccacaagttaaataaa

SEQ ID NO: 1044977 - DNA, 21 bp, Homo sapiens
tccacaatagtcagaaaacaa

SEQ ID NO: 1044978 - DNA, 13 bp, Homo sapiens
tccacacacagag

SEQ ID NO: 1044979 - DNA, 19 bp, Homo sapiens
tccacacattccagccagg

SEQ ID NO: 1044980 - DNA, 14 bp, Homo sapiens
tccacacatttaaa

SEQ ID NO: 1044981 - DNA, 19 bp, Homo sapiens
tccacacatttaaaacatt

SEQ ID NO: 1044982 - DNA, 18 bp, Homo sapiens
tccacaccactgttgcct

SEQ ID NO: 1044983 - DNA, 16 bp, Homo sapiens
tccacaccagtggcct

SEQ ID NO: 1044984 - DNA, 17 bp, Homo sapiens
tccacaccagtggcctc

SEQ ID NO: 1044985 - DNA, 18 bp, Homo sapiens
tccacaccagtggcctcg

SEQ ID NO: 1044986 - DNA, 18 bp, Homo sapiens
tccacacctccaatgctg

SEQ ID NO: 1044987 - DNA, 15 bp, Homo sapiens
tccacaccttttatt

SEQ ID NO: 1044988 - DNA, 19 bp, Homo sapiens
tccacagaggacacagaga

SEQ ID NO: 1044989 - DNA, 19 bp, Homo sapiens
tccacagagtgagccagtg

SEQ ID NO: 1044990 - DNA, 20 bp, Homo sapiens
tccacagcaaccccaggctg

SEQ ID NO: 1044991 - DNA, 14 bp, Homo sapiens
tccacagccgcagc

SEQ ID NO: 1044992 - DNA, 17 bp, Homo sapiens
tccacagccgcagcctc

SEQ ID NO: 1044993 - DNA, 15 bp, Homo sapiens
tccacagcctgcaag

SEQ ID NO: 1044994 - DNA, 19 bp, Homo sapiens
tccacagcgagggcagctg

SEQ ID NO: 1044995 - DNA, 22 bp, Homo sapiens
tccacagcgagggcagctgcta

SEQ ID NO: 1044996 - DNA, 14 bp, Homo sapiens
tccacagctacctc

SEQ ID NO: 1044997 - DNA, 19 bp, Homo sapiens
tccacagctgaagagcaag

SEQ ID NO: 1044998 - DNA, 13 bp, Homo sapiens
tccacagctgcag

SEQ ID NO: 1044999 - DNA, 12 bp, Homo sapiens
tccacaggacac

SEQ ID NO: 1045000 - DNA, 19 bp, Homo sapiens
tccacagggagcaaacact

SEQ ID NO: 1045001 - DNA, 18 bp, Homo sapiens
tccacaggggcaggcctg

SEQ ID NO: 1045002 - DNA, 22 bp, Homo sapiens
tccacaggggcaggcctgggac

SEQ ID NO: 1045003 - DNA, 16 bp, Homo sapiens
tccacagtcccccacc

SEQ ID NO: 1045004 - DNA, 20 bp, Homo sapiens
tccacagtcccccacccacc

SEQ ID NO: 1045005 - DNA, 22 bp, Homo sapiens
tccacagtcccccacccacctc

SEQ ID NO: 1045006 - DNA, 13 bp, Homo sapiens
tgaaagtttagat

SEQ ID NO: 1045007 - DNA, 17 bp, Homo sapiens
tgaaagtttgcactgta

SEQ ID NO: 1045008 - DNA, 21 bp, Homo sapiens
tgaaagttttccagtattgaa

SEQ ID NO: 1045009 - DNA, 16 bp, Homo sapiens
tgaaagttttgtaaaa

SEQ ID NO: 1045010 - DNA, 20 bp, Homo sapiens
tgaaagttttgtaaaagaaa

SEQ ID NO: 1045011 - DNA, 22 bp, Homo sapiens
tgaaagttttgtaaaagaaatc

SEQ ID NO: 1045012 - DNA, 22 bp, Homo sapiens
tgaaataaaaaaaaaaggatga

SEQ ID NO: 1045013 - DNA, 17 bp, Homo sapiens
tgaaataaaactggctt

SEQ ID NO: 1045014 - DNA, 23 bp, Homo sapiens
tgaaataaacagtctaaagaaga

SEQ ID NO: 1045015 - DNA, 21 bp, Homo sapiens
tgaaataaacctgcactgaaa

SEQ ID NO: 1045016 - DNA, 17 bp, Homo sapiens
tgaaataaatgtttcaa

SEQ ID NO: 1045017 - DNA, 17 bp, Homo sapiens
tgaaataaattctgact

SEQ ID NO: 1045018 - DNA, 14 bp, Homo sapiens
tgaaataactcctt

SEQ ID NO: 1045019 - DNA, 20 bp, Homo sapiens
tgaaataactggaacaaatt

SEQ ID NO: 1045020 - DNA, 20 bp, Homo sapiens
tgaaataataaaatgcaaat

SEQ ID NO: 1045021 - DNA, 22 bp, Homo sapiens
tgaaataataaaatgcaaatga

SEQ ID NO: 1045022 - DNA, 13 bp, Homo sapiens
tgaaataatatat

SEQ ID NO: 1045023 - DNA, 18 bp, Homo sapiens
tgaaataatatatttctt

SEQ ID NO: 1045024 - DNA, 15 bp, Homo sapiens
tgaaataatcagtga

SEQ ID NO: 1045025 - DNA, 21 bp, Homo sapiens
tgaaataatcagtgactgaaa

SEQ ID NO: 1045026 - DNA, 18 bp, Homo sapiens
tgaaataatttgtgtctg

SEQ ID NO: 1045027 - DNA, 20 bp, Homo sapiens
tgaaataatttttaactttt

SEQ ID NO: 1045028 - DNA, 21 bp, Homo sapiens
tgaaataccaacctgaagaca

SEQ ID NO: 1045029 - DNA, 22 bp, Homo sapiens
tgaaataccagtgaaccaaaga

SEQ ID NO: 1045030 - DNA, 14 bp, Homo sapiens
tgaaataccagtgt

SEQ ID NO: 1045031 - DNA, 23 bp, Homo sapiens
tgaaataccttttctcacaaaaa

SEQ ID NO: 1045032 - DNA, 17 bp, Homo sapiens
tgaaatactgagatgct

SEQ ID NO: 1045033 - DNA, 21 bp, Homo sapiens
tgaaatagctttactgtttct

SEQ ID NO: 1045034 - DNA, 23 bp, Homo sapiens
tgaaatagctttactgtttctca

SEQ ID NO: 1045035 - DNA, 19 bp, Homo sapiens
tgaaatagttcaaagccaa

SEQ ID NO: 1045036 - DNA, 16 bp, Homo sapiens
tgaaatataaactgta

SEQ ID NO: 1045037 - DNA, 20 bp, Homo sapiens
tgaaatataaactgtagcga

SEQ ID NO: 1045038 - DNA, 15 bp, Homo sapiens
tgaaatataattgta

SEQ ID NO: 1045039 - DNA, 13 bp, Homo sapiens
tgaaatatataat

SEQ ID NO: 1045040 - DNA, 19 bp, Homo sapiens
tgaaatatatattgtaaag

SEQ ID NO: 1045041 - DNA, 17 bp, Homo sapiens
tgaaatatatgtgaaag

SEQ ID NO: 1045042 - DNA, 23 bp, Homo sapiens
tgaaatatcatcacgtatgttat

SEQ ID NO: 1045043 - DNA, 13 bp, Homo sapiens
tgaaatatgcata

SEQ ID NO: 1045044 - DNA, 14 bp, Homo sapiens
tgaaatattaaaat

SEQ ID NO: 1045045 - DNA, 14 bp, Homo sapiens
tgaaatattcagaa

SEQ ID NO: 1045046 - DNA, 13 bp, Homo sapiens
tgaaatattgctg

SEQ ID NO: 1045047 - DNA, 17 bp, Homo sapiens
tgaaatattgctgtata

SEQ ID NO: 1045048 - DNA, 21 bp, Homo sapiens
tgaaatattttttaatttaaa

SEQ ID NO: 1045049 - DNA, 19 bp, Homo sapiens
tgaaatcaatgcaagagtg

SEQ ID NO: 1045050 - DNA, 22 bp, Homo sapiens
tgaaatcaatgcaagagtgatt

SEQ ID NO: 1045051 - DNA, 17 bp, Homo sapiens
tgaaatcagtatcagaa

SEQ ID NO: 1045052 - DNA, 19 bp, Homo sapiens
tgaaatcagtatcagaata

SEQ ID NO: 1045053 - DNA, 20 bp, Homo sapiens
tgaaatccatatatatgaaa

SEQ ID NO: 1045054 - DNA, 19 bp, Homo sapiens
tgaaatcccatctctacaa

SEQ ID NO: 1045055 - DNA, 23 bp, Homo sapiens
tgaaatcctcagccgagaaattg

SEQ ID NO: 1045056 - DNA, 15 bp, Homo sapiens
tgaaatctaggaaaa

SEQ ID NO: 1045057 - DNA, 23 bp, Homo sapiens
tgaaatctgtttgttgacttatt

SEQ ID NO: 1045058 - DNA, 21 bp, Homo sapiens
tgaaatgacatgttcctttaa

SEQ ID NO: 1045059 - DNA, 21 bp, Homo sapiens
tgaaatgagtaaaaactagaa

SEQ ID NO: 1045060 - DNA, 17 bp, Homo sapiens
tgaaatgagttggccag

SEQ ID NO: 1045061 - DNA, 17 bp, Homo sapiens
tgaaatgataaagactt

SEQ ID NO: 1045062 - DNA, 14 bp, Homo sapiens
tgaaatgcactgta

SEQ ID NO: 1045063 - DNA, 20 bp, Homo sapiens
tgaaatgcatcaggtccttt

SEQ ID NO: 1045064 - DNA, 17 bp, Homo sapiens
tgaaatgctgcatttta

SEQ ID NO: 1045065 - DNA, 22 bp, Homo sapiens
tgaaatgcttatgcttgtgtat

SEQ ID NO: 1045066 - DNA, 19 bp, Homo sapiens
tgaaatgcttttatattct

SEQ ID NO: 1045067 - DNA, 22 bp, Homo sapiens
tgaaatgcttttatattctaat

SEQ ID NO: 1045068 - DNA, 19 bp, Homo sapiens
tgaaatggatactacatct

SEQ ID NO: 1045069 - DNA, 15 bp, Homo sapiens
tgaaatgggcattta

SEQ ID NO: 1045070 - DNA, 12 bp, Homo sapiens
tgaaatgtaaca

SEQ ID NO: 1045071 - DNA, 14 bp, Homo sapiens
tgaaatgtaacatg

SEQ ID NO: 1045072 - DNA, 18 bp, Homo sapiens
tgaaatgtataattaact

SEQ ID NO: 1045073 - DNA, 19 bp, Homo sapiens
tgaaatgtgtttctgtata

SEQ ID NO: 1045074 - DNA, 13 bp, Homo sapiens
tgaaatgttctta

SEQ ID NO: 1045075 - DNA, 21 bp, Homo sapiens
tgaaatgtttggattctctta

SEQ ID NO: 1045076 - DNA, 15 bp, Homo sapiens
tgaaattaaaaataa

SEQ ID NO: 1045077 - DNA, 14 bp, Homo sapiens
tgaaattaaagaaa

SEQ ID NO: 1045078 - DNA, 17 bp, Homo sapiens
tgaaattaaagtatgca

SEQ ID NO: 1045079 - DNA, 18 bp, Homo sapiens
tgaaattaaccatagatg

SEQ ID NO: 1045080 - DNA, 22 bp, Homo sapiens
tgaaattaaccatagatgtaga

SEQ ID NO: 1045081 - DNA, 14 bp, Homo sapiens
tgaaattaacctct

SEQ ID NO: 1045082 - DNA, 16 bp, Homo sapiens
tgaaattaatttgtga

SEQ ID NO: 1045083 - DNA, 23 bp, Homo sapiens
tgaaattactacaaaatttgaaa

SEQ ID NO: 1045084 - DNA, 15 bp, Homo sapiens
tgaaattactgtgta

SEQ ID NO: 1045085 - DNA, 17 bp, Homo sapiens
tgaaattactgtgtaaa

SEQ ID NO: 1045086 - DNA, 19 bp, Homo sapiens
tgaaattactgtgtaaata

SEQ ID NO: 1045087 - DNA, 23 bp, Homo sapiens
tgaaattatatatatacacatat

SEQ ID NO: 1045088 - DNA, 18 bp, Homo sapiens
tgaaattatgtatgttta

SEQ ID NO: 1045089 - DNA, 19 bp, Homo sapiens
tgaaattcaaaatgctcta

SEQ ID NO: 1045090 - DNA, 23 bp, Homo sapiens
tgaaattcagagcaagttcctga

SEQ ID NO: 1045091 - DNA, 17 bp, Homo sapiens
tgaaattccagcaataa

SEQ ID NO: 1045092 - DNA, 21 bp, Homo sapiens
tgaaattccagcaataagaaa

SEQ ID NO: 1045093 - DNA, 23 bp, Homo sapiens
tgaaattccagcaataagaaatg

SEQ ID NO: 1045094 - DNA, 13 bp, Homo sapiens
tgaaattcctcct

SEQ ID NO: 1045095 - DNA, 17 bp, Homo sapiens
tgaaattcctccttccc

SEQ ID NO: 1045096 - DNA, 16 bp, Homo sapiens
tgaaattctcctggag

SEQ ID NO: 1045097 - DNA, 16 bp, Homo sapiens
tgaaattcttgaagtt

SEQ ID NO: 1045098 - DNA, 22 bp, Homo sapiens
tgaaattgataatgctttcaca

SEQ ID NO: 1045099 - DNA, 23 bp, Homo sapiens
tgaaattgtacatatttgtggaa

SEQ ID NO: 1045100 - DNA, 18 bp, Homo sapiens
tgaaattgtagtgcaaaa

SEQ ID NO: 1045101 - DNA, 23 bp, Homo sapiens
tgaaattgtttaagtgttgtaaa

SEQ ID NO: 1045102 - DNA, 15 bp, Homo sapiens
tgaaatttaaataat

SEQ ID NO: 1045103 - DNA, 19 bp, Homo sapiens
tgaaatttaaataatagac

SEQ ID NO: 1045104 - DNA, 13 bp, Homo sapiens
tgaaatttacaaa

SEQ ID NO: 1045105 - DNA, 20 bp, Homo sapiens
tgaaatttattagttaatat

SEQ ID NO: 1045106 - DNA, 13 bp, Homo sapiens
tgaaatttctcat

SEQ ID NO: 1045107 - DNA, 20 bp, Homo sapiens
tgaaatttgttatacttcaa

SEQ ID NO: 1045108 - DNA, 19 bp, Homo sapiens
tgaaattttaaaaattgtt

SEQ ID NO: 1045109 - DNA, 19 bp, Homo sapiens
tgaaattttctagactttc

SEQ ID NO: 1045110 - DNA, 20 bp, Homo sapiens
tgaaattttctagactttct

SEQ ID NO: 1045111 - DNA, 19 bp, Homo sapiens
tgaaatttttattaaatta

SEQ ID NO: 1045112 - DNA, 18 bp, Homo sapiens
tgaaatttttttcctaag

SEQ ID NO: 1045113 - DNA, 18 bp, Homo sapiens
tgaacaaaaatgtttcca

SEQ ID NO: 1045114 - DNA, 22 bp, Homo sapiens
tgaacaaacactgaatcatgtt

SEQ ID NO: 1045115 - DNA, 15 bp, Homo sapiens
tgaacaaagcagcca

SEQ ID NO: 1045116 - DNA, 11 bp, Homo sapiens
tgaacaagaat

SEQ ID NO: 1045117 - DNA, 17 bp, Homo sapiens
tgaacaagcttcagtaa

SEQ ID NO: 1045118 - DNA, 15 bp, Homo sapiens
tgaacaagtccctgt

SEQ ID NO: 1045119 - DNA, 23 bp, Homo sapiens
tgaacaagtgggccattagccag

SEQ ID NO: 1045120 - DNA, 16 bp, Homo sapiens
tgaacaatcaaagcac

SEQ ID NO: 1045121 - DNA, 18 bp, Homo sapiens
tgaacacaaactgtaaat

SEQ ID NO: 1045122 - DNA, 19 bp, Homo sapiens
tgaacacaaactgtaaata

SEQ ID NO: 1045123 - DNA, 11 bp, Homo sapiens
gccccctgccc

SEQ ID NO: 1045124 - DNA, 18 bp, Homo sapiens
gccccctgccccccagcc

SEQ ID NO: 1045125 - DNA, 19 bp, Homo sapiens
gccccctgccctcccctct

SEQ ID NO: 1045126 - DNA, 20 bp, Homo sapiens
gccccctgcttacttggtga

SEQ ID NO: 1045127 - DNA, 20 bp, Homo sapiens
gccccctgcttggccaggag

SEQ ID NO: 1045128 - DNA, 21 bp, Homo sapiens
gccccctggatgtcccctgtc

SEQ ID NO: 1045129 - DNA, 14 bp, Homo sapiens
gccccctggcagct

SEQ ID NO: 1045130 - DNA, 17 bp, Homo sapiens
gccccctggcagctgcc

SEQ ID NO: 1045131 - DNA, 22 bp, Homo sapiens
gccccctggcagctgcccctcc

SEQ ID NO: 1045132 - DNA, 23 bp, Homo sapiens
gccccctggcagctgcccctcct

SEQ ID NO: 1045133 - DNA, 16 bp, Homo sapiens
gccccctggcctctgt

SEQ ID NO: 1045134 - DNA, 21 bp, Homo sapiens
gccccctgtacatttgtgctc

SEQ ID NO: 1045135 - DNA, 16 bp, Homo sapiens
gcccccttccccagcc

SEQ ID NO: 1045136 - DNA, 19 bp, Homo sapiens
gcccccttccccagccctt

SEQ ID NO: 1045137 - DNA, 15 bp, Homo sapiens
gcccccttctcccac

SEQ ID NO: 1045138 - DNA, 22 bp, Homo sapiens
gcccccttctcccacactgcta

SEQ ID NO: 1045139 - DNA, 19 bp, Homo sapiens
gcccccttgcccatcagcc

SEQ ID NO: 1045140 - DNA, 15 bp, Homo sapiens
gcccccttgccctcc

SEQ ID NO: 1045141 - DNA, 17 bp, Homo sapiens
gcccccttgccctccgc

SEQ ID NO: 1045142 - DNA, 17 bp, Homo sapiens
gccccctttcccgggct

SEQ ID NO: 1045143 - DNA, 18 bp, Homo sapiens
gccccctttcccgggctg

SEQ ID NO: 1045144 - DNA, 22 bp, Homo sapiens
gccccgacacacggggctcggg

SEQ ID NO: 1045145 - DNA, 15 bp, Homo sapiens
gccccgacaggtctt

SEQ ID NO: 1045146 - DNA, 19 bp, Homo sapiens
gccccgagcccaggcagct

SEQ ID NO: 1045147 - DNA, 14 bp, Homo sapiens
gccccgcacgggct

SEQ ID NO: 1045148 - DNA, 15 bp, Homo sapiens
gccccgccagggctg

SEQ ID NO: 1045149 - DNA, 17 bp, Homo sapiens
gccccgccagggctggg

SEQ ID NO: 1045150 - DNA, 13 bp, Homo sapiens
gccccgccccaca

SEQ ID NO: 1045151 - DNA, 16 bp, Homo sapiens
gccccgccccagccct

SEQ ID NO: 1045152 - DNA, 17 bp, Homo sapiens
gccccgccccccagagc

SEQ ID NO: 1045153 - DNA, 15 bp, Homo sapiens
gccccgccctgcccc

SEQ ID NO: 1045154 - DNA, 22 bp, Homo sapiens
gccccgcctgagtcagtgctct

SEQ ID NO: 1045155 - DNA, 20 bp, Homo sapiens
gccccgcctgtcacaataaa

SEQ ID NO: 1045156 - DNA, 16 bp, Homo sapiens
gccccgccttcctggg

SEQ ID NO: 1045157 - DNA, 17 bp, Homo sapiens
gccccgccttcgtgtgc

SEQ ID NO: 1045158 - DNA, 13 bp, Homo sapiens
gccccgctcaggc

SEQ ID NO: 1045159 - DNA, 14 bp, Homo sapiens
gccccgctcaggcc

SEQ ID NO: 1045160 - DNA, 18 bp, Homo sapiens
gccccgctcccacctagt

SEQ ID NO: 1045161 - DNA, 16 bp, Homo sapiens
gccccgctgagcttgg

SEQ ID NO: 1045162 - DNA, 18 bp, Homo sapiens
gccccgctgagcttggag

SEQ ID NO: 1045163 - DNA, 23 bp, Homo sapiens
gccccgctgggatttcttcgctg

SEQ ID NO: 1045164 - DNA, 21 bp, Homo sapiens
gccccggaggagctgggccag

SEQ ID NO: 1045165 - DNA, 21 bp, Homo sapiens
gccccggatcagagcaggacc

SEQ ID NO: 1045166 - DNA, 22 bp, Homo sapiens
gccccggcaagccacaggaagg

SEQ ID NO: 1045167 - DNA, 16 bp, Homo sapiens
gccccggccccagcca

SEQ ID NO: 1045168 - DNA, 17 bp, Homo sapiens
gccccggccccagccag

SEQ ID NO: 1045169 - DNA, 14 bp, Homo sapiens
gccccggcctcctc

SEQ ID NO: 1045170 - DNA, 14 bp, Homo sapiens
gccccggccttgct

SEQ ID NO: 1045171 - DNA, 19 bp, Homo sapiens
gccccgggctctggccacc

SEQ ID NO: 1045172 - DNA, 21 bp, Homo sapiens
gccccgggctctggccaccct

SEQ ID NO: 1045173 - DNA, 13 bp, Homo sapiens
gccccgggctggc

SEQ ID NO: 1045174 - DNA, 14 bp, Homo sapiens
gccccgggctggcc

SEQ ID NO: 1045175 - DNA, 18 bp, Homo sapiens
gccccgggtgcctcagag

SEQ ID NO: 1045176 - DNA, 15 bp, Homo sapiens
gccccgtcaccatct

SEQ ID NO: 1045177 - DNA, 20 bp, Homo sapiens
gccccgtcaccatctcaggc

SEQ ID NO: 1045178 - DNA, 17 bp, Homo sapiens
gccccgtccccctctgg

SEQ ID NO: 1045179 - DNA, 19 bp, Homo sapiens
gccccgtcggactgccccc

SEQ ID NO: 1045180 - DNA, 23 bp, Homo sapiens
gccccgtcggactgcccccagaa

SEQ ID NO: 1045181 - DNA, 17 bp, Homo sapiens
gccccgtgtgaatgtag

SEQ ID NO: 1045182 - DNA, 21 bp, Homo sapiens
gccccgtgtgaatgtagcttc

SEQ ID NO: 1045183 - DNA, 18 bp, Homo sapiens
gccccgttccctgtcaga

SEQ ID NO: 1045184 - DNA, 21 bp, Homo sapiens
gccccgttgtgagctggatag

SEQ ID NO: 1045185 - DNA, 15 bp, Homo sapiens
gccccgttttgggga

SEQ ID NO: 1045186 - DNA, 17 bp, Homo sapiens
gcccctaaagatgggag

SEQ ID NO: 1045187 - DNA, 18 bp, Homo sapiens
gcccctaaagatgggagg

SEQ ID NO: 1045188 - DNA, 20 bp, Homo sapiens
gcccctaaagatgggaggag

SEQ ID NO: 1045189 - DNA, 22 bp, Homo sapiens
gcccctaaagatgggaggagac

SEQ ID NO: 1045190 - DNA, 17 bp, Homo sapiens
gcccctaatctctgtag

SEQ ID NO: 1045191 - DNA, 15 bp, Homo sapiens
gcccctacccctgcc

SEQ ID NO: 1045192 - DNA, 17 bp, Homo sapiens
gcccctacccctgccct

SEQ ID NO: 1045193 - DNA, 19 bp, Homo sapiens
gcccctactgctgtgaacc

SEQ ID NO: 1045194 - DNA, 17 bp, Homo sapiens
gcccctagggtccctcg

SEQ ID NO: 1045195 - DNA, 19 bp, Homo sapiens
gcccctagtgctattctgt

SEQ ID NO: 1045196 - DNA, 18 bp, Homo sapiens
gcccctatagcactgagc

SEQ ID NO: 1045197 - DNA, 21 bp, Homo sapiens
gcccctatagcactgagctca

SEQ ID NO: 1045198 - DNA, 17 bp, Homo sapiens
gcccctcacatcctctc

SEQ ID NO: 1045199 - DNA, 22 bp, Homo sapiens
gcccctcacatcctctccagga

SEQ ID NO: 1045200 - DNA, 14 bp, Homo sapiens
gcccctcacccacc

SEQ ID NO: 1045201 - DNA, 14 bp, Homo sapiens
gcccctgtggccaa

SEQ ID NO: 1045202 - DNA, 16 bp, Homo sapiens
gcccctgtggccaact

SEQ ID NO: 1045203 - DNA, 20 bp, Homo sapiens
gcccctgtggccaactgcaa

SEQ ID NO: 1045204 - DNA, 21 bp, Homo sapiens
gcccctgtggccaactgcaaa

SEQ ID NO: 1045205 - DNA, 14 bp, Homo sapiens
gcccctgtggccct

SEQ ID NO: 1045206 - DNA, 18 bp, Homo sapiens
gcccctgtggccctggcc

SEQ ID NO: 1045207 - DNA, 20 bp, Homo sapiens
gcccctgttgaggtgggtgg

SEQ ID NO: 1045208 - DNA, 16 bp, Homo sapiens
gccccttaagggttga

SEQ ID NO: 1045209 - DNA, 20 bp, Homo sapiens
gccccttaagggttgaaggc

SEQ ID NO: 1045210 - DNA, 18 bp, Homo sapiens
gccccttcactcattttt

SEQ ID NO: 1045211 - DNA, 23 bp, Homo sapiens
gccccttcacttctgaccacact

SEQ ID NO: 1045212 - DNA, 19 bp, Homo sapiens
gccccttccaaatgtccct

SEQ ID NO: 1045213 - DNA, 15 bp, Homo sapiens
gccccttcccatctc

SEQ ID NO: 1045214 - DNA, 14 bp, Homo sapiens
gccccttccccaag

SEQ ID NO: 1045215 - DNA, 17 bp, Homo sapiens
gccccttccccctccaa

SEQ ID NO: 1045216 - DNA, 18 bp, Homo sapiens
gccccttctcagaatcta

SEQ ID NO: 1045217 - DNA, 14 bp, Homo sapiens
gccccttctgctca

SEQ ID NO: 1045218 - DNA, 20 bp, Homo sapiens
gccccttcttccaaggagca

SEQ ID NO: 1045219 - DNA, 22 bp, Homo sapiens
gccccttcttgggccccagacc

SEQ ID NO: 1045220 - DNA, 14 bp, Homo sapiens
gccccttgcaagcc

SEQ ID NO: 1045221 - DNA, 17 bp, Homo sapiens
gccccttgcaagccata

SEQ ID NO: 1045222 - DNA, 13 bp, Homo sapiens
gccccttggagag

SEQ ID NO: 1045223 - DNA, 21 bp, Homo sapiens
gccccttggagagagaggctg

SEQ ID NO: 1045224 - DNA, 13 bp, Homo sapiens
gccccttgggcat

SEQ ID NO: 1045225 - DNA, 15 bp, Homo sapiens
gcccctttacggaca

SEQ ID NO: 1045226 - DNA, 16 bp, Homo sapiens
gcccctttccccacgc

SEQ ID NO: 1045227 - DNA, 14 bp, Homo sapiens
gcccctttgcctct

SEQ ID NO: 1045228 - DNA, 16 bp, Homo sapiens
gcccctttgcctctgt

SEQ ID NO: 1045229 - DNA, 21 bp, Homo sapiens
gcccctttgcctctgtcctcc

SEQ ID NO: 1045230 - DNA, 15 bp, Homo sapiens
gccccttttctctgc

SEQ ID NO: 1045231 - DNA, 19 bp, Homo sapiens
gcccctttttactcccctt

SEQ ID NO: 1045232 - DNA, 20 bp, Homo sapiens
gcccctttttactccccttg

SEQ ID NO: 1045233 - DNA, 19 bp, Homo sapiens
gcccgaaactaagccaggc

SEQ ID NO: 1045234 - DNA, 10 bp, Homo sapiens
tccctcaccc

SEQ ID NO: 1045235 - DNA, 22 bp, Homo sapiens
tccctcacccaagtttccggag

SEQ ID NO: 1045236 - DNA, 17 bp, Homo sapiens
tccctcaccctgagccc

SEQ ID NO: 1045237 - DNA, 13 bp, Homo sapiens
tccctcacctgta

SEQ ID NO: 1045238 - DNA, 20 bp, Homo sapiens
tccctcacgtttcttcccca

SEQ ID NO: 1045239 - DNA, 14 bp, Homo sapiens
tccctcagccccca

SEQ ID NO: 1045240 - DNA, 15 bp, Homo sapiens
tccctcagcccctct

SEQ ID NO: 1045241 - DNA, 17 bp, Homo sapiens
tccctcagcccctcttg

SEQ ID NO: 1045242 - DNA, 14 bp, Homo sapiens
tccctcagcctccc

SEQ ID NO: 1045243 - DNA, 19 bp, Homo sapiens
tccctcagggagcgatcca

SEQ ID NO: 1045244 - DNA, 22 bp, Homo sapiens
tccctcaggggcaggtggtgga

SEQ ID NO: 1045245 - DNA, 13 bp, Homo sapiens
tccctcatctctc

SEQ ID NO: 1045246 - DNA, 21 bp, Homo sapiens
tccctcatctgtccctccggg

SEQ ID NO: 1045247 - DNA, 17 bp, Homo sapiens
tccctcattcatcttgc

SEQ ID NO: 1045248 - DNA, 20 bp, Homo sapiens
tccctcattcatcttgcaag

SEQ ID NO: 1045249 - DNA, 19 bp, Homo sapiens
tccctccaagcctggcacc

SEQ ID NO: 1045250 - DNA, 22 bp, Homo sapiens
tccctccaagcctggcacccac

SEQ ID NO: 1045251 - DNA, 16 bp, Homo sapiens
tccctccaccagcctg

SEQ ID NO: 1045252 - DNA, 17 bp, Homo sapiens
tccctccaccagcctgc

SEQ ID NO: 1045253 - DNA, 18 bp, Homo sapiens
tccctccaccagcctgct

SEQ ID NO: 1045254 - DNA, 19 bp, Homo sapiens
tccctccaccagcctgctg

SEQ ID NO: 1045255 - DNA, 14 bp, Homo sapiens
tccctccaccccac

SEQ ID NO: 1045256 - DNA, 16 bp, Homo sapiens
tccctccacccccatg

SEQ ID NO: 1045257 - DNA, 22 bp, Homo sapiens
tccctccacccccatgtggcag

SEQ ID NO: 1045258 - DNA, 13 bp, Homo sapiens
tccctccactcct

SEQ ID NO: 1045259 - DNA, 16 bp, Homo sapiens
tccctccactcctctc

SEQ ID NO: 1045260 - DNA, 23 bp, Homo sapiens
tccctccagggaaaatgacttta

SEQ ID NO: 1045261 - DNA, 22 bp, Homo sapiens
tccctcccagaggagccaccag

SEQ ID NO: 1045262 - DNA, 16 bp, Homo sapiens
tccctcccagcgctct

SEQ ID NO: 1045263 - DNA, 18 bp, Homo sapiens
tccctcccagctgcactt

SEQ ID NO: 1045264 - DNA, 16 bp, Homo sapiens
tccctcccatcctcca

SEQ ID NO: 1045265 - DNA, 13 bp, Homo sapiens
tccctccccaccc

SEQ ID NO: 1045266 - DNA, 15 bp, Homo sapiens
tccctccccacccaa

SEQ ID NO: 1045267 - DNA, 19 bp, Homo sapiens
tccctccccacccaagaga

SEQ ID NO: 1045268 - DNA, 13 bp, Homo sapiens
tccctccccagct

SEQ ID NO: 1045269 - DNA, 14 bp, Homo sapiens
tccctccccagctc

SEQ ID NO: 1045270 - DNA, 15 bp, Homo sapiens
tccctcccccagcag

SEQ ID NO: 1045271 - DNA, 16 bp, Homo sapiens
tccctcccccagcaga

SEQ ID NO: 1045272 - DNA, 16 bp, Homo sapiens
tccctccccctccttg

SEQ ID NO: 1045273 - DNA, 15 bp, Homo sapiens
tccctcccctgccct

SEQ ID NO: 1045274 - DNA, 22 bp, Homo sapiens
tccctcccggcatgggaaagcc

SEQ ID NO: 1045275 - DNA, 14 bp, Homo sapiens
tccctcccggctgc

SEQ ID NO: 1045276 - DNA, 22 bp, Homo sapiens
tccctcccgtagtctcctgggt

SEQ ID NO: 1045277 - DNA, 18 bp, Homo sapiens
tccctccctagcccttcc

SEQ ID NO: 1045278 - DNA, 19 bp, Homo sapiens
tccctccgatccttcctcc

SEQ ID NO: 1045279 - DNA, 13 bp, Homo sapiens
tccctcctagctc

SEQ ID NO: 1045280 - DNA, 16 bp, Homo sapiens
tccctcctcacctctg

SEQ ID NO: 1045281 - DNA, 11 bp, Homo sapiens
tccctcctcag

SEQ ID NO: 1045282 - DNA, 13 bp, Homo sapiens
tccctcctcaggg

SEQ ID NO: 1045283 - DNA, 21 bp, Homo sapiens
tccctcctccaggcctgcctc

SEQ ID NO: 1045284 - DNA, 20 bp, Homo sapiens
tccctcctcccatgtcactg

SEQ ID NO: 1045285 - DNA, 15 bp, Homo sapiens
tccctcctctcacct

SEQ ID NO: 1045286 - DNA, 15 bp, Homo sapiens
tccctcctctggcag

SEQ ID NO: 1045287 - DNA, 20 bp, Homo sapiens
tccctcctgagtgccccact

SEQ ID NO: 1045288 - DNA, 16 bp, Homo sapiens
tccctcctgccgactc

SEQ ID NO: 1045289 - DNA, 14 bp, Homo sapiens
tccctcctgctact

SEQ ID NO: 1045290 - DNA, 14 bp, Homo sapiens
tccctcctgctttg

SEQ ID NO: 1045291 - DNA, 22 bp, Homo sapiens
tccctcctgctttgcgtgcccg

SEQ ID NO: 1045292 - DNA, 11 bp, Homo sapiens
tccctcctggt

SEQ ID NO: 1045293 - DNA, 18 bp, Homo sapiens
tccctcctggtcctggac

SEQ ID NO: 1045294 - DNA, 21 bp, Homo sapiens
tccctcgacttgaccctttcc

SEQ ID NO: 1045295 - DNA, 19 bp, Homo sapiens
tccctcgctgcacaaatac

SEQ ID NO: 1045296 - DNA, 22 bp, Homo sapiens
tccctcgctgcacaaatactcc

SEQ ID NO: 1045297 - DNA, 17 bp, Homo sapiens
tccctcggccccaccca

SEQ ID NO: 1045298 - DNA, 19 bp, Homo sapiens
tccctcggcgttagtccct

SEQ ID NO: 1045299 - DNA, 21 bp, Homo sapiens
tccctcggcgttagtccctag

SEQ ID NO: 1045300 - DNA, 22 bp, Homo sapiens
tccctcggggaccgttcagtgt

SEQ ID NO: 1045301 - DNA, 16 bp, Homo sapiens
tccctcgggggctctt

SEQ ID NO: 1045302 - DNA, 19 bp, Homo sapiens
tccctcgggggctcttccc

SEQ ID NO: 1045303 - DNA, 21 bp, Homo sapiens
tccctcgggggctcttcccct

SEQ ID NO: 1045304 - DNA, 22 bp, Homo sapiens
tccctcgggggctcttccccta

SEQ ID NO: 1045305 - DNA, 15 bp, Homo sapiens
tccctcgtccacagg

SEQ ID NO: 1045306 - DNA, 16 bp, Homo sapiens
tccctctactcttcct

SEQ ID NO: 1045307 - DNA, 20 bp, Homo sapiens
tccctctcaggcatgcctgt

SEQ ID NO: 1045308 - DNA, 22 bp, Homo sapiens
tccctctcaggcatgcctgtgt

SEQ ID NO: 1045309 - DNA, 20 bp, Homo sapiens
tccctctcatgtccctccag

SEQ ID NO: 1045310 - DNA, 20 bp, Homo sapiens
tccctctccactcttctctc

SEQ ID NO: 1045311 - DNA, 21 bp, Homo sapiens
tccctctccactcttctctcc

SEQ ID NO: 1045312 - DNA, 13 bp, Homo sapiens
tccctctcctgcc

SEQ ID NO: 1045313 - DNA, 17 bp, Homo sapiens
tccctctcctgcccaga

SEQ ID NO: 1045314 - DNA, 15 bp, Homo sapiens
tccctctcctgccta

SEQ ID NO: 1045315 - DNA, 14 bp, Homo sapiens
tccctctcctgtcc

SEQ ID NO: 1045316 - DNA, 23 bp, Homo sapiens
tccctctcggaaggctggctggg

SEQ ID NO: 1045317 - DNA, 17 bp, Homo sapiens
tccctctctcccatttc

SEQ ID NO: 1045318 - DNA, 12 bp, Homo sapiens
tccctctctctt

SEQ ID NO: 1045319 - DNA, 19 bp, Homo sapiens
tccctctctcttctgctcc

SEQ ID NO: 1045320 - DNA, 18 bp, Homo sapiens
tccctctcttccgggagc

SEQ ID NO: 1045321 - DNA, 19 bp, Homo sapiens
tccctctcttccgggagct

SEQ ID NO: 1045322 - DNA, 21 bp, Homo sapiens
tccctctcttccgggagctgg

SEQ ID NO: 1045323 - DNA, 22 bp, Homo sapiens
tccctctcttccgggagctggt

SEQ ID NO: 1045324 - DNA, 22 bp, Homo sapiens
tccctctgaagagaccttggct

SEQ ID NO: 1045325 - DNA, 23 bp, Homo sapiens
tccctctgaagagaccttggctg

SEQ ID NO: 1045326 - DNA, 18 bp, Homo sapiens
tccctctgatttttcctt

SEQ ID NO: 1045327 - DNA, 12 bp, Homo sapiens
tccctctgccag

SEQ ID NO: 1045328 - DNA, 23 bp, Homo sapiens
tccctctgccccaagcagccagc

SEQ ID NO: 1045329 - DNA, 17 bp, Homo sapiens
gccctaaggttttgttg

SEQ ID NO: 1045330 - DNA, 22 bp, Homo sapiens
gccctaaggttttgttgtgttc

SEQ ID NO: 1045331 - DNA, 16 bp, Homo sapiens
gccctacagagctgtg

SEQ ID NO: 1045332 - DNA, 15 bp, Homo sapiens
gccctacagcaccct

SEQ ID NO: 1045333 - DNA, 16 bp, Homo sapiens
gccctactcctgcggc

SEQ ID NO: 1045334 - DNA, 16 bp, Homo sapiens
gccctacttccaggat

SEQ ID NO: 1045335 - DNA, 18 bp, Homo sapiens
gccctacttccaggatgg

SEQ ID NO: 1045336 - DNA, 13 bp, Homo sapiens
gccctagaccctc

SEQ ID NO: 1045337 - DNA, 16 bp, Homo sapiens
gccctagaccctcccc

SEQ ID NO: 1045338 - DNA, 13 bp, Homo sapiens
gccctagagcaca

SEQ ID NO: 1045339 - DNA, 19 bp, Homo sapiens
gccctagagcacactgtag

SEQ ID NO: 1045340 - DNA, 19 bp, Homo sapiens
gccctagcccagactctga

SEQ ID NO: 1045341 - DNA, 21 bp, Homo sapiens
gccctagcccagactctgagc

SEQ ID NO: 1045342 - DNA, 21 bp, Homo sapiens
gccctagcgctctcttccaga

SEQ ID NO: 1045343 - DNA, 15 bp, Homo sapiens
gccctagctgacccc

SEQ ID NO: 1045344 - DNA, 18 bp, Homo sapiens
gccctaggcgggatgggc

SEQ ID NO: 1045345 - DNA, 14 bp, Homo sapiens
gccctatgggcctg

SEQ ID NO: 1045346 - DNA, 15 bp, Homo sapiens
gccctatgggcctgc

SEQ ID NO: 1045347 - DNA, 16 bp, Homo sapiens
gccctatgggcctgcc

SEQ ID NO: 1045348 - DNA, 21 bp, Homo sapiens
gccctatgggcctgccgggct

SEQ ID NO: 1045349 - DNA, 17 bp, Homo sapiens
gccctatttttgcaatg

SEQ ID NO: 1045350 - DNA, 19 bp, Homo sapiens
gccctcaccccaatccctg

SEQ ID NO: 1045351 - DNA, 13 bp, Homo sapiens
gccctcacctctg

SEQ ID NO: 1045352 - DNA, 14 bp, Homo sapiens
gccctcacctctga

SEQ ID NO: 1045353 - DNA, 17 bp, Homo sapiens
gccctcacctctgagga

SEQ ID NO: 1045354 - DNA, 13 bp, Homo sapiens
gccctcacctgca

SEQ ID NO: 1045355 - DNA, 14 bp, Homo sapiens
gccctcacctgcag

SEQ ID NO: 1045356 - DNA, 14 bp, Homo sapiens
tgaacttgctcttt

SEQ ID NO: 1045357 - DNA, 21 bp, Homo sapiens
tgaacttggagagggggccgg

SEQ ID NO: 1045358 - DNA, 12 bp, Homo sapiens
tgaactttaaaa

SEQ ID NO: 1045359 - DNA, 16 bp, Homo sapiens
tgaactttctccctca

SEQ ID NO: 1045360 - DNA, 16 bp, Homo sapiens
tgaactttgacctctg

SEQ ID NO: 1045361 - DNA, 19 bp, Homo sapiens
tgaactttgacctctgcag

SEQ ID NO: 1045362 - DNA, 19 bp, Homo sapiens
tgaacttttacagaatgca

SEQ ID NO: 1045363 - DNA, 15 bp, Homo sapiens
tgaacttttgtaatt

SEQ ID NO: 1045364 - DNA, 22 bp, Homo sapiens
tgaacttttgtaatttgaattg

SEQ ID NO: 1045365 - DNA, 16 bp, Homo sapiens
tgaacttttgtactga

SEQ ID NO: 1045366 - DNA, 21 bp, Homo sapiens
tgaactttttatttgaggaga

SEQ ID NO: 1045367 - DNA, 22 bp, Homo sapiens
tgaactttttatttgaggagac

SEQ ID NO: 1045368 - DNA, 23 bp, Homo sapiens
tgaactttttatttgaggagacg

SEQ ID NO: 1045369 - DNA, 22 bp, Homo sapiens
tgaactttttctaggtggcagg

SEQ ID NO: 1045370 - DNA, 21 bp, Homo sapiens
tgaagaaaaaaatgtacattt

SEQ ID NO: 1045371 - DNA, 20 bp, Homo sapiens
tgaagaaaaaatcagaacta

SEQ ID NO: 1045372 - DNA, 17 bp, Homo sapiens
tgaagaaaactccttta

SEQ ID NO: 1045373 - DNA, 15 bp, Homo sapiens
tgaagaaaatcactt

SEQ ID NO: 1045374 - DNA, 21 bp, Homo sapiens
tgaagaaacagagtggcctcc

SEQ ID NO: 1045375 - DNA, 20 bp, Homo sapiens
tgaagaaagccagacaactt

SEQ ID NO: 1045376 - DNA, 13 bp, Homo sapiens
tgaagaaagtcaa

SEQ ID NO: 1045377 - DNA, 16 bp, Homo sapiens
tgaagaaagtcaaaaa

SEQ ID NO: 1045378 - DNA, 15 bp, Homo sapiens
tgaagaaataaatga

SEQ ID NO: 1045379 - DNA, 22 bp, Homo sapiens
tgaagaaatttatgaagcagat

SEQ ID NO: 1045380 - DNA, 18 bp, Homo sapiens
tgaagaacacagcatgtg

SEQ ID NO: 1045381 - DNA, 16 bp, Homo sapiens
tgaagaactgcacttt

SEQ ID NO: 1045382 - DNA, 17 bp, Homo sapiens
tgaagaactgcactttt

SEQ ID NO: 1045383 - DNA, 15 bp, Homo sapiens
tgaagaactgcaggc

SEQ ID NO: 1045384 - DNA, 19 bp, Homo sapiens
tgaagaagaaccagcccag

SEQ ID NO: 1045385 - DNA, 21 bp, Homo sapiens
tgaagaagaaccagcccagcc

SEQ ID NO: 1045386 - DNA, 21 bp, Homo sapiens
tgaagaagtcactgaacaaaa

SEQ ID NO: 1045387 - DNA, 23 bp, Homo sapiens
tgaagaagtcactgaacaaaacc

SEQ ID NO: 1045388 - DNA, 16 bp, Homo sapiens
tgaagaatacttctca

SEQ ID NO: 1045389 - DNA, 20 bp, Homo sapiens
tgaagaatacttctcatttt

SEQ ID NO: 1045390 - DNA, 21 bp, Homo sapiens
tgaagaatacttctcattttt

SEQ ID NO: 1045391 - DNA, 11 bp, Homo sapiens
tgaagaatcac

SEQ ID NO: 1045392 - DNA, 18 bp, Homo sapiens
tgaagaatgcattcaaaa

SEQ ID NO: 1045393 - DNA, 15 bp, Homo sapiens
tgaagaatggcgcca

SEQ ID NO: 1045394 - DNA, 13 bp, Homo sapiens
tgaagaatgttaa

SEQ ID NO: 1045395 - DNA, 23 bp, Homo sapiens
tgaagaatgttagagtaatgaaa

SEQ ID NO: 1045396 - DNA, 17 bp, Homo sapiens
tgaagaattaagataca

SEQ ID NO: 1045397 - DNA, 16 bp, Homo sapiens
tgaagaattattcagt

SEQ ID NO: 1045398 - DNA, 20 bp, Homo sapiens
tgaagaattattcagtgaat

SEQ ID NO: 1045399 - DNA, 13 bp, Homo sapiens
tgaagacaatgac

SEQ ID NO: 1045400 - DNA, 17 bp, Homo sapiens
tgaagacaatgacttac

SEQ ID NO: 1045401 - DNA, 18 bp, Homo sapiens
tgaagacacagcctcccc

SEQ ID NO: 1045402 - DNA, 14 bp, Homo sapiens
tgaagacagagcaa

SEQ ID NO: 1045403 - DNA, 22 bp, Homo sapiens
tgaagacagagcaaagcgccca

SEQ ID NO: 1045404 - DNA, 20 bp, Homo sapiens
tgaagacattttttgctata

SEQ ID NO: 1045405 - DNA, 20 bp, Homo sapiens
tgaagaccacatccacacac

SEQ ID NO: 1045406 - DNA, 14 bp, Homo sapiens
tgaagacctaaagt

SEQ ID NO: 1045407 - DNA, 15 bp, Homo sapiens
tgaagacctaaagtg

SEQ ID NO: 1045408 - DNA, 12 bp, Homo sapiens
tgaagacgtgga

SEQ ID NO: 1045409 - DNA, 20 bp, Homo sapiens
tgaagacgtggactcctctt

SEQ ID NO: 1045410 - DNA, 21 bp, Homo sapiens
tgaagacgtggactcctcttg

SEQ ID NO: 1045411 - DNA, 21 bp, Homo sapiens
tgaagactcacttctcagctg

SEQ ID NO: 1045412 - DNA, 19 bp, Homo sapiens
tgaagactctgcagccctc

SEQ ID NO: 1045413 - DNA, 15 bp, Homo sapiens
tgaagacttcttggg

SEQ ID NO: 1045414 - DNA, 12 bp, Homo sapiens
tgaagagacaga

SEQ ID NO: 1045415 - DNA, 19 bp, Homo sapiens
tgaagagacagagacaagt

SEQ ID NO: 1045416 - DNA, 16 bp, Homo sapiens
tgaagagacaggcacc

SEQ ID NO: 1045417 - DNA, 20 bp, Homo sapiens
tgaagagagggacaggcact

SEQ ID NO: 1045418 - DNA, 22 bp, Homo sapiens
tgaagagagggacaggcactcc

SEQ ID NO: 1045419 - DNA, 21 bp, Homo sapiens
tgaagagatttcaacaagaat

SEQ ID NO: 1045420 - DNA, 22 bp, Homo sapiens
tgaagagccggtggtgcccgtg

SEQ ID NO: 1045421 - DNA, 19 bp, Homo sapiens
tgaagagcgctcctctgcc

SEQ ID NO: 1045422 - DNA, 14 bp, Homo sapiens
tgaagagcttgctt

SEQ ID NO: 1045423 - DNA, 23 bp, Homo sapiens
tgaagaggaggggaagaggcctg

SEQ ID NO: 1045424 - DNA, 16 bp, Homo sapiens
tgaagaggcgggccag

SEQ ID NO: 1045425 - DNA, 20 bp, Homo sapiens
tgaagaggcgggccagccag

SEQ ID NO: 1045426 - DNA, 23 bp, Homo sapiens
tgaagaggcgggccagccaggcg

SEQ ID NO: 1045427 - DNA, 18 bp, Homo sapiens
tgaagagggagaagcatg

SEQ ID NO: 1045428 - DNA, 21 bp, Homo sapiens
tgaagagggagaagcatgaaa

SEQ ID NO: 1045429 - DNA, 16 bp, Homo sapiens
tgaagaggggcagccc

SEQ ID NO: 1045430 - DNA, 17 bp, Homo sapiens
tgaagaggggcagccct

SEQ ID NO: 1045431 - DNA, 17 bp, Homo sapiens
tgaagagtatccttcct

SEQ ID NO: 1045432 - DNA, 13 bp, Homo sapiens
tgaagagtcagaa

SEQ ID NO: 1045433 - DNA, 18 bp, Homo sapiens
tgaagagtgagagggcat

SEQ ID NO: 1045434 - DNA, 16 bp, Homo sapiens
tgaagataatttgcat

SEQ ID NO: 1045435 - DNA, 13 bp, Homo sapiens
tgaagatcaattt

SEQ ID NO: 1045436 - DNA, 19 bp, Homo sapiens
tgaagatcgttagtatcta

SEQ ID NO: 1045437 - DNA, 16 bp, Homo sapiens
tgaagatgaaggggct

SEQ ID NO: 1045438 - DNA, 13 bp, Homo sapiens
tgaagatgatcat

SEQ ID NO: 1045439 - DNA, 15 bp, Homo sapiens
tgaagatgccttgag

SEQ ID NO: 1045440 - DNA, 18 bp, Homo sapiens
tgaagatggcatcctgtg

SEQ ID NO: 1045441 - DNA, 21 bp, Homo sapiens
tgaagatggtttcaattcaga

SEQ ID NO: 1045442 - DNA, 16 bp, Homo sapiens
tgaagatgtctaatag

SEQ ID NO: 1045443 - DNA, 14 bp, Homo sapiens
tgaagatgtctcct

SEQ ID NO: 1045444 - DNA, 16 bp, Homo sapiens
tgaagatgtctcctca

SEQ ID NO: 1045445 - DNA, 19 bp, Homo sapiens
tgaagattctcctgtgcta

SEQ ID NO: 1045446 - DNA, 16 bp, Homo sapiens
tgaagattctttccca

SEQ ID NO: 1045447 - DNA, 20 bp, Homo sapiens
tgaagcaaactaactttttt

SEQ ID NO: 1045448 - DNA, 18 bp, Homo sapiens
tgaagcaaagcaccagct

SEQ ID NO: 1045449 - DNA, 20 bp, Homo sapiens
tgaagcaactacaacttctc

SEQ ID NO: 1045450 - DNA, 12 bp, Homo sapiens
tgaagcaataac

SEQ ID NO: 1045451 - DNA, 17 bp, Homo sapiens
tgaagcaataactccaa

SEQ ID NO: 1045452 - DNA, 21 bp, Homo sapiens
tgaagcaataactccaagcag

SEQ ID NO: 1045453 - DNA, 21 bp, Homo sapiens
tgaagcacagagggctaggga

SEQ ID NO: 1045454 - DNA, 21 bp, Homo sapiens
tgaagcacttaagtcttcctt

SEQ ID NO: 1045455 - DNA, 16 bp, Homo sapiens
tgaagcagatttattt

SEQ ID NO: 1045456 - DNA, 20 bp, Homo sapiens
tgaagcagcctctccccagg

SEQ ID NO: 1045457 - DNA, 13 bp, Homo sapiens
tgaagcaggaggc

SEQ ID NO: 1045458 - DNA, 21 bp, Homo sapiens
tgaagcagggtttcttttctt

SEQ ID NO: 1045459 - DNA, 20 bp, Homo sapiens
tgaagcaggttcccaagctc

SEQ ID NO: 1045460 - DNA, 15 bp, Homo sapiens
tgaagcagtcagccc

SEQ ID NO: 1045461 - DNA, 16 bp, Homo sapiens
tgaagcagtcttgctc

SEQ ID NO: 1045462 - DNA, 21 bp, Homo sapiens
tgaagcagtgcctcgaggcac

SEQ ID NO: 1045463 - DNA, 13 bp, Homo sapiens
tgaagcataattt

SEQ ID NO: 1045464 - DNA, 20 bp, Homo sapiens
tgaagcatagctacaatttg

SEQ ID NO: 1045465 - DNA, 12 bp, Homo sapiens
tgaagcatgctt

SEQ ID NO: 1045466 - DNA, 20 bp, Homo sapiens
tgaagcatgtttcatgtttt

SEQ ID NO: 1045467 - DNA, 20 bp, Homo sapiens
tgaagcatttcaaagccctg

SEQ ID NO: 1045468 - DNA, 14 bp, Homo sapiens
tgaagccaaagaaa

SEQ ID NO: 1045469 - DNA, 23 bp, Homo sapiens
tgaagccaagtggggtgctggga

SEQ ID NO: 1045470 - DNA, 19 bp, Homo sapiens
tgaagccaattcagacagg

SEQ ID NO: 1045471 - DNA, 18 bp, Homo sapiens
tgaagccacttggcccag

SEQ ID NO: 1045472 - DNA, 19 bp, Homo sapiens
tgaagccacttggcccaga

SEQ ID NO: 1045473 - DNA, 11 bp, Homo sapiens
tgaagccagat

SEQ ID NO: 1045474 - DNA, 16 bp, Homo sapiens
tgaagccagatccacc

SEQ ID NO: 1045475 - DNA, 19 bp, Homo sapiens
tgaagccagatccacccta

SEQ ID NO: 1045476 - DNA, 23 bp, Homo sapiens
tgaagccagctcacagtgctgtg

SEQ ID NO: 1045477 - DNA, 21 bp, Homo sapiens
tgaagccatgagttccagaaa

SEQ ID NO: 1045478 - DNA, 13 bp, Homo sapiens
tgaagccatgtct

SEQ ID NO: 1045479 - DNA, 17 bp, Homo sapiens
tgaagcccagcgacaca

SEQ ID NO: 1045480 - DNA, 19 bp, Homo sapiens
ggagcagggaaggcctgac

SEQ ID NO: 1045481 - DNA, 15 bp, Homo sapiens
ggagcaggtggcttg

SEQ ID NO: 1045482 - DNA, 19 bp, Homo sapiens
ggagcagttttcccctggc

SEQ ID NO: 1045483 - DNA, 18 bp, Homo sapiens
ggagcatagaagccacat

SEQ ID NO: 1045484 - DNA, 14 bp, Homo sapiens
ggagcatcagccag

SEQ ID NO: 1045485 - DNA, 13 bp, Homo sapiens
ggagcatcccagg

SEQ ID NO: 1045486 - DNA, 14 bp, Homo sapiens
ggagcatcccggag

SEQ ID NO: 1045487 - DNA, 16 bp, Homo sapiens
ggagcatctcttgagg

SEQ ID NO: 1045488 - DNA, 15 bp, Homo sapiens
ggagcatgcttacct

SEQ ID NO: 1045489 - DNA, 24 bp, Homo sapiens
ggagcatttaatggcagctagtgc

SEQ ID NO: 1045490 - DNA, 16 bp, Homo sapiens
ggagccacaggcaggg

SEQ ID NO: 1045491 - DNA, 22 bp, Homo sapiens
ggagccacaggcaggggtgaga

SEQ ID NO: 1045492 - DNA, 23 bp, Homo sapiens
ggagccacgcctatgccctgccc

SEQ ID NO: 1045493 - DNA, 21 bp, Homo sapiens
ggagccactcctctgactcag

SEQ ID NO: 1045494 - DNA, 15 bp, Homo sapiens
ggagccacttctccc

SEQ ID NO: 1045495 - DNA, 23 bp, Homo sapiens
ggagccagctgcttgacctagct

SEQ ID NO: 1045496 - DNA, 16 bp, Homo sapiens
ggagccagctgctttt

SEQ ID NO: 1045497 - DNA, 11 bp, Homo sapiens
ggagccagggc

SEQ ID NO: 1045498 - DNA, 14 bp, Homo sapiens
ggagccagggcaga

SEQ ID NO: 1045499 - DNA, 12 bp, Homo sapiens
ggagccagggta

SEQ ID NO: 1045500 - DNA, 15 bp, Homo sapiens
ggagccagtcctcca

SEQ ID NO: 1045501 - DNA, 19 bp, Homo sapiens
ggagccatcaccctcaccc

SEQ ID NO: 1045502 - DNA, 20 bp, Homo sapiens
ggagccatcccttcggagcc

SEQ ID NO: 1045503 - DNA, 21 bp, Homo sapiens
ggagccatcccttcggagcca

SEQ ID NO: 1045504 - DNA, 20 bp, Homo sapiens
ggagccatggaaggtgccag

SEQ ID NO: 1045505 - DNA, 18 bp, Homo sapiens
ggagccattgaacagctg

SEQ ID NO: 1045506 - DNA, 19 bp, Homo sapiens
ggagccattgaacagctgt

SEQ ID NO: 1045507 - DNA, 22 bp, Homo sapiens
ggagccattgaacagctgtgag

SEQ ID NO: 1045508 - DNA, 14 bp, Homo sapiens
ggagccatttgaga

SEQ ID NO: 1045509 - DNA, 13 bp, Homo sapiens
ggagcccacaacc

SEQ ID NO: 1045510 - DNA, 14 bp, Homo sapiens
ggagcccacaacct

SEQ ID NO: 1045511 - DNA, 23 bp, Homo sapiens
ggagcccacagcgagcctgtgcc

SEQ ID NO: 1045512 - DNA, 12 bp, Homo sapiens
ggagcccagcct

SEQ ID NO: 1045513 - DNA, 17 bp, Homo sapiens
ggagcccagcctgggag

SEQ ID NO: 1045514 - DNA, 19 bp, Homo sapiens
ggagcccagcctgggagcc

SEQ ID NO: 1045515 - DNA, 20 bp, Homo sapiens
ggagcccagcctgggagccc

SEQ ID NO: 1045516 - DNA, 12 bp, Homo sapiens
ggagcccagggc

SEQ ID NO: 1045517 - DNA, 12 bp, Homo sapiens
ggagcccagtgg

SEQ ID NO: 1045518 - DNA, 19 bp, Homo sapiens
ggagcccatactcagcctg

SEQ ID NO: 1045519 - DNA, 21 bp, Homo sapiens
ggagcccataggccaccccct

SEQ ID NO: 1045520 - DNA, 17 bp, Homo sapiens
ggagccccagctaccct

SEQ ID NO: 1045521 - DNA, 14 bp, Homo sapiens
ggagccccaggcct

SEQ ID NO: 1045522 - DNA, 14 bp, Homo sapiens
ggagccccagggtc

SEQ ID NO: 1045523 - DNA, 16 bp, Homo sapiens
ggagccccattcctgg

SEQ ID NO: 1045524 - DNA, 20 bp, Homo sapiens
ggagcccccaacacaggcaa

SEQ ID NO: 1045525 - DNA, 14 bp, Homo sapiens
ggagcccccagata

SEQ ID NO: 1045526 - DNA, 22 bp, Homo sapiens
ggagcccccagcagaggcaggc

SEQ ID NO: 1045527 - DNA, 20 bp, Homo sapiens
ggagcccccgccccgcccca

SEQ ID NO: 1045528 - DNA, 15 bp, Homo sapiens
ggagccccctctgcc

SEQ ID NO: 1045529 - DNA, 11 bp, Homo sapiens
ggagcccctga

SEQ ID NO: 1045530 - DNA, 15 bp, Homo sapiens
ggagcccctgggtgg

SEQ ID NO: 1045531 - DNA, 21 bp, Homo sapiens
ggagcccgcacccccaccctt

SEQ ID NO: 1045532 - DNA, 20 bp, Homo sapiens
ggagcccgcttcaagctctc

SEQ ID NO: 1045533 - DNA, 12 bp, Homo sapiens
ggagccctcaga

SEQ ID NO: 1045534 - DNA, 14 bp, Homo sapiens
ggagccctcaggct

SEQ ID NO: 1045535 - DNA, 15 bp, Homo sapiens
ggagccctcaggctc

SEQ ID NO: 1045536 - DNA, 18 bp, Homo sapiens
ggagccctcaggctcccc

SEQ ID NO: 1045537 - DNA, 19 bp, Homo sapiens
ggagccctcaggctcccca

SEQ ID NO: 1045538 - DNA, 19 bp, Homo sapiens
ggagccctgaccttggctg

SEQ ID NO: 1045539 - DNA, 22 bp, Homo sapiens
ggagccctgaccttggctgact

SEQ ID NO: 1045540 - DNA, 21 bp, Homo sapiens
ggagccctgaggacctctcag

SEQ ID NO: 1045541 - DNA, 20 bp, Homo sapiens
ggagccctgggcggagtccc

SEQ ID NO: 1045542 - DNA, 22 bp, Homo sapiens
ggagccctgttggcagctctag

SEQ ID NO: 1045543 - DNA, 15 bp, Homo sapiens
ggagccgaagcccag

SEQ ID NO: 1045544 - DNA, 21 bp, Homo sapiens
ggagccgagatcacgccactg

SEQ ID NO: 1045545 - DNA, 21 bp, Homo sapiens
ggagccgaggcctaccccgca

SEQ ID NO: 1045546 - DNA, 13 bp, Homo sapiens
ggagccgcagcag

SEQ ID NO: 1045547 - DNA, 13 bp, Homo sapiens
ggagccgctggca

SEQ ID NO: 1045548 - DNA, 18 bp, Homo sapiens
ggagccgggaccctcagg

SEQ ID NO: 1045549 - DNA, 18 bp, Homo sapiens
ggagccggtaactgtcct

SEQ ID NO: 1045550 - DNA, 19 bp, Homo sapiens
ggagccggtaactgtcctg

SEQ ID NO: 1045551 - DNA, 20 bp, Homo sapiens
ggagccggtaactgtcctgt

SEQ ID NO: 1045552 - DNA, 20 bp, Homo sapiens
ggagcctagcggagcccagc

SEQ ID NO: 1045553 - DNA, 15 bp, Homo sapiens
ggagcctagctcctg

SEQ ID NO: 1045554 - DNA, 21 bp, Homo sapiens
ggagcctcatccgaggcaggg

SEQ ID NO: 1045555 - DNA, 23 bp, Homo sapiens
ggagcctcatgttctcttcccag

SEQ ID NO: 1045556 - DNA, 21 bp, Homo sapiens
ggagcctccccatctgtccag

SEQ ID NO: 1045557 - DNA, 19 bp, Homo sapiens
ggagcctccccctcagatg

SEQ ID NO: 1045558 - DNA, 16 bp, Homo sapiens
ggagcctcgcccctcc

SEQ ID NO: 1045559 - DNA, 14 bp, Homo sapiens
ggagcctctggctt

SEQ ID NO: 1045560 - DNA, 12 bp, Homo sapiens
ggagcctctttt

SEQ ID NO: 1045561 - DNA, 16 bp, Homo sapiens
ggagcctgaggcagga

SEQ ID NO: 1045562 - DNA, 17 bp, Homo sapiens
ggagcctgaggcaggag

SEQ ID NO: 1045563 - DNA, 22 bp, Homo sapiens
ggagcctgcaaactcactgctc

SEQ ID NO: 1045564 - DNA, 11 bp, Homo sapiens
ggagcctgcag

SEQ ID NO: 1045565 - DNA, 16 bp, Homo sapiens
ggagcctgcagggtgg

SEQ ID NO: 1045566 - DNA, 14 bp, Homo sapiens
ggagcctgctctcc

SEQ ID NO: 1045567 - DNA, 14 bp, Homo sapiens
ggagcctggaactg

SEQ ID NO: 1045568 - DNA, 22 bp, Homo sapiens
ggagccttcccaagttgtgctt

SEQ ID NO: 1045569 - DNA, 18 bp, Homo sapiens
ggagcgaggtcagaggag

SEQ ID NO: 1045570 - DNA, 15 bp, Homo sapiens
ggagcgatccagggg

SEQ ID NO: 1045571 - DNA, 21 bp, Homo sapiens
ggagcgcacctgccccctggt

SEQ ID NO: 1045572 - DNA, 14 bp, Homo sapiens
ggagcgctagtgcc

SEQ ID NO: 1045573 - DNA, 18 bp, Homo sapiens
ggagcgctagtgccttgc

SEQ ID NO: 1045574 - DNA, 20 bp, Homo sapiens
ggagcggccggccagcccct

SEQ ID NO: 1045575 - DNA, 13 bp, Homo sapiens
ggagcggggggga

SEQ ID NO: 1045576 - DNA, 16 bp, Homo sapiens
ggagcgtctgggaact

SEQ ID NO: 1045577 - DNA, 17 bp, Homo sapiens
ggagctaacactggccc

SEQ ID NO: 1045578 - DNA, 18 bp, Homo sapiens
ggagctactgacattcct

SEQ ID NO: 1045579 - DNA, 22 bp, Homo sapiens
ggagctatcaggaacagctatg

SEQ ID NO: 1045580 - DNA, 12 bp, Homo sapiens
ggagctcaccct

SEQ ID NO: 1045581 - DNA, 16 bp, Homo sapiens
ggagctcaccctgccc

SEQ ID NO: 1045582 - DNA, 12 bp, Homo sapiens
ggagctcagccc

SEQ ID NO: 1045583 - DNA, 20 bp, Homo sapiens
ggagctccactctgcttctc

SEQ ID NO: 1045584 - DNA, 18 bp, Homo sapiens
ggagctcgcccctcccct

SEQ ID NO: 1045585 - DNA, 19 bp, Homo sapiens
ggagctctgcgccaggcag

SEQ ID NO: 1045586 - DNA, 15 bp, Homo sapiens
ggagctcttggaaga

SEQ ID NO: 1045587 - DNA, 20 bp, Homo sapiens
ggagctcttggaagagctct

SEQ ID NO: 1045588 - DNA, 20 bp, Homo sapiens
ggagctgagggagggagcca

SEQ ID NO: 1045589 - DNA, 21 bp, Homo sapiens
ggagctgagggagggagccat

SEQ ID NO: 1045590 - DNA, 18 bp, Homo sapiens
ggagctgagtcacctcct

SEQ ID NO: 1045591 - DNA, 16 bp, Homo sapiens
ggagctgagtggggga

SEQ ID NO: 1045592 - DNA, 20 bp, Homo sapiens
ggagctgatgccccttctcc

SEQ ID NO: 1045593 - DNA, 22 bp, Homo sapiens
ggagctgatttccaggcccctg

SEQ ID NO: 1045594 - DNA, 16 bp, Homo sapiens
ggagctgcagagcagc

SEQ ID NO: 1045595 - DNA, 19 bp, Homo sapiens
ggagctgccacagagaagt

SEQ ID NO: 1045596 - DNA, 17 bp, Homo sapiens
ggagctgccttggctca

SEQ ID NO: 1045597 - DNA, 21 bp, Homo sapiens
ggagctgccttggctcagaca

SEQ ID NO: 1045598 - DNA, 16 bp, Homo sapiens
ggagctgcgccggaca

SEQ ID NO: 1045599 - DNA, 22 bp, Homo sapiens
ggagctgcgcttccctgcagtc

SEQ ID NO: 1045600 - DNA, 12 bp, Homo sapiens
ggagctgctggc

SEQ ID NO: 1045601 - DNA, 21 bp, Homo sapiens
ggagctgctggctgacctggg

SEQ ID NO: 1045602 - DNA, 14 bp, Homo sapiens
ggagctgctgggct

SEQ ID NO: 1045603 - DNA, 15 bp, Homo sapiens
ggagctgctgggcta

SEQ ID NO: 1045604 - DNA, 12 bp, Homo sapiens
ggagctggaacc

SEQ ID NO: 1045605 - DNA, 18 bp, Homo sapiens
tgaagccgactctggccc

SEQ ID NO: 1045606 - DNA, 20 bp, Homo sapiens
tgaagccgactctggccctg

SEQ ID NO: 1045607 - DNA, 15 bp, Homo sapiens
tgaagcctccgtgga

SEQ ID NO: 1045608 - DNA, 20 bp, Homo sapiens
tgaagcctctgccctgcctc

SEQ ID NO: 1045609 - DNA, 21 bp, Homo sapiens
tgaagcctctgccctgcctcc

SEQ ID NO: 1045610 - DNA, 16 bp, Homo sapiens
tgaagccttcttctgc

SEQ ID NO: 1045611 - DNA, 17 bp, Homo sapiens
tgaagcctttggtgaat

SEQ ID NO: 1045612 - DNA, 14 bp, Homo sapiens
tgaagcgtgttttt

SEQ ID NO: 1045613 - DNA, 18 bp, Homo sapiens
tgaagctaaaaggaaaag

SEQ ID NO: 1045614 - DNA, 15 bp, Homo sapiens
tgaagctaagattta

SEQ ID NO: 1045615 - DNA, 14 bp, Homo sapiens
tgaagctaatacaa

SEQ ID NO: 1045616 - DNA, 15 bp, Homo sapiens
tgaagctaatgtcac

SEQ ID NO: 1045617 - DNA, 17 bp, Homo sapiens
tgaagctcacactgatg

SEQ ID NO: 1045618 - DNA, 19 bp, Homo sapiens
tgaagctcgcatccagaca

SEQ ID NO: 1045619 - DNA, 21 bp, Homo sapiens
tgaagctcgcatccagacagt

SEQ ID NO: 1045620 - DNA, 13 bp, Homo sapiens
tgaagctgctgtg

SEQ ID NO: 1045621 - DNA, 18 bp, Homo sapiens
tgaagctgctgtgtcctc

SEQ ID NO: 1045622 - DNA, 14 bp, Homo sapiens
tgaagctggagcag

SEQ ID NO: 1045623 - DNA, 15 bp, Homo sapiens
tgaagctggagcagc

SEQ ID NO: 1045624 - DNA, 18 bp, Homo sapiens
tgaagctgggctgtctct

SEQ ID NO: 1045625 - DNA, 16 bp, Homo sapiens
tgaagctgttgtgtga

SEQ ID NO: 1045626 - DNA, 13 bp, Homo sapiens
tgaagcttcatgc

SEQ ID NO: 1045627 - DNA, 15 bp, Homo sapiens
tgaagcttgactccc

SEQ ID NO: 1045628 - DNA, 21 bp, Homo sapiens
tgaagcttgcaccttttcatg

SEQ ID NO: 1045629 - DNA, 23 bp, Homo sapiens
tgaaggaaaaacacaagcaaaaa

SEQ ID NO: 1045630 - DNA, 22 bp, Homo sapiens
tgaaggaaaagcaagaaacagt

SEQ ID NO: 1045631 - DNA, 15 bp, Homo sapiens
tgaaggaacttgtct

SEQ ID NO: 1045632 - DNA, 19 bp, Homo sapiens
tgaaggaatagccagagag

SEQ ID NO: 1045633 - DNA, 20 bp, Homo sapiens
tgaaggaatagccagagagg

SEQ ID NO: 1045634 - DNA, 14 bp, Homo sapiens
tgaaggaatatatg

SEQ ID NO: 1045635 - DNA, 23 bp, Homo sapiens
tgaaggaatatatggcagagttg

SEQ ID NO: 1045636 - DNA, 15 bp, Homo sapiens
tgaaggaattacatt

SEQ ID NO: 1045637 - DNA, 18 bp, Homo sapiens
tgaaggacacttcctgcc

SEQ ID NO: 1045638 - DNA, 14 bp, Homo sapiens
tgaaggaccccagg

SEQ ID NO: 1045639 - DNA, 15 bp, Homo sapiens
tgaaggaccccaggt

SEQ ID NO: 1045640 - DNA, 17 bp, Homo sapiens
tgaaggactaatagaaa

SEQ ID NO: 1045641 - DNA, 20 bp, Homo sapiens
tgaaggactaatagaaaagt

SEQ ID NO: 1045642 - DNA, 22 bp, Homo sapiens
tgaaggactaatagaaaagtat

SEQ ID NO: 1045643 - DNA, 22 bp, Homo sapiens
tgaaggagccccattcctggga

SEQ ID NO: 1045644 - DNA, 17 bp, Homo sapiens
tgaaggaggtcaggccc

SEQ ID NO: 1045645 - DNA, 13 bp, Homo sapiens
tgaaggaggtgag

SEQ ID NO: 1045646 - DNA, 13 bp, Homo sapiens
tgaaggatggtta

SEQ ID NO: 1045647 - DNA, 13 bp, Homo sapiens
tgaaggattgcat

SEQ ID NO: 1045648 - DNA, 18 bp, Homo sapiens
tgaaggattgcatcctgc

SEQ ID NO: 1045649 - DNA, 21 bp, Homo sapiens
tgaaggattgcatcctgctgg

SEQ ID NO: 1045650 - DNA, 23 bp, Homo sapiens
tgaaggcaaaaactgtactgtgt

SEQ ID NO: 1045651 - DNA, 15 bp, Homo sapiens
tgaaggcagaaagca

SEQ ID NO: 1045652 - DNA, 18 bp, Homo sapiens
tgaaggcagtctgaaccc

SEQ ID NO: 1045653 - DNA, 19 bp, Homo sapiens
tgaaggcccaagagcagag

SEQ ID NO: 1045654 - DNA, 15 bp, Homo sapiens
tgaaggccctgctga

SEQ ID NO: 1045655 - DNA, 17 bp, Homo sapiens
tgaaggctaaaaagcaa

SEQ ID NO: 1045656 - DNA, 23 bp, Homo sapiens
tgaaggctctcacccccatccct

SEQ ID NO: 1045657 - DNA, 15 bp, Homo sapiens
tgaaggctgtatcta

SEQ ID NO: 1045658 - DNA, 19 bp, Homo sapiens
tgaaggctgtatctatttt

SEQ ID NO: 1045659 - DNA, 18 bp, Homo sapiens
tgaagggaaaggatattt

SEQ ID NO: 1045660 - DNA, 21 bp, Homo sapiens
tgaagggaaaggatattttct

SEQ ID NO: 1045661 - DNA, 22 bp, Homo sapiens
tgaagggaaaggatattttctt

SEQ ID NO: 1045662 - DNA, 15 bp, Homo sapiens
tgaagggaagagaca

SEQ ID NO: 1045663 - DNA, 23 bp, Homo sapiens
tgaagggaaggcaaaggcagagg

SEQ ID NO: 1045664 - DNA, 17 bp, Homo sapiens
tgaagggaccctttggg

SEQ ID NO: 1045665 - DNA, 14 bp, Homo sapiens
tgaagggagagcca

SEQ ID NO: 1045666 - DNA, 15 bp, Homo sapiens
tgaagggcaagaaat

SEQ ID NO: 1045667 - DNA, 21 bp, Homo sapiens
tgaagggcatacaatgaaaag

SEQ ID NO: 1045668 - DNA, 13 bp, Homo sapiens
tgaagggctggaa

SEQ ID NO: 1045669 - DNA, 16 bp, Homo sapiens
tgaaggggaaacacac

SEQ ID NO: 1045670 - DNA, 19 bp, Homo sapiens
tgaaggggcacaccactgc

SEQ ID NO: 1045671 - DNA, 10 bp, Homo sapiens
tgaaggggcg

SEQ ID NO: 1045672 - DNA, 12 bp, Homo sapiens
tgaaggggcggg

SEQ ID NO: 1045673 - DNA, 21 bp, Homo sapiens
tgaagggggtaccttaagaga

SEQ ID NO: 1045674 - DNA, 17 bp, Homo sapiens
tgaaggtattggcctgt

SEQ ID NO: 1045675 - DNA, 18 bp, Homo sapiens
tgaaggtattggcctgtt

SEQ ID NO: 1045676 - DNA, 22 bp, Homo sapiens
tgaaggtctgtcataggactct

SEQ ID NO: 1045677 - DNA, 22 bp, Homo sapiens
tgaaggtctttgttatgacagt

SEQ ID NO: 1045678 - DNA, 15 bp, Homo sapiens
tgaaggtgacagcag

SEQ ID NO: 1045679 - DNA, 19 bp, Homo sapiens
tgaaggtgataagggaaaa

SEQ ID NO: 1045680 - DNA, 15 bp, Homo sapiens
tgaaggttaggattt

SEQ ID NO: 1045681 - DNA, 17 bp, Homo sapiens
tgaaggttcccaaggac

SEQ ID NO: 1045682 - DNA, 22 bp, Homo sapiens
tgaaggtttacaatttacaaag

SEQ ID NO: 1045683 - DNA, 16 bp, Homo sapiens
tgaagtaaattaaaca

SEQ ID NO: 1045684 - DNA, 15 bp, Homo sapiens
tgaagtaaattatgt

SEQ ID NO: 1045685 - DNA, 16 bp, Homo sapiens
tgaagtaaattatgta

SEQ ID NO: 1045686 - DNA, 21 bp, Homo sapiens
tgaagtaatatgcacacattt

SEQ ID NO: 1045687 - DNA, 22 bp, Homo sapiens
tgaagtaatatgcacacatttt

SEQ ID NO: 1045688 - DNA, 15 bp, Homo sapiens
tgaagtacaaacatg

SEQ ID NO: 1045689 - DNA, 16 bp, Homo sapiens
tgaagtacaaacatga

SEQ ID NO: 1045690 - DNA, 17 bp, Homo sapiens
tgaagtacaaacatgaa

SEQ ID NO: 1045691 - DNA, 20 bp, Homo sapiens
tgaagtacaaacatgaaaaa

SEQ ID NO: 1045692 - DNA, 15 bp, Homo sapiens
tgaagtacacctgtg

SEQ ID NO: 1045693 - DNA, 22 bp, Homo sapiens
tgaagtacagcataagggaatc

SEQ ID NO: 1045694 - DNA, 13 bp, Homo sapiens
tgaagtagatggt

SEQ ID NO: 1045695 - DNA, 15 bp, Homo sapiens
tgaagtagtttgtat

SEQ ID NO: 1045696 - DNA, 13 bp, Homo sapiens
tgaagtatacttt

SEQ ID NO: 1045697 - DNA, 13 bp, Homo sapiens
tgaagtatctttg

SEQ ID NO: 1045698 - DNA, 18 bp, Homo sapiens
tgaagtcacatcacagga

SEQ ID NO: 1045699 - DNA, 14 bp, Homo sapiens
tgaagtcactgcac

SEQ ID NO: 1045700 - DNA, 20 bp, Homo sapiens
tgaagtcagccacactgggc

SEQ ID NO: 1045701 - DNA, 23 bp, Homo sapiens
tgaagtccaaattgtttgtacag

SEQ ID NO: 1045702 - DNA, 13 bp, Homo sapiens
tgaagtccttcag

SEQ ID NO: 1045703 - DNA, 18 bp, Homo sapiens
tgaagtcgagcactctaa

SEQ ID NO: 1045704 - DNA, 20 bp, Homo sapiens
tgaagtcgagcactctaatt

SEQ ID NO: 1045705 - DNA, 20 bp, Homo sapiens
tgaagtcgggtcaaaaataa

SEQ ID NO: 1045706 - DNA, 15 bp, Homo sapiens
tgaagtctagaatca

SEQ ID NO: 1045707 - DNA, 19 bp, Homo sapiens
tgaagtctagaatcatact

SEQ ID NO: 1045708 - DNA, 16 bp, Homo sapiens
tgaagtcttccctcag

SEQ ID NO: 1045709 - DNA, 22 bp, Homo sapiens
tgaagtcttccctcagatttcc

SEQ ID NO: 1045710 - DNA, 14 bp, Homo sapiens
tgaagtcttttctg

SEQ ID NO: 1045711 - DNA, 17 bp, Homo sapiens
tgaagtgagcacagcct

SEQ ID NO: 1045712 - DNA, 18 bp, Homo sapiens
tgaagtgcctactggggg

SEQ ID NO: 1045713 - DNA, 17 bp, Homo sapiens
tgaagtgcgtgaatgta

SEQ ID NO: 1045714 - DNA, 14 bp, Homo sapiens
tgaagtggccctcc

SEQ ID NO: 1045715 - DNA, 14 bp, Homo sapiens
tgaagtggcctctt

SEQ ID NO: 1045716 - DNA, 21 bp, Homo sapiens
tgaagtggttgcattctacta

SEQ ID NO: 1045717 - DNA, 23 bp, Homo sapiens
tgaagtggtttgcaggtcagcct

SEQ ID NO: 1045718 - DNA, 22 bp, Homo sapiens
tgaagtgtacctgtgtacataa

SEQ ID NO: 1045719 - DNA, 18 bp, Homo sapiens
tgaagtgtaggcagacac

SEQ ID NO: 1045720 - DNA, 14 bp, Homo sapiens
tgaagtgtggctgg

SEQ ID NO: 1045721 - DNA, 18 bp, Homo sapiens
tgaagtgtggctggtgtc

SEQ ID NO: 1045722 - DNA, 15 bp, Homo sapiens
tgaagtgtgggataa

SEQ ID NO: 1045723 - DNA, 19 bp, Homo sapiens
tgaagtgtgtggctgggcg

SEQ ID NO: 1045724 - DNA, 17 bp, Homo sapiens
tgaagtgttctgagctg

SEQ ID NO: 1045725 - DNA, 22 bp, Homo sapiens
tgaagttaaaacacctttcctt

SEQ ID NO: 1045726 - DNA, 14 bp, Homo sapiens
tgaagttaacagag

SEQ ID NO: 1045727 - DNA, 15 bp, Homo sapiens
tgaagttagtggaaa

SEQ ID NO: 1045728 - DNA, 19 bp, Homo sapiens
tgaagttcatggtgatcag

SEQ ID NO: 1045729 - DNA, 15 bp, Homo sapiens
ggagctggccccgcc

SEQ ID NO: 1045730 - DNA, 20 bp, Homo sapiens
ggagctggccccgccgcctg

SEQ ID NO: 1045731 - DNA, 21 bp, Homo sapiens
ggagctggcggggaaccctgg

SEQ ID NO: 1045732 - DNA, 19 bp, Homo sapiens
ggagctggctgtgcctgct

SEQ ID NO: 1045733 - DNA, 16 bp, Homo sapiens
ggagctgggcccctgc

SEQ ID NO: 1045734 - DNA, 17 bp, Homo sapiens
ggagctgggcccctgca

SEQ ID NO: 1045735 - DNA, 17 bp, Homo sapiens
ggagctggtgacagcct

SEQ ID NO: 1045736 - DNA, 18 bp, Homo sapiens
ggagctggtgacagcctt

SEQ ID NO: 1045737 - DNA, 18 bp, Homo sapiens
ggagctggttagaaatgc

SEQ ID NO: 1045738 - DNA, 23 bp, Homo sapiens
ggagctggttagaaatgcagaat

SEQ ID NO: 1045739 - DNA, 21 bp, Homo sapiens
ggagctggttcctctctccca

SEQ ID NO: 1045740 - DNA, 16 bp, Homo sapiens
ggagcttaagaaagaa

SEQ ID NO: 1045741 - DNA, 14 bp, Homo sapiens
ggagcttacccaag

SEQ ID NO: 1045742 - DNA, 18 bp, Homo sapiens
ggagcttcctggctctgg

SEQ ID NO: 1045743 - DNA, 17 bp, Homo sapiens
ggagcttcggggcctcc

SEQ ID NO: 1045744 - DNA, 20 bp, Homo sapiens
ggagcttcttgtttccttgt

SEQ ID NO: 1045745 - DNA, 19 bp, Homo sapiens
ggagcttgggactcaggtc

SEQ ID NO: 1045746 - DNA, 20 bp, Homo sapiens
ggagctttcaaagaaggaat

SEQ ID NO: 1045747 - DNA, 18 bp, Homo sapiens
ggagctttctcaatgtct

SEQ ID NO: 1045748 - DNA, 19 bp, Homo sapiens
ggagctttctcaatgtctt

SEQ ID NO: 1045749 - DNA, 23 bp, Homo sapiens
ggagctttctcaatgtcttccca

SEQ ID NO: 1045750 - DNA, 23 bp, Homo sapiens
ggagctttttcagaaacagggca

SEQ ID NO: 1045751 - DNA, 17 bp, Homo sapiens
ggaggaaaaaagaacca

SEQ ID NO: 1045752 - DNA, 22 bp, Homo sapiens
ggaggaaaaccaagccgtggct

SEQ ID NO: 1045753 - DNA, 17 bp, Homo sapiens
ggaggaaaaggcccctg

SEQ ID NO: 1045754 - DNA, 22 bp, Homo sapiens
ggaggaaacagttctcactggg

SEQ ID NO: 1045755 - DNA, 19 bp, Homo sapiens
ggaggaaagggcctggcca

SEQ ID NO: 1045756 - DNA, 23 bp, Homo sapiens
ggaggaaatttgaatgggtccat

SEQ ID NO: 1045757 - DNA, 19 bp, Homo sapiens
ggaggaaccagagtgctga

SEQ ID NO: 1045758 - DNA, 15 bp, Homo sapiens
ggaggaacgggcagc

SEQ ID NO: 1045759 - DNA, 20 bp, Homo sapiens
ggaggaacgggcagccacag

SEQ ID NO: 1045760 - DNA, 18 bp, Homo sapiens
ggaggaagagccacctgc

SEQ ID NO: 1045761 - DNA, 20 bp, Homo sapiens
ggaggaagttctccagcttc

SEQ ID NO: 1045762 - DNA, 21 bp, Homo sapiens
ggaggaagttctccagcttca

SEQ ID NO: 1045763 - DNA, 18 bp, Homo sapiens
ggaggaatcactggggat

SEQ ID NO: 1045764 - DNA, 20 bp, Homo sapiens
ggaggaatcactggggatgg

SEQ ID NO: 1045765 - DNA, 22 bp, Homo sapiens
ggaggaatcgaggaaccagagc

SEQ ID NO: 1045766 - DNA, 23 bp, Homo sapiens
ggaggaatcgaggaaccagagcc

SEQ ID NO: 1045767 - DNA, 16 bp, Homo sapiens
ggaggaatgctccccc

SEQ ID NO: 1045768 - DNA, 17 bp, Homo sapiens
ggaggaatgctccccca

SEQ ID NO: 1045769 - DNA, 18 bp, Homo sapiens
ggaggaatgctcccccat

SEQ ID NO: 1045770 - DNA, 16 bp, Homo sapiens
ggaggaatgctggact

SEQ ID NO: 1045771 - DNA, 13 bp, Homo sapiens
ggaggacaggcag

SEQ ID NO: 1045772 - DNA, 16 bp, Homo sapiens
ggaggacaggcaggcc

SEQ ID NO: 1045773 - DNA, 22 bp, Homo sapiens
ggaggacaggcgggaggaggtg

SEQ ID NO: 1045774 - DNA, 19 bp, Homo sapiens
ggaggaccagggccctggg

SEQ ID NO: 1045775 - DNA, 13 bp, Homo sapiens
ggaggacccagga

SEQ ID NO: 1045776 - DNA, 14 bp, Homo sapiens
ggaggacccaggac

SEQ ID NO: 1045777 - DNA, 17 bp, Homo sapiens
ggaggaccccgagggct

SEQ ID NO: 1045778 - DNA, 16 bp, Homo sapiens
ggaggaccgttctctg

SEQ ID NO: 1045779 - DNA, 12 bp, Homo sapiens
ggaggacctggc

SEQ ID NO: 1045780 - DNA, 23 bp, Homo sapiens
ggaggacctggcgtgctcagacc

SEQ ID NO: 1045781 - DNA, 13 bp, Homo sapiens
ggaggacctgggg

SEQ ID NO: 1045782 - DNA, 18 bp, Homo sapiens
ggaggacctggggcacag

SEQ ID NO: 1045783 - DNA, 19 bp, Homo sapiens
ggaggacctggggcacagt

SEQ ID NO: 1045784 - DNA, 22 bp, Homo sapiens
ggaggacggttgtaagcagttg

SEQ ID NO: 1045785 - DNA, 19 bp, Homo sapiens
ggaggactccaggcagcag

SEQ ID NO: 1045786 - DNA, 15 bp, Homo sapiens
ggaggactgagcccc

SEQ ID NO: 1045787 - DNA, 20 bp, Homo sapiens
ggaggacttggagggtctgg

SEQ ID NO: 1045788 - DNA, 13 bp, Homo sapiens
ggaggagagaaga

SEQ ID NO: 1045789 - DNA, 16 bp, Homo sapiens
ggaggagagagagggg

SEQ ID NO: 1045790 - DNA, 15 bp, Homo sapiens
ggaggagagccactg

SEQ ID NO: 1045791 - DNA, 16 bp, Homo sapiens
ggaggagagccactgg

SEQ ID NO: 1045792 - DNA, 22 bp, Homo sapiens
ggaggagatgttgaggggagga

SEQ ID NO: 1045793 - DNA, 15 bp, Homo sapiens
ggaggagcacagttt

SEQ ID NO: 1045794 - DNA, 23 bp, Homo sapiens
ggaggagcagcaagaagcagcct

SEQ ID NO: 1045795 - DNA, 22 bp, Homo sapiens
ggaggagcagcctcgaggctgg

SEQ ID NO: 1045796 - DNA, 23 bp, Homo sapiens
ggaggagcagcctcgaggctggt

SEQ ID NO: 1045797 - DNA, 11 bp, Homo sapiens
ggaggagcctt

SEQ ID NO: 1045798 - DNA, 18 bp, Homo sapiens
ggaggagccttgctgggc

SEQ ID NO: 1045799 - DNA, 21 bp, Homo sapiens
ggaggagccttgctgggccag

SEQ ID NO: 1045800 - DNA, 23 bp, Homo sapiens
ggaggagccttgctgggccaggg

SEQ ID NO: 1045801 - DNA, 15 bp, Homo sapiens
ggaggagctgaggga

SEQ ID NO: 1045802 - DNA, 17 bp, Homo sapiens
ggaggagcttgggggat

SEQ ID NO: 1045803 - DNA, 16 bp, Homo sapiens
ggaggaggacacagca

SEQ ID NO: 1045804 - DNA, 12 bp, Homo sapiens
ggaggaggagat

SEQ ID NO: 1045805 - DNA, 13 bp, Homo sapiens
ggaggaggagcct

SEQ ID NO: 1045806 - DNA, 16 bp, Homo sapiens
ggaggaggaggagcct

SEQ ID NO: 1045807 - DNA, 16 bp, Homo sapiens
ggaggaggccacctct

SEQ ID NO: 1045808 - DNA, 12 bp, Homo sapiens
ggaggagggaga

SEQ ID NO: 1045809 - DNA, 14 bp, Homo sapiens
ggaggagggaggcg

SEQ ID NO: 1045810 - DNA, 15 bp, Homo sapiens
ggaggaggggaagaa

SEQ ID NO: 1045811 - DNA, 17 bp, Homo sapiens
ggaggaggggaagctgg

SEQ ID NO: 1045812 - DNA, 15 bp, Homo sapiens
ggaggagggggccgg

SEQ ID NO: 1045813 - DNA, 15 bp, Homo sapiens
ggaggagggttgtgc

SEQ ID NO: 1045814 - DNA, 22 bp, Homo sapiens
ggaggatcactggagcccagga

SEQ ID NO: 1045815 - DNA, 21 bp, Homo sapiens
ggaggatctcttgagcctggg

SEQ ID NO: 1045816 - DNA, 12 bp, Homo sapiens
ggaggatggaga

SEQ ID NO: 1045817 - DNA, 19 bp, Homo sapiens
ggaggattctttccccaga

SEQ ID NO: 1045818 - DNA, 20 bp, Homo sapiens
ggaggattgcttgagcccag

SEQ ID NO: 1045819 - DNA, 19 bp, Homo sapiens
ggaggcaacactgctgtcc

SEQ ID NO: 1045820 - DNA, 21 bp, Homo sapiens
ggaggcaacactgctgtccac

SEQ ID NO: 1045821 - DNA, 23 bp, Homo sapiens
ggaggcaagaggggtggagactg

SEQ ID NO: 1045822 - DNA, 16 bp, Homo sapiens
ggaggcaccagctctg

SEQ ID NO: 1045823 - DNA, 20 bp, Homo sapiens
ggaggcaccagctctgtggc

SEQ ID NO: 1045824 - DNA, 23 bp, Homo sapiens
ggaggcacctccaggcaggccag

SEQ ID NO: 1045825 - DNA, 19 bp, Homo sapiens
ggaggcagagcgggaggga

SEQ ID NO: 1045826 - DNA, 12 bp, Homo sapiens
ggaggcagcaga

SEQ ID NO: 1045827 - DNA, 17 bp, Homo sapiens
ggaggcagccagggctt

SEQ ID NO: 1045828 - DNA, 14 bp, Homo sapiens
ggaggcagcgtggg

SEQ ID NO: 1045829 - DNA, 13 bp, Homo sapiens
ggaggcagggcct

SEQ ID NO: 1045830 - DNA, 13 bp, Homo sapiens
ggaggcagggctg

SEQ ID NO: 1045831 - DNA, 14 bp, Homo sapiens
ggaggcagggctgg

SEQ ID NO: 1045832 - DNA, 13 bp, Homo sapiens
ggaggcaggggac

SEQ ID NO: 1045833 - DNA, 20 bp, Homo sapiens
ggaggcaggggacaagggag

SEQ ID NO: 1045834 - DNA, 14 bp, Homo sapiens
ggaggcaggggctg

SEQ ID NO: 1045835 - DNA, 14 bp, Homo sapiens
ggaggcatctgcac

SEQ ID NO: 1045836 - DNA, 19 bp, Homo sapiens
ggaggccaaggtgggcgga

SEQ ID NO: 1045837 - DNA, 17 bp, Homo sapiens
ggaggccaataaaaagt

SEQ ID NO: 1045838 - DNA, 23 bp, Homo sapiens
ggaggccaccccaaaccccagcc

SEQ ID NO: 1045839 - DNA, 12 bp, Homo sapiens
ggaggccacctc

SEQ ID NO: 1045840 - DNA, 18 bp, Homo sapiens
ggaggccacctctccaag

SEQ ID NO: 1045841 - DNA, 18 bp, Homo sapiens
ggaggccacgtcccaccc

SEQ ID NO: 1045842 - DNA, 19 bp, Homo sapiens
ggaggccacgtcccacccc

SEQ ID NO: 1045843 - DNA, 18 bp, Homo sapiens
ggaggccagagtctccca

SEQ ID NO: 1045844 - DNA, 20 bp, Homo sapiens
ggaggccagagtctcccagt

SEQ ID NO: 1045845 - DNA, 14 bp, Homo sapiens
ggaggcccaaatga

SEQ ID NO: 1045846 - DNA, 14 bp, Homo sapiens
ggaggcccaacctc

SEQ ID NO: 1045847 - DNA, 16 bp, Homo sapiens
ggaggcccaggctggg

SEQ ID NO: 1045848 - DNA, 20 bp, Homo sapiens
ggaggcccaggctgggaact

SEQ ID NO: 1045849 - DNA, 23 bp, Homo sapiens
ggaggccctcctgtgctggggga

SEQ ID NO: 1045850 - DNA, 13 bp, Homo sapiens
ggaggccctgcct

SEQ ID NO: 1045851 - DNA, 18 bp, Homo sapiens
ggaggccctgttccctgg

SEQ ID NO: 1045852 - DNA, 22 bp, Homo sapiens
ggaggccgcttagtgctgcttt

SEQ ID NO: 1045853 - DNA, 21 bp, Homo sapiens
tgaagttgctgtttatttttt

SEQ ID NO: 1045854 - DNA, 20 bp, Homo sapiens
tgaagttggcacatttcatg

SEQ ID NO: 1045855 - DNA, 17 bp, Homo sapiens
tgaagttggccaccttg

SEQ ID NO: 1045856 - DNA, 13 bp, Homo sapiens
tgaagtttcaagt

SEQ ID NO: 1045857 - DNA, 16 bp, Homo sapiens
tgaagtttccgccccc

SEQ ID NO: 1045858 - DNA, 15 bp, Homo sapiens
tgaagttttacattg

SEQ ID NO: 1045859 - DNA, 16 bp, Homo sapiens
tgaagttttacattgt

SEQ ID NO: 1045860 - DNA, 14 bp, Homo sapiens
tgaagttttccttg

SEQ ID NO: 1045861 - DNA, 17 bp, Homo sapiens
tgaataaaaaatagaca

SEQ ID NO: 1045862 - DNA, 15 bp, Homo sapiens
tgaataaaaagtgaa

SEQ ID NO: 1045863 - DNA, 18 bp, Homo sapiens
tgaataaaaagtgaactt

SEQ ID NO: 1045864 - DNA, 11 bp, Homo sapiens
tgaataaaaca

SEQ ID NO: 1045865 - DNA, 16 bp, Homo sapiens
tgaataaaacactcat

SEQ ID NO: 1045866 - DNA, 13 bp, Homo sapiens
tgaataaactgaa

SEQ ID NO: 1045867 - DNA, 14 bp, Homo sapiens
tgaataaactgaat

SEQ ID NO: 1045868 - DNA, 16 bp, Homo sapiens
tgaataaactgaatat

SEQ ID NO: 1045869 - DNA, 14 bp, Homo sapiens
tgaataaagaatgc

SEQ ID NO: 1045870 - DNA, 16 bp, Homo sapiens
tgaataaagaatgcca

SEQ ID NO: 1045871 - DNA, 15 bp, Homo sapiens
tgaataaagacacct

SEQ ID NO: 1045872 - DNA, 12 bp, Homo sapiens
tgaataaatgtc

SEQ ID NO: 1045873 - DNA, 14 bp, Homo sapiens
tgaataaatgtctt

SEQ ID NO: 1045874 - DNA, 18 bp, Homo sapiens
tgaataaattcagtattt

SEQ ID NO: 1045875 - DNA, 19 bp, Homo sapiens
tgaataaattctataggaa

SEQ ID NO: 1045876 - DNA, 21 bp, Homo sapiens
tgaataaattctataggaaca

SEQ ID NO: 1045877 - DNA, 19 bp, Homo sapiens
tgaataaattttcaaatcc

SEQ ID NO: 1045878 - DNA, 17 bp, Homo sapiens
tgaataagccattctga

SEQ ID NO: 1045879 - DNA, 13 bp, Homo sapiens
tgaataatacagt

SEQ ID NO: 1045880 - DNA, 17 bp, Homo sapiens
tgaataatgcctttgta

SEQ ID NO: 1045881 - DNA, 16 bp, Homo sapiens
tgaataatggaaaatg

SEQ ID NO: 1045882 - DNA, 19 bp, Homo sapiens
tgaataatggaaaatgcca

SEQ ID NO: 1045883 - DNA, 14 bp, Homo sapiens
tgaataatttccca

SEQ ID NO: 1045884 - DNA, 22 bp, Homo sapiens
tgaataatttcccaattaggaa

SEQ ID NO: 1045885 - DNA, 15 bp, Homo sapiens
tgaatacaaagtgat

SEQ ID NO: 1045886 - DNA, 17 bp, Homo sapiens
tgaatacaattaaaggt

SEQ ID NO: 1045887 - DNA, 17 bp, Homo sapiens
tgaataccactctgtaa

SEQ ID NO: 1045888 - DNA, 20 bp, Homo sapiens
tgaataccactctgtaattg

SEQ ID NO: 1045889 - DNA, 22 bp, Homo sapiens
tgaatacgctaagcctggaagc

SEQ ID NO: 1045890 - DNA, 20 bp, Homo sapiens
tgaatactatccatgtaata

SEQ ID NO: 1045891 - DNA, 22 bp, Homo sapiens
tgaatactctgccctctagagc

SEQ ID NO: 1045892 - DNA, 21 bp, Homo sapiens
tgaatactcttgaaaggccaa

SEQ ID NO: 1045893 - DNA, 14 bp, Homo sapiens
tgaatactgctaca

SEQ ID NO: 1045894 - DNA, 15 bp, Homo sapiens
tgaatactgtgaaaa

SEQ ID NO: 1045895 - DNA, 20 bp, Homo sapiens
tgaatacttactataatttg

SEQ ID NO: 1045896 - DNA, 23 bp, Homo sapiens
tgaatacttactataatttgact

SEQ ID NO: 1045897 - DNA, 16 bp, Homo sapiens
tgaatactttttacaa

SEQ ID NO: 1045898 - DNA, 17 bp, Homo sapiens
tgaatagaagcccaaat

SEQ ID NO: 1045899 - DNA, 22 bp, Homo sapiens
tgaatagatgtgcccttttata

SEQ ID NO: 1045900 - DNA, 13 bp, Homo sapiens
tgaatagcacagg

SEQ ID NO: 1045901 - DNA, 18 bp, Homo sapiens
tgaataggtagtatcata

SEQ ID NO: 1045902 - DNA, 13 bp, Homo sapiens
tgaatagttgctt

SEQ ID NO: 1045903 - DNA, 13 bp, Homo sapiens
tgaatataaaaaa

SEQ ID NO: 1045904 - DNA, 13 bp, Homo sapiens
tgaatataaatgt

SEQ ID NO: 1045905 - DNA, 17 bp, Homo sapiens
tgaatataacttttgtg

SEQ ID NO: 1045906 - DNA, 20 bp, Homo sapiens
tgaatataacttttgtggac

SEQ ID NO: 1045907 - DNA, 22 bp, Homo sapiens
tgaatataatatatttgtgtat

SEQ ID NO: 1045908 - DNA, 12 bp, Homo sapiens
tgaatataatga

SEQ ID NO: 1045909 - DNA, 21 bp, Homo sapiens
tgaatatacagcaggtgctca

SEQ ID NO: 1045910 - DNA, 19 bp, Homo sapiens
tgaatatactcattagaat

SEQ ID NO: 1045911 - DNA, 13 bp, Homo sapiens
tgaatatataaac

SEQ ID NO: 1045912 - DNA, 16 bp, Homo sapiens
tgaatatataaacact

SEQ ID NO: 1045913 - DNA, 17 bp, Homo sapiens
tgaatatataaacactc

SEQ ID NO: 1045914 - DNA, 18 bp, Homo sapiens
tgaatatattataatctt

SEQ ID NO: 1045915 - DNA, 23 bp, Homo sapiens
tgaatatatttaagcaacatctt

SEQ ID NO: 1045916 - DNA, 18 bp, Homo sapiens
tgaatatcattgatttta

SEQ ID NO: 1045917 - DNA, 14 bp, Homo sapiens
tgaatatctttcga

SEQ ID NO: 1045918 - DNA, 22 bp, Homo sapiens
tgaatatgatccctaatgtgtt

SEQ ID NO: 1045919 - DNA, 15 bp, Homo sapiens
tgaatattactctca

SEQ ID NO: 1045920 - DNA, 15 bp, Homo sapiens
tgaatattattcctc

SEQ ID NO: 1045921 - DNA, 18 bp, Homo sapiens
tgaatattcctggactta

SEQ ID NO: 1045922 - DNA, 11 bp, Homo sapiens
tgaatatttat

SEQ ID NO: 1045923 - DNA, 20 bp, Homo sapiens
tgaatatttatatttcacta

SEQ ID NO: 1045924 - DNA, 18 bp, Homo sapiens
tgaatatttggaattgaa

SEQ ID NO: 1045925 - DNA, 21 bp, Homo sapiens
tgaatatttgttatgtagata

SEQ ID NO: 1045926 - DNA, 18 bp, Homo sapiens
tgaatatttgttttaata

SEQ ID NO: 1045927 - DNA, 14 bp, Homo sapiens
tgaatattttggaa

SEQ ID NO: 1045928 - DNA, 23 bp, Homo sapiens
tgaatattttggaaactgctaaa

SEQ ID NO: 1045929 - DNA, 20 bp, Homo sapiens
tgaatcaaagtgtctagaca

SEQ ID NO: 1045930 - DNA, 13 bp, Homo sapiens
tgaatcaataata

SEQ ID NO: 1045931 - DNA, 16 bp, Homo sapiens
tgaatcaataatatat

SEQ ID NO: 1045932 - DNA, 17 bp, Homo sapiens
tgaatcaataatatatt

SEQ ID NO: 1045933 - DNA, 22 bp, Homo sapiens
tgaatcaataatatattttctg

SEQ ID NO: 1045934 - DNA, 13 bp, Homo sapiens
tgaatcaatcctg

SEQ ID NO: 1045935 - DNA, 15 bp, Homo sapiens
tgaatcaatgaaaaa

SEQ ID NO: 1045936 - DNA, 22 bp, Homo sapiens
tgaatcagaccctaccccacca

SEQ ID NO: 1045937 - DNA, 15 bp, Homo sapiens
tgaatcagctggaca

SEQ ID NO: 1045938 - DNA, 15 bp, Homo sapiens
tgaatcaggcaaagt

SEQ ID NO: 1045939 - DNA, 16 bp, Homo sapiens
tgaatcagtataaaca

SEQ ID NO: 1045940 - DNA, 21 bp, Homo sapiens
tgaatcagtataaacaaagtt

SEQ ID NO: 1045941 - DNA, 22 bp, Homo sapiens
tgaatcagtataaacaaagtta

SEQ ID NO: 1045942 - DNA, 15 bp, Homo sapiens
tgaatcatgagcctg

SEQ ID NO: 1045943 - DNA, 14 bp, Homo sapiens
tgaatcatgttaat

SEQ ID NO: 1045944 - DNA, 19 bp, Homo sapiens
tgaatcatgttaatagaca

SEQ ID NO: 1045945 - DNA, 19 bp, Homo sapiens
tgaatccaaatctgtcctc

SEQ ID NO: 1045946 - DNA, 21 bp, Homo sapiens
tgaatccaaatctgtcctctg

SEQ ID NO: 1045947 - DNA, 20 bp, Homo sapiens
tgaatcccatcaggctgtta

SEQ ID NO: 1045948 - DNA, 15 bp, Homo sapiens
tgaatccccgacccc

SEQ ID NO: 1045949 - DNA, 17 bp, Homo sapiens
tgaatccccgacccccc

SEQ ID NO: 1045950 - DNA, 15 bp, Homo sapiens
tgaatcctaagggct

SEQ ID NO: 1045951 - DNA, 18 bp, Homo sapiens
tgaatcctcagagagttg

SEQ ID NO: 1045952 - DNA, 22 bp, Homo sapiens
tgaatctataagtagtaaatca

SEQ ID NO: 1045953 - DNA, 12 bp, Homo sapiens
tgaatctatgcc

SEQ ID NO: 1045954 - DNA, 14 bp, Homo sapiens
tgaatctatgccaa

SEQ ID NO: 1045955 - DNA, 23 bp, Homo sapiens
tgaatctatggctttaaataaat

SEQ ID NO: 1045956 - DNA, 19 bp, Homo sapiens
tgaatctcccctcctcaca

SEQ ID NO: 1045957 - DNA, 14 bp, Homo sapiens
tgaatctctgtata

SEQ ID NO: 1045958 - DNA, 23 bp, Homo sapiens
tgaatctctgtatatttgattct

SEQ ID NO: 1045959 - DNA, 17 bp, Homo sapiens
tgaatctgaactgctct

SEQ ID NO: 1045960 - DNA, 14 bp, Homo sapiens
tgaatctgattgca

SEQ ID NO: 1045961 - DNA, 17 bp, Homo sapiens
tgaatctgattgcactg

SEQ ID NO: 1045962 - DNA, 13 bp, Homo sapiens
tgaatctgcaggg

SEQ ID NO: 1045963 - DNA, 20 bp, Homo sapiens
tgaatctgcagggagcaact

SEQ ID NO: 1045964 - DNA, 14 bp, Homo sapiens
tgaatctgggaggg

SEQ ID NO: 1045965 - DNA, 15 bp, Homo sapiens
tgaatctgtacatgt

SEQ ID NO: 1045966 - DNA, 18 bp, Homo sapiens
tgaatctgtgcaaacagt

SEQ ID NO: 1045967 - DNA, 20 bp, Homo sapiens
tgaatctgtgcaaacagtaa

SEQ ID NO: 1045968 - DNA, 21 bp, Homo sapiens
tgaatctgtgcaaacagtaac

SEQ ID NO: 1045969 - DNA, 14 bp, Homo sapiens
tgaatctgtgcctg

SEQ ID NO: 1045970 - DNA, 16 bp, Homo sapiens
tgaatctttcatacat

SEQ ID NO: 1045971 - DNA, 17 bp, Homo sapiens
tgaatctttcatacata

SEQ ID NO: 1045972 - DNA, 21 bp, Homo sapiens
tgaatctttcatacatatata

SEQ ID NO: 1045973 - DNA, 16 bp, Homo sapiens
tgaatctttctcctgg

SEQ ID NO: 1045974 - DNA, 19 bp, Homo sapiens
tgaatctttctcctggtga

SEQ ID NO: 1045975 - DNA, 21 bp, Homo sapiens
tgaatcttttttttatataaa

SEQ ID NO: 1045976 - DNA, 18 bp, Homo sapiens
tgaatgaaaaatttaagc

SEQ ID NO: 1045977 - DNA, 19 bp, Homo sapiens
tgaatgaaaaatttaagca

SEQ ID NO: 1045978 - DNA, 13 bp, Homo sapiens
ggaggcctcaggt

SEQ ID NO: 1045979 - DNA, 16 bp, Homo sapiens
ggaggcctcaggtgct

SEQ ID NO: 1045980 - DNA, 17 bp, Homo sapiens
ggaggcctcaggtgctg

SEQ ID NO: 1045981 - DNA, 19 bp, Homo sapiens
ggaggcctcaggtgctgtc

SEQ ID NO: 1045982 - DNA, 16 bp, Homo sapiens
ggaggcctctggccct

SEQ ID NO: 1045983 - DNA, 14 bp, Homo sapiens
ggaggcctgatgct

SEQ ID NO: 1045984 - DNA, 18 bp, Homo sapiens
ggaggccttccagctgct

SEQ ID NO: 1045985 - DNA, 17 bp, Homo sapiens
ggaggccttggggtggg

SEQ ID NO: 1045986 - DNA, 18 bp, Homo sapiens
ggaggccttggggtgggg

SEQ ID NO: 1045987 - DNA, 20 bp, Homo sapiens
ggaggccttggggtgggggc

SEQ ID NO: 1045988 - DNA, 22 bp, Homo sapiens
ggaggcgcagggacatggggca

SEQ ID NO: 1045989 - DNA, 13 bp, Homo sapiens
ggaggcggcagct

SEQ ID NO: 1045990 - DNA, 16 bp, Homo sapiens
ggaggcggggaggagg

SEQ ID NO: 1045991 - DNA, 15 bp, Homo sapiens
ggaggcggtggcaga

SEQ ID NO: 1045992 - DNA, 16 bp, Homo sapiens
ggaggcgtgcccccct

SEQ ID NO: 1045993 - DNA, 18 bp, Homo sapiens
ggaggcgtgcccccctcc

SEQ ID NO: 1045994 - DNA, 15 bp, Homo sapiens
ggaggcgtggaggag

SEQ ID NO: 1045995 - DNA, 16 bp, Homo sapiens
ggaggcgtggaggaga

SEQ ID NO: 1045996 - DNA, 16 bp, Homo sapiens
ggaggctccagagggc

SEQ ID NO: 1045997 - DNA, 22 bp, Homo sapiens
ggaggctcctgcctgagcttcc

SEQ ID NO: 1045998 - DNA, 11 bp, Homo sapiens
ggaggctctct

SEQ ID NO: 1045999 - DNA, 14 bp, Homo sapiens
ggaggctctctgta

SEQ ID NO: 1046000 - DNA, 16 bp, Homo sapiens
ggaggctgaggcagaa

SEQ ID NO: 1046001 - DNA, 14 bp, Homo sapiens
ggaggctgcagagc

SEQ ID NO: 1046002 - DNA, 20 bp, Homo sapiens
ggaggctgcagagctgaccc

SEQ ID NO: 1046003 - DNA, 13 bp, Homo sapiens
ggaggctgggccc

SEQ ID NO: 1046004 - DNA, 19 bp, Homo sapiens
ggaggctgggcccctggga

SEQ ID NO: 1046005 - DNA, 14 bp, Homo sapiens
ggaggctggggccc

SEQ ID NO: 1046006 - DNA, 15 bp, Homo sapiens
ggaggcttcctgcgt

SEQ ID NO: 1046007 - DNA, 16 bp, Homo sapiens
ggaggcttgtcagagc

SEQ ID NO: 1046008 - DNA, 19 bp, Homo sapiens
ggagggaaaagggaagtag

SEQ ID NO: 1046009 - DNA, 15 bp, Homo sapiens
ggagggaagagtgga

SEQ ID NO: 1046010 - DNA, 19 bp, Homo sapiens
ggagggaagggccaccctg

SEQ ID NO: 1046011 - DNA, 21 bp, Homo sapiens
ggagggaaggggatggaggcc

SEQ ID NO: 1046012 - DNA, 22 bp, Homo sapiens
ggagggaaggggatggaggcca

SEQ ID NO: 1046013 - DNA, 15 bp, Homo sapiens
ggagggaagtcctgg

SEQ ID NO: 1046014 - DNA, 22 bp, Homo sapiens
ggagggacaagtggactcaggg

SEQ ID NO: 1046015 - DNA, 12 bp, Homo sapiens
ggagggacaggg

SEQ ID NO: 1046016 - DNA, 19 bp, Homo sapiens
ggagggacttggctgtcct

SEQ ID NO: 1046017 - DNA, 14 bp, Homo sapiens
ggagggagaaagga

SEQ ID NO: 1046018 - DNA, 16 bp, Homo sapiens
ggagggagaaagggta

SEQ ID NO: 1046019 - DNA, 13 bp, Homo sapiens
ggagggagaggga

SEQ ID NO: 1046020 - DNA, 13 bp, Homo sapiens
ggagggaggcacc

SEQ ID NO: 1046021 - DNA, 15 bp, Homo sapiens
ggagggaggccaggc

SEQ ID NO: 1046022 - DNA, 21 bp, Homo sapiens
ggagggaggcggggaggagga

SEQ ID NO: 1046023 - DNA, 15 bp, Homo sapiens
ggagggaggctcagg

SEQ ID NO: 1046024 - DNA, 16 bp, Homo sapiens
ggagggaggctcaggt

SEQ ID NO: 1046025 - DNA, 12 bp, Homo sapiens
ggagggaggctg

SEQ ID NO: 1046026 - DNA, 21 bp, Homo sapiens
ggagggagttttgtctgtctc

SEQ ID NO: 1046027 - DNA, 14 bp, Homo sapiens
ggagggatgccccc

SEQ ID NO: 1046028 - DNA, 21 bp, Homo sapiens
ggagggatgcccccaggcagc

SEQ ID NO: 1046029 - DNA, 21 bp, Homo sapiens
ggagggatgctgcctgagtca

SEQ ID NO: 1046030 - DNA, 22 bp, Homo sapiens
ggagggatggagaggcggcctc

SEQ ID NO: 1046031 - DNA, 21 bp, Homo sapiens
ggagggcaaggggttcccttg

SEQ ID NO: 1046032 - DNA, 13 bp, Homo sapiens
ggagggcacagca

SEQ ID NO: 1046033 - DNA, 14 bp, Homo sapiens
ggagggcagagcca

SEQ ID NO: 1046034 - DNA, 16 bp, Homo sapiens
ggagggcagcagggct

SEQ ID NO: 1046035 - DNA, 17 bp, Homo sapiens
ggagggcagcagggcta

SEQ ID NO: 1046036 - DNA, 12 bp, Homo sapiens
ggagggcaggct

SEQ ID NO: 1046037 - DNA, 17 bp, Homo sapiens
ggagggcaggctgaggt

SEQ ID NO: 1046038 - DNA, 14 bp, Homo sapiens
ggagggcccctgcg

SEQ ID NO: 1046039 - DNA, 16 bp, Homo sapiens
ggagggccgcagggcc

SEQ ID NO: 1046040 - DNA, 21 bp, Homo sapiens
ggagggccggcggctctgagc

SEQ ID NO: 1046041 - DNA, 22 bp, Homo sapiens
ggagggccggcggctctgagca

SEQ ID NO: 1046042 - DNA, 21 bp, Homo sapiens
ggagggccgtaccccaccctc

SEQ ID NO: 1046043 - DNA, 13 bp, Homo sapiens
ggagggctcctgg

SEQ ID NO: 1046044 - DNA, 13 bp, Homo sapiens
ggagggctgcagt

SEQ ID NO: 1046045 - DNA, 18 bp, Homo sapiens
ggagggcttggggctgca

SEQ ID NO: 1046046 - DNA, 17 bp, Homo sapiens
ggaggggaaaaaaatgt

SEQ ID NO: 1046047 - DNA, 13 bp, Homo sapiens
ggaggggaagctg

SEQ ID NO: 1046048 - DNA, 14 bp, Homo sapiens
ggaggggaaggggc

SEQ ID NO: 1046049 - DNA, 11 bp, Homo sapiens
ggaggggacag

SEQ ID NO: 1046050 - DNA, 16 bp, Homo sapiens
ggaggggacagaggcc

SEQ ID NO: 1046051 - DNA, 20 bp, Homo sapiens
ggaggggacccagctcctct

SEQ ID NO: 1046052 - DNA, 21 bp, Homo sapiens
ggaggggactatttatgaagg

SEQ ID NO: 1046053 - DNA, 18 bp, Homo sapiens
ggaggggaggcagatgga

SEQ ID NO: 1046054 - DNA, 17 bp, Homo sapiens
ggaggggcagcctgtgc

SEQ ID NO: 1046055 - DNA, 12 bp, Homo sapiens
ggaggggccagt

SEQ ID NO: 1046056 - DNA, 16 bp, Homo sapiens
ggaggggccctcaggc

SEQ ID NO: 1046057 - DNA, 15 bp, Homo sapiens
ggaggggcctaggcc

SEQ ID NO: 1046058 - DNA, 18 bp, Homo sapiens
ggaggggcctggcagccg

SEQ ID NO: 1046059 - DNA, 19 bp, Homo sapiens
ggaggggctggggcaggct

SEQ ID NO: 1046060 - DNA, 13 bp, Homo sapiens
ggagggggaagca

SEQ ID NO: 1046061 - DNA, 18 bp, Homo sapiens
ggaggggggagggggaag

SEQ ID NO: 1046062 - DNA, 15 bp, Homo sapiens
ggagggggtcctgac

SEQ ID NO: 1046063 - DNA, 17 bp, Homo sapiens
ggaggggtgtggcagtg

SEQ ID NO: 1046064 - DNA, 23 bp, Homo sapiens
ggagggtaaatgatgtggtgcct

SEQ ID NO: 1046065 - DNA, 17 bp, Homo sapiens
ggagggtctgggggcag

SEQ ID NO: 1046066 - DNA, 18 bp, Homo sapiens
ggagggtctgggggcagc

SEQ ID NO: 1046067 - DNA, 19 bp, Homo sapiens
ggagggtctgggggcagct

SEQ ID NO: 1046068 - DNA, 22 bp, Homo sapiens
ggagggtcttttaccctgtgtc

SEQ ID NO: 1046069 - DNA, 15 bp, Homo sapiens
ggagggtggcaggtg

SEQ ID NO: 1046070 - DNA, 13 bp, Homo sapiens
ggagggtgggaag

SEQ ID NO: 1046071 - DNA, 14 bp, Homo sapiens
ggagggtgggaagg

SEQ ID NO: 1046072 - DNA, 15 bp, Homo sapiens
ggagggttcccctgg

SEQ ID NO: 1046073 - DNA, 13 bp, Homo sapiens
ggaggtagagagg

SEQ ID NO: 1046074 - DNA, 23 bp, Homo sapiens
ggaggtcacattcaggaagatga

SEQ ID NO: 1046075 - DNA, 21 bp, Homo sapiens
ggaggtcactggaaaggggag

SEQ ID NO: 1046076 - DNA, 21 bp, Homo sapiens
ggaggtcattttttaaatcca

SEQ ID NO: 1046077 - DNA, 22 bp, Homo sapiens
ggaggtcgaccccaaagcccct

SEQ ID NO: 1046078 - DNA, 15 bp, Homo sapiens
ggaggtgctggggga

SEQ ID NO: 1046079 - DNA, 22 bp, Homo sapiens
ggaggtgcttaagcagaagcat

SEQ ID NO: 1046080 - DNA, 20 bp, Homo sapiens
ggaggtggagattgcagtga

SEQ ID NO: 1046081 - DNA, 15 bp, Homo sapiens
tgaattgtccccagt

SEQ ID NO: 1046082 - DNA, 13 bp, Homo sapiens
tgaattgtctttt

SEQ ID NO: 1046083 - DNA, 19 bp, Homo sapiens
tgaattgtcttttagacaa

SEQ ID NO: 1046084 - DNA, 23 bp, Homo sapiens
tgaattgtgtattgatgcaatat

SEQ ID NO: 1046085 - DNA, 11 bp, Homo sapiens
tgaattgttat

SEQ ID NO: 1046086 - DNA, 14 bp, Homo sapiens
tgaattgttatgaa

SEQ ID NO: 1046087 - DNA, 17 bp, Homo sapiens
tgaattgttatgaaaat

SEQ ID NO: 1046088 - DNA, 14 bp, Homo sapiens
tgaattgtttataa

SEQ ID NO: 1046089 - DNA, 15 bp, Homo sapiens
tgaatttaaggcaaa

SEQ ID NO: 1046090 - DNA, 20 bp, Homo sapiens
tgaatttaaggcaaaaaagg

SEQ ID NO: 1046091 - DNA, 14 bp, Homo sapiens
tgaatttatcttta

SEQ ID NO: 1046092 - DNA, 19 bp, Homo sapiens
tgaatttcaggcattttgt

SEQ ID NO: 1046093 - DNA, 23 bp, Homo sapiens
tgaatttctaccagatgtgcttt

SEQ ID NO: 1046094 - DNA, 23 bp, Homo sapiens
tgaatttctagacagtattgcca

SEQ ID NO: 1046095 - DNA, 23 bp, Homo sapiens
tgaatttcttttgccgttattaa

SEQ ID NO: 1046096 - DNA, 19 bp, Homo sapiens
tgaatttgaatgaaaaatt

SEQ ID NO: 1046097 - DNA, 20 bp, Homo sapiens
tgaatttgcacggtttgtga

SEQ ID NO: 1046098 - DNA, 11 bp, Homo sapiens
tgaatttggag

SEQ ID NO: 1046099 - DNA, 14 bp, Homo sapiens
tgaatttggagact

SEQ ID NO: 1046100 - DNA, 17 bp, Homo sapiens
tgaatttggagactctg

SEQ ID NO: 1046101 - DNA, 20 bp, Homo sapiens
tgaatttgggatactaaagt

SEQ ID NO: 1046102 - DNA, 17 bp, Homo sapiens
tgaatttgggcctcttg

SEQ ID NO: 1046103 - DNA, 13 bp, Homo sapiens
tgaatttgtagtt

SEQ ID NO: 1046104 - DNA, 24 bp, Homo sapiens
tgaatttgtccattgtaaatctga

SEQ ID NO: 1046105 - DNA, 16 bp, Homo sapiens
tgaattttcaaggcct

SEQ ID NO: 1046106 - DNA, 13 bp, Homo sapiens
ggagtagctagtt

SEQ ID NO: 1046107 - DNA, 21 bp, Homo sapiens
ggagtattgaatggtggtgga

SEQ ID NO: 1046108 - DNA, 14 bp, Homo sapiens
ggagtcactgagac

SEQ ID NO: 1046109 - DNA, 18 bp, Homo sapiens
ggagtcagagccctggct

SEQ ID NO: 1046110 - DNA, 22 bp, Homo sapiens
ggagtcagagccctggctgggt

SEQ ID NO: 1046111 - DNA, 20 bp, Homo sapiens
ggagtcaggcctgggcagga

SEQ ID NO: 1046112 - DNA, 14 bp, Homo sapiens
ggagtcaggggctc

SEQ ID NO: 1046113 - DNA, 12 bp, Homo sapiens
ggagtcagggtg

SEQ ID NO: 1046114 - DNA, 18 bp, Homo sapiens
ggagtcatttgagtctct

SEQ ID NO: 1046115 - DNA, 15 bp, Homo sapiens
ggagtccagctctac

SEQ ID NO: 1046116 - DNA, 16 bp, Homo sapiens
ggagtcccaaggaaag

SEQ ID NO: 1046117 - DNA, 17 bp, Homo sapiens
ggagtcccaaggaaagc

SEQ ID NO: 1046118 - DNA, 23 bp, Homo sapiens
ggagtcccacccggacaggtggg

SEQ ID NO: 1046119 - DNA, 15 bp, Homo sapiens
ggagtcccagagccc

SEQ ID NO: 1046120 - DNA, 14 bp, Homo sapiens
ggagtccccatccc

SEQ ID NO: 1046121 - DNA, 13 bp, Homo sapiens
ggagtcccctcac

SEQ ID NO: 1046122 - DNA, 15 bp, Homo sapiens
ggagtcccctcacct

SEQ ID NO: 1046123 - DNA, 15 bp, Homo sapiens
ggagtcccgtcagga

SEQ ID NO: 1046124 - DNA, 19 bp, Homo sapiens
ggagtccttacctcgggga

SEQ ID NO: 1046125 - DNA, 21 bp, Homo sapiens
ggagtccttacctcggggaga

SEQ ID NO: 1046126 - DNA, 18 bp, Homo sapiens
ggagtcggttagtcattg

SEQ ID NO: 1046127 - DNA, 15 bp, Homo sapiens
ggagtctatgcttaa

SEQ ID NO: 1046128 - DNA, 17 bp, Homo sapiens
ggagtctcaggaggagg

SEQ ID NO: 1046129 - DNA, 20 bp, Homo sapiens
ggagtctcaggaggaggctg

SEQ ID NO: 1046130 - DNA, 15 bp, Homo sapiens
ggagtctgactgtgc

SEQ ID NO: 1046131 - DNA, 16 bp, Homo sapiens
ggagtctgactgtgcc

SEQ ID NO: 1046132 - DNA, 12 bp, Homo sapiens
ggagtctgagtc

SEQ ID NO: 1046133 - DNA, 18 bp, Homo sapiens
ggagtctgagtctgagtc

SEQ ID NO: 1046134 - DNA, 22 bp, Homo sapiens
ggagtctgagtctgagtcctgt

SEQ ID NO: 1046135 - DNA, 13 bp, Homo sapiens
ggagtctgccact

SEQ ID NO: 1046136 - DNA, 16 bp, Homo sapiens
ggagtctgtgctcttt

SEQ ID NO: 1046137 - DNA, 18 bp, Homo sapiens
ggagtcttcagacccaga

SEQ ID NO: 1046138 - DNA, 21 bp, Homo sapiens
ggagtcttgggtggcgctggt

SEQ ID NO: 1046139 - DNA, 12 bp, Homo sapiens
ggagtcttgtgc

SEQ ID NO: 1046140 - DNA, 22 bp, Homo sapiens
ggagtgaaacagagaaagaaaa

SEQ ID NO: 1046141 - DNA, 23 bp, Homo sapiens
ggagtgaaacctttagggcagct

SEQ ID NO: 1046142 - DNA, 12 bp, Homo sapiens
ggagtgaagagg

SEQ ID NO: 1046143 - DNA, 15 bp, Homo sapiens
ggagtgaagaggggc

SEQ ID NO: 1046144 - DNA, 19 bp, Homo sapiens
ggagtgaagaggggcagcc

SEQ ID NO: 1046145 - DNA, 20 bp, Homo sapiens
ggagtgaagaggggcagccc

SEQ ID NO: 1046146 - DNA, 18 bp, Homo sapiens
ggagtgaccgggcactgg

SEQ ID NO: 1046147 - DNA, 21 bp, Homo sapiens
ggagtgagcagctactgtaac

SEQ ID NO: 1046148 - DNA, 21 bp, Homo sapiens
ggagtgaggaatagttgagcc

SEQ ID NO: 1046149 - DNA, 23 bp, Homo sapiens
ggagtgaggaatagttgagcccc

SEQ ID NO: 1046150 - DNA, 23 bp, Homo sapiens
ggagtgagggcctcagagcctga

SEQ ID NO: 1046151 - DNA, 23 bp, Homo sapiens
ggagtgagtcacctgctccagaa

SEQ ID NO: 1046152 - DNA, 22 bp, Homo sapiens
ggagtgatatgatccagagcag

SEQ ID NO: 1046153 - DNA, 16 bp, Homo sapiens
ggagtgatggtgtcct

SEQ ID NO: 1046154 - DNA, 20 bp, Homo sapiens
ggagtgatggtgtccttccc

SEQ ID NO: 1046155 - DNA, 18 bp, Homo sapiens
ggagtgcagaacacctgg

SEQ ID NO: 1046156 - DNA, 21 bp, Homo sapiens
ggagtgcagaacacctggccg

SEQ ID NO: 1046157 - DNA, 18 bp, Homo sapiens
ggagtgcagccttctcca

SEQ ID NO: 1046158 - DNA, 15 bp, Homo sapiens
ggagtgcagggagga

SEQ ID NO: 1046159 - DNA, 18 bp, Homo sapiens
ggagtgcagggaggagag

SEQ ID NO: 1046160 - DNA, 15 bp, Homo sapiens
ggagtgccctgcagg

SEQ ID NO: 1046161 - DNA, 19 bp, Homo sapiens
ggagtgccctgcaggcaca

SEQ ID NO: 1046162 - DNA, 20 bp, Homo sapiens
ggagtgccctgcaggcacag

SEQ ID NO: 1046163 - DNA, 23 bp, Homo sapiens
ggagtgcgctcttggtccctggt

SEQ ID NO: 1046164 - DNA, 14 bp, Homo sapiens
ggagtgctgcttgt

SEQ ID NO: 1046165 - DNA, 21 bp, Homo sapiens
ggagtgctgttttgttatata

SEQ ID NO: 1046166 - DNA, 13 bp, Homo sapiens
ggagtgggcacct

SEQ ID NO: 1046167 - DNA, 16 bp, Homo sapiens
ggagtgggcacctcag

SEQ ID NO: 1046168 - DNA, 23 bp, Homo sapiens
ggagtggggtggtgtcagaccct

SEQ ID NO: 1046169 - DNA, 16 bp, Homo sapiens
ggagtggtgcagacag

SEQ ID NO: 1046170 - DNA, 21 bp, Homo sapiens
ggagtgtcggatcctgtgagt

SEQ ID NO: 1046171 - DNA, 12 bp, Homo sapiens
ggagtgtgcaga

SEQ ID NO: 1046172 - DNA, 21 bp, Homo sapiens
ggagtgtgcatttcagcttga

SEQ ID NO: 1046173 - DNA, 19 bp, Homo sapiens
ggagtgtgtattgttccca

SEQ ID NO: 1046174 - DNA, 17 bp, Homo sapiens
ggagtgtgtcagagccc

SEQ ID NO: 1046175 - DNA, 14 bp, Homo sapiens
ggagtgttatgtat

SEQ ID NO: 1046176 - DNA, 13 bp, Homo sapiens
ggagtgttctgtg

SEQ ID NO: 1046177 - DNA, 19 bp, Homo sapiens
ggagtgttctgtgggcttg

SEQ ID NO: 1046178 - DNA, 15 bp, Homo sapiens
ggagttcaccttgga

SEQ ID NO: 1046179 - DNA, 13 bp, Homo sapiens
ggagttcctgctc

SEQ ID NO: 1046180 - DNA, 12 bp, Homo sapiens
ggagttctctga

SEQ ID NO: 1046181 - DNA, 19 bp, Homo sapiens
ggagttctctgatgcagaa

SEQ ID NO: 1046182 - DNA, 23 bp, Homo sapiens
ggagttgaggtgtcagagaaaat

SEQ ID NO: 1046183 - DNA, 19 bp, Homo sapiens
ggagttgagtcacaagagg

SEQ ID NO: 1046184 - DNA, 22 bp, Homo sapiens
ggagttgtcaagtctctgctgg

SEQ ID NO: 1046185 - DNA, 19 bp, Homo sapiens
ggagtttaagaccagcctg

SEQ ID NO: 1046186 - DNA, 20 bp, Homo sapiens
ggagtttagggaacaatttg

SEQ ID NO: 1046187 - DNA, 17 bp, Homo sapiens
ggagtttattacaatgt

SEQ ID NO: 1046188 - DNA, 21 bp, Homo sapiens
ggagtttgacaccttagagaa

SEQ ID NO: 1046189 - DNA, 16 bp, Homo sapiens
ggagttttatttttaa

SEQ ID NO: 1046190 - DNA, 17 bp, Homo sapiens
ggagttttggcagccag

SEQ ID NO: 1046191 - DNA, 18 bp, Homo sapiens
ggagttttgtctgtctcc

SEQ ID NO: 1046192 - DNA, 16 bp, Homo sapiens
ggagtttttttataca

SEQ ID NO: 1046193 - DNA, 23 bp, Homo sapiens
ggagtttttttatacaatgttct

SEQ ID NO: 1046194 - DNA, 21 bp, Homo sapiens
ggataaaaagccagggctgga

SEQ ID NO: 1046195 - DNA, 17 bp, Homo sapiens
ggataaaaaggaaggag

SEQ ID NO: 1046196 - DNA, 21 bp, Homo sapiens
ggataaaaaggaaggagagat

SEQ ID NO: 1046197 - DNA, 15 bp, Homo sapiens
ggataaaatgaggtt

SEQ ID NO: 1046198 - DNA, 21 bp, Homo sapiens
ggataaaccaccctctgggga

SEQ ID NO: 1046199 - DNA, 22 bp, Homo sapiens
ggataaagaatactatttccaa

SEQ ID NO: 1046200 - DNA, 14 bp, Homo sapiens
ggataaagccactt

SEQ ID NO: 1046201 - DNA, 17 bp, Homo sapiens
ggataacagaggcagga

SEQ ID NO: 1046202 - DNA, 15 bp, Homo sapiens
tgacactaagaaaat

SEQ ID NO: 1046203 - DNA, 21 bp, Homo sapiens
tgacactagcccaatgaaatg

SEQ ID NO: 1046204 - DNA, 13 bp, Homo sapiens
tgacactgagccc

SEQ ID NO: 1046205 - DNA, 15 bp, Homo sapiens
tgacactgagcccca

SEQ ID NO: 1046206 - DNA, 21 bp, Homo sapiens
tgacactgatgagtttcactg

SEQ ID NO: 1046207 - DNA, 19 bp, Homo sapiens
tgacactgctctaacagcc

SEQ ID NO: 1046208 - DNA, 20 bp, Homo sapiens
tgacacttcagagagctggt

SEQ ID NO: 1046209 - DNA, 24 bp, Homo sapiens
tgacacttcagagagctggtagtt

SEQ ID NO: 1046210 - DNA, 16 bp, Homo sapiens
tgacacttcccagtgg

SEQ ID NO: 1046211 - DNA, 23 bp, Homo sapiens
tgacactttctgctggaagctgt

SEQ ID NO: 1046212 - DNA, 18 bp, Homo sapiens
tgacacttttaaaaaaca

SEQ ID NO: 1046213 - DNA, 19 bp, Homo sapiens
tgacacttttaaaaaacaa

SEQ ID NO: 1046214 - DNA, 19 bp, Homo sapiens
tgacacttttcatatcatt

SEQ ID NO: 1046215 - DNA, 22 bp, Homo sapiens
tgacactttttgtattttttcc

SEQ ID NO: 1046216 - DNA, 15 bp, Homo sapiens
tgacagaaggtgcca

SEQ ID NO: 1046217 - DNA, 18 bp, Homo sapiens
tgacagaatcttgtattt

SEQ ID NO: 1046218 - DNA, 18 bp, Homo sapiens
tgacagaccacatcttta

SEQ ID NO: 1046219 - DNA, 22 bp, Homo sapiens
tgacagaccacatctttatctg

SEQ ID NO: 1046220 - DNA, 21 bp, Homo sapiens
tgacagagcaagactctgtct

SEQ ID NO: 1046221 - DNA, 23 bp, Homo sapiens
tgacagagcagctaactccgaga

SEQ ID NO: 1046222 - DNA, 16 bp, Homo sapiens
tgacagatcaagctgt

SEQ ID NO: 1046223 - DNA, 17 bp, Homo sapiens
tgacagatcaagctgtg

SEQ ID NO: 1046224 - DNA, 18 bp, Homo sapiens
tgacagatcaagctgtga

SEQ ID NO: 1046225 - DNA, 15 bp, Homo sapiens
tgacagatgccaact

SEQ ID NO: 1046226 - DNA, 15 bp, Homo sapiens
tgacagattctgaca

SEQ ID NO: 1046227 - DNA, 20 bp, Homo sapiens
tgacagcatgtgccctcctg

SEQ ID NO: 1046228 - DNA, 11 bp, Homo sapiens
tgacagcccaa

SEQ ID NO: 1046229 - DNA, 11 bp, Homo sapiens
tgacagcctcc

SEQ ID NO: 1046230 - DNA, 22 bp, Homo sapiens
tgacagcctcccacccccatct

SEQ ID NO: 1046231 - DNA, 19 bp, Homo sapiens
tgacagcgatggcaggcct

SEQ ID NO: 1046232 - DNA, 20 bp, Homo sapiens
tgacagcgatggcaggcctg

SEQ ID NO: 1046233 - DNA, 20 bp, Homo sapiens
ggatcaaacctttctggcct

SEQ ID NO: 1046234 - DNA, 22 bp, Homo sapiens
ggatcaaacctttctggcctgt

SEQ ID NO: 1046235 - DNA, 14 bp, Homo sapiens
ggatcaaggagcgc

SEQ ID NO: 1046236 - DNA, 16 bp, Homo sapiens
ggatcacagcctctga

SEQ ID NO: 1046237 - DNA, 13 bp, Homo sapiens
ggatcacagggcc

SEQ ID NO: 1046238 - DNA, 14 bp, Homo sapiens
ggatcacagggccc

SEQ ID NO: 1046239 - DNA, 18 bp, Homo sapiens
ggatcactggagcccagg

SEQ ID NO: 1046240 - DNA, 17 bp, Homo sapiens
ggatcacttgagcccag

SEQ ID NO: 1046241 - DNA, 15 bp, Homo sapiens
ggatcagagcaggac

SEQ ID NO: 1046242 - DNA, 17 bp, Homo sapiens
ggatcagagcaggacct

SEQ ID NO: 1046243 - DNA, 18 bp, Homo sapiens
ggatcagagcaggacctc

SEQ ID NO: 1046244 - DNA, 19 bp, Homo sapiens
ggatcagagcgcacaggga

SEQ ID NO: 1046245 - DNA, 16 bp, Homo sapiens
ggatcagatgaactct

SEQ ID NO: 1046246 - DNA, 21 bp, Homo sapiens
ggatcagatgaactcttagaa

SEQ ID NO: 1046247 - DNA, 12 bp, Homo sapiens
ggatcagatgac

SEQ ID NO: 1046248 - DNA, 12 bp, Homo sapiens
ggatcagccccg

SEQ ID NO: 1046249 - DNA, 14 bp, Homo sapiens
ggatcagccccgcc

SEQ ID NO: 1046250 - DNA, 13 bp, Homo sapiens
ggatcaggaagcc

SEQ ID NO: 1046251 - DNA, 14 bp, Homo sapiens
ggatcaggctgctg

SEQ ID NO: 1046252 - DNA, 18 bp, Homo sapiens
ggatcaggctgctggaaa

SEQ ID NO: 1046253 - DNA, 20 bp, Homo sapiens
ggatcagggaatccagctcc

SEQ ID NO: 1046254 - DNA, 17 bp, Homo sapiens
ggatccaaactgatcca

SEQ ID NO: 1046255 - DNA, 15 bp, Homo sapiens
ggatccacttcttgg

SEQ ID NO: 1046256 - DNA, 13 bp, Homo sapiens
ggatccagaaggg

SEQ ID NO: 1046257 - DNA, 13 bp, Homo sapiens
ggatccccctctt

SEQ ID NO: 1046258 - DNA, 22 bp, Homo sapiens
ggatccccgcctggccaggagc

SEQ ID NO: 1046259 - DNA, 13 bp, Homo sapiens
ggatccctcatct

SEQ ID NO: 1046260 - DNA, 18 bp, Homo sapiens
ggatcctagccttatcct

SEQ ID NO: 1046261 - DNA, 20 bp, Homo sapiens
ggatcctagccttatcctct

SEQ ID NO: 1046262 - DNA, 21 bp, Homo sapiens
ggatcctattctcaccaggaa

SEQ ID NO: 1046263 - DNA, 12 bp, Homo sapiens
ggatcctccctc

SEQ ID NO: 1046264 - DNA, 17 bp, Homo sapiens
ggatcctgaatctgtgc

SEQ ID NO: 1046265 - DNA, 12 bp, Homo sapiens
ggatcctgcact

SEQ ID NO: 1046266 - DNA, 11 bp, Homo sapiens
ggatcctgccc

SEQ ID NO: 1046267 - DNA, 12 bp, Homo sapiens
ggatcctgcccc

SEQ ID NO: 1046268 - DNA, 14 bp, Homo sapiens
ggatcctgccccca

SEQ ID NO: 1046269 - DNA, 16 bp, Homo sapiens
ggatcctgcccccaag

SEQ ID NO: 1046270 - DNA, 20 bp, Homo sapiens
ggatcctgcccccaagtcat

SEQ ID NO: 1046271 - DNA, 18 bp, Homo sapiens
ggatccttcagcacagga

SEQ ID NO: 1046272 - DNA, 13 bp, Homo sapiens
ggatccttgggcc

SEQ ID NO: 1046273 - DNA, 14 bp, Homo sapiens
ggatcgaggcatgg

SEQ ID NO: 1046274 - DNA, 21 bp, Homo sapiens
ggatcgagtgtagctgtgaaa

SEQ ID NO: 1046275 - DNA, 14 bp, Homo sapiens
ggatcgatgtgctc

SEQ ID NO: 1046276 - DNA, 15 bp, Homo sapiens
ggatcggactctgcc

SEQ ID NO: 1046277 - DNA, 23 bp, Homo sapiens
ggatcggaggcttgtcagagctg

SEQ ID NO: 1046278 - DNA, 12 bp, Homo sapiens
ggatctaccagc

SEQ ID NO: 1046279 - DNA, 13 bp, Homo sapiens
ggatctaccagca

SEQ ID NO: 1046280 - DNA, 17 bp, Homo sapiens
ggatctacctggaggga

SEQ ID NO: 1046281 - DNA, 14 bp, Homo sapiens
ggatctatttcatg

SEQ ID NO: 1046282 - DNA, 13 bp, Homo sapiens
ggatctcaagcca

SEQ ID NO: 1046283 - DNA, 17 bp, Homo sapiens
ggatctcaagccagccc

SEQ ID NO: 1046284 - DNA, 17 bp, Homo sapiens
ggatctcacaggctgag

SEQ ID NO: 1046285 - DNA, 13 bp, Homo sapiens
ggatctcaggggc

SEQ ID NO: 1046286 - DNA, 24 bp, Homo sapiens
ggatctcattggacccttccatgg

SEQ ID NO: 1046287 - DNA, 21 bp, Homo sapiens
ggatctccaaggaccaggtta

SEQ ID NO: 1046288 - DNA, 21 bp, Homo sapiens
ggatctccactgataagactg

SEQ ID NO: 1046289 - DNA, 23 bp, Homo sapiens
ggatctcctgctgccttttctgg

SEQ ID NO: 1046290 - DNA, 18 bp, Homo sapiens
ggatctcttaagacagca

SEQ ID NO: 1046291 - DNA, 23 bp, Homo sapiens
ggatctgagctcccacctccctt

SEQ ID NO: 1046292 - DNA, 17 bp, Homo sapiens
ggatctgagtaggtctg

SEQ ID NO: 1046293 - DNA, 18 bp, Homo sapiens
ggatctgctgaggcccag

SEQ ID NO: 1046294 - DNA, 19 bp, Homo sapiens
ggatctgggaccctttcct

SEQ ID NO: 1046295 - DNA, 17 bp, Homo sapiens
ggatctggtcctaccca

SEQ ID NO: 1046296 - DNA, 14 bp, Homo sapiens
ggatcttattttgt

SEQ ID NO: 1046297 - DNA, 15 bp, Homo sapiens
ggatcttcccacagg

SEQ ID NO: 1046298 - DNA, 18 bp, Homo sapiens
ggatcttcccacaggagg

SEQ ID NO: 1046299 - DNA, 20 bp, Homo sapiens
ggatcttctatcattccaat

SEQ ID NO: 1046300 - DNA, 21 bp, Homo sapiens
ggatcttgaatgtggtctcag

SEQ ID NO: 1046301 - DNA, 11 bp, Homo sapiens
ggatgaaagct

SEQ ID NO: 1046302 - DNA, 13 bp, Homo sapiens
ggatgaatctccc

SEQ ID NO: 1046303 - DNA, 22 bp, Homo sapiens
ggatgaatgaggtcccaggcag

SEQ ID NO: 1046304 - DNA, 21 bp, Homo sapiens
ggatgaattccaaattctgct

SEQ ID NO: 1046305 - DNA, 18 bp, Homo sapiens
ggatgacaccctggcctg

SEQ ID NO: 1046306 - DNA, 15 bp, Homo sapiens
ggatgacatgtccct

SEQ ID NO: 1046307 - DNA, 16 bp, Homo sapiens
ggatgacatgtcccta

SEQ ID NO: 1046308 - DNA, 18 bp, Homo sapiens
ggatgacttttttataca

SEQ ID NO: 1046309 - DNA, 12 bp, Homo sapiens
ggatgagaatgt

SEQ ID NO: 1046310 - DNA, 14 bp, Homo sapiens
ggatgagaatgtga

SEQ ID NO: 1046311 - DNA, 15 bp, Homo sapiens
ggatgagctggaagg

SEQ ID NO: 1046312 - DNA, 20 bp, Homo sapiens
ggatgaggtggtggagtgga

SEQ ID NO: 1046313 - DNA, 18 bp, Homo sapiens
ggatgatggcagagccag

SEQ ID NO: 1046314 - DNA, 20 bp, Homo sapiens
ggatgattcagaaattggaa

SEQ ID NO: 1046315 - DNA, 18 bp, Homo sapiens
ggatgatttcatcttctg

SEQ ID NO: 1046316 - DNA, 18 bp, Homo sapiens
ggatgcaaggtagcatgg

SEQ ID NO: 1046317 - DNA, 23 bp, Homo sapiens
ggatgcacagagttgttacattt

SEQ ID NO: 1046318 - DNA, 13 bp, Homo sapiens
ggatgcacatttc

SEQ ID NO: 1046319 - DNA, 21 bp, Homo sapiens
ggatgcattctgataggaggg

SEQ ID NO: 1046320 - DNA, 22 bp, Homo sapiens
ggatgcattctgataggagggg

SEQ ID NO: 1046321 - DNA, 20 bp, Homo sapiens
ggatgccaacaccttcttgg

SEQ ID NO: 1046322 - DNA, 20 bp, Homo sapiens
ggatgccactcctccctccg

SEQ ID NO: 1046323 - DNA, 15 bp, Homo sapiens
ggatgccctggaggt

SEQ ID NO: 1046324 - DNA, 12 bp, Homo sapiens
tgacattgtctc

SEQ ID NO: 1046325 - DNA, 14 bp, Homo sapiens
tgacattgtctcct

SEQ ID NO: 1046326 - DNA, 19 bp, Homo sapiens
tgacatttacaggagggcc

SEQ ID NO: 1046327 - DNA, 16 bp, Homo sapiens
tgacatttatatattg

SEQ ID NO: 1046328 - DNA, 12 bp, Homo sapiens
tgacatttatgt

SEQ ID NO: 1046329 - DNA, 14 bp, Homo sapiens
tgacatttatgtct

SEQ ID NO: 1046330 - DNA, 13 bp, Homo sapiens
tgacatttcatct

SEQ ID NO: 1046331 - DNA, 14 bp, Homo sapiens
tgacatttcatctg

SEQ ID NO: 1046332 - DNA, 12 bp, Homo sapiens
tgacatttctaa

SEQ ID NO: 1046333 - DNA, 15 bp, Homo sapiens
tgacatttggagagg

SEQ ID NO: 1046334 - DNA, 22 bp, Homo sapiens
tgacatttgggagacatgtgac

SEQ ID NO: 1046335 - DNA, 14 bp, Homo sapiens
tgacatttgtagtt

SEQ ID NO: 1046336 - DNA, 12 bp, Homo sapiens
tgacattttaca

SEQ ID NO: 1046337 - DNA, 15 bp, Homo sapiens
tgacattttacatta

SEQ ID NO: 1046338 - DNA, 16 bp, Homo sapiens
tgacattttatttttt

SEQ ID NO: 1046339 - DNA, 21 bp, Homo sapiens
tgacatttttttctgatttgt

SEQ ID NO: 1046340 - DNA, 15 bp, Homo sapiens
tgaccaaaagttaca

SEQ ID NO: 1046341 - DNA, 16 bp, Homo sapiens
tgaccaaaagttacat

SEQ ID NO: 1046342 - DNA, 22 bp, Homo sapiens
tgaccaaaagttacatgtttgc

SEQ ID NO: 1046343 - DNA, 12 bp, Homo sapiens
tgaccaaaatac

SEQ ID NO: 1046344 - DNA, 22 bp, Homo sapiens
tgaccaaaattttaagtaggaa

SEQ ID NO: 1046345 - DNA, 17 bp, Homo sapiens
tgaccaaaccagccttc

SEQ ID NO: 1046346 - DNA, 19 bp, Homo sapiens
tgaccaaagtcccttcctg

SEQ ID NO: 1046347 - DNA, 19 bp, Homo sapiens
tgaccaaatggccagtttt

SEQ ID NO: 1046348 - DNA, 20 bp, Homo sapiens
tgaccaacatggagaaaccc

SEQ ID NO: 1046349 - DNA, 23 bp, Homo sapiens
tgaccaacatggagaaaccctgt

SEQ ID NO: 1046350 - DNA, 12 bp, Homo sapiens
tgaccaactgtg

SEQ ID NO: 1046351 - DNA, 18 bp, Homo sapiens
tgaccaagaactgcatgg

SEQ ID NO: 1046352 - DNA, 19 bp, Homo sapiens
tgaccaagaactgcatgga

SEQ ID NO: 1046353 - DNA, 21 bp, Homo sapiens
tgaccaagactgagccagctt

SEQ ID NO: 1046354 - DNA, 17 bp, Homo sapiens
tgaccaagagagaaaga

SEQ ID NO: 1046355 - DNA, 18 bp, Homo sapiens
tgaccaagagagaaagaa

SEQ ID NO: 1046356 - DNA, 15 bp, Homo sapiens
tgaccaagatactta

SEQ ID NO: 1046357 - DNA, 23 bp, Homo sapiens
tgaccaatattatactaagaaaa

SEQ ID NO: 1046358 - DNA, 21 bp, Homo sapiens
tgaccaatattgtacagtttt

SEQ ID NO: 1046359 - DNA, 19 bp, Homo sapiens
tgaccaattgtgctgccat

SEQ ID NO: 1046360 - DNA, 17 bp, Homo sapiens
tgaccacaccttggcct

SEQ ID NO: 1046361 - DNA, 15 bp, Homo sapiens
ggatgggctcccacc

SEQ ID NO: 1046362 - DNA, 19 bp, Homo sapiens
ggatggggagaatggtcaa

SEQ ID NO: 1046363 - DNA, 18 bp, Homo sapiens
ggatgggtcccctccgcc

SEQ ID NO: 1046364 - DNA, 12 bp, Homo sapiens
ggatgggtgggg

SEQ ID NO: 1046365 - DNA, 15 bp, Homo sapiens
ggatgggtgtgggag

SEQ ID NO: 1046366 - DNA, 17 bp, Homo sapiens
ggatgggttccagaggt

SEQ ID NO: 1046367 - DNA, 20 bp, Homo sapiens
ggatggtaggattgctgggg

SEQ ID NO: 1046368 - DNA, 14 bp, Homo sapiens
ggatggtcctgggg

SEQ ID NO: 1046369 - DNA, 17 bp, Homo sapiens
ggatggtgcatgggctc

SEQ ID NO: 1046370 - DNA, 13 bp, Homo sapiens
ggatggtgcccct

SEQ ID NO: 1046371 - DNA, 19 bp, Homo sapiens
ggatggtggcacaggcact

SEQ ID NO: 1046372 - DNA, 16 bp, Homo sapiens
ggatgtaaacagtgcc

SEQ ID NO: 1046373 - DNA, 20 bp, Homo sapiens
ggatgtaaacagtgcctgct

SEQ ID NO: 1046374 - DNA, 13 bp, Homo sapiens
ggatgtagaactt

SEQ ID NO: 1046375 - DNA, 20 bp, Homo sapiens
ggatgtagagagaacaggtg

SEQ ID NO: 1046376 - DNA, 20 bp, Homo sapiens
ggatgtagtgattaaatata

SEQ ID NO: 1046377 - DNA, 14 bp, Homo sapiens
ggatgtcagacaat

SEQ ID NO: 1046378 - DNA, 20 bp, Homo sapiens
ggatgtcccctgtcccacca

SEQ ID NO: 1046379 - DNA, 21 bp, Homo sapiens
ggatgtcccctgtcccaccaa

SEQ ID NO: 1046380 - DNA, 14 bp, Homo sapiens
ggatgtcttccttg

SEQ ID NO: 1046381 - DNA, 13 bp, Homo sapiens
ggatgtgtgcatg

SEQ ID NO: 1046382 - DNA, 20 bp, Homo sapiens
ggatgttacaagtttgctaa

SEQ ID NO: 1046383 - DNA, 16 bp, Homo sapiens
ggatgttatgaacagc

SEQ ID NO: 1046384 - DNA, 18 bp, Homo sapiens
ggatgttatgaacagctg

SEQ ID NO: 1046385 - DNA, 23 bp, Homo sapiens
ggatgttcagcactgtcccttgc

SEQ ID NO: 1046386 - DNA, 14 bp, Homo sapiens
ggatgttctgcctc

SEQ ID NO: 1046387 - DNA, 17 bp, Homo sapiens
ggatgttgcttctgaat

SEQ ID NO: 1046388 - DNA, 19 bp, Homo sapiens
ggatgttgcttctgaatca

SEQ ID NO: 1046389 - DNA, 17 bp, Homo sapiens
ggatgtttacctggtgc

SEQ ID NO: 1046390 - DNA, 18 bp, Homo sapiens
ggatgtttacctggtgct

SEQ ID NO: 1046391 - DNA, 19 bp, Homo sapiens
ggatgtttagcagtggctg

SEQ ID NO: 1046392 - DNA, 23 bp, Homo sapiens
ggatgtttggaaaaaactctgaa

SEQ ID NO: 1046393 - DNA, 14 bp, Homo sapiens
ggattaaactcagt

SEQ ID NO: 1046394 - DNA, 23 bp, Homo sapiens
ggattaaacttaatctaaatgga

SEQ ID NO: 1046395 - DNA, 16 bp, Homo sapiens
ggattaacctctgcac

SEQ ID NO: 1046396 - DNA, 19 bp, Homo sapiens
ggattacaggcatgtgcca

SEQ ID NO: 1046397 - DNA, 20 bp, Homo sapiens
ggattacaggcatgtgccac

SEQ ID NO: 1046398 - DNA, 19 bp, Homo sapiens
ggattattcatttaaaatg

SEQ ID NO: 1046399 - DNA, 21 bp, Homo sapiens
ggattattcatttaaaatgat

SEQ ID NO: 1046400 - DNA, 13 bp, Homo sapiens
ggattcagccttc

SEQ ID NO: 1046401 - DNA, 14 bp, Homo sapiens
ggattcaggctgct

SEQ ID NO: 1046402 - DNA, 22 bp, Homo sapiens
ggattcattgtctctcacagat

SEQ ID NO: 1046403 - DNA, 13 bp, Homo sapiens
ggattcatttcct

SEQ ID NO: 1046404 - DNA, 23 bp, Homo sapiens
ggattcccaccaaggtcttcagc

SEQ ID NO: 1046405 - DNA, 22 bp, Homo sapiens
ggattcccccccctttcctaaa

SEQ ID NO: 1046406 - DNA, 15 bp, Homo sapiens
ggattccccctgccc

SEQ ID NO: 1046407 - DNA, 17 bp, Homo sapiens
ggattccccctgccctg

SEQ ID NO: 1046408 - DNA, 22 bp, Homo sapiens
ggattccccctgccctgtgccg

SEQ ID NO: 1046409 - DNA, 14 bp, Homo sapiens
ggattcctgaccca

SEQ ID NO: 1046410 - DNA, 19 bp, Homo sapiens
ggattcctgacccaggccg

SEQ ID NO: 1046411 - DNA, 20 bp, Homo sapiens
ggattcctgacccaggccgc

SEQ ID NO: 1046412 - DNA, 17 bp, Homo sapiens
ggattcctgagctggcc

SEQ ID NO: 1046413 - DNA, 22 bp, Homo sapiens
ggattcctgagctggcctgtct

SEQ ID NO: 1046414 - DNA, 19 bp, Homo sapiens
ggattgaaaatgtccagga

SEQ ID NO: 1046415 - DNA, 17 bp, Homo sapiens
ggattgaggggccctgg

SEQ ID NO: 1046416 - DNA, 20 bp, Homo sapiens
ggattgatcggagcctcctc

SEQ ID NO: 1046417 - DNA, 17 bp, Homo sapiens
ggattgcacgtggcctc

SEQ ID NO: 1046418 - DNA, 14 bp, Homo sapiens
ggattgcatcctgc

SEQ ID NO: 1046419 - DNA, 19 bp, Homo sapiens
ggattgcctttaatatttt

SEQ ID NO: 1046420 - DNA, 18 bp, Homo sapiens
ggattgctctggagcagc

SEQ ID NO: 1046421 - DNA, 20 bp, Homo sapiens
ggattgcttcaattaaaatt

SEQ ID NO: 1046422 - DNA, 16 bp, Homo sapiens
ggattggaatgcagag

SEQ ID NO: 1046423 - DNA, 23 bp, Homo sapiens
ggattggcaactcttcagacgga

SEQ ID NO: 1046424 - DNA, 21 bp, Homo sapiens
ggattggcaagtaacttctga

SEQ ID NO: 1046425 - DNA, 22 bp, Homo sapiens
ggattggccaaacatcagacct

SEQ ID NO: 1046426 - DNA, 12 bp, Homo sapiens
ggattggggaag

SEQ ID NO: 1046427 - DNA, 14 bp, Homo sapiens
ggattgggggctgg

SEQ ID NO: 1046428 - DNA, 18 bp, Homo sapiens
ggattgggggctggtgcc

SEQ ID NO: 1046429 - DNA, 16 bp, Homo sapiens
ggattggggtccctct

SEQ ID NO: 1046430 - DNA, 22 bp, Homo sapiens
ggattggggtgataaggggcct

SEQ ID NO: 1046431 - DNA, 20 bp, Homo sapiens
ggattgtatcaagtggcatg

SEQ ID NO: 1046432 - DNA, 22 bp, Homo sapiens
ggattgtccctgtgttgtccca

SEQ ID NO: 1046433 - DNA, 14 bp, Homo sapiens
ggattgtggaaaac

SEQ ID NO: 1046434 - DNA, 18 bp, Homo sapiens
ggatttaccagcttaaga

SEQ ID NO: 1046435 - DNA, 18 bp, Homo sapiens
ggatttataaatgctatt

SEQ ID NO: 1046436 - DNA, 21 bp, Homo sapiens
ggatttatagtatgtgacttt

SEQ ID NO: 1046437 - DNA, 17 bp, Homo sapiens
ggatttattatataaat

SEQ ID NO: 1046438 - DNA, 20 bp, Homo sapiens
ggatttcatgatttcatttc

SEQ ID NO: 1046439 - DNA, 20 bp, Homo sapiens
ggatttcctggagtgccctg

SEQ ID NO: 1046440 - DNA, 15 bp, Homo sapiens
ggatttcgtttttct

SEQ ID NO: 1046441 - DNA, 13 bp, Homo sapiens
ggatttctcccag

SEQ ID NO: 1046442 - DNA, 22 bp, Homo sapiens
ggatttgaacttgctctttttg

SEQ ID NO: 1046443 - DNA, 16 bp, Homo sapiens
ggatttgattcatttt

SEQ ID NO: 1046444 - DNA, 22 bp, Homo sapiens
ggatttgattcattttcctgtt

SEQ ID NO: 1046445 - DNA, 13 bp, Homo sapiens
tgaccctcagctg

SEQ ID NO: 1046446 - DNA, 17 bp, Homo sapiens
tgaccctcagctgtcac

SEQ ID NO: 1046447 - DNA, 18 bp, Homo sapiens
tgaccctcagctgtcacc

SEQ ID NO: 1046448 - DNA, 22 bp, Homo sapiens
tgaccctcagctgtcacctgct

SEQ ID NO: 1046449 - DNA, 11 bp, Homo sapiens
tgaccctccaa

SEQ ID NO: 1046450 - DNA, 13 bp, Homo sapiens
tgaccctccaaat

SEQ ID NO: 1046451 - DNA, 14 bp, Homo sapiens
tgaccctccaaatg

SEQ ID NO: 1046452 - DNA, 15 bp, Homo sapiens
tgaccctcccactcc

SEQ ID NO: 1046453 - DNA, 16 bp, Homo sapiens
tgaccctcccagtctc

SEQ ID NO: 1046454 - DNA, 21 bp, Homo sapiens
tgaccctcccggcctggcttc

SEQ ID NO: 1046455 - DNA, 23 bp, Homo sapiens
tgaccctccttctattttcccta

SEQ ID NO: 1046456 - DNA, 12 bp, Homo sapiens
tgaccctctgtc

SEQ ID NO: 1046457 - DNA, 14 bp, Homo sapiens
tgaccctctgtccc

SEQ ID NO: 1046458 - DNA, 21 bp, Homo sapiens
tgaccctctgtccccaggcct

SEQ ID NO: 1046459 - DNA, 22 bp, Homo sapiens
tgaccctgaaaggaacactggc

SEQ ID NO: 1046460 - DNA, 17 bp, Homo sapiens
tgaccctgaggaggccg

SEQ ID NO: 1046461 - DNA, 14 bp, Homo sapiens
tgaccctgcaccct

SEQ ID NO: 1046462 - DNA, 22 bp, Homo sapiens
tgaccctgcgaaggggccctgg

SEQ ID NO: 1046463 - DNA, 23 bp, Homo sapiens
tgaccctgcgaaggggccctggt

SEQ ID NO: 1046464 - DNA, 18 bp, Homo sapiens
tgaccctgggcttctgta

SEQ ID NO: 1046465 - DNA, 23 bp, Homo sapiens
tgaccctggtgggctgttcagct

SEQ ID NO: 1046466 - DNA, 17 bp, Homo sapiens
tgaccctgtatatagcc

SEQ ID NO: 1046467 - DNA, 22 bp, Homo sapiens
tgacccttacagcctctgactt

SEQ ID NO: 1046468 - DNA, 12 bp, Homo sapiens
tgacccttcagg

SEQ ID NO: 1046469 - DNA, 15 bp, Homo sapiens
tgacccttcagggcc

SEQ ID NO: 1046470 - DNA, 20 bp, Homo sapiens
tgacccttcagggccagaag

SEQ ID NO: 1046471 - DNA, 21 bp, Homo sapiens
tgacccttcagggccagaagg

SEQ ID NO: 1046472 - DNA, 20 bp, Homo sapiens
tgacccttctacatttgagg

SEQ ID NO: 1046473 - DNA, 13 bp, Homo sapiens
tgaccctttcctc

SEQ ID NO: 1046474 - DNA, 16 bp, Homo sapiens
tgaccctttcctcccc

SEQ ID NO: 1046475 - DNA, 18 bp, Homo sapiens
tgaccgatgtgtctccca

SEQ ID NO: 1046476 - DNA, 18 bp, Homo sapiens
tgaccgattatgctttct

SEQ ID NO: 1046477 - DNA, 14 bp, Homo sapiens
tgaccgcccagctc

SEQ ID NO: 1046478 - DNA, 16 bp, Homo sapiens
tgaccggacttttctg

SEQ ID NO: 1046479 - DNA, 21 bp, Homo sapiens
tgaccggtttggagtaatcag

SEQ ID NO: 1046480 - DNA, 21 bp, Homo sapiens
tgaccgtactctcacatgtgg

SEQ ID NO: 1046481 - DNA, 14 bp, Homo sapiens
tgaccgtgtacaat

SEQ ID NO: 1046482 - DNA, 16 bp, Homo sapiens
tgaccgttttcacttg

SEQ ID NO: 1046483 - DNA, 21 bp, Homo sapiens
tgaccgttttcacttgtctcc

SEQ ID NO: 1046484 - DNA, 22 bp, Homo sapiens
tgaccgttttcatcctggcctc

SEQ ID NO: 1046485 - DNA, 16 bp, Homo sapiens
tgacctaaattagata

SEQ ID NO: 1046486 - DNA, 17 bp, Homo sapiens
tgacctaaattatttac

SEQ ID NO: 1046487 - DNA, 16 bp, Homo sapiens
ggcaacgaagaaaaaa

SEQ ID NO: 1046488 - DNA, 16 bp, Homo sapiens
ggcaacgtagcctggg

SEQ ID NO: 1046489 - DNA, 19 bp, Homo sapiens
ggcaactgcattggctttg

SEQ ID NO: 1046490 - DNA, 19 bp, Homo sapiens
ggcaactggccatttgcca

SEQ ID NO: 1046491 - DNA, 16 bp, Homo sapiens
ggcaagaacagtgggc

SEQ ID NO: 1046492 - DNA, 21 bp, Homo sapiens
ggcaagaacccaagtgcctca

SEQ ID NO: 1046493 - DNA, 20 bp, Homo sapiens
ggcaagaattcttatgctta

SEQ ID NO: 1046494 - DNA, 17 bp, Homo sapiens
ggcaagacagaaaagtg

SEQ ID NO: 1046495 - DNA, 17 bp, Homo sapiens
ggcaagactgcaaactt

SEQ ID NO: 1046496 - DNA, 17 bp, Homo sapiens
ggcaagagactgggagc

SEQ ID NO: 1046497 - DNA, 16 bp, Homo sapiens
ggcaagagggaaggtg

SEQ ID NO: 1046498 - DNA, 20 bp, Homo sapiens
ggcaagagggaggggacaga

SEQ ID NO: 1046499 - DNA, 22 bp, Homo sapiens
ggcaagagggaggggacagagg

SEQ ID NO: 1046500 - DNA, 16 bp, Homo sapiens
ggcaagagggggtgga

SEQ ID NO: 1046501 - DNA, 17 bp, Homo sapiens
ggcaagagggtgacagc

SEQ ID NO: 1046502 - DNA, 15 bp, Homo sapiens
ggcaagatgtttctt

SEQ ID NO: 1046503 - DNA, 18 bp, Homo sapiens
ggcaagccagggcccaga

SEQ ID NO: 1046504 - DNA, 20 bp, Homo sapiens
ggcaagccagggcccagagc

SEQ ID NO: 1046505 - DNA, 14 bp, Homo sapiens
ggcaagcccctcag

SEQ ID NO: 1046506 - DNA, 18 bp, Homo sapiens
ggcaagcccctcagccct

SEQ ID NO: 1046507 - DNA, 22 bp, Homo sapiens
ggcaaggaaacaggctccaaga

SEQ ID NO: 1046508 - DNA, 12 bp, Homo sapiens
ggcaaggcaggt

SEQ ID NO: 1046509 - DNA, 22 bp, Homo sapiens
ggcaaggcaggtgcctccaggt

SEQ ID NO: 1046510 - DNA, 16 bp, Homo sapiens
ggcaagggctcctatc

SEQ ID NO: 1046511 - DNA, 15 bp, Homo sapiens
ggcaaggggtttcca

SEQ ID NO: 1046512 - DNA, 15 bp, Homo sapiens
ggcaagggtgcctca

SEQ ID NO: 1046513 - DNA, 16 bp, Homo sapiens
ggcaagtcacttaact

SEQ ID NO: 1046514 - DNA, 21 bp, Homo sapiens
ggcaagtcggggcctgggaca

SEQ ID NO: 1046515 - DNA, 16 bp, Homo sapiens
ggcaagtgagagggga

SEQ ID NO: 1046516 - DNA, 19 bp, Homo sapiens
ggcaagtgagaggggaggg

SEQ ID NO: 1046517 - DNA, 22 bp, Homo sapiens
ggcaagtgagaggggagggagg

SEQ ID NO: 1046518 - DNA, 23 bp, Homo sapiens
ggcaagtgagaggggagggaggg

SEQ ID NO: 1046519 - DNA, 13 bp, Homo sapiens
ggcaagtgattga

SEQ ID NO: 1046520 - DNA, 22 bp, Homo sapiens
ggcaagtggtagggatgaggtc

SEQ ID NO: 1046521 - DNA, 10 bp, Homo sapiens
ggcaataaac

SEQ ID NO: 1046522 - DNA, 20 bp, Homo sapiens
ggcaatgccatcagcccctg

SEQ ID NO: 1046523 - DNA, 23 bp, Homo sapiens
ggcaatgccatcagcccctggga

SEQ ID NO: 1046524 - DNA, 19 bp, Homo sapiens
ggcaatgggccgtcccctc

SEQ ID NO: 1046525 - DNA, 11 bp, Homo sapiens
ggcaattagtg

SEQ ID NO: 1046526 - DNA, 15 bp, Homo sapiens
ggcaattttgtggtt

SEQ ID NO: 1046527 - DNA, 13 bp, Homo sapiens
ggcacacagagat

SEQ ID NO: 1046528 - DNA, 19 bp, Homo sapiens
ggcacacagcagcccccca

SEQ ID NO: 1046529 - DNA, 17 bp, Homo sapiens
ggcacaccactgccctg

SEQ ID NO: 1046530 - DNA, 20 bp, Homo sapiens
ggcacaccactgccctgcct

SEQ ID NO: 1046531 - DNA, 21 bp, Homo sapiens
ggcacaccactgccctgcctg

SEQ ID NO: 1046532 - DNA, 21 bp, Homo sapiens
ggcacaccttccccggggttc

SEQ ID NO: 1046533 - DNA, 18 bp, Homo sapiens
ggcacacgcctcccactg

SEQ ID NO: 1046534 - DNA, 20 bp, Homo sapiens
ggcacacgcctgtagtccca

SEQ ID NO: 1046535 - DNA, 21 bp, Homo sapiens
ggcacagaaacacaatatttt

SEQ ID NO: 1046536 - DNA, 19 bp, Homo sapiens
ggcacagacttctggaagg

SEQ ID NO: 1046537 - DNA, 13 bp, Homo sapiens
ggcacagaggagg

SEQ ID NO: 1046538 - DNA, 17 bp, Homo sapiens
ggcacagatgaccaaag

SEQ ID NO: 1046539 - DNA, 17 bp, Homo sapiens
ggcacagattgaagaat

SEQ ID NO: 1046540 - DNA, 22 bp, Homo sapiens
ggcacagcggagtctgtcctgt

SEQ ID NO: 1046541 - DNA, 17 bp, Homo sapiens
ggcacagctgccctgct

SEQ ID NO: 1046542 - DNA, 14 bp, Homo sapiens
ggcacagctgtctg

SEQ ID NO: 1046543 - DNA, 17 bp, Homo sapiens
ggcacagctgtctgcca

SEQ ID NO: 1046544 - DNA, 23 bp, Homo sapiens
ggcacagctgtctgccaggcact

SEQ ID NO: 1046545 - DNA, 24 bp, Homo sapiens
ggcacagctgtctgccaggcactc

SEQ ID NO: 1046546 - DNA, 13 bp, Homo sapiens
ggcacaggcactg

SEQ ID NO: 1046547 - DNA, 14 bp, Homo sapiens
ggcacaggccccct

SEQ ID NO: 1046548 - DNA, 15 bp, Homo sapiens
ggcacaggccccctt

SEQ ID NO: 1046549 - DNA, 19 bp, Homo sapiens
ggcacagggtctgctcttt

SEQ ID NO: 1046550 - DNA, 15 bp, Homo sapiens
ggcacagtccaggaa

SEQ ID NO: 1046551 - DNA, 13 bp, Homo sapiens
ggcacagtgctgc

SEQ ID NO: 1046552 - DNA, 16 bp, Homo sapiens
ggcacagtgggagctg

SEQ ID NO: 1046553 - DNA, 19 bp, Homo sapiens
ggcacagtgggagctgagc

SEQ ID NO: 1046554 - DNA, 13 bp, Homo sapiens
ggcacatcagcac

SEQ ID NO: 1046555 - DNA, 18 bp, Homo sapiens
ggcacatgaaaaatttta

SEQ ID NO: 1046556 - DNA, 22 bp, Homo sapiens
ggcacattaactccctccacca

SEQ ID NO: 1046557 - DNA, 16 bp, Homo sapiens
ggcaccaaagccacca

SEQ ID NO: 1046558 - DNA, 15 bp, Homo sapiens
ggcaccaccaggagc

SEQ ID NO: 1046559 - DNA, 16 bp, Homo sapiens
ggcaccaccaggagca

SEQ ID NO: 1046560 - DNA, 15 bp, Homo sapiens
ggcaccaccagggtg

SEQ ID NO: 1046561 - DNA, 16 bp, Homo sapiens
ggcaccaccagggtgg

SEQ ID NO: 1046562 - DNA, 22 bp, Homo sapiens
ggcaccactgcactccagcctg

SEQ ID NO: 1046563 - DNA, 19 bp, Homo sapiens
ggcaccagaggctgcagaa

SEQ ID NO: 1046564 - DNA, 18 bp, Homo sapiens
ggcaccagatgcaacctc

SEQ ID NO: 1046565 - DNA, 17 bp, Homo sapiens
ggcaccagccccctgga

SEQ ID NO: 1046566 - DNA, 18 bp, Homo sapiens
tgacggtgcagtctgggt

SEQ ID NO: 1046567 - DNA, 13 bp, Homo sapiens
tgacgtattatct

SEQ ID NO: 1046568 - DNA, 19 bp, Homo sapiens
tgacgtcaagtctccttcc

SEQ ID NO: 1046569 - DNA, 23 bp, Homo sapiens
tgacgtcactttttggccatgta

SEQ ID NO: 1046570 - DNA, 18 bp, Homo sapiens
tgacgtgcacctgtactc

SEQ ID NO: 1046571 - DNA, 23 bp, Homo sapiens
tgacgtgcacctgtactcaggag

SEQ ID NO: 1046572 - DNA, 23 bp, Homo sapiens
tgacgtgcactgtgaatcctggc

SEQ ID NO: 1046573 - DNA, 18 bp, Homo sapiens
tgacgtgccttttgcacc

SEQ ID NO: 1046574 - DNA, 23 bp, Homo sapiens
tgacgtgccttttgcacccctcc

SEQ ID NO: 1046575 - DNA, 14 bp, Homo sapiens
tgacgttccgggca

SEQ ID NO: 1046576 - DNA, 15 bp, Homo sapiens
tgacgttgttgtcat

SEQ ID NO: 1046577 - DNA, 12 bp, Homo sapiens
tgacgtttacat

SEQ ID NO: 1046578 - DNA, 22 bp, Homo sapiens
tgactaaaaaacaaagaagaca

SEQ ID NO: 1046579 - DNA, 22 bp, Homo sapiens
tgactaaaaatattataactta

SEQ ID NO: 1046580 - DNA, 18 bp, Homo sapiens
tgactaaactttttttct

SEQ ID NO: 1046581 - DNA, 17 bp, Homo sapiens
tgactaaagagagaatg

SEQ ID NO: 1046582 - DNA, 17 bp, Homo sapiens
tgactaaagctatgtta

SEQ ID NO: 1046583 - DNA, 12 bp, Homo sapiens
tgactaaataaa

SEQ ID NO: 1046584 - DNA, 15 bp, Homo sapiens
tgactaaattttctt

SEQ ID NO: 1046585 - DNA, 13 bp, Homo sapiens
tgactaagaattt

SEQ ID NO: 1046586 - DNA, 23 bp, Homo sapiens
tgactaatgctttttagaaagca

SEQ ID NO: 1046587 - DNA, 21 bp, Homo sapiens
tgactaattttacatgtttat

SEQ ID NO: 1046588 - DNA, 22 bp, Homo sapiens
tgactactaacaaatgtaaaat

SEQ ID NO: 1046589 - DNA, 21 bp, Homo sapiens
tgactagaagggccagtcctg

SEQ ID NO: 1046590 - DNA, 23 bp, Homo sapiens
tgactagatgatggatgccaata

SEQ ID NO: 1046591 - DNA, 18 bp, Homo sapiens
tgactaggcatacactgt

SEQ ID NO: 1046592 - DNA, 23 bp, Homo sapiens
tgactagggattcaggctgcttg

SEQ ID NO: 1046593 - DNA, 23 bp, Homo sapiens
tgactaggtattgtctactctga

SEQ ID NO: 1046594 - DNA, 16 bp, Homo sapiens
tgactagtagatttct

SEQ ID NO: 1046595 - DNA, 21 bp, Homo sapiens
tgactatatagagatgttttt

SEQ ID NO: 1046596 - DNA, 13 bp, Homo sapiens
tgactatgtaaac

SEQ ID NO: 1046597 - DNA, 13 bp, Homo sapiens
tgactcaaggcca

SEQ ID NO: 1046598 - DNA, 18 bp, Homo sapiens
tgactcaaggccaataat

SEQ ID NO: 1046599 - DNA, 14 bp, Homo sapiens
tgactcacacctga

SEQ ID NO: 1046600 - DNA, 12 bp, Homo sapiens
tgactcacccaa

SEQ ID NO: 1046601 - DNA, 18 bp, Homo sapiens
tgactcacttatcccaag

SEQ ID NO: 1046602 - DNA, 16 bp, Homo sapiens
tgactcagatgtctct

SEQ ID NO: 1046603 - DNA, 16 bp, Homo sapiens
tgactcagcagaggca

SEQ ID NO: 1046604 - DNA, 16 bp, Homo sapiens
tgactcataggtccct

SEQ ID NO: 1046605 - DNA, 21 bp, Homo sapiens
tgactcatggcagctgtttct

SEQ ID NO: 1046606 - DNA, 15 bp, Homo sapiens
tgactccaaccattc

SEQ ID NO: 1046607 - DNA, 13 bp, Homo sapiens
tgactccagagtc

SEQ ID NO: 1046608 - DNA, 18 bp, Homo sapiens
tgactccagagtctgagc

SEQ ID NO: 1046609 - DNA, 13 bp, Homo sapiens
tgactccctcccc

SEQ ID NO: 1046610 - DNA, 12 bp, Homo sapiens
tgactccctggg

SEQ ID NO: 1046611 - DNA, 14 bp, Homo sapiens
tgactccctgggag

SEQ ID NO: 1046612 - DNA, 21 bp, Homo sapiens
tgactccctgggagccgcctg

SEQ ID NO: 1046613 - DNA, 13 bp, Homo sapiens
tgactccctgtgg

SEQ ID NO: 1046614 - DNA, 15 bp, Homo sapiens
tgactccctgtgggg

SEQ ID NO: 1046615 - DNA, 14 bp, Homo sapiens
tgactcctggactc

SEQ ID NO: 1046616 - DNA, 20 bp, Homo sapiens
tgactcgacaaaggccacag

SEQ ID NO: 1046617 - DNA, 14 bp, Homo sapiens
tgactcgggagctg

SEQ ID NO: 1046618 - DNA, 16 bp, Homo sapiens
tgactcgggagctgca

SEQ ID NO: 1046619 - DNA, 17 bp, Homo sapiens
tgactcgggagctgcac

SEQ ID NO: 1046620 - DNA, 20 bp, Homo sapiens
tgactcgggagctgcacaca

SEQ ID NO: 1046621 - DNA, 18 bp, Homo sapiens
tgactcgggggtggggaa

SEQ ID NO: 1046622 - DNA, 14 bp, Homo sapiens
tgactcggtttctc

SEQ ID NO: 1046623 - DNA, 15 bp, Homo sapiens
tgactctataagcaa

SEQ ID NO: 1046624 - DNA, 16 bp, Homo sapiens
tgactctcacctgtac

SEQ ID NO: 1046625 - DNA, 11 bp, Homo sapiens
tgactctccac

SEQ ID NO: 1046626 - DNA, 20 bp, Homo sapiens
tgactctctgagctggggag

SEQ ID NO: 1046627 - DNA, 13 bp, Homo sapiens
tgactctctgtga

SEQ ID NO: 1046628 - DNA, 16 bp, Homo sapiens
tgactctgaaatctga

SEQ ID NO: 1046629 - DNA, 22 bp, Homo sapiens
tgactctgaaatctgaagacct

SEQ ID NO: 1046630 - DNA, 15 bp, Homo sapiens
tgactcttccgtgca

SEQ ID NO: 1046631 - DNA, 15 bp, Homo sapiens
tgactcttggagcct

SEQ ID NO: 1046632 - DNA, 16 bp, Homo sapiens
tgactctttattgtct

SEQ ID NO: 1046633 - DNA, 13 bp, Homo sapiens
tgactctttcaaa

SEQ ID NO: 1046634 - DNA, 19 bp, Homo sapiens
tgactctttcctaaagcca

SEQ ID NO: 1046635 - DNA, 23 bp, Homo sapiens
tgactctttctgaaggaagagaa

SEQ ID NO: 1046636 - DNA, 22 bp, Homo sapiens
tgactgaacgatccttcaaagt

SEQ ID NO: 1046637 - DNA, 14 bp, Homo sapiens
tgactgaaggaaaa

SEQ ID NO: 1046638 - DNA, 15 bp, Homo sapiens
tgactgaaggaaaag

SEQ ID NO: 1046639 - DNA, 15 bp, Homo sapiens
tgactgaatttcttt

SEQ ID NO: 1046640 - DNA, 21 bp, Homo sapiens
tgactgcaagcatttttccat

SEQ ID NO: 1046641 - DNA, 22 bp, Homo sapiens
tgactgcaccagcgcccccaga

SEQ ID NO: 1046642 - DNA, 17 bp, Homo sapiens
tgactgcacccagctcc

SEQ ID NO: 1046643 - DNA, 18 bp, Homo sapiens
tgactgcacccagctcca

SEQ ID NO: 1046644 - DNA, 12 bp, Homo sapiens
tgactgcagttg

SEQ ID NO: 1046645 - DNA, 19 bp, Homo sapiens
tgactgccaggataaagct

SEQ ID NO: 1046646 - DNA, 20 bp, Homo sapiens
tgactgctcagaacttgctg

SEQ ID NO: 1046647 - DNA, 20 bp, Homo sapiens
tgactgctccccagccctgg

SEQ ID NO: 1046648 - DNA, 11 bp, Homo sapiens
tgactgctgct

SEQ ID NO: 1046649 - DNA, 16 bp, Homo sapiens
tgactgctgctcccca

SEQ ID NO: 1046650 - DNA, 20 bp, Homo sapiens
tgactgctgctccccacccc

SEQ ID NO: 1046651 - DNA, 13 bp, Homo sapiens
tgactggagtaaa

SEQ ID NO: 1046652 - DNA, 14 bp, Homo sapiens
tgactggctgtctg

SEQ ID NO: 1046653 - DNA, 15 bp, Homo sapiens
tgactgggaaagtta

SEQ ID NO: 1046654 - DNA, 17 bp, Homo sapiens
tgactgggcaacactgc

SEQ ID NO: 1046655 - DNA, 18 bp, Homo sapiens
tgactgggcaacactgca

SEQ ID NO: 1046656 - DNA, 19 bp, Homo sapiens
tgactgggcaacactgcag

SEQ ID NO: 1046657 - DNA, 13 bp, Homo sapiens
tgactgggccaca

SEQ ID NO: 1046658 - DNA, 14 bp, Homo sapiens
tgactgggccacag

SEQ ID NO: 1046659 - DNA, 17 bp, Homo sapiens
tgactggggagggctgc

SEQ ID NO: 1046660 - DNA, 11 bp, Homo sapiens
tgactggggct

SEQ ID NO: 1046661 - DNA, 19 bp, Homo sapiens
tgactggggctggggtgag

SEQ ID NO: 1046662 - DNA, 14 bp, Homo sapiens
tgactggttgtcag

SEQ ID NO: 1046663 - DNA, 15 bp, Homo sapiens
tgactggttgtcaga

SEQ ID NO: 1046664 - DNA, 16 bp, Homo sapiens
tgactggttgtcagaa

SEQ ID NO: 1046665 - DNA, 18 bp, Homo sapiens
tgactggttgtcagaatg

SEQ ID NO: 1046666 - DNA, 21 bp, Homo sapiens
tgactggttgtcagaatggaa

SEQ ID NO: 1046667 - DNA, 21 bp, Homo sapiens
tgactggtttacaggccctgc

SEQ ID NO: 1046668 - DNA, 19 bp, Homo sapiens
tgactgtaccacagacaca

SEQ ID NO: 1046669 - DNA, 15 bp, Homo sapiens
tgactgtagccacag

SEQ ID NO: 1046670 - DNA, 12 bp, Homo sapiens
tgactgtatcta

SEQ ID NO: 1046671 - DNA, 16 bp, Homo sapiens
tgactgtatctgtgta

SEQ ID NO: 1046672 - DNA, 17 bp, Homo sapiens
tgactgtatctgtgtag

SEQ ID NO: 1046673 - DNA, 14 bp, Homo sapiens
tgactgtcagcaag

SEQ ID NO: 1046674 - DNA, 15 bp, Homo sapiens
tgactgtcagggagg

SEQ ID NO: 1046675 - DNA, 16 bp, Homo sapiens
tgactgtcagggaggg

SEQ ID NO: 1046676 - DNA, 16 bp, Homo sapiens
tgactgtccaggagct

SEQ ID NO: 1046677 - DNA, 22 bp, Homo sapiens
tgactgtcccaccgggagcctc

SEQ ID NO: 1046678 - DNA, 22 bp, Homo sapiens
tgactgtctagccactccctcc

SEQ ID NO: 1046679 - DNA, 18 bp, Homo sapiens
tgactgtgaactgggcat

SEQ ID NO: 1046680 - DNA, 21 bp, Homo sapiens
tgactgtggtagccagcatcg

SEQ ID NO: 1046681 - DNA, 17 bp, Homo sapiens
tgactgttgatgaagta

SEQ ID NO: 1046682 - DNA, 18 bp, Homo sapiens
tgactgttgatgaagtat

SEQ ID NO: 1046683 - DNA, 21 bp, Homo sapiens
tgactgttgtagcattttcct

SEQ ID NO: 1046684 - DNA, 22 bp, Homo sapiens
tgactgttgtagcattttcctg

SEQ ID NO: 1046685 - DNA, 16 bp, Homo sapiens
tgactgtttcattcac

SEQ ID NO: 1046686 - DNA, 17 bp, Homo sapiens
tgactgtttcttttgta

SEQ ID NO: 1046687 - DNA, 16 bp, Homo sapiens
tgactgtttggcttat

SEQ ID NO: 1046688 - DNA, 22 bp, Homo sapiens
tgactgtttggcttataaacac

SEQ ID NO: 1046689 - DNA, 16 bp, Homo sapiens
tgactgttttttttgc

SEQ ID NO: 1046690 - DNA, 13 bp, Homo sapiens
tgacttaatgtga

SEQ ID NO: 1046691 - DNA, 13 bp, Homo sapiens
tgacttactgtac

SEQ ID NO: 1046692 - DNA, 20 bp, Homo sapiens
tgacttactgtacatgaaaa

SEQ ID NO: 1046693 - DNA, 20 bp, Homo sapiens
tgacttagacctatactgaa

SEQ ID NO: 1046694 - DNA, 23 bp, Homo sapiens
tgacttagatattaaaatttggt

SEQ ID NO: 1046695 - DNA, 20 bp, Homo sapiens
tgacttagcgtcaagacatt

SEQ ID NO: 1046696 - DNA, 23 bp, Homo sapiens
tgacttaggtaaaataaaagact

SEQ ID NO: 1046697 - DNA, 16 bp, Homo sapiens
tgacttaggtttttag

SEQ ID NO: 1046698 - DNA, 14 bp, Homo sapiens
tgacttatagtaca

SEQ ID NO: 1046699 - DNA, 22 bp, Homo sapiens
tgacttattccctgagactttt

SEQ ID NO: 1046700 - DNA, 14 bp, Homo sapiens
tgacttatttctgc

SEQ ID NO: 1046701 - DNA, 20 bp, Homo sapiens
tgacttatttctgctctgga

SEQ ID NO: 1046702 - DNA, 21 bp, Homo sapiens
tgacttatttctgctctggaa

SEQ ID NO: 1046703 - DNA, 17 bp, Homo sapiens
tgacttattttgtctta

SEQ ID NO: 1046704 - DNA, 18 bp, Homo sapiens
tgacttattttgtcttat

SEQ ID NO: 1046705 - DNA, 17 bp, Homo sapiens
tgacttcaatgatagta

SEQ ID NO: 1046706 - DNA, 13 bp, Homo sapiens
tgacttcactgta

SEQ ID NO: 1046707 - DNA, 19 bp, Homo sapiens
tgacttcatggaatggaca

SEQ ID NO: 1046708 - DNA, 16 bp, Homo sapiens
tgacttcatttgtgcc

SEQ ID NO: 1046709 - DNA, 19 bp, Homo sapiens
tgacttcatttgtgccaca

SEQ ID NO: 1046710 - DNA, 16 bp, Homo sapiens
tgacttccctggtcac

SEQ ID NO: 1046711 - DNA, 14 bp, Homo sapiens
tgacttcctggtga

SEQ ID NO: 1046712 - DNA, 20 bp, Homo sapiens
tgacttcgactgtgacctgt

SEQ ID NO: 1046713 - DNA, 16 bp, Homo sapiens
tgacttctagcagaga

SEQ ID NO: 1046714 - DNA, 21 bp, Homo sapiens
tgacttctagctgtctgtgaa

SEQ ID NO: 1046715 - DNA, 11 bp, Homo sapiens
tgacttctccc

SEQ ID NO: 1046716 - DNA, 14 bp, Homo sapiens
tgacttctcccccg

SEQ ID NO: 1046717 - DNA, 14 bp, Homo sapiens
tgacttctcccctg

SEQ ID NO: 1046718 - DNA, 16 bp, Homo sapiens
tgacttctgcctggag

SEQ ID NO: 1046719 - DNA, 21 bp, Homo sapiens
tgacttctgctggcatcaaga

SEQ ID NO: 1046720 - DNA, 16 bp, Homo sapiens
tgacttgactttagtc

SEQ ID NO: 1046721 - DNA, 14 bp, Homo sapiens
tgacttgagccact

SEQ ID NO: 1046722 - DNA, 12 bp, Homo sapiens
tgacttgagtgt

SEQ ID NO: 1046723 - DNA, 12 bp, Homo sapiens
tgacttgcttta

SEQ ID NO: 1046724 - DNA, 15 bp, Homo sapiens
tgacttgctttagtt

SEQ ID NO: 1046725 - DNA, 19 bp, Homo sapiens
tgacttggcacttaagtgc

SEQ ID NO: 1046726 - DNA, 21 bp, Homo sapiens
tgacttggtggcttttccttg

SEQ ID NO: 1046727 - DNA, 22 bp, Homo sapiens
tgacttggttctgaagccatgt

SEQ ID NO: 1046728 - DNA, 19 bp, Homo sapiens
tgacttgtatattttaaga

SEQ ID NO: 1046729 - DNA, 13 bp, Homo sapiens
tgacttgttctga

SEQ ID NO: 1046730 - DNA, 18 bp, Homo sapiens
tgactttacgcccatctc

SEQ ID NO: 1046731 - DNA, 20 bp, Homo sapiens
tgactttacttgtggtgtga

SEQ ID NO: 1046732 - DNA, 18 bp, Homo sapiens
tgactttagtctgcaaaa

SEQ ID NO: 1046733 - DNA, 12 bp, Homo sapiens
tgactttataaa

SEQ ID NO: 1046734 - DNA, 17 bp, Homo sapiens
tgactttatctcctgct

SEQ ID NO: 1046735 - DNA, 18 bp, Homo sapiens
tgactttatgttgtatga

SEQ ID NO: 1046736 - DNA, 23 bp, Homo sapiens
tgactttatgttgtatgattcca

SEQ ID NO: 1046737 - DNA, 21 bp, Homo sapiens
tgactttattgcttaatttct

SEQ ID NO: 1046738 - DNA, 16 bp, Homo sapiens
tgactttatttttcta

SEQ ID NO: 1046739 - DNA, 12 bp, Homo sapiens
tgactttgaact

SEQ ID NO: 1046740 - DNA, 14 bp, Homo sapiens
tgactttgaactga

SEQ ID NO: 1046741 - DNA, 14 bp, Homo sapiens
tgactttgccccct

SEQ ID NO: 1046742 - DNA, 15 bp, Homo sapiens
tgactttgcttgctt

SEQ ID NO: 1046743 - DNA, 13 bp, Homo sapiens
tgactttggggac

SEQ ID NO: 1046744 - DNA, 15 bp, Homo sapiens
tgactttggggacag

SEQ ID NO: 1046745 - DNA, 12 bp, Homo sapiens
tgactttgtata

SEQ ID NO: 1046746 - DNA, 15 bp, Homo sapiens
tgacttttctgatta

SEQ ID NO: 1046747 - DNA, 19 bp, Homo sapiens
tgacttttctgattaatat

SEQ ID NO: 1046748 - DNA, 19 bp, Homo sapiens
tgacttttctgtaattcag

SEQ ID NO: 1046749 - DNA, 17 bp, Homo sapiens
tgactttttagccagtg

SEQ ID NO: 1046750 - DNA, 18 bp, Homo sapiens
tgactttttagccagtga

SEQ ID NO: 1046751 - DNA, 14 bp, Homo sapiens
tgactttttataaa

SEQ ID NO: 1046752 - DNA, 22 bp, Homo sapiens
tgactttttctgagcttttcat

SEQ ID NO: 1046753 - DNA, 17 bp, Homo sapiens
tgactttttgcatttaa

SEQ ID NO: 1046754 - DNA, 22 bp, Homo sapiens
tgactttttggaattcagcagt

SEQ ID NO: 1046755 - DNA, 23 bp, Homo sapiens
tgactttttggaattcagcagtt

SEQ ID NO: 1046756 - DNA, 23 bp, Homo sapiens
tgagaaaaatagagcaaaatcaa

SEQ ID NO: 1046757 - DNA, 13 bp, Homo sapiens
tgagaaaactcaa

SEQ ID NO: 1046758 - DNA, 17 bp, Homo sapiens
tgagaaaacttctttta

SEQ ID NO: 1046759 - DNA, 19 bp, Homo sapiens
tgagaaaagtattctcaaa

SEQ ID NO: 1046760 - DNA, 20 bp, Homo sapiens
tgagaaaatgcgagactctg

SEQ ID NO: 1046761 - DNA, 20 bp, Homo sapiens
tgagaaacaacaatttctac

SEQ ID NO: 1046762 - DNA, 18 bp, Homo sapiens
tgagaaacttaaatgtta

SEQ ID NO: 1046763 - DNA, 22 bp, Homo sapiens
tgagaaactttgatctctgctt

SEQ ID NO: 1046764 - DNA, 19 bp, Homo sapiens
tgagaaagatgttccagtg

SEQ ID NO: 1046765 - DNA, 15 bp, Homo sapiens
tgagaaagcccacct

SEQ ID NO: 1046766 - DNA, 17 bp, Homo sapiens
tgagaaagcccacctgg

SEQ ID NO: 1046767 - DNA, 22 bp, Homo sapiens
tgagaaagcccacctgggctgg

SEQ ID NO: 1046768 - DNA, 21 bp, Homo sapiens
tgagaaagcttttattccttt

SEQ ID NO: 1046769 - DNA, 19 bp, Homo sapiens
tgagaaagggatggtggag

SEQ ID NO: 1046770 - DNA, 13 bp, Homo sapiens
tgagaaagggcat

SEQ ID NO: 1046771 - DNA, 16 bp, Homo sapiens
tgagaaataggtatca

SEQ ID NO: 1046772 - DNA, 21 bp, Homo sapiens
tgagaaataggtatcaaaata

SEQ ID NO: 1046773 - DNA, 14 bp, Homo sapiens
tgagaaatcctgga

SEQ ID NO: 1046774 - DNA, 22 bp, Homo sapiens
tgagaaatgaataatttcccaa

SEQ ID NO: 1046775 - DNA, 14 bp, Homo sapiens
tgagaaatgttaaa

SEQ ID NO: 1046776 - DNA, 14 bp, Homo sapiens
tgagaaatttaaac

SEQ ID NO: 1046777 - DNA, 17 bp, Homo sapiens
tgagaaatttaaactat

SEQ ID NO: 1046778 - DNA, 18 bp, Homo sapiens
tgagaaatttaaactata

SEQ ID NO: 1046779 - DNA, 20 bp, Homo sapiens
tgagaacaaagctgttaaac

SEQ ID NO: 1046780 - DNA, 22 bp, Homo sapiens
tgagaacaaagctgttaaactg

SEQ ID NO: 1046781 - DNA, 23 bp, Homo sapiens
tgagaacaaagctgttaaactgt

SEQ ID NO: 1046782 - DNA, 20 bp, Homo sapiens
tgagaacagcatatgatttc

SEQ ID NO: 1046783 - DNA, 20 bp, Homo sapiens
tgagaacatccataatttgg

SEQ ID NO: 1046784 - DNA, 16 bp, Homo sapiens
tgagaaccgtgacatc

SEQ ID NO: 1046785 - DNA, 20 bp, Homo sapiens
tgagaaccttggaccactcc

SEQ ID NO: 1046786 - DNA, 17 bp, Homo sapiens
tgagaactcagaagaga

SEQ ID NO: 1046787 - DNA, 21 bp, Homo sapiens
tgagaactcagaagagaaata

SEQ ID NO: 1046788 - DNA, 23 bp, Homo sapiens
tgagaactctctccctggtctct

SEQ ID NO: 1046789 - DNA, 14 bp, Homo sapiens
tgagaactgacaaa

SEQ ID NO: 1046790 - DNA, 15 bp, Homo sapiens
tgagaactgacaaag

SEQ ID NO: 1046791 - DNA, 13 bp, Homo sapiens
tgagaactgactt

SEQ ID NO: 1046792 - DNA, 17 bp, Homo sapiens
tgagaactgactttctc

SEQ ID NO: 1046793 - DNA, 20 bp, Homo sapiens
tgagaactgcatatgtttcg

SEQ ID NO: 1046794 - DNA, 21 bp, Homo sapiens
tgagaacttttttgaggcctt

SEQ ID NO: 1046795 - DNA, 18 bp, Homo sapiens
tgagaagaagtggctgcc

SEQ ID NO: 1046796 - DNA, 15 bp, Homo sapiens
tgagaagaatgaaaa

SEQ ID NO: 1046797 - DNA, 16 bp, Homo sapiens
tgagaagaatgaaaat

SEQ ID NO: 1046798 - DNA, 17 bp, Homo sapiens
tgagaagagcttgcaca

SEQ ID NO: 1046799 - DNA, 18 bp, Homo sapiens
tgagaagagcttgcacag

SEQ ID NO: 1046800 - DNA, 19 bp, Homo sapiens
tgagaagagcttgcacagc

SEQ ID NO: 1046801 - DNA, 16 bp, Homo sapiens
tgagaagaggaggagg

SEQ ID NO: 1046802 - DNA, 15 bp, Homo sapiens
tgagaagagggcctg

SEQ ID NO: 1046803 - DNA, 20 bp, Homo sapiens
tgagaagagggcctgtggga

SEQ ID NO: 1046804 - DNA, 16 bp, Homo sapiens
tgagaagataatcatt

SEQ ID NO: 1046805 - DNA, 19 bp, Homo sapiens
tgagaagcagtataagcct

SEQ ID NO: 1046806 - DNA, 13 bp, Homo sapiens
tgagaagccaagc

SEQ ID NO: 1046807 - DNA, 19 bp, Homo sapiens
tgagaagccttcagctcca

SEQ ID NO: 1046808 - DNA, 14 bp, Homo sapiens
tgagaagcggtcat

SEQ ID NO: 1046809 - DNA, 13 bp, Homo sapiens
tgagaagctgagg

SEQ ID NO: 1046810 - DNA, 12 bp, Homo sapiens
gtattatttata

SEQ ID NO: 1046811 - DNA, 19 bp, Homo sapiens
gtattcaaaaattatctat

SEQ ID NO: 1046812 - DNA, 20 bp, Homo sapiens
gtattcaacaatttcaataa

SEQ ID NO: 1046813 - DNA, 18 bp, Homo sapiens
gtattcaagcaaacatca

SEQ ID NO: 1046814 - DNA, 22 bp, Homo sapiens
gtattcaataccgctcagtatt

SEQ ID NO: 1046815 - DNA, 23 bp, Homo sapiens
gtattcaataccgctcagtattt

SEQ ID NO: 1046816 - DNA, 13 bp, Homo sapiens
gtattcagaggca

SEQ ID NO: 1046817 - DNA, 14 bp, Homo sapiens
gtattcaggcactg

SEQ ID NO: 1046818 - DNA, 15 bp, Homo sapiens
gtattcaggcactga

SEQ ID NO: 1046819 - DNA, 19 bp, Homo sapiens
gtattccaccttaaattaa

SEQ ID NO: 1046820 - DNA, 18 bp, Homo sapiens
gtattccatgagctgctc

SEQ ID NO: 1046821 - DNA, 14 bp, Homo sapiens
gtattcccttcagg

SEQ ID NO: 1046822 - DNA, 16 bp, Homo sapiens
gtattcccttgtattt

SEQ ID NO: 1046823 - DNA, 22 bp, Homo sapiens
gtattcccttgtattttgttaa

SEQ ID NO: 1046824 - DNA, 16 bp, Homo sapiens
gtattcctagcaaatt

SEQ ID NO: 1046825 - DNA, 23 bp, Homo sapiens
gtattcctagcaaatttctctct

SEQ ID NO: 1046826 - DNA, 20 bp, Homo sapiens
gtattccttttgtgtacagt

SEQ ID NO: 1046827 - DNA, 17 bp, Homo sapiens
gtattctagtggctgtt

SEQ ID NO: 1046828 - DNA, 18 bp, Homo sapiens
gtattctagtggctgttc

SEQ ID NO: 1046829 - DNA, 14 bp, Homo sapiens
gtattctcagagca

SEQ ID NO: 1046830 - DNA, 18 bp, Homo sapiens
gtattctcagagcatgtg

SEQ ID NO: 1046831 - DNA, 21 bp, Homo sapiens
gtattctcagagcatgtgtca

SEQ ID NO: 1046832 - DNA, 16 bp, Homo sapiens
gtattctgacatgtaa

SEQ ID NO: 1046833 - DNA, 13 bp, Homo sapiens
gtattctgtggcc

SEQ ID NO: 1046834 - DNA, 15 bp, Homo sapiens
gtattcttcaacctc

SEQ ID NO: 1046835 - DNA, 16 bp, Homo sapiens
gtattcttgtttgaat

SEQ ID NO: 1046836 - DNA, 17 bp, Homo sapiens
gtattgaaaacttcaaa

SEQ ID NO: 1046837 - DNA, 22 bp, Homo sapiens
gtattgacaactgcacatgaaa

SEQ ID NO: 1046838 - DNA, 21 bp, Homo sapiens
gtattgactgtaccacagaca

SEQ ID NO: 1046839 - DNA, 17 bp, Homo sapiens
gtattgagatattacac

SEQ ID NO: 1046840 - DNA, 21 bp, Homo sapiens
gtattgagggccagtgatgat

SEQ ID NO: 1046841 - DNA, 23 bp, Homo sapiens
gtattgagggccagtgatgatgt

SEQ ID NO: 1046842 - DNA, 22 bp, Homo sapiens
gtattgattacaaataaacagt

SEQ ID NO: 1046843 - DNA, 21 bp, Homo sapiens
gtattgcacattgtaaaaagt

SEQ ID NO: 1046844 - DNA, 19 bp, Homo sapiens
gtattgccacctctggcca

SEQ ID NO: 1046845 - DNA, 16 bp, Homo sapiens
gtattgcttattttat

SEQ ID NO: 1046846 - DNA, 13 bp, Homo sapiens
gtattgcttcctg

SEQ ID NO: 1046847 - DNA, 22 bp, Homo sapiens
gtattggaaaataaaaatgcta

SEQ ID NO: 1046848 - DNA, 18 bp, Homo sapiens
gtattggagcacatgtta

SEQ ID NO: 1046849 - DNA, 12 bp, Homo sapiens
gtattggcctgg

SEQ ID NO: 1046850 - DNA, 13 bp, Homo sapiens
gtattgtaaaaca

SEQ ID NO: 1046851 - DNA, 15 bp, Homo sapiens
gtattgtaaaacatt

SEQ ID NO: 1046852 - DNA, 11 bp, Homo sapiens
gtattgtaaat

SEQ ID NO: 1046853 - DNA, 20 bp, Homo sapiens
gtattgtaaattatatttgt

SEQ ID NO: 1046854 - DNA, 18 bp, Homo sapiens
gtattgtaagtggaaaat

SEQ ID NO: 1046855 - DNA, 16 bp, Homo sapiens
gtattgtctactctga

SEQ ID NO: 1046856 - DNA, 23 bp, Homo sapiens
gtattgtgttttgctttggaaac

SEQ ID NO: 1046857 - DNA, 15 bp, Homo sapiens
ttgtgagagcgaggc

SEQ ID NO: 1046858 - DNA, 18 bp, Homo sapiens
ttgtgagccaccacgtcc

SEQ ID NO: 1046859 - DNA, 21 bp, Homo sapiens
ttgtgagctctggttattttt

SEQ ID NO: 1046860 - DNA, 13 bp, Homo sapiens
ttgtgagctggat

SEQ ID NO: 1046861 - DNA, 20 bp, Homo sapiens
ttgtgaggcttctaataaag

SEQ ID NO: 1046862 - DNA, 22 bp, Homo sapiens
ttgtgagtttaccttgtatact

SEQ ID NO: 1046863 - DNA, 18 bp, Homo sapiens
ttgtgatacaatgctgtg

SEQ ID NO: 1046864 - DNA, 18 bp, Homo sapiens
ttgtgatattaaatttca

SEQ ID NO: 1046865 - DNA, 20 bp, Homo sapiens
ttgtgatcagcattgtgact

SEQ ID NO: 1046866 - DNA, 15 bp, Homo sapiens
ttgtgatgaatcaat

SEQ ID NO: 1046867 - DNA, 17 bp, Homo sapiens
ttgtgatgatgctgtga

SEQ ID NO: 1046868 - DNA, 19 bp, Homo sapiens
ttgtgatgtatattccttt

SEQ ID NO: 1046869 - DNA, 20 bp, Homo sapiens
ttgtgatgtatattcctttg

SEQ ID NO: 1046870 - DNA, 22 bp, Homo sapiens
ttgtgattatttcactttagat

SEQ ID NO: 1046871 - DNA, 14 bp, Homo sapiens
ttgtgattcctacc

SEQ ID NO: 1046872 - DNA, 14 bp, Homo sapiens
ttgtgatttcttta

SEQ ID NO: 1046873 - DNA, 23 bp, Homo sapiens
ttgtgatttctttaaaagaatga

SEQ ID NO: 1046874 - DNA, 12 bp, Homo sapiens
ttgtgatttttg

SEQ ID NO: 1046875 - DNA, 18 bp, Homo sapiens
ttgtgcacatttatttcc

SEQ ID NO: 1046876 - DNA, 21 bp, Homo sapiens
ttgtgcaccctctatcccaat

SEQ ID NO: 1046877 - DNA, 18 bp, Homo sapiens
ttgtgcagtgttagtatt

SEQ ID NO: 1046878 - DNA, 19 bp, Homo sapiens
ttgtgcatgtttactttat

SEQ ID NO: 1046879 - DNA, 22 bp, Homo sapiens
ttgtgcattatctagatactgt

SEQ ID NO: 1046880 - DNA, 16 bp, Homo sapiens
ttgtgcattctttggt

SEQ ID NO: 1046881 - DNA, 15 bp, Homo sapiens
ttgtgccaagccttc

SEQ ID NO: 1046882 - DNA, 20 bp, Homo sapiens
ttgtgccaagccttctgtga

SEQ ID NO: 1046883 - DNA, 22 bp, Homo sapiens
ttgtgccaatatgtattgtaaa

SEQ ID NO: 1046884 - DNA, 17 bp, Homo sapiens
ttgtgccagcccggagg

SEQ ID NO: 1046885 - DNA, 20 bp, Homo sapiens
ttgtgcccagggttttgccc

SEQ ID NO: 1046886 - DNA, 16 bp, Homo sapiens
ttgtgccccttcactc

SEQ ID NO: 1046887 - DNA, 17 bp, Homo sapiens
ttgtgcccttgtatagt

SEQ ID NO: 1046888 - DNA, 23 bp, Homo sapiens
ttgtgctacttagtaaaaattga

SEQ ID NO: 1046889 - DNA, 18 bp, Homo sapiens
ttgtgctagaaattttca

SEQ ID NO: 1046890 - DNA, 23 bp, Homo sapiens
ttgtgctcctcttgattcctggt

SEQ ID NO: 1046891 - DNA, 22 bp, Homo sapiens
ttgtgctgatcgtgctaaattt

SEQ ID NO: 1046892 - DNA, 20 bp, Homo sapiens
ttgtgctgggtcccagcctg

SEQ ID NO: 1046893 - DNA, 14 bp, Homo sapiens
ttgtgctgtgggca

SEQ ID NO: 1046894 - DNA, 19 bp, Homo sapiens
ttgtgctgtgggcagcacc

SEQ ID NO: 1046895 - DNA, 21 bp, Homo sapiens
ttgtgcttcacagtagagcca

SEQ ID NO: 1046896 - DNA, 13 bp, Homo sapiens
ttgtgcttcttca

SEQ ID NO: 1046897 - DNA, 22 bp, Homo sapiens
ttgtgcttgtcattccagagtg

SEQ ID NO: 1046898 - DNA, 19 bp, Homo sapiens
ttgtgctttgctcttgtcc

SEQ ID NO: 1046899 - DNA, 14 bp, Homo sapiens
ttgtgcttttcctg

SEQ ID NO: 1046900 - DNA, 21 bp, Homo sapiens
ttgtggaaaatgaaaattagg

SEQ ID NO: 1046901 - DNA, 23 bp, Homo sapiens
ttgtggaaagataataaattgat

SEQ ID NO: 1046902 - DNA, 15 bp, Homo sapiens
ttgtggaacaaaagt

SEQ ID NO: 1046903 - DNA, 22 bp, Homo sapiens
ttgtggaatggagattcagttt

SEQ ID NO: 1046904 - DNA, 22 bp, Homo sapiens
ttgtggagcgccagctctgccc

SEQ ID NO: 1046905 - DNA, 17 bp, Homo sapiens
ttgtggatgctccaggg

SEQ ID NO: 1046906 - DNA, 18 bp, Homo sapiens
ttgtggattataaaaaat

SEQ ID NO: 1046907 - DNA, 21 bp, Homo sapiens
ttgtggatttaacagaaatgt

SEQ ID NO: 1046908 - DNA, 19 bp, Homo sapiens
ttgtggccccttttacttt

SEQ ID NO: 1046909 - DNA, 11 bp, Homo sapiens
ttgtggcctca

SEQ ID NO: 1046910 - DNA, 12 bp, Homo sapiens
ttgtggcctcag

SEQ ID NO: 1046911 - DNA, 18 bp, Homo sapiens
ttgtggctcctatctgtg

SEQ ID NO: 1046912 - DNA, 20 bp, Homo sapiens
ttgtggggaggctgcactgg

SEQ ID NO: 1046913 - DNA, 14 bp, Homo sapiens
ttgtggggccagga

SEQ ID NO: 1046914 - DNA, 14 bp, Homo sapiens
ttgtggggtgcagc

SEQ ID NO: 1046915 - DNA, 21 bp, Homo sapiens
ttgtggggtgcagctgggtgg

SEQ ID NO: 1046916 - DNA, 18 bp, Homo sapiens
ttgtggttatcactttaa

SEQ ID NO: 1046917 - DNA, 22 bp, Homo sapiens
ttgtggttccatgcagccttgg

SEQ ID NO: 1046918 - DNA, 15 bp, Homo sapiens
ttgtgtaaaaaatgg

SEQ ID NO: 1046919 - DNA, 19 bp, Homo sapiens
ttgtgtaaaaaatggaaaa

SEQ ID NO: 1046920 - DNA, 16 bp, Homo sapiens
ttgtgtaaatttgtat

SEQ ID NO: 1046921 - DNA, 18 bp, Homo sapiens
ttgtgtaagaaatacaga

SEQ ID NO: 1046922 - DNA, 21 bp, Homo sapiens
ttgtgtaatctaagtatatgt

SEQ ID NO: 1046923 - DNA, 23 bp, Homo sapiens
ttgtgtaatgaaaatgaatatct

SEQ ID NO: 1046924 - DNA, 13 bp, Homo sapiens
ttgtgtacttgac

SEQ ID NO: 1046925 - DNA, 18 bp, Homo sapiens
ttgtgtagatttgaaaat

SEQ ID NO: 1046926 - DNA, 13 bp, Homo sapiens
ttgtgtagccttt

SEQ ID NO: 1046927 - DNA, 23 bp, Homo sapiens
ttgtgtatattggtgtatattat

SEQ ID NO: 1046928 - DNA, 23 bp, Homo sapiens
ttgtgtatgtacttagctgtact

SEQ ID NO: 1046929 - DNA, 13 bp, Homo sapiens
ttgtgtatttaac

SEQ ID NO: 1046930 - DNA, 23 bp, Homo sapiens
ttgtgtatttacgctttgattca

SEQ ID NO: 1046931 - DNA, 15 bp, Homo sapiens
ttgtgtattttcctg

SEQ ID NO: 1046932 - DNA, 20 bp, Homo sapiens
ttgtgtcagaaacatgaaat

SEQ ID NO: 1046933 - DNA, 19 bp, Homo sapiens
ttgtgtcagagctgggagt

SEQ ID NO: 1046934 - DNA, 19 bp, Homo sapiens
ttgtgtcataaattacaca

SEQ ID NO: 1046935 - DNA, 23 bp, Homo sapiens
ttgtgtccctggaaccttctaga

SEQ ID NO: 1046936 - DNA, 19 bp, Homo sapiens
ttgtgtcctccaggagctt

SEQ ID NO: 1046937 - DNA, 19 bp, Homo sapiens
ttgtgtctggcagtttata

SEQ ID NO: 1046938 - DNA, 22 bp, Homo sapiens
ttgtgtctgtgccctccaaaga

SEQ ID NO: 1046939 - DNA, 13 bp, Homo sapiens
ttgtgtctgtgtt

SEQ ID NO: 1046940 - DNA, 19 bp, Homo sapiens
ttgtgtctttgtctggcca

SEQ ID NO: 1046941 - DNA, 16 bp, Homo sapiens
ttgtgtgcttctgctc

SEQ ID NO: 1046942 - DNA, 17 bp, Homo sapiens
ttgtgtgcttctgctca

SEQ ID NO: 1046943 - DNA, 16 bp, Homo sapiens
ttgtgtggattcttta

SEQ ID NO: 1046944 - DNA, 20 bp, Homo sapiens
ttgtgtggcaatgggatttg

SEQ ID NO: 1046945 - DNA, 16 bp, Homo sapiens
ttgtgtgtatatgtat

SEQ ID NO: 1046946 - DNA, 19 bp, Homo sapiens
ttgtgtgtattcagaggca

SEQ ID NO: 1046947 - DNA, 16 bp, Homo sapiens
ttgtgtgtatttgtat

SEQ ID NO: 1046948 - DNA, 20 bp, Homo sapiens
ttgtgtgtgtgtcagctgag

SEQ ID NO: 1046949 - DNA, 22 bp, Homo sapiens
ttgtgtgtttaggcctcatttc

SEQ ID NO: 1046950 - DNA, 18 bp, Homo sapiens
ttgtgtgttttgtacact

SEQ ID NO: 1046951 - DNA, 16 bp, Homo sapiens
ttgtgttaagcttgcg

SEQ ID NO: 1046952 - DNA, 15 bp, Homo sapiens
ttgtgttattcgtga

SEQ ID NO: 1046953 - DNA, 21 bp, Homo sapiens
ttgtgttcagctctttccaaa

SEQ ID NO: 1046954 - DNA, 22 bp, Homo sapiens
ttgtgttcagctctttccaaat

SEQ ID NO: 1046955 - DNA, 17 bp, Homo sapiens
ttgtgttcctatggaaa

SEQ ID NO: 1046956 - DNA, 17 bp, Homo sapiens
ttgtgttcctggctgat

SEQ ID NO: 1046957 - DNA, 22 bp, Homo sapiens
ttgtgttctgttgaaggtgcca

SEQ ID NO: 1046958 - DNA, 22 bp, Homo sapiens
ttgtgttctgtttgttaaaact

SEQ ID NO: 1046959 - DNA, 23 bp, Homo sapiens
ttgtgttgttttttgttcaatgt

SEQ ID NO: 1046960 - DNA, 14 bp, Homo sapiens
ttgtgtttactttt

SEQ ID NO: 1046961 - DNA, 20 bp, Homo sapiens
ttgtgtttgcttaaacaaag

SEQ ID NO: 1046962 - DNA, 20 bp, Homo sapiens
ttgtgttttaaaaaaactga

SEQ ID NO: 1046963 - DNA, 21 bp, Homo sapiens
ttgtgttttaaaaaaactgaa

SEQ ID NO: 1046964 - DNA, 11 bp, Homo sapiens
ttgtgttttct

SEQ ID NO: 1046965 - DNA, 17 bp, Homo sapiens
ttgtgttttcttgtaaa

SEQ ID NO: 1046966 - DNA, 18 bp, Homo sapiens
ttgtgtttttaatttatt

SEQ ID NO: 1046967 - DNA, 21 bp, Homo sapiens
ttgtgtttttaatttatttat

SEQ ID NO: 1046968 - DNA, 16 bp, Homo sapiens
ttgtgttttttaagat

SEQ ID NO: 1046969 - DNA, 14 bp, Homo sapiens
ttgttaaaactggc

SEQ ID NO: 1046970 - DNA, 15 bp, Homo sapiens
ttgttaaaagatggt

SEQ ID NO: 1046971 - DNA, 22 bp, Homo sapiens
ttgttaaagctggaacatttga

SEQ ID NO: 1046972 - DNA, 17 bp, Homo sapiens
ttgttaaaggcaatggt

SEQ ID NO: 1046973 - DNA, 12 bp, Homo sapiens
ttgttaaatttt

SEQ ID NO: 1046974 - DNA, 14 bp, Homo sapiens
ttgttaagaaaaat

SEQ ID NO: 1046975 - DNA, 18 bp, Homo sapiens
ttgttaagaagttgaact

SEQ ID NO: 1046976 - DNA, 18 bp, Homo sapiens
ttgttaagggcattttta

SEQ ID NO: 1046977 - DNA, 22 bp, Homo sapiens
tatgtgagagattctgtgatct

SEQ ID NO: 1046978 - DNA, 16 bp, Homo sapiens
tatgtgagatttcctt

SEQ ID NO: 1046979 - DNA, 17 bp, Homo sapiens
tatgtgagcgagcaagc

SEQ ID NO: 1046980 - DNA, 23 bp, Homo sapiens
tatgtgagggtatgaagagctgt

SEQ ID NO: 1046981 - DNA, 21 bp, Homo sapiens
ttgttaataaaagtacatgtt

SEQ ID NO: 1046982 - DNA, 22 bp, Homo sapiens
ttgttaatatcactcattaatt

SEQ ID NO: 1046983 - DNA, 17 bp, Homo sapiens
ttgttaatgaaaatgtc

SEQ ID NO: 1046984 - DNA, 18 bp, Homo sapiens
ttgttaatgaaaatgtca

SEQ ID NO: 1046985 - DNA, 19 bp, Homo sapiens
ttgttaatgaaaatgtcag

SEQ ID NO: 1046986 - DNA, 18 bp, Homo sapiens
ttgttaatgtcattgcta

SEQ ID NO: 1046987 - DNA, 16 bp, Homo sapiens
ttgttaatgttctgaa

SEQ ID NO: 1046988 - DNA, 17 bp, Homo sapiens
ttgttaattcctatgaa

SEQ ID NO: 1046989 - DNA, 20 bp, Homo sapiens
ttgttaatttagaaaacttt

SEQ ID NO: 1046990 - DNA, 21 bp, Homo sapiens
ttgttacataaggatgacttt

SEQ ID NO: 1046991 - DNA, 14 bp, Homo sapiens
ttgttacattttta

SEQ ID NO: 1046992 - DNA, 22 bp, Homo sapiens
ttgttaccatactgtctctgga

SEQ ID NO: 1046993 - DNA, 15 bp, Homo sapiens
ttgttacctacctta

SEQ ID NO: 1046994 - DNA, 12 bp, Homo sapiens
ttgttaccttta

SEQ ID NO: 1046995 - DNA, 16 bp, Homo sapiens
ttgttacgtagcctaa

SEQ ID NO: 1046996 - DNA, 22 bp, Homo sapiens
ttgttactcatcgggcccaggg

SEQ ID NO: 1046997 - DNA, 19 bp, Homo sapiens
ttgttactgctgattcttg

SEQ ID NO: 1046998 - DNA, 14 bp, Homo sapiens
ttgttacttctgag

SEQ ID NO: 1046999 - DNA, 16 bp, Homo sapiens
ttgttagcccttcaga

SEQ ID NO: 1047000 - DNA, 17 bp, Homo sapiens
ttgttagcccttcagat

SEQ ID NO: 1047001 - DNA, 21 bp, Homo sapiens
ttgttagggctgcttttctta

SEQ ID NO: 1047002 - DNA, 23 bp, Homo sapiens
ttgttagggctgcttttcttaag

SEQ ID NO: 1047003 - DNA, 22 bp, Homo sapiens
ttgttagtatgaggcatttgtt

SEQ ID NO: 1047004 - DNA, 16 bp, Homo sapiens
ttgttagtttagtgtg

SEQ ID NO: 1047005 - DNA, 18 bp, Homo sapiens
ttgttataaaataacatg

SEQ ID NO: 1047006 - DNA, 14 bp, Homo sapiens
ttgttataaataaa

SEQ ID NO: 1047007 - DNA, 16 bp, Homo sapiens
ttgttatacttcaaaa

SEQ ID NO: 1047008 - DNA, 17 bp, Homo sapiens
ttgttatagattgtctt

SEQ ID NO: 1047009 - DNA, 13 bp, Homo sapiens
ttgttatattata

SEQ ID NO: 1047010 - DNA, 12 bp, Homo sapiens
ttgttatcaaaa

SEQ ID NO: 1047011 - DNA, 14 bp, Homo sapiens
ttgttatcaaaata

SEQ ID NO: 1047012 - DNA, 16 bp, Homo sapiens
ttgttatcagtcaata

SEQ ID NO: 1047013 - DNA, 21 bp, Homo sapiens
ttgttatgccatgatttttgg

SEQ ID NO: 1047014 - DNA, 14 bp, Homo sapiens
ttgttatgtacaaa

SEQ ID NO: 1047015 - DNA, 13 bp, Homo sapiens
ttgttattaaatg

SEQ ID NO: 1047016 - DNA, 14 bp, Homo sapiens
ttgttattaaatgt

SEQ ID NO: 1047017 - DNA, 14 bp, Homo sapiens
ttgttattaatgtt

SEQ ID NO: 1047018 - DNA, 13 bp, Homo sapiens
ttgttattcctag

SEQ ID NO: 1047019 - DNA, 19 bp, Homo sapiens
ttgttattgatgttgctgt

SEQ ID NO: 1047020 - DNA, 14 bp, Homo sapiens
ttgttatttataac

SEQ ID NO: 1047021 - DNA, 13 bp, Homo sapiens
ttgttattttcag

SEQ ID NO: 1047022 - DNA, 15 bp, Homo sapiens
ttgttattttgcaac

SEQ ID NO: 1047023 - DNA, 15 bp, Homo sapiens
ttgttcactgaaggt

SEQ ID NO: 1047024 - DNA, 14 bp, Homo sapiens
ttgttcacttaaat

SEQ ID NO: 1047025 - DNA, 16 bp, Homo sapiens
ttgttcatcatccaga

SEQ ID NO: 1047026 - DNA, 11 bp, Homo sapiens
ttgttcattta

SEQ ID NO: 1047027 - DNA, 12 bp, Homo sapiens
ttgttcatttag

SEQ ID NO: 1047028 - DNA, 17 bp, Homo sapiens
ttgttcattttgagctg

SEQ ID NO: 1047029 - DNA, 14 bp, Homo sapiens
ttgttccaggctca

SEQ ID NO: 1047030 - DNA, 18 bp, Homo sapiens
ttgttcccctaagtggat

SEQ ID NO: 1047031 - DNA, 14 bp, Homo sapiens
ttgttccctctccc

SEQ ID NO: 1047032 - DNA, 17 bp, Homo sapiens
ttgttcgtttcatcagg

SEQ ID NO: 1047033 - DNA, 11 bp, Homo sapiens
ttgttctagac

SEQ ID NO: 1047034 - DNA, 15 bp, Homo sapiens
ttgttctagacttcc

SEQ ID NO: 1047035 - DNA, 18 bp, Homo sapiens
ttgttctagacttcccca

SEQ ID NO: 1047036 - DNA, 21 bp, Homo sapiens
ttgttctagacttccccatcc

SEQ ID NO: 1047037 - DNA, 16 bp, Homo sapiens
ttgttctagtactgta

SEQ ID NO: 1047038 - DNA, 22 bp, Homo sapiens
ttgttctccgggtgtggcctca

SEQ ID NO: 1047039 - DNA, 23 bp, Homo sapiens
ttgttctccgggtgtggcctcag

SEQ ID NO: 1047040 - DNA, 20 bp, Homo sapiens
ttgttctctggaacctgact

SEQ ID NO: 1047041 - DNA, 12 bp, Homo sapiens
ttgttctctggg

SEQ ID NO: 1047042 - DNA, 17 bp, Homo sapiens
ttgttctcttctgcgta

SEQ ID NO: 1047043 - DNA, 13 bp, Homo sapiens
ttgttctgagtaa

SEQ ID NO: 1047044 - DNA, 23 bp, Homo sapiens
ttgttctgtggttttcccctccc

SEQ ID NO: 1047045 - DNA, 14 bp, Homo sapiens
ttgttctgttaact

SEQ ID NO: 1047046 - DNA, 15 bp, Homo sapiens
ttgttctgttaactg

SEQ ID NO: 1047047 - DNA, 18 bp, Homo sapiens
ttgttctgttaactgaat

SEQ ID NO: 1047048 - DNA, 14 bp, Homo sapiens
ttgttcttgtattt

SEQ ID NO: 1047049 - DNA, 16 bp, Homo sapiens
ttgttctttgtgtttt

SEQ ID NO: 1047050 - DNA, 13 bp, Homo sapiens
ttgttctttttat

SEQ ID NO: 1047051 - DNA, 22 bp, Homo sapiens
ttgttgaaaaagtttgtttttg

SEQ ID NO: 1047052 - DNA, 16 bp, Homo sapiens
ttgttgacaaaatttt

SEQ ID NO: 1047053 - DNA, 18 bp, Homo sapiens
ttgttgacagttctgaag

SEQ ID NO: 1047054 - DNA, 21 bp, Homo sapiens
ttgttgacagttctgaagaat

SEQ ID NO: 1047055 - DNA, 12 bp, Homo sapiens
ttgttgacattc

SEQ ID NO: 1047056 - DNA, 15 bp, Homo sapiens
ttgttgactgtgatt

SEQ ID NO: 1047057 - DNA, 18 bp, Homo sapiens
ttgttgagctattgctgt

SEQ ID NO: 1047058 - DNA, 14 bp, Homo sapiens
ttgttgaggtggtc

SEQ ID NO: 1047059 - DNA, 11 bp, Homo sapiens
ttgttgatatt

SEQ ID NO: 1047060 - DNA, 13 bp, Homo sapiens
ttgttgattaatt

SEQ ID NO: 1047061 - DNA, 19 bp, Homo sapiens
ttgttgcaagtactgctgt

SEQ ID NO: 1047062 - DNA, 16 bp, Homo sapiens
ttgttgcactaaaaag

SEQ ID NO: 1047063 - DNA, 18 bp, Homo sapiens
ttgttgcagagatttcct

SEQ ID NO: 1047064 - DNA, 14 bp, Homo sapiens
ttgttgcggatgga

SEQ ID NO: 1047065 - DNA, 16 bp, Homo sapiens
ttgttgcgttcctttc

SEQ ID NO: 1047066 - DNA, 14 bp, Homo sapiens
ttgttgctatacat

SEQ ID NO: 1047067 - DNA, 18 bp, Homo sapiens
ttgttgctgttgatgttt

SEQ ID NO: 1047068 - DNA, 20 bp, Homo sapiens
ttgttggagtgtaaaccaaa

SEQ ID NO: 1047069 - DNA, 15 bp, Homo sapiens
ttgttggatcttcaa

SEQ ID NO: 1047070 - DNA, 20 bp, Homo sapiens
ttgttggatcttcaatggct

SEQ ID NO: 1047071 - DNA, 16 bp, Homo sapiens
ttgttggcaagctgca

SEQ ID NO: 1047072 - DNA, 21 bp, Homo sapiens
ttgttggcccttccagtggga

SEQ ID NO: 1047073 - DNA, 18 bp, Homo sapiens
ttgttggcctccggcctc

SEQ ID NO: 1047074 - DNA, 19 bp, Homo sapiens
ttgttgggattcctgaccc

SEQ ID NO: 1047075 - DNA, 16 bp, Homo sapiens
ttgttggggctttaca

SEQ ID NO: 1047076 - DNA, 17 bp, Homo sapiens
ttgttggtacctttcta

SEQ ID NO: 1047077 - DNA, 20 bp, Homo sapiens
ttgttggtgaattttcaagg

SEQ ID NO: 1047078 - DNA, 15 bp, Homo sapiens
ttgttggtgcacagc

SEQ ID NO: 1047079 - DNA, 20 bp, Homo sapiens
ttgttggttgattgtttaag

SEQ ID NO: 1047080 - DNA, 19 bp, Homo sapiens
ttgttgtcccaatgaaata

SEQ ID NO: 1047081 - DNA, 16 bp, Homo sapiens
ttgttgtccttttcat

SEQ ID NO: 1047082 - DNA, 19 bp, Homo sapiens
ttgttgtctccacttgtat

SEQ ID NO: 1047083 - DNA, 14 bp, Homo sapiens
ttgttgtcttcact

SEQ ID NO: 1047084 - DNA, 21 bp, Homo sapiens
ttgttgtttgccatactttgt

SEQ ID NO: 1047085 - DNA, 15 bp, Homo sapiens
ttgttgtttgtatgt

SEQ ID NO: 1047086 - DNA, 21 bp, Homo sapiens
ttgtttaaacccaagtgctgc

SEQ ID NO: 1047087 - DNA, 20 bp, Homo sapiens
ttgtttaaagaagctctcca

SEQ ID NO: 1047088 - DNA, 21 bp, Homo sapiens
ttgtttaaagaagctctccag

SEQ ID NO: 1047089 - DNA, 13 bp, Homo sapiens
ttgtttaaagcat

SEQ ID NO: 1047090 - DNA, 15 bp, Homo sapiens
ttgtttaaatataaa

SEQ ID NO: 1047091 - DNA, 12 bp, Homo sapiens
ttgtttaacata

SEQ ID NO: 1047092 - DNA, 13 bp, Homo sapiens
ttgtttacaataa

SEQ ID NO: 1047093 - DNA, 21 bp, Homo sapiens
ttgtttacagcactactctgt

SEQ ID NO: 1047094 - DNA, 13 bp, Homo sapiens
ttgtttagaaaaa

SEQ ID NO: 1047095 - DNA, 14 bp, Homo sapiens
ttgtttagaaacag

SEQ ID NO: 1047096 - DNA, 15 bp, Homo sapiens
ttgtttagaaacaga

SEQ ID NO: 1047097 - DNA, 16 bp, Homo sapiens
ttgtttataataaaaa

SEQ ID NO: 1047098 - DNA, 14 bp, Homo sapiens
ttgtttatcaactt

SEQ ID NO: 1047099 - DNA, 19 bp, Homo sapiens
ttgtttatcagatacatca

SEQ ID NO: 1047100 - DNA, 20 bp, Homo sapiens
tattaagaaaggaagcattg

SEQ ID NO: 1047101 - DNA, 13 bp, Homo sapiens
tattaagatggat

SEQ ID NO: 1047102 - DNA, 16 bp, Homo sapiens
tattaagatggattct

SEQ ID NO: 1047103 - DNA, 21 bp, Homo sapiens
tattaagatggattctcagat

SEQ ID NO: 1047104 - DNA, 17 bp, Homo sapiens
tattaagatttccaagt

SEQ ID NO: 1047105 - DNA, 14 bp, Homo sapiens
tattaagcagtaaa

SEQ ID NO: 1047106 - DNA, 13 bp, Homo sapiens
tattaagcttttt

SEQ ID NO: 1047107 - DNA, 16 bp, Homo sapiens
tattaagctttttgga

SEQ ID NO: 1047108 - DNA, 18 bp, Homo sapiens
tattaagggtaggatgtt

SEQ ID NO: 1047109 - DNA, 16 bp, Homo sapiens
tattaaggtgtggctt

SEQ ID NO: 1047110 - DNA, 20 bp, Homo sapiens
ttgtttcattgactatcaaa

SEQ ID NO: 1047111 - DNA, 15 bp, Homo sapiens
ttgtttccaacttgt

SEQ ID NO: 1047112 - DNA, 16 bp, Homo sapiens
ttgtttccaacttgtc

SEQ ID NO: 1047113 - DNA, 16 bp, Homo sapiens
ttgtttcctcttccaa

SEQ ID NO: 1047114 - DNA, 15 bp, Homo sapiens
ttgtttcctttcact

SEQ ID NO: 1047115 - DNA, 22 bp, Homo sapiens
ttgtttctagactataaatgtt

SEQ ID NO: 1047116 - DNA, 17 bp, Homo sapiens
ttgtttctccccctggg

SEQ ID NO: 1047117 - DNA, 21 bp, Homo sapiens
ttgtttctgacccactgatct

SEQ ID NO: 1047118 - DNA, 17 bp, Homo sapiens
ttgtttctgtcaagcat

SEQ ID NO: 1047119 - DNA, 16 bp, Homo sapiens
ttgtttctgttccaaa

SEQ ID NO: 1047120 - DNA, 17 bp, Homo sapiens
ttgtttctgttccaaat

SEQ ID NO: 1047121 - DNA, 23 bp, Homo sapiens
ttgtttcttaaataagaaacttt

SEQ ID NO: 1047122 - DNA, 22 bp, Homo sapiens
ttgtttgaccccagtttcttct

SEQ ID NO: 1047123 - DNA, 20 bp, Homo sapiens
ttgtttgagacagggtctca

SEQ ID NO: 1047124 - DNA, 23 bp, Homo sapiens
ttgtttgaggcaaattaactgta

SEQ ID NO: 1047125 - DNA, 22 bp, Homo sapiens
ttgtttgagtttttcctcccag

SEQ ID NO: 1047126 - DNA, 17 bp, Homo sapiens
ttgtttgattcagcaaa

SEQ ID NO: 1047127 - DNA, 16 bp, Homo sapiens
ttgtttgccatacttt

SEQ ID NO: 1047128 - DNA, 23 bp, Homo sapiens
ttgtttgctcttttaagcagtct

SEQ ID NO: 1047129 - DNA, 12 bp, Homo sapiens
ttgtttgctgct

SEQ ID NO: 1047130 - DNA, 14 bp, Homo sapiens
ttgtttgctgctat

SEQ ID NO: 1047131 - DNA, 13 bp, Homo sapiens
ttgtttgcttatt

SEQ ID NO: 1047132 - DNA, 15 bp, Homo sapiens
ttgtttgcttattgt

SEQ ID NO: 1047133 - DNA, 15 bp, Homo sapiens
ttgtttgcttccatt

SEQ ID NO: 1047134 - DNA, 16 bp, Homo sapiens
ttgtttgggatcagct

SEQ ID NO: 1047135 - DNA, 19 bp, Homo sapiens
ttgtttgggatcagcttct

SEQ ID NO: 1047136 - DNA, 21 bp, Homo sapiens
ttgtttgggtatcctgcccag

SEQ ID NO: 1047137 - DNA, 21 bp, Homo sapiens
ttgtttgtacagtaatatgtt

SEQ ID NO: 1047138 - DNA, 23 bp, Homo sapiens
ttgttttaaaataagttaaaggc

SEQ ID NO: 1047139 - DNA, 14 bp, Homo sapiens
ttgttttaaaatgc

SEQ ID NO: 1047140 - DNA, 20 bp, Homo sapiens
ttgttttaccagctcccagg

SEQ ID NO: 1047141 - DNA, 13 bp, Homo sapiens
ttgttttcttaaa

SEQ ID NO: 1047142 - DNA, 18 bp, Homo sapiens
ttgttttcttctgtatgt

SEQ ID NO: 1047143 - DNA, 19 bp, Homo sapiens
ttgttttgacggatgattg

SEQ ID NO: 1047144 - DNA, 20 bp, Homo sapiens
ttgttttgagctttccatgt

SEQ ID NO: 1047145 - DNA, 24 bp, Homo sapiens
ttgttttgagctttccatgttgct

SEQ ID NO: 1047146 - DNA, 23 bp, Homo sapiens
ttgttttgatgtttgtggcctca

SEQ ID NO: 1047147 - DNA, 20 bp, Homo sapiens
ttgttttgcacactttgcca

SEQ ID NO: 1047148 - DNA, 14 bp, Homo sapiens
ttgttttgcacttt

SEQ ID NO: 1047149 - DNA, 12 bp, Homo sapiens
ttgttttgtaga

SEQ ID NO: 1047150 - DNA, 16 bp, Homo sapiens
ttgttttgtgcagaga

SEQ ID NO: 1047151 - DNA, 15 bp, Homo sapiens
ttgttttgtgtttca

SEQ ID NO: 1047152 - DNA, 14 bp, Homo sapiens
ttgttttgttttaa

SEQ ID NO: 1047153 - DNA, 14 bp, Homo sapiens
ttgtttttaaactg

SEQ ID NO: 1047154 - DNA, 16 bp, Homo sapiens
ttgtttttaaactgta

SEQ ID NO: 1047155 - DNA, 18 bp, Homo sapiens
ttgtttttaaactgtaca

SEQ ID NO: 1047156 - DNA, 19 bp, Homo sapiens
ttgtttttaatctcctgtt

SEQ ID NO: 1047157 - DNA, 13 bp, Homo sapiens
ttgtttttcattc

SEQ ID NO: 1047158 - DNA, 13 bp, Homo sapiens
ttgtttttccttg

SEQ ID NO: 1047159 - DNA, 22 bp, Homo sapiens
ttgtttttccttgtatttaaat

SEQ ID NO: 1047160 - DNA, 13 bp, Homo sapiens
ttgtttttctcac

SEQ ID NO: 1047161 - DNA, 17 bp, Homo sapiens
ttgtttttgcatgaaat

SEQ ID NO: 1047162 - DNA, 17 bp, Homo sapiens
ttgtttttggaaagaaa

SEQ ID NO: 1047163 - DNA, 19 bp, Homo sapiens
ttgttttttcatagtgcct

SEQ ID NO: 1047164 - DNA, 13 bp, Homo sapiens
tttaaaaaaactg

SEQ ID NO: 1047165 - DNA, 19 bp, Homo sapiens
tttaaaaaaactgaaggtt

SEQ ID NO: 1047166 - DNA, 21 bp, Homo sapiens
tttaaaaaaactgaaggtttt

SEQ ID NO: 1047167 - DNA, 17 bp, Homo sapiens
tttaaaaaaatcacaaa

SEQ ID NO: 1047168 - DNA, 15 bp, Homo sapiens
tttaaaaaaatttga

SEQ ID NO: 1047169 - DNA, 13 bp, Homo sapiens
tttaaaaaacaaa

SEQ ID NO: 1047170 - DNA, 18 bp, Homo sapiens
tttaaaaaacaaaaaaag

SEQ ID NO: 1047171 - DNA, 19 bp, Homo sapiens
tttaaaaaactattttatg

SEQ ID NO: 1047172 - DNA, 19 bp, Homo sapiens
tttaaaaaagcaacagaaa

SEQ ID NO: 1047173 - DNA, 20 bp, Homo sapiens
tttaaaaaagcttaaaactt

SEQ ID NO: 1047174 - DNA, 21 bp, Homo sapiens
tttaaaaaagcttaaaacttt

SEQ ID NO: 1047175 - DNA, 23 bp, Homo sapiens
tttaaaaaagcttaaaactttga

SEQ ID NO: 1047176 - DNA, 16 bp, Homo sapiens
tttaaaaaataccatt

SEQ ID NO: 1047177 - DNA, 15 bp, Homo sapiens
tttaaaaaatatttt

SEQ ID NO: 1047178 - DNA, 15 bp, Homo sapiens
tttaaaaaatcaatc

SEQ ID NO: 1047179 - DNA, 20 bp, Homo sapiens
tttaaaaaattaaaaatgaa

SEQ ID NO: 1047180 - DNA, 19 bp, Homo sapiens
tttaaaaaccaatcatttt

SEQ ID NO: 1047181 - DNA, 23 bp, Homo sapiens
tttaaaaaccaatcattttaaga

SEQ ID NO: 1047182 - DNA, 13 bp, Homo sapiens
tttaaaaactctt

SEQ ID NO: 1047183 - DNA, 17 bp, Homo sapiens
tttaaaaactcttcagt

SEQ ID NO: 1047184 - DNA, 14 bp, Homo sapiens
tttaaaaactgttt

SEQ ID NO: 1047185 - DNA, 18 bp, Homo sapiens
tttaaaaagcaaatcttt

SEQ ID NO: 1047186 - DNA, 13 bp, Homo sapiens
tttaaaaagctca

SEQ ID NO: 1047187 - DNA, 18 bp, Homo sapiens
tttaaaaagctcactgct

SEQ ID NO: 1047188 - DNA, 20 bp, Homo sapiens
tttaaaaaggaaatttgttt

SEQ ID NO: 1047189 - DNA, 18 bp, Homo sapiens
tttaaaaaggtaaatggt

SEQ ID NO: 1047190 - DNA, 18 bp, Homo sapiens
tttaaaaagtaagttaat

SEQ ID NO: 1047191 - DNA, 23 bp, Homo sapiens
tttaaaaataagtcaacagtaaa

SEQ ID NO: 1047192 - DNA, 11 bp, Homo sapiens
tttaaaaatat

SEQ ID NO: 1047193 - DNA, 16 bp, Homo sapiens
tttaaaaatatttcag

SEQ ID NO: 1047194 - DNA, 17 bp, Homo sapiens
tttaaaaatatttcaga

SEQ ID NO: 1047195 - DNA, 14 bp, Homo sapiens
tttaaaaatatttt

SEQ ID NO: 1047196 - DNA, 13 bp, Homo sapiens
tttaaaaatgtct

SEQ ID NO: 1047197 - DNA, 17 bp, Homo sapiens
tttaaaaatgtcttgct

SEQ ID NO: 1047198 - DNA, 19 bp, Homo sapiens
tttaaaaattgaaaaaagt

SEQ ID NO: 1047199 - DNA, 15 bp, Homo sapiens
tttaaaaattgttat

SEQ ID NO: 1047200 - DNA, 13 bp, Homo sapiens
tttaaaacactaa

SEQ ID NO: 1047201 - DNA, 15 bp, Homo sapiens
tttaaaacaggcaaa

SEQ ID NO: 1047202 - DNA, 16 bp, Homo sapiens
tttaaaacatttttta

SEQ ID NO: 1047203 - DNA, 17 bp, Homo sapiens
tttaaaaccacagctgg

SEQ ID NO: 1047204 - DNA, 12 bp, Homo sapiens
tttaaaactctg

SEQ ID NO: 1047205 - DNA, 20 bp, Homo sapiens
tttaaaactgtatttaagga

SEQ ID NO: 1047206 - DNA, 11 bp, Homo sapiens
tttaaaacttg

SEQ ID NO: 1047207 - DNA, 13 bp, Homo sapiens
tttaaaagaatga

SEQ ID NO: 1047208 - DNA, 16 bp, Homo sapiens
tttaaaagacaagact

SEQ ID NO: 1047209 - DNA, 13 bp, Homo sapiens
tttaaaagataca

SEQ ID NO: 1047210 - DNA, 20 bp, Homo sapiens
tttaaaagcacaatcactaa

SEQ ID NO: 1047211 - DNA, 16 bp, Homo sapiens
tttaaaagcatgaaac

SEQ ID NO: 1047212 - DNA, 15 bp, Homo sapiens
tttaaaagcattttt

SEQ ID NO: 1047213 - DNA, 13 bp, Homo sapiens
tttaaaaggcaac

SEQ ID NO: 1047214 - DNA, 17 bp, Homo sapiens
tttaaaaggcaactcaa

SEQ ID NO: 1047215 - DNA, 10 bp, Homo sapiens
tttaaaaggg

SEQ ID NO: 1047216 - DNA, 21 bp, Homo sapiens
tttaaaaggtattttgaatac

SEQ ID NO: 1047217 - DNA, 16 bp, Homo sapiens
tttaaaagtatcttta

SEQ ID NO: 1047218 - DNA, 20 bp, Homo sapiens
tttaaaagttactcctttta

SEQ ID NO: 1047219 - DNA, 22 bp, Homo sapiens
tttaaaagttttgaaggaaacc

SEQ ID NO: 1047220 - DNA, 15 bp, Homo sapiens
tttaaaataaaatga

SEQ ID NO: 1047221 - DNA, 21 bp, Homo sapiens
tttaaaatagaaattttgtaa

SEQ ID NO: 1047222 - DNA, 17 bp, Homo sapiens
tattattattatacttc

SEQ ID NO: 1047223 - DNA, 23 bp, Homo sapiens
tattattcaaaccaatttcttcc

SEQ ID NO: 1047224 - DNA, 22 bp, Homo sapiens
tattattccaaagttatttcat

SEQ ID NO: 1047225 - DNA, 17 bp, Homo sapiens
tattattcccgacgaca

SEQ ID NO: 1047226 - DNA, 15 bp, Homo sapiens
tattattctgcagca

SEQ ID NO: 1047227 - DNA, 15 bp, Homo sapiens
tattattgaaattgt

SEQ ID NO: 1047228 - DNA, 15 bp, Homo sapiens
tattatttattgtat

SEQ ID NO: 1047229 - DNA, 12 bp, Homo sapiens
tattatttctgt

SEQ ID NO: 1047230 - DNA, 13 bp, Homo sapiens
tattatttctgtt

SEQ ID NO: 1047231 - DNA, 16 bp, Homo sapiens
tattatttcttctctt

SEQ ID NO: 1047232 - DNA, 12 bp, Homo sapiens
tattatttgcag

SEQ ID NO: 1047233 - DNA, 14 bp, Homo sapiens
tattatttggagtt

SEQ ID NO: 1047234 - DNA, 16 bp, Homo sapiens
tattatttgtcttaaa

SEQ ID NO: 1047235 - DNA, 20 bp, Homo sapiens
tattatttttacctaaagac

SEQ ID NO: 1047236 - DNA, 16 bp, Homo sapiens
tattcaaagagaaaac

SEQ ID NO: 1047237 - DNA, 13 bp, Homo sapiens
tattcaaatgaag

SEQ ID NO: 1047238 - DNA, 19 bp, Homo sapiens
tattcaaatgaaggtggtt

SEQ ID NO: 1047239 - DNA, 19 bp, Homo sapiens
tattcaacaatttcaataa

SEQ ID NO: 1047240 - DNA, 19 bp, Homo sapiens
tattcaagcaaacatcaaa

SEQ ID NO: 1047241 - DNA, 16 bp, Homo sapiens
tattcaagttattgta

SEQ ID NO: 1047242 - DNA, 20 bp, Homo sapiens
tattcacagttttttaaaaa

SEQ ID NO: 1047243 - DNA, 19 bp, Homo sapiens
tattcacctcagtagaaaa

SEQ ID NO: 1047244 - DNA, 22 bp, Homo sapiens
tattcacgccattggttggaag

SEQ ID NO: 1047245 - DNA, 13 bp, Homo sapiens
tattcagaaatta

SEQ ID NO: 1047246 - DNA, 15 bp, Homo sapiens
tattcagaaattaaa

SEQ ID NO: 1047247 - DNA, 18 bp, Homo sapiens
tattcagaactatttaaa

SEQ ID NO: 1047248 - DNA, 20 bp, Homo sapiens
tattcagaactatttaaaat

SEQ ID NO: 1047249 - DNA, 16 bp, Homo sapiens
tattcagacaaaatgg

SEQ ID NO: 1047250 - DNA, 14 bp, Homo sapiens
tattcagacaagca

SEQ ID NO: 1047251 - DNA, 18 bp, Homo sapiens
tattcagacaagcaacag

SEQ ID NO: 1047252 - DNA, 21 bp, Homo sapiens
tattcagagttagatattatt

SEQ ID NO: 1047253 - DNA, 15 bp, Homo sapiens
tattcagatgtatgt

SEQ ID NO: 1047254 - DNA, 16 bp, Homo sapiens
tattcagcttcatttg

SEQ ID NO: 1047255 - DNA, 14 bp, Homo sapiens
tattcaggagttgg

SEQ ID NO: 1047256 - DNA, 16 bp, Homo sapiens
tattcaggcactgaga

SEQ ID NO: 1047257 - DNA, 20 bp, Homo sapiens
tattcagtaataactctacc

SEQ ID NO: 1047258 - DNA, 15 bp, Homo sapiens
tattcagtagtttga

SEQ ID NO: 1047259 - DNA, 19 bp, Homo sapiens
tattcagtgaaaagatttt

SEQ ID NO: 1047260 - DNA, 16 bp, Homo sapiens
tattcagtgaatttgt

SEQ ID NO: 1047261 - DNA, 21 bp, Homo sapiens
tattcagtgctgtggcctggg

SEQ ID NO: 1047262 - DNA, 22 bp, Homo sapiens
tattcagtgctgtggcctgggc

SEQ ID NO: 1047263 - DNA, 15 bp, Homo sapiens
tattcagtgtcactg

SEQ ID NO: 1047264 - DNA, 16 bp, Homo sapiens
tattcataatgaatta

SEQ ID NO: 1047265 - DNA, 21 bp, Homo sapiens
tattcataatgaattataaca

SEQ ID NO: 1047266 - DNA, 14 bp, Homo sapiens
tattcatgcttctt

SEQ ID NO: 1047267 - DNA, 19 bp, Homo sapiens
tattcattaagtaatcttt

SEQ ID NO: 1047268 - DNA, 21 bp, Homo sapiens
tattcattaagtaatcttttt

SEQ ID NO: 1047269 - DNA, 18 bp, Homo sapiens
tattcattattcctcaga

SEQ ID NO: 1047270 - DNA, 19 bp, Homo sapiens
tattcattatttgtcaaat

SEQ ID NO: 1047271 - DNA, 23 bp, Homo sapiens
tattcattatttgtcaaattgtc

SEQ ID NO: 1047272 - DNA, 16 bp, Homo sapiens
tattcattggcagctc

SEQ ID NO: 1047273 - DNA, 22 bp, Homo sapiens
tattcattggcagctcaaagac

SEQ ID NO: 1047274 - DNA, 16 bp, Homo sapiens
tattcatttaaaatga

SEQ ID NO: 1047275 - DNA, 13 bp, Homo sapiens
tattcattttact

SEQ ID NO: 1047276 - DNA, 15 bp, Homo sapiens
tattcattttctcta

SEQ ID NO: 1047277 - DNA, 17 bp, Homo sapiens
tattccaagacatgtct

SEQ ID NO: 1047278 - DNA, 16 bp, Homo sapiens
tattccaaggaaaatt

SEQ ID NO: 1047279 - DNA, 20 bp, Homo sapiens
tattccaccttaaattaaac

SEQ ID NO: 1047280 - DNA, 13 bp, Homo sapiens
tattccagaagaa

SEQ ID NO: 1047281 - DNA, 20 bp, Homo sapiens
tattccagaatgctgtacat

SEQ ID NO: 1047282 - DNA, 23 bp, Homo sapiens
tattccagaatgctgtacatcta

SEQ ID NO: 1047283 - DNA, 15 bp, Homo sapiens
tattccatatttatt

SEQ ID NO: 1047284 - DNA, 18 bp, Homo sapiens
tattccatccatatactt

SEQ ID NO: 1047285 - DNA, 19 bp, Homo sapiens
tattccatccatatacttt

SEQ ID NO: 1047286 - DNA, 16 bp, Homo sapiens
tattccatgaatgtat

SEQ ID NO: 1047287 - DNA, 17 bp, Homo sapiens
tattccatgaatgtatc

SEQ ID NO: 1047288 - DNA, 21 bp, Homo sapiens
tattccatgagctgctcatta

SEQ ID NO: 1047289 - DNA, 13 bp, Homo sapiens
tattcccaagccg

SEQ ID NO: 1047290 - DNA, 16 bp, Homo sapiens
tattcccactcaccag

SEQ ID NO: 1047291 - DNA, 23 bp, Homo sapiens
tattccccagcagggtcttttca

SEQ ID NO: 1047292 - DNA, 17 bp, Homo sapiens
tattccccattcttcct

SEQ ID NO: 1047293 - DNA, 22 bp, Homo sapiens
tattccccatttcctgtacaat

SEQ ID NO: 1047294 - DNA, 20 bp, Homo sapiens
tattcccctatctctagaat

SEQ ID NO: 1047295 - DNA, 22 bp, Homo sapiens
tattcccctatctctagaattt

SEQ ID NO: 1047296 - DNA, 19 bp, Homo sapiens
tattcccgacgacacatat

SEQ ID NO: 1047297 - DNA, 14 bp, Homo sapiens
tattccctgcccaa

SEQ ID NO: 1047298 - DNA, 22 bp, Homo sapiens
tattccctgcccaaacccttaa

SEQ ID NO: 1047299 - DNA, 19 bp, Homo sapiens
tattcccttgtattttgtt

SEQ ID NO: 1047300 - DNA, 18 bp, Homo sapiens
tattccctttgacttcag

SEQ ID NO: 1047301 - DNA, 19 bp, Homo sapiens
tattccgatacaaagtgtt

SEQ ID NO: 1047302 - DNA, 21 bp, Homo sapiens
tattcctatatagtttattga

SEQ ID NO: 1047303 - DNA, 22 bp, Homo sapiens
tattcctatatagtttattgac

SEQ ID NO: 1047304 - DNA, 14 bp, Homo sapiens
tattcctgaatgaa

SEQ ID NO: 1047305 - DNA, 20 bp, Homo sapiens
tattcctgaatgaaatatca

SEQ ID NO: 1047306 - DNA, 18 bp, Homo sapiens
tattcctggacttacaaa

SEQ ID NO: 1047307 - DNA, 17 bp, Homo sapiens
tattcctgtatgttgtc

SEQ ID NO: 1047308 - DNA, 12 bp, Homo sapiens
tattcctttccc

SEQ ID NO: 1047309 - DNA, 15 bp, Homo sapiens
tattcctttcccttc

SEQ ID NO: 1047310 - DNA, 19 bp, Homo sapiens
tattcctttcccttcctct

SEQ ID NO: 1047311 - DNA, 19 bp, Homo sapiens
tattccttttgtgtacagt

SEQ ID NO: 1047312 - DNA, 14 bp, Homo sapiens
tattcgcccacccg

SEQ ID NO: 1047313 - DNA, 19 bp, Homo sapiens
tattctaagaaatatctgt

SEQ ID NO: 1047314 - DNA, 15 bp, Homo sapiens
tattctagtggctgt

SEQ ID NO: 1047315 - DNA, 17 bp, Homo sapiens
tattctagtggctgttc

SEQ ID NO: 1047316 - DNA, 17 bp, Homo sapiens
tattctagttaaggaaa

SEQ ID NO: 1047317 - DNA, 14 bp, Homo sapiens
tattctatatgaat

SEQ ID NO: 1047318 - DNA, 14 bp, Homo sapiens
tattctcactccac

SEQ ID NO: 1047319 - DNA, 12 bp, Homo sapiens
tattctcagagc

SEQ ID NO: 1047320 - DNA, 17 bp, Homo sapiens
tattctcagagcatgtg

SEQ ID NO: 1047321 - DNA, 20 bp, Homo sapiens
tattctcaggtaatcatttt

SEQ ID NO: 1047322 - DNA, 17 bp, Homo sapiens
tattctccactttttct

SEQ ID NO: 1047323 - DNA, 16 bp, Homo sapiens
tattctcctccctgtt

SEQ ID NO: 1047324 - DNA, 13 bp, Homo sapiens
tattctcctgcca

SEQ ID NO: 1047325 - DNA, 15 bp, Homo sapiens
tattctctatttgaa

SEQ ID NO: 1047326 - DNA, 12 bp, Homo sapiens
tattctctgagc

SEQ ID NO: 1047327 - DNA, 23 bp, Homo sapiens
tattctctttaccttctaaaagc

SEQ ID NO: 1047328 - DNA, 14 bp, Homo sapiens
tattctgacatgta

SEQ ID NO: 1047329 - DNA, 16 bp, Homo sapiens
tattctgacttcctct

SEQ ID NO: 1047330 - DNA, 20 bp, Homo sapiens
tattctgggcaccacaaaat

SEQ ID NO: 1047331 - DNA, 22 bp, Homo sapiens
tattctgggcaccacaaaatat

SEQ ID NO: 1047332 - DNA, 15 bp, Homo sapiens
tattctgtaaagctt

SEQ ID NO: 1047333 - DNA, 19 bp, Homo sapiens
tattctgtagattctgtgg

SEQ ID NO: 1047334 - DNA, 18 bp, Homo sapiens
tattctgtcatttacaca

SEQ ID NO: 1047335 - DNA, 22 bp, Homo sapiens
tattctgtggttctataataag

SEQ ID NO: 1047336 - DNA, 12 bp, Homo sapiens
tattctgttgct

SEQ ID NO: 1047337 - DNA, 16 bp, Homo sapiens
tattctgttttgttaa

SEQ ID NO: 1047338 - DNA, 19 bp, Homo sapiens
tattcttaagcactttgaa

SEQ ID NO: 1047339 - DNA, 21 bp, Homo sapiens
tattcttaagcactttgaaaa

SEQ ID NO: 1047340 - DNA, 22 bp, Homo sapiens
tattcttattggaaatgtactt

SEQ ID NO: 1047341 - DNA, 13 bp, Homo sapiens
tattcttctttct

SEQ ID NO: 1047342 - DNA, 20 bp, Homo sapiens
tattcttgatttatttgctt

SEQ ID NO: 1047343 - DNA, 22 bp, Homo sapiens
tattcttgctttagaaaacatt

SEQ ID NO: 1047344 - DNA, 21 bp, Homo sapiens
tttaacctagatgtttaacaa

SEQ ID NO: 1047345 - DNA, 22 bp, Homo sapiens
tttaactactttactaaattaa

SEQ ID NO: 1047346 - DNA, 15 bp, Homo sapiens
tttaactagaattta

SEQ ID NO: 1047347 - DNA, 18 bp, Homo sapiens
tttaactctagaatttgg

SEQ ID NO: 1047348 - DNA, 20 bp, Homo sapiens
tttaactgatttaacacttt

SEQ ID NO: 1047349 - DNA, 21 bp, Homo sapiens
tttaactgatttaacactttt

SEQ ID NO: 1047350 - DNA, 19 bp, Homo sapiens
tttaactggtgcactttgt

SEQ ID NO: 1047351 - DNA, 13 bp, Homo sapiens
tttaacttaaata

SEQ ID NO: 1047352 - DNA, 14 bp, Homo sapiens
tttaactttaccat

SEQ ID NO: 1047353 - DNA, 13 bp, Homo sapiens
tttaactttgaaa

SEQ ID NO: 1047354 - DNA, 10 bp, Homo sapiens
tttaactttt

SEQ ID NO: 1047355 - DNA, 11 bp, Homo sapiens
tttaacttttt

SEQ ID NO: 1047356 - DNA, 16 bp, Homo sapiens
tttaacttttttttat

SEQ ID NO: 1047357 - DNA, 22 bp, Homo sapiens
tttaagaaaaaataacacacat

SEQ ID NO: 1047358 - DNA, 21 bp, Homo sapiens
tttaagaaaatacaataaact

SEQ ID NO: 1047359 - DNA, 11 bp, Homo sapiens
tttaagaaaga

SEQ ID NO: 1047360 - DNA, 12 bp, Homo sapiens
tttaagaaagag

SEQ ID NO: 1047361 - DNA, 15 bp, Homo sapiens
tttaagaaagagaat

SEQ ID NO: 1047362 - DNA, 23 bp, Homo sapiens
tttaagaaagagaatgaactgtg

SEQ ID NO: 1047363 - DNA, 21 bp, Homo sapiens
tttaagaaccttaatgacaac

SEQ ID NO: 1047364 - DNA, 13 bp, Homo sapiens
tttaagaacttca

SEQ ID NO: 1047365 - DNA, 18 bp, Homo sapiens
tttaagaacttcattttt

SEQ ID NO: 1047366 - DNA, 19 bp, Homo sapiens
tttaagaatagttctaaaa

SEQ ID NO: 1047367 - DNA, 15 bp, Homo sapiens
tattgaatatatcag

SEQ ID NO: 1047368 - DNA, 21 bp, Homo sapiens
tattgaatatatcagaatctg

SEQ ID NO: 1047369 - DNA, 14 bp, Homo sapiens
tattgaatcttaat

SEQ ID NO: 1047370 - DNA, 14 bp, Homo sapiens
tattgaattagaaa

SEQ ID NO: 1047371 - DNA, 18 bp, Homo sapiens
tattgaatttttcctatg

SEQ ID NO: 1047372 - DNA, 19 bp, Homo sapiens
tattgacaataaaatatta

SEQ ID NO: 1047373 - DNA, 13 bp, Homo sapiens
tattgacacagaa

SEQ ID NO: 1047374 - DNA, 16 bp, Homo sapiens
tattgacacagaaaat

SEQ ID NO: 1047375 - DNA, 18 bp, Homo sapiens
tattgacacagaaaatgt

SEQ ID NO: 1047376 - DNA, 24 bp, Homo sapiens
tattgacactgaacttaataactg

SEQ ID NO: 1047377 - DNA, 13 bp, Homo sapiens
tattgacatcagt

SEQ ID NO: 1047378 - DNA, 14 bp, Homo sapiens
tattgacatttgta

SEQ ID NO: 1047379 - DNA, 15 bp, Homo sapiens
tattgacatttgtag

SEQ ID NO: 1047380 - DNA, 22 bp, Homo sapiens
tattgactaacaggccaaagag

SEQ ID NO: 1047381 - DNA, 22 bp, Homo sapiens
tattgacttgttacatgaagat

SEQ ID NO: 1047382 - DNA, 23 bp, Homo sapiens
tattgactttatgttgtatgatt

SEQ ID NO: 1047383 - DNA, 15 bp, Homo sapiens
tattgactttcttaa

SEQ ID NO: 1047384 - DNA, 16 bp, Homo sapiens
tattgactttgacaat

SEQ ID NO: 1047385 - DNA, 19 bp, Homo sapiens
tattgactttgacaattac

SEQ ID NO: 1047386 - DNA, 20 bp, Homo sapiens
tattgagaatcccttaaaat

SEQ ID NO: 1047387 - DNA, 15 bp, Homo sapiens
tattgagatttctta

SEQ ID NO: 1047388 - DNA, 17 bp, Homo sapiens
tattgagcagaattcat

SEQ ID NO: 1047389 - DNA, 18 bp, Homo sapiens
tattgagcagaattcatt

SEQ ID NO: 1047390 - DNA, 21 bp, Homo sapiens
tattgagcagaattcattcat

SEQ ID NO: 1047391 - DNA, 18 bp, Homo sapiens
tattgaggccaagaatat

SEQ ID NO: 1047392 - DNA, 21 bp, Homo sapiens
tattgagtcttaactgtattt

SEQ ID NO: 1047393 - DNA, 19 bp, Homo sapiens
tattgagttccagttgaag

SEQ ID NO: 1047394 - DNA, 21 bp, Homo sapiens
tattgagttccagttgaagtt

SEQ ID NO: 1047395 - DNA, 15 bp, Homo sapiens
tattgatagtactct

SEQ ID NO: 1047396 - DNA, 21 bp, Homo sapiens
tattgatatgcttatacactt

SEQ ID NO: 1047397 - DNA, 12 bp, Homo sapiens
tattgatcaaat

SEQ ID NO: 1047398 - DNA, 14 bp, Homo sapiens
tattgatcccacat

SEQ ID NO: 1047399 - DNA, 23 bp, Homo sapiens
tattgatcccttctcctgccctt

SEQ ID NO: 1047400 - DNA, 21 bp, Homo sapiens
tattgatgataacacttaaaa

SEQ ID NO: 1047401 - DNA, 17 bp, Homo sapiens
tattgatgattttgtaa

SEQ ID NO: 1047402 - DNA, 22 bp, Homo sapiens
tattgatgcaatataagcataa

SEQ ID NO: 1047403 - DNA, 20 bp, Homo sapiens
tattgatgtacagtctgtca

SEQ ID NO: 1047404 - DNA, 22 bp, Homo sapiens
tattgatgtacagtctgtcatg

SEQ ID NO: 1047405 - DNA, 23 bp, Homo sapiens
tattgattacaaataaacagttg

SEQ ID NO: 1047406 - DNA, 16 bp, Homo sapiens
tattgcaaaatacatg

SEQ ID NO: 1047407 - DNA, 18 bp, Homo sapiens
tattgcaaaatacatgaa

SEQ ID NO: 1047408 - DNA, 20 bp, Homo sapiens
tattgcaaaatagcatttgt

SEQ ID NO: 1047409 - DNA, 22 bp, Homo sapiens
tattgcaaaggttccaactgta

SEQ ID NO: 1047410 - DNA, 20 bp, Homo sapiens
tattgcaactcttttaagtg

SEQ ID NO: 1047411 - DNA, 14 bp, Homo sapiens
tattgcaataaagt

SEQ ID NO: 1047412 - DNA, 16 bp, Homo sapiens
tattgcaataaagtat

SEQ ID NO: 1047413 - DNA, 16 bp, Homo sapiens
tattgcacatcatatt

SEQ ID NO: 1047414 - DNA, 15 bp, Homo sapiens
tattgcacattgttc

SEQ ID NO: 1047415 - DNA, 14 bp, Homo sapiens
tattgcagaatgtg

SEQ ID NO: 1047416 - DNA, 22 bp, Homo sapiens
tattgcagaatgtgggtattga

SEQ ID NO: 1047417 - DNA, 11 bp, Homo sapiens
tattgcagttt

SEQ ID NO: 1047418 - DNA, 20 bp, Homo sapiens
tattgcagtttatcattcaa

SEQ ID NO: 1047419 - DNA, 13 bp, Homo sapiens
tattgcatataga

SEQ ID NO: 1047420 - DNA, 18 bp, Homo sapiens
tattgcatatagatttag

SEQ ID NO: 1047421 - DNA, 17 bp, Homo sapiens
tattgcatctgtataag

SEQ ID NO: 1047422 - DNA, 17 bp, Homo sapiens
tattgcatttatatgta

SEQ ID NO: 1047423 - DNA, 22 bp, Homo sapiens
tattgcatttggattggggtcc

SEQ ID NO: 1047424 - DNA, 15 bp, Homo sapiens
tattgcctctacttt

SEQ ID NO: 1047425 - DNA, 13 bp, Homo sapiens
tattgccttattt

SEQ ID NO: 1047426 - DNA, 17 bp, Homo sapiens
tattgccttttaatttt

SEQ ID NO: 1047427 - DNA, 21 bp, Homo sapiens
tattgccttttaatttttaat

SEQ ID NO: 1047428 - DNA, 13 bp, Homo sapiens
tattgctaaaagt

SEQ ID NO: 1047429 - DNA, 19 bp, Homo sapiens
tattgctaaaatattttag

SEQ ID NO: 1047430 - DNA, 12 bp, Homo sapiens
tattgctcctcc

SEQ ID NO: 1047431 - DNA, 13 bp, Homo sapiens
tattgctgtctgg

SEQ ID NO: 1047432 - DNA, 12 bp, Homo sapiens
tattgctgtgtc

SEQ ID NO: 1047433 - DNA, 12 bp, Homo sapiens
tattgcttattt

SEQ ID NO: 1047434 - DNA, 14 bp, Homo sapiens
tattgcttatttta

SEQ ID NO: 1047435 - DNA, 24 bp, Homo sapiens
tattggaaaataaaaatgctataa

SEQ ID NO: 1047436 - DNA, 15 bp, Homo sapiens
tattggaacttgcga

SEQ ID NO: 1047437 - DNA, 14 bp, Homo sapiens
tattggaagctgct

SEQ ID NO: 1047438 - DNA, 15 bp, Homo sapiens
tattggaattaacct

SEQ ID NO: 1047439 - DNA, 16 bp, Homo sapiens
tattggaattaacctg

SEQ ID NO: 1047440 - DNA, 21 bp, Homo sapiens
tattggaattaacctggtgct

SEQ ID NO: 1047441 - DNA, 20 bp, Homo sapiens
tattggacggtttctagcct

SEQ ID NO: 1047442 - DNA, 21 bp, Homo sapiens
tattggacggtttctagcctc

SEQ ID NO: 1047443 - DNA, 22 bp, Homo sapiens
tattggacggtttctagcctct

SEQ ID NO: 1047444 - DNA, 21 bp, Homo sapiens
tattggagggtaaatgatgtg

SEQ ID NO: 1047445 - DNA, 20 bp, Homo sapiens
tattggaggtgagatcacag

SEQ ID NO: 1047446 - DNA, 17 bp, Homo sapiens
tattggcagccaaggaa

SEQ ID NO: 1047447 - DNA, 19 bp, Homo sapiens
tattggcagccaaggaatg

SEQ ID NO: 1047448 - DNA, 23 bp, Homo sapiens
tattggcagccaaggaatgtgtc

SEQ ID NO: 1047449 - DNA, 14 bp, Homo sapiens
tattggcctggagg

SEQ ID NO: 1047450 - DNA, 20 bp, Homo sapiens
tattgggcacagcctagggt

SEQ ID NO: 1047451 - DNA, 21 bp, Homo sapiens
tattggggttgagagggaaaa

SEQ ID NO: 1047452 - DNA, 20 bp, Homo sapiens
tattgggttcattattggaa

SEQ ID NO: 1047453 - DNA, 14 bp, Homo sapiens
tattgggtttttat

SEQ ID NO: 1047454 - DNA, 22 bp, Homo sapiens
tattggtccagcttgctcttca

SEQ ID NO: 1047455 - DNA, 15 bp, Homo sapiens
tattggtgcgttttt

SEQ ID NO: 1047456 - DNA, 17 bp, Homo sapiens
tattggtgtaaggtact

SEQ ID NO: 1047457 - DNA, 20 bp, Homo sapiens
tattggtgtatattatataa

SEQ ID NO: 1047458 - DNA, 20 bp, Homo sapiens
tattggttggtgtgaagaaa

SEQ ID NO: 1047459 - DNA, 12 bp, Homo sapiens
tattgtaaagaa

SEQ ID NO: 1047460 - DNA, 14 bp, Homo sapiens
tattgtaaatactg

SEQ ID NO: 1047461 - DNA, 13 bp, Homo sapiens
tattgtaaatgtg

SEQ ID NO: 1047462 - DNA, 23 bp, Homo sapiens
tattgtaatatagaaaaaaacat

SEQ ID NO: 1047463 - DNA, 18 bp, Homo sapiens
tattgtaatcgtgtgcca

SEQ ID NO: 1047464 - DNA, 21 bp, Homo sapiens
tattgtaatgagtgaattgaa

SEQ ID NO: 1047465 - DNA, 20 bp, Homo sapiens
tattgtacaaatgtaagcaa

SEQ ID NO: 1047466 - DNA, 19 bp, Homo sapiens
tttaattaattaagtatct

SEQ ID NO: 1047467 - DNA, 22 bp, Homo sapiens
tttaattaattgggccagcttt

SEQ ID NO: 1047468 - DNA, 17 bp, Homo sapiens
tttaattcaccaaagta

SEQ ID NO: 1047469 - DNA, 19 bp, Homo sapiens
tttaattcacctcagcctg

SEQ ID NO: 1047470 - DNA, 23 bp, Homo sapiens
tttaattcatcccaactgtcttt

SEQ ID NO: 1047471 - DNA, 16 bp, Homo sapiens
tttaattcatgtttct

SEQ ID NO: 1047472 - DNA, 16 bp, Homo sapiens
tttaattccaatatga

SEQ ID NO: 1047473 - DNA, 21 bp, Homo sapiens
tttaattccaatatgatgact

SEQ ID NO: 1047474 - DNA, 14 bp, Homo sapiens
tttaattctcattt

SEQ ID NO: 1047475 - DNA, 21 bp, Homo sapiens
tttaattctgtcttgttcatt

SEQ ID NO: 1047476 - DNA, 13 bp, Homo sapiens
tttaattgaaact

SEQ ID NO: 1047477 - DNA, 14 bp, Homo sapiens
tttaattgctttga

SEQ ID NO: 1047478 - DNA, 18 bp, Homo sapiens
tttaattgctttgaagca

SEQ ID NO: 1047479 - DNA, 12 bp, Homo sapiens
tttaattgtaaa

SEQ ID NO: 1047480 - DNA, 21 bp, Homo sapiens
tttaattgtagttctgtgtac

SEQ ID NO: 1047481 - DNA, 21 bp, Homo sapiens
tttaattgtataagtcaagca

SEQ ID NO: 1047482 - DNA, 13 bp, Homo sapiens
tttaatttaaagc

SEQ ID NO: 1047483 - DNA, 16 bp, Homo sapiens
tttaatttagtaaatg

SEQ ID NO: 1047484 - DNA, 14 bp, Homo sapiens
tttaatttatgtaa

SEQ ID NO: 1047485 - DNA, 22 bp, Homo sapiens
tttaatttattaattgctttga

SEQ ID NO: 1047486 - DNA, 20 bp, Homo sapiens
tttaatttatttattaagat

SEQ ID NO: 1047487 - DNA, 15 bp, Homo sapiens
tttaatttcaggaaa

SEQ ID NO: 1047488 - DNA, 21 bp, Homo sapiens
tttaatttctaagaagttact

SEQ ID NO: 1047489 - DNA, 12 bp, Homo sapiens
tttaatttctac

SEQ ID NO: 1047490 - DNA, 16 bp, Homo sapiens
tttaatttgaaatatg

SEQ ID NO: 1047491 - DNA, 18 bp, Homo sapiens
tttaattttaactgattt

SEQ ID NO: 1047492 - DNA, 13 bp, Homo sapiens
tttaattttaatg

SEQ ID NO: 1047493 - DNA, 22 bp, Homo sapiens
tttaatttttgcttttagaaaa

SEQ ID NO: 1047494 - DNA, 17 bp, Homo sapiens
tattgttaaattacatt

SEQ ID NO: 1047495 - DNA, 15 bp, Homo sapiens
tattgttactctggt

SEQ ID NO: 1047496 - DNA, 22 bp, Homo sapiens
tattgttagaaaatgacttatt

SEQ ID NO: 1047497 - DNA, 20 bp, Homo sapiens
tattgttccaagacattgtc

SEQ ID NO: 1047498 - DNA, 23 bp, Homo sapiens
tattgttccaagacattgtcaat

SEQ ID NO: 1047499 - DNA, 17 bp, Homo sapiens
tattgttccagcagttt

SEQ ID NO: 1047500 - DNA, 23 bp, Homo sapiens
tattgttccagcagttttcaagt

SEQ ID NO: 1047501 - DNA, 13 bp, Homo sapiens
tattgttcccagt

SEQ ID NO: 1047502 - DNA, 17 bp, Homo sapiens
tattgttcccagtgaca

SEQ ID NO: 1047503 - DNA, 15 bp, Homo sapiens
tattgttctcacact

SEQ ID NO: 1047504 - DNA, 17 bp, Homo sapiens
tattgttgaaaaagttt

SEQ ID NO: 1047505 - DNA, 21 bp, Homo sapiens
tattgttgaacatacttcaaa

SEQ ID NO: 1047506 - DNA, 19 bp, Homo sapiens
tattgttgacaactgtgac

SEQ ID NO: 1047507 - DNA, 20 bp, Homo sapiens
tattgttgacaactgtgact

SEQ ID NO: 1047508 - DNA, 11 bp, Homo sapiens
tattgtttaaa

SEQ ID NO: 1047509 - DNA, 12 bp, Homo sapiens
tattgtttaaaa

SEQ ID NO: 1047510 - DNA, 12 bp, Homo sapiens
tattgtttcaat

SEQ ID NO: 1047511 - DNA, 15 bp, Homo sapiens
tattgtttctgcatt

SEQ ID NO: 1047512 - DNA, 18 bp, Homo sapiens
tattgtttgatgttttta

SEQ ID NO: 1047513 - DNA, 14 bp, Homo sapiens
tattgtttgctgtt

SEQ ID NO: 1047514 - DNA, 16 bp, Homo sapiens
tattgtttgctgttgg

SEQ ID NO: 1047515 - DNA, 22 bp, Homo sapiens
tattgttttcagtgtacatgga

SEQ ID NO: 1047516 - DNA, 15 bp, Homo sapiens
tattgttttctcctt

SEQ ID NO: 1047517 - DNA, 15 bp, Homo sapiens
tattgttttctgtaa

SEQ ID NO: 1047518 - DNA, 17 bp, Homo sapiens
tattgttttctgtaaat

SEQ ID NO: 1047519 - DNA, 22 bp, Homo sapiens
tattgttttctgtaaataacct

SEQ ID NO: 1047520 - DNA, 16 bp, Homo sapiens
tatttaaaaaaaaagt

SEQ ID NO: 1047521 - DNA, 16 bp, Homo sapiens
tatttaaaaaactaaa

SEQ ID NO: 1047522 - DNA, 21 bp, Homo sapiens
tatttaaaaaactaaaaacta

SEQ ID NO: 1047523 - DNA, 21 bp, Homo sapiens
tatttaaaaaattaaaaatga

SEQ ID NO: 1047524 - DNA, 20 bp, Homo sapiens
tatttaaaaagaaacagaaa

SEQ ID NO: 1047525 - DNA, 23 bp, Homo sapiens
tatttaaaaataagtcaacagta

SEQ ID NO: 1047526 - DNA, 15 bp, Homo sapiens
tatttaaaaatattt

SEQ ID NO: 1047527 - DNA, 21 bp, Homo sapiens
tatttaaaaatatttcagata

SEQ ID NO: 1047528 - DNA, 15 bp, Homo sapiens
tatttaaaaatgtct

SEQ ID NO: 1047529 - DNA, 14 bp, Homo sapiens
tatttaaaaattgt

SEQ ID NO: 1047530 - DNA, 15 bp, Homo sapiens
tatttaaaaattgtt

SEQ ID NO: 1047531 - DNA, 16 bp, Homo sapiens
tatttaaaaattgttt

SEQ ID NO: 1047532 - DNA, 23 bp, Homo sapiens
tatttaaaaattgtttcttgaca

SEQ ID NO: 1047533 - DNA, 12 bp, Homo sapiens
tatttaaaactt

SEQ ID NO: 1047534 - DNA, 16 bp, Homo sapiens
tatttaaaataaattc

SEQ ID NO: 1047535 - DNA, 23 bp, Homo sapiens
tatttaaaatagcaaaagaagaa

SEQ ID NO: 1047536 - DNA, 23 bp, Homo sapiens
tatttaaaatgctcaatttcagc

SEQ ID NO: 1047537 - DNA, 14 bp, Homo sapiens
tatttaaaattggc

SEQ ID NO: 1047538 - DNA, 21 bp, Homo sapiens
tatttaaaccgctaaaagaaa

SEQ ID NO: 1047539 - DNA, 20 bp, Homo sapiens
tatttaaacctttttcttga

SEQ ID NO: 1047540 - DNA, 15 bp, Homo sapiens
tatttaaactatctt

SEQ ID NO: 1047541 - DNA, 13 bp, Homo sapiens
tatttaaagaaag

SEQ ID NO: 1047542 - DNA, 20 bp, Homo sapiens
tatttaaagaatgagaaaca

SEQ ID NO: 1047543 - DNA, 19 bp, Homo sapiens
tatttaaagatcttttaga

SEQ ID NO: 1047544 - DNA, 12 bp, Homo sapiens
tatttaaatgca

SEQ ID NO: 1047545 - DNA, 15 bp, Homo sapiens
tatttaaatgcatgt

SEQ ID NO: 1047546 - DNA, 18 bp, Homo sapiens
tatttaaatgttctaaca

SEQ ID NO: 1047547 - DNA, 18 bp, Homo sapiens
tatttaacaaaaaatgta

SEQ ID NO: 1047548 - DNA, 18 bp, Homo sapiens
tatttaacaactgggtca

SEQ ID NO: 1047549 - DNA, 14 bp, Homo sapiens
tatttaacagaaat

SEQ ID NO: 1047550 - DNA, 16 bp, Homo sapiens
tatttaacagaaattg

SEQ ID NO: 1047551 - DNA, 21 bp, Homo sapiens
tatttaacagctgaattatct

SEQ ID NO: 1047552 - DNA, 15 bp, Homo sapiens
tatttaacattattt

SEQ ID NO: 1047553 - DNA, 16 bp, Homo sapiens
tatttaactctcttta

SEQ ID NO: 1047554 - DNA, 14 bp, Homo sapiens
tatttaactgatta

SEQ ID NO: 1047555 - DNA, 15 bp, Homo sapiens
tatttaactggtgca

SEQ ID NO: 1047556 - DNA, 23 bp, Homo sapiens
tatttaactggtgcactttgtaa

SEQ ID NO: 1047557 - DNA, 14 bp, Homo sapiens
tatttaagaaaata

SEQ ID NO: 1047558 - DNA, 20 bp, Homo sapiens
tatttaagaaaatacaataa

SEQ ID NO: 1047559 - DNA, 22 bp, Homo sapiens
tatttaagaaaatacaataaac

SEQ ID NO: 1047560 - DNA, 21 bp, Homo sapiens
tatttaagatatatacatgga

SEQ ID NO: 1047561 - DNA, 18 bp, Homo sapiens
tatttaagatgtacattt

SEQ ID NO: 1047562 - DNA, 21 bp, Homo sapiens
tatttaagatgtacatttaat

SEQ ID NO: 1047563 - DNA, 20 bp, Homo sapiens
tatttaagcaacatcttttt

SEQ ID NO: 1047564 - DNA, 21 bp, Homo sapiens
tatttaagcaacatcttttta

SEQ ID NO: 1047565 - DNA, 20 bp, Homo sapiens
tatttaagcacataaagacc

SEQ ID NO: 1047566 - DNA, 18 bp, Homo sapiens
tatttaagcctcatattt

SEQ ID NO: 1047567 - DNA, 21 bp, Homo sapiens
tatttaagcctcatatttaaa

SEQ ID NO: 1047568 - DNA, 13 bp, Homo sapiens
tatttaagccttt

SEQ ID NO: 1047569 - DNA, 17 bp, Homo sapiens
tatttaaggaatcaaat

SEQ ID NO: 1047570 - DNA, 17 bp, Homo sapiens
tatttaataacaattgt

SEQ ID NO: 1047571 - DNA, 13 bp, Homo sapiens
tatttaatagcaa

SEQ ID NO: 1047572 - DNA, 22 bp, Homo sapiens
tatttaatatctggcactgtta

SEQ ID NO: 1047573 - DNA, 14 bp, Homo sapiens
tatttaatatgtca

SEQ ID NO: 1047574 - DNA, 14 bp, Homo sapiens
tatttaatgctgtg

SEQ ID NO: 1047575 - DNA, 20 bp, Homo sapiens
tatttaatggaagtgtattt

SEQ ID NO: 1047576 - DNA, 12 bp, Homo sapiens
tatttaatgttt

SEQ ID NO: 1047577 - DNA, 13 bp, Homo sapiens
tatttaatgtttt

SEQ ID NO: 1047578 - DNA, 16 bp, Homo sapiens
tatttaatgttttaaa

SEQ ID NO: 1047579 - DNA, 20 bp, Homo sapiens
tatttaattaaatctcaaat

SEQ ID NO: 1047580 - DNA, 13 bp, Homo sapiens
tatttaatttgga

SEQ ID NO: 1047581 - DNA, 14 bp, Homo sapiens
tatttacaatgtat

SEQ ID NO: 1047582 - DNA, 15 bp, Homo sapiens
tatttacagaagaaa

SEQ ID NO: 1047583 - DNA, 23 bp, Homo sapiens
tatttacagaagaaaagcatgca

SEQ ID NO: 1047584 - DNA, 17 bp, Homo sapiens
tatttacataaagactg

SEQ ID NO: 1047585 - DNA, 10 bp, Homo sapiens
tatttacatt

SEQ ID NO: 1047586 - DNA, 14 bp, Homo sapiens
tatttacatttaat

SEQ ID NO: 1047587 - DNA, 15 bp, Homo sapiens
tatttacgctttgat

SEQ ID NO: 1047588 - DNA, 22 bp, Homo sapiens
tttactggttgcatggaaatca

SEQ ID NO: 1047589 - DNA, 17 bp, Homo sapiens
tttactgtgaaactggc

SEQ ID NO: 1047590 - DNA, 18 bp, Homo sapiens
tttactgttttaattgta

SEQ ID NO: 1047591 - DNA, 15 bp, Homo sapiens
tttacttcttataca

SEQ ID NO: 1047592 - DNA, 17 bp, Homo sapiens
tttacttgtggtgtgac

SEQ ID NO: 1047593 - DNA, 18 bp, Homo sapiens
tttactttagaagcctgc

SEQ ID NO: 1047594 - DNA, 22 bp, Homo sapiens
tttactttattaatatgagtta

SEQ ID NO: 1047595 - DNA, 15 bp, Homo sapiens
tttactttgtacttg

SEQ ID NO: 1047596 - DNA, 16 bp, Homo sapiens
tttacttttaaactgt

SEQ ID NO: 1047597 - DNA, 18 bp, Homo sapiens
tttacttttttaacatgt

SEQ ID NO: 1047598 - DNA, 16 bp, Homo sapiens
tttagaaaaaaacatg

SEQ ID NO: 1047599 - DNA, 18 bp, Homo sapiens
tttagaaaaaaacatgaa

SEQ ID NO: 1047600 - DNA, 23 bp, Homo sapiens
tttagaaaaaagtttacaacata

SEQ ID NO: 1047601 - DNA, 23 bp, Homo sapiens
tttagaaaaaatggatgcccaga

SEQ ID NO: 1047602 - DNA, 21 bp, Homo sapiens
tttagaaaaacatttaaactt

SEQ ID NO: 1047603 - DNA, 14 bp, Homo sapiens
tttagaaaacttta

SEQ ID NO: 1047604 - DNA, 13 bp, Homo sapiens
tttagaaaatata

SEQ ID NO: 1047605 - DNA, 20 bp, Homo sapiens
tttagaaactgatttcttca

SEQ ID NO: 1047606 - DNA, 23 bp, Homo sapiens
tttagaaagaagcccaatattat

SEQ ID NO: 1047607 - DNA, 16 bp, Homo sapiens
tttagaaagctgacat

SEQ ID NO: 1047608 - DNA, 17 bp, Homo sapiens
tttagaaataaacctta

SEQ ID NO: 1047609 - DNA, 20 bp, Homo sapiens
tttagaaataaaccttaata

SEQ ID NO: 1047610 - DNA, 19 bp, Homo sapiens
tttagaaatactgcaagaa

SEQ ID NO: 1047611 - DNA, 16 bp, Homo sapiens
tttagaaatattcaaa

SEQ ID NO: 1047612 - DNA, 14 bp, Homo sapiens
tttagaaatgcata

SEQ ID NO: 1047613 - DNA, 16 bp, Homo sapiens
tttagaacagcattgt

SEQ ID NO: 1047614 - DNA, 13 bp, Homo sapiens
tttagaaccagcc

SEQ ID NO: 1047615 - DNA, 14 bp, Homo sapiens
tttagaagtagaat

SEQ ID NO: 1047616 - DNA, 23 bp, Homo sapiens
tttagaataaattcccaacttct

SEQ ID NO: 1047617 - DNA, 19 bp, Homo sapiens
tttagaataagaatttgca

SEQ ID NO: 1047618 - DNA, 18 bp, Homo sapiens
tttagaatcttttaaata

SEQ ID NO: 1047619 - DNA, 15 bp, Homo sapiens
tttagaccatttatc

SEQ ID NO: 1047620 - DNA, 22 bp, Homo sapiens
tttagaccctattgctgcttga

SEQ ID NO: 1047621 - DNA, 14 bp, Homo sapiens
tatttatatatatt

SEQ ID NO: 1047622 - DNA, 17 bp, Homo sapiens
tatttatatgtacatga

SEQ ID NO: 1047623 - DNA, 15 bp, Homo sapiens
tatttatatttggaa

SEQ ID NO: 1047624 - DNA, 14 bp, Homo sapiens
tatttatcaaaatg

SEQ ID NO: 1047625 - DNA, 15 bp, Homo sapiens
tatttatcagtgaca

SEQ ID NO: 1047626 - DNA, 18 bp, Homo sapiens
tatttatcagtgacagag

SEQ ID NO: 1047627 - DNA, 16 bp, Homo sapiens
tatttatccctttcct

SEQ ID NO: 1047628 - DNA, 18 bp, Homo sapiens
tatttatccctttcctgg

SEQ ID NO: 1047629 - DNA, 16 bp, Homo sapiens
tatttatctgagcaat

SEQ ID NO: 1047630 - DNA, 23 bp, Homo sapiens
tatttatctgagcaataacttct

SEQ ID NO: 1047631 - DNA, 21 bp, Homo sapiens
tatttatctgtagtaaactat

SEQ ID NO: 1047632 - DNA, 12 bp, Homo sapiens
tatttatcttta

SEQ ID NO: 1047633 - DNA, 13 bp, Homo sapiens
tatttatgaaaaa

SEQ ID NO: 1047634 - DNA, 18 bp, Homo sapiens
tatttatgcgtaatttaa

SEQ ID NO: 1047635 - DNA, 19 bp, Homo sapiens
tatttatgcgtaatttaat

SEQ ID NO: 1047636 - DNA, 21 bp, Homo sapiens
tatttatgcgtaatttaatgg

SEQ ID NO: 1047637 - DNA, 22 bp, Homo sapiens
tatttatggattaaaaactgct

SEQ ID NO: 1047638 - DNA, 16 bp, Homo sapiens
tatttatgtaaaagga

SEQ ID NO: 1047639 - DNA, 16 bp, Homo sapiens
tatttatgtaatttgt

SEQ ID NO: 1047640 - DNA, 19 bp, Homo sapiens
tatttatgtaatttgtaca

SEQ ID NO: 1047641 - DNA, 20 bp, Homo sapiens
tatttatgtaatttgtacag

SEQ ID NO: 1047642 - DNA, 21 bp, Homo sapiens
tatttatgtctatttaagcct

SEQ ID NO: 1047643 - DNA, 13 bp, Homo sapiens
tatttattaagat

SEQ ID NO: 1047644 - DNA, 17 bp, Homo sapiens
tatttattaatatttaa

SEQ ID NO: 1047645 - DNA, 18 bp, Homo sapiens
tatttattaatatttaac

SEQ ID NO: 1047646 - DNA, 14 bp, Homo sapiens
tatttattacataa

SEQ ID NO: 1047647 - DNA, 15 bp, Homo sapiens
tatttattacctctg

SEQ ID NO: 1047648 - DNA, 13 bp, Homo sapiens
tatttattactgt

SEQ ID NO: 1047649 - DNA, 15 bp, Homo sapiens
tatttattattaatt

SEQ ID NO: 1047650 - DNA, 14 bp, Homo sapiens
tatttattatttat

SEQ ID NO: 1047651 - DNA, 19 bp, Homo sapiens
tatttattattttcacctg

SEQ ID NO: 1047652 - DNA, 19 bp, Homo sapiens
tatttattcactgtaagtt

SEQ ID NO: 1047653 - DNA, 15 bp, Homo sapiens
tatttattcataatg

SEQ ID NO: 1047654 - DNA, 22 bp, Homo sapiens
tatttattcattatttgtcaaa

SEQ ID NO: 1047655 - DNA, 23 bp, Homo sapiens
tatttattcattatttgtcaaat

SEQ ID NO: 1047656 - DNA, 20 bp, Homo sapiens
tatttattgcattgctggta

SEQ ID NO: 1047657 - DNA, 14 bp, Homo sapiens
tatttattggtttt

SEQ ID NO: 1047658 - DNA, 24 bp, Homo sapiens
tatttattgttagaaaatgactta

SEQ ID NO: 1047659 - DNA, 14 bp, Homo sapiens
tatttattgttgcc

SEQ ID NO: 1047660 - DNA, 13 bp, Homo sapiens
tatttatttatgg

SEQ ID NO: 1047661 - DNA, 14 bp, Homo sapiens
tatttatttattta

SEQ ID NO: 1047662 - DNA, 18 bp, Homo sapiens
tatttatttcagatgttt

SEQ ID NO: 1047663 - DNA, 14 bp, Homo sapiens
tatttatttcctgc

SEQ ID NO: 1047664 - DNA, 15 bp, Homo sapiens
tatttatttcctgct

SEQ ID NO: 1047665 - DNA, 23 bp, Homo sapiens
tatttattttcagtatactgtgt

SEQ ID NO: 1047666 - DNA, 20 bp, Homo sapiens
tatttattttcctaaagaga

SEQ ID NO: 1047667 - DNA, 21 bp, Homo sapiens
tatttattttcctaaagagag

SEQ ID NO: 1047668 - DNA, 17 bp, Homo sapiens
tatttattttcctcccc

SEQ ID NO: 1047669 - DNA, 19 bp, Homo sapiens
tatttatttttgtgtaggt

SEQ ID NO: 1047670 - DNA, 14 bp, Homo sapiens
tatttcaaaatgtc

SEQ ID NO: 1047671 - DNA, 14 bp, Homo sapiens
tatttcaaattgga

SEQ ID NO: 1047672 - DNA, 18 bp, Homo sapiens
tatttcaaattggagctt

SEQ ID NO: 1047673 - DNA, 15 bp, Homo sapiens
tatttcaatgttagc

SEQ ID NO: 1047674 - DNA, 20 bp, Homo sapiens
tatttcactttagatgctga

SEQ ID NO: 1047675 - DNA, 19 bp, Homo sapiens
tatttcagatatcaaaatt

SEQ ID NO: 1047676 - DNA, 13 bp, Homo sapiens
tatttcagatgta

SEQ ID NO: 1047677 - DNA, 16 bp, Homo sapiens
tatttcagatgtaatg

SEQ ID NO: 1047678 - DNA, 20 bp, Homo sapiens
tatttcagatgtaatgtttt

SEQ ID NO: 1047679 - DNA, 18 bp, Homo sapiens
tatttcagtgttacctgt

SEQ ID NO: 1047680 - DNA, 13 bp, Homo sapiens
tatttcatcacaa

SEQ ID NO: 1047681 - DNA, 21 bp, Homo sapiens
tatttcatgattcaacctgat

SEQ ID NO: 1047682 - DNA, 21 bp, Homo sapiens
tatttcatgctgggaatgaga

SEQ ID NO: 1047683 - DNA, 12 bp, Homo sapiens
tatttcatgtgg

SEQ ID NO: 1047684 - DNA, 17 bp, Homo sapiens
tatttcatgtggctgta

SEQ ID NO: 1047685 - DNA, 13 bp, Homo sapiens
tatttcatgtttt

SEQ ID NO: 1047686 - DNA, 16 bp, Homo sapiens
tatttccaaaagcaca

SEQ ID NO: 1047687 - DNA, 15 bp, Homo sapiens
tatttccactaaaaa

SEQ ID NO: 1047688 - DNA, 22 bp, Homo sapiens
tatttccagtgttctatgaaca

SEQ ID NO: 1047689 - DNA, 21 bp, Homo sapiens
tatttccattctttcagctgt

SEQ ID NO: 1047690 - DNA, 22 bp, Homo sapiens
tatttccctcacctttcccatc

SEQ ID NO: 1047691 - DNA, 18 bp, Homo sapiens
tatttccctctcattttg

SEQ ID NO: 1047692 - DNA, 12 bp, Homo sapiens
tatttcccttcc

SEQ ID NO: 1047693 - DNA, 21 bp, Homo sapiens
tatttcctgaaataaatgttt

SEQ ID NO: 1047694 - DNA, 13 bp, Homo sapiens
tatttcctgactt

SEQ ID NO: 1047695 - DNA, 16 bp, Homo sapiens
tatttcctgacttgag

SEQ ID NO: 1047696 - DNA, 19 bp, Homo sapiens
tatttccttaaactgtgtg

SEQ ID NO: 1047697 - DNA, 15 bp, Homo sapiens
tatttcgaaactgcc

SEQ ID NO: 1047698 - DNA, 19 bp, Homo sapiens
tatttcgaaactgccaagg

SEQ ID NO: 1047699 - DNA, 15 bp, Homo sapiens
tatttctaactatat

SEQ ID NO: 1047700 - DNA, 22 bp, Homo sapiens
tatttctaagaaatagagccaa

SEQ ID NO: 1047701 - DNA, 23 bp, Homo sapiens
tatttctaagtatttaaatgttc

SEQ ID NO: 1047702 - DNA, 24 bp, Homo sapiens
tatttctaattccacaggtcatca

SEQ ID NO: 1047703 - DNA, 14 bp, Homo sapiens
tatttctacagaga

SEQ ID NO: 1047704 - DNA, 15 bp, Homo sapiens
tatttctacagagaa

SEQ ID NO: 1047705 - DNA, 17 bp, Homo sapiens
tatttctactatataca

SEQ ID NO: 1047706 - DNA, 18 bp, Homo sapiens
tatttctactgtcaaatg

SEQ ID NO: 1047707 - DNA, 14 bp, Homo sapiens
tatttctaggcaca

SEQ ID NO: 1047708 - DNA, 19 bp, Homo sapiens
tatttctagttctttcctc

SEQ ID NO: 1047709 - DNA, 15 bp, Homo sapiens
tatttctatgtcatt

SEQ ID NO: 1047710 - DNA, 20 bp, Homo sapiens
tttataactcatcataaaat

SEQ ID NO: 1047711 - DNA, 17 bp, Homo sapiens
tttataagaaaaacttt

SEQ ID NO: 1047712 - DNA, 18 bp, Homo sapiens
tttataagaattttgctt

SEQ ID NO: 1047713 - DNA, 13 bp, Homo sapiens
tttataatagatt

SEQ ID NO: 1047714 - DNA, 13 bp, Homo sapiens
tttataataggaa

SEQ ID NO: 1047715 - DNA, 16 bp, Homo sapiens
tttataatctgaagat

SEQ ID NO: 1047716 - DNA, 17 bp, Homo sapiens
tttataatgattcataa

SEQ ID NO: 1047717 - DNA, 14 bp, Homo sapiens
tttataatgtattt

SEQ ID NO: 1047718 - DNA, 15 bp, Homo sapiens
tttataatgtatttg

SEQ ID NO: 1047719 - DNA, 18 bp, Homo sapiens
tttataattggtgctatt

SEQ ID NO: 1047720 - DNA, 13 bp, Homo sapiens
tttataattgttt

SEQ ID NO: 1047721 - DNA, 16 bp, Homo sapiens
tttatacagaactcac

SEQ ID NO: 1047722 - DNA, 18 bp, Homo sapiens
tttatacagctgtattgt

SEQ ID NO: 1047723 - DNA, 22 bp, Homo sapiens
tttatacagctgtattgtctga

SEQ ID NO: 1047724 - DNA, 12 bp, Homo sapiens
tttatacataaa

SEQ ID NO: 1047725 - DNA, 22 bp, Homo sapiens
tttataccagcttaatagctgt

SEQ ID NO: 1047726 - DNA, 18 bp, Homo sapiens
tttatacccccaggaaac

SEQ ID NO: 1047727 - DNA, 14 bp, Homo sapiens
tttatacggaaaaa

SEQ ID NO: 1047728 - DNA, 17 bp, Homo sapiens
tttatactcagaactgt

SEQ ID NO: 1047729 - DNA, 21 bp, Homo sapiens
tttatactctagaacatgcac

SEQ ID NO: 1047730 - DNA, 23 bp, Homo sapiens
tttatactctagaacatgcacat

SEQ ID NO: 1047731 - DNA, 16 bp, Homo sapiens
tttatactctttctgt

SEQ ID NO: 1047732 - DNA, 15 bp, Homo sapiens
tttatactgcacagt

SEQ ID NO: 1047733 - DNA, 13 bp, Homo sapiens
tttatactgtata

SEQ ID NO: 1047734 - DNA, 19 bp, Homo sapiens
tttatactgtatttctaag

SEQ ID NO: 1047735 - DNA, 19 bp, Homo sapiens
tttatactttaaagtattt

SEQ ID NO: 1047736 - DNA, 14 bp, Homo sapiens
tttatagaagaaat

SEQ ID NO: 1047737 - DNA, 18 bp, Homo sapiens
tttatagaaggaatttgt

SEQ ID NO: 1047738 - DNA, 22 bp, Homo sapiens
tttatagaaggaatttgtactt

SEQ ID NO: 1047739 - DNA, 21 bp, Homo sapiens
tttatagaataatgtgggaag

SEQ ID NO: 1047740 - DNA, 18 bp, Homo sapiens
tttatagacattatgtga

SEQ ID NO: 1047741 - DNA, 21 bp, Homo sapiens
tttatagcaagatattgatca

SEQ ID NO: 1047742 - DNA, 22 bp, Homo sapiens
tttatagcaagatattgatcaa

SEQ ID NO: 1047743 - DNA, 20 bp, Homo sapiens
tttataggaatagaggaaga

SEQ ID NO: 1047744 - DNA, 15 bp, Homo sapiens
tttataggtgaaaga

SEQ ID NO: 1047745 - DNA, 16 bp, Homo sapiens
tttataggtgagaaaa

SEQ ID NO: 1047746 - DNA, 19 bp, Homo sapiens
tttatagtttgtacatgca

SEQ ID NO: 1047747 - DNA, 14 bp, Homo sapiens
tttatataagtctg

SEQ ID NO: 1047748 - DNA, 21 bp, Homo sapiens
tatttgaatgatttttcttta

SEQ ID NO: 1047749 - DNA, 13 bp, Homo sapiens
tatttgactcttt

SEQ ID NO: 1047750 - DNA, 18 bp, Homo sapiens
tatttgactctttcaaag

SEQ ID NO: 1047751 - DNA, 19 bp, Homo sapiens
tatttgactctttcaaaga

SEQ ID NO: 1047752 - DNA, 17 bp, Homo sapiens
tatttgacttgcatgaa

SEQ ID NO: 1047753 - DNA, 11 bp, Homo sapiens
tatttgagaaa

SEQ ID NO: 1047754 - DNA, 14 bp, Homo sapiens
tatttgagaagata

SEQ ID NO: 1047755 - DNA, 17 bp, Homo sapiens
tatttgagaattttgtt

SEQ ID NO: 1047756 - DNA, 16 bp, Homo sapiens
tatttgagacggggtc

SEQ ID NO: 1047757 - DNA, 22 bp, Homo sapiens
tatttgagacggggtctccctg

SEQ ID NO: 1047758 - DNA, 16 bp, Homo sapiens
tatttgagactagttt

SEQ ID NO: 1047759 - DNA, 22 bp, Homo sapiens
tatttgagcatgcacagctgct

SEQ ID NO: 1047760 - DNA, 19 bp, Homo sapiens
tatttgaggggtttcagaa

SEQ ID NO: 1047761 - DNA, 21 bp, Homo sapiens
tatttgattcaaaatatttaa

SEQ ID NO: 1047762 - DNA, 13 bp, Homo sapiens
tatttgcaaaccc

SEQ ID NO: 1047763 - DNA, 19 bp, Homo sapiens
tatttgcaaaccctttgta

SEQ ID NO: 1047764 - DNA, 23 bp, Homo sapiens
tatttgcagataattctggacca

SEQ ID NO: 1047765 - DNA, 19 bp, Homo sapiens
tatttgcagtatgaactat

SEQ ID NO: 1047766 - DNA, 15 bp, Homo sapiens
tatttgcagttactt

SEQ ID NO: 1047767 - DNA, 20 bp, Homo sapiens
tatttgcagttacttgaata

SEQ ID NO: 1047768 - DNA, 22 bp, Homo sapiens
tatttgcataacaattcctcta

SEQ ID NO: 1047769 - DNA, 16 bp, Homo sapiens
tatttgcatatttatt

SEQ ID NO: 1047770 - DNA, 23 bp, Homo sapiens
tatttgccagagccaaattttat

SEQ ID NO: 1047771 - DNA, 16 bp, Homo sapiens
tatttggaaagagacc

SEQ ID NO: 1047772 - DNA, 18 bp, Homo sapiens
tatttggaatatttgaat

SEQ ID NO: 1047773 - DNA, 15 bp, Homo sapiens
tatttggctgggcta

SEQ ID NO: 1047774 - DNA, 23 bp, Homo sapiens
tatttgtaaaagaacagtaaaca

SEQ ID NO: 1047775 - DNA, 17 bp, Homo sapiens
tatttgtaaatctgcca

SEQ ID NO: 1047776 - DNA, 21 bp, Homo sapiens
tatttgtaaatttagtgtttt

SEQ ID NO: 1047777 - DNA, 17 bp, Homo sapiens
tatttgtaagatatttg

SEQ ID NO: 1047778 - DNA, 15 bp, Homo sapiens
tatttgtaatagatg

SEQ ID NO: 1047779 - DNA, 12 bp, Homo sapiens
tatttgtaatta

SEQ ID NO: 1047780 - DNA, 15 bp, Homo sapiens
tatttgtaattaaaa

SEQ ID NO: 1047781 - DNA, 20 bp, Homo sapiens
tatttgtacaattttaaagt

SEQ ID NO: 1047782 - DNA, 22 bp, Homo sapiens
tatttgtataaaagtgtgaaat

SEQ ID NO: 1047783 - DNA, 21 bp, Homo sapiens
tatttgtataaattaaataaa

SEQ ID NO: 1047784 - DNA, 15 bp, Homo sapiens
tatttgtatatattt

SEQ ID NO: 1047785 - DNA, 18 bp, Homo sapiens
tatttgtatatattttat

SEQ ID NO: 1047786 - DNA, 18 bp, Homo sapiens
tatttgtattaataaagc

SEQ ID NO: 1047787 - DNA, 21 bp, Homo sapiens
tatttgtatttttttgcaagt

SEQ ID NO: 1047788 - DNA, 14 bp, Homo sapiens
tatttgtcatgaca

SEQ ID NO: 1047789 - DNA, 16 bp, Homo sapiens
tatttgtcatgacagt

SEQ ID NO: 1047790 - DNA, 24 bp, Homo sapiens
tatttgtcatgacagtgcttgcat

SEQ ID NO: 1047791 - DNA, 17 bp, Homo sapiens
tatttgtcgtgttggaa

SEQ ID NO: 1047792 - DNA, 23 bp, Homo sapiens
tatttgtcttaaaaaatgtgaaa

SEQ ID NO: 1047793 - DNA, 21 bp, Homo sapiens
tatttgtgacttttaaaaata

SEQ ID NO: 1047794 - DNA, 18 bp, Homo sapiens
tatttgtgatagcacttt

SEQ ID NO: 1047795 - DNA, 17 bp, Homo sapiens
tatttgtgctatagtat

SEQ ID NO: 1047796 - DNA, 12 bp, Homo sapiens
tatttgtggaat

SEQ ID NO: 1047797 - DNA, 13 bp, Homo sapiens
tatttgtgtaata

SEQ ID NO: 1047798 - DNA, 15 bp, Homo sapiens
tatttgtgtatttaa

SEQ ID NO: 1047799 - DNA, 19 bp, Homo sapiens
tatttgtgtattttcctgg

SEQ ID NO: 1047800 - DNA, 22 bp, Homo sapiens
tatttgtgtattttcctggatt

SEQ ID NO: 1047801 - DNA, 12 bp, Homo sapiens
tatttgtgtttt

SEQ ID NO: 1047802 - DNA, 18 bp, Homo sapiens
tatttgtttacatgcaga

SEQ ID NO: 1047803 - DNA, 14 bp, Homo sapiens
tatttgttttcatg

SEQ ID NO: 1047804 - DNA, 15 bp, Homo sapiens
tattttaaaatttca

SEQ ID NO: 1047805 - DNA, 14 bp, Homo sapiens
tattttaaagaatt

SEQ ID NO: 1047806 - DNA, 16 bp, Homo sapiens
tattttaaagaattgt

SEQ ID NO: 1047807 - DNA, 16 bp, Homo sapiens
tattttaaatataaat

SEQ ID NO: 1047808 - DNA, 17 bp, Homo sapiens
tattttaaatataaata

SEQ ID NO: 1047809 - DNA, 23 bp, Homo sapiens
tattttaaatataaatagctaat

SEQ ID NO: 1047810 - DNA, 14 bp, Homo sapiens
tattttaacacttt

SEQ ID NO: 1047811 - DNA, 12 bp, Homo sapiens
tattttaagaaa

SEQ ID NO: 1047812 - DNA, 20 bp, Homo sapiens
tattttaagaaagagaatga

SEQ ID NO: 1047813 - DNA, 19 bp, Homo sapiens
tattttaatattttgtatt

SEQ ID NO: 1047814 - DNA, 21 bp, Homo sapiens
tattttaatgtatatttgctg

SEQ ID NO: 1047815 - DNA, 23 bp, Homo sapiens
tattttacaattttttatcatgc

SEQ ID NO: 1047816 - DNA, 22 bp, Homo sapiens
tattttacatgaagctgtataa

SEQ ID NO: 1047817 - DNA, 15 bp, Homo sapiens
tattttacatttaga

SEQ ID NO: 1047818 - DNA, 13 bp, Homo sapiens
tattttactttgt

SEQ ID NO: 1047819 - DNA, 20 bp, Homo sapiens
tattttagcagttctgcaaa

SEQ ID NO: 1047820 - DNA, 14 bp, Homo sapiens
tattttaggcactg

SEQ ID NO: 1047821 - DNA, 14 bp, Homo sapiens
tattttataagaaa

SEQ ID NO: 1047822 - DNA, 15 bp, Homo sapiens
tattttataagaaaa

SEQ ID NO: 1047823 - DNA, 17 bp, Homo sapiens
tattttataagaaaaac

SEQ ID NO: 1047824 - DNA, 13 bp, Homo sapiens
tattttatataaa

SEQ ID NO: 1047825 - DNA, 14 bp, Homo sapiens
tattttatatgaga

SEQ ID NO: 1047826 - DNA, 20 bp, Homo sapiens
tattttatatgagagaatca

SEQ ID NO: 1047827 - DNA, 15 bp, Homo sapiens
tattttatcctctgg

SEQ ID NO: 1047828 - DNA, 20 bp, Homo sapiens
tattttatgtctgtaatcat

SEQ ID NO: 1047829 - DNA, 14 bp, Homo sapiens
tattttattactgt

SEQ ID NO: 1047830 - DNA, 14 bp, Homo sapiens
tattttattatgca

SEQ ID NO: 1047831 - DNA, 20 bp, Homo sapiens
tattttattcagtagtttga

SEQ ID NO: 1047832 - DNA, 19 bp, Homo sapiens
tttatgagccagacaaatg

SEQ ID NO: 1047833 - DNA, 15 bp, Homo sapiens
tttatgatcagtgtt

SEQ ID NO: 1047834 - DNA, 14 bp, Homo sapiens
tttatgcacagcct

SEQ ID NO: 1047835 - DNA, 17 bp, Homo sapiens
tttatgcagacagtctg

SEQ ID NO: 1047836 - DNA, 17 bp, Homo sapiens
tttatgcatatgtagat

SEQ ID NO: 1047837 - DNA, 20 bp, Homo sapiens
tttatgcatatgtagataca

SEQ ID NO: 1047838 - DNA, 15 bp, Homo sapiens
tttatgcattgcctt

SEQ ID NO: 1047839 - DNA, 13 bp, Homo sapiens
tttatgcatttca

SEQ ID NO: 1047840 - DNA, 14 bp, Homo sapiens
tttatgcatttcat

SEQ ID NO: 1047841 - DNA, 15 bp, Homo sapiens
tttatgcatttcatt

SEQ ID NO: 1047842 - DNA, 14 bp, Homo sapiens
tttatgctgtattt

SEQ ID NO: 1047843 - DNA, 18 bp, Homo sapiens
tttatgcttaaaatatgt

SEQ ID NO: 1047844 - DNA, 23 bp, Homo sapiens
tttatggaaaaattgacaaaaaa

SEQ ID NO: 1047845 - DNA, 16 bp, Homo sapiens
tttatggcatgattta

SEQ ID NO: 1047846 - DNA, 17 bp, Homo sapiens
tttatggccttaatata

SEQ ID NO: 1047847 - DNA, 20 bp, Homo sapiens
tttatggcttttgtgcatta

SEQ ID NO: 1047848 - DNA, 24 bp, Homo sapiens
tttatggcttttgtgcattatcta

SEQ ID NO: 1047849 - DNA, 16 bp, Homo sapiens
tttatggtttctccag

SEQ ID NO: 1047850 - DNA, 22 bp, Homo sapiens
tttatgtaaactgcattagaaa

SEQ ID NO: 1047851 - DNA, 14 bp, Homo sapiens
tttatgtaatttca

SEQ ID NO: 1047852 - DNA, 19 bp, Homo sapiens
tttatgtaatttgtacagg

SEQ ID NO: 1047853 - DNA, 12 bp, Homo sapiens
tttatgtacaac

SEQ ID NO: 1047854 - DNA, 12 bp, Homo sapiens
tttatgtactgc

SEQ ID NO: 1047855 - DNA, 14 bp, Homo sapiens
tttatgtagcacat

SEQ ID NO: 1047856 - DNA, 11 bp, Homo sapiens
tttatgtctgg

SEQ ID NO: 1047857 - DNA, 14 bp, Homo sapiens
tttatgtgagattt

SEQ ID NO: 1047858 - DNA, 19 bp, Homo sapiens
tttatgtgatgccaaagat

SEQ ID NO: 1047859 - DNA, 23 bp, Homo sapiens
tttatgtgatgccaaagatgttt

SEQ ID NO: 1047860 - DNA, 15 bp, Homo sapiens
tttatgttaaaagat

SEQ ID NO: 1047861 - DNA, 17 bp, Homo sapiens
tttatgttcatttgttt

SEQ ID NO: 1047862 - DNA, 14 bp, Homo sapiens
tttatgttccttta

SEQ ID NO: 1047863 - DNA, 14 bp, Homo sapiens
tttatgttgatctg

SEQ ID NO: 1047864 - DNA, 18 bp, Homo sapiens
tttatgttgatctgcata

SEQ ID NO: 1047865 - DNA, 14 bp, Homo sapiens
tttatgttgtatga

SEQ ID NO: 1047866 - DNA, 20 bp, Homo sapiens
tttatgttttgtttctgaaa

SEQ ID NO: 1047867 - DNA, 14 bp, Homo sapiens
tttatgtttttggt

SEQ ID NO: 1047868 - DNA, 15 bp, Homo sapiens
tttattaaaaatgtt

SEQ ID NO: 1047869 - DNA, 18 bp, Homo sapiens
tttattaaaatatttcag

SEQ ID NO: 1047870 - DNA, 16 bp, Homo sapiens
tttattaaaatcttaa

SEQ ID NO: 1047871 - DNA, 22 bp, Homo sapiens
tttattaaaatgattgtaaaat

SEQ ID NO: 1047872 - DNA, 23 bp, Homo sapiens
tttattaaaatgattgtaaaata

SEQ ID NO: 1047873 - DNA, 20 bp, Homo sapiens
tttattaaacaattttgtta

SEQ ID NO: 1047874 - DNA, 22 bp, Homo sapiens
tttattaaacagatttttacaa

SEQ ID NO: 1047875 - DNA, 23 bp, Homo sapiens
tattttggattgtatattgtgtt

SEQ ID NO: 1047876 - DNA, 17 bp, Homo sapiens
tattttggtacttttat

SEQ ID NO: 1047877 - DNA, 21 bp, Homo sapiens
tattttggttcttagttctca

SEQ ID NO: 1047878 - DNA, 17 bp, Homo sapiens
tattttgtaaaatgtat

SEQ ID NO: 1047879 - DNA, 22 bp, Homo sapiens
tattttgtaaaatgtattatgt

SEQ ID NO: 1047880 - DNA, 21 bp, Homo sapiens
tattttgtaaactcaaaatat

SEQ ID NO: 1047881 - DNA, 18 bp, Homo sapiens
tattttgtaatattctgt

SEQ ID NO: 1047882 - DNA, 21 bp, Homo sapiens
tattttgtaatattctgtttt

SEQ ID NO: 1047883 - DNA, 15 bp, Homo sapiens
tattttgtactttgt

SEQ ID NO: 1047884 - DNA, 14 bp, Homo sapiens
tattttgtagatgt

SEQ ID NO: 1047885 - DNA, 18 bp, Homo sapiens
tattttgtatatttgtaa

SEQ ID NO: 1047886 - DNA, 13 bp, Homo sapiens
tattttgtctaaa

SEQ ID NO: 1047887 - DNA, 19 bp, Homo sapiens
tattttgtgatgatgctgt

SEQ ID NO: 1047888 - DNA, 20 bp, Homo sapiens
tattttgtgatgatgctgtg

SEQ ID NO: 1047889 - DNA, 23 bp, Homo sapiens
tattttgtggttctattttactt

SEQ ID NO: 1047890 - DNA, 17 bp, Homo sapiens
tattttgtgtacaagtt

SEQ ID NO: 1047891 - DNA, 13 bp, Homo sapiens
tattttgtgtgac

SEQ ID NO: 1047892 - DNA, 15 bp, Homo sapiens
tattttgtgtgacca

SEQ ID NO: 1047893 - DNA, 21 bp, Homo sapiens
tattttgttttgtgcagagat

SEQ ID NO: 1047894 - DNA, 24 bp, Homo sapiens
tattttgttttttttgactaaagc

SEQ ID NO: 1047895 - DNA, 19 bp, Homo sapiens
tatttttaaaatatttaac

SEQ ID NO: 1047896 - DNA, 17 bp, Homo sapiens
tatttttaaagaatgtt

SEQ ID NO: 1047897 - DNA, 15 bp, Homo sapiens
tatttttaaagatag

SEQ ID NO: 1047898 - DNA, 13 bp, Homo sapiens
tatttttaaataa

SEQ ID NO: 1047899 - DNA, 20 bp, Homo sapiens
tatttttaacacttaaattt

SEQ ID NO: 1047900 - DNA, 12 bp, Homo sapiens
tatttttaatgg

SEQ ID NO: 1047901 - DNA, 14 bp, Homo sapiens
tatttttaattaat

SEQ ID NO: 1047902 - DNA, 21 bp, Homo sapiens
tatttttaattaattgggcca

SEQ ID NO: 1047903 - DNA, 16 bp, Homo sapiens
tatttttacatttaaa

SEQ ID NO: 1047904 - DNA, 23 bp, Homo sapiens
tatttttacgatctgtttccaaa

SEQ ID NO: 1047905 - DNA, 14 bp, Homo sapiens
tatttttagaataa

SEQ ID NO: 1047906 - DNA, 22 bp, Homo sapiens
tatttttatataatatctaaag

SEQ ID NO: 1047907 - DNA, 19 bp, Homo sapiens
tatttttatatcatgcaaa

SEQ ID NO: 1047908 - DNA, 17 bp, Homo sapiens
tatttttatatttcctt

SEQ ID NO: 1047909 - DNA, 17 bp, Homo sapiens
tatttttatcatgaatt

SEQ ID NO: 1047910 - DNA, 12 bp, Homo sapiens
tatttttatcta

SEQ ID NO: 1047911 - DNA, 14 bp, Homo sapiens
tatttttatgtgca

SEQ ID NO: 1047912 - DNA, 17 bp, Homo sapiens
tatttttattaaatgta

SEQ ID NO: 1047913 - DNA, 16 bp, Homo sapiens
tatttttattactttt

SEQ ID NO: 1047914 - DNA, 13 bp, Homo sapiens
tatttttcaaata

SEQ ID NO: 1047915 - DNA, 20 bp, Homo sapiens
tatttttcaataaagcattt

SEQ ID NO: 1047916 - DNA, 17 bp, Homo sapiens
tatttttcagttccaag

SEQ ID NO: 1047917 - DNA, 15 bp, Homo sapiens
tatttttctgagatt

SEQ ID NO: 1047918 - DNA, 14 bp, Homo sapiens
tatttttctgttac

SEQ ID NO: 1047919 - DNA, 17 bp, Homo sapiens
tatttttcttgctgttc

SEQ ID NO: 1047920 - DNA, 19 bp, Homo sapiens
tatttttgaacccctgtgt

SEQ ID NO: 1047921 - DNA, 20 bp, Homo sapiens
tatttttgaacccctgtgtc

SEQ ID NO: 1047922 - DNA, 18 bp, Homo sapiens
tatttttgactgtagcca

SEQ ID NO: 1047923 - DNA, 19 bp, Homo sapiens
tatttttgataccttcaat

SEQ ID NO: 1047924 - DNA, 12 bp, Homo sapiens
tatttttgcaaa

SEQ ID NO: 1047925 - DNA, 15 bp, Homo sapiens
tatttttgcaaaata

SEQ ID NO: 1047926 - DNA, 20 bp, Homo sapiens
tatttttgcaaaataagttt

SEQ ID NO: 1047927 - DNA, 19 bp, Homo sapiens
tatttttggcagtctgaat

SEQ ID NO: 1047928 - DNA, 14 bp, Homo sapiens
tatttttggggcat

SEQ ID NO: 1047929 - DNA, 19 bp, Homo sapiens
tatttttggggcatcctgg

SEQ ID NO: 1047930 - DNA, 12 bp, Homo sapiens
tatttttgtact

SEQ ID NO: 1047931 - DNA, 14 bp, Homo sapiens
tatttttgtagtga

SEQ ID NO: 1047932 - DNA, 13 bp, Homo sapiens
tatttttgtataa

SEQ ID NO: 1047933 - DNA, 17 bp, Homo sapiens
tatttttgtatgccttt

SEQ ID NO: 1047934 - DNA, 13 bp, Homo sapiens
tatttttgtgtag

SEQ ID NO: 1047935 - DNA, 15 bp, Homo sapiens
tatttttgtgtaggt

SEQ ID NO: 1047936 - DNA, 16 bp, Homo sapiens
tatttttgtgtttgaa

SEQ ID NO: 1047937 - DNA, 13 bp, Homo sapiens
tatttttgttaat

SEQ ID NO: 1047938 - DNA, 14 bp, Homo sapiens
tatttttgtttaca

SEQ ID NO: 1047939 - DNA, 20 bp, Homo sapiens
tatttttgtttcttccaaag

SEQ ID NO: 1047940 - DNA, 12 bp, Homo sapiens
tattttttaaag

SEQ ID NO: 1047941 - DNA, 20 bp, Homo sapiens
tattttttacttttcacact

SEQ ID NO: 1047942 - DNA, 16 bp, Homo sapiens
tattttttatatatac

SEQ ID NO: 1047943 - DNA, 21 bp, Homo sapiens
tattttttatttctaagtatt

SEQ ID NO: 1047944 - DNA, 15 bp, Homo sapiens
tattttttccctcct

SEQ ID NO: 1047945 - DNA, 11 bp, Homo sapiens
tattttttcct

SEQ ID NO: 1047946 - DNA, 14 bp, Homo sapiens
tattttttccttaa

SEQ ID NO: 1047947 - DNA, 16 bp, Homo sapiens
tattttttccttttgt

SEQ ID NO: 1047948 - DNA, 13 bp, Homo sapiens
tattttttctaca

SEQ ID NO: 1047949 - DNA, 14 bp, Homo sapiens
tattttttctacac

SEQ ID NO: 1047950 - DNA, 18 bp, Homo sapiens
tattttttctacacagta

SEQ ID NO: 1047951 - DNA, 12 bp, Homo sapiens
tattttttctat

SEQ ID NO: 1047952 - DNA, 12 bp, Homo sapiens
tattttttctgt

SEQ ID NO: 1047953 - DNA, 21 bp, Homo sapiens
tattttttgaaggtttcagat

SEQ ID NO: 1047954 - DNA, 13 bp, Homo sapiens
tattttttgggcc

SEQ ID NO: 1047955 - DNA, 16 bp, Homo sapiens
tttatttctgcatatg

SEQ ID NO: 1047956 - DNA, 12 bp, Homo sapiens
tttatttgttga

SEQ ID NO: 1047957 - DNA, 21 bp, Homo sapiens
tttattttaaaacagaagaat

SEQ ID NO: 1047958 - DNA, 15 bp, Homo sapiens
tttattttacattta

SEQ ID NO: 1047959 - DNA, 19 bp, Homo sapiens
tttattttagcagttctgc

SEQ ID NO: 1047960 - DNA, 16 bp, Homo sapiens
tttattttaggcactg

SEQ ID NO: 1047961 - DNA, 12 bp, Homo sapiens
tttattttattg

SEQ ID NO: 1047962 - DNA, 21 bp, Homo sapiens
tttattttcagtatactgtgt

SEQ ID NO: 1047963 - DNA, 16 bp, Homo sapiens
tttattttcctcccca

SEQ ID NO: 1047964 - DNA, 19 bp, Homo sapiens
tttattttgctccctctgt

SEQ ID NO: 1047965 - DNA, 18 bp, Homo sapiens
tttattttgctttgtctt

SEQ ID NO: 1047966 - DNA, 23 bp, Homo sapiens
tttattttggaattggtgtatat

SEQ ID NO: 1047967 - DNA, 22 bp, Homo sapiens
tttattttgtgctcatttaagt

SEQ ID NO: 1047968 - DNA, 15 bp, Homo sapiens
tttatttttaagaaa

SEQ ID NO: 1047969 - DNA, 23 bp, Homo sapiens
tttatttttacaagaagtttatt

SEQ ID NO: 1047970 - DNA, 16 bp, Homo sapiens
tttatttttcatattg

SEQ ID NO: 1047971 - DNA, 22 bp, Homo sapiens
tttatttttgcaaaataagttt

SEQ ID NO: 1047972 - DNA, 16 bp, Homo sapiens
tttattttttaaatgt

SEQ ID NO: 1047973 - DNA, 17 bp, Homo sapiens
tttattttttaagtatt

SEQ ID NO: 1047974 - DNA, 13 bp, Homo sapiens
tttattttttacc

SEQ ID NO: 1047975 - DNA, 16 bp, Homo sapiens
tttatttttttgtaca

SEQ ID NO: 1047976 - DNA, 18 bp, Homo sapiens
tttattttttttaaagaa

SEQ ID NO: 1047977 - DNA, 21 bp, Homo sapiens
tttcaaaaaaaaaaaaaaaga

SEQ ID NO: 1047978 - DNA, 16 bp, Homo sapiens
tttcaaaaatataact

SEQ ID NO: 1047979 - DNA, 21 bp, Homo sapiens
tttcaaaaatataacttaaaa

SEQ ID NO: 1047980 - DNA, 13 bp, Homo sapiens
tttcaaaagaaag

SEQ ID NO: 1047981 - DNA, 15 bp, Homo sapiens
tttcaaaatacattt

SEQ ID NO: 1047982 - DNA, 13 bp, Homo sapiens
tttcaaacaaaat

SEQ ID NO: 1047983 - DNA, 22 bp, Homo sapiens
tttcaaactgagtaaattggaa

SEQ ID NO: 1047984 - DNA, 12 bp, Homo sapiens
tttcaaacttta

SEQ ID NO: 1047985 - DNA, 16 bp, Homo sapiens
tttcaaactttactat

SEQ ID NO: 1047986 - DNA, 14 bp, Homo sapiens
tttcaaagaaggaa

SEQ ID NO: 1047987 - DNA, 21 bp, Homo sapiens
tttcaaagcaattgaaatgca

SEQ ID NO: 1047988 - DNA, 17 bp, Homo sapiens
tttcaaagccctgcctc

SEQ ID NO: 1047989 - DNA, 19 bp, Homo sapiens
tttcaaatagggtctaact

SEQ ID NO: 1047990 - DNA, 14 bp, Homo sapiens
tttcaaatccttat

SEQ ID NO: 1047991 - DNA, 11 bp, Homo sapiens
tttcaaatgca

SEQ ID NO: 1047992 - DNA, 14 bp, Homo sapiens
tttcaaatgcagaa

SEQ ID NO: 1047993 - DNA, 13 bp, Homo sapiens
tttcaaattatat

SEQ ID NO: 1047994 - DNA, 21 bp, Homo sapiens
tttcaaatttagaaactaatt

SEQ ID NO: 1047995 - DNA, 23 bp, Homo sapiens
tttcaacaagaatattgtatgtt

SEQ ID NO: 1047996 - DNA, 16 bp, Homo sapiens
tttcaacatgagtgta

SEQ ID NO: 1047997 - DNA, 20 bp, Homo sapiens
tttcaacgcagccctgcttt

SEQ ID NO: 1047998 - DNA, 15 bp, Homo sapiens
tttcaacggaaagtg

SEQ ID NO: 1047999 - DNA, 22 bp, Homo sapiens
tttcaacttggcttcctttctt

SEQ ID NO: 1048000 - DNA, 17 bp, Homo sapiens
tttcaagaaaatctttg

SEQ ID NO: 1048001 - DNA, 14 bp, Homo sapiens
tttcaagaacctgg

SEQ ID NO: 1048002 - DNA, 16 bp, Homo sapiens
tttcaagaacctggaa

SEQ ID NO: 1048003 - DNA, 13 bp, Homo sapiens
tttcaagaatatg

SEQ ID NO: 1048004 - DNA, 17 bp, Homo sapiens
tcaaaagctatttaaag

SEQ ID NO: 1048005 - DNA, 18 bp, Homo sapiens
tcaaaagctgggaaccag

SEQ ID NO: 1048006 - DNA, 16 bp, Homo sapiens
tcaaaagctgggcagg

SEQ ID NO: 1048007 - DNA, 11 bp, Homo sapiens
tcaaaaggaac

SEQ ID NO: 1048008 - DNA, 18 bp, Homo sapiens
tcaaaagggaagagtttt

SEQ ID NO: 1048009 - DNA, 20 bp, Homo sapiens
tcaaaagggccaaagaacca

SEQ ID NO: 1048010 - DNA, 13 bp, Homo sapiens
tcaaaaggtgcct

SEQ ID NO: 1048011 - DNA, 23 bp, Homo sapiens
tcaaaaggtgcctgtgaggcagg

SEQ ID NO: 1048012 - DNA, 15 bp, Homo sapiens
tcaaaagtctatttt

SEQ ID NO: 1048013 - DNA, 14 bp, Homo sapiens
tcaaaagttgaaat

SEQ ID NO: 1048014 - DNA, 16 bp, Homo sapiens
tcaaaagttgaaatta

SEQ ID NO: 1048015 - DNA, 13 bp, Homo sapiens
tcaaaagtttgtt

SEQ ID NO: 1048016 - DNA, 13 bp, Homo sapiens
tcaaaataaaaag

SEQ ID NO: 1048017 - DNA, 20 bp, Homo sapiens
tcaaaataaaaagcctcagt

SEQ ID NO: 1048018 - DNA, 21 bp, Homo sapiens
tcaaaataaaaagtgacacag

SEQ ID NO: 1048019 - DNA, 23 bp, Homo sapiens
tcaaaataaaaagtgacacagca

SEQ ID NO: 1048020 - DNA, 13 bp, Homo sapiens
tcaaaataattct

SEQ ID NO: 1048021 - DNA, 14 bp, Homo sapiens
tcaaaatagaaaag

SEQ ID NO: 1048022 - DNA, 19 bp, Homo sapiens
tcaaaatagaaaagttatt

SEQ ID NO: 1048023 - DNA, 14 bp, Homo sapiens
tcaaaatattgagc

SEQ ID NO: 1048024 - DNA, 15 bp, Homo sapiens
tcaaaatatttaaaa

SEQ ID NO: 1048025 - DNA, 18 bp, Homo sapiens
tcaaaatatttgtacata

SEQ ID NO: 1048026 - DNA, 19 bp, Homo sapiens
tcaaaatcagtttttcata

SEQ ID NO: 1048027 - DNA, 21 bp, Homo sapiens
tcaaaatcagtttttcatact

SEQ ID NO: 1048028 - DNA, 11 bp, Homo sapiens
tcaaaatgaca

SEQ ID NO: 1048029 - DNA, 20 bp, Homo sapiens
tcaaaatgctctaatgagca

SEQ ID NO: 1048030 - DNA, 14 bp, Homo sapiens
tcaaaatgtagctt

SEQ ID NO: 1048031 - DNA, 12 bp, Homo sapiens
tcaaaattaata

SEQ ID NO: 1048032 - DNA, 13 bp, Homo sapiens
tcaaaattaatag

SEQ ID NO: 1048033 - DNA, 15 bp, Homo sapiens
tcaaaattacatata

SEQ ID NO: 1048034 - DNA, 17 bp, Homo sapiens
tcaaaattctagctgta

SEQ ID NO: 1048035 - DNA, 21 bp, Homo sapiens
tcaaaatttaacagttacctg

SEQ ID NO: 1048036 - DNA, 23 bp, Homo sapiens
tcaaaatttgctgccaaatgcgt

SEQ ID NO: 1048037 - DNA, 19 bp, Homo sapiens
tcaaacaaactctctgaac

SEQ ID NO: 1048038 - DNA, 22 bp, Homo sapiens
tcaaacaacctgcccaaagatt

SEQ ID NO: 1048039 - DNA, 21 bp, Homo sapiens
tcaaacaccaacataaaaatg

SEQ ID NO: 1048040 - DNA, 20 bp, Homo sapiens
tcaaacagtaggttggcagt

SEQ ID NO: 1048041 - DNA, 20 bp, Homo sapiens
tcaaacattcgtgagctggg

SEQ ID NO: 1048042 - DNA, 14 bp, Homo sapiens
tcaaaccaaagctg

SEQ ID NO: 1048043 - DNA, 16 bp, Homo sapiens
tcaaaccaatttcttc

SEQ ID NO: 1048044 - DNA, 18 bp, Homo sapiens
tcaaaccaatttcttcct

SEQ ID NO: 1048045 - DNA, 17 bp, Homo sapiens
tcaaaccacttgcctgg

SEQ ID NO: 1048046 - DNA, 20 bp, Homo sapiens
tcaaaccacttgcctggggc

SEQ ID NO: 1048047 - DNA, 19 bp, Homo sapiens
tcaaaccccgaccacctgc

SEQ ID NO: 1048048 - DNA, 23 bp, Homo sapiens
tcaaaccccgaccacctgcccaa

SEQ ID NO: 1048049 - DNA, 17 bp, Homo sapiens
tcaaaccctagccttgc

SEQ ID NO: 1048050 - DNA, 18 bp, Homo sapiens
tcaaaccctagccttgct

SEQ ID NO: 1048051 - DNA, 20 bp, Homo sapiens
tcaaaccctagccttgcttg

SEQ ID NO: 1048052 - DNA, 21 bp, Homo sapiens
tcaaaccgtggtaccccccct

SEQ ID NO: 1048053 - DNA, 20 bp, Homo sapiens
tcaaacctttctggcctgtt

SEQ ID NO: 1048054 - DNA, 19 bp, Homo sapiens
tcaaacgggggccttctgg

SEQ ID NO: 1048055 - DNA, 16 bp, Homo sapiens
tcaaactaaattcaaa

SEQ ID NO: 1048056 - DNA, 17 bp, Homo sapiens
tcaaactactgtacatt

SEQ ID NO: 1048057 - DNA, 19 bp, Homo sapiens
tcaaactactgtacatttt

SEQ ID NO: 1048058 - DNA, 18 bp, Homo sapiens
tcaaactcaatgctttat

SEQ ID NO: 1048059 - DNA, 15 bp, Homo sapiens
tcaaactcctgacct

SEQ ID NO: 1048060 - DNA, 14 bp, Homo sapiens
tcaaactcttaaaa

SEQ ID NO: 1048061 - DNA, 15 bp, Homo sapiens
tcaaactgaggaatt

SEQ ID NO: 1048062 - DNA, 22 bp, Homo sapiens
tcaaactgagtaaattggaaac

SEQ ID NO: 1048063 - DNA, 23 bp, Homo sapiens
tcaaactgagtaaattggaaaca

SEQ ID NO: 1048064 - DNA, 15 bp, Homo sapiens
tcaaactgcacatct

SEQ ID NO: 1048065 - DNA, 14 bp, Homo sapiens
tcaaactggggcct

SEQ ID NO: 1048066 - DNA, 19 bp, Homo sapiens
tcaaactggggcctccaga

SEQ ID NO: 1048067 - DNA, 22 bp, Homo sapiens
tcaaactggggcctccagaact

SEQ ID NO: 1048068 - DNA, 23 bp, Homo sapiens
tcaaactggggcctccagaactc

SEQ ID NO: 1048069 - DNA, 19 bp, Homo sapiens
tcaaactggggcctccctg

SEQ ID NO: 1048070 - DNA, 15 bp, Homo sapiens
tcaaactttactatg

SEQ ID NO: 1048071 - DNA, 16 bp, Homo sapiens
tcaaactttactatgg

SEQ ID NO: 1048072 - DNA, 14 bp, Homo sapiens
tcaaactttcactt

SEQ ID NO: 1048073 - DNA, 16 bp, Homo sapiens
tcaaactttcactttg

SEQ ID NO: 1048074 - DNA, 14 bp, Homo sapiens
tcaaactttttcca

SEQ ID NO: 1048075 - DNA, 15 bp, Homo sapiens
tcaaactttttccag

SEQ ID NO: 1048076 - DNA, 17 bp, Homo sapiens
tcaaactttttccagca

SEQ ID NO: 1048077 - DNA, 22 bp, Homo sapiens
tttcactgataccacgaggaaa

SEQ ID NO: 1048078 - DNA, 10 bp, Homo sapiens
tttcactgct

SEQ ID NO: 1048079 - DNA, 18 bp, Homo sapiens
tttcactgctggctgcct

SEQ ID NO: 1048080 - DNA, 22 bp, Homo sapiens
tttcactgctggctgccttaga

SEQ ID NO: 1048081 - DNA, 13 bp, Homo sapiens
tttcactgtactg

SEQ ID NO: 1048082 - DNA, 17 bp, Homo sapiens
tttcactgtactgcatg

SEQ ID NO: 1048083 - DNA, 21 bp, Homo sapiens
tttcactgtctttaattctgt

SEQ ID NO: 1048084 - DNA, 16 bp, Homo sapiens
tttcacttaatgtttc

SEQ ID NO: 1048085 - DNA, 22 bp, Homo sapiens
tttcacttcaagggagaatata

SEQ ID NO: 1048086 - DNA, 13 bp, Homo sapiens
tttcacttcttcc

SEQ ID NO: 1048087 - DNA, 14 bp, Homo sapiens
tttcacttcttcct

SEQ ID NO: 1048088 - DNA, 15 bp, Homo sapiens
tttcacttcttccta

SEQ ID NO: 1048089 - DNA, 15 bp, Homo sapiens
tttcacttgaaagat

SEQ ID NO: 1048090 - DNA, 23 bp, Homo sapiens
tttcacttgaaagattttattgt

SEQ ID NO: 1048091 - DNA, 12 bp, Homo sapiens
tttcacttgtat

SEQ ID NO: 1048092 - DNA, 14 bp, Homo sapiens
tttcacttgtattg

SEQ ID NO: 1048093 - DNA, 17 bp, Homo sapiens
tttcacttgtattgact

SEQ ID NO: 1048094 - DNA, 19 bp, Homo sapiens
tttcacttgtcttgctctt

SEQ ID NO: 1048095 - DNA, 20 bp, Homo sapiens
tttcacttgtcttgctctta

SEQ ID NO: 1048096 - DNA, 17 bp, Homo sapiens
tttcactttagatgctg

SEQ ID NO: 1048097 - DNA, 17 bp, Homo sapiens
tttcactttctgtctag

SEQ ID NO: 1048098 - DNA, 13 bp, Homo sapiens
tttcactttgaaa

SEQ ID NO: 1048099 - DNA, 17 bp, Homo sapiens
tttcacttttgttctgc

SEQ ID NO: 1048100 - DNA, 15 bp, Homo sapiens
tttcagaaacagggc

SEQ ID NO: 1048101 - DNA, 16 bp, Homo sapiens
tttcagaaacagggca

SEQ ID NO: 1048102 - DNA, 18 bp, Homo sapiens
tttcagaaacagggcagc

SEQ ID NO: 1048103 - DNA, 16 bp, Homo sapiens
tttcagaaatatgtgg

SEQ ID NO: 1048104 - DNA, 11 bp, Homo sapiens
tttcagaaatg

SEQ ID NO: 1048105 - DNA, 12 bp, Homo sapiens
tttcagaaatgt

SEQ ID NO: 1048106 - DNA, 16 bp, Homo sapiens
tttcagaagaaataaa

SEQ ID NO: 1048107 - DNA, 21 bp, Homo sapiens
tttcagaagaaataaatatac

SEQ ID NO: 1048108 - DNA, 16 bp, Homo sapiens
tttcagaagcaagcca

SEQ ID NO: 1048109 - DNA, 15 bp, Homo sapiens
tttcagaaggaccaa

SEQ ID NO: 1048110 - DNA, 19 bp, Homo sapiens
tttcagaaggtatcagtta

SEQ ID NO: 1048111 - DNA, 21 bp, Homo sapiens
tttcagaagtgagctttgctg

SEQ ID NO: 1048112 - DNA, 14 bp, Homo sapiens
tttcagaagtgatt

SEQ ID NO: 1048113 - DNA, 16 bp, Homo sapiens
tttcagaagttagttt

SEQ ID NO: 1048114 - DNA, 20 bp, Homo sapiens
tttcagacagggtctgaagg

SEQ ID NO: 1048115 - DNA, 22 bp, Homo sapiens
tttcagacatatccaaagggaa

SEQ ID NO: 1048116 - DNA, 15 bp, Homo sapiens
tttcagacttgtcaa

SEQ ID NO: 1048117 - DNA, 16 bp, Homo sapiens
tttcagagaaaggact

SEQ ID NO: 1048118 - DNA, 22 bp, Homo sapiens
tttcagagccagcctggctctg

SEQ ID NO: 1048119 - DNA, 21 bp, Homo sapiens
tttcagagggtaagtaaacag

SEQ ID NO: 1048120 - DNA, 22 bp, Homo sapiens
tttcagagtgactacacacagt

SEQ ID NO: 1048121 - DNA, 16 bp, Homo sapiens
tttcagatataaaaga

SEQ ID NO: 1048122 - DNA, 16 bp, Homo sapiens
tttcagatatatatca

SEQ ID NO: 1048123 - DNA, 15 bp, Homo sapiens
tttcagatatcaaaa

SEQ ID NO: 1048124 - DNA, 22 bp, Homo sapiens
tttcagatatcaaaattctagc

SEQ ID NO: 1048125 - DNA, 23 bp, Homo sapiens
tttcagatatcttggacaaatca

SEQ ID NO: 1048126 - DNA, 13 bp, Homo sapiens
tttcagatgaggt

SEQ ID NO: 1048127 - DNA, 20 bp, Homo sapiens
tttcagatgtcttctgcctg

SEQ ID NO: 1048128 - DNA, 22 bp, Homo sapiens
tttcagatgtcttctgcctgtt

SEQ ID NO: 1048129 - DNA, 16 bp, Homo sapiens
tttcagattgtggaat

SEQ ID NO: 1048130 - DNA, 18 bp, Homo sapiens
tttcagattttttaaaat

SEQ ID NO: 1048131 - DNA, 17 bp, Homo sapiens
tcaaagtggtaaatact

SEQ ID NO: 1048132 - DNA, 18 bp, Homo sapiens
tcaaagtggtaaatactg

SEQ ID NO: 1048133 - DNA, 22 bp, Homo sapiens
tcaaagtggtaaatactgtgaa

SEQ ID NO: 1048134 - DNA, 20 bp, Homo sapiens
tcaaagtgtatatttattca

SEQ ID NO: 1048135 - DNA, 19 bp, Homo sapiens
tcaaagtgttgtgttcctg

SEQ ID NO: 1048136 - DNA, 19 bp, Homo sapiens
tcaaagtgttttctctgaa

SEQ ID NO: 1048137 - DNA, 22 bp, Homo sapiens
tcaaagttaattcacctatgtt

SEQ ID NO: 1048138 - DNA, 16 bp, Homo sapiens
tcaaagttgtagttct

SEQ ID NO: 1048139 - DNA, 13 bp, Homo sapiens
tcaaagtttaata

SEQ ID NO: 1048140 - DNA, 14 bp, Homo sapiens
tcaaagtttaataa

SEQ ID NO: 1048141 - DNA, 14 bp, Homo sapiens
tcaaataaaaataa

SEQ ID NO: 1048142 - DNA, 19 bp, Homo sapiens
tcaaataaaaattctagat

SEQ ID NO: 1048143 - DNA, 20 bp, Homo sapiens
tcaaataaaaattctagatt

SEQ ID NO: 1048144 - DNA, 15 bp, Homo sapiens
tcaaataaaatatca

SEQ ID NO: 1048145 - DNA, 17 bp, Homo sapiens
tcaaataaaatatcata

SEQ ID NO: 1048146 - DNA, 19 bp, Homo sapiens
tcaaataaaatatcataaa

SEQ ID NO: 1048147 - DNA, 23 bp, Homo sapiens
tcaaataaaatatcataaagcat

SEQ ID NO: 1048148 - DNA, 12 bp, Homo sapiens
tcaaataaagaa

SEQ ID NO: 1048149 - DNA, 14 bp, Homo sapiens
tcaaataaatttct

SEQ ID NO: 1048150 - DNA, 16 bp, Homo sapiens
tcaaataaatttctgg

SEQ ID NO: 1048151 - DNA, 18 bp, Homo sapiens
tcaaataagtatttataa

SEQ ID NO: 1048152 - DNA, 13 bp, Homo sapiens
tcaaataagtctt

SEQ ID NO: 1048153 - DNA, 22 bp, Homo sapiens
tcaaataatccattccaaaata

SEQ ID NO: 1048154 - DNA, 21 bp, Homo sapiens
tcaaatacatttaaaacatta

SEQ ID NO: 1048155 - DNA, 15 bp, Homo sapiens
tcaaatactttaaag

SEQ ID NO: 1048156 - DNA, 19 bp, Homo sapiens
tcaaatagatttttgattc

SEQ ID NO: 1048157 - DNA, 20 bp, Homo sapiens
tcaaataggctattaaaaaa

SEQ ID NO: 1048158 - DNA, 20 bp, Homo sapiens
tcaaatatcatttactcttc

SEQ ID NO: 1048159 - DNA, 18 bp, Homo sapiens
tcaaatatctctatttaa

SEQ ID NO: 1048160 - DNA, 16 bp, Homo sapiens
tcaaatcaggttttct

SEQ ID NO: 1048161 - DNA, 23 bp, Homo sapiens
tcaaatcagtcttccttgtggaa

SEQ ID NO: 1048162 - DNA, 23 bp, Homo sapiens
tcaaatcagtgatctatgtttgt

SEQ ID NO: 1048163 - DNA, 14 bp, Homo sapiens
tcaaatcattcctt

SEQ ID NO: 1048164 - DNA, 15 bp, Homo sapiens
tcaaatccatccaga

SEQ ID NO: 1048165 - DNA, 20 bp, Homo sapiens
tcaaatcccaaaccattact

SEQ ID NO: 1048166 - DNA, 16 bp, Homo sapiens
tcaaatccctctccaa

SEQ ID NO: 1048167 - DNA, 22 bp, Homo sapiens
tcaaatcgaatagggaagtaaa

SEQ ID NO: 1048168 - DNA, 13 bp, Homo sapiens
tcaaatctattca

SEQ ID NO: 1048169 - DNA, 14 bp, Homo sapiens
tcaaatctattcag

SEQ ID NO: 1048170 - DNA, 17 bp, Homo sapiens
tcaaatctattcagaca

SEQ ID NO: 1048171 - DNA, 12 bp, Homo sapiens
tcaaatctcagc

SEQ ID NO: 1048172 - DNA, 15 bp, Homo sapiens
tcaaatctcagcaaa

SEQ ID NO: 1048173 - DNA, 16 bp, Homo sapiens
tcaaatctccagtatt

SEQ ID NO: 1048174 - DNA, 16 bp, Homo sapiens
tcaaatctcctgctga

SEQ ID NO: 1048175 - DNA, 18 bp, Homo sapiens
tcaaatctgtgctctttc

SEQ ID NO: 1048176 - DNA, 15 bp, Homo sapiens
tcaaatcttacaaaa

SEQ ID NO: 1048177 - DNA, 16 bp, Homo sapiens
tcaaatcttacaaaat

SEQ ID NO: 1048178 - DNA, 15 bp, Homo sapiens
tcaaatgaaactctt

SEQ ID NO: 1048179 - DNA, 20 bp, Homo sapiens
tcaaatgaaatgtatgcatt

SEQ ID NO: 1048180 - DNA, 13 bp, Homo sapiens
tcaaatgaacttt

SEQ ID NO: 1048181 - DNA, 19 bp, Homo sapiens
tcaaatgaataatgccttt

SEQ ID NO: 1048182 - DNA, 23 bp, Homo sapiens
tcaaatgaatggaggaactttcc

SEQ ID NO: 1048183 - DNA, 22 bp, Homo sapiens
tcaaatgagtaacatttgctgt

SEQ ID NO: 1048184 - DNA, 17 bp, Homo sapiens
tcaaatgatgtgcaaaa

SEQ ID NO: 1048185 - DNA, 23 bp, Homo sapiens
tcaaatgcgcgtgtgcacgtgtg

SEQ ID NO: 1048186 - DNA, 19 bp, Homo sapiens
tcaaatgctcagaccagct

SEQ ID NO: 1048187 - DNA, 14 bp, Homo sapiens
tcaaatgggaaaaa

SEQ ID NO: 1048188 - DNA, 18 bp, Homo sapiens
tcaaatgggaaaaaaaca

SEQ ID NO: 1048189 - DNA, 18 bp, Homo sapiens
tcaaatgggagactcttt

SEQ ID NO: 1048190 - DNA, 20 bp, Homo sapiens
tcaaatggtaggcatttcct

SEQ ID NO: 1048191 - DNA, 16 bp, Homo sapiens
tcaaatggtgtcatgg

SEQ ID NO: 1048192 - DNA, 16 bp, Homo sapiens
tcaaatgtaaatttac

SEQ ID NO: 1048193 - DNA, 14 bp, Homo sapiens
tcaaatgtttcctt

SEQ ID NO: 1048194 - DNA, 20 bp, Homo sapiens
tcaaatgtttccttaaacat

SEQ ID NO: 1048195 - DNA, 20 bp, Homo sapiens
tcaaattaaaacagctgcat

SEQ ID NO: 1048196 - DNA, 22 bp, Homo sapiens
tcaaattaataatcttattagg

SEQ ID NO: 1048197 - DNA, 22 bp, Homo sapiens
tcaaattagaagacatttatac

SEQ ID NO: 1048198 - DNA, 17 bp, Homo sapiens
tcaaattatagaaacaa

SEQ ID NO: 1048199 - DNA, 18 bp, Homo sapiens
tttcatcctgtgtcccct

SEQ ID NO: 1048200 - DNA, 15 bp, Homo sapiens
tttcatccttcccca

SEQ ID NO: 1048201 - DNA, 23 bp, Homo sapiens
tttcatccttttttctcttctgt

SEQ ID NO: 1048202 - DNA, 16 bp, Homo sapiens
tttcatctatttctga

SEQ ID NO: 1048203 - DNA, 21 bp, Homo sapiens
tttcatctcagagtccactgt

SEQ ID NO: 1048204 - DNA, 21 bp, Homo sapiens
tttcatctcatttaagggaaa

SEQ ID NO: 1048205 - DNA, 22 bp, Homo sapiens
tttcatctcatttaagggaaaa

SEQ ID NO: 1048206 - DNA, 17 bp, Homo sapiens
tttcatctcctgagtat

SEQ ID NO: 1048207 - DNA, 18 bp, Homo sapiens
tttcatctctctacctcc

SEQ ID NO: 1048208 - DNA, 14 bp, Homo sapiens
tttcatctgggaaa

SEQ ID NO: 1048209 - DNA, 15 bp, Homo sapiens
tttcatctgggaaag

SEQ ID NO: 1048210 - DNA, 14 bp, Homo sapiens
tttcatcttaaact

SEQ ID NO: 1048211 - DNA, 12 bp, Homo sapiens
tttcatgaaaaa

SEQ ID NO: 1048212 - DNA, 15 bp, Homo sapiens
tttcatgaaaaagct

SEQ ID NO: 1048213 - DNA, 20 bp, Homo sapiens
tttcatgaaaaagctgcttc

SEQ ID NO: 1048214 - DNA, 17 bp, Homo sapiens
tttcatgaccagtaaag

SEQ ID NO: 1048215 - DNA, 24 bp, Homo sapiens
tttcatgaccagtaaaggctgctg

SEQ ID NO: 1048216 - DNA, 20 bp, Homo sapiens
tttcatgaggggaaagggag

SEQ ID NO: 1048217 - DNA, 21 bp, Homo sapiens
tttcatgattagcaagttaca

SEQ ID NO: 1048218 - DNA, 18 bp, Homo sapiens
tttcatggacactttgaa

SEQ ID NO: 1048219 - DNA, 15 bp, Homo sapiens
tttcatggaggggaa

SEQ ID NO: 1048220 - DNA, 18 bp, Homo sapiens
tttcatggcccttcaaat

SEQ ID NO: 1048221 - DNA, 14 bp, Homo sapiens
tttcatgtaaataa

SEQ ID NO: 1048222 - DNA, 18 bp, Homo sapiens
tttcatgtcccagaactt

SEQ ID NO: 1048223 - DNA, 17 bp, Homo sapiens
tttcatgtggctgtaga

SEQ ID NO: 1048224 - DNA, 14 bp, Homo sapiens
tttcatgttggttt

SEQ ID NO: 1048225 - DNA, 21 bp, Homo sapiens
tttcattaatacagggcattt

SEQ ID NO: 1048226 - DNA, 15 bp, Homo sapiens
tttcattatcatcaa

SEQ ID NO: 1048227 - DNA, 12 bp, Homo sapiens
tttcattatgca

SEQ ID NO: 1048228 - DNA, 17 bp, Homo sapiens
tttcattatgctttgaa

SEQ ID NO: 1048229 - DNA, 21 bp, Homo sapiens
tttcattatgctttgaacttt

SEQ ID NO: 1048230 - DNA, 16 bp, Homo sapiens
tttcattcaaatcagt

SEQ ID NO: 1048231 - DNA, 18 bp, Homo sapiens
tttcattcagcctttaga

SEQ ID NO: 1048232 - DNA, 15 bp, Homo sapiens
tttcattcatcccat

SEQ ID NO: 1048233 - DNA, 16 bp, Homo sapiens
tttcattccattgcct

SEQ ID NO: 1048234 - DNA, 14 bp, Homo sapiens
tttcattccctgta

SEQ ID NO: 1048235 - DNA, 21 bp, Homo sapiens
tttcattccttcagatttggc

SEQ ID NO: 1048236 - DNA, 22 bp, Homo sapiens
tttcattgactatcaaactgaa

SEQ ID NO: 1048237 - DNA, 23 bp, Homo sapiens
tttcattgcctgtgtatggaaaa

SEQ ID NO: 1048238 - DNA, 22 bp, Homo sapiens
tttcattggtacacgtgtaaca

SEQ ID NO: 1048239 - DNA, 13 bp, Homo sapiens
tttcattgtacaa

SEQ ID NO: 1048240 - DNA, 19 bp, Homo sapiens
tttcattgtacaagtatta

SEQ ID NO: 1048241 - DNA, 23 bp, Homo sapiens
tttcattgtatgatgtgttgtga

SEQ ID NO: 1048242 - DNA, 19 bp, Homo sapiens
tttcatttaagggaaagaa

SEQ ID NO: 1048243 - DNA, 23 bp, Homo sapiens
tttcatttaagggaaagaaaatg

SEQ ID NO: 1048244 - DNA, 21 bp, Homo sapiens
tttcatttactctaaaaactg

SEQ ID NO: 1048245 - DNA, 20 bp, Homo sapiens
tttcatttatctataattta

SEQ ID NO: 1048246 - DNA, 14 bp, Homo sapiens
tttcatttgtaaaa

SEQ ID NO: 1048247 - DNA, 14 bp, Homo sapiens
tttcatttgtacaa

SEQ ID NO: 1048248 - DNA, 17 bp, Homo sapiens
tttcatttgtacaaggt

SEQ ID NO: 1048249 - DNA, 16 bp, Homo sapiens
tttcattttaaaaagt

SEQ ID NO: 1048250 - DNA, 14 bp, Homo sapiens
tttcattttgcaga

SEQ ID NO: 1048251 - DNA, 22 bp, Homo sapiens
tttcattttgcagaaggaaatg

SEQ ID NO: 1048252 - DNA, 15 bp, Homo sapiens
tttccaaaacaaaaa

SEQ ID NO: 1048253 - DNA, 20 bp, Homo sapiens
tttccaaaacaatttctttt

SEQ ID NO: 1048254 - DNA, 19 bp, Homo sapiens
tttccaaaataatctatat

SEQ ID NO: 1048255 - DNA, 22 bp, Homo sapiens
tttccaaaataatctatattaa

SEQ ID NO: 1048256 - DNA, 18 bp, Homo sapiens
tttccaaacttgaaaaca

SEQ ID NO: 1048257 - DNA, 15 bp, Homo sapiens
tcaacgtattgtttc

SEQ ID NO: 1048258 - DNA, 14 bp, Homo sapiens
tcaactcacagctt

SEQ ID NO: 1048259 - DNA, 16 bp, Homo sapiens
tcaactcacagcttct

SEQ ID NO: 1048260 - DNA, 17 bp, Homo sapiens
tcaactcacagcttctc

SEQ ID NO: 1048261 - DNA, 15 bp, Homo sapiens
tcaactccctgcccc

SEQ ID NO: 1048262 - DNA, 18 bp, Homo sapiens
tcaactcgggggcgcctg

SEQ ID NO: 1048263 - DNA, 16 bp, Homo sapiens
tcaactctacccctgc

SEQ ID NO: 1048264 - DNA, 12 bp, Homo sapiens
tcaactgaaggg

SEQ ID NO: 1048265 - DNA, 18 bp, Homo sapiens
tcaactgaccagcctcca

SEQ ID NO: 1048266 - DNA, 22 bp, Homo sapiens
tcaactgcccctgacttaactt

SEQ ID NO: 1048267 - DNA, 14 bp, Homo sapiens
tcaactgcctactc

SEQ ID NO: 1048268 - DNA, 18 bp, Homo sapiens
tcaactgcctactccaaa

SEQ ID NO: 1048269 - DNA, 18 bp, Homo sapiens
tcaactggagcaagaagg

SEQ ID NO: 1048270 - DNA, 21 bp, Homo sapiens
tcaactggagtctatgcttaa

SEQ ID NO: 1048271 - DNA, 22 bp, Homo sapiens
tcaactgtattgggccttttgg

SEQ ID NO: 1048272 - DNA, 23 bp, Homo sapiens
tcaactgtcttcctcaaaataaa

SEQ ID NO: 1048273 - DNA, 15 bp, Homo sapiens
tcaacttaaaagtca

SEQ ID NO: 1048274 - DNA, 12 bp, Homo sapiens
tcaacttaacat

SEQ ID NO: 1048275 - DNA, 15 bp, Homo sapiens
tcaacttaataagat

SEQ ID NO: 1048276 - DNA, 13 bp, Homo sapiens
tcaactttactgt

SEQ ID NO: 1048277 - DNA, 14 bp, Homo sapiens
tcaactttactgta

SEQ ID NO: 1048278 - DNA, 20 bp, Homo sapiens
tcaactttactgtaatataa

SEQ ID NO: 1048279 - DNA, 12 bp, Homo sapiens
tcaactttcaga

SEQ ID NO: 1048280 - DNA, 12 bp, Homo sapiens
tcaagaaacagc

SEQ ID NO: 1048281 - DNA, 13 bp, Homo sapiens
tcaagaaacagcc

SEQ ID NO: 1048282 - DNA, 18 bp, Homo sapiens
tcaagaaacagccagcaa

SEQ ID NO: 1048283 - DNA, 20 bp, Homo sapiens
tcaagaaacagccagcaaga

SEQ ID NO: 1048284 - DNA, 22 bp, Homo sapiens
tcaagaaactgaggaattttct

SEQ ID NO: 1048285 - DNA, 21 bp, Homo sapiens
tcaagaaagcttcaaactgca

SEQ ID NO: 1048286 - DNA, 13 bp, Homo sapiens
tcaagaaaggaaa

SEQ ID NO: 1048287 - DNA, 16 bp, Homo sapiens
tcaagaaaggagggga

SEQ ID NO: 1048288 - DNA, 20 bp, Homo sapiens
tcaagaaataaaaggaagcc

SEQ ID NO: 1048289 - DNA, 14 bp, Homo sapiens
tcaagaacaaacac

SEQ ID NO: 1048290 - DNA, 14 bp, Homo sapiens
tcaagaagaaaaag

SEQ ID NO: 1048291 - DNA, 11 bp, Homo sapiens
tcaagaagaat

SEQ ID NO: 1048292 - DNA, 15 bp, Homo sapiens
tcaagaagaatgaac

SEQ ID NO: 1048293 - DNA, 12 bp, Homo sapiens
tcaagaagacat

SEQ ID NO: 1048294 - DNA, 14 bp, Homo sapiens
tcaagaagggctgc

SEQ ID NO: 1048295 - DNA, 19 bp, Homo sapiens
tcaagaatagcattgtaaa

SEQ ID NO: 1048296 - DNA, 18 bp, Homo sapiens
tcaagaatctagaagatg

SEQ ID NO: 1048297 - DNA, 14 bp, Homo sapiens
tcaagacatttgct

SEQ ID NO: 1048298 - DNA, 13 bp, Homo sapiens
tcaagaccagcct

SEQ ID NO: 1048299 - DNA, 11 bp, Homo sapiens
tcaagaccccc

SEQ ID NO: 1048300 - DNA, 12 bp, Homo sapiens
tcaagacctgag

SEQ ID NO: 1048301 - DNA, 16 bp, Homo sapiens
tcaagaccttctcccc

SEQ ID NO: 1048302 - DNA, 15 bp, Homo sapiens
tcaagactttagctt

SEQ ID NO: 1048303 - DNA, 19 bp, Homo sapiens
tcaagactttagcttttcc

SEQ ID NO: 1048304 - DNA, 13 bp, Homo sapiens
tcaagactttgat

SEQ ID NO: 1048305 - DNA, 14 bp, Homo sapiens
tcaagactttgatc

SEQ ID NO: 1048306 - DNA, 15 bp, Homo sapiens
tcaagactttgatcc

SEQ ID NO: 1048307 - DNA, 16 bp, Homo sapiens
tcaagactttgatcct

SEQ ID NO: 1048308 - DNA, 17 bp, Homo sapiens
tcaagactttgatcctt

SEQ ID NO: 1048309 - DNA, 19 bp, Homo sapiens
tcaagactttgatccttgg

SEQ ID NO: 1048310 - DNA, 11 bp, Homo sapiens
tcaagagaaac

SEQ ID NO: 1048311 - DNA, 12 bp, Homo sapiens
tcaagagaaact

SEQ ID NO: 1048312 - DNA, 13 bp, Homo sapiens
tcaagagaaactt

SEQ ID NO: 1048313 - DNA, 15 bp, Homo sapiens
tcaagagaaacttca

SEQ ID NO: 1048314 - DNA, 13 bp, Homo sapiens
tcaagagaatcaa

SEQ ID NO: 1048315 - DNA, 14 bp, Homo sapiens
tcaagagaatcaac

SEQ ID NO: 1048316 - DNA, 15 bp, Homo sapiens
tcaagagaatcaaca

SEQ ID NO: 1048317 - DNA, 22 bp, Homo sapiens
tcaagagagaggctgagaaatg

SEQ ID NO: 1048318 - DNA, 17 bp, Homo sapiens
tcaagagcatgcacatg

SEQ ID NO: 1048319 - DNA, 22 bp, Homo sapiens
tcaagagctagaaaaataaaat

SEQ ID NO: 1048320 - DNA, 23 bp, Homo sapiens
tcaagaggaaaggcgcccccgcc

SEQ ID NO: 1048321 - DNA, 21 bp, Homo sapiens
tcaagagggcactggtggccc

SEQ ID NO: 1048322 - DNA, 13 bp, Homo sapiens
tttcccagtattt

SEQ ID NO: 1048323 - DNA, 14 bp, Homo sapiens
tttcccataatttt

SEQ ID NO: 1048324 - DNA, 13 bp, Homo sapiens
tttcccatctgca

SEQ ID NO: 1048325 - DNA, 22 bp, Homo sapiens
tttcccatctgcaccccttctc

SEQ ID NO: 1048326 - DNA, 17 bp, Homo sapiens
tttcccatgactcttgg

SEQ ID NO: 1048327 - DNA, 22 bp, Homo sapiens
tttcccatttgtgccagaggaa

SEQ ID NO: 1048328 - DNA, 21 bp, Homo sapiens
tttccccacattctatagcca

SEQ ID NO: 1048329 - DNA, 16 bp, Homo sapiens
tttccccatctctgtc

SEQ ID NO: 1048330 - DNA, 17 bp, Homo sapiens
tttccccatctctgtct

SEQ ID NO: 1048331 - DNA, 12 bp, Homo sapiens
tttccccctcct

SEQ ID NO: 1048332 - DNA, 20 bp, Homo sapiens
tttccccgggggaggaaggg

SEQ ID NO: 1048333 - DNA, 16 bp, Homo sapiens
tttcccctgctcccct

SEQ ID NO: 1048334 - DNA, 13 bp, Homo sapiens
tttcccctggcct

SEQ ID NO: 1048335 - DNA, 14 bp, Homo sapiens
tttcccctgtcagt

SEQ ID NO: 1048336 - DNA, 23 bp, Homo sapiens
tttcccctgtcagtttcccctct

SEQ ID NO: 1048337 - DNA, 13 bp, Homo sapiens
tttcccctgttaa

SEQ ID NO: 1048338 - DNA, 14 bp, Homo sapiens
tttccccttcctca

SEQ ID NO: 1048339 - DNA, 13 bp, Homo sapiens
tttcccctttcct

SEQ ID NO: 1048340 - DNA, 14 bp, Homo sapiens
tttcccggagccat

SEQ ID NO: 1048341 - DNA, 14 bp, Homo sapiens
tttcccgggctgtc

SEQ ID NO: 1048342 - DNA, 15 bp, Homo sapiens
tttccctactcccca

SEQ ID NO: 1048343 - DNA, 23 bp, Homo sapiens
tttccctagaaagccatattcca

SEQ ID NO: 1048344 - DNA, 15 bp, Homo sapiens
tttccctatccacag

SEQ ID NO: 1048345 - DNA, 15 bp, Homo sapiens
tttccctcaccccct

SEQ ID NO: 1048346 - DNA, 13 bp, Homo sapiens
tttccctccccag

SEQ ID NO: 1048347 - DNA, 18 bp, Homo sapiens
tttccctccccagaatca

SEQ ID NO: 1048348 - DNA, 18 bp, Homo sapiens
tttccctcgtccgtctgt

SEQ ID NO: 1048349 - DNA, 12 bp, Homo sapiens
tttccctctttt

SEQ ID NO: 1048350 - DNA, 13 bp, Homo sapiens
tttccctgaggaa

SEQ ID NO: 1048351 - DNA, 16 bp, Homo sapiens
tttccctgaggaatga

SEQ ID NO: 1048352 - DNA, 14 bp, Homo sapiens
tttccctgcccctg

SEQ ID NO: 1048353 - DNA, 17 bp, Homo sapiens
tttccctgcccctgtcc

SEQ ID NO: 1048354 - DNA, 16 bp, Homo sapiens
tttccctgcctctcat

SEQ ID NO: 1048355 - DNA, 13 bp, Homo sapiens
tttccctggacag

SEQ ID NO: 1048356 - DNA, 13 bp, Homo sapiens
tttccctgtgtgg

SEQ ID NO: 1048357 - DNA, 14 bp, Homo sapiens
tttccctgtgtgga

SEQ ID NO: 1048358 - DNA, 18 bp, Homo sapiens
tttcccttaacttttcct

SEQ ID NO: 1048359 - DNA, 15 bp, Homo sapiens
tttcccttccaaaga

SEQ ID NO: 1048360 - DNA, 12 bp, Homo sapiens
tttcccttcctc

SEQ ID NO: 1048361 - DNA, 13 bp, Homo sapiens
tttcccttcctct

SEQ ID NO: 1048362 - DNA, 15 bp, Homo sapiens
tttcccttcctcttc

SEQ ID NO: 1048363 - DNA, 17 bp, Homo sapiens
tttcccttgcttcccct

SEQ ID NO: 1048364 - DNA, 16 bp, Homo sapiens
tttccctttttaaaaa

SEQ ID NO: 1048365 - DNA, 22 bp, Homo sapiens
tttccgctgtcgccccaggccc

SEQ ID NO: 1048366 - DNA, 16 bp, Homo sapiens
tttccgtttgcttttg

SEQ ID NO: 1048367 - DNA, 23 bp, Homo sapiens
tttccgtttttttttttttattg

SEQ ID NO: 1048368 - DNA, 13 bp, Homo sapiens
tttcctaaacata

SEQ ID NO: 1048369 - DNA, 18 bp, Homo sapiens
tttcctaaacataattgt

SEQ ID NO: 1048370 - DNA, 23 bp, Homo sapiens
tttcctaaacataattgtggatt

SEQ ID NO: 1048371 - DNA, 14 bp, Homo sapiens
tttcctaaagccaa

SEQ ID NO: 1048372 - DNA, 18 bp, Homo sapiens
tttcctaagtttttttca

SEQ ID NO: 1048373 - DNA, 23 bp, Homo sapiens
tttcctaataaagttctgtactc

SEQ ID NO: 1048374 - DNA, 21 bp, Homo sapiens
tttcctacaactaaaaataaa

SEQ ID NO: 1048375 - DNA, 16 bp, Homo sapiens
tttcctactgtcctgg

SEQ ID NO: 1048376 - DNA, 14 bp, Homo sapiens
tttcctagaggttc

SEQ ID NO: 1048377 - DNA, 23 bp, Homo sapiens
tttcctagccctctcacatttat

SEQ ID NO: 1048378 - DNA, 23 bp, Homo sapiens
tttcctaggcccaggcctgggtt

SEQ ID NO: 1048379 - DNA, 17 bp, Homo sapiens
tttcctatcatgttaac

SEQ ID NO: 1048380 - DNA, 15 bp, Homo sapiens
tttcctatgggaaca

SEQ ID NO: 1048381 - DNA, 16 bp, Homo sapiens
tttcctattctgttgc

SEQ ID NO: 1048382 - DNA, 18 bp, Homo sapiens
tttcctattctgttgcca

SEQ ID NO: 1048383 - DNA, 16 bp, Homo sapiens
tttcctatttcagtgt

SEQ ID NO: 1048384 - DNA, 13 bp, Homo sapiens
tttcctcaagcaa

SEQ ID NO: 1048385 - DNA, 19 bp, Homo sapiens
tttcctcatcctttccctc

SEQ ID NO: 1048386 - DNA, 20 bp, Homo sapiens
tttcctcatcctttccctct

SEQ ID NO: 1048387 - DNA, 14 bp, Homo sapiens
tcaaggccctcgga

SEQ ID NO: 1048388 - DNA, 16 bp, Homo sapiens
tcaaggccctcggagc

SEQ ID NO: 1048389 - DNA, 23 bp, Homo sapiens
tcaaggccgagggccaggcagaa

SEQ ID NO: 1048390 - DNA, 12 bp, Homo sapiens
tcaaggcctccc

SEQ ID NO: 1048391 - DNA, 21 bp, Homo sapiens
tcaaggccttcagtttatttc

SEQ ID NO: 1048392 - DNA, 17 bp, Homo sapiens
tcaaggctggggcatgg

SEQ ID NO: 1048393 - DNA, 14 bp, Homo sapiens
tcaaggcttccact

SEQ ID NO: 1048394 - DNA, 17 bp, Homo sapiens
tcaagggagaatataga

SEQ ID NO: 1048395 - DNA, 17 bp, Homo sapiens
tcaagggcttactattt

SEQ ID NO: 1048396 - DNA, 18 bp, Homo sapiens
tcaagggcttactatttc

SEQ ID NO: 1048397 - DNA, 15 bp, Homo sapiens
tcaaggggcagggag

SEQ ID NO: 1048398 - DNA, 14 bp, Homo sapiens
tcaaggggctggaa

SEQ ID NO: 1048399 - DNA, 15 bp, Homo sapiens
tcaagggtccagaag

SEQ ID NO: 1048400 - DNA, 16 bp, Homo sapiens
tcaagggtccagaagt

SEQ ID NO: 1048401 - DNA, 14 bp, Homo sapiens
tcaaggtaagctca

SEQ ID NO: 1048402 - DNA, 18 bp, Homo sapiens
tcaaggtcatcaaacatt

SEQ ID NO: 1048403 - DNA, 14 bp, Homo sapiens
tcaaggtccattat

SEQ ID NO: 1048404 - DNA, 20 bp, Homo sapiens
tcaaggtggccaaattattt

SEQ ID NO: 1048405 - DNA, 16 bp, Homo sapiens
tcaaggtgtggaaggg

SEQ ID NO: 1048406 - DNA, 15 bp, Homo sapiens
tcaagtaacacttta

SEQ ID NO: 1048407 - DNA, 17 bp, Homo sapiens
tcaagtaataaaaagag

SEQ ID NO: 1048408 - DNA, 15 bp, Homo sapiens
tcaagtaatacaaac

SEQ ID NO: 1048409 - DNA, 19 bp, Homo sapiens
tcaagtacccattctgttt

SEQ ID NO: 1048410 - DNA, 21 bp, Homo sapiens
tcaagtacctatattgattta

SEQ ID NO: 1048411 - DNA, 23 bp, Homo sapiens
tcaagtactgttttgaagctggg

SEQ ID NO: 1048412 - DNA, 15 bp, Homo sapiens
tcaagtattatacct

SEQ ID NO: 1048413 - DNA, 14 bp, Homo sapiens
tcaagtccatctga

SEQ ID NO: 1048414 - DNA, 17 bp, Homo sapiens
tcaagtccatctgacaa

SEQ ID NO: 1048415 - DNA, 19 bp, Homo sapiens
tcaagtctctgctggccca

SEQ ID NO: 1048416 - DNA, 12 bp, Homo sapiens
tcaagtcttccc

SEQ ID NO: 1048417 - DNA, 15 bp, Homo sapiens
tcaagtgaaaaagga

SEQ ID NO: 1048418 - DNA, 18 bp, Homo sapiens
tcaagtggggctcgccat

SEQ ID NO: 1048419 - DNA, 20 bp, Homo sapiens
tcaagtgtagaagaaaatat

SEQ ID NO: 1048420 - DNA, 15 bp, Homo sapiens
tcaagtgtcatatgt

SEQ ID NO: 1048421 - DNA, 21 bp, Homo sapiens
tcaagtgttaaattatttttt

SEQ ID NO: 1048422 - DNA, 14 bp, Homo sapiens
tcaagttaaagtga

SEQ ID NO: 1048423 - DNA, 15 bp, Homo sapiens
tcaagttagctcagg

SEQ ID NO: 1048424 - DNA, 20 bp, Homo sapiens
tcaagttattcaaatttgta

SEQ ID NO: 1048425 - DNA, 23 bp, Homo sapiens
tcaagttattcaaatttgtacag

SEQ ID NO: 1048426 - DNA, 16 bp, Homo sapiens
tcaagttcttggacca

SEQ ID NO: 1048427 - DNA, 15 bp, Homo sapiens
tcaagttgagatttt

SEQ ID NO: 1048428 - DNA, 21 bp, Homo sapiens
tcaagttgattagaaagacca

SEQ ID NO: 1048429 - DNA, 16 bp, Homo sapiens
tcaagttgtaaataat

SEQ ID NO: 1048430 - DNA, 21 bp, Homo sapiens
tcaagttgtaacttatattga

SEQ ID NO: 1048431 - DNA, 17 bp, Homo sapiens
tcaagttgtgcttgttt

SEQ ID NO: 1048432 - DNA, 20 bp, Homo sapiens
tcaagttgttgactgtgatt

SEQ ID NO: 1048433 - DNA, 23 bp, Homo sapiens
tcaagtttccccagcttcatctt

SEQ ID NO: 1048434 - DNA, 17 bp, Homo sapiens
tcaagttttaaagttca

SEQ ID NO: 1048435 - DNA, 20 bp, Homo sapiens
tcaataaaagagctgtctga

SEQ ID NO: 1048436 - DNA, 15 bp, Homo sapiens
tcaataaaatgtgat

SEQ ID NO: 1048437 - DNA, 18 bp, Homo sapiens
tcaataaaatgtgatttt

SEQ ID NO: 1048438 - DNA, 18 bp, Homo sapiens
tcaataaacaacagctga

SEQ ID NO: 1048439 - DNA, 23 bp, Homo sapiens
tcaataaacagcttcatgccttt

SEQ ID NO: 1048440 - DNA, 15 bp, Homo sapiens
tcaataaagaaaact

SEQ ID NO: 1048441 - DNA, 12 bp, Homo sapiens
tcaataaagcag

SEQ ID NO: 1048442 - DNA, 14 bp, Homo sapiens
tcaataaagcagag

SEQ ID NO: 1048443 - DNA, 17 bp, Homo sapiens
tcaataaagcagagcca

SEQ ID NO: 1048444 - DNA, 15 bp, Homo sapiens
tcaataaatgacacc

SEQ ID NO: 1048445 - DNA, 19 bp, Homo sapiens
tttccttgtttatcagata

SEQ ID NO: 1048446 - DNA, 16 bp, Homo sapiens
tttcctttaccttttc

SEQ ID NO: 1048447 - DNA, 19 bp, Homo sapiens
tttcctttatatttagtga

SEQ ID NO: 1048448 - DNA, 15 bp, Homo sapiens
tttcctttatgtgaa

SEQ ID NO: 1048449 - DNA, 21 bp, Homo sapiens
tttcctttatgtgaattttta

SEQ ID NO: 1048450 - DNA, 16 bp, Homo sapiens
tttccttttcatctgt

SEQ ID NO: 1048451 - DNA, 16 bp, Homo sapiens
tttccttttcttaaaa

SEQ ID NO: 1048452 - DNA, 18 bp, Homo sapiens
tttccttttcttaaaaca

SEQ ID NO: 1048453 - DNA, 13 bp, Homo sapiens
tttcctttttaat

SEQ ID NO: 1048454 - DNA, 19 bp, Homo sapiens
tttcctttttaatatgctt

SEQ ID NO: 1048455 - DNA, 12 bp, Homo sapiens
tttcctttttct

SEQ ID NO: 1048456 - DNA, 14 bp, Homo sapiens
tttcctttttctaa

SEQ ID NO: 1048457 - DNA, 18 bp, Homo sapiens
tttcctttttgacactga

SEQ ID NO: 1048458 - DNA, 15 bp, Homo sapiens
tttcctttttgagat

SEQ ID NO: 1048459 - DNA, 17 bp, Homo sapiens
tttccttttttgtctat

SEQ ID NO: 1048460 - DNA, 19 bp, Homo sapiens
tttccttttttgtctatga

SEQ ID NO: 1048461 - DNA, 13 bp, Homo sapiens
tttcgaaactgcc

SEQ ID NO: 1048462 - DNA, 16 bp, Homo sapiens
tttcgaaactgccaag

SEQ ID NO: 1048463 - DNA, 20 bp, Homo sapiens
tttcgacgcttaacctttcc

SEQ ID NO: 1048464 - DNA, 16 bp, Homo sapiens
tttcgactggtccagc

SEQ ID NO: 1048465 - DNA, 17 bp, Homo sapiens
tttcgactggtccagct

SEQ ID NO: 1048466 - DNA, 19 bp, Homo sapiens
tttcgacttgcatttttgc

SEQ ID NO: 1048467 - DNA, 13 bp, Homo sapiens
tttcgaggcctga

SEQ ID NO: 1048468 - DNA, 13 bp, Homo sapiens
tttcgataaacaa

SEQ ID NO: 1048469 - DNA, 15 bp, Homo sapiens
tttcgccttaaactc

SEQ ID NO: 1048470 - DNA, 17 bp, Homo sapiens
tttcgccttaaactctg

SEQ ID NO: 1048471 - DNA, 12 bp, Homo sapiens
tttcgctttcct

SEQ ID NO: 1048472 - DNA, 15 bp, Homo sapiens
tttcgctttcctctg

SEQ ID NO: 1048473 - DNA, 12 bp, Homo sapiens
tttcggaaaaaa

SEQ ID NO: 1048474 - DNA, 19 bp, Homo sapiens
tttcggaaaaaaaaaaaga

SEQ ID NO: 1048475 - DNA, 22 bp, Homo sapiens
tttcggaaaaaaaaaaagaaaa

SEQ ID NO: 1048476 - DNA, 18 bp, Homo sapiens
tttcggacagtttatttg

SEQ ID NO: 1048477 - DNA, 15 bp, Homo sapiens
tttcgggctgagaag

SEQ ID NO: 1048478 - DNA, 17 bp, Homo sapiens
tttcgtaccttcccact

SEQ ID NO: 1048479 - DNA, 15 bp, Homo sapiens
tttcgttaacattga

SEQ ID NO: 1048480 - DNA, 12 bp, Homo sapiens
tttcgttctgct

SEQ ID NO: 1048481 - DNA, 12 bp, Homo sapiens
tttcgtttgttt

SEQ ID NO: 1048482 - DNA, 19 bp, Homo sapiens
tttcgtttttcttggggta

SEQ ID NO: 1048483 - DNA, 13 bp, Homo sapiens
tttctaaaagctt

SEQ ID NO: 1048484 - DNA, 16 bp, Homo sapiens
tttctaaaagctttca

SEQ ID NO: 1048485 - DNA, 19 bp, Homo sapiens
tttctaaaagctttcatgt

SEQ ID NO: 1048486 - DNA, 15 bp, Homo sapiens
tttctaaaatctaaa

SEQ ID NO: 1048487 - DNA, 17 bp, Homo sapiens
tttctaaaatctaaaat

SEQ ID NO: 1048488 - DNA, 20 bp, Homo sapiens
tttctaaaggctacctttgt

SEQ ID NO: 1048489 - DNA, 15 bp, Homo sapiens
tttctaaagtaaaat

SEQ ID NO: 1048490 - DNA, 16 bp, Homo sapiens
tttctaaagtaaaatt

SEQ ID NO: 1048491 - DNA, 22 bp, Homo sapiens
tttctaaagtaaaattgaagca

SEQ ID NO: 1048492 - DNA, 17 bp, Homo sapiens
tttctaaataaaaatat

SEQ ID NO: 1048493 - DNA, 18 bp, Homo sapiens
tttctaacaattttcaga

SEQ ID NO: 1048494 - DNA, 21 bp, Homo sapiens
tttctaacaattttcagacct

SEQ ID NO: 1048495 - DNA, 17 bp, Homo sapiens
tttctaacagtccttgc

SEQ ID NO: 1048496 - DNA, 18 bp, Homo sapiens
tttctaacagtccttgct

SEQ ID NO: 1048497 - DNA, 19 bp, Homo sapiens
tttctaaccaagaggctgg

SEQ ID NO: 1048498 - DNA, 17 bp, Homo sapiens
tttctaaccttgaatgc

SEQ ID NO: 1048499 - DNA, 14 bp, Homo sapiens
tttctaagaaaatg

SEQ ID NO: 1048500 - DNA, 16 bp, Homo sapiens
tttctaagaaaatgta

SEQ ID NO: 1048501 - DNA, 22 bp, Homo sapiens
tttctaagaaatagagccaact

SEQ ID NO: 1048502 - DNA, 19 bp, Homo sapiens
tttctaagaagttgtttga

SEQ ID NO: 1048503 - DNA, 13 bp, Homo sapiens
tttctaagacagt

SEQ ID NO: 1048504 - DNA, 13 bp, Homo sapiens
tttctaagagaag

SEQ ID NO: 1048505 - DNA, 23 bp, Homo sapiens
tttctaagcgatcctcctgtcta

SEQ ID NO: 1048506 - DNA, 15 bp, Homo sapiens
tttctaatagagaga

SEQ ID NO: 1048507 - DNA, 22 bp, Homo sapiens
tttctaattgtaagtgaaatta

SEQ ID NO: 1048508 - DNA, 15 bp, Homo sapiens
tttctaatttgcact

SEQ ID NO: 1048509 - DNA, 17 bp, Homo sapiens
tttctacaatgtgaact

SEQ ID NO: 1048510 - DNA, 22 bp, Homo sapiens
tttctacaatgtgaactttatt

SEQ ID NO: 1048511 - DNA, 21 bp, Homo sapiens
tttctacaattaatagtttgt

SEQ ID NO: 1048512 - DNA, 19 bp, Homo sapiens
tttctacacagtaaaaact

SEQ ID NO: 1048513 - DNA, 20 bp, Homo sapiens
tttctacactgtattacata

SEQ ID NO: 1048514 - DNA, 19 bp, Homo sapiens
tttctacatgactgggcct

SEQ ID NO: 1048515 - DNA, 15 bp, Homo sapiens
tcaatgtcaagtacc

SEQ ID NO: 1048516 - DNA, 11 bp, Homo sapiens
tcaatgtcact

SEQ ID NO: 1048517 - DNA, 13 bp, Homo sapiens
tcaatgtcattac

SEQ ID NO: 1048518 - DNA, 15 bp, Homo sapiens
tcaatgtcattacat

SEQ ID NO: 1048519 - DNA, 16 bp, Homo sapiens
tcaatgtccagtgagt

SEQ ID NO: 1048520 - DNA, 20 bp, Homo sapiens
tcaatgtgaaacacatgcca

SEQ ID NO: 1048521 - DNA, 15 bp, Homo sapiens
tcaatgtgaatcaga

SEQ ID NO: 1048522 - DNA, 17 bp, Homo sapiens
tcaatgtgattctaatg

SEQ ID NO: 1048523 - DNA, 18 bp, Homo sapiens
tcaatgtgattctaatgt

SEQ ID NO: 1048524 - DNA, 22 bp, Homo sapiens
tcaatgtgattctaatgtcttc

SEQ ID NO: 1048525 - DNA, 18 bp, Homo sapiens
tcaatgtggtgatgaaat

SEQ ID NO: 1048526 - DNA, 22 bp, Homo sapiens
tcaatgtgtcatttccggctgc

SEQ ID NO: 1048527 - DNA, 20 bp, Homo sapiens
tcaatgtgtctttctaagaa

SEQ ID NO: 1048528 - DNA, 19 bp, Homo sapiens
tcaatgtgttggaaactgt

SEQ ID NO: 1048529 - DNA, 11 bp, Homo sapiens
tcaatgttcat

SEQ ID NO: 1048530 - DNA, 16 bp, Homo sapiens
tcaatgttcattgtaa

SEQ ID NO: 1048531 - DNA, 18 bp, Homo sapiens
tcaatgttcattgtaatg

SEQ ID NO: 1048532 - DNA, 21 bp, Homo sapiens
tcaatgtttatgcaaggaagg

SEQ ID NO: 1048533 - DNA, 18 bp, Homo sapiens
tcaatgtttcttctaggt

SEQ ID NO: 1048534 - DNA, 18 bp, Homo sapiens
tcaatgtttttaaaaatc

SEQ ID NO: 1048535 - DNA, 23 bp, Homo sapiens
tcaattaaaatagtctctttaaa

SEQ ID NO: 1048536 - DNA, 13 bp, Homo sapiens
tcaattaaagtct

SEQ ID NO: 1048537 - DNA, 22 bp, Homo sapiens
tcaattacttattttaggaaat

SEQ ID NO: 1048538 - DNA, 15 bp, Homo sapiens
tcaattcaaagctgt

SEQ ID NO: 1048539 - DNA, 17 bp, Homo sapiens
tcaattcaaagctgtgt

SEQ ID NO: 1048540 - DNA, 18 bp, Homo sapiens
tcaattcagattgtcttg

SEQ ID NO: 1048541 - DNA, 21 bp, Homo sapiens
tcaattccatttaaaaaacaa

SEQ ID NO: 1048542 - DNA, 17 bp, Homo sapiens
tcaattcctgggcccca

SEQ ID NO: 1048543 - DNA, 21 bp, Homo sapiens
tcaattctgatgttactgaga

SEQ ID NO: 1048544 - DNA, 22 bp, Homo sapiens
tcaattcttcatgcgtgccctt

SEQ ID NO: 1048545 - DNA, 12 bp, Homo sapiens
tcaattgacaaa

SEQ ID NO: 1048546 - DNA, 16 bp, Homo sapiens
tcaattgcatctccca

SEQ ID NO: 1048547 - DNA, 17 bp, Homo sapiens
tcaattggcagtgactt

SEQ ID NO: 1048548 - DNA, 18 bp, Homo sapiens
tcaattgtaaattgaatc

SEQ ID NO: 1048549 - DNA, 17 bp, Homo sapiens
tcaattgtcacttttta

SEQ ID NO: 1048550 - DNA, 12 bp, Homo sapiens
tcaatttctccc

SEQ ID NO: 1048551 - DNA, 14 bp, Homo sapiens
tcaatttgctgaaa

SEQ ID NO: 1048552 - DNA, 23 bp, Homo sapiens
tcaatttggagcattaactaaat

SEQ ID NO: 1048553 - DNA, 17 bp, Homo sapiens
tcaatttggatatttgg

SEQ ID NO: 1048554 - DNA, 16 bp, Homo sapiens
tcaatttgtatatcat

SEQ ID NO: 1048555 - DNA, 15 bp, Homo sapiens
tcaattttaaacata

SEQ ID NO: 1048556 - DNA, 13 bp, Homo sapiens
tcaattttatgta

SEQ ID NO: 1048557 - DNA, 16 bp, Homo sapiens
tcaattttatgtattc

SEQ ID NO: 1048558 - DNA, 12 bp, Homo sapiens
tcaatttttccc

SEQ ID NO: 1048559 - DNA, 15 bp, Homo sapiens
tcaatttttcccagt

SEQ ID NO: 1048560 - DNA, 14 bp, Homo sapiens
tcacaaaaacaaaa

SEQ ID NO: 1048561 - DNA, 15 bp, Homo sapiens
tcacaaaaacaaaaa

SEQ ID NO: 1048562 - DNA, 13 bp, Homo sapiens
tcacaaaaaggca

SEQ ID NO: 1048563 - DNA, 16 bp, Homo sapiens
tcacaaaaaggcaaat

SEQ ID NO: 1048564 - DNA, 18 bp, Homo sapiens
tcacaaaaaggcaaatat

SEQ ID NO: 1048565 - DNA, 23 bp, Homo sapiens
tcacaaaaatttgaacactggct

SEQ ID NO: 1048566 - DNA, 12 bp, Homo sapiens
tcacaaaagaaa

SEQ ID NO: 1048567 - DNA, 19 bp, Homo sapiens
tcacaaaagaaaaaaaact

SEQ ID NO: 1048568 - DNA, 20 bp, Homo sapiens
tcacagtgctcttttctcct

SEQ ID NO: 1048569 - DNA, 14 bp, Homo sapiens
tcacagtgctgtgt

SEQ ID NO: 1048570 - DNA, 16 bp, Homo sapiens
tcacagtgcttttaag

SEQ ID NO: 1048571 - DNA, 17 bp, Homo sapiens
tcacagtgttgcccagg

SEQ ID NO: 1048572 - DNA, 14 bp, Homo sapiens
tcacagtgtttcga

SEQ ID NO: 1048573 - DNA, 22 bp, Homo sapiens
tcacagtgtttgcaatggtgtt

SEQ ID NO: 1048574 - DNA, 17 bp, Homo sapiens
tcacagttcctcgccct

SEQ ID NO: 1048575 - DNA, 18 bp, Homo sapiens
tcacagttcctcgccctg

SEQ ID NO: 1048576 - DNA, 17 bp, Homo sapiens
tcacagttggccttcag

SEQ ID NO: 1048577 - DNA, 16 bp, Homo sapiens
tcacataccctccccc

SEQ ID NO: 1048578 - DNA, 16 bp, Homo sapiens
tcacatagatgtccct

SEQ ID NO: 1048579 - DNA, 17 bp, Homo sapiens
tcacatagatgtccctt

SEQ ID NO: 1048580 - DNA, 16 bp, Homo sapiens
tcacatattgatttcc

SEQ ID NO: 1048581 - DNA, 20 bp, Homo sapiens
tcacatattgatttccgtta

SEQ ID NO: 1048582 - DNA, 13 bp, Homo sapiens
tcacatcacagga

SEQ ID NO: 1048583 - DNA, 16 bp, Homo sapiens
tcacatccatctactt

SEQ ID NO: 1048584 - DNA, 13 bp, Homo sapiens
tcacatcctcctg

SEQ ID NO: 1048585 - DNA, 17 bp, Homo sapiens
tcacatcctcctgccca

SEQ ID NO: 1048586 - DNA, 23 bp, Homo sapiens
tcacatcctcctgcccagctcct

SEQ ID NO: 1048587 - DNA, 11 bp, Homo sapiens
tcacatcctgg

SEQ ID NO: 1048588 - DNA, 21 bp, Homo sapiens
tcacatcgcttctgtgtatct

SEQ ID NO: 1048589 - DNA, 15 bp, Homo sapiens
tcacatctaaagctt

SEQ ID NO: 1048590 - DNA, 16 bp, Homo sapiens
tcacatctaaagcttt

SEQ ID NO: 1048591 - DNA, 17 bp, Homo sapiens
tcacatctctggaaatt

SEQ ID NO: 1048592 - DNA, 13 bp, Homo sapiens
tcacatgaccaca

SEQ ID NO: 1048593 - DNA, 14 bp, Homo sapiens
tcacatgaccacat

SEQ ID NO: 1048594 - DNA, 18 bp, Homo sapiens
tcacatgaccacatagca

SEQ ID NO: 1048595 - DNA, 16 bp, Homo sapiens
tcacatggtgccccta

SEQ ID NO: 1048596 - DNA, 21 bp, Homo sapiens
tcacattaaaaaatgaaatat

SEQ ID NO: 1048597 - DNA, 20 bp, Homo sapiens
tcacattaatatttgctgac

SEQ ID NO: 1048598 - DNA, 18 bp, Homo sapiens
tcacattaatctcaaaga

SEQ ID NO: 1048599 - DNA, 15 bp, Homo sapiens
tcacattagaattag

SEQ ID NO: 1048600 - DNA, 13 bp, Homo sapiens
tcacattagatct

SEQ ID NO: 1048601 - DNA, 13 bp, Homo sapiens
tcacattctgctt

SEQ ID NO: 1048602 - DNA, 15 bp, Homo sapiens
tcacattctgcttaa

SEQ ID NO: 1048603 - DNA, 19 bp, Homo sapiens
tcacatttccagggcagca

SEQ ID NO: 1048604 - DNA, 15 bp, Homo sapiens
tcacatttgatgtac

SEQ ID NO: 1048605 - DNA, 19 bp, Homo sapiens
tcacatttgatgtacatgt

SEQ ID NO: 1048606 - DNA, 21 bp, Homo sapiens
tcacatttgtatgtgtgtaga

SEQ ID NO: 1048607 - DNA, 14 bp, Homo sapiens
tcacattttaagtg

SEQ ID NO: 1048608 - DNA, 16 bp, Homo sapiens
tcacattttccttttc

SEQ ID NO: 1048609 - DNA, 22 bp, Homo sapiens
tcacattttgttaagaagttga

SEQ ID NO: 1048610 - DNA, 20 bp, Homo sapiens
tcacatttttaaaagaacaa

SEQ ID NO: 1048611 - DNA, 20 bp, Homo sapiens
tcacatttttttatgctctt

SEQ ID NO: 1048612 - DNA, 14 bp, Homo sapiens
tcaccaagcagtgg

SEQ ID NO: 1048613 - DNA, 12 bp, Homo sapiens
tcaccaagctca

SEQ ID NO: 1048614 - DNA, 12 bp, Homo sapiens
tcaccaaggaaa

SEQ ID NO: 1048615 - DNA, 21 bp, Homo sapiens
tcaccaaggcagtgcatgcat

SEQ ID NO: 1048616 - DNA, 16 bp, Homo sapiens
tcaccaagtgcaatag

SEQ ID NO: 1048617 - DNA, 15 bp, Homo sapiens
tcaccaatcatagtg

SEQ ID NO: 1048618 - DNA, 16 bp, Homo sapiens
tcaccaatgagcctta

SEQ ID NO: 1048619 - DNA, 17 bp, Homo sapiens
tcaccacaagctgagca

SEQ ID NO: 1048620 - DNA, 18 bp, Homo sapiens
tcaccacacccaggtctc

SEQ ID NO: 1048621 - DNA, 19 bp, Homo sapiens
tcaccacacccaggtctct

SEQ ID NO: 1048622 - DNA, 19 bp, Homo sapiens
tcaccacagtaagttccta

SEQ ID NO: 1048623 - DNA, 19 bp, Homo sapiens
tcaccacataccatgtgga

SEQ ID NO: 1048624 - DNA, 13 bp, Homo sapiens
tcaccaccacccc

SEQ ID NO: 1048625 - DNA, 14 bp, Homo sapiens
tcaccacccagccc

SEQ ID NO: 1048626 - DNA, 17 bp, Homo sapiens
tcaccacccagcccttc

SEQ ID NO: 1048627 - DNA, 18 bp, Homo sapiens
tcaccacccagcccttcc

SEQ ID NO: 1048628 - DNA, 11 bp, Homo sapiens
tcaccaccccc

SEQ ID NO: 1048629 - DNA, 12 bp, Homo sapiens
tcaccaccccca

SEQ ID NO: 1048630 - DNA, 16 bp, Homo sapiens
tcaccaccgcctctgg

SEQ ID NO: 1048631 - DNA, 24 bp, Homo sapiens
tcaccacctatatccagaagggga

SEQ ID NO: 1048632 - DNA, 18 bp, Homo sapiens
tcaccacgactggccagg

SEQ ID NO: 1048633 - DNA, 12 bp, Homo sapiens
tcaccactcctc

SEQ ID NO: 1048634 - DNA, 14 bp, Homo sapiens
tcaccactcctctc

SEQ ID NO: 1048635 - DNA, 21 bp, Homo sapiens
tcaccactcctctcccttgag

SEQ ID NO: 1048636 - DNA, 15 bp, Homo sapiens
tcaccagagacttta

SEQ ID NO: 1048637 - DNA, 15 bp, Homo sapiens
tcaccagcaacatct

SEQ ID NO: 1048638 - DNA, 21 bp, Homo sapiens
tcaccagcaacatctcgagcc

SEQ ID NO: 1048639 - DNA, 19 bp, Homo sapiens
tcaccagccccactgccag

SEQ ID NO: 1048640 - DNA, 24 bp, Homo sapiens
tcaccagccccactgccagcagca

SEQ ID NO: 1048641 - DNA, 11 bp, Homo sapiens
tcaccagccct

SEQ ID NO: 1048642 - DNA, 15 bp, Homo sapiens
tcaccagccctgcag

SEQ ID NO: 1048643 - DNA, 15 bp, Homo sapiens
tcaccagctgcctct

SEQ ID NO: 1048644 - DNA, 15 bp, Homo sapiens
tcaccagctgctgtg

SEQ ID NO: 1048645 - DNA, 17 bp, Homo sapiens
tcaccaggacttggggt

SEQ ID NO: 1048646 - DNA, 19 bp, Homo sapiens
tttctgactgtccctgcca

SEQ ID NO: 1048647 - DNA, 20 bp, Homo sapiens
tttctgacttctagctgtct

SEQ ID NO: 1048648 - DNA, 16 bp, Homo sapiens
tttctgagcacacttt

SEQ ID NO: 1048649 - DNA, 16 bp, Homo sapiens
tttctgagcttttcat

SEQ ID NO: 1048650 - DNA, 21 bp, Homo sapiens
tttctgagtgagttttactct

SEQ ID NO: 1048651 - DNA, 23 bp, Homo sapiens
tttctgagtgagttttactctta

SEQ ID NO: 1048652 - DNA, 23 bp, Homo sapiens
tttctgattaatatatttaatat

SEQ ID NO: 1048653 - DNA, 10 bp, Homo sapiens
tttctgattc

SEQ ID NO: 1048654 - DNA, 19 bp, Homo sapiens
tttctgcagaaatttgcaa

SEQ ID NO: 1048655 - DNA, 19 bp, Homo sapiens
tttctgcagtagtctctgt

SEQ ID NO: 1048656 - DNA, 13 bp, Homo sapiens
tttctgcatatgt

SEQ ID NO: 1048657 - DNA, 15 bp, Homo sapiens
tttctgccctggctg

SEQ ID NO: 1048658 - DNA, 22 bp, Homo sapiens
tttctgcctggagtgtatgact

SEQ ID NO: 1048659 - DNA, 15 bp, Homo sapiens
tttctgcctttcccc

SEQ ID NO: 1048660 - DNA, 15 bp, Homo sapiens
tttctgctcagcttc

SEQ ID NO: 1048661 - DNA, 18 bp, Homo sapiens
tttctgctcagcttctcc

SEQ ID NO: 1048662 - DNA, 15 bp, Homo sapiens
tttctgcttctctct

SEQ ID NO: 1048663 - DNA, 14 bp, Homo sapiens
tttctggaaatttt

SEQ ID NO: 1048664 - DNA, 15 bp, Homo sapiens
tttctggaaattttg

SEQ ID NO: 1048665 - DNA, 21 bp, Homo sapiens
tttctggaatacatgaaatat

SEQ ID NO: 1048666 - DNA, 11 bp, Homo sapiens
tttctggactg

SEQ ID NO: 1048667 - DNA, 12 bp, Homo sapiens
tttctggactgg

SEQ ID NO: 1048668 - DNA, 18 bp, Homo sapiens
tttctggcagctgtggta

SEQ ID NO: 1048669 - DNA, 11 bp, Homo sapiens
tttctggccag

SEQ ID NO: 1048670 - DNA, 16 bp, Homo sapiens
tttctggcctgttatg

SEQ ID NO: 1048671 - DNA, 13 bp, Homo sapiens
tttctgggctttc

SEQ ID NO: 1048672 - DNA, 14 bp, Homo sapiens
tttctgggctttct

SEQ ID NO: 1048673 - DNA, 16 bp, Homo sapiens
tttctgggctttctcc

SEQ ID NO: 1048674 - DNA, 21 bp, Homo sapiens
tttctggggaaaaaaaagaga

SEQ ID NO: 1048675 - DNA, 18 bp, Homo sapiens
tttctggggggatatttc

SEQ ID NO: 1048676 - DNA, 18 bp, Homo sapiens
tttctgggtccctgctcc

SEQ ID NO: 1048677 - DNA, 15 bp, Homo sapiens
tttctgggtcctgaa

SEQ ID NO: 1048678 - DNA, 22 bp, Homo sapiens
tttctggtccctcttctctcct

SEQ ID NO: 1048679 - DNA, 15 bp, Homo sapiens
tttctggtggtctgt

SEQ ID NO: 1048680 - DNA, 14 bp, Homo sapiens
tttctggttccaaa

SEQ ID NO: 1048681 - DNA, 15 bp, Homo sapiens
tttctgtaaactctg

SEQ ID NO: 1048682 - DNA, 19 bp, Homo sapiens
tttctgtaattcaggtttt

SEQ ID NO: 1048683 - DNA, 19 bp, Homo sapiens
tttctgtatactgtaaaag

SEQ ID NO: 1048684 - DNA, 21 bp, Homo sapiens
tttctgtatactgtaaaagtt

SEQ ID NO: 1048685 - DNA, 20 bp, Homo sapiens
tttctgtatatttgtcatga

SEQ ID NO: 1048686 - DNA, 15 bp, Homo sapiens
tttctgtcaagaaga

SEQ ID NO: 1048687 - DNA, 19 bp, Homo sapiens
tttctgtcagatgagaaca

SEQ ID NO: 1048688 - DNA, 22 bp, Homo sapiens
tttctgtcagatgagaacaaag

SEQ ID NO: 1048689 - DNA, 13 bp, Homo sapiens
tttctgtcctggg

SEQ ID NO: 1048690 - DNA, 14 bp, Homo sapiens
tttctgtgaagcta

SEQ ID NO: 1048691 - DNA, 15 bp, Homo sapiens
tcacctttcctctcc

SEQ ID NO: 1048692 - DNA, 18 bp, Homo sapiens
tcacctttctgggctttc

SEQ ID NO: 1048693 - DNA, 15 bp, Homo sapiens
tcaccttttcaggaa

SEQ ID NO: 1048694 - DNA, 20 bp, Homo sapiens
tcacctttttgacttttcca

SEQ ID NO: 1048695 - DNA, 18 bp, Homo sapiens
tcacgaactcattaacaa

SEQ ID NO: 1048696 - DNA, 21 bp, Homo sapiens
tcacgaattccatcttgtaaa

SEQ ID NO: 1048697 - DNA, 18 bp, Homo sapiens
tcacgacacatttgcctt

SEQ ID NO: 1048698 - DNA, 16 bp, Homo sapiens
tcacgacgctgcagag

SEQ ID NO: 1048699 - DNA, 16 bp, Homo sapiens
tcacgagatcttcctt

SEQ ID NO: 1048700 - DNA, 16 bp, Homo sapiens
tcacgagatttgccag

SEQ ID NO: 1048701 - DNA, 13 bp, Homo sapiens
tcacgattcattt

SEQ ID NO: 1048702 - DNA, 21 bp, Homo sapiens
tcacgatttgcaggattccct

SEQ ID NO: 1048703 - DNA, 21 bp, Homo sapiens
tcacgcaggctgagtccagag

SEQ ID NO: 1048704 - DNA, 14 bp, Homo sapiens
tcacgcatgcagtg

SEQ ID NO: 1048705 - DNA, 17 bp, Homo sapiens
tcacgccacccccgccc

SEQ ID NO: 1048706 - DNA, 18 bp, Homo sapiens
tcacgccacccccgcccc

SEQ ID NO: 1048707 - DNA, 22 bp, Homo sapiens
tcacgccactgcactccagcct

SEQ ID NO: 1048708 - DNA, 21 bp, Homo sapiens
tcacgccgggagaagccacct

SEQ ID NO: 1048709 - DNA, 22 bp, Homo sapiens
tcacgccgggagaagccacctt

SEQ ID NO: 1048710 - DNA, 19 bp, Homo sapiens
tcacgcctatgatcccagc

SEQ ID NO: 1048711 - DNA, 23 bp, Homo sapiens
tcacgcctgtaatcccagcactt

SEQ ID NO: 1048712 - DNA, 19 bp, Homo sapiens
tcacgcctgtaatcctagc

SEQ ID NO: 1048713 - DNA, 14 bp, Homo sapiens
tcacgccttggcct

SEQ ID NO: 1048714 - DNA, 13 bp, Homo sapiens
tcacgctccctga

SEQ ID NO: 1048715 - DNA, 15 bp, Homo sapiens
tcacgctctggacat

SEQ ID NO: 1048716 - DNA, 16 bp, Homo sapiens
tcacgctttcatgacc

SEQ ID NO: 1048717 - DNA, 14 bp, Homo sapiens
tcacgctttcctga

SEQ ID NO: 1048718 - DNA, 22 bp, Homo sapiens
tcacgctttcctgaatccaaac

SEQ ID NO: 1048719 - DNA, 17 bp, Homo sapiens
tcacggaagagccttgc

SEQ ID NO: 1048720 - DNA, 22 bp, Homo sapiens
tcacgggagatttcttgttgct

SEQ ID NO: 1048721 - DNA, 18 bp, Homo sapiens
tcacgggcagtagctgtg

SEQ ID NO: 1048722 - DNA, 20 bp, Homo sapiens
tcacgggcatgggcactccc

SEQ ID NO: 1048723 - DNA, 13 bp, Homo sapiens
tcacgggccctgc

SEQ ID NO: 1048724 - DNA, 16 bp, Homo sapiens
tcacgggccctgcccc

SEQ ID NO: 1048725 - DNA, 20 bp, Homo sapiens
tcacggtgacacaggtcagg

SEQ ID NO: 1048726 - DNA, 20 bp, Homo sapiens
tcacgtaaagctagaaatga

SEQ ID NO: 1048727 - DNA, 15 bp, Homo sapiens
tcacgtaaatattca

SEQ ID NO: 1048728 - DNA, 22 bp, Homo sapiens
tcacgtaagatacaagtttcag

SEQ ID NO: 1048729 - DNA, 20 bp, Homo sapiens
tcacgtatttcacagagcac

SEQ ID NO: 1048730 - DNA, 24 bp, Homo sapiens
tcacgtatttcacagagcacgcct

SEQ ID NO: 1048731 - DNA, 20 bp, Homo sapiens
tcacgtcctgagaaagctca

SEQ ID NO: 1048732 - DNA, 14 bp, Homo sapiens
tcacgtgaaatatt

SEQ ID NO: 1048733 - DNA, 18 bp, Homo sapiens
tcacgtgcaggacagctc

SEQ ID NO: 1048734 - DNA, 19 bp, Homo sapiens
tcacgtgcaggacagctct

SEQ ID NO: 1048735 - DNA, 22 bp, Homo sapiens
tcacgtgcaggacagctcttga

SEQ ID NO: 1048736 - DNA, 23 bp, Homo sapiens
tcacgtggcctccgcagtgtctc

SEQ ID NO: 1048737 - DNA, 21 bp, Homo sapiens
tcacgtggctcgactatagaa

SEQ ID NO: 1048738 - DNA, 14 bp, Homo sapiens
tcacgttggccctc

SEQ ID NO: 1048739 - DNA, 13 bp, Homo sapiens
tcacgttggtctt

SEQ ID NO: 1048740 - DNA, 17 bp, Homo sapiens
tcacgtttcttccccaa

SEQ ID NO: 1048741 - DNA, 19 bp, Homo sapiens
tcactaaaaggaagacagt

SEQ ID NO: 1048742 - DNA, 17 bp, Homo sapiens
tcactaaactttatttg

SEQ ID NO: 1048743 - DNA, 19 bp, Homo sapiens
tcactaaactttatttgta

SEQ ID NO: 1048744 - DNA, 21 bp, Homo sapiens
tcactaaactttatttgtaaa

SEQ ID NO: 1048745 - DNA, 22 bp, Homo sapiens
tcactaacagggagaagtagct

SEQ ID NO: 1048746 - DNA, 15 bp, Homo sapiens
tcactaaccaacaag

SEQ ID NO: 1048747 - DNA, 19 bp, Homo sapiens
tcactaatactaattcatt

SEQ ID NO: 1048748 - DNA, 15 bp, Homo sapiens
tcactaatttttgta

SEQ ID NO: 1048749 - DNA, 16 bp, Homo sapiens
tcactaatttttgtat

SEQ ID NO: 1048750 - DNA, 18 bp, Homo sapiens
tcactacaagtcagctcc

SEQ ID NO: 1048751 - DNA, 20 bp, Homo sapiens
tcactaccctgattcttgat

SEQ ID NO: 1048752 - DNA, 22 bp, Homo sapiens
tcactagagtgctctgaccctg

SEQ ID NO: 1048753 - DNA, 14 bp, Homo sapiens
tcactagggctgag

SEQ ID NO: 1048754 - DNA, 19 bp, Homo sapiens
tcactagggctgaggggcc

SEQ ID NO: 1048755 - DNA, 17 bp, Homo sapiens
tcactaggtaacttatt

SEQ ID NO: 1048756 - DNA, 21 bp, Homo sapiens
tcactataatgatctaagaag

SEQ ID NO: 1048757 - DNA, 22 bp, Homo sapiens
tcactatgaatgggttgttaaa

SEQ ID NO: 1048758 - DNA, 18 bp, Homo sapiens
tcactattcttaagcact

SEQ ID NO: 1048759 - DNA, 21 bp, Homo sapiens
tcactattcttaagcactttg

SEQ ID NO: 1048760 - DNA, 22 bp, Homo sapiens
tcactattcttaagcactttga

SEQ ID NO: 1048761 - DNA, 18 bp, Homo sapiens
tcactatttcctttataa

SEQ ID NO: 1048762 - DNA, 20 bp, Homo sapiens
tcactatttttatttatatt

SEQ ID NO: 1048763 - DNA, 22 bp, Homo sapiens
tcactcaagagttcagtgctca

SEQ ID NO: 1048764 - DNA, 21 bp, Homo sapiens
tcactcaccactaccagccag

SEQ ID NO: 1048765 - DNA, 22 bp, Homo sapiens
tcactcaccactaccagccagc

SEQ ID NO: 1048766 - DNA, 16 bp, Homo sapiens
tcactcactcactccc

SEQ ID NO: 1048767 - DNA, 13 bp, Homo sapiens
tcactcactccaa

SEQ ID NO: 1048768 - DNA, 20 bp, Homo sapiens
tcactcactgaggccatcag

SEQ ID NO: 1048769 - DNA, 19 bp, Homo sapiens
tcactcagccaccctgagt

SEQ ID NO: 1048770 - DNA, 21 bp, Homo sapiens
tcactcagcccctacccctgc

SEQ ID NO: 1048771 - DNA, 22 bp, Homo sapiens
tcactcatgcaaactgctttat

SEQ ID NO: 1048772 - DNA, 23 bp, Homo sapiens
tcactcatgcaaactgctttatt

SEQ ID NO: 1048773 - DNA, 14 bp, Homo sapiens
tcactcattaatta

SEQ ID NO: 1048774 - DNA, 17 bp, Homo sapiens
tcactcattgacatgat

SEQ ID NO: 1048775 - DNA, 20 bp, Homo sapiens
tcactcattgacatgatata

SEQ ID NO: 1048776 - DNA, 13 bp, Homo sapiens
tcactcattgctg

SEQ ID NO: 1048777 - DNA, 15 bp, Homo sapiens
tcactcattgctgag

SEQ ID NO: 1048778 - DNA, 13 bp, Homo sapiens
tttgagactgaaa

SEQ ID NO: 1048779 - DNA, 19 bp, Homo sapiens
tttgagactgaaatttagt

SEQ ID NO: 1048780 - DNA, 18 bp, Homo sapiens
tttgagagaagccacgct

SEQ ID NO: 1048781 - DNA, 22 bp, Homo sapiens
tttgagagagagtcttactctg

SEQ ID NO: 1048782 - DNA, 19 bp, Homo sapiens
tttgagcccattcttctgg

SEQ ID NO: 1048783 - DNA, 19 bp, Homo sapiens
tttgagctgaaatgctgca

SEQ ID NO: 1048784 - DNA, 21 bp, Homo sapiens
tttgagctgaaatgctgcatt

SEQ ID NO: 1048785 - DNA, 14 bp, Homo sapiens
tttgagctgccttc

SEQ ID NO: 1048786 - DNA, 20 bp, Homo sapiens
tttgaggaagtggctgtccc

SEQ ID NO: 1048787 - DNA, 21 bp, Homo sapiens
tttgaggaagtggctgtccct

SEQ ID NO: 1048788 - DNA, 22 bp, Homo sapiens
tttgaggaagtggctgtccctg

SEQ ID NO: 1048789 - DNA, 18 bp, Homo sapiens
tttgaggaagttttgtct

SEQ ID NO: 1048790 - DNA, 23 bp, Homo sapiens
tttgaggagaagggggtctctgt

SEQ ID NO: 1048791 - DNA, 21 bp, Homo sapiens
tttgaggatatattttcactt

SEQ ID NO: 1048792 - DNA, 22 bp, Homo sapiens
tttgaggatgggatgtattttt

SEQ ID NO: 1048793 - DNA, 17 bp, Homo sapiens
tttgaggcaaattaact

SEQ ID NO: 1048794 - DNA, 17 bp, Homo sapiens
tttgagggcatgaagct

SEQ ID NO: 1048795 - DNA, 16 bp, Homo sapiens
tttgaggggaaaacac

SEQ ID NO: 1048796 - DNA, 20 bp, Homo sapiens
tttgaggtcaagtaagaaga

SEQ ID NO: 1048797 - DNA, 19 bp, Homo sapiens
tttgagtcaaaagcctggg

SEQ ID NO: 1048798 - DNA, 20 bp, Homo sapiens
tttgagtcttggtgctatca

SEQ ID NO: 1048799 - DNA, 21 bp, Homo sapiens
tttgagtttttcctcccagtg

SEQ ID NO: 1048800 - DNA, 16 bp, Homo sapiens
tttgataaacattcct

SEQ ID NO: 1048801 - DNA, 20 bp, Homo sapiens
tttgataaagtaattcatac

SEQ ID NO: 1048802 - DNA, 18 bp, Homo sapiens
tttgataagcacattaaa

SEQ ID NO: 1048803 - DNA, 22 bp, Homo sapiens
tttgatacagttttcagaaaaa

SEQ ID NO: 1048804 - DNA, 15 bp, Homo sapiens
tttgatacataataa

SEQ ID NO: 1048805 - DNA, 18 bp, Homo sapiens
tttgatactaagcattga

SEQ ID NO: 1048806 - DNA, 21 bp, Homo sapiens
tttgatactaagcattgaatg

SEQ ID NO: 1048807 - DNA, 16 bp, Homo sapiens
tttgatatacattgtg

SEQ ID NO: 1048808 - DNA, 16 bp, Homo sapiens
tttgatataccaaatt

SEQ ID NO: 1048809 - DNA, 19 bp, Homo sapiens
tttgatattaaaggagtta

SEQ ID NO: 1048810 - DNA, 17 bp, Homo sapiens
tttgatcagacagcttg

SEQ ID NO: 1048811 - DNA, 15 bp, Homo sapiens
tttgctatgtaaggg

SEQ ID NO: 1048812 - DNA, 23 bp, Homo sapiens
tttgctattgacaagtcatttta

SEQ ID NO: 1048813 - DNA, 14 bp, Homo sapiens
tttgctcagtgtcc

SEQ ID NO: 1048814 - DNA, 11 bp, Homo sapiens
tttgctcatgt

SEQ ID NO: 1048815 - DNA, 23 bp, Homo sapiens
tttgctccagataactctctttc

SEQ ID NO: 1048816 - DNA, 11 bp, Homo sapiens
tttgctccctc

SEQ ID NO: 1048817 - DNA, 23 bp, Homo sapiens
tttgctcttgtttttattaattt

SEQ ID NO: 1048818 - DNA, 19 bp, Homo sapiens
tttgctgaattcctttaca

SEQ ID NO: 1048819 - DNA, 12 bp, Homo sapiens
tttgctgagact

SEQ ID NO: 1048820 - DNA, 17 bp, Homo sapiens
tttgctgatttctagtg

SEQ ID NO: 1048821 - DNA, 13 bp, Homo sapiens
tttgctgcaaaga

SEQ ID NO: 1048822 - DNA, 14 bp, Homo sapiens
tttgctgcatttta

SEQ ID NO: 1048823 - DNA, 19 bp, Homo sapiens
tttgctgccaaatgcgtat

SEQ ID NO: 1048824 - DNA, 22 bp, Homo sapiens
tttgctgctaccgccctgggct

SEQ ID NO: 1048825 - DNA, 16 bp, Homo sapiens
tttgctgctatgaaaa

SEQ ID NO: 1048826 - DNA, 23 bp, Homo sapiens
tttgctgctatgaaaatgagcat

SEQ ID NO: 1048827 - DNA, 23 bp, Homo sapiens
tttgctggagaagtgtgtttctt

SEQ ID NO: 1048828 - DNA, 20 bp, Homo sapiens
tttgctggagtctccagatg

SEQ ID NO: 1048829 - DNA, 22 bp, Homo sapiens
tttgctggttataacagcaaat

SEQ ID NO: 1048830 - DNA, 18 bp, Homo sapiens
tttgctggtttgaaagat

SEQ ID NO: 1048831 - DNA, 14 bp, Homo sapiens
tttgctgtactctt

SEQ ID NO: 1048832 - DNA, 18 bp, Homo sapiens
tttgctgtatatttgtga

SEQ ID NO: 1048833 - DNA, 13 bp, Homo sapiens
tttgctgtctttc

SEQ ID NO: 1048834 - DNA, 15 bp, Homo sapiens
tttgctgtgaggaat

SEQ ID NO: 1048835 - DNA, 12 bp, Homo sapiens
tttgctgtgcca

SEQ ID NO: 1048836 - DNA, 17 bp, Homo sapiens
tttgctgttactgcttc

SEQ ID NO: 1048837 - DNA, 19 bp, Homo sapiens
tttgctgtttatacttgag

SEQ ID NO: 1048838 - DNA, 13 bp, Homo sapiens
tttgcttaaaata

SEQ ID NO: 1048839 - DNA, 18 bp, Homo sapiens
tttgcttaaaatatgtga

SEQ ID NO: 1048840 - DNA, 21 bp, Homo sapiens
tttgcttaaactaatgaacaa

SEQ ID NO: 1048841 - DNA, 17 bp, Homo sapiens
tttgcttaacattagat

SEQ ID NO: 1048842 - DNA, 21 bp, Homo sapiens
tttgcttaatttccttctgtt

SEQ ID NO: 1048843 - DNA, 23 bp, Homo sapiens
tttgcttaatttccttctgttaa

SEQ ID NO: 1048844 - DNA, 15 bp, Homo sapiens
tttgcttattgttcc

SEQ ID NO: 1048845 - DNA, 18 bp, Homo sapiens
tttgcttatttttataat

SEQ ID NO: 1048846 - DNA, 13 bp, Homo sapiens
tttgcttcataaa

SEQ ID NO: 1048847 - DNA, 20 bp, Homo sapiens
tttgcttcatagtattggag

SEQ ID NO: 1048848 - DNA, 12 bp, Homo sapiens
tttgcttcctca

SEQ ID NO: 1048849 - DNA, 19 bp, Homo sapiens
tttgcttgctcatatgcat

SEQ ID NO: 1048850 - DNA, 15 bp, Homo sapiens
tttgctttcttgtct

SEQ ID NO: 1048851 - DNA, 17 bp, Homo sapiens
tttgctttgaaaatatt

SEQ ID NO: 1048852 - DNA, 15 bp, Homo sapiens
tttgctttgctttct

SEQ ID NO: 1048853 - DNA, 14 bp, Homo sapiens
tttgctttggaaac

SEQ ID NO: 1048854 - DNA, 19 bp, Homo sapiens
tttgctttggttaaaaatg

SEQ ID NO: 1048855 - DNA, 15 bp, Homo sapiens
tttgctttgtgattt

SEQ ID NO: 1048856 - DNA, 15 bp, Homo sapiens
tttggaaaaaactct

SEQ ID NO: 1048857 - DNA, 20 bp, Homo sapiens
tttggaaaagtggcgtggga

SEQ ID NO: 1048858 - DNA, 12 bp, Homo sapiens
tttggaaaataa

SEQ ID NO: 1048859 - DNA, 14 bp, Homo sapiens
tttggaaagagacc

SEQ ID NO: 1048860 - DNA, 15 bp, Homo sapiens
tttggaaagagacca

SEQ ID NO: 1048861 - DNA, 14 bp, Homo sapiens
tttggaaataaaaa

SEQ ID NO: 1048862 - DNA, 23 bp, Homo sapiens
tttggaaattaggttgaaacata

SEQ ID NO: 1048863 - DNA, 21 bp, Homo sapiens
tttggaaccagactcttgcct

SEQ ID NO: 1048864 - DNA, 13 bp, Homo sapiens
tttggaaccttgt

SEQ ID NO: 1048865 - DNA, 14 bp, Homo sapiens
tttggaaccttgtt

SEQ ID NO: 1048866 - DNA, 11 bp, Homo sapiens
tttggaaggag

SEQ ID NO: 1048867 - DNA, 18 bp, Homo sapiens
tttggaagtttgtgttct

SEQ ID NO: 1048868 - DNA, 13 bp, Homo sapiens
tttggaatacttt

SEQ ID NO: 1048869 - DNA, 15 bp, Homo sapiens
tttggaatacttttt

SEQ ID NO: 1048870 - DNA, 14 bp, Homo sapiens
tttggaatatttga

SEQ ID NO: 1048871 - DNA, 15 bp, Homo sapiens
tttggaatatttgaa

SEQ ID NO: 1048872 - DNA, 16 bp, Homo sapiens
tttggaatatttgctt

SEQ ID NO: 1048873 - DNA, 22 bp, Homo sapiens
tttggaatcttctctttgacaa

SEQ ID NO: 1048874 - DNA, 15 bp, Homo sapiens
tttggaatgaagaaa

SEQ ID NO: 1048875 - DNA, 11 bp, Homo sapiens
tttggaatgtg

SEQ ID NO: 1048876 - DNA, 19 bp, Homo sapiens
tttggaattattgtagaca

SEQ ID NO: 1048877 - DNA, 16 bp, Homo sapiens
tttggaattggtgtat

SEQ ID NO: 1048878 - DNA, 16 bp, Homo sapiens
tttggacagtttacca

SEQ ID NO: 1048879 - DNA, 18 bp, Homo sapiens
tttggacatggaaagaaa

SEQ ID NO: 1048880 - DNA, 15 bp, Homo sapiens
tttggacccagggcc

SEQ ID NO: 1048881 - DNA, 16 bp, Homo sapiens
tttggaccccagctgg

SEQ ID NO: 1048882 - DNA, 17 bp, Homo sapiens
tttggaccccagctggg

SEQ ID NO: 1048883 - DNA, 16 bp, Homo sapiens
tttggacctaatccaa

SEQ ID NO: 1048884 - DNA, 17 bp, Homo sapiens
tttggagaaaaaaatca

SEQ ID NO: 1048885 - DNA, 20 bp, Homo sapiens
tttggagcacaaaattcaaa

SEQ ID NO: 1048886 - DNA, 18 bp, Homo sapiens
tttggagcactctgagtt

SEQ ID NO: 1048887 - DNA, 17 bp, Homo sapiens
tttggagcctgccaaga

SEQ ID NO: 1048888 - DNA, 11 bp, Homo sapiens
tttggagggga

SEQ ID NO: 1048889 - DNA, 19 bp, Homo sapiens
tttggagtgttatgtattt

SEQ ID NO: 1048890 - DNA, 15 bp, Homo sapiens
tttggatatgtaaaa

SEQ ID NO: 1048891 - DNA, 19 bp, Homo sapiens
tttggatatttttgtactt

SEQ ID NO: 1048892 - DNA, 21 bp, Homo sapiens
tttggatatttttgtacttga

SEQ ID NO: 1048893 - DNA, 21 bp, Homo sapiens
tttggatcatttttaactgat

SEQ ID NO: 1048894 - DNA, 17 bp, Homo sapiens
tttggatcttgaatgtg

SEQ ID NO: 1048895 - DNA, 18 bp, Homo sapiens
tttggattcttatgtagc

SEQ ID NO: 1048896 - DNA, 23 bp, Homo sapiens
tttggcaaggaaaggggagaagg

SEQ ID NO: 1048897 - DNA, 17 bp, Homo sapiens
tttggcaatgccatcat

SEQ ID NO: 1048898 - DNA, 22 bp, Homo sapiens
tttggcaggggcagaaaactct

SEQ ID NO: 1048899 - DNA, 15 bp, Homo sapiens
tttggccagggaggc

SEQ ID NO: 1048900 - DNA, 12 bp, Homo sapiens
tttggcccccga

SEQ ID NO: 1048901 - DNA, 21 bp, Homo sapiens
tttggcccccgagctgggggc

SEQ ID NO: 1048902 - DNA, 12 bp, Homo sapiens
tttggccctgga

SEQ ID NO: 1048903 - DNA, 18 bp, Homo sapiens
tttggccctggagccagg

SEQ ID NO: 1048904 - DNA, 12 bp, Homo sapiens
tttggcctgttt

SEQ ID NO: 1048905 - DNA, 15 bp, Homo sapiens
tttggccttaagaac

SEQ ID NO: 1048906 - DNA, 19 bp, Homo sapiens
tttggccttaagaactgtg

SEQ ID NO: 1048907 - DNA, 10 bp, Homo sapiens
tttggccttg

SEQ ID NO: 1048908 - DNA, 19 bp, Homo sapiens
tttggcgggccaaggactg

SEQ ID NO: 1048909 - DNA, 11 bp, Homo sapiens
tcactgtgctg

SEQ ID NO: 1048910 - DNA, 20 bp, Homo sapiens
tcactgtggccacagccccc

SEQ ID NO: 1048911 - DNA, 21 bp, Homo sapiens
tcactgtgggaaggccagctg

SEQ ID NO: 1048912 - DNA, 17 bp, Homo sapiens
tcactgtggtcctatgc

SEQ ID NO: 1048913 - DNA, 11 bp, Homo sapiens
tcactgtgtta

SEQ ID NO: 1048914 - DNA, 14 bp, Homo sapiens
tcactgtgttactg

SEQ ID NO: 1048915 - DNA, 18 bp, Homo sapiens
tcactgttccctctgctc

SEQ ID NO: 1048916 - DNA, 19 bp, Homo sapiens
tcactgttccctctgctcc

SEQ ID NO: 1048917 - DNA, 22 bp, Homo sapiens
tcactgttccctctgctcctgg

SEQ ID NO: 1048918 - DNA, 17 bp, Homo sapiens
tcactgttccctctggc

SEQ ID NO: 1048919 - DNA, 18 bp, Homo sapiens
tcactgttccctctggct

SEQ ID NO: 1048920 - DNA, 15 bp, Homo sapiens
tcactgttgaaaatt

SEQ ID NO: 1048921 - DNA, 18 bp, Homo sapiens
tcactgttgaaaattatt

SEQ ID NO: 1048922 - DNA, 20 bp, Homo sapiens
tcactgtttagaacacacac

SEQ ID NO: 1048923 - DNA, 14 bp, Homo sapiens
tcactgtttcatct

SEQ ID NO: 1048924 - DNA, 16 bp, Homo sapiens
tcactgtttgttttta

SEQ ID NO: 1048925 - DNA, 17 bp, Homo sapiens
tcactgtttttattcct

SEQ ID NO: 1048926 - DNA, 22 bp, Homo sapiens
tcactgtttttattccttccat

SEQ ID NO: 1048927 - DNA, 22 bp, Homo sapiens
tcacttaaacttgcatcactta

SEQ ID NO: 1048928 - DNA, 15 bp, Homo sapiens
tcacttaaattcttt

SEQ ID NO: 1048929 - DNA, 15 bp, Homo sapiens
tcacttaagtgtctg

SEQ ID NO: 1048930 - DNA, 22 bp, Homo sapiens
tcacttacataaagctcccttg

SEQ ID NO: 1048931 - DNA, 20 bp, Homo sapiens
tcacttaccccgagacctca

SEQ ID NO: 1048932 - DNA, 12 bp, Homo sapiens
tcacttagtcct

SEQ ID NO: 1048933 - DNA, 14 bp, Homo sapiens
tcacttcaatgtgt

SEQ ID NO: 1048934 - DNA, 13 bp, Homo sapiens
tcagaaggagaag

SEQ ID NO: 1048935 - DNA, 18 bp, Homo sapiens
tcagaagtcatcttgcta

SEQ ID NO: 1048936 - DNA, 15 bp, Homo sapiens
tcagaagtgagcttt

SEQ ID NO: 1048937 - DNA, 22 bp, Homo sapiens
tcagaatagccacatttggaat

SEQ ID NO: 1048938 - DNA, 23 bp, Homo sapiens
tcagaatagccacatttggaata

SEQ ID NO: 1048939 - DNA, 22 bp, Homo sapiens
tcagaatagctgttttgtgtat

SEQ ID NO: 1048940 - DNA, 16 bp, Homo sapiens
tcagaataggaaaaca

SEQ ID NO: 1048941 - DNA, 17 bp, Homo sapiens
tcagaatattaataaaa

SEQ ID NO: 1048942 - DNA, 14 bp, Homo sapiens
tcagaatattgtct

SEQ ID NO: 1048943 - DNA, 22 bp, Homo sapiens
tcagaatccaagtgaacactag

SEQ ID NO: 1048944 - DNA, 18 bp, Homo sapiens
tcagaatcccttaacagt

SEQ ID NO: 1048945 - DNA, 14 bp, Homo sapiens
tcagaatctaccca

SEQ ID NO: 1048946 - DNA, 19 bp, Homo sapiens
tcagaatctacccaaagga

SEQ ID NO: 1048947 - DNA, 20 bp, Homo sapiens
tcagaatctacccaaaggat

SEQ ID NO: 1048948 - DNA, 14 bp, Homo sapiens
tcagaatctgtgtg

SEQ ID NO: 1048949 - DNA, 18 bp, Homo sapiens
tcagaatgaaccctcctc

SEQ ID NO: 1048950 - DNA, 22 bp, Homo sapiens
tcagaatggaagagagaaagca

SEQ ID NO: 1048951 - DNA, 18 bp, Homo sapiens
tcagaatggaatccatct

SEQ ID NO: 1048952 - DNA, 22 bp, Homo sapiens
tcagaatggaatccatctgtct

SEQ ID NO: 1048953 - DNA, 14 bp, Homo sapiens
tcagaatgtaaaag

SEQ ID NO: 1048954 - DNA, 18 bp, Homo sapiens
tcagaatgtgaaaaagga

SEQ ID NO: 1048955 - DNA, 16 bp, Homo sapiens
tcagaattaaactttt

SEQ ID NO: 1048956 - DNA, 20 bp, Homo sapiens
tcagaattaaacttttaatt

SEQ ID NO: 1048957 - DNA, 21 bp, Homo sapiens
tcagaattaagcagaacactg

SEQ ID NO: 1048958 - DNA, 20 bp, Homo sapiens
tcagaattatttttaaaaag

SEQ ID NO: 1048959 - DNA, 21 bp, Homo sapiens
tcagaattcggtgtgctgcca

SEQ ID NO: 1048960 - DNA, 10 bp, Homo sapiens
tcagaattct

SEQ ID NO: 1048961 - DNA, 12 bp, Homo sapiens
tcagaattctca

SEQ ID NO: 1048962 - DNA, 20 bp, Homo sapiens
tcagaattctcagaatctca

SEQ ID NO: 1048963 - DNA, 23 bp, Homo sapiens
tcagaattctctagtttgattaa

SEQ ID NO: 1048964 - DNA, 21 bp, Homo sapiens
tcagaattgatcattttcccc

SEQ ID NO: 1048965 - DNA, 19 bp, Homo sapiens
tcagaattggcataatttg

SEQ ID NO: 1048966 - DNA, 21 bp, Homo sapiens
tcagaatttagtgtatccata

SEQ ID NO: 1048967 - DNA, 19 bp, Homo sapiens
tcagaatttatctccctta

SEQ ID NO: 1048968 - DNA, 14 bp, Homo sapiens
tcagaattttgtat

SEQ ID NO: 1048969 - DNA, 13 bp, Homo sapiens
tcagacaaaatgg

SEQ ID NO: 1048970 - DNA, 20 bp, Homo sapiens
tcagacaagcactattttat

SEQ ID NO: 1048971 - DNA, 20 bp, Homo sapiens
tcagacacaggaaaaataaa

SEQ ID NO: 1048972 - DNA, 20 bp, Homo sapiens
tcagacacatgctatgttct

SEQ ID NO: 1048973 - DNA, 16 bp, Homo sapiens
tcagacaccctctcct

SEQ ID NO: 1048974 - DNA, 17 bp, Homo sapiens
tcagacaccctctcctt

SEQ ID NO: 1048975 - DNA, 18 bp, Homo sapiens
tcagacaccctctcctta

SEQ ID NO: 1048976 - DNA, 22 bp, Homo sapiens
tcagacacctgttcacagaaaa

SEQ ID NO: 1048977 - DNA, 16 bp, Homo sapiens
tcagacacgattgaga

SEQ ID NO: 1048978 - DNA, 20 bp, Homo sapiens
tcagacactaaatgcagaca

SEQ ID NO: 1048979 - DNA, 14 bp, Homo sapiens
tcagacactttgga

SEQ ID NO: 1048980 - DNA, 15 bp, Homo sapiens
tcagacagaacttga

SEQ ID NO: 1048981 - DNA, 16 bp, Homo sapiens
tcagacagaacttgaa

SEQ ID NO: 1048982 - DNA, 15 bp, Homo sapiens
tcagacatacagctg

SEQ ID NO: 1048983 - DNA, 21 bp, Homo sapiens
tcagacatccatgtttgtaaa

SEQ ID NO: 1048984 - DNA, 22 bp, Homo sapiens
tcagacatctccagtgtgccag

SEQ ID NO: 1048985 - DNA, 20 bp, Homo sapiens
tcagacatgttttccgtgaa

SEQ ID NO: 1048986 - DNA, 14 bp, Homo sapiens
tcagacatttatat

SEQ ID NO: 1048987 - DNA, 14 bp, Homo sapiens
tcagaccacggctc

SEQ ID NO: 1048988 - DNA, 14 bp, Homo sapiens
tcagacccagagaa

SEQ ID NO: 1048989 - DNA, 12 bp, Homo sapiens
tcagaccccagc

SEQ ID NO: 1048990 - DNA, 19 bp, Homo sapiens
tcagaccccagttctaggg

SEQ ID NO: 1048991 - DNA, 12 bp, Homo sapiens
tcagacccccac

SEQ ID NO: 1048992 - DNA, 14 bp, Homo sapiens
tcagacccccactc

SEQ ID NO: 1048993 - DNA, 15 bp, Homo sapiens
tcagacccccccatt

SEQ ID NO: 1048994 - DNA, 17 bp, Homo sapiens
tcagaccccctcagcct

SEQ ID NO: 1048995 - DNA, 22 bp, Homo sapiens
tcagaccccctcagccttggga

SEQ ID NO: 1048996 - DNA, 16 bp, Homo sapiens
tcagaccctaccccac

SEQ ID NO: 1048997 - DNA, 16 bp, Homo sapiens
tcagacctgtcttcca

SEQ ID NO: 1048998 - DNA, 20 bp, Homo sapiens
tcagaccttggatcagatga

SEQ ID NO: 1048999 - DNA, 15 bp, Homo sapiens
tcagacctttactga

SEQ ID NO: 1049000 - DNA, 20 bp, Homo sapiens
tcagacgtgctccctcccat

SEQ ID NO: 1049001 - DNA, 22 bp, Homo sapiens
tcagactagccactcctgccag

SEQ ID NO: 1049002 - DNA, 14 bp, Homo sapiens
tcagactctagaaa

SEQ ID NO: 1049003 - DNA, 15 bp, Homo sapiens
tcagactctgggtcc

SEQ ID NO: 1049004 - DNA, 17 bp, Homo sapiens
tcagactgacactacta

SEQ ID NO: 1049005 - DNA, 17 bp, Homo sapiens
tcagactgctgggactg

SEQ ID NO: 1049006 - DNA, 13 bp, Homo sapiens
tcagactggctgg

SEQ ID NO: 1049007 - DNA, 15 bp, Homo sapiens
tcagacttaccagga

SEQ ID NO: 1049008 - DNA, 13 bp, Homo sapiens
tcagactttgctt

SEQ ID NO: 1049009 - DNA, 20 bp, Homo sapiens
tcagagaaggaaaagactga

SEQ ID NO: 1049010 - DNA, 14 bp, Homo sapiens
tcagagacaaaata

SEQ ID NO: 1049011 - DNA, 21 bp, Homo sapiens
tcagagacaaaatatttccca

SEQ ID NO: 1049012 - DNA, 14 bp, Homo sapiens
tcagagaccagggc

SEQ ID NO: 1049013 - DNA, 14 bp, Homo sapiens
tcagagagagtgtt

SEQ ID NO: 1049014 - DNA, 11 bp, Homo sapiens
tcagagagcct

SEQ ID NO: 1049015 - DNA, 22 bp, Homo sapiens
tcagagagcgagcgctacccac

SEQ ID NO: 1049016 - DNA, 21 bp, Homo sapiens
tcagagaggccttttggaatg

SEQ ID NO: 1049017 - DNA, 22 bp, Homo sapiens
tcagagaggccttttggaatgt

SEQ ID NO: 1049018 - DNA, 22 bp, Homo sapiens
tcagagatgatcagtccaactg

SEQ ID NO: 1049019 - DNA, 22 bp, Homo sapiens
tcagagatggtaatctacagct

SEQ ID NO: 1049020 - DNA, 23 bp, Homo sapiens
tcagagatggtaatctacagctc

SEQ ID NO: 1049021 - DNA, 19 bp, Homo sapiens
tcagagatgtccattttta

SEQ ID NO: 1049022 - DNA, 14 bp, Homo sapiens
tcagagcagcagaa

SEQ ID NO: 1049023 - DNA, 18 bp, Homo sapiens
tcagagcaggacctccct

SEQ ID NO: 1049024 - DNA, 14 bp, Homo sapiens
tcagagcaggggtc

SEQ ID NO: 1049025 - DNA, 16 bp, Homo sapiens
tcagagccagcctggc

SEQ ID NO: 1049026 - DNA, 15 bp, Homo sapiens
tcagagccagtgaag

SEQ ID NO: 1049027 - DNA, 16 bp, Homo sapiens
tcagagcccccagccc

SEQ ID NO: 1049028 - DNA, 19 bp, Homo sapiens
tcagagcccccagccctgg

SEQ ID NO: 1049029 - DNA, 20 bp, Homo sapiens
tcagagcccccagccctggg

SEQ ID NO: 1049030 - DNA, 18 bp, Homo sapiens
tcagagccctggctgggt

SEQ ID NO: 1049031 - DNA, 20 bp, Homo sapiens
tcagagccctggctgggttc

SEQ ID NO: 1049032 - DNA, 18 bp, Homo sapiens
tcagagcctgacctgaga

SEQ ID NO: 1049033 - DNA, 22 bp, Homo sapiens
tcagagccttccatgacctccc

SEQ ID NO: 1049034 - DNA, 19 bp, Homo sapiens
tcagagcgccaggaagcca

SEQ ID NO: 1049035 - DNA, 22 bp, Homo sapiens
tcagagcgccaggaagccagag

SEQ ID NO: 1049036 - DNA, 21 bp, Homo sapiens
tcagagctaagggtgggtgct

SEQ ID NO: 1049037 - DNA, 14 bp, Homo sapiens
tcagagctttgtca

SEQ ID NO: 1049038 - DNA, 17 bp, Homo sapiens
tcagagctttgtcactt

SEQ ID NO: 1049039 - DNA, 23 bp, Homo sapiens
tttgtagcataactgtagctcaa

SEQ ID NO: 1049040 - DNA, 20 bp, Homo sapiens
tttgtaggctgttccctttg

SEQ ID NO: 1049041 - DNA, 19 bp, Homo sapiens
tttgtagtagcgtttttta

SEQ ID NO: 1049042 - DNA, 16 bp, Homo sapiens
tttgtagtgaaataat

SEQ ID NO: 1049043 - DNA, 14 bp, Homo sapiens
tttgtataaaaagg

SEQ ID NO: 1049044 - DNA, 15 bp, Homo sapiens
tttgtataaaaagga

SEQ ID NO: 1049045 - DNA, 20 bp, Homo sapiens
tttgtataaaagtgtgaaat

SEQ ID NO: 1049046 - DNA, 19 bp, Homo sapiens
tttgtataaaatccataga

SEQ ID NO: 1049047 - DNA, 20 bp, Homo sapiens
tttgtataaatgacaaagtg

SEQ ID NO: 1049048 - DNA, 18 bp, Homo sapiens
tttgtataacttcttaaa

SEQ ID NO: 1049049 - DNA, 19 bp, Homo sapiens
tttgtataacttttgatga

SEQ ID NO: 1049050 - DNA, 13 bp, Homo sapiens
tttgtataattgg

SEQ ID NO: 1049051 - DNA, 17 bp, Homo sapiens
tttgtatagtaaagtga

SEQ ID NO: 1049052 - DNA, 21 bp, Homo sapiens
tttgtatagtattggaaaata

SEQ ID NO: 1049053 - DNA, 13 bp, Homo sapiens
tttgtatatccta

SEQ ID NO: 1049054 - DNA, 17 bp, Homo sapiens
tttgtatatttgcaaac

SEQ ID NO: 1049055 - DNA, 17 bp, Homo sapiens
tttgttataccatttcc

SEQ ID NO: 1049056 - DNA, 16 bp, Homo sapiens
tttgttatacttcaaa

SEQ ID NO: 1049057 - DNA, 13 bp, Homo sapiens
tttgttatagatt

SEQ ID NO: 1049058 - DNA, 12 bp, Homo sapiens
tttgttatgaca

SEQ ID NO: 1049059 - DNA, 12 bp, Homo sapiens
tttgttattcct

SEQ ID NO: 1049060 - DNA, 17 bp, Homo sapiens
tttgttatttacactgg

SEQ ID NO: 1049061 - DNA, 15 bp, Homo sapiens
tttgttcaaagttgt

SEQ ID NO: 1049062 - DNA, 16 bp, Homo sapiens
tttgttcaatgttcca

SEQ ID NO: 1049063 - DNA, 18 bp, Homo sapiens
tttgttcaatgttccatt

SEQ ID NO: 1049064 - DNA, 21 bp, Homo sapiens
tttgttcaatgttccattctt

SEQ ID NO: 1049065 - DNA, 19 bp, Homo sapiens
tttgttcactgaaggtgat

SEQ ID NO: 1049066 - DNA, 20 bp, Homo sapiens
tttgttcgcatggtcacaca

SEQ ID NO: 1049067 - DNA, 14 bp, Homo sapiens
tttgttctacatga

SEQ ID NO: 1049068 - DNA, 21 bp, Homo sapiens
tttgttctctgaattttcaga

SEQ ID NO: 1049069 - DNA, 16 bp, Homo sapiens
tttgttctgttctggg

SEQ ID NO: 1049070 - DNA, 15 bp, Homo sapiens
tttgttgaagtttga

SEQ ID NO: 1049071 - DNA, 20 bp, Homo sapiens
tttgttgacattctgaatgc

SEQ ID NO: 1049072 - DNA, 23 bp, Homo sapiens
tttgttgagctggtaacatcgtt

SEQ ID NO: 1049073 - DNA, 14 bp, Homo sapiens
tttgttgccccaga

SEQ ID NO: 1049074 - DNA, 19 bp, Homo sapiens
tttgttggagtgtttctaa

SEQ ID NO: 1049075 - DNA, 12 bp, Homo sapiens
tttgttgtaaaa

SEQ ID NO: 1049076 - DNA, 12 bp, Homo sapiens
tttgttgtagat

SEQ ID NO: 1049077 - DNA, 15 bp, Homo sapiens
tttgttgtcagctga

SEQ ID NO: 1049078 - DNA, 13 bp, Homo sapiens
tttgttgtgactt

SEQ ID NO: 1049079 - DNA, 22 bp, Homo sapiens
tttgttgtggccaatgtcgaaa

SEQ ID NO: 1049080 - DNA, 15 bp, Homo sapiens
tttgttgtgtgtgca

SEQ ID NO: 1049081 - DNA, 15 bp, Homo sapiens
tttgttgtgttctgt

SEQ ID NO: 1049082 - DNA, 18 bp, Homo sapiens
tttgttgtgttctgttga

SEQ ID NO: 1049083 - DNA, 12 bp, Homo sapiens
tttgttgtttat

SEQ ID NO: 1049084 - DNA, 14 bp, Homo sapiens
tttgtttaaaattc

SEQ ID NO: 1049085 - DNA, 17 bp, Homo sapiens
tttgtttaaagaataaa

SEQ ID NO: 1049086 - DNA, 14 bp, Homo sapiens
tttgtttaactttt

SEQ ID NO: 1049087 - DNA, 22 bp, Homo sapiens
tttgtttaatttttatttcttc

SEQ ID NO: 1049088 - DNA, 11 bp, Homo sapiens
tttgtttagaa

SEQ ID NO: 1049089 - DNA, 13 bp, Homo sapiens
tttgtttatgcat

SEQ ID NO: 1049090 - DNA, 14 bp, Homo sapiens
tttgtttatgcata

SEQ ID NO: 1049091 - DNA, 18 bp, Homo sapiens
tttgtttcaaagggattg

SEQ ID NO: 1049092 - DNA, 21 bp, Homo sapiens
tttgtttcaagaacctggaaa

SEQ ID NO: 1049093 - DNA, 17 bp, Homo sapiens
tttgtttcaatgaggtg

SEQ ID NO: 1049094 - DNA, 14 bp, Homo sapiens
tttgtttcctttgt

SEQ ID NO: 1049095 - DNA, 16 bp, Homo sapiens
tttgtttctgaaaatt

SEQ ID NO: 1049096 - DNA, 13 bp, Homo sapiens
tttgtttctgtat

SEQ ID NO: 1049097 - DNA, 12 bp, Homo sapiens
tttgtttcttct

SEQ ID NO: 1049098 - DNA, 14 bp, Homo sapiens
tttgtttcttcttt

SEQ ID NO: 1049099 - DNA, 14 bp, Homo sapiens
tttgtttgaactga

SEQ ID NO: 1049100 - DNA, 11 bp, Homo sapiens
tttgtttgctt

SEQ ID NO: 1049101 - DNA, 14 bp, Homo sapiens
tttgttttcaagat

SEQ ID NO: 1049102 - DNA, 20 bp, Homo sapiens
tttgttttcacactgataca

SEQ ID NO: 1049103 - DNA, 13 bp, Homo sapiens
tttgttttcttaa

SEQ ID NO: 1049104 - DNA, 13 bp, Homo sapiens
tttgttttctttg

SEQ ID NO: 1049105 - DNA, 14 bp, Homo sapiens
tttgttttgaaagt

SEQ ID NO: 1049106 - DNA, 14 bp, Homo sapiens
tttgttttgttgga

SEQ ID NO: 1049107 - DNA, 18 bp, Homo sapiens
tttgtttttaaaatagaa

SEQ ID NO: 1049108 - DNA, 20 bp, Homo sapiens
tttgtttttaaactgtacag

SEQ ID NO: 1049109 - DNA, 16 bp, Homo sapiens
tttgtttttattttca

SEQ ID NO: 1049110 - DNA, 14 bp, Homo sapiens
tttgtttttcattc

SEQ ID NO: 1049111 - DNA, 13 bp, Homo sapiens
tttgtttttctca

SEQ ID NO: 1049112 - DNA, 14 bp, Homo sapiens
tttgtttttctcac

SEQ ID NO: 1049113 - DNA, 18 bp, Homo sapiens
tttgtttttgcatgaaat

SEQ ID NO: 1049114 - DNA, 13 bp, Homo sapiens
tttgtttttgctt

SEQ ID NO: 1049115 - DNA, 16 bp, Homo sapiens
tttgttttttgtaact

SEQ ID NO: 1049116 - DNA, 17 bp, Homo sapiens
tttgttttttgtaacta

SEQ ID NO: 1049117 - DNA, 21 bp, Homo sapiens
tttgttttttgtaactacaaa

SEQ ID NO: 1049118 - DNA, 22 bp, Homo sapiens
tttgtttttttccaactgtgtt

SEQ ID NO: 1049119 - DNA, 21 bp, Homo sapiens
ttttaaaaaagcttaaaactt

SEQ ID NO: 1049120 - DNA, 21 bp, Homo sapiens
ttttaaaaaagggagtttttg

SEQ ID NO: 1049121 - DNA, 23 bp, Homo sapiens
ttttaaaaaataccattgaaatc

SEQ ID NO: 1049122 - DNA, 18 bp, Homo sapiens
ttttaaaaaatattttct

SEQ ID NO: 1049123 - DNA, 16 bp, Homo sapiens
ttttaaaaaatggtca

SEQ ID NO: 1049124 - DNA, 17 bp, Homo sapiens
ttttaaaaaatggtcac

SEQ ID NO: 1049125 - DNA, 14 bp, Homo sapiens
ttttaaaaactctt

SEQ ID NO: 1049126 - DNA, 18 bp, Homo sapiens
ttttaaaaactcttcagt

SEQ ID NO: 1049127 - DNA, 17 bp, Homo sapiens
ttttaaaaaggtaaatg

SEQ ID NO: 1049128 - DNA, 21 bp, Homo sapiens
ttttaaaaaggtaaatggtta

SEQ ID NO: 1049129 - DNA, 16 bp, Homo sapiens
ttttaaaaatacatat

SEQ ID NO: 1049130 - DNA, 17 bp, Homo sapiens
ttttaaaaatagacact

SEQ ID NO: 1049131 - DNA, 20 bp, Homo sapiens
ttttaaaaattgttaatttt

SEQ ID NO: 1049132 - DNA, 19 bp, Homo sapiens
ttttaaaacactaaaagca

SEQ ID NO: 1049133 - DNA, 16 bp, Homo sapiens
ttttaaaacacttcca

SEQ ID NO: 1049134 - DNA, 15 bp, Homo sapiens
ttttaaaagacaaga

SEQ ID NO: 1049135 - DNA, 22 bp, Homo sapiens
ttttaaaaggcagattaaaagc

SEQ ID NO: 1049136 - DNA, 13 bp, Homo sapiens
ttttaaaagtttc

SEQ ID NO: 1049137 - DNA, 15 bp, Homo sapiens
ttttaaaagtttcaa

SEQ ID NO: 1049138 - DNA, 22 bp, Homo sapiens
ttttaaaagtttcaatgtgatt

SEQ ID NO: 1049139 - DNA, 23 bp, Homo sapiens
ttttaaaagttttgaaggaaacc

SEQ ID NO: 1049140 - DNA, 15 bp, Homo sapiens
ttttaaaataagtct

SEQ ID NO: 1049141 - DNA, 16 bp, Homo sapiens
ttttaaaatagaaatt

SEQ ID NO: 1049142 - DNA, 20 bp, Homo sapiens
ttttaaaatatcctgtaact

SEQ ID NO: 1049143 - DNA, 21 bp, Homo sapiens
ttttaaaatatcctgtaacta

SEQ ID NO: 1049144 - DNA, 17 bp, Homo sapiens
ttttaaaatatttaact

SEQ ID NO: 1049145 - DNA, 20 bp, Homo sapiens
ttttaaaatatttaactttt

SEQ ID NO: 1049146 - DNA, 16 bp, Homo sapiens
ttttaaaatctgattt

SEQ ID NO: 1049147 - DNA, 19 bp, Homo sapiens
ttttaaaatgagagtcact

SEQ ID NO: 1049148 - DNA, 14 bp, Homo sapiens
ttttaaacaaaata

SEQ ID NO: 1049149 - DNA, 16 bp, Homo sapiens
ttttaaacaaaataga

SEQ ID NO: 1049150 - DNA, 20 bp, Homo sapiens
ttttaaacaaaatagaagct

SEQ ID NO: 1049151 - DNA, 13 bp, Homo sapiens
ttttaaacagtga

SEQ ID NO: 1049152 - DNA, 15 bp, Homo sapiens
ttttaaacatgtaaa

SEQ ID NO: 1049153 - DNA, 21 bp, Homo sapiens
ttttaaaccaaaacaccccaa

SEQ ID NO: 1049154 - DNA, 17 bp, Homo sapiens
ttttaaacgtggattgt

SEQ ID NO: 1049155 - DNA, 21 bp, Homo sapiens
ttttaaactaagatctgttaa

SEQ ID NO: 1049156 - DNA, 22 bp, Homo sapiens
ttttaaactaagatctgttaaa

SEQ ID NO: 1049157 - DNA, 13 bp, Homo sapiens
ttttaaactgtgt

SEQ ID NO: 1049158 - DNA, 20 bp, Homo sapiens
ttttaaactgtgtacataac

SEQ ID NO: 1049159 - DNA, 14 bp, Homo sapiens
ttttaaacttgaaa

SEQ ID NO: 1049160 - DNA, 23 bp, Homo sapiens
ttttaaagaaaaaaattgaaatg

SEQ ID NO: 1049161 - DNA, 18 bp, Homo sapiens
ttttaaagaaaagatgaa

SEQ ID NO: 1049162 - DNA, 19 bp, Homo sapiens
ttttaaagaaaagatgaaa

SEQ ID NO: 1049163 - DNA, 17 bp, Homo sapiens
ttttaaagaatgctctt

SEQ ID NO: 1049164 - DNA, 12 bp, Homo sapiens
ttttaaagaatt

SEQ ID NO: 1049165 - DNA, 22 bp, Homo sapiens
ttttaaagacccaacttgccaa

SEQ ID NO: 1049166 - DNA, 15 bp, Homo sapiens
ttttaaagatctgta

SEQ ID NO: 1049167 - DNA, 11 bp, Homo sapiens
ttttaaagatt

SEQ ID NO: 1049168 - DNA, 15 bp, Homo sapiens
ttttaaagcctggct

SEQ ID NO: 1049169 - DNA, 17 bp, Homo sapiens
ttttaaagcctggcttc

SEQ ID NO: 1049170 - DNA, 20 bp, Homo sapiens
ttttaaaggaatgtgaaatt

SEQ ID NO: 1049171 - DNA, 17 bp, Homo sapiens
tcagcagttgacatcca

SEQ ID NO: 1049172 - DNA, 23 bp, Homo sapiens
tcagcatagcctgcctgatccct

SEQ ID NO: 1049173 - DNA, 22 bp, Homo sapiens
tcagcatatttgtatagttgct

SEQ ID NO: 1049174 - DNA, 23 bp, Homo sapiens
tcagcatatttgtatagttgctt

SEQ ID NO: 1049175 - DNA, 12 bp, Homo sapiens
tcagcatgacaa

SEQ ID NO: 1049176 - DNA, 14 bp, Homo sapiens
tcagcatgacaaaa

SEQ ID NO: 1049177 - DNA, 22 bp, Homo sapiens
tcagcatgacaaaaataacact

SEQ ID NO: 1049178 - DNA, 15 bp, Homo sapiens
tcaggccaggtgggc

SEQ ID NO: 1049179 - DNA, 16 bp, Homo sapiens
tcaggcccagctgctc

SEQ ID NO: 1049180 - DNA, 15 bp, Homo sapiens
ttttactccagtggt

SEQ ID NO: 1049181 - DNA, 13 bp, Homo sapiens
ttttactcccctt

SEQ ID NO: 1049182 - DNA, 12 bp, Homo sapiens
ttttactctgcc

SEQ ID NO: 1049183 - DNA, 16 bp, Homo sapiens
ttttactctgcctaca

SEQ ID NO: 1049184 - DNA, 14 bp, Homo sapiens
ttttactgaacaat

SEQ ID NO: 1049185 - DNA, 15 bp, Homo sapiens
ttttactttggttta

SEQ ID NO: 1049186 - DNA, 22 bp, Homo sapiens
ttttagaaaaacatttaaactt

SEQ ID NO: 1049187 - DNA, 19 bp, Homo sapiens
ttttagaaactacaaatat

SEQ ID NO: 1049188 - DNA, 16 bp, Homo sapiens
ttttagaaatgcatat

SEQ ID NO: 1049189 - DNA, 22 bp, Homo sapiens
ttttagaaatgcatatttgcca

SEQ ID NO: 1049190 - DNA, 13 bp, Homo sapiens
ttttagaaattgg

SEQ ID NO: 1049191 - DNA, 11 bp, Homo sapiens
ttttagaacag

SEQ ID NO: 1049192 - DNA, 17 bp, Homo sapiens
ttttagaataagaattt

SEQ ID NO: 1049193 - DNA, 20 bp, Homo sapiens
ttttagaataagaatttgca

SEQ ID NO: 1049194 - DNA, 20 bp, Homo sapiens
ttttagagaatgtgtttcaa

SEQ ID NO: 1049195 - DNA, 19 bp, Homo sapiens
ttttagagcttccaaatgt

SEQ ID NO: 1049196 - DNA, 19 bp, Homo sapiens
ttttagattggttctgttt

SEQ ID NO: 1049197 - DNA, 20 bp, Homo sapiens
ttttagattggttctgtttt

SEQ ID NO: 1049198 - DNA, 11 bp, Homo sapiens
ttttagcatgt

SEQ ID NO: 1049199 - DNA, 21 bp, Homo sapiens
ttttagccatttctccatggg

SEQ ID NO: 1049200 - DNA, 19 bp, Homo sapiens
ttttagcctagttcatcca

SEQ ID NO: 1049201 - DNA, 20 bp, Homo sapiens
ttttagcctcttccctctga

SEQ ID NO: 1049202 - DNA, 20 bp, Homo sapiens
ttttagccttaaatttttgt

SEQ ID NO: 1049203 - DNA, 21 bp, Homo sapiens
ttttagctgatgaacttattc

SEQ ID NO: 1049204 - DNA, 23 bp, Homo sapiens
ttttagctggtgtcagcccctct

SEQ ID NO: 1049205 - DNA, 16 bp, Homo sapiens
ttttaggaaacttgta

SEQ ID NO: 1049206 - DNA, 18 bp, Homo sapiens
ttttaggaagcaagctta

SEQ ID NO: 1049207 - DNA, 13 bp, Homo sapiens
ttttaggaataat

SEQ ID NO: 1049208 - DNA, 18 bp, Homo sapiens
ttttaggaataataaatt

SEQ ID NO: 1049209 - DNA, 14 bp, Homo sapiens
ttttaggacatctt

SEQ ID NO: 1049210 - DNA, 15 bp, Homo sapiens
ttttaggtagaaaaa

SEQ ID NO: 1049211 - DNA, 19 bp, Homo sapiens
ttttaggtgttgattttct

SEQ ID NO: 1049212 - DNA, 16 bp, Homo sapiens
ttttaggttgttacca

SEQ ID NO: 1049213 - DNA, 17 bp, Homo sapiens
ttttagtcactaagact

SEQ ID NO: 1049214 - DNA, 19 bp, Homo sapiens
ttttagtgtgtgcataata

SEQ ID NO: 1049215 - DNA, 22 bp, Homo sapiens
ttttagttatagtgtttaactg

SEQ ID NO: 1049216 - DNA, 14 bp, Homo sapiens
ttttagttggaatg

SEQ ID NO: 1049217 - DNA, 12 bp, Homo sapiens
ttttataaactt

SEQ ID NO: 1049218 - DNA, 14 bp, Homo sapiens
ttttataaacttta

SEQ ID NO: 1049219 - DNA, 17 bp, Homo sapiens
ttttataaactttacct

SEQ ID NO: 1049220 - DNA, 19 bp, Homo sapiens
ttttataaactttaccttt

SEQ ID NO: 1049221 - DNA, 22 bp, Homo sapiens
ttttataaatactgcaaatcag

SEQ ID NO: 1049222 - DNA, 12 bp, Homo sapiens
ttttataaatta

SEQ ID NO: 1049223 - DNA, 13 bp, Homo sapiens
ttttataagaaaa

SEQ ID NO: 1049224 - DNA, 14 bp, Homo sapiens
ttttataagaaaaa

SEQ ID NO: 1049225 - DNA, 14 bp, Homo sapiens
ttttataagaattt

SEQ ID NO: 1049226 - DNA, 15 bp, Homo sapiens
ttttataaggaaact

SEQ ID NO: 1049227 - DNA, 16 bp, Homo sapiens
ttttataatgattcat

SEQ ID NO: 1049228 - DNA, 16 bp, Homo sapiens
ttttataatgttgtat

SEQ ID NO: 1049229 - DNA, 21 bp, Homo sapiens
ttttatacataaacaagacca

SEQ ID NO: 1049230 - DNA, 10 bp, Homo sapiens
ttttatacca

SEQ ID NO: 1049231 - DNA, 13 bp, Homo sapiens
ttttatactcaga

SEQ ID NO: 1049232 - DNA, 17 bp, Homo sapiens
ttttatactccatacat

SEQ ID NO: 1049233 - DNA, 20 bp, Homo sapiens
ttttatactccatacataac

SEQ ID NO: 1049234 - DNA, 13 bp, Homo sapiens
ttttatactcttt

SEQ ID NO: 1049235 - DNA, 15 bp, Homo sapiens
ttttatactgcacag

SEQ ID NO: 1049236 - DNA, 15 bp, Homo sapiens
ttttatactgtacat

SEQ ID NO: 1049237 - DNA, 16 bp, Homo sapiens
ttttatactgtacatg

SEQ ID NO: 1049238 - DNA, 15 bp, Homo sapiens
ttttatactgtactt

SEQ ID NO: 1049239 - DNA, 22 bp, Homo sapiens
ttttatagatgggcaactggct

SEQ ID NO: 1049240 - DNA, 15 bp, Homo sapiens
ttttataggagagat

SEQ ID NO: 1049241 - DNA, 13 bp, Homo sapiens
ttttatatctttt

SEQ ID NO: 1049242 - DNA, 15 bp, Homo sapiens
ttttatatgtaaatg

SEQ ID NO: 1049243 - DNA, 19 bp, Homo sapiens
ttttatatgtgagcgagca

SEQ ID NO: 1049244 - DNA, 9 bp, Homo sapiens
ttttatatt

SEQ ID NO: 1049245 - DNA, 17 bp, Homo sapiens
ttttatattaatgtact

SEQ ID NO: 1049246 - DNA, 18 bp, Homo sapiens
ttttatattacttttgta

SEQ ID NO: 1049247 - DNA, 11 bp, Homo sapiens
ttttatattct

SEQ ID NO: 1049248 - DNA, 21 bp, Homo sapiens
ttttatattgccttatttccc

SEQ ID NO: 1049249 - DNA, 11 bp, Homo sapiens
ttttatattta

SEQ ID NO: 1049250 - DNA, 12 bp, Homo sapiens
ttttatatttaa

SEQ ID NO: 1049251 - DNA, 22 bp, Homo sapiens
ttttatatttcctttatgtgaa

SEQ ID NO: 1049252 - DNA, 12 bp, Homo sapiens
ttttatatttgt

SEQ ID NO: 1049253 - DNA, 14 bp, Homo sapiens
ttttatatttgtag

SEQ ID NO: 1049254 - DNA, 16 bp, Homo sapiens
ttttatattttctatt

SEQ ID NO: 1049255 - DNA, 20 bp, Homo sapiens
ttttatcaattatattatgt

SEQ ID NO: 1049256 - DNA, 19 bp, Homo sapiens
ttttatcatgacatgttat

SEQ ID NO: 1049257 - DNA, 16 bp, Homo sapiens
ttttatcatgcatgtc

SEQ ID NO: 1049258 - DNA, 19 bp, Homo sapiens
ttttatcattttcaaaatg

SEQ ID NO: 1049259 - DNA, 19 bp, Homo sapiens
ttttatcccatttagtgtg

SEQ ID NO: 1049260 - DNA, 17 bp, Homo sapiens
ttttatccctcacctgt

SEQ ID NO: 1049261 - DNA, 18 bp, Homo sapiens
ttttatcgtcactgctta

SEQ ID NO: 1049262 - DNA, 19 bp, Homo sapiens
ttttatcgtcactgcttaa

SEQ ID NO: 1049263 - DNA, 20 bp, Homo sapiens
ttttatctgagttacagaaa

SEQ ID NO: 1049264 - DNA, 18 bp, Homo sapiens
ttttatctggtgcctcct

SEQ ID NO: 1049265 - DNA, 15 bp, Homo sapiens
ttttatctgtttcct

SEQ ID NO: 1049266 - DNA, 18 bp, Homo sapiens
ttttatgaacattgtact

SEQ ID NO: 1049267 - DNA, 16 bp, Homo sapiens
ttttatgcacagccta

SEQ ID NO: 1049268 - DNA, 24 bp, Homo sapiens
ttttatgcagaagcatattttgct

SEQ ID NO: 1049269 - DNA, 18 bp, Homo sapiens
ttttatgcagacagtctg

SEQ ID NO: 1049270 - DNA, 18 bp, Homo sapiens
ttttatggcatgatttat

SEQ ID NO: 1049271 - DNA, 22 bp, Homo sapiens
ttttatggcatgatttatatat

SEQ ID NO: 1049272 - DNA, 19 bp, Homo sapiens
ttttatggcttttgtgcat

SEQ ID NO: 1049273 - DNA, 21 bp, Homo sapiens
ttttatggcttttgtgcatta

SEQ ID NO: 1049274 - DNA, 17 bp, Homo sapiens
ttttatggttacttctt

SEQ ID NO: 1049275 - DNA, 19 bp, Homo sapiens
ttttatgtacaaccctgac

SEQ ID NO: 1049276 - DNA, 12 bp, Homo sapiens
ttttatgtgaga

SEQ ID NO: 1049277 - DNA, 15 bp, Homo sapiens
ttttatgtggtctta

SEQ ID NO: 1049278 - DNA, 23 bp, Homo sapiens
ttttatgttaaaaagaaatccag

SEQ ID NO: 1049279 - DNA, 15 bp, Homo sapiens
ttttatgttgatctg

SEQ ID NO: 1049280 - DNA, 19 bp, Homo sapiens
ttttattaaaatatttcag

SEQ ID NO: 1049281 - DNA, 22 bp, Homo sapiens
ttttattaagctttttggaatc

SEQ ID NO: 1049282 - DNA, 13 bp, Homo sapiens
ttttattaatgca

SEQ ID NO: 1049283 - DNA, 19 bp, Homo sapiens
ttttattacagaaatgttt

SEQ ID NO: 1049284 - DNA, 23 bp, Homo sapiens
ttttattatcagttaaaatcaca

SEQ ID NO: 1049285 - DNA, 18 bp, Homo sapiens
ttttattcctgtatgttg

SEQ ID NO: 1049286 - DNA, 19 bp, Homo sapiens
ttttattcggcatttaact

SEQ ID NO: 1049287 - DNA, 14 bp, Homo sapiens
ttttattctgactt

SEQ ID NO: 1049288 - DNA, 14 bp, Homo sapiens
ttttattctgtttt

SEQ ID NO: 1049289 - DNA, 13 bp, Homo sapiens
ttttattcttttt

SEQ ID NO: 1049290 - DNA, 14 bp, Homo sapiens
ttttattggggaat

SEQ ID NO: 1049291 - DNA, 14 bp, Homo sapiens
ttttattgttttca

SEQ ID NO: 1049292 - DNA, 19 bp, Homo sapiens
ttttatttagttgaaaaat

SEQ ID NO: 1049293 - DNA, 14 bp, Homo sapiens
ttttatttcaatgt

SEQ ID NO: 1049294 - DNA, 14 bp, Homo sapiens
ttttatttcattgg

SEQ ID NO: 1049295 - DNA, 15 bp, Homo sapiens
ttttatttctgattt

SEQ ID NO: 1049296 - DNA, 11 bp, Homo sapiens
ttttattttat

SEQ ID NO: 1049297 - DNA, 15 bp, Homo sapiens
ttttattttgctgag

SEQ ID NO: 1049298 - DNA, 15 bp, Homo sapiens
ttttattttggaatt

SEQ ID NO: 1049299 - DNA, 12 bp, Homo sapiens
ttttatttttga

SEQ ID NO: 1049300 - DNA, 14 bp, Homo sapiens
ttttcaaaagaaag

SEQ ID NO: 1049301 - DNA, 14 bp, Homo sapiens
gccatcttcccagc

SEQ ID NO: 1049302 - DNA, 20 bp, Homo sapiens
gccatcttctccccgaggct

SEQ ID NO: 1049303 - DNA, 23 bp, Homo sapiens
gccatcttctccccgaggctgcc

SEQ ID NO: 1049304 - DNA, 17 bp, Homo sapiens
gccatcttcttccctta

SEQ ID NO: 1049305 - DNA, 21 bp, Homo sapiens
gccatgaaccaaatggttctt

SEQ ID NO: 1049306 - DNA, 15 bp, Homo sapiens
gccatgaagggaccc

SEQ ID NO: 1049307 - DNA, 20 bp, Homo sapiens
gccatgaagtcaccgggatg

SEQ ID NO: 1049308 - DNA, 20 bp, Homo sapiens
gccatgaatctctgcctctc

SEQ ID NO: 1049309 - DNA, 21 bp, Homo sapiens
gccatgaatctctgcctctcc

SEQ ID NO: 1049310 - DNA, 19 bp, Homo sapiens
gccatgacatttcatctgg

SEQ ID NO: 1049311 - DNA, 21 bp, Homo sapiens
gccatgagactgatccctggc

SEQ ID NO: 1049312 - DNA, 23 bp, Homo sapiens
gccatgagctccagacccccagc

SEQ ID NO: 1049313 - DNA, 16 bp, Homo sapiens
gccatgaggcctcagt

SEQ ID NO: 1049314 - DNA, 21 bp, Homo sapiens
gccatgataagaacagagtgc

SEQ ID NO: 1049315 - DNA, 20 bp, Homo sapiens
gccatgatgtccttggactc

SEQ ID NO: 1049316 - DNA, 20 bp, Homo sapiens
gccatgattcgcccaaagcc

SEQ ID NO: 1049317 - DNA, 14 bp, Homo sapiens
gccatgatttgtcc

SEQ ID NO: 1049318 - DNA, 19 bp, Homo sapiens
gccatgatttgtcccagcc

SEQ ID NO: 1049319 - DNA, 21 bp, Homo sapiens
gccatgatttgtcccagcctg

SEQ ID NO: 1049320 - DNA, 23 bp, Homo sapiens
gccatgatttttggtatttatgt

SEQ ID NO: 1049321 - DNA, 14 bp, Homo sapiens
gccatgcagacctc

SEQ ID NO: 1049322 - DNA, 20 bp, Homo sapiens
gccatgcagacctcatgccc

SEQ ID NO: 1049323 - DNA, 22 bp, Homo sapiens
gccatgcagacctcatgcccag

SEQ ID NO: 1049324 - DNA, 23 bp, Homo sapiens
gccatgcagacctcatgcccagc

SEQ ID NO: 1049325 - DNA, 14 bp, Homo sapiens
gccatgcaggaggt

SEQ ID NO: 1049326 - DNA, 17 bp, Homo sapiens
gccatgcaggaggtgga

SEQ ID NO: 1049327 - DNA, 13 bp, Homo sapiens
gccatgccactgc

SEQ ID NO: 1049328 - DNA, 17 bp, Homo sapiens
gccatgccactgccagg

SEQ ID NO: 1049329 - DNA, 21 bp, Homo sapiens
gccatgccactgccaggcacc

SEQ ID NO: 1049330 - DNA, 23 bp, Homo sapiens
gccatgccactgccaggcacctg

SEQ ID NO: 1049331 - DNA, 19 bp, Homo sapiens
gccatgccccacccccctc

SEQ ID NO: 1049332 - DNA, 13 bp, Homo sapiens
gccatgcctcatg

SEQ ID NO: 1049333 - DNA, 16 bp, Homo sapiens
gccatgcctcatgcca

SEQ ID NO: 1049334 - DNA, 12 bp, Homo sapiens
gccatgcctccc

SEQ ID NO: 1049335 - DNA, 15 bp, Homo sapiens
gccatgcgaggggcc

SEQ ID NO: 1049336 - DNA, 23 bp, Homo sapiens
gccatgcgaggggccagcagagg

SEQ ID NO: 1049337 - DNA, 15 bp, Homo sapiens
gccatgctacagtta

SEQ ID NO: 1049338 - DNA, 19 bp, Homo sapiens
gccatgctcaacccccctc

SEQ ID NO: 1049339 - DNA, 22 bp, Homo sapiens
gccatgctgggccactggggac

SEQ ID NO: 1049340 - DNA, 17 bp, Homo sapiens
gccatgctttttggtga

SEQ ID NO: 1049341 - DNA, 14 bp, Homo sapiens
gccatggaaggtgc

SEQ ID NO: 1049342 - DNA, 16 bp, Homo sapiens
gccatggaaggtgcca

SEQ ID NO: 1049343 - DNA, 23 bp, Homo sapiens
gccatggaaggtgccagaaggaa

SEQ ID NO: 1049344 - DNA, 19 bp, Homo sapiens
gccatggaattccctcctg

SEQ ID NO: 1049345 - DNA, 17 bp, Homo sapiens
gccatggacgaatatga

SEQ ID NO: 1049346 - DNA, 18 bp, Homo sapiens
gccatggactctacactg

SEQ ID NO: 1049347 - DNA, 22 bp, Homo sapiens
gccatggactctacactgtgaa

SEQ ID NO: 1049348 - DNA, 12 bp, Homo sapiens
gccatggccccc

SEQ ID NO: 1049349 - DNA, 19 bp, Homo sapiens
gccatggccccccactccc

SEQ ID NO: 1049350 - DNA, 21 bp, Homo sapiens
gccatggccccccactccccc

SEQ ID NO: 1049351 - DNA, 14 bp, Homo sapiens
gccatggcctctgc

SEQ ID NO: 1049352 - DNA, 17 bp, Homo sapiens
gccatggcgtgtccctc

SEQ ID NO: 1049353 - DNA, 14 bp, Homo sapiens
gccatggctcaggc

SEQ ID NO: 1049354 - DNA, 15 bp, Homo sapiens
gccatggctcaggca

SEQ ID NO: 1049355 - DNA, 15 bp, Homo sapiens
gccatgggaacctca

SEQ ID NO: 1049356 - DNA, 15 bp, Homo sapiens
gccatgggcctgctg

SEQ ID NO: 1049357 - DNA, 13 bp, Homo sapiens
gccatgggcctgg

SEQ ID NO: 1049358 - DNA, 14 bp, Homo sapiens
gccatgggcctggg

SEQ ID NO: 1049359 - DNA, 15 bp, Homo sapiens
gccatgggcctgggc

SEQ ID NO: 1049360 - DNA, 17 bp, Homo sapiens
gccatgggcctgggcct

SEQ ID NO: 1049361 - DNA, 21 bp, Homo sapiens
gccatgggcctgggcctgctt

SEQ ID NO: 1049362 - DNA, 16 bp, Homo sapiens
gccatggggtccatcc

SEQ ID NO: 1049363 - DNA, 17 bp, Homo sapiens
gccatgggtgcagaccc

SEQ ID NO: 1049364 - DNA, 11 bp, Homo sapiens
gccatggtgga

SEQ ID NO: 1049365 - DNA, 17 bp, Homo sapiens
gccatgtacctcccctg

SEQ ID NO: 1049366 - DNA, 17 bp, Homo sapiens
gccatgtactagtttta

SEQ ID NO: 1049367 - DNA, 23 bp, Homo sapiens
gccatgtagccacccaactttgt

SEQ ID NO: 1049368 - DNA, 14 bp, Homo sapiens
gccatgtcacctgg

SEQ ID NO: 1049369 - DNA, 23 bp, Homo sapiens
gccatgtcacctggctgctaggc

SEQ ID NO: 1049370 - DNA, 14 bp, Homo sapiens
gccatgtcagacac

SEQ ID NO: 1049371 - DNA, 17 bp, Homo sapiens
gccatgtgaagagggag

SEQ ID NO: 1049372 - DNA, 14 bp, Homo sapiens
gccatgtgagccac

SEQ ID NO: 1049373 - DNA, 23 bp, Homo sapiens
gccatgtggcctgcccagcctca

SEQ ID NO: 1049374 - DNA, 18 bp, Homo sapiens
gccatgtggggttgctga

SEQ ID NO: 1049375 - DNA, 21 bp, Homo sapiens
gccatgtttagattccaggat

SEQ ID NO: 1049376 - DNA, 18 bp, Homo sapiens
gccatgtttttcccctgc

SEQ ID NO: 1049377 - DNA, 17 bp, Homo sapiens
gccatgtttttgccaaa

SEQ ID NO: 1049378 - DNA, 12 bp, Homo sapiens
gccattaaaata

SEQ ID NO: 1049379 - DNA, 18 bp, Homo sapiens
gccattaaaataaaacaa

SEQ ID NO: 1049380 - DNA, 13 bp, Homo sapiens
gccattaccccat

SEQ ID NO: 1049381 - DNA, 16 bp, Homo sapiens
gccattaccccatacc

SEQ ID NO: 1049382 - DNA, 17 bp, Homo sapiens
gccattagagcacagct

SEQ ID NO: 1049383 - DNA, 16 bp, Homo sapiens
gccattatatttgcat

SEQ ID NO: 1049384 - DNA, 18 bp, Homo sapiens
gccattatgcaaatggag

SEQ ID NO: 1049385 - DNA, 14 bp, Homo sapiens
gccattattatgat

SEQ ID NO: 1049386 - DNA, 22 bp, Homo sapiens
gccattattttctgtcagatga

SEQ ID NO: 1049387 - DNA, 22 bp, Homo sapiens
gccattcacttcataatccagt

SEQ ID NO: 1049388 - DNA, 16 bp, Homo sapiens
gccattccaaaatatt

SEQ ID NO: 1049389 - DNA, 17 bp, Homo sapiens
gccattctgactcatat

SEQ ID NO: 1049390 - DNA, 22 bp, Homo sapiens
gccattctgccgccccctcctg

SEQ ID NO: 1049391 - DNA, 17 bp, Homo sapiens
gccattgaacagctgtg

SEQ ID NO: 1049392 - DNA, 18 bp, Homo sapiens
gccattgaacagctgtga

SEQ ID NO: 1049393 - DNA, 17 bp, Homo sapiens
gccattgccaccaggag

SEQ ID NO: 1049394 - DNA, 15 bp, Homo sapiens
gccattgccaggaga

SEQ ID NO: 1049395 - DNA, 15 bp, Homo sapiens
gccattggcctcttg

SEQ ID NO: 1049396 - DNA, 16 bp, Homo sapiens
gccattggcctcttgt

SEQ ID NO: 1049397 - DNA, 20 bp, Homo sapiens
gccattggctatttaaaact

SEQ ID NO: 1049398 - DNA, 19 bp, Homo sapiens
gccattgtgaaccaatgca

SEQ ID NO: 1049399 - DNA, 18 bp, Homo sapiens
gccattgtggaagacagt

SEQ ID NO: 1049400 - DNA, 11 bp, Homo sapiens
gccatttaaaa

SEQ ID NO: 1049401 - DNA, 18 bp, Homo sapiens
gccatttaaaaagttgta

SEQ ID NO: 1049402 - DNA, 19 bp, Homo sapiens
gccatttatacctttgaaa

SEQ ID NO: 1049403 - DNA, 12 bp, Homo sapiens
gccatttctaaa

SEQ ID NO: 1049404 - DNA, 12 bp, Homo sapiens
gccatttctctg

SEQ ID NO: 1049405 - DNA, 12 bp, Homo sapiens
gccatttcttct

SEQ ID NO: 1049406 - DNA, 23 bp, Homo sapiens
gccatttgcaataacagctgcaa

SEQ ID NO: 1049407 - DNA, 23 bp, Homo sapiens
gccatttgcaccctccgccttca

SEQ ID NO: 1049408 - DNA, 22 bp, Homo sapiens
gccattttaaattttattttta

SEQ ID NO: 1049409 - DNA, 18 bp, Homo sapiens
gccatttttcaaagcaat

SEQ ID NO: 1049410 - DNA, 15 bp, Homo sapiens
gccatttttctgggg

SEQ ID NO: 1049411 - DNA, 22 bp, Homo sapiens
gcccaaacagctgtatttatat

SEQ ID NO: 1049412 - DNA, 14 bp, Homo sapiens
gcccaaacccttaa

SEQ ID NO: 1049413 - DNA, 11 bp, Homo sapiens
gcccaaactcc

SEQ ID NO: 1049414 - DNA, 21 bp, Homo sapiens
gcccaaactccccttccctgg

SEQ ID NO: 1049415 - DNA, 23 bp, Homo sapiens
gcccaaactccccttccctgggg

SEQ ID NO: 1049416 - DNA, 14 bp, Homo sapiens
gcccaaaggcccag

SEQ ID NO: 1049417 - DNA, 16 bp, Homo sapiens
gcccaaaggcccaggg

SEQ ID NO: 1049418 - DNA, 20 bp, Homo sapiens
gcccaaaggggacaggcctc

SEQ ID NO: 1049419 - DNA, 14 bp, Homo sapiens
gcccaaatgatgga

SEQ ID NO: 1049420 - DNA, 14 bp, Homo sapiens
gcccaacctcctga

SEQ ID NO: 1049421 - DNA, 19 bp, Homo sapiens
gcccaactaacagtcaaga

SEQ ID NO: 1049422 - DNA, 22 bp, Homo sapiens
gcccaagaatagatgctgactg

SEQ ID NO: 1049423 - DNA, 20 bp, Homo sapiens
gcccaagagcagagtctggg

SEQ ID NO: 1049424 - DNA, 20 bp, Homo sapiens
gcccaagaggactgagactg

SEQ ID NO: 1049425 - DNA, 14 bp, Homo sapiens
gccaggaagccaga

SEQ ID NO: 1049426 - DNA, 15 bp, Homo sapiens
gccaggaagccagag

SEQ ID NO: 1049427 - DNA, 18 bp, Homo sapiens
gccaggaagccagagccc

SEQ ID NO: 1049428 - DNA, 19 bp, Homo sapiens
gccaggaagccagagcccc

SEQ ID NO: 1049429 - DNA, 20 bp, Homo sapiens
gccaggaagccagagcccca

SEQ ID NO: 1049430 - DNA, 18 bp, Homo sapiens
gccaggacaatgaaatac

SEQ ID NO: 1049431 - DNA, 15 bp, Homo sapiens
gccaggacagcagca

SEQ ID NO: 1049432 - DNA, 19 bp, Homo sapiens
gccaggacagtcagctctc

SEQ ID NO: 1049433 - DNA, 13 bp, Homo sapiens
gccaggaccccaa

SEQ ID NO: 1049434 - DNA, 15 bp, Homo sapiens
gccaggaccccaggt

SEQ ID NO: 1049435 - DNA, 19 bp, Homo sapiens
gccaggacccgccagcccc

SEQ ID NO: 1049436 - DNA, 20 bp, Homo sapiens
gccaggacccgccagccccg

SEQ ID NO: 1049437 - DNA, 22 bp, Homo sapiens
gccaggacccgccagccccgct

SEQ ID NO: 1049438 - DNA, 19 bp, Homo sapiens
gccaggacccgcctgctcc

SEQ ID NO: 1049439 - DNA, 22 bp, Homo sapiens
gccaggactccccaggccaggc

SEQ ID NO: 1049440 - DNA, 19 bp, Homo sapiens
gccaggagaagctcagctg

SEQ ID NO: 1049441 - DNA, 16 bp, Homo sapiens
gccaggagatggcccc

SEQ ID NO: 1049442 - DNA, 23 bp, Homo sapiens
gccaggaggctttaagctccagc

SEQ ID NO: 1049443 - DNA, 23 bp, Homo sapiens
gccaggagggcacagcaggggag

SEQ ID NO: 1049444 - DNA, 14 bp, Homo sapiens
gccaggagtctgtg

SEQ ID NO: 1049445 - DNA, 15 bp, Homo sapiens
gccaggagtctgtgc

SEQ ID NO: 1049446 - DNA, 16 bp, Homo sapiens
gccaggagtctgtgct

SEQ ID NO: 1049447 - DNA, 19 bp, Homo sapiens
gccaggagtctgtgctctt

SEQ ID NO: 1049448 - DNA, 15 bp, Homo sapiens
gccaggagtgccccc

SEQ ID NO: 1049449 - DNA, 17 bp, Homo sapiens
gccaggatccccctctt

SEQ ID NO: 1049450 - DNA, 12 bp, Homo sapiens
gccaggatgccc

SEQ ID NO: 1049451 - DNA, 20 bp, Homo sapiens
gccaggcaccccctggagag

SEQ ID NO: 1049452 - DNA, 15 bp, Homo sapiens
gccaggcacctggcc

SEQ ID NO: 1049453 - DNA, 23 bp, Homo sapiens
gccaggcacctggcctgctggga

SEQ ID NO: 1049454 - DNA, 10 bp, Homo sapiens
gccaggcaga

SEQ ID NO: 1049455 - DNA, 13 bp, Homo sapiens
gccaggcagagct

SEQ ID NO: 1049456 - DNA, 15 bp, Homo sapiens
gccaggcagagctga

SEQ ID NO: 1049457 - DNA, 22 bp, Homo sapiens
gccaggcagatcctctggacac

SEQ ID NO: 1049458 - DNA, 21 bp, Homo sapiens
gccaggcagatctgtgcccca

SEQ ID NO: 1049459 - DNA, 23 bp, Homo sapiens
gccaggcagatctgtgccccatg

SEQ ID NO: 1049460 - DNA, 19 bp, Homo sapiens
gccaggcaggcgggcgcca

SEQ ID NO: 1049461 - DNA, 16 bp, Homo sapiens
gccaggcaggggtggg

SEQ ID NO: 1049462 - DNA, 20 bp, Homo sapiens
gccaggcaggggtgggagag

SEQ ID NO: 1049463 - DNA, 18 bp, Homo sapiens
gccaggcaggtgcctgga

SEQ ID NO: 1049464 - DNA, 20 bp, Homo sapiens
gccaggccacctccagaaac

SEQ ID NO: 1049465 - DNA, 13 bp, Homo sapiens
gccaggccagcct

SEQ ID NO: 1049466 - DNA, 15 bp, Homo sapiens
gccaggccagcctcc

SEQ ID NO: 1049467 - DNA, 19 bp, Homo sapiens
gccaggccagcctccgaga

SEQ ID NO: 1049468 - DNA, 12 bp, Homo sapiens
gccaggccagct

SEQ ID NO: 1049469 - DNA, 12 bp, Homo sapiens
gccaggcccagg

SEQ ID NO: 1049470 - DNA, 14 bp, Homo sapiens
gccaggcccaggcc

SEQ ID NO: 1049471 - DNA, 16 bp, Homo sapiens
gccaggcccaggccag

SEQ ID NO: 1049472 - DNA, 18 bp, Homo sapiens
gccaggcccaggccagcc

SEQ ID NO: 1049473 - DNA, 18 bp, Homo sapiens
gccaggcccatctcaggt

SEQ ID NO: 1049474 - DNA, 23 bp, Homo sapiens
gccaggcccatctcaggtgccac

SEQ ID NO: 1049475 - DNA, 18 bp, Homo sapiens
gccaggcccggggctggc

SEQ ID NO: 1049476 - DNA, 15 bp, Homo sapiens
gccaggcctgcagac

SEQ ID NO: 1049477 - DNA, 15 bp, Homo sapiens
gccaggcctggctgg

SEQ ID NO: 1049478 - DNA, 14 bp, Homo sapiens
gccaggcgagcctg

SEQ ID NO: 1049479 - DNA, 21 bp, Homo sapiens
gccaggcgagcctgactctgt

SEQ ID NO: 1049480 - DNA, 16 bp, Homo sapiens
gccaggcggccctggg

SEQ ID NO: 1049481 - DNA, 17 bp, Homo sapiens
gccaggcggccctgggg

SEQ ID NO: 1049482 - DNA, 18 bp, Homo sapiens
gccaggcggccctgggga

SEQ ID NO: 1049483 - DNA, 19 bp, Homo sapiens
gccaggcggccctggggag

SEQ ID NO: 1049484 - DNA, 20 bp, Homo sapiens
gccaggcgttggtgccactt

SEQ ID NO: 1049485 - DNA, 21 bp, Homo sapiens
gccaggcgttggtgccacttc

SEQ ID NO: 1049486 - DNA, 23 bp, Homo sapiens
gccaggctatggttgccacccca

SEQ ID NO: 1049487 - DNA, 16 bp, Homo sapiens
gccaggctgaccacag

SEQ ID NO: 1049488 - DNA, 18 bp, Homo sapiens
gccaggctgcctggcctt

SEQ ID NO: 1049489 - DNA, 14 bp, Homo sapiens
gccaggctgttgga

SEQ ID NO: 1049490 - DNA, 15 bp, Homo sapiens
gccaggcttgcctgg

SEQ ID NO: 1049491 - DNA, 21 bp, Homo sapiens
gccaggcttgcctgggctggg

SEQ ID NO: 1049492 - DNA, 9 bp, Homo sapiens
gccagggag

SEQ ID NO: 1049493 - DNA, 14 bp, Homo sapiens
gccagggagcttgc

SEQ ID NO: 1049494 - DNA, 10 bp, Homo sapiens
gccagggagg

SEQ ID NO: 1049495 - DNA, 13 bp, Homo sapiens
gccagggaggcag

SEQ ID NO: 1049496 - DNA, 15 bp, Homo sapiens
gccagggaggcagag

SEQ ID NO: 1049497 - DNA, 12 bp, Homo sapiens
gccagggaggcg

SEQ ID NO: 1049498 - DNA, 14 bp, Homo sapiens
gccagggaggcgca

SEQ ID NO: 1049499 - DNA, 18 bp, Homo sapiens
gccagggaggcgcaggga

SEQ ID NO: 1049500 - DNA, 16 bp, Homo sapiens
gccagggcaatgccat

SEQ ID NO: 1049501 - DNA, 17 bp, Homo sapiens
gccagggcaatgccatc

SEQ ID NO: 1049502 - DNA, 13 bp, Homo sapiens
gccagggcagagg

SEQ ID NO: 1049503 - DNA, 21 bp, Homo sapiens
gccagggcagcaagggacctg

SEQ ID NO: 1049504 - DNA, 24 bp, Homo sapiens
gccagggcagcaagggacctgctc

SEQ ID NO: 1049505 - DNA, 19 bp, Homo sapiens
gccagggcagggccccagg

SEQ ID NO: 1049506 - DNA, 14 bp, Homo sapiens
gccagggcagggtc

SEQ ID NO: 1049507 - DNA, 19 bp, Homo sapiens
gccagggccacgctccagc

SEQ ID NO: 1049508 - DNA, 20 bp, Homo sapiens
gccagggccacgctccagct

SEQ ID NO: 1049509 - DNA, 13 bp, Homo sapiens
gccagggccaggg

SEQ ID NO: 1049510 - DNA, 19 bp, Homo sapiens
tccatacctgcccctgcct

SEQ ID NO: 1049511 - DNA, 23 bp, Homo sapiens
tccatagacatcagtattctgcc

SEQ ID NO: 1049512 - DNA, 23 bp, Homo sapiens
tccataggactaccgcaggcccg

SEQ ID NO: 1049513 - DNA, 14 bp, Homo sapiens
tccatataacaatt

SEQ ID NO: 1049514 - DNA, 17 bp, Homo sapiens
tccatatatatgaaatg

SEQ ID NO: 1049515 - DNA, 18 bp, Homo sapiens
tccatatatatgaaatgt

SEQ ID NO: 1049516 - DNA, 20 bp, Homo sapiens
tccatatcagaactgtgcca

SEQ ID NO: 1049517 - DNA, 15 bp, Homo sapiens
tccatatccctgccc

SEQ ID NO: 1049518 - DNA, 19 bp, Homo sapiens
tccatatccctgcccagcc

SEQ ID NO: 1049519 - DNA, 14 bp, Homo sapiens
tccatatcttgcga

SEQ ID NO: 1049520 - DNA, 21 bp, Homo sapiens
tccatatcttgcgaatccaag

SEQ ID NO: 1049521 - DNA, 21 bp, Homo sapiens
tccatcacctgaaacactgga

SEQ ID NO: 1049522 - DNA, 21 bp, Homo sapiens
tccatcagatgtgttcctcca

SEQ ID NO: 1049523 - DNA, 14 bp, Homo sapiens
tccatcaggccact

SEQ ID NO: 1049524 - DNA, 15 bp, Homo sapiens
tccatcagtgcatga

SEQ ID NO: 1049525 - DNA, 22 bp, Homo sapiens
tccatcatttctgtctttaaga

SEQ ID NO: 1049526 - DNA, 13 bp, Homo sapiens
tccatccaaggcc

SEQ ID NO: 1049527 - DNA, 15 bp, Homo sapiens
tccatccacatggga

SEQ ID NO: 1049528 - DNA, 14 bp, Homo sapiens
tccatccatctcca

SEQ ID NO: 1049529 - DNA, 15 bp, Homo sapiens
tccatccccatcggc

SEQ ID NO: 1049530 - DNA, 16 bp, Homo sapiens
tccatccccctgcctc

SEQ ID NO: 1049531 - DNA, 16 bp, Homo sapiens
tccatcccctccctgc

SEQ ID NO: 1049532 - DNA, 17 bp, Homo sapiens
tccatcccctccctgcc

SEQ ID NO: 1049533 - DNA, 18 bp, Homo sapiens
tccatcccctccctgcct

SEQ ID NO: 1049534 - DNA, 22 bp, Homo sapiens
tccatccctaccccctaagagc

SEQ ID NO: 1049535 - DNA, 22 bp, Homo sapiens
tccatccctagaagagcacaga

SEQ ID NO: 1049536 - DNA, 23 bp, Homo sapiens
tccatccctctaatgagactgac

SEQ ID NO: 1049537 - DNA, 21 bp, Homo sapiens
tccatccctgaaatttctcat

SEQ ID NO: 1049538 - DNA, 17 bp, Homo sapiens
tccatccgactgcccct

SEQ ID NO: 1049539 - DNA, 18 bp, Homo sapiens
tccatccgactgcccctg

SEQ ID NO: 1049540 - DNA, 19 bp, Homo sapiens
tccatccgactgcccctgc

SEQ ID NO: 1049541 - DNA, 12 bp, Homo sapiens
tccatcctgcaa

SEQ ID NO: 1049542 - DNA, 19 bp, Homo sapiens
tccatcctgcaaaggccct

SEQ ID NO: 1049543 - DNA, 23 bp, Homo sapiens
tccatcctgcaaaggcccttgtc

SEQ ID NO: 1049544 - DNA, 18 bp, Homo sapiens
tccatcgccatcttcttc

SEQ ID NO: 1049545 - DNA, 22 bp, Homo sapiens
tccatcgccatcttcttccctt

SEQ ID NO: 1049546 - DNA, 16 bp, Homo sapiens
tccatcgtctcatcct

SEQ ID NO: 1049547 - DNA, 19 bp, Homo sapiens
tccatcgtctcatcctcct

SEQ ID NO: 1049548 - DNA, 20 bp, Homo sapiens
tccatcgtctcatcctcctt

SEQ ID NO: 1049549 - DNA, 17 bp, Homo sapiens
tccatctagcagctggc

SEQ ID NO: 1049550 - DNA, 20 bp, Homo sapiens
tccatctcctataatctgtc

SEQ ID NO: 1049551 - DNA, 18 bp, Homo sapiens
tccatctctcatcctcca

SEQ ID NO: 1049552 - DNA, 13 bp, Homo sapiens
tccatctgacaaa

SEQ ID NO: 1049553 - DNA, 13 bp, Homo sapiens
tccatctgtccac

SEQ ID NO: 1049554 - DNA, 13 bp, Homo sapiens
tccatctgtccgt

SEQ ID NO: 1049555 - DNA, 21 bp, Homo sapiens
tccatctgtccgtccagagcc

SEQ ID NO: 1049556 - DNA, 17 bp, Homo sapiens
tccatcttaatgttact

SEQ ID NO: 1049557 - DNA, 18 bp, Homo sapiens
tccatcttggtagttctg

SEQ ID NO: 1049558 - DNA, 21 bp, Homo sapiens
tccatcttggtagttctgtgc

SEQ ID NO: 1049559 - DNA, 21 bp, Homo sapiens
tccatcttgtggggccaggac

SEQ ID NO: 1049560 - DNA, 15 bp, Homo sapiens
tccatctttctacag

SEQ ID NO: 1049561 - DNA, 13 bp, Homo sapiens
tccatctttttct

SEQ ID NO: 1049562 - DNA, 11 bp, Homo sapiens
tccatgaaaac

SEQ ID NO: 1049563 - DNA, 20 bp, Homo sapiens
tccatgaagaccacatccac

SEQ ID NO: 1049564 - DNA, 20 bp, Homo sapiens
tccatgaagagcttgtgtcc

SEQ ID NO: 1049565 - DNA, 15 bp, Homo sapiens
tccatgaaggcagag

SEQ ID NO: 1049566 - DNA, 12 bp, Homo sapiens
tccatgaatgta

SEQ ID NO: 1049567 - DNA, 13 bp, Homo sapiens
tccatgaatgtat

SEQ ID NO: 1049568 - DNA, 16 bp, Homo sapiens
tccatgaatgtatcag

SEQ ID NO: 1049569 - DNA, 21 bp, Homo sapiens
tccatgaatgtatcaggaaat

SEQ ID NO: 1049570 - DNA, 17 bp, Homo sapiens
tccatgaattttaaaat

SEQ ID NO: 1049571 - DNA, 14 bp, Homo sapiens
tccatgagctgctc

SEQ ID NO: 1049572 - DNA, 16 bp, Homo sapiens
tccatgagctgctcat

SEQ ID NO: 1049573 - DNA, 18 bp, Homo sapiens
tccatgaggtactggtcc

SEQ ID NO: 1049574 - DNA, 23 bp, Homo sapiens
tccatgagttttttctcttgggc

SEQ ID NO: 1049575 - DNA, 14 bp, Homo sapiens
tccatgatggaata

SEQ ID NO: 1049576 - DNA, 21 bp, Homo sapiens
tccatgcaccctcatacacag

SEQ ID NO: 1049577 - DNA, 19 bp, Homo sapiens
tccatgcagactcctcaga

SEQ ID NO: 1049578 - DNA, 21 bp, Homo sapiens
tccatgcagggggctcctggg

SEQ ID NO: 1049579 - DNA, 17 bp, Homo sapiens
tccatgccccagctctg

SEQ ID NO: 1049580 - DNA, 19 bp, Homo sapiens
tccatgccccagctctgga

SEQ ID NO: 1049581 - DNA, 15 bp, Homo sapiens
tccatgcccgagtcc

SEQ ID NO: 1049582 - DNA, 14 bp, Homo sapiens
tccatgcctctgga

SEQ ID NO: 1049583 - DNA, 16 bp, Homo sapiens
tccatgcctgagggtg

SEQ ID NO: 1049584 - DNA, 18 bp, Homo sapiens
tccatgcgtgtttctgac

SEQ ID NO: 1049585 - DNA, 19 bp, Homo sapiens
tccatgcgtgtttctgact

SEQ ID NO: 1049586 - DNA, 22 bp, Homo sapiens
tccatgcgtgtttctgactctg

SEQ ID NO: 1049587 - DNA, 20 bp, Homo sapiens
tccatgctgcaaaggagaag

SEQ ID NO: 1049588 - DNA, 20 bp, Homo sapiens
tccatgctggatactggaca

SEQ ID NO: 1049589 - DNA, 21 bp, Homo sapiens
tccatgctggatactggacac

SEQ ID NO: 1049590 - DNA, 20 bp, Homo sapiens
tccatgctgtgcgcccaggg

SEQ ID NO: 1049591 - DNA, 15 bp, Homo sapiens
tccatggaaataaaa

SEQ ID NO: 1049592 - DNA, 22 bp, Homo sapiens
tccatggaaataaaaagtatgt

SEQ ID NO: 1049593 - DNA, 20 bp, Homo sapiens
tccatggccctgtcccaggc

SEQ ID NO: 1049594 - DNA, 20 bp, Homo sapiens
tccatggctaagaccacaga

SEQ ID NO: 1049595 - DNA, 21 bp, Homo sapiens
tccatggctaagaccacagac

SEQ ID NO: 1049596 - DNA, 16 bp, Homo sapiens
tccatggcttcctcct

SEQ ID NO: 1049597 - DNA, 20 bp, Homo sapiens
tccatggcttcctcctccct

SEQ ID NO: 1049598 - DNA, 14 bp, Homo sapiens
tccatggcttcctg

SEQ ID NO: 1049599 - DNA, 22 bp, Homo sapiens
tccatggcttcctgagaaagcc

SEQ ID NO: 1049600 - DNA, 17 bp, Homo sapiens
tccatgggaaagatggt

SEQ ID NO: 1049601 - DNA, 20 bp, Homo sapiens
tccatgggagccagctgctt

SEQ ID NO: 1049602 - DNA, 16 bp, Homo sapiens
tccatgggcagagccc

SEQ ID NO: 1049603 - DNA, 18 bp, Homo sapiens
tccatgggcagagcccaa

SEQ ID NO: 1049604 - DNA, 23 bp, Homo sapiens
tccatgggcagagcccaagggaa

SEQ ID NO: 1049605 - DNA, 18 bp, Homo sapiens
tccatgggcccgctgcct

SEQ ID NO: 1049606 - DNA, 21 bp, Homo sapiens
tccatggtagcccatctctcc

SEQ ID NO: 1049607 - DNA, 14 bp, Homo sapiens
tccatgtactgtag

SEQ ID NO: 1049608 - DNA, 14 bp, Homo sapiens
tccatgtacttgtt

SEQ ID NO: 1049609 - DNA, 18 bp, Homo sapiens
tccatgtacttgtttgca

SEQ ID NO: 1049610 - DNA, 14 bp, Homo sapiens
tccatgtagcagga

SEQ ID NO: 1049611 - DNA, 16 bp, Homo sapiens
tccatgtcgcctctgc

SEQ ID NO: 1049612 - DNA, 19 bp, Homo sapiens
tccatgtcgcctctgcatt

SEQ ID NO: 1049613 - DNA, 18 bp, Homo sapiens
tccatgtgattaatgttt

SEQ ID NO: 1049614 - DNA, 19 bp, Homo sapiens
tccatgtgccccctctacc

SEQ ID NO: 1049615 - DNA, 22 bp, Homo sapiens
tccatgtggagaaaggagtgaa

SEQ ID NO: 1049616 - DNA, 16 bp, Homo sapiens
tccatgttctattttt

SEQ ID NO: 1049617 - DNA, 20 bp, Homo sapiens
tccatgtttattgtttttta

SEQ ID NO: 1049618 - DNA, 14 bp, Homo sapiens
tccattaacagcaa

SEQ ID NO: 1049619 - DNA, 13 bp, Homo sapiens
tccattaatttaa

SEQ ID NO: 1049620 - DNA, 17 bp, Homo sapiens
tccattaatttaaatga

SEQ ID NO: 1049621 - DNA, 14 bp, Homo sapiens
tccattaggatttg

SEQ ID NO: 1049622 - DNA, 14 bp, Homo sapiens
tccattatccttta

SEQ ID NO: 1049623 - DNA, 15 bp, Homo sapiens
tccattcacaagcct

SEQ ID NO: 1049624 - DNA, 18 bp, Homo sapiens
tccattcagaaagcttca

SEQ ID NO: 1049625 - DNA, 12 bp, Homo sapiens
tccattccagaa

SEQ ID NO: 1049626 - DNA, 14 bp, Homo sapiens
tccattcctcaggg

SEQ ID NO: 1049627 - DNA, 15 bp, Homo sapiens
tccattcctcaggga

SEQ ID NO: 1049628 - DNA, 16 bp, Homo sapiens
tccattctcccaggta

SEQ ID NO: 1049629 - DNA, 21 bp, Homo sapiens
tccattcttcagtgtctctgt

SEQ ID NO: 1049630 - DNA, 17 bp, Homo sapiens
tccattcttcttgctac

SEQ ID NO: 1049631 - DNA, 19 bp, Homo sapiens
tcccatgactgcacccagc

SEQ ID NO: 1049632 - DNA, 15 bp, Homo sapiens
tcccatgaggtcttc

SEQ ID NO: 1049633 - DNA, 15 bp, Homo sapiens
tcccatgatccctgt

SEQ ID NO: 1049634 - DNA, 16 bp, Homo sapiens
tcccatgatccctgtg

SEQ ID NO: 1049635 - DNA, 15 bp, Homo sapiens
tcccatgcaggccct

SEQ ID NO: 1049636 - DNA, 12 bp, Homo sapiens
tcccatgccctg

SEQ ID NO: 1049637 - DNA, 13 bp, Homo sapiens
tcccatgcctggt

SEQ ID NO: 1049638 - DNA, 19 bp, Homo sapiens
tcccatgcctggtcccaag

SEQ ID NO: 1049639 - DNA, 19 bp, Homo sapiens
tcccatgcctgtctctgtt

SEQ ID NO: 1049640 - DNA, 15 bp, Homo sapiens
tcccatggacactcc

SEQ ID NO: 1049641 - DNA, 21 bp, Homo sapiens
tcccatggacactccagtgcc

SEQ ID NO: 1049642 - DNA, 12 bp, Homo sapiens
tcccatggctga

SEQ ID NO: 1049643 - DNA, 14 bp, Homo sapiens
tcccatggctgaag

SEQ ID NO: 1049644 - DNA, 18 bp, Homo sapiens
tcccatggctgaagctgg

SEQ ID NO: 1049645 - DNA, 19 bp, Homo sapiens
tcccatggctgaagctgga

SEQ ID NO: 1049646 - DNA, 22 bp, Homo sapiens
tcccatggctgaagctggagca

SEQ ID NO: 1049647 - DNA, 24 bp, Homo sapiens
tcccatggctgaagctggagcagc

SEQ ID NO: 1049648 - DNA, 23 bp, Homo sapiens
tcccatgggcagaggaccaggct

SEQ ID NO: 1049649 - DNA, 21 bp, Homo sapiens
tcccatggggaaaccctggag

SEQ ID NO: 1049650 - DNA, 12 bp, Homo sapiens
tcccatggtgta

SEQ ID NO: 1049651 - DNA, 21 bp, Homo sapiens
tcccatgtagccccctggcct

SEQ ID NO: 1049652 - DNA, 22 bp, Homo sapiens
tcccatgtatttatctctattt

SEQ ID NO: 1049653 - DNA, 15 bp, Homo sapiens
tcccatgtcacctca

SEQ ID NO: 1049654 - DNA, 16 bp, Homo sapiens
tcccatgttgcatgcc

SEQ ID NO: 1049655 - DNA, 20 bp, Homo sapiens
tcccatgttgcatgcctatg

SEQ ID NO: 1049656 - DNA, 21 bp, Homo sapiens
tcccattaggacaatcagtcc

SEQ ID NO: 1049657 - DNA, 23 bp, Homo sapiens
tcccattaggacaatcagtcccc

SEQ ID NO: 1049658 - DNA, 19 bp, Homo sapiens
tcccattattatttctgtt

SEQ ID NO: 1049659 - DNA, 15 bp, Homo sapiens
tcccattccctggga

SEQ ID NO: 1049660 - DNA, 21 bp, Homo sapiens
tcccattcctccactctgtat

SEQ ID NO: 1049661 - DNA, 14 bp, Homo sapiens
tcccattcctccct

SEQ ID NO: 1049662 - DNA, 14 bp, Homo sapiens
tcccattctagatc

SEQ ID NO: 1049663 - DNA, 21 bp, Homo sapiens
tcccattctagatcctgcacc

SEQ ID NO: 1049664 - DNA, 22 bp, Homo sapiens
tcccattctagatcctgcaccc

SEQ ID NO: 1049665 - DNA, 13 bp, Homo sapiens
tcccattctgcac

SEQ ID NO: 1049666 - DNA, 16 bp, Homo sapiens
tcccattctgcaccac

SEQ ID NO: 1049667 - DNA, 17 bp, Homo sapiens
tcccattgtccctctgc

SEQ ID NO: 1049668 - DNA, 18 bp, Homo sapiens
tcccattgtccctctgcc

SEQ ID NO: 1049669 - DNA, 16 bp, Homo sapiens
tcccatttagtgtgaa

SEQ ID NO: 1049670 - DNA, 13 bp, Homo sapiens
tcccatttcctga

SEQ ID NO: 1049671 - DNA, 15 bp, Homo sapiens
tcccatttcctgatc

SEQ ID NO: 1049672 - DNA, 16 bp, Homo sapiens
tcccatttcctgatct

SEQ ID NO: 1049673 - DNA, 18 bp, Homo sapiens
tcccatttcctgatctag

SEQ ID NO: 1049674 - DNA, 16 bp, Homo sapiens
tcccatttctcactga

SEQ ID NO: 1049675 - DNA, 18 bp, Homo sapiens
tcccatttctcactgaga

SEQ ID NO: 1049676 - DNA, 17 bp, Homo sapiens
tcccatttctgttgctg

SEQ ID NO: 1049677 - DNA, 18 bp, Homo sapiens
tcccatttcttgctagct

SEQ ID NO: 1049678 - DNA, 16 bp, Homo sapiens
tcccattttcatcctg

SEQ ID NO: 1049679 - DNA, 19 bp, Homo sapiens
tcccattttcatcctgagc

SEQ ID NO: 1049680 - DNA, 22 bp, Homo sapiens
tcccattttccccttcctcatt

SEQ ID NO: 1049681 - DNA, 13 bp, Homo sapiens
tcccattttgcaa

SEQ ID NO: 1049682 - DNA, 22 bp, Homo sapiens
tcccattttgcaaaatttccag

SEQ ID NO: 1049683 - DNA, 18 bp, Homo sapiens
tcccattttggaagtttt

SEQ ID NO: 1049684 - DNA, 18 bp, Homo sapiens
tcccattttggaatttgc

SEQ ID NO: 1049685 - DNA, 19 bp, Homo sapiens
tccccaaaagcgtgagctt

SEQ ID NO: 1049686 - DNA, 16 bp, Homo sapiens
tccccaaacaggacag

SEQ ID NO: 1049687 - DNA, 22 bp, Homo sapiens
tccccaaacttatggacactgc

SEQ ID NO: 1049688 - DNA, 10 bp, Homo sapiens
tccccaaagt

SEQ ID NO: 1049689 - DNA, 16 bp, Homo sapiens
tccccaaatggctgct

SEQ ID NO: 1049690 - DNA, 18 bp, Homo sapiens
tccccaaatggctgcttt

SEQ ID NO: 1049691 - DNA, 22 bp, Homo sapiens
tccccaacaattggagggtctt

SEQ ID NO: 1049692 - DNA, 16 bp, Homo sapiens
tccccaacacctgcct

SEQ ID NO: 1049693 - DNA, 17 bp, Homo sapiens
tccccaacacctgcctc

SEQ ID NO: 1049694 - DNA, 18 bp, Homo sapiens
tccccaacacctgcctct

SEQ ID NO: 1049695 - DNA, 19 bp, Homo sapiens
tccccaacacctgcctctg

SEQ ID NO: 1049696 - DNA, 20 bp, Homo sapiens
tccccaacacctgcctctga

SEQ ID NO: 1049697 - DNA, 13 bp, Homo sapiens
tccccaaccacag

SEQ ID NO: 1049698 - DNA, 17 bp, Homo sapiens
tccccaaccacagagaa

SEQ ID NO: 1049699 - DNA, 21 bp, Homo sapiens
tccccaacccccattctcatc

SEQ ID NO: 1049700 - DNA, 20 bp, Homo sapiens
tccccaaccctaggttccct

SEQ ID NO: 1049701 - DNA, 18 bp, Homo sapiens
tccccaaccctgcccctg

SEQ ID NO: 1049702 - DNA, 21 bp, Homo sapiens
tccccaacggggtggggaggg

SEQ ID NO: 1049703 - DNA, 11 bp, Homo sapiens
tccccaactcc

SEQ ID NO: 1049704 - DNA, 14 bp, Homo sapiens
tccccaactccatg

SEQ ID NO: 1049705 - DNA, 17 bp, Homo sapiens
tccccaagaaagcctca

SEQ ID NO: 1049706 - DNA, 15 bp, Homo sapiens
tccccaaggatgacc

SEQ ID NO: 1049707 - DNA, 17 bp, Homo sapiens
tccccaaggatgaccac

SEQ ID NO: 1049708 - DNA, 19 bp, Homo sapiens
tccccaatccatgcttcac

SEQ ID NO: 1049709 - DNA, 22 bp, Homo sapiens
tccccaattacagggtgactca

SEQ ID NO: 1049710 - DNA, 18 bp, Homo sapiens
tccccacacacaggcctt

SEQ ID NO: 1049711 - DNA, 21 bp, Homo sapiens
tccccacacacaggccttctg

SEQ ID NO: 1049712 - DNA, 11 bp, Homo sapiens
tccccacacag

SEQ ID NO: 1049713 - DNA, 16 bp, Homo sapiens
tccccacacagcctct

SEQ ID NO: 1049714 - DNA, 15 bp, Homo sapiens
tccccacactccact

SEQ ID NO: 1049715 - DNA, 18 bp, Homo sapiens
tccccacactccactctg

SEQ ID NO: 1049716 - DNA, 22 bp, Homo sapiens
tccccacagactgccccagcca

SEQ ID NO: 1049717 - DNA, 23 bp, Homo sapiens
tccccacagactgccccagccaa

SEQ ID NO: 1049718 - DNA, 19 bp, Homo sapiens
tccccacagcgtccctggc

SEQ ID NO: 1049719 - DNA, 20 bp, Homo sapiens
tccccacagcgtccctggcg

SEQ ID NO: 1049720 - DNA, 18 bp, Homo sapiens
tccccacagctttgcacc

SEQ ID NO: 1049721 - DNA, 12 bp, Homo sapiens
tccccaccagct

SEQ ID NO: 1049722 - DNA, 15 bp, Homo sapiens
tccccaccccagtgg

SEQ ID NO: 1049723 - DNA, 18 bp, Homo sapiens
tccccaccccagtgggaa

SEQ ID NO: 1049724 - DNA, 14 bp, Homo sapiens
tccccacccctacc

SEQ ID NO: 1049725 - DNA, 16 bp, Homo sapiens
tccccacccctgcccc

SEQ ID NO: 1049726 - DNA, 18 bp, Homo sapiens
tccccacccctgccccca

SEQ ID NO: 1049727 - DNA, 15 bp, Homo sapiens
tccccaccctccact

SEQ ID NO: 1049728 - DNA, 12 bp, Homo sapiens
tccccaccctga

SEQ ID NO: 1049729 - DNA, 15 bp, Homo sapiens
tccccacctgtagct

SEQ ID NO: 1049730 - DNA, 18 bp, Homo sapiens
tccccaccttcaattcct

SEQ ID NO: 1049731 - DNA, 22 bp, Homo sapiens
tccccaccttcaattcctgggc

SEQ ID NO: 1049732 - DNA, 20 bp, Homo sapiens
tccccaccttcacctcggag

SEQ ID NO: 1049733 - DNA, 20 bp, Homo sapiens
tccccaccttccccagactc

SEQ ID NO: 1049734 - DNA, 20 bp, Homo sapiens
tccccacgacccctgcctcg

SEQ ID NO: 1049735 - DNA, 21 bp, Homo sapiens
tccccacgacccctgcctcga

SEQ ID NO: 1049736 - DNA, 22 bp, Homo sapiens
tccccacgacccctgcctcgag

SEQ ID NO: 1049737 - DNA, 17 bp, Homo sapiens
tccccacgagggctggc

SEQ ID NO: 1049738 - DNA, 20 bp, Homo sapiens
tccccacgagggctggctgg

SEQ ID NO: 1049739 - DNA, 23 bp, Homo sapiens
tccccacggggcctcgggacctc

SEQ ID NO: 1049740 - DNA, 21 bp, Homo sapiens
tccccactaggttcttttcca

SEQ ID NO: 1049741 - DNA, 14 bp, Homo sapiens
tccccactccaccc

SEQ ID NO: 1049742 - DNA, 15 bp, Homo sapiens
tccccactccaccct

SEQ ID NO: 1049743 - DNA, 17 bp, Homo sapiens
tccccactccaccctgt

SEQ ID NO: 1049744 - DNA, 12 bp, Homo sapiens
tccccactcccg

SEQ ID NO: 1049745 - DNA, 23 bp, Homo sapiens
tccccactcccgaaagcctttcc

SEQ ID NO: 1049746 - DNA, 13 bp, Homo sapiens
tccccactccctt

SEQ ID NO: 1049747 - DNA, 16 bp, Homo sapiens
tccccactcccttggt

SEQ ID NO: 1049748 - DNA, 18 bp, Homo sapiens
tccccactcctctcccac

SEQ ID NO: 1049749 - DNA, 19 bp, Homo sapiens
tccccactgacagcctccc

SEQ ID NO: 1049750 - DNA, 14 bp, Homo sapiens
tccccactgtccta

SEQ ID NO: 1049751 - DNA, 18 bp, Homo sapiens
tccccacttctgtgccac

SEQ ID NO: 1049752 - DNA, 19 bp, Homo sapiens
tccccacttgtccgctggg

SEQ ID NO: 1049753 - DNA, 19 bp, Homo sapiens
tccccagaactggctgggc

SEQ ID NO: 1049754 - DNA, 20 bp, Homo sapiens
tccccagaactggctgggcc

SEQ ID NO: 1049755 - DNA, 17 bp, Homo sapiens
gccagatgattttcctc

SEQ ID NO: 1049756 - DNA, 22 bp, Homo sapiens
gccagatgcacatccctggaag

SEQ ID NO: 1049757 - DNA, 21 bp, Homo sapiens
gccagatgcggggacaggctg

SEQ ID NO: 1049758 - DNA, 22 bp, Homo sapiens
gccagatggactccagcctgcc

SEQ ID NO: 1049759 - DNA, 21 bp, Homo sapiens
gccagatggcccctccactgg

SEQ ID NO: 1049760 - DNA, 16 bp, Homo sapiens
gccagattctgcctct

SEQ ID NO: 1049761 - DNA, 17 bp, Homo sapiens
gccagattctgcctctc

SEQ ID NO: 1049762 - DNA, 18 bp, Homo sapiens
gccagattctgcctctct

SEQ ID NO: 1049763 - DNA, 19 bp, Homo sapiens
gccagattctgcctctctg

SEQ ID NO: 1049764 - DNA, 14 bp, Homo sapiens
gccagatttgtctt

SEQ ID NO: 1049765 - DNA, 15 bp, Homo sapiens
gccagatttgtcttt

SEQ ID NO: 1049766 - DNA, 12 bp, Homo sapiens
gccagatttttt

SEQ ID NO: 1049767 - DNA, 22 bp, Homo sapiens
gccagcaacgcttgtagaactc

SEQ ID NO: 1049768 - DNA, 14 bp, Homo sapiens
gccagcaactgaat

SEQ ID NO: 1049769 - DNA, 16 bp, Homo sapiens
gccagcaactgaataa

SEQ ID NO: 1049770 - DNA, 15 bp, Homo sapiens
gccagcaaggcaggt

SEQ ID NO: 1049771 - DNA, 16 bp, Homo sapiens
gccagcaaggcaggtt

SEQ ID NO: 1049772 - DNA, 14 bp, Homo sapiens
gccagcaataaaaa

SEQ ID NO: 1049773 - DNA, 22 bp, Homo sapiens
gccagcaataaaaactgtctgt

SEQ ID NO: 1049774 - DNA, 23 bp, Homo sapiens
gccagcaatgacatctcaggggc

SEQ ID NO: 1049775 - DNA, 13 bp, Homo sapiens
gccagcacacagg

SEQ ID NO: 1049776 - DNA, 24 bp, Homo sapiens
gccagcacaggggccccagatctg

SEQ ID NO: 1049777 - DNA, 17 bp, Homo sapiens
gccagcaccacagccgg

SEQ ID NO: 1049778 - DNA, 16 bp, Homo sapiens
gccagcaccctctcct

SEQ ID NO: 1049779 - DNA, 19 bp, Homo sapiens
gccagcaccctctcctggg

SEQ ID NO: 1049780 - DNA, 14 bp, Homo sapiens
gccagcacctggca

SEQ ID NO: 1049781 - DNA, 16 bp, Homo sapiens
gccagcacttgtatat

SEQ ID NO: 1049782 - DNA, 19 bp, Homo sapiens
gccagcacttgtccagctg

SEQ ID NO: 1049783 - DNA, 13 bp, Homo sapiens
gccagcagagggc

SEQ ID NO: 1049784 - DNA, 13 bp, Homo sapiens
gccagcagcagca

SEQ ID NO: 1049785 - DNA, 15 bp, Homo sapiens
gccagcagcctcgca

SEQ ID NO: 1049786 - DNA, 23 bp, Homo sapiens
gccagcagcctcgcacaggccct

SEQ ID NO: 1049787 - DNA, 13 bp, Homo sapiens
gccagcaggcctc

SEQ ID NO: 1049788 - DNA, 16 bp, Homo sapiens
gccagcatagggggga

SEQ ID NO: 1049789 - DNA, 22 bp, Homo sapiens
gccagccaagctttaaattatg

SEQ ID NO: 1049790 - DNA, 19 bp, Homo sapiens
gccagccaatccctggcca

SEQ ID NO: 1049791 - DNA, 18 bp, Homo sapiens
gccagccaatttcccgga

SEQ ID NO: 1049792 - DNA, 20 bp, Homo sapiens
gccagccaatttcccggagc

SEQ ID NO: 1049793 - DNA, 21 bp, Homo sapiens
gccagccaatttcccggagcc

SEQ ID NO: 1049794 - DNA, 13 bp, Homo sapiens
gccagccagcagc

SEQ ID NO: 1049795 - DNA, 16 bp, Homo sapiens
gccagccagcagccag

SEQ ID NO: 1049796 - DNA, 15 bp, Homo sapiens
gccagccaggccctg

SEQ ID NO: 1049797 - DNA, 21 bp, Homo sapiens
gccagccagtcttgcctaggc

SEQ ID NO: 1049798 - DNA, 14 bp, Homo sapiens
gccagccagtgcca

SEQ ID NO: 1049799 - DNA, 19 bp, Homo sapiens
gccagcccaaaccttgggc

SEQ ID NO: 1049800 - DNA, 14 bp, Homo sapiens
gccagcccagccag

SEQ ID NO: 1049801 - DNA, 21 bp, Homo sapiens
gccagcccatggcccccaata

SEQ ID NO: 1049802 - DNA, 18 bp, Homo sapiens
gccagccccaagctgggc

SEQ ID NO: 1049803 - DNA, 20 bp, Homo sapiens
gccagccccaagctgggccg

SEQ ID NO: 1049804 - DNA, 15 bp, Homo sapiens
gccagccccacccag

SEQ ID NO: 1049805 - DNA, 17 bp, Homo sapiens
gccagccccacccagga

SEQ ID NO: 1049806 - DNA, 21 bp, Homo sapiens
gccagccccacccccagccag

SEQ ID NO: 1049807 - DNA, 23 bp, Homo sapiens
gccagccccacccccagccaggc

SEQ ID NO: 1049808 - DNA, 13 bp, Homo sapiens
gccagccccccca

SEQ ID NO: 1049809 - DNA, 15 bp, Homo sapiens
gccagcccccccacc

SEQ ID NO: 1049810 - DNA, 22 bp, Homo sapiens
gccagcccccccacccaccccc

SEQ ID NO: 1049811 - DNA, 14 bp, Homo sapiens
gccagccccctcca

SEQ ID NO: 1049812 - DNA, 17 bp, Homo sapiens
gccagccccctccagct

SEQ ID NO: 1049813 - DNA, 20 bp, Homo sapiens
gccagccccctccagctcat

SEQ ID NO: 1049814 - DNA, 21 bp, Homo sapiens
gccagccccctccagctcatg

SEQ ID NO: 1049815 - DNA, 22 bp, Homo sapiens
gccagccccctccagctcatga

SEQ ID NO: 1049816 - DNA, 17 bp, Homo sapiens
gccagccccgctcccac

SEQ ID NO: 1049817 - DNA, 11 bp, Homo sapiens
gccagcccctc

SEQ ID NO: 1049818 - DNA, 20 bp, Homo sapiens
gccagcccctggccccagga

SEQ ID NO: 1049819 - DNA, 14 bp, Homo sapiens
gccagccctccctg

SEQ ID NO: 1049820 - DNA, 15 bp, Homo sapiens
gccagccctccctgt

SEQ ID NO: 1049821 - DNA, 21 bp, Homo sapiens
gccagccctccctgtcctcct

SEQ ID NO: 1049822 - DNA, 23 bp, Homo sapiens
gccagccctccctgtcctcctcg

SEQ ID NO: 1049823 - DNA, 16 bp, Homo sapiens
gccagccctgcagccc

SEQ ID NO: 1049824 - DNA, 14 bp, Homo sapiens
gccagccctggccc

SEQ ID NO: 1049825 - DNA, 16 bp, Homo sapiens
gccagccctggcccac

SEQ ID NO: 1049826 - DNA, 20 bp, Homo sapiens
gccagcccttccctggcccc

SEQ ID NO: 1049827 - DNA, 18 bp, Homo sapiens
gccagccgaccctcctgg

SEQ ID NO: 1049828 - DNA, 21 bp, Homo sapiens
gccagccgaccctcctggcct

SEQ ID NO: 1049829 - DNA, 18 bp, Homo sapiens
gccagccgccctgggctg

SEQ ID NO: 1049830 - DNA, 16 bp, Homo sapiens
gccagccggtgcctgg

SEQ ID NO: 1049831 - DNA, 21 bp, Homo sapiens
gccagccgtgatgctcaggct

SEQ ID NO: 1049832 - DNA, 12 bp, Homo sapiens
gccagcctcagt

SEQ ID NO: 1049833 - DNA, 14 bp, Homo sapiens
gccagcctcagtgc

SEQ ID NO: 1049834 - DNA, 19 bp, Homo sapiens
gccagcctcagtgccactt

SEQ ID NO: 1049835 - DNA, 18 bp, Homo sapiens
gccagcctccgagaggga

SEQ ID NO: 1049836 - DNA, 21 bp, Homo sapiens
gccagcctccgagagggagag

SEQ ID NO: 1049837 - DNA, 12 bp, Homo sapiens
gccagcctcctc

SEQ ID NO: 1049838 - DNA, 16 bp, Homo sapiens
gccagcctccttgctg

SEQ ID NO: 1049839 - DNA, 11 bp, Homo sapiens
gccagcctggc

SEQ ID NO: 1049840 - DNA, 16 bp, Homo sapiens
gccagcctggcttctg

SEQ ID NO: 1049841 - DNA, 21 bp, Homo sapiens
gccagcctggcttctggagcc

SEQ ID NO: 1049842 - DNA, 15 bp, Homo sapiens
gccagcctgggactc

SEQ ID NO: 1049843 - DNA, 14 bp, Homo sapiens
gccagcctggtcca

SEQ ID NO: 1049844 - DNA, 21 bp, Homo sapiens
gccagcctggtccatgcaggg

SEQ ID NO: 1049845 - DNA, 13 bp, Homo sapiens
gccagccttcccc

SEQ ID NO: 1049846 - DNA, 21 bp, Homo sapiens
tcccagatggcttcggagggc

SEQ ID NO: 1049847 - DNA, 16 bp, Homo sapiens
tcccagatgtaaagaa

SEQ ID NO: 1049848 - DNA, 22 bp, Homo sapiens
tcccagcaagacctcatctgtg

SEQ ID NO: 1049849 - DNA, 15 bp, Homo sapiens
tcccagcactgcctc

SEQ ID NO: 1049850 - DNA, 17 bp, Homo sapiens
tcccagcactgcctcct

SEQ ID NO: 1049851 - DNA, 18 bp, Homo sapiens
tcccagcactgcctcctg

SEQ ID NO: 1049852 - DNA, 16 bp, Homo sapiens
tcccagcactttggga

SEQ ID NO: 1049853 - DNA, 22 bp, Homo sapiens
tcccagcactttgggaggctga

SEQ ID NO: 1049854 - DNA, 22 bp, Homo sapiens
tcccagcactttgggagtccaa

SEQ ID NO: 1049855 - DNA, 13 bp, Homo sapiens
tcccagcagagcc

SEQ ID NO: 1049856 - DNA, 18 bp, Homo sapiens
tcccagcagagcccacca

SEQ ID NO: 1049857 - DNA, 21 bp, Homo sapiens
tcccagcagagcccaccagcc

SEQ ID NO: 1049858 - DNA, 13 bp, Homo sapiens
tcccagcagccct

SEQ ID NO: 1049859 - DNA, 18 bp, Homo sapiens
tcccagcagccctaagga

SEQ ID NO: 1049860 - DNA, 12 bp, Homo sapiens
tcccagccaccc

SEQ ID NO: 1049861 - DNA, 16 bp, Homo sapiens
tcccagccactcggga

SEQ ID NO: 1049862 - DNA, 20 bp, Homo sapiens
tcccagccactcgggaggct

SEQ ID NO: 1049863 - DNA, 19 bp, Homo sapiens
tcccagccagcccgccgcc

SEQ ID NO: 1049864 - DNA, 16 bp, Homo sapiens
tcccagccccaggcct

SEQ ID NO: 1049865 - DNA, 14 bp, Homo sapiens
tccattgtgtgagt

SEQ ID NO: 1049866 - DNA, 20 bp, Homo sapiens
tccattgtgtgatccagccc

SEQ ID NO: 1049867 - DNA, 16 bp, Homo sapiens
tccattgtgtggcctg

SEQ ID NO: 1049868 - DNA, 11 bp, Homo sapiens
tccattgttgt

SEQ ID NO: 1049869 - DNA, 16 bp, Homo sapiens
tccattgtttaaagat

SEQ ID NO: 1049870 - DNA, 23 bp, Homo sapiens
tccattgtttgaaacaaagaagg

SEQ ID NO: 1049871 - DNA, 16 bp, Homo sapiens
tccatttactgacact

SEQ ID NO: 1049872 - DNA, 17 bp, Homo sapiens
tccatttacttaagact

SEQ ID NO: 1049873 - DNA, 19 bp, Homo sapiens
tccatttacttaagactta

SEQ ID NO: 1049874 - DNA, 14 bp, Homo sapiens
tccatttagttctt

SEQ ID NO: 1049875 - DNA, 23 bp, Homo sapiens
tccatttataaccccagcctgac

SEQ ID NO: 1049876 - DNA, 18 bp, Homo sapiens
tccatttatgctggttaa

SEQ ID NO: 1049877 - DNA, 16 bp, Homo sapiens
tccatttattgtttga

SEQ ID NO: 1049878 - DNA, 19 bp, Homo sapiens
tccatttatttatgaaaaa

SEQ ID NO: 1049879 - DNA, 14 bp, Homo sapiens
tccatttcccctct

SEQ ID NO: 1049880 - DNA, 20 bp, Homo sapiens
tccatttctcaatcagtgca

SEQ ID NO: 1049881 - DNA, 17 bp, Homo sapiens
tccatttctcatgtttt

SEQ ID NO: 1049882 - DNA, 11 bp, Homo sapiens
tccatttctgt

SEQ ID NO: 1049883 - DNA, 14 bp, Homo sapiens
tccatttctttctt

SEQ ID NO: 1049884 - DNA, 22 bp, Homo sapiens
tccatttcttttatacctttcc

SEQ ID NO: 1049885 - DNA, 18 bp, Homo sapiens
tccatttgaataaaatga

SEQ ID NO: 1049886 - DNA, 12 bp, Homo sapiens
tccatttgcaag

SEQ ID NO: 1049887 - DNA, 15 bp, Homo sapiens
tccatttgcaaggga

SEQ ID NO: 1049888 - DNA, 15 bp, Homo sapiens
tccatttgcatttgt

SEQ ID NO: 1049889 - DNA, 16 bp, Homo sapiens
tccatttggaattaca

SEQ ID NO: 1049890 - DNA, 13 bp, Homo sapiens
tccatttgttcct

SEQ ID NO: 1049891 - DNA, 15 bp, Homo sapiens
tccatttgttcctgc

SEQ ID NO: 1049892 - DNA, 16 bp, Homo sapiens
tccatttgttcctgct

SEQ ID NO: 1049893 - DNA, 19 bp, Homo sapiens
tccatttgttcctgcttcc

SEQ ID NO: 1049894 - DNA, 21 bp, Homo sapiens
tccattttaacaactgctctt

SEQ ID NO: 1049895 - DNA, 19 bp, Homo sapiens
tccattttaggtgataaaa

SEQ ID NO: 1049896 - DNA, 11 bp, Homo sapiens
tccattttcta

SEQ ID NO: 1049897 - DNA, 22 bp, Homo sapiens
tccattttcttattgcgctgct

SEQ ID NO: 1049898 - DNA, 15 bp, Homo sapiens
tccattttcttctct

SEQ ID NO: 1049899 - DNA, 24 bp, Homo sapiens
tccatttttacaagttatagtact

SEQ ID NO: 1049900 - DNA, 15 bp, Homo sapiens
tccatttttcctctg

SEQ ID NO: 1049901 - DNA, 19 bp, Homo sapiens
tccattttttcttcccttt

SEQ ID NO: 1049902 - DNA, 15 bp, Homo sapiens
tcccaaaatcccctc

SEQ ID NO: 1049903 - DNA, 22 bp, Homo sapiens
tcccaaaatcccctcagcctct

SEQ ID NO: 1049904 - DNA, 14 bp, Homo sapiens
tcccaaaattgttt

SEQ ID NO: 1049905 - DNA, 15 bp, Homo sapiens
tcccaaaattgtttt

SEQ ID NO: 1049906 - DNA, 20 bp, Homo sapiens
tcccaaaccacgcctcttga

SEQ ID NO: 1049907 - DNA, 14 bp, Homo sapiens
tcccaaacccagtc

SEQ ID NO: 1049908 - DNA, 21 bp, Homo sapiens
tcccaaacccagtctcctctc

SEQ ID NO: 1049909 - DNA, 23 bp, Homo sapiens
tcccaaacccagtctcctctcca

SEQ ID NO: 1049910 - DNA, 24 bp, Homo sapiens
tcccaaacgccctttcctcctcag

SEQ ID NO: 1049911 - DNA, 19 bp, Homo sapiens
tcccaaactttaaaatgcg

SEQ ID NO: 1049912 - DNA, 18 bp, Homo sapiens
tcccaaagcacttttaaa

SEQ ID NO: 1049913 - DNA, 19 bp, Homo sapiens
tcccaaagccagaaccaga

SEQ ID NO: 1049914 - DNA, 13 bp, Homo sapiens
tcccaaagtgctg

SEQ ID NO: 1049915 - DNA, 14 bp, Homo sapiens
tcccaaagtgctgg

SEQ ID NO: 1049916 - DNA, 17 bp, Homo sapiens
tcccaaatttgattgat

SEQ ID NO: 1049917 - DNA, 13 bp, Homo sapiens
tcccaacagcctt

SEQ ID NO: 1049918 - DNA, 22 bp, Homo sapiens
tcccaacagccttagctgccag

SEQ ID NO: 1049919 - DNA, 14 bp, Homo sapiens
tcccaacatgggag

SEQ ID NO: 1049920 - DNA, 20 bp, Homo sapiens
tcccaacatgggagggatca

SEQ ID NO: 1049921 - DNA, 21 bp, Homo sapiens
tcccaacatgggagggatcag

SEQ ID NO: 1049922 - DNA, 14 bp, Homo sapiens
tcccaacattctgc

SEQ ID NO: 1049923 - DNA, 19 bp, Homo sapiens
tcccaaccaaccagcaggg

SEQ ID NO: 1049924 - DNA, 17 bp, Homo sapiens
tcccaacccccctcctg

SEQ ID NO: 1049925 - DNA, 18 bp, Homo sapiens
tcccaacccccctcctgc

SEQ ID NO: 1049926 - DNA, 19 bp, Homo sapiens
tcccaacccccctcctgct

SEQ ID NO: 1049927 - DNA, 15 bp, Homo sapiens
tcccaaccctggctt

SEQ ID NO: 1049928 - DNA, 20 bp, Homo sapiens
tcccaacctctttttcctcc

SEQ ID NO: 1049929 - DNA, 18 bp, Homo sapiens
tcccaacgagcctcctca

SEQ ID NO: 1049930 - DNA, 22 bp, Homo sapiens
tcccaacgagcctcctcagggg

SEQ ID NO: 1049931 - DNA, 14 bp, Homo sapiens
tcccaactctagct

SEQ ID NO: 1049932 - DNA, 20 bp, Homo sapiens
tcccaagaaaggaaaccttt

SEQ ID NO: 1049933 - DNA, 17 bp, Homo sapiens
tcccaagaccctgcccc

SEQ ID NO: 1049934 - DNA, 13 bp, Homo sapiens
tcccaagagctac

SEQ ID NO: 1049935 - DNA, 13 bp, Homo sapiens
tcccaagcctcct

SEQ ID NO: 1049936 - DNA, 18 bp, Homo sapiens
tcccaagcgttcctggcc

SEQ ID NO: 1049937 - DNA, 21 bp, Homo sapiens
tcccaagcgttcctggccttc

SEQ ID NO: 1049938 - DNA, 12 bp, Homo sapiens
tcccaaggaaag

SEQ ID NO: 1049939 - DNA, 13 bp, Homo sapiens
tcccaaggaaagc

SEQ ID NO: 1049940 - DNA, 22 bp, Homo sapiens
tcccaaggaaagccccagcact

SEQ ID NO: 1049941 - DNA, 20 bp, Homo sapiens
tcccaaggaagctccttcct

SEQ ID NO: 1049942 - DNA, 12 bp, Homo sapiens
tcccaaggacat

SEQ ID NO: 1049943 - DNA, 14 bp, Homo sapiens
tcccaaggagctga

SEQ ID NO: 1049944 - DNA, 23 bp, Homo sapiens
tcccaaggccaagattgtccttt

SEQ ID NO: 1049945 - DNA, 18 bp, Homo sapiens
tcccaaggctctgagcaa

SEQ ID NO: 1049946 - DNA, 16 bp, Homo sapiens
tcccaagggacagcaa

SEQ ID NO: 1049947 - DNA, 20 bp, Homo sapiens
tcccaagggtgccctttggg

SEQ ID NO: 1049948 - DNA, 16 bp, Homo sapiens
tcccaaggtcctctca

SEQ ID NO: 1049949 - DNA, 17 bp, Homo sapiens
tcccaaggtcctctcag

SEQ ID NO: 1049950 - DNA, 17 bp, Homo sapiens
tcccaaggttggagccc

SEQ ID NO: 1049951 - DNA, 21 bp, Homo sapiens
tcccaaggttggagcccaggg

SEQ ID NO: 1049952 - DNA, 23 bp, Homo sapiens
tcccaaggttggagcccagggca

SEQ ID NO: 1049953 - DNA, 13 bp, Homo sapiens
tcccaagtatgcc

SEQ ID NO: 1049954 - DNA, 23 bp, Homo sapiens
tcccaagtttccatagcaacagg

SEQ ID NO: 1049955 - DNA, 23 bp, Homo sapiens
tcccaagttttaggacaaacagc

SEQ ID NO: 1049956 - DNA, 11 bp, Homo sapiens
tcccaataaaa

SEQ ID NO: 1049957 - DNA, 13 bp, Homo sapiens
tcccaataaaagt

SEQ ID NO: 1049958 - DNA, 14 bp, Homo sapiens
tcccaatacaaaga

SEQ ID NO: 1049959 - DNA, 22 bp, Homo sapiens
tcccaatagcaacgtagcttct

SEQ ID NO: 1049960 - DNA, 17 bp, Homo sapiens
tcccaataggcagactg

SEQ ID NO: 1049961 - DNA, 20 bp, Homo sapiens
tcccaatcaaagaattacag

SEQ ID NO: 1049962 - DNA, 16 bp, Homo sapiens
tcccaatcagcttttg

SEQ ID NO: 1049963 - DNA, 23 bp, Homo sapiens
tcccaatcagcttttgttctaga

SEQ ID NO: 1049964 - DNA, 20 bp, Homo sapiens
tcccaatccttatcccaagc

SEQ ID NO: 1049965 - DNA, 20 bp, Homo sapiens
tcccaatctttctatataaa

SEQ ID NO: 1049966 - DNA, 24 bp, Homo sapiens
tcccaatctttctatataaaatgt

SEQ ID NO: 1049967 - DNA, 17 bp, Homo sapiens
tcccaattaaaatacta

SEQ ID NO: 1049968 - DNA, 20 bp, Homo sapiens
tcccaattagcttggcctac

SEQ ID NO: 1049969 - DNA, 20 bp, Homo sapiens
tcccaattcggggcctgctg

SEQ ID NO: 1049970 - DNA, 19 bp, Homo sapiens
tcccacaaaagacagaccc

SEQ ID NO: 1049971 - DNA, 11 bp, Homo sapiens
tcccacacagg

SEQ ID NO: 1049972 - DNA, 23 bp, Homo sapiens
tcccacactgtgcagacccagtc

SEQ ID NO: 1049973 - DNA, 16 bp, Homo sapiens
tcccacactgtggcca

SEQ ID NO: 1049974 - DNA, 19 bp, Homo sapiens
tcccacactgtggccaggc

SEQ ID NO: 1049975 - DNA, 15 bp, Homo sapiens
tcccacagacctgca

SEQ ID NO: 1049976 - DNA, 20 bp, Homo sapiens
tcccacagagtgctggactg

SEQ ID NO: 1049977 - DNA, 17 bp, Homo sapiens
tcccacaggacatttct

SEQ ID NO: 1049978 - DNA, 12 bp, Homo sapiens
tcccacaggagg

SEQ ID NO: 1049979 - DNA, 13 bp, Homo sapiens
tcccacaggaggg

SEQ ID NO: 1049980 - DNA, 15 bp, Homo sapiens
tcccacaggcccttc

SEQ ID NO: 1049981 - DNA, 17 bp, Homo sapiens
tcccacaggcccttcct

SEQ ID NO: 1049982 - DNA, 20 bp, Homo sapiens
tcccacatccaactccagca

SEQ ID NO: 1049983 - DNA, 14 bp, Homo sapiens
tcccacatgaggcc

SEQ ID NO: 1049984 - DNA, 19 bp, Homo sapiens
tcccacatgggcccaggcc

SEQ ID NO: 1049985 - DNA, 22 bp, Homo sapiens
tcccacatgggcccaggcctca

SEQ ID NO: 1049986 - DNA, 15 bp, Homo sapiens
tcccacattaaagaa

SEQ ID NO: 1049987 - DNA, 14 bp, Homo sapiens
tcccacatttccat

SEQ ID NO: 1049988 - DNA, 21 bp, Homo sapiens
tcccaccaacaaaatccatgt

SEQ ID NO: 1049989 - DNA, 17 bp, Homo sapiens
gtggacctagcctggat

SEQ ID NO: 1049990 - DNA, 15 bp, Homo sapiens
gtggaccttcctgcc

SEQ ID NO: 1049991 - DNA, 18 bp, Homo sapiens
gtggacggcgctgcctca

SEQ ID NO: 1049992 - DNA, 18 bp, Homo sapiens
gtggacggggaggctctc

SEQ ID NO: 1049993 - DNA, 14 bp, Homo sapiens
gtggacgtgcactg

SEQ ID NO: 1049994 - DNA, 16 bp, Homo sapiens
gtggactcagggcagc

SEQ ID NO: 1049995 - DNA, 22 bp, Homo sapiens
gtggactctgaggactcctgag

SEQ ID NO: 1049996 - DNA, 20 bp, Homo sapiens
gtggactgagtgggaagccc

SEQ ID NO: 1049997 - DNA, 23 bp, Homo sapiens
gtggactgcagtcggcatgccag

SEQ ID NO: 1049998 - DNA, 14 bp, Homo sapiens
gtggactgcattta

SEQ ID NO: 1049999 - DNA, 16 bp, Homo sapiens
gtggactggctgtgcc

SEQ ID NO: 1050000 - DNA, 21 bp, Homo sapiens
gtggactggtgtcataaactt

SEQ ID NO: 1050001 - DNA, 16 bp, Homo sapiens
gtggactgtcctgagg

SEQ ID NO: 1050002 - DNA, 22 bp, Homo sapiens
gtggactgtcctgaggagccct

SEQ ID NO: 1050003 - DNA, 17 bp, Homo sapiens
gtggagacactgagtca

SEQ ID NO: 1050004 - DNA, 11 bp, Homo sapiens
gtggagacagt

SEQ ID NO: 1050005 - DNA, 14 bp, Homo sapiens
gtggagacagtcct

SEQ ID NO: 1050006 - DNA, 22 bp, Homo sapiens
gtggagaccctgccacagccag

SEQ ID NO: 1050007 - DNA, 18 bp, Homo sapiens
gtggagactgcttcccat

SEQ ID NO: 1050008 - DNA, 20 bp, Homo sapiens
gtggagaggggtgcacccac

SEQ ID NO: 1050009 - DNA, 17 bp, Homo sapiens
gtggagatagtgccagg

SEQ ID NO: 1050010 - DNA, 15 bp, Homo sapiens
gtggagatggactca

SEQ ID NO: 1050011 - DNA, 17 bp, Homo sapiens
gtggagcaaaaggcagc

SEQ ID NO: 1050012 - DNA, 18 bp, Homo sapiens
gtggagcaaaaggcagct

SEQ ID NO: 1050013 - DNA, 19 bp, Homo sapiens
gtggagcaaaaggcagctc

SEQ ID NO: 1050014 - DNA, 14 bp, Homo sapiens
gtggagcagagctc

SEQ ID NO: 1050015 - DNA, 14 bp, Homo sapiens
gtggagcagcagcc

SEQ ID NO: 1050016 - DNA, 15 bp, Homo sapiens
gtggagcagcagcca

SEQ ID NO: 1050017 - DNA, 13 bp, Homo sapiens
gtggagcagccag

SEQ ID NO: 1050018 - DNA, 16 bp, Homo sapiens
gtggagcatgggcctg

SEQ ID NO: 1050019 - DNA, 11 bp, Homo sapiens
gtggagccagg

SEQ ID NO: 1050020 - DNA, 12 bp, Homo sapiens
gtggagccaggg

SEQ ID NO: 1050021 - DNA, 22 bp, Homo sapiens
gtggagccaggttgtcgggccc

SEQ ID NO: 1050022 - DNA, 18 bp, Homo sapiens
gtggagccattgaacagc

SEQ ID NO: 1050023 - DNA, 16 bp, Homo sapiens
gtggagctcagccccg

SEQ ID NO: 1050024 - DNA, 20 bp, Homo sapiens
gtggagctcgcccctcccct

SEQ ID NO: 1050025 - DNA, 15 bp, Homo sapiens
gtggaggaagagcca

SEQ ID NO: 1050026 - DNA, 22 bp, Homo sapiens
gtggaggaagcccaccaatctg

SEQ ID NO: 1050027 - DNA, 16 bp, Homo sapiens
gtggaggaaggctctg

SEQ ID NO: 1050028 - DNA, 16 bp, Homo sapiens
gtggaggaaggtgctg

SEQ ID NO: 1050029 - DNA, 20 bp, Homo sapiens
gtggaggaaggtgctgagct

SEQ ID NO: 1050030 - DNA, 16 bp, Homo sapiens
gtggaggaatgctccc

SEQ ID NO: 1050031 - DNA, 13 bp, Homo sapiens
gtggaggacagac

SEQ ID NO: 1050032 - DNA, 18 bp, Homo sapiens
gtggaggaccgttctctg

SEQ ID NO: 1050033 - DNA, 11 bp, Homo sapiens
gtggaggagag

SEQ ID NO: 1050034 - DNA, 13 bp, Homo sapiens
gtggaggagagga

SEQ ID NO: 1050035 - DNA, 20 bp, Homo sapiens
gtggaggagctgagggaggg

SEQ ID NO: 1050036 - DNA, 11 bp, Homo sapiens
gtggaggagga

SEQ ID NO: 1050037 - DNA, 14 bp, Homo sapiens
gtggaggaggaggg

SEQ ID NO: 1050038 - DNA, 15 bp, Homo sapiens
gtggaggaggttggg

SEQ ID NO: 1050039 - DNA, 14 bp, Homo sapiens
gtggaggcacttta

SEQ ID NO: 1050040 - DNA, 15 bp, Homo sapiens
gtggaggcctgatgc

SEQ ID NO: 1050041 - DNA, 17 bp, Homo sapiens
gtggaggcctgatgctg

SEQ ID NO: 1050042 - DNA, 22 bp, Homo sapiens
gtggagggaaggataaagccac

SEQ ID NO: 1050043 - DNA, 23 bp, Homo sapiens
gtggagggacaagtggactcagg

SEQ ID NO: 1050044 - DNA, 12 bp, Homo sapiens
gtggagggaggg

SEQ ID NO: 1050045 - DNA, 16 bp, Homo sapiens
gtggaggttgagtgag

SEQ ID NO: 1050046 - DNA, 20 bp, Homo sapiens
gtggaggttgagtgagccgg

SEQ ID NO: 1050047 - DNA, 14 bp, Homo sapiens
gtggaggttgcagt

SEQ ID NO: 1050048 - DNA, 19 bp, Homo sapiens
gtggaggttgcagtgagct

SEQ ID NO: 1050049 - DNA, 14 bp, Homo sapiens
gtggagtaaatatt

SEQ ID NO: 1050050 - DNA, 18 bp, Homo sapiens
gtggagtgagagcctttg

SEQ ID NO: 1050051 - DNA, 12 bp, Homo sapiens
gtggagttcacc

SEQ ID NO: 1050052 - DNA, 19 bp, Homo sapiens
gtggagttcaccttggaag

SEQ ID NO: 1050053 - DNA, 20 bp, Homo sapiens
gtggagttcaccttggaagg

SEQ ID NO: 1050054 - DNA, 16 bp, Homo sapiens
gtggagttggggctgc

SEQ ID NO: 1050055 - DNA, 14 bp, Homo sapiens
gtggatacagtgcc

SEQ ID NO: 1050056 - DNA, 22 bp, Homo sapiens
gtggatagcccatagctatttt

SEQ ID NO: 1050057 - DNA, 16 bp, Homo sapiens
gtggatataaaatgtg

SEQ ID NO: 1050058 - DNA, 17 bp, Homo sapiens
gtggatataaaatgtgc

SEQ ID NO: 1050059 - DNA, 21 bp, Homo sapiens
gtggatcacacctcagtggga

SEQ ID NO: 1050060 - DNA, 22 bp, Homo sapiens
gtggatcacacctcagtgggaa

SEQ ID NO: 1050061 - DNA, 15 bp, Homo sapiens
gtggatcacagaggc

SEQ ID NO: 1050062 - DNA, 16 bp, Homo sapiens
gtggatcacagaggct

SEQ ID NO: 1050063 - DNA, 15 bp, Homo sapiens
gtggatcacctgagg

SEQ ID NO: 1050064 - DNA, 20 bp, Homo sapiens
gtggatcgagtgtagctgtg

SEQ ID NO: 1050065 - DNA, 22 bp, Homo sapiens
gtggatcgagtgtagctgtgaa

SEQ ID NO: 1050066 - DNA, 23 bp, Homo sapiens
gtggatcgagtgtagctgtgaaa

SEQ ID NO: 1050067 - DNA, 17 bp, Homo sapiens
gtggatctccaaggacc

SEQ ID NO: 1050068 - DNA, 23 bp, Homo sapiens
gtggatctccaaggaccaggtta

SEQ ID NO: 1050069 - DNA, 17 bp, Homo sapiens
gtggatctgtccaagga

SEQ ID NO: 1050070 - DNA, 22 bp, Homo sapiens
gtggatcttcagaactgccctt

SEQ ID NO: 1050071 - DNA, 15 bp, Homo sapiens
gtggatgctgagctg

SEQ ID NO: 1050072 - DNA, 17 bp, Homo sapiens
gtggatgctgagctgtg

SEQ ID NO: 1050073 - DNA, 13 bp, Homo sapiens
gtggatggcccca

SEQ ID NO: 1050074 - DNA, 15 bp, Homo sapiens
gtggatggccccagc

SEQ ID NO: 1050075 - DNA, 16 bp, Homo sapiens
gtggatgggaatttgt

SEQ ID NO: 1050076 - DNA, 22 bp, Homo sapiens
gtggatgggaatttgtcagcgt

SEQ ID NO: 1050077 - DNA, 17 bp, Homo sapiens
gtggatgggatcctctc

SEQ ID NO: 1050078 - DNA, 15 bp, Homo sapiens
gtggatgtcttcctt

SEQ ID NO: 1050079 - DNA, 19 bp, Homo sapiens
gtggatgtcttccttggag

SEQ ID NO: 1050080 - DNA, 14 bp, Homo sapiens
gtggatgtttttaa

SEQ ID NO: 1050081 - DNA, 17 bp, Homo sapiens
gtggattatttcatttt

SEQ ID NO: 1050082 - DNA, 18 bp, Homo sapiens
gtggattctgaggccctg

SEQ ID NO: 1050083 - DNA, 13 bp, Homo sapiens
gtggattgagggt

SEQ ID NO: 1050084 - DNA, 19 bp, Homo sapiens
gtggattgcacgtggcctc

SEQ ID NO: 1050085 - DNA, 22 bp, Homo sapiens
gtggattgcccgcgctcaggag

SEQ ID NO: 1050086 - DNA, 19 bp, Homo sapiens
gtggattgggctgcaggct

SEQ ID NO: 1050087 - DNA, 12 bp, Homo sapiens
gtgtatatatat

SEQ ID NO: 1050088 - DNA, 13 bp, Homo sapiens
gtgtatatcagaa

SEQ ID NO: 1050089 - DNA, 23 bp, Homo sapiens
gtgtatatccttccaaaaaatta

SEQ ID NO: 1050090 - DNA, 17 bp, Homo sapiens
gtgtatatttattcata

SEQ ID NO: 1050091 - DNA, 19 bp, Homo sapiens
gtgtatcagtgtttatgtg

SEQ ID NO: 1050092 - DNA, 13 bp, Homo sapiens
gtgtatcctgggg

SEQ ID NO: 1050093 - DNA, 18 bp, Homo sapiens
gtgtatctaaaggatgga

SEQ ID NO: 1050094 - DNA, 19 bp, Homo sapiens
gtgtatctgtgcttctaat

SEQ ID NO: 1050095 - DNA, 15 bp, Homo sapiens
gtgtatgactaaaga

SEQ ID NO: 1050096 - DNA, 19 bp, Homo sapiens
gtgtatggaaataaatgta

SEQ ID NO: 1050097 - DNA, 17 bp, Homo sapiens
gtgtatgtacatatata

SEQ ID NO: 1050098 - DNA, 16 bp, Homo sapiens
gtgtatgtgtgtgtgt

SEQ ID NO: 1050099 - DNA, 22 bp, Homo sapiens
gtgtatgtttgcacacttgtgt

SEQ ID NO: 1050100 - DNA, 16 bp, Homo sapiens
gtgtattaaaaaaaac

SEQ ID NO: 1050101 - DNA, 14 bp, Homo sapiens
gtgtattatcattt

SEQ ID NO: 1050102 - DNA, 13 bp, Homo sapiens
gtgtattccaaga

SEQ ID NO: 1050103 - DNA, 19 bp, Homo sapiens
gtgtattctagttttgtca

SEQ ID NO: 1050104 - DNA, 20 bp, Homo sapiens
gtgtattgagtcttaactgt

SEQ ID NO: 1050105 - DNA, 22 bp, Homo sapiens
gtgtattgagtcttaactgtat

SEQ ID NO: 1050106 - DNA, 15 bp, Homo sapiens
gtgtattgatgcaat

SEQ ID NO: 1050107 - DNA, 17 bp, Homo sapiens
gtgtatttaacagggag

SEQ ID NO: 1050108 - DNA, 16 bp, Homo sapiens
gtgtatttatttaaaa

SEQ ID NO: 1050109 - DNA, 19 bp, Homo sapiens
gtgtatttattttacagct

SEQ ID NO: 1050110 - DNA, 19 bp, Homo sapiens
gtgtatttcttatacgctt

SEQ ID NO: 1050111 - DNA, 10 bp, Homo sapiens
gtgtatttgc

SEQ ID NO: 1050112 - DNA, 19 bp, Homo sapiens
gtgtatttgctaattttta

SEQ ID NO: 1050113 - DNA, 16 bp, Homo sapiens
gtgtatttgtattaat

SEQ ID NO: 1050114 - DNA, 21 bp, Homo sapiens
gtgtatttgtattaataaagc

SEQ ID NO: 1050115 - DNA, 16 bp, Homo sapiens
gtgtattttattcagt

SEQ ID NO: 1050116 - DNA, 17 bp, Homo sapiens
gtgtattttattcagta

SEQ ID NO: 1050117 - DNA, 22 bp, Homo sapiens
gtgtatttttcaggtaggccct

SEQ ID NO: 1050118 - DNA, 19 bp, Homo sapiens
gtgtatttttgtaaaaaat

SEQ ID NO: 1050119 - DNA, 23 bp, Homo sapiens
gtgtatttttttactaatagaca

SEQ ID NO: 1050120 - DNA, 14 bp, Homo sapiens
gtgtcaagaaggaa

SEQ ID NO: 1050121 - DNA, 21 bp, Homo sapiens
gtgtcaagctgctctgagcca

SEQ ID NO: 1050122 - DNA, 16 bp, Homo sapiens
gtgtcaagttgtgctt

SEQ ID NO: 1050123 - DNA, 23 bp, Homo sapiens
gtgtcaagttgtgcttgtttaca

SEQ ID NO: 1050124 - DNA, 23 bp, Homo sapiens
gtgtcacagttcttggtgactgt

SEQ ID NO: 1050125 - DNA, 14 bp, Homo sapiens
gtgtcaccctgtgg

SEQ ID NO: 1050126 - DNA, 15 bp, Homo sapiens
gtgtcacttgtgctt

SEQ ID NO: 1050127 - DNA, 12 bp, Homo sapiens
gtgtcagagcct

SEQ ID NO: 1050128 - DNA, 16 bp, Homo sapiens
gtgtcagctgaggctg

SEQ ID NO: 1050129 - DNA, 17 bp, Homo sapiens
gtgtcagctgaggctgg

SEQ ID NO: 1050130 - DNA, 13 bp, Homo sapiens
gtgtcaggcaggt

SEQ ID NO: 1050131 - DNA, 21 bp, Homo sapiens
gtgtcaggcaggtttgccagt

SEQ ID NO: 1050132 - DNA, 12 bp, Homo sapiens
gtgtcaggcccg

SEQ ID NO: 1050133 - DNA, 21 bp, Homo sapiens
gtgtcaggcccgtcggagctg

SEQ ID NO: 1050134 - DNA, 12 bp, Homo sapiens
gtgtcaggccct

SEQ ID NO: 1050135 - DNA, 18 bp, Homo sapiens
gtgtcaggccctctgcct

SEQ ID NO: 1050136 - DNA, 16 bp, Homo sapiens
gtgtcagtatccaggc

SEQ ID NO: 1050137 - DNA, 23 bp, Homo sapiens
gtgtcatatatggggggccaaca

SEQ ID NO: 1050138 - DNA, 17 bp, Homo sapiens
gtgtcatgaagaatgtt

SEQ ID NO: 1050139 - DNA, 20 bp, Homo sapiens
cttgatacccccctctgtct

SEQ ID NO: 1050140 - DNA, 17 bp, Homo sapiens
cttgatatagaaagctg

SEQ ID NO: 1050141 - DNA, 14 bp, Homo sapiens
cttgatatgtaagt

SEQ ID NO: 1050142 - DNA, 23 bp, Homo sapiens
cttgatcagccccaccctggcct

SEQ ID NO: 1050143 - DNA, 13 bp, Homo sapiens
cttgatcagtgac

SEQ ID NO: 1050144 - DNA, 20 bp, Homo sapiens
cttgatctgtatatacaata

SEQ ID NO: 1050145 - DNA, 22 bp, Homo sapiens
cttgatctgtatatacaataac

SEQ ID NO: 1050146 - DNA, 14 bp, Homo sapiens
cttgatctgtgatt

SEQ ID NO: 1050147 - DNA, 15 bp, Homo sapiens
cttgatctgtgattt

SEQ ID NO: 1050148 - DNA, 16 bp, Homo sapiens
cttgatcttaaagatc

SEQ ID NO: 1050149 - DNA, 16 bp, Homo sapiens
cttgatctttgagccc

SEQ ID NO: 1050150 - DNA, 14 bp, Homo sapiens
cttgatgaagcaag

SEQ ID NO: 1050151 - DNA, 21 bp, Homo sapiens
cttgatgaccaaagtcctttt

SEQ ID NO: 1050152 - DNA, 16 bp, Homo sapiens
cttgatgactgctgat

SEQ ID NO: 1050153 - DNA, 18 bp, Homo sapiens
cttgatgcacagagaagc

SEQ ID NO: 1050154 - DNA, 16 bp, Homo sapiens
cttgatgccaaaatga

SEQ ID NO: 1050155 - DNA, 15 bp, Homo sapiens
cttgatgccagaggg

SEQ ID NO: 1050156 - DNA, 18 bp, Homo sapiens
cttgatgccagagggcca

SEQ ID NO: 1050157 - DNA, 19 bp, Homo sapiens
cttgatgccagagggccag

SEQ ID NO: 1050158 - DNA, 21 bp, Homo sapiens
cttgatgccagagggccagca

SEQ ID NO: 1050159 - DNA, 14 bp, Homo sapiens
cttgatgttgctta

SEQ ID NO: 1050160 - DNA, 13 bp, Homo sapiens
cttgatgtttaga

SEQ ID NO: 1050161 - DNA, 20 bp, Homo sapiens
cttgatgtttagaaaagtat

SEQ ID NO: 1050162 - DNA, 17 bp, Homo sapiens
cttgatgtttggggtct

SEQ ID NO: 1050163 - DNA, 17 bp, Homo sapiens
cttgatgtttgttagac

SEQ ID NO: 1050164 - DNA, 14 bp, Homo sapiens
cttgattataaatg

SEQ ID NO: 1050165 - DNA, 16 bp, Homo sapiens
cttgattcatctctgg

SEQ ID NO: 1050166 - DNA, 14 bp, Homo sapiens
cttgattcccaccg

SEQ ID NO: 1050167 - DNA, 13 bp, Homo sapiens
cttgattcctggt

SEQ ID NO: 1050168 - DNA, 13 bp, Homo sapiens
cttgattctgcag

SEQ ID NO: 1050169 - DNA, 21 bp, Homo sapiens
cttgattctgcagtaaatctt

SEQ ID NO: 1050170 - DNA, 17 bp, Homo sapiens
cttgattgagaaagatg

SEQ ID NO: 1050171 - DNA, 19 bp, Homo sapiens
cttgatttaaacacacaga

SEQ ID NO: 1050172 - DNA, 13 bp, Homo sapiens
cttgatttgatgt

SEQ ID NO: 1050173 - DNA, 13 bp, Homo sapiens
cttgatttgcatg

SEQ ID NO: 1050174 - DNA, 18 bp, Homo sapiens
cttgatttgcatggattt

SEQ ID NO: 1050175 - DNA, 14 bp, Homo sapiens
cttgattttttcaa

SEQ ID NO: 1050176 - DNA, 12 bp, Homo sapiens
cttgcaaagtat

SEQ ID NO: 1050177 - DNA, 23 bp, Homo sapiens
cttgcaaatacctcctccctaat

SEQ ID NO: 1050178 - DNA, 14 bp, Homo sapiens
cttgcaacacacag

SEQ ID NO: 1050179 - DNA, 15 bp, Homo sapiens
cttgcaacacacaga

SEQ ID NO: 1050180 - DNA, 17 bp, Homo sapiens
cttgcaacacacagaca

SEQ ID NO: 1050181 - DNA, 15 bp, Homo sapiens
cttgcaaccaggcag

SEQ ID NO: 1050182 - DNA, 21 bp, Homo sapiens
cttgcaactaaggacaaatta

SEQ ID NO: 1050183 - DNA, 20 bp, Homo sapiens
cttgcaacttcatgtcaact

SEQ ID NO: 1050184 - DNA, 13 bp, Homo sapiens
cttgcaagccata

SEQ ID NO: 1050185 - DNA, 17 bp, Homo sapiens
cttgcaatctaatctga

SEQ ID NO: 1050186 - DNA, 18 bp, Homo sapiens
cttgcaatctaatctgaa

SEQ ID NO: 1050187 - DNA, 18 bp, Homo sapiens
cttgcacacccactgccc

SEQ ID NO: 1050188 - DNA, 14 bp, Homo sapiens
cttgcacagccaac

SEQ ID NO: 1050189 - DNA, 20 bp, Homo sapiens
cttgcacagccaacgagaca

SEQ ID NO: 1050190 - DNA, 18 bp, Homo sapiens
cttgcaccaaattatctt

SEQ ID NO: 1050191 - DNA, 20 bp, Homo sapiens
cttgcacccctcactctggc

SEQ ID NO: 1050192 - DNA, 21 bp, Homo sapiens
cttgcacggctgctcggcttg

SEQ ID NO: 1050193 - DNA, 17 bp, Homo sapiens
cttgcactcctcacaca

SEQ ID NO: 1050194 - DNA, 18 bp, Homo sapiens
cttgcactcctcacacag

SEQ ID NO: 1050195 - DNA, 16 bp, Homo sapiens
cttgcactccttccct

SEQ ID NO: 1050196 - DNA, 18 bp, Homo sapiens
cttgcactggccttctga

SEQ ID NO: 1050197 - DNA, 15 bp, Homo sapiens
cttgcagaactgcca

SEQ ID NO: 1050198 - DNA, 16 bp, Homo sapiens
cttgcagaactgccat

SEQ ID NO: 1050199 - DNA, 18 bp, Homo sapiens
cttgcagaactgccatta

SEQ ID NO: 1050200 - DNA, 13 bp, Homo sapiens
cttgcagagcttg

SEQ ID NO: 1050201 - DNA, 17 bp, Homo sapiens
cttgcagaggagcccag

SEQ ID NO: 1050202 - DNA, 22 bp, Homo sapiens
cttgcagaggagcccagtgggc

SEQ ID NO: 1050203 - DNA, 13 bp, Homo sapiens
cttgcagccagga

SEQ ID NO: 1050204 - DNA, 14 bp, Homo sapiens
cttgcagccaggag

SEQ ID NO: 1050205 - DNA, 17 bp, Homo sapiens
cttgcagccaggagaag

SEQ ID NO: 1050206 - DNA, 21 bp, Homo sapiens
cttgcaggggtcccccctcaa

SEQ ID NO: 1050207 - DNA, 21 bp, Homo sapiens
cttgcagtccgttgctgaaaa

SEQ ID NO: 1050208 - DNA, 15 bp, Homo sapiens
cttgcagttttgtaa

SEQ ID NO: 1050209 - DNA, 18 bp, Homo sapiens
gtgtctgtccatctgtct

SEQ ID NO: 1050210 - DNA, 15 bp, Homo sapiens
gtgtctgtgccatgg

SEQ ID NO: 1050211 - DNA, 15 bp, Homo sapiens
gtgtctgtgtttaat

SEQ ID NO: 1050212 - DNA, 12 bp, Homo sapiens
gtgtctgttgct

SEQ ID NO: 1050213 - DNA, 12 bp, Homo sapiens
gtgtcttagcat

SEQ ID NO: 1050214 - DNA, 17 bp, Homo sapiens
gtgtcttccactttgca

SEQ ID NO: 1050215 - DNA, 15 bp, Homo sapiens
gtgtcttccataatg

SEQ ID NO: 1050216 - DNA, 17 bp, Homo sapiens
gtgtcttcctagaattc

SEQ ID NO: 1050217 - DNA, 23 bp, Homo sapiens
gtgtcttgggcagagctggctct

SEQ ID NO: 1050218 - DNA, 18 bp, Homo sapiens
gtgtgaaagtcagatgcc

SEQ ID NO: 1050219 - DNA, 13 bp, Homo sapiens
gtgtgaaatatat

SEQ ID NO: 1050220 - DNA, 18 bp, Homo sapiens
gtgtgaactgctttcaag

SEQ ID NO: 1050221 - DNA, 15 bp, Homo sapiens
gtgtgaactgggcac

SEQ ID NO: 1050222 - DNA, 15 bp, Homo sapiens
gtgtgaagaaagcca

SEQ ID NO: 1050223 - DNA, 23 bp, Homo sapiens
gtgtgaagccgccagttcatctt

SEQ ID NO: 1050224 - DNA, 18 bp, Homo sapiens
gtgtgaaggtcctgctat

SEQ ID NO: 1050225 - DNA, 18 bp, Homo sapiens
gtgtgaatactggaagct

SEQ ID NO: 1050226 - DNA, 19 bp, Homo sapiens
gtgtgaatgtgggcactgg

SEQ ID NO: 1050227 - DNA, 22 bp, Homo sapiens
gtgtgacaattctgtttttaat

SEQ ID NO: 1050228 - DNA, 18 bp, Homo sapiens
gtgtgacagtttccaaat

SEQ ID NO: 1050229 - DNA, 19 bp, Homo sapiens
gtgtgacagtttccaaatt

SEQ ID NO: 1050230 - DNA, 16 bp, Homo sapiens
gtgtgaccaactgtgt

SEQ ID NO: 1050231 - DNA, 13 bp, Homo sapiens
gtgtgaccctggg

SEQ ID NO: 1050232 - DNA, 14 bp, Homo sapiens
gtgtgactaactat

SEQ ID NO: 1050233 - DNA, 16 bp, Homo sapiens
gtgtgactcgggagct

SEQ ID NO: 1050234 - DNA, 22 bp, Homo sapiens
gtgtgactcgggagctgcacac

SEQ ID NO: 1050235 - DNA, 21 bp, Homo sapiens
gtgtgagaagtgaatgctggg

SEQ ID NO: 1050236 - DNA, 16 bp, Homo sapiens
gtgtgagagtgtgagc

SEQ ID NO: 1050237 - DNA, 22 bp, Homo sapiens
gtgtgagcgcttctgcagcctc

SEQ ID NO: 1050238 - DNA, 17 bp, Homo sapiens
gtgtgagcgtggccttg

SEQ ID NO: 1050239 - DNA, 15 bp, Homo sapiens
gtgtgaggccagggc

SEQ ID NO: 1050240 - DNA, 12 bp, Homo sapiens
gtgtgagggcag

SEQ ID NO: 1050241 - DNA, 17 bp, Homo sapiens
gtgtgagtaagagctgg

SEQ ID NO: 1050242 - DNA, 17 bp, Homo sapiens
gtgtgagtggcagccat

SEQ ID NO: 1050243 - DNA, 18 bp, Homo sapiens
gtgtgagtggcagccatg

SEQ ID NO: 1050244 - DNA, 15 bp, Homo sapiens
gtgtgagtgtgacag

SEQ ID NO: 1050245 - DNA, 14 bp, Homo sapiens
gtgtgagtgtgtgc

SEQ ID NO: 1050246 - DNA, 15 bp, Homo sapiens
gtgtgatccagccct

SEQ ID NO: 1050247 - DNA, 16 bp, Homo sapiens
gtgtgatccagccctg

SEQ ID NO: 1050248 - DNA, 21 bp, Homo sapiens
gtgtgatcttaatatatttga

SEQ ID NO: 1050249 - DNA, 17 bp, Homo sapiens
gtgtgatgaactttctc

SEQ ID NO: 1050250 - DNA, 16 bp, Homo sapiens
gtgtgattgaatctga

SEQ ID NO: 1050251 - DNA, 19 bp, Homo sapiens
gtgtgattgcacagaattt

SEQ ID NO: 1050252 - DNA, 14 bp, Homo sapiens
gtgtgatttcctaa

SEQ ID NO: 1050253 - DNA, 22 bp, Homo sapiens
gtgtgatttcctaaacataatt

SEQ ID NO: 1050254 - DNA, 15 bp, Homo sapiens
gtgtgcaacagacaa

SEQ ID NO: 1050255 - DNA, 16 bp, Homo sapiens
gtgtgcaacagacaag

SEQ ID NO: 1050256 - DNA, 20 bp, Homo sapiens
gtgtgcaactggccagccaa

SEQ ID NO: 1050257 - DNA, 19 bp, Homo sapiens
gtgtgcacacgtgtgtatg

SEQ ID NO: 1050258 - DNA, 20 bp, Homo sapiens
gtgtgcacacgtgtgtatga

SEQ ID NO: 1050259 - DNA, 14 bp, Homo sapiens
gtgtgcacagaaaa

SEQ ID NO: 1050260 - DNA, 14 bp, Homo sapiens
gtgtgcagacagcc

SEQ ID NO: 1050261 - DNA, 23 bp, Homo sapiens
gtgtgcagacagccatgcgtggc

SEQ ID NO: 1050262 - DNA, 13 bp, Homo sapiens
gtgtgcagactga

SEQ ID NO: 1050263 - DNA, 12 bp, Homo sapiens
gtgtgcaggagc

SEQ ID NO: 1050264 - DNA, 17 bp, Homo sapiens
gtgtgcaggagcctccc

SEQ ID NO: 1050265 - DNA, 13 bp, Homo sapiens
gtgtgcagtgaag

SEQ ID NO: 1050266 - DNA, 22 bp, Homo sapiens
gtgtgcatagcgtcctgccctg

SEQ ID NO: 1050267 - DNA, 23 bp, Homo sapiens
gtgtgcatagcgtcctgccctgc

SEQ ID NO: 1050268 - DNA, 15 bp, Homo sapiens
cttgcccgctcccac

SEQ ID NO: 1050269 - DNA, 18 bp, Homo sapiens
cttgcccggattctggga

SEQ ID NO: 1050270 - DNA, 18 bp, Homo sapiens
cttgcccgtcggccctgc

SEQ ID NO: 1050271 - DNA, 16 bp, Homo sapiens
cttgcccgtcgtgtgc

SEQ ID NO: 1050272 - DNA, 17 bp, Homo sapiens
cttgcccgtcgtgtgct

SEQ ID NO: 1050273 - DNA, 22 bp, Homo sapiens
cttgcccgtcgtgtgctgaaga

SEQ ID NO: 1050274 - DNA, 14 bp, Homo sapiens
cttgccctccgcct

SEQ ID NO: 1050275 - DNA, 18 bp, Homo sapiens
cttgccctccgcctggga

SEQ ID NO: 1050276 - DNA, 12 bp, Homo sapiens
cttgccctgacc

SEQ ID NO: 1050277 - DNA, 14 bp, Homo sapiens
cttgccctgacctc

SEQ ID NO: 1050278 - DNA, 18 bp, Homo sapiens
cttgccctgttctcttca

SEQ ID NO: 1050279 - DNA, 19 bp, Homo sapiens
cttgcccttccctgtccct

SEQ ID NO: 1050280 - DNA, 17 bp, Homo sapiens
cttgcccttgccctgac

SEQ ID NO: 1050281 - DNA, 16 bp, Homo sapiens
cttgcccttgggtgct

SEQ ID NO: 1050282 - DNA, 17 bp, Homo sapiens
cttgccctttcccccca

SEQ ID NO: 1050283 - DNA, 14 bp, Homo sapiens
cttgccgagcctaa

SEQ ID NO: 1050284 - DNA, 23 bp, Homo sapiens
cttgccgcgtcgccctcccaggc

SEQ ID NO: 1050285 - DNA, 21 bp, Homo sapiens
cttgcctaactaactggcagg

SEQ ID NO: 1050286 - DNA, 18 bp, Homo sapiens
cttgcctagccccaggtc

SEQ ID NO: 1050287 - DNA, 18 bp, Homo sapiens
cttgcctaggccaaatgc

SEQ ID NO: 1050288 - DNA, 16 bp, Homo sapiens
cttgcctagggcctgg

SEQ ID NO: 1050289 - DNA, 15 bp, Homo sapiens
cttgcctcaatgcca

SEQ ID NO: 1050290 - DNA, 12 bp, Homo sapiens
cttgcctcccca

SEQ ID NO: 1050291 - DNA, 20 bp, Homo sapiens
cttgcctccccatttcccat

SEQ ID NO: 1050292 - DNA, 16 bp, Homo sapiens
cttgcctcctggaaga

SEQ ID NO: 1050293 - DNA, 13 bp, Homo sapiens
cttgcctctctca

SEQ ID NO: 1050294 - DNA, 13 bp, Homo sapiens
cttgcctctgtgc

SEQ ID NO: 1050295 - DNA, 14 bp, Homo sapiens
cttgcctctgtgct

SEQ ID NO: 1050296 - DNA, 15 bp, Homo sapiens
cttgcctctgtgctg

SEQ ID NO: 1050297 - DNA, 16 bp, Homo sapiens
cttgcctctgtgctgt

SEQ ID NO: 1050298 - DNA, 12 bp, Homo sapiens
cttgcctcttcc

SEQ ID NO: 1050299 - DNA, 13 bp, Homo sapiens
cttgcctcttcct

SEQ ID NO: 1050300 - DNA, 16 bp, Homo sapiens
cttgcctgaactccag

SEQ ID NO: 1050301 - DNA, 12 bp, Homo sapiens
cttgcctgaagc

SEQ ID NO: 1050302 - DNA, 14 bp, Homo sapiens
cttgcctgatataa

SEQ ID NO: 1050303 - DNA, 11 bp, Homo sapiens
cttgcctgcct

SEQ ID NO: 1050304 - DNA, 12 bp, Homo sapiens
cttgcctgcctc

SEQ ID NO: 1050305 - DNA, 11 bp, Homo sapiens
cttgcctggaa

SEQ ID NO: 1050306 - DNA, 20 bp, Homo sapiens
cttgcctgggctgggcagcc

SEQ ID NO: 1050307 - DNA, 20 bp, Homo sapiens
cttgcctgtttcccaggccc

SEQ ID NO: 1050308 - DNA, 23 bp, Homo sapiens
cttgccttaaatatatcccatat

SEQ ID NO: 1050309 - DNA, 19 bp, Homo sapiens
cttgccttaaccagtctct

SEQ ID NO: 1050310 - DNA, 17 bp, Homo sapiens
cttgccttaataaatat

SEQ ID NO: 1050311 - DNA, 20 bp, Homo sapiens
cttgccttaataaatatgta

SEQ ID NO: 1050312 - DNA, 18 bp, Homo sapiens
cttgccttattagagtgt

SEQ ID NO: 1050313 - DNA, 15 bp, Homo sapiens
cttgccttgcttctc

SEQ ID NO: 1050314 - DNA, 16 bp, Homo sapiens
cttgccttgcttctcc

SEQ ID NO: 1050315 - DNA, 20 bp, Homo sapiens
cttgccttgcttctcccatt

SEQ ID NO: 1050316 - DNA, 21 bp, Homo sapiens
cttgccttgcttctcccattt

SEQ ID NO: 1050317 - DNA, 20 bp, Homo sapiens
cttgcgaatccaagctccct

SEQ ID NO: 1050318 - DNA, 17 bp, Homo sapiens
cttgcgagtccaaggcc

SEQ ID NO: 1050319 - DNA, 13 bp, Homo sapiens
cttgcgcctcagc

SEQ ID NO: 1050320 - DNA, 21 bp, Homo sapiens
cttgcgcctcagccctcagtt

SEQ ID NO: 1050321 - DNA, 16 bp, Homo sapiens
cttgcggaagccatag

SEQ ID NO: 1050322 - DNA, 17 bp, Homo sapiens
cttgcggcaaaaggaaa

SEQ ID NO: 1050323 - DNA, 15 bp, Homo sapiens
cttgcgtatgtctgt

SEQ ID NO: 1050324 - DNA, 13 bp, Homo sapiens
cttgcgtcctgca

SEQ ID NO: 1050325 - DNA, 14 bp, Homo sapiens
cttgctaaagcact

SEQ ID NO: 1050326 - DNA, 19 bp, Homo sapiens
cttgctaaagcactttgca

SEQ ID NO: 1050327 - DNA, 21 bp, Homo sapiens
cttgctaaagcactttgcact

SEQ ID NO: 1050328 - DNA, 13 bp, Homo sapiens
cttgctatttcaa

SEQ ID NO: 1050329 - DNA, 15 bp, Homo sapiens
cttgctatttcaata

SEQ ID NO: 1050330 - DNA, 22 bp, Homo sapiens
cttgctatttgagcatgcacag

SEQ ID NO: 1050331 - DNA, 21 bp, Homo sapiens
cttgctcagatagatctgtgt

SEQ ID NO: 1050332 - DNA, 22 bp, Homo sapiens
gattacataatcaaagctacct

SEQ ID NO: 1050333 - DNA, 15 bp, Homo sapiens
gattacataatctgt

SEQ ID NO: 1050334 - DNA, 14 bp, Homo sapiens
gattacatgcatgt

SEQ ID NO: 1050335 - DNA, 20 bp, Homo sapiens
gattacccaaatataaccat

SEQ ID NO: 1050336 - DNA, 18 bp, Homo sapiens
gattactcagagcagatg

SEQ ID NO: 1050337 - DNA, 12 bp, Homo sapiens
gattactctttg

SEQ ID NO: 1050338 - DNA, 19 bp, Homo sapiens
gattacttctctataaaaa

SEQ ID NO: 1050339 - DNA, 20 bp, Homo sapiens
gattacttctctataaaaaa

SEQ ID NO: 1050340 - DNA, 21 bp, Homo sapiens
gattagaaatgaccaatatta

SEQ ID NO: 1050341 - DNA, 17 bp, Homo sapiens
gattagaagctgaaaac

SEQ ID NO: 1050342 - DNA, 19 bp, Homo sapiens
gattagacagaacacctat

SEQ ID NO: 1050343 - DNA, 18 bp, Homo sapiens
gattagacctttatccag

SEQ ID NO: 1050344 - DNA, 18 bp, Homo sapiens
gattagagtggttattca

SEQ ID NO: 1050345 - DNA, 19 bp, Homo sapiens
gattagagtggttattcat

SEQ ID NO: 1050346 - DNA, 16 bp, Homo sapiens
gattagattgcaaagc

SEQ ID NO: 1050347 - DNA, 16 bp, Homo sapiens
gattagggaaaatgga

SEQ ID NO: 1050348 - DNA, 22 bp, Homo sapiens
gattaggtgaagggatggggga

SEQ ID NO: 1050349 - DNA, 18 bp, Homo sapiens
gattagtataatatttct

SEQ ID NO: 1050350 - DNA, 16 bp, Homo sapiens
gattataaaaaatgta

SEQ ID NO: 1050351 - DNA, 13 bp, Homo sapiens
gattataaatgtt

SEQ ID NO: 1050352 - DNA, 23 bp, Homo sapiens
gattatcagtatcacgatttgca

SEQ ID NO: 1050353 - DNA, 20 bp, Homo sapiens
gattatcgttttcttaaagt

SEQ ID NO: 1050354 - DNA, 21 bp, Homo sapiens
gattatcgttttcttaaagtg

SEQ ID NO: 1050355 - DNA, 18 bp, Homo sapiens
gattatcttcagcccagg

SEQ ID NO: 1050356 - DNA, 18 bp, Homo sapiens
gattatggaaaaataaaa

SEQ ID NO: 1050357 - DNA, 13 bp, Homo sapiens
gattatgtgactt

SEQ ID NO: 1050358 - DNA, 19 bp, Homo sapiens
gattattaacgatgtccaa

SEQ ID NO: 1050359 - DNA, 17 bp, Homo sapiens
gattattactaattcta

SEQ ID NO: 1050360 - DNA, 17 bp, Homo sapiens
gattattacttctgttt

SEQ ID NO: 1050361 - DNA, 19 bp, Homo sapiens
gattattacttctgtttct

SEQ ID NO: 1050362 - DNA, 15 bp, Homo sapiens
gattattataaacta

SEQ ID NO: 1050363 - DNA, 17 bp, Homo sapiens
gattattataaactata

SEQ ID NO: 1050364 - DNA, 19 bp, Homo sapiens
gattattcatttaaaatga

SEQ ID NO: 1050365 - DNA, 21 bp, Homo sapiens
gattattgagttccagttgaa

SEQ ID NO: 1050366 - DNA, 17 bp, Homo sapiens
gattatttaagactaaa

SEQ ID NO: 1050367 - DNA, 16 bp, Homo sapiens
gattatttctgtattt

SEQ ID NO: 1050368 - DNA, 11 bp, Homo sapiens
gattatttgca

SEQ ID NO: 1050369 - DNA, 12 bp, Homo sapiens
gattatttgcat

SEQ ID NO: 1050370 - DNA, 17 bp, Homo sapiens
gattatttgcatgttat

SEQ ID NO: 1050371 - DNA, 18 bp, Homo sapiens
gattatttgcatgttatg

SEQ ID NO: 1050372 - DNA, 18 bp, Homo sapiens
gattattttttatactgt

SEQ ID NO: 1050373 - DNA, 14 bp, Homo sapiens
gattcaaaatattt

SEQ ID NO: 1050374 - DNA, 18 bp, Homo sapiens
gattcaaaatatttaaaa

SEQ ID NO: 1050375 - DNA, 22 bp, Homo sapiens
gattcaaaatatttaaaaatgt

SEQ ID NO: 1050376 - DNA, 21 bp, Homo sapiens
gattcaaaccaaagctgcctg

SEQ ID NO: 1050377 - DNA, 13 bp, Homo sapiens
gattcaaattgct

SEQ ID NO: 1050378 - DNA, 15 bp, Homo sapiens
gattcaacagggaag

SEQ ID NO: 1050379 - DNA, 13 bp, Homo sapiens
gattcaagccatt

SEQ ID NO: 1050380 - DNA, 22 bp, Homo sapiens
gattcaatctgtaaactgtgta

SEQ ID NO: 1050381 - DNA, 17 bp, Homo sapiens
gattcaattttctttaa

SEQ ID NO: 1050382 - DNA, 18 bp, Homo sapiens
gattcaattttttaatgt

SEQ ID NO: 1050383 - DNA, 21 bp, Homo sapiens
gattcacacctgactctgaaa

SEQ ID NO: 1050384 - DNA, 14 bp, Homo sapiens
gattcacctcttcc

SEQ ID NO: 1050385 - DNA, 17 bp, Homo sapiens
gattcacctcttcctct

SEQ ID NO: 1050386 - DNA, 14 bp, Homo sapiens
gattcacctgtaaa

SEQ ID NO: 1050387 - DNA, 15 bp, Homo sapiens
gattcacctgtaaaa

SEQ ID NO: 1050388 - DNA, 19 bp, Homo sapiens
gattcacctgtaaaacttt

SEQ ID NO: 1050389 - DNA, 20 bp, Homo sapiens
gattcacctgtaaaacttta

SEQ ID NO: 1050390 - DNA, 22 bp, Homo sapiens
gattcacctgtaaaactttatt

SEQ ID NO: 1050391 - DNA, 15 bp, Homo sapiens
gattcacgcttttgt

SEQ ID NO: 1050392 - DNA, 21 bp, Homo sapiens
gattcactttgtttatgcata

SEQ ID NO: 1050393 - DNA, 23 bp, Homo sapiens
gattcagaaaatgttctgtttgc

SEQ ID NO: 1050394 - DNA, 15 bp, Homo sapiens
gattcagatcgaaat

SEQ ID NO: 1050395 - DNA, 13 bp, Homo sapiens
gattcagccttct

SEQ ID NO: 1050396 - DNA, 15 bp, Homo sapiens
gattcagccttcttt

SEQ ID NO: 1050397 - DNA, 22 bp, Homo sapiens
gattcagctcattatgaaaaac

SEQ ID NO: 1050398 - DNA, 13 bp, Homo sapiens
gattcaggaatgt

SEQ ID NO: 1050399 - DNA, 19 bp, Homo sapiens
gattcaggagttttaatgt

SEQ ID NO: 1050400 - DNA, 15 bp, Homo sapiens
gattcaggccagccc

SEQ ID NO: 1050401 - DNA, 16 bp, Homo sapiens
gattcaggccagccca

SEQ ID NO: 1050402 - DNA, 22 bp, Homo sapiens
gattcaggccagcccagccagg

SEQ ID NO: 1050403 - DNA, 13 bp, Homo sapiens
gattcaggctgct

SEQ ID NO: 1050404 - DNA, 16 bp, Homo sapiens
gattcaggctgcttgg

SEQ ID NO: 1050405 - DNA, 14 bp, Homo sapiens
gattcaggggaagg

SEQ ID NO: 1050406 - DNA, 15 bp, Homo sapiens
gattcaggggaaggg

SEQ ID NO: 1050407 - DNA, 16 bp, Homo sapiens
gattcaggggaagggc

SEQ ID NO: 1050408 - DNA, 16 bp, Homo sapiens
gattcaggggctttgg

SEQ ID NO: 1050409 - DNA, 17 bp, Homo sapiens
gattcaggggctttggg

SEQ ID NO: 1050410 - DNA, 20 bp, Homo sapiens
gattcagtgttaaatgtgat

SEQ ID NO: 1050411 - DNA, 22 bp, Homo sapiens
gattcagttttcatttggttca

SEQ ID NO: 1050412 - DNA, 16 bp, Homo sapiens
gattcatagtaacttc

SEQ ID NO: 1050413 - DNA, 19 bp, Homo sapiens
gattcatagtaacttctta

SEQ ID NO: 1050414 - DNA, 17 bp, Homo sapiens
gattcatatttacttct

SEQ ID NO: 1050415 - DNA, 14 bp, Homo sapiens
gattcatctctggt

SEQ ID NO: 1050416 - DNA, 13 bp, Homo sapiens
gattcatttcctg

SEQ ID NO: 1050417 - DNA, 16 bp, Homo sapiens
gattcatttcctgccc

SEQ ID NO: 1050418 - DNA, 23 bp, Homo sapiens
gattcatttcctgcccttcctca

SEQ ID NO: 1050419 - DNA, 16 bp, Homo sapiens
gattcattttcctgtt

SEQ ID NO: 1050420 - DNA, 18 bp, Homo sapiens
gattcatttttgaaactg

SEQ ID NO: 1050421 - DNA, 18 bp, Homo sapiens
gattccaaaaagcacata

SEQ ID NO: 1050422 - DNA, 10 bp, Homo sapiens
gattccaaat

SEQ ID NO: 1050423 - DNA, 13 bp, Homo sapiens
gattccaaataaa

SEQ ID NO: 1050424 - DNA, 21 bp, Homo sapiens
gattccaaggctttaaagctg

SEQ ID NO: 1050425 - DNA, 22 bp, Homo sapiens
tattttaggcactgttcaatac

SEQ ID NO: 1050426 - DNA, 21 bp, Homo sapiens
tattttagtatacgtataaat

SEQ ID NO: 1050427 - DNA, 15 bp, Homo sapiens
tattttatataataa

SEQ ID NO: 1050428 - DNA, 19 bp, Homo sapiens
tattttatatcatacagtt

SEQ ID NO: 1050429 - DNA, 20 bp, Homo sapiens
tattttatatcatacagttt

SEQ ID NO: 1050430 - DNA, 13 bp, Homo sapiens
tattttatatgtt

SEQ ID NO: 1050431 - DNA, 16 bp, Homo sapiens
tattttatatgttcat

SEQ ID NO: 1050432 - DNA, 23 bp, Homo sapiens
tattttatatttaaaaattgttt

SEQ ID NO: 1050433 - DNA, 13 bp, Homo sapiens
tattttatcctgt

SEQ ID NO: 1050434 - DNA, 13 bp, Homo sapiens
tattttcaaagaa

SEQ ID NO: 1050435 - DNA, 13 bp, Homo sapiens
tattttcaagaaa

SEQ ID NO: 1050436 - DNA, 14 bp, Homo sapiens
tattttcaccattt

SEQ ID NO: 1050437 - DNA, 20 bp, Homo sapiens
tattttcagtatactgtgtg

SEQ ID NO: 1050438 - DNA, 19 bp, Homo sapiens
tattttcagtcaaaacttt

SEQ ID NO: 1050439 - DNA, 15 bp, Homo sapiens
tattttcatttgtac

SEQ ID NO: 1050440 - DNA, 15 bp, Homo sapiens
tattttcatttttgt

SEQ ID NO: 1050441 - DNA, 18 bp, Homo sapiens
tattttccagccttatgt

SEQ ID NO: 1050442 - DNA, 22 bp, Homo sapiens
tattttccataaatttggactg

SEQ ID NO: 1050443 - DNA, 22 bp, Homo sapiens
tattttccctattagagaagag

SEQ ID NO: 1050444 - DNA, 12 bp, Homo sapiens
tattttcctaaa

SEQ ID NO: 1050445 - DNA, 16 bp, Homo sapiens
tattttcctaaagaga

SEQ ID NO: 1050446 - DNA, 16 bp, Homo sapiens
tattttcctaatgtga

SEQ ID NO: 1050447 - DNA, 15 bp, Homo sapiens
tattttcctccccag

SEQ ID NO: 1050448 - DNA, 13 bp, Homo sapiens
tattttcgggatt

SEQ ID NO: 1050449 - DNA, 14 bp, Homo sapiens
tattttctacagtg

SEQ ID NO: 1050450 - DNA, 19 bp, Homo sapiens
tattttctattttaagact

SEQ ID NO: 1050451 - DNA, 12 bp, Homo sapiens
tattttctgtca

SEQ ID NO: 1050452 - DNA, 21 bp, Homo sapiens
tattttctgtcagatgagaac

SEQ ID NO: 1050453 - DNA, 21 bp, Homo sapiens
tattttcttacccaatttccc

SEQ ID NO: 1050454 - DNA, 19 bp, Homo sapiens
gatttcatcttctggaata

SEQ ID NO: 1050455 - DNA, 16 bp, Homo sapiens
gatttcatgctatctc

SEQ ID NO: 1050456 - DNA, 18 bp, Homo sapiens
gatttcatgctatctctg

SEQ ID NO: 1050457 - DNA, 20 bp, Homo sapiens
gatttcatttcaactgtttg

SEQ ID NO: 1050458 - DNA, 14 bp, Homo sapiens
gatttccaggcccc

SEQ ID NO: 1050459 - DNA, 17 bp, Homo sapiens
gatttccaggcccctga

SEQ ID NO: 1050460 - DNA, 13 bp, Homo sapiens
gatttccatctta

SEQ ID NO: 1050461 - DNA, 23 bp, Homo sapiens
gatttccctgcagacctcaagcc

SEQ ID NO: 1050462 - DNA, 19 bp, Homo sapiens
gatttcccttcatttaaac

SEQ ID NO: 1050463 - DNA, 22 bp, Homo sapiens
gatttcctccatggtggaaggg

SEQ ID NO: 1050464 - DNA, 13 bp, Homo sapiens
gatttcctggagt

SEQ ID NO: 1050465 - DNA, 18 bp, Homo sapiens
gatttcctggagtgccct

SEQ ID NO: 1050466 - DNA, 19 bp, Homo sapiens
gatttcctggagtgccctg

SEQ ID NO: 1050467 - DNA, 22 bp, Homo sapiens
gatttccttgaatgtggcttga

SEQ ID NO: 1050468 - DNA, 16 bp, Homo sapiens
gatttctaacagtcct

SEQ ID NO: 1050469 - DNA, 18 bp, Homo sapiens
gatttctagcaggcagga

SEQ ID NO: 1050470 - DNA, 13 bp, Homo sapiens
gatttctagtgta

SEQ ID NO: 1050471 - DNA, 11 bp, Homo sapiens
gatttctctga

SEQ ID NO: 1050472 - DNA, 21 bp, Homo sapiens
gatttctcttgggcaggcaga

SEQ ID NO: 1050473 - DNA, 14 bp, Homo sapiens
gatttctgaggaaa

SEQ ID NO: 1050474 - DNA, 19 bp, Homo sapiens
gatttctgcccttgttcca

SEQ ID NO: 1050475 - DNA, 12 bp, Homo sapiens
gatttctgggat

SEQ ID NO: 1050476 - DNA, 22 bp, Homo sapiens
gatttctgtttagataatacac

SEQ ID NO: 1050477 - DNA, 17 bp, Homo sapiens
gatttcttcaaatctca

SEQ ID NO: 1050478 - DNA, 17 bp, Homo sapiens
gatttcttcagaattag

SEQ ID NO: 1050479 - DNA, 17 bp, Homo sapiens
gatttcttcgctgctct

SEQ ID NO: 1050480 - DNA, 16 bp, Homo sapiens
gatttcttttttatgt

SEQ ID NO: 1050481 - DNA, 18 bp, Homo sapiens
gatttgaaaaaaagcatg

SEQ ID NO: 1050482 - DNA, 21 bp, Homo sapiens
gatttgaaaaaaagcatggta

SEQ ID NO: 1050483 - DNA, 13 bp, Homo sapiens
gatttgaaaaact

SEQ ID NO: 1050484 - DNA, 16 bp, Homo sapiens
gatttgaaaaactttt

SEQ ID NO: 1050485 - DNA, 18 bp, Homo sapiens
gatttgaaaaacttttag

SEQ ID NO: 1050486 - DNA, 14 bp, Homo sapiens
gatttgaaaattgt

SEQ ID NO: 1050487 - DNA, 18 bp, Homo sapiens
gatttgaagaacatgtga

SEQ ID NO: 1050488 - DNA, 20 bp, Homo sapiens
gatttgaagaacatgtgaga

SEQ ID NO: 1050489 - DNA, 13 bp, Homo sapiens
gatttgatctttg

SEQ ID NO: 1050490 - DNA, 18 bp, Homo sapiens
gatttgatgctgtttgac

SEQ ID NO: 1050491 - DNA, 14 bp, Homo sapiens
gatttgatgtgact

SEQ ID NO: 1050492 - DNA, 17 bp, Homo sapiens
gatttgatgtgactttt

SEQ ID NO: 1050493 - DNA, 19 bp, Homo sapiens
gatttgattcattttcctg

SEQ ID NO: 1050494 - DNA, 15 bp, Homo sapiens
gatttgcattgaaca

SEQ ID NO: 1050495 - DNA, 12 bp, Homo sapiens
gatttgccagca

SEQ ID NO: 1050496 - DNA, 14 bp, Homo sapiens
gatttgccagcaca

SEQ ID NO: 1050497 - DNA, 15 bp, Homo sapiens
gatttgccagcacag

SEQ ID NO: 1050498 - DNA, 20 bp, Homo sapiens
gatttgccagcacaggggcc

SEQ ID NO: 1050499 - DNA, 15 bp, Homo sapiens
gatttggaattgaac

SEQ ID NO: 1050500 - DNA, 19 bp, Homo sapiens
gatttggagaccgaagact

SEQ ID NO: 1050501 - DNA, 19 bp, Homo sapiens
gatttgggctgaatgtatg

SEQ ID NO: 1050502 - DNA, 22 bp, Homo sapiens
gatttggtacttttgagtgtgt

SEQ ID NO: 1050503 - DNA, 18 bp, Homo sapiens
gatttggttgcactttag

SEQ ID NO: 1050504 - DNA, 24 bp, Homo sapiens
gatttggttgcactttagacattt

SEQ ID NO: 1050505 - DNA, 12 bp, Homo sapiens
gatttgtaccat

SEQ ID NO: 1050506 - DNA, 11 bp, Homo sapiens
gatttgtagca

SEQ ID NO: 1050507 - DNA, 17 bp, Homo sapiens
gatttgtagcactgagg

SEQ ID NO: 1050508 - DNA, 13 bp, Homo sapiens
gatttgtatattt

SEQ ID NO: 1050509 - DNA, 14 bp, Homo sapiens
gatttgtcccagcc

SEQ ID NO: 1050510 - DNA, 18 bp, Homo sapiens
gatttgtccttttatttc

SEQ ID NO: 1050511 - DNA, 22 bp, Homo sapiens
gatttgttgacagcaaaatgtt

SEQ ID NO: 1050512 - DNA, 22 bp, Homo sapiens
gatttgttgccatgtgcacctt

SEQ ID NO: 1050513 - DNA, 16 bp, Homo sapiens
gattttaaaatgaata

SEQ ID NO: 1050514 - DNA, 21 bp, Homo sapiens
gattttaaattcacaatagaa

SEQ ID NO: 1050515 - DNA, 14 bp, Homo sapiens
gattttaacaataa

SEQ ID NO: 1050516 - DNA, 17 bp, Homo sapiens
gattttaacaataacta

SEQ ID NO: 1050517 - DNA, 23 bp, Homo sapiens
gattttaacaataactactgtgt

SEQ ID NO: 1050518 - DNA, 19 bp, Homo sapiens
gattttaagtattgtttcc

SEQ ID NO: 1050519 - DNA, 18 bp, Homo sapiens
gattttaatttcaggaaa

SEQ ID NO: 1050520 - DNA, 22 bp, Homo sapiens
gattttaattttatattcagtg

SEQ ID NO: 1050521 - DNA, 15 bp, Homo sapiens
gattttaattttgaa

SEQ ID NO: 1050522 - DNA, 16 bp, Homo sapiens
gattttacaaaagatg

SEQ ID NO: 1050523 - DNA, 18 bp, Homo sapiens
gattttacaattgaaatg

SEQ ID NO: 1050524 - DNA, 19 bp, Homo sapiens
gattttaccaaagcatcaa

SEQ ID NO: 1050525 - DNA, 14 bp, Homo sapiens
gattttagataaag

SEQ ID NO: 1050526 - DNA, 15 bp, Homo sapiens
gattttatattttct

SEQ ID NO: 1050527 - DNA, 19 bp, Homo sapiens
gattttatattttctattt

SEQ ID NO: 1050528 - DNA, 22 bp, Homo sapiens
gattttattacagaaatgtttt

SEQ ID NO: 1050529 - DNA, 15 bp, Homo sapiens
gattttatttgacaa

SEQ ID NO: 1050530 - DNA, 18 bp, Homo sapiens
gattttcaagattctaaa

SEQ ID NO: 1050531 - DNA, 19 bp, Homo sapiens
gattttcaagattctaaag

SEQ ID NO: 1050532 - DNA, 21 bp, Homo sapiens
gattttcaagattctaaagct

SEQ ID NO: 1050533 - DNA, 19 bp, Homo sapiens
gattttcacattcttggct

SEQ ID NO: 1050534 - DNA, 15 bp, Homo sapiens
gattttcatttcatg

SEQ ID NO: 1050535 - DNA, 17 bp, Homo sapiens
gattttctagaaatgtt

SEQ ID NO: 1050536 - DNA, 17 bp, Homo sapiens
gattttctattgttact

SEQ ID NO: 1050537 - DNA, 18 bp, Homo sapiens
gattttctattgttactc

SEQ ID NO: 1050538 - DNA, 22 bp, Homo sapiens
gattttctattgttactctggt

SEQ ID NO: 1050539 - DNA, 16 bp, Homo sapiens
gattttctccagctca

SEQ ID NO: 1050540 - DNA, 21 bp, Homo sapiens
gattttcttaaggaattttgt

SEQ ID NO: 1050541 - DNA, 17 bp, Homo sapiens
gattttcttttgccttt

SEQ ID NO: 1050542 - DNA, 16 bp, Homo sapiens
gattttgaacttttta

SEQ ID NO: 1050543 - DNA, 15 bp, Homo sapiens
gattttgcaaaatga

SEQ ID NO: 1050544 - DNA, 15 bp, Homo sapiens
gattttgccctcctg

SEQ ID NO: 1050545 - DNA, 16 bp, Homo sapiens
gattttgccctcctgc

SEQ ID NO: 1050546 - DNA, 16 bp, Homo sapiens
gattttgctgtagaag

SEQ ID NO: 1050547 - DNA, 18 bp, Homo sapiens
gattttggataaatcatt

SEQ ID NO: 1050548 - DNA, 16 bp, Homo sapiens
gattttggcagggcgg

SEQ ID NO: 1050549 - DNA, 15 bp, Homo sapiens
gattttgtaattctt

SEQ ID NO: 1050550 - DNA, 20 bp, Homo sapiens
gattttgtgttttttcgttc

SEQ ID NO: 1050551 - DNA, 20 bp, Homo sapiens
gatttttaccgtttcttccc

SEQ ID NO: 1050552 - DNA, 22 bp, Homo sapiens
gatttttctaaccttgaatgct

SEQ ID NO: 1050553 - DNA, 23 bp, Homo sapiens
gatttttctaaccttgaatgctg

SEQ ID NO: 1050554 - DNA, 16 bp, Homo sapiens
gatttttctataatca

SEQ ID NO: 1050555 - DNA, 11 bp, Homo sapiens
gatttttctct

SEQ ID NO: 1050556 - DNA, 21 bp, Homo sapiens
gatttttcttcaggtaacact

SEQ ID NO: 1050557 - DNA, 15 bp, Homo sapiens
gatttttctttaact

SEQ ID NO: 1050558 - DNA, 22 bp, Homo sapiens
gatttttgaaaatcctgaataa

SEQ ID NO: 1050559 - DNA, 15 bp, Homo sapiens
tcaaatgacccaaag

SEQ ID NO: 1050560 - DNA, 17 bp, Homo sapiens
tcaaatgacccaaagac

SEQ ID NO: 1050561 - DNA, 19 bp, Homo sapiens
tcaaatgacccaaagacca

SEQ ID NO: 1050562 - DNA, 16 bp, Homo sapiens
tcaaatgcagtatatt

SEQ ID NO: 1050563 - DNA, 14 bp, Homo sapiens
tcaaatgctcagac

SEQ ID NO: 1050564 - DNA, 21 bp, Homo sapiens
tcaaatgctcagaccagctct

SEQ ID NO: 1050565 - DNA, 15 bp, Homo sapiens
tcaaatggtgtcatg

SEQ ID NO: 1050566 - DNA, 18 bp, Homo sapiens
tcaaatgttacagtttat

SEQ ID NO: 1050567 - DNA, 23 bp, Homo sapiens
tcaaatgttacagtttatattgt

SEQ ID NO: 1050568 - DNA, 23 bp, Homo sapiens
tcaaatgtttccttaaacatgaa

SEQ ID NO: 1050569 - DNA, 12 bp, Homo sapiens
tcaaattaataa

SEQ ID NO: 1050570 - DNA, 15 bp, Homo sapiens
tcaaattagaagaca

SEQ ID NO: 1050571 - DNA, 13 bp, Homo sapiens
tcaaattcaaata

SEQ ID NO: 1050572 - DNA, 14 bp, Homo sapiens
tcaaattcttctga

SEQ ID NO: 1050573 - DNA, 15 bp, Homo sapiens
tcaaattcttctgaa

SEQ ID NO: 1050574 - DNA, 16 bp, Homo sapiens
tcaaattcttctgaac

SEQ ID NO: 1050575 - DNA, 16 bp, Homo sapiens
tcaaattgagagaatg

SEQ ID NO: 1050576 - DNA, 22 bp, Homo sapiens
gcaaatggaggcttttcactgc

SEQ ID NO: 1050577 - DNA, 21 bp, Homo sapiens
gcaaatgggagctgagcagcc

SEQ ID NO: 1050578 - DNA, 18 bp, Homo sapiens
gcaaatgtcttccaggtc

SEQ ID NO: 1050579 - DNA, 12 bp, Homo sapiens
gcaaatgtgtac

SEQ ID NO: 1050580 - DNA, 12 bp, Homo sapiens
gcaaatgttttg

SEQ ID NO: 1050581 - DNA, 16 bp, Homo sapiens
gcaaattactccaagg

SEQ ID NO: 1050582 - DNA, 18 bp, Homo sapiens
gcaaattatttattactt

SEQ ID NO: 1050583 - DNA, 16 bp, Homo sapiens
gcaaattcagaactga

SEQ ID NO: 1050584 - DNA, 17 bp, Homo sapiens
gcaaattcttttgaatt

SEQ ID NO: 1050585 - DNA, 21 bp, Homo sapiens
gcaaatttctataaatttaag

SEQ ID NO: 1050586 - DNA, 17 bp, Homo sapiens
gcaaattttgtattatt

SEQ ID NO: 1050587 - DNA, 18 bp, Homo sapiens
gcaaattttgtattattg

SEQ ID NO: 1050588 - DNA, 19 bp, Homo sapiens
gcaacaaacctcactgaga

SEQ ID NO: 1050589 - DNA, 17 bp, Homo sapiens
gcaacaagactgccagg

SEQ ID NO: 1050590 - DNA, 22 bp, Homo sapiens
gcaacaatacatgctgctaatt

SEQ ID NO: 1050591 - DNA, 21 bp, Homo sapiens
gcaacactccggtcagcccct

SEQ ID NO: 1050592 - DNA, 22 bp, Homo sapiens
gcaacactccggtcagcccctg

SEQ ID NO: 1050593 - DNA, 14 bp, Homo sapiens
gcaacactgctgtc

SEQ ID NO: 1050594 - DNA, 15 bp, Homo sapiens
gcaacagaaaaatgg

SEQ ID NO: 1050595 - DNA, 13 bp, Homo sapiens
gcaacagacaagt

SEQ ID NO: 1050596 - DNA, 19 bp, Homo sapiens
gcaacagagtgagaccctg

SEQ ID NO: 1050597 - DNA, 14 bp, Homo sapiens
gcaacagcaagaaa

SEQ ID NO: 1050598 - DNA, 13 bp, Homo sapiens
gcaacagcactgg

SEQ ID NO: 1050599 - DNA, 15 bp, Homo sapiens
gcaacagggagcacc

SEQ ID NO: 1050600 - DNA, 21 bp, Homo sapiens
gcaacagggagcacctgtctg

SEQ ID NO: 1050601 - DNA, 23 bp, Homo sapiens
gcaacaggggaggaaaaaagaac

SEQ ID NO: 1050602 - DNA, 21 bp, Homo sapiens
gcaacagtaatctatgtgttt

SEQ ID NO: 1050603 - DNA, 16 bp, Homo sapiens
gcaacatatctctgcc

SEQ ID NO: 1050604 - DNA, 15 bp, Homo sapiens
gcaacatctctgaat

SEQ ID NO: 1050605 - DNA, 14 bp, Homo sapiens
gcaacattcattgc

SEQ ID NO: 1050606 - DNA, 11 bp, Homo sapiens
gcaacattcct

SEQ ID NO: 1050607 - DNA, 12 bp, Homo sapiens
gcaacattcctt

SEQ ID NO: 1050608 - DNA, 23 bp, Homo sapiens
gcaaccaactatccaagtgttat

SEQ ID NO: 1050609 - DNA, 17 bp, Homo sapiens
gcaaccaactgccccag

SEQ ID NO: 1050610 - DNA, 19 bp, Homo sapiens
gcaaccacatgtcccagat

SEQ ID NO: 1050611 - DNA, 14 bp, Homo sapiens
gcaaccactaagaa

SEQ ID NO: 1050612 - DNA, 14 bp, Homo sapiens
gcaaccagcaaatt

SEQ ID NO: 1050613 - DNA, 15 bp, Homo sapiens
gcaaccaggcagctg

SEQ ID NO: 1050614 - DNA, 16 bp, Homo sapiens
gcaaccaggcagctga

SEQ ID NO: 1050615 - DNA, 21 bp, Homo sapiens
gcaaccaggcagctgagacca

SEQ ID NO: 1050616 - DNA, 18 bp, Homo sapiens
gcaaccataagacaaact

SEQ ID NO: 1050617 - DNA, 19 bp, Homo sapiens
gcaaccccaggctgaagca

SEQ ID NO: 1050618 - DNA, 18 bp, Homo sapiens
gcaaccccagttctgctc

SEQ ID NO: 1050619 - DNA, 13 bp, Homo sapiens
gcaacccctgtac

SEQ ID NO: 1050620 - DNA, 21 bp, Homo sapiens
gcaacccgctggagcccacag

SEQ ID NO: 1050621 - DNA, 13 bp, Homo sapiens
gcaaccctgcctg

SEQ ID NO: 1050622 - DNA, 16 bp, Homo sapiens
gcaaccgggccctctc

SEQ ID NO: 1050623 - DNA, 23 bp, Homo sapiens
gcaaccgtctgttatgctgtgac

SEQ ID NO: 1050624 - DNA, 15 bp, Homo sapiens
gcaacctcactatgg

SEQ ID NO: 1050625 - DNA, 19 bp, Homo sapiens
gcaacctcagtaatttaga

SEQ ID NO: 1050626 - DNA, 23 bp, Homo sapiens
gcaacctctgcctcccaggttcc

SEQ ID NO: 1050627 - DNA, 15 bp, Homo sapiens
gcaacctgcaggctc

SEQ ID NO: 1050628 - DNA, 22 bp, Homo sapiens
gcaacctttcacctttgtgtat

SEQ ID NO: 1050629 - DNA, 23 bp, Homo sapiens
gcaacgaagaaaaaaaataacac

SEQ ID NO: 1050630 - DNA, 17 bp, Homo sapiens
gcaacgcccctccaaac

SEQ ID NO: 1050631 - DNA, 22 bp, Homo sapiens
gcaacgggattgaagggtcctg

SEQ ID NO: 1050632 - DNA, 13 bp, Homo sapiens
gcaactaaggaca

SEQ ID NO: 1050633 - DNA, 14 bp, Homo sapiens
gcaactaaggacaa

SEQ ID NO: 1050634 - DNA, 19 bp, Homo sapiens
gcaactaaggacaaattag

SEQ ID NO: 1050635 - DNA, 20 bp, Homo sapiens
gcaactaatgtttgaacaaa

SEQ ID NO: 1050636 - DNA, 16 bp, Homo sapiens
gcaactagccaaggct

SEQ ID NO: 1050637 - DNA, 22 bp, Homo sapiens
gcaactcaaggactttgcagcc

SEQ ID NO: 1050638 - DNA, 17 bp, Homo sapiens
gcaactctccactccat

SEQ ID NO: 1050639 - DNA, 18 bp, Homo sapiens
gcaactcttttaagtgcc

SEQ ID NO: 1050640 - DNA, 20 bp, Homo sapiens
gcaactgaacaaaagctcag

SEQ ID NO: 1050641 - DNA, 21 bp, Homo sapiens
gcaactgaataaatacctctt

SEQ ID NO: 1050642 - DNA, 19 bp, Homo sapiens
gcaactgacctgagcggca

SEQ ID NO: 1050643 - DNA, 21 bp, Homo sapiens
gcaactgacttcatttgtgcc

SEQ ID NO: 1050644 - DNA, 22 bp, Homo sapiens
gcaactgacttcatttgtgcca

SEQ ID NO: 1050645 - DNA, 16 bp, Homo sapiens
gcaactgcccttccag

SEQ ID NO: 1050646 - DNA, 20 bp, Homo sapiens
gcaactgctcagctctggtc

SEQ ID NO: 1050647 - DNA, 14 bp, Homo sapiens
gcaactggccagcc

SEQ ID NO: 1050648 - DNA, 20 bp, Homo sapiens
gcaactgttatgaaataaag

SEQ ID NO: 1050649 - DNA, 18 bp, Homo sapiens
gcaacttccgctgagggg

SEQ ID NO: 1050650 - DNA, 14 bp, Homo sapiens
gcaacttgcttcta

SEQ ID NO: 1050651 - DNA, 21 bp, Homo sapiens
gcaacttgtctttttctggac

SEQ ID NO: 1050652 - DNA, 21 bp, Homo sapiens
gcaagaaagagggtcccaggg

SEQ ID NO: 1050653 - DNA, 20 bp, Homo sapiens
gcaagaaaggggacccaaga

SEQ ID NO: 1050654 - DNA, 22 bp, Homo sapiens
gcaagaaatggcgtctgctctg

SEQ ID NO: 1050655 - DNA, 18 bp, Homo sapiens
gcaagaagcagcctgttt

SEQ ID NO: 1050656 - DNA, 16 bp, Homo sapiens
gcaagaataaaaaaga

SEQ ID NO: 1050657 - DNA, 13 bp, Homo sapiens
gcaagaattaaaa

SEQ ID NO: 1050658 - DNA, 18 bp, Homo sapiens
gcaagaattaaaactgag

SEQ ID NO: 1050659 - DNA, 15 bp, Homo sapiens
gcaagaatttgatcg

SEQ ID NO: 1050660 - DNA, 20 bp, Homo sapiens
gcaagacagaaaagtgcctg

SEQ ID NO: 1050661 - DNA, 18 bp, Homo sapiens
gcaagaccacggagggag

SEQ ID NO: 1050662 - DNA, 23 bp, Homo sapiens
gcaagaccacggagggagcgaca

SEQ ID NO: 1050663 - DNA, 16 bp, Homo sapiens
gcaagaccctgtctct

SEQ ID NO: 1050664 - DNA, 17 bp, Homo sapiens
gcaagacctagtcccct

SEQ ID NO: 1050665 - DNA, 22 bp, Homo sapiens
gcaagacctagtcccctttcct

SEQ ID NO: 1050666 - DNA, 23 bp, Homo sapiens
gcaagacctcatctgtggagctg

SEQ ID NO: 1050667 - DNA, 14 bp, Homo sapiens
gcaagacgccctct

SEQ ID NO: 1050668 - DNA, 19 bp, Homo sapiens
gcaagacgtaaagaatttt

SEQ ID NO: 1050669 - DNA, 17 bp, Homo sapiens
gcaagagagatgttttg

SEQ ID NO: 1050670 - DNA, 22 bp, Homo sapiens
gcaagagccttggtgtccacct

SEQ ID NO: 1050671 - DNA, 16 bp, Homo sapiens
gcaagagggaaggtga

SEQ ID NO: 1050672 - DNA, 15 bp, Homo sapiens
gcaagagggagggga

SEQ ID NO: 1050673 - DNA, 17 bp, Homo sapiens
gcaagagggaggggaca

SEQ ID NO: 1050674 - DNA, 19 bp, Homo sapiens
gcaagagggggacctgcca

SEQ ID NO: 1050675 - DNA, 17 bp, Homo sapiens
gcaagaggggtggagac

SEQ ID NO: 1050676 - DNA, 15 bp, Homo sapiens
gcaagagggtctctt

SEQ ID NO: 1050677 - DNA, 17 bp, Homo sapiens
gcaagagtaagcagtgt

SEQ ID NO: 1050678 - DNA, 19 bp, Homo sapiens
gcaagagtgattgcagctt

SEQ ID NO: 1050679 - DNA, 15 bp, Homo sapiens
gcaagagtgtgaaat

SEQ ID NO: 1050680 - DNA, 15 bp, Homo sapiens
gcaagatgtgaatta

SEQ ID NO: 1050681 - DNA, 14 bp, Homo sapiens
gcaagattgcttaa

SEQ ID NO: 1050682 - DNA, 18 bp, Homo sapiens
gcaagattggaaagacag

SEQ ID NO: 1050683 - DNA, 19 bp, Homo sapiens
gcaagattggaaagacagg

SEQ ID NO: 1050684 - DNA, 19 bp, Homo sapiens
gcaagcagctggtcagtct

SEQ ID NO: 1050685 - DNA, 12 bp, Homo sapiens
gcaagcagcttt

SEQ ID NO: 1050686 - DNA, 12 bp, Homo sapiens
gcaagcagggaa

SEQ ID NO: 1050687 - DNA, 23 bp, Homo sapiens
gcaagcagtctaccctgtccttt

SEQ ID NO: 1050688 - DNA, 22 bp, Homo sapiens
gcaagcatgtaacttatattaa

SEQ ID NO: 1050689 - DNA, 17 bp, Homo sapiens
gcaagcattcagaagaa

SEQ ID NO: 1050690 - DNA, 18 bp, Homo sapiens
gcaagcattcagaagaaa

SEQ ID NO: 1050691 - DNA, 15 bp, Homo sapiens
tcaagtttacacttc

SEQ ID NO: 1050692 - DNA, 15 bp, Homo sapiens
tcaagttttaaagtt

SEQ ID NO: 1050693 - DNA, 21 bp, Homo sapiens
tcaagttttaagtgaaagtga

SEQ ID NO: 1050694 - DNA, 15 bp, Homo sapiens
tcaataaaagagctg

SEQ ID NO: 1050695 - DNA, 14 bp, Homo sapiens
tcaataaaatgtga

SEQ ID NO: 1050696 - DNA, 17 bp, Homo sapiens
tcaataaacaacagctg

SEQ ID NO: 1050697 - DNA, 19 bp, Homo sapiens
gcaccaggaagtgtttatg

SEQ ID NO: 1050698 - DNA, 20 bp, Homo sapiens
gcaccaggcacgaacccacc

SEQ ID NO: 1050699 - DNA, 19 bp, Homo sapiens
gcaccaggggtttctcgca

SEQ ID NO: 1050700 - DNA, 12 bp, Homo sapiens
gcaccataactt

SEQ ID NO: 1050701 - DNA, 22 bp, Homo sapiens
gcaccatccctttttgaagtgt

SEQ ID NO: 1050702 - DNA, 15 bp, Homo sapiens
gcaccatctgcttgg

SEQ ID NO: 1050703 - DNA, 23 bp, Homo sapiens
gcaccattctgactcggtttctc

SEQ ID NO: 1050704 - DNA, 22 bp, Homo sapiens
gcacccacaaataaatgacaag

SEQ ID NO: 1050705 - DNA, 22 bp, Homo sapiens
gcacccaccagaaattccagta

SEQ ID NO: 1050706 - DNA, 13 bp, Homo sapiens
gcacccaccctgg

SEQ ID NO: 1050707 - DNA, 20 bp, Homo sapiens
gcacccaccgtctcggccct

SEQ ID NO: 1050708 - DNA, 14 bp, Homo sapiens
tcaccctatatata

SEQ ID NO: 1050709 - DNA, 15 bp, Homo sapiens
tcaccctcatgaaaa

SEQ ID NO: 1050710 - DNA, 15 bp, Homo sapiens
tcaccctccacctct

SEQ ID NO: 1050711 - DNA, 15 bp, Homo sapiens
tcaccctccacttcc

SEQ ID NO: 1050712 - DNA, 10 bp, Homo sapiens
tcaccctcct

SEQ ID NO: 1050713 - DNA, 15 bp, Homo sapiens
tcaccctctgtcccc

SEQ ID NO: 1050714 - DNA, 19 bp, Homo sapiens
tcaccctgagccccttcct

SEQ ID NO: 1050715 - DNA, 13 bp, Homo sapiens
tcaccctgcagag

SEQ ID NO: 1050716 - DNA, 12 bp, Homo sapiens
tcaccctgcccg

SEQ ID NO: 1050717 - DNA, 21 bp, Homo sapiens
tcaccctgcccgctcccaacc

SEQ ID NO: 1050718 - DNA, 15 bp, Homo sapiens
tcaccctgccttatc

SEQ ID NO: 1050719 - DNA, 14 bp, Homo sapiens
tcaccctgggcagt

SEQ ID NO: 1050720 - DNA, 13 bp, Homo sapiens
tcaccctgtcaag

SEQ ID NO: 1050721 - DNA, 13 bp, Homo sapiens
tcaccctgtgggt

SEQ ID NO: 1050722 - DNA, 17 bp, Homo sapiens
tcacccttaacccaagg

SEQ ID NO: 1050723 - DNA, 16 bp, Homo sapiens
tcacccttcctggccc

SEQ ID NO: 1050724 - DNA, 18 bp, Homo sapiens
tcacccttcctggcccag

SEQ ID NO: 1050725 - DNA, 15 bp, Homo sapiens
tcaccgacagcggcc

SEQ ID NO: 1050726 - DNA, 20 bp, Homo sapiens
tcaccgagagtagccgagag

SEQ ID NO: 1050727 - DNA, 16 bp, Homo sapiens
tcaccgagtgggggca

SEQ ID NO: 1050728 - DNA, 22 bp, Homo sapiens
tcaccgcggacgtgctggcctt

SEQ ID NO: 1050729 - DNA, 17 bp, Homo sapiens
tcaccgctgggtggttt

SEQ ID NO: 1050730 - DNA, 14 bp, Homo sapiens
tcaccggagctttc

SEQ ID NO: 1050731 - DNA, 22 bp, Homo sapiens
tcaccggctctcacctggccct

SEQ ID NO: 1050732 - DNA, 17 bp, Homo sapiens
tcaccggtcagtgcctt

SEQ ID NO: 1050733 - DNA, 17 bp, Homo sapiens
tcaccgtggaccttcct

SEQ ID NO: 1050734 - DNA, 18 bp, Homo sapiens
tcaccgtggaccttcctg

SEQ ID NO: 1050735 - DNA, 19 bp, Homo sapiens
tcaccgtggaccttcctgc

SEQ ID NO: 1050736 - DNA, 13 bp, Homo sapiens
tcaccgtgggctc

SEQ ID NO: 1050737 - DNA, 15 bp, Homo sapiens
tcaccgtgggctccc

SEQ ID NO: 1050738 - DNA, 18 bp, Homo sapiens
tcaccgtgggctccctga

SEQ ID NO: 1050739 - DNA, 18 bp, Homo sapiens
tcacctaagcacttctag

SEQ ID NO: 1050740 - DNA, 19 bp, Homo sapiens
tcacctaagtctctgtgaa

SEQ ID NO: 1050741 - DNA, 15 bp, Homo sapiens
tcacctagaaattga

SEQ ID NO: 1050742 - DNA, 16 bp, Homo sapiens
tcacctagaacgtgca

SEQ ID NO: 1050743 - DNA, 18 bp, Homo sapiens
tcacctagagccagacca

SEQ ID NO: 1050744 - DNA, 23 bp, Homo sapiens
tcacctagcaacatatctctgcc

SEQ ID NO: 1050745 - DNA, 16 bp, Homo sapiens
tcacctcagagtggag

SEQ ID NO: 1050746 - DNA, 10 bp, Homo sapiens
tcacctcagc

SEQ ID NO: 1050747 - DNA, 15 bp, Homo sapiens
tcacctcagcctgga

SEQ ID NO: 1050748 - DNA, 18 bp, Homo sapiens
tcacctcaggccaggtgc

SEQ ID NO: 1050749 - DNA, 13 bp, Homo sapiens
tcacctcatgccc

SEQ ID NO: 1050750 - DNA, 14 bp, Homo sapiens
tcacctcattctga

SEQ ID NO: 1050751 - DNA, 13 bp, Homo sapiens
tcacctcccctcc

SEQ ID NO: 1050752 - DNA, 13 bp, Homo sapiens
tcacctccctgct

SEQ ID NO: 1050753 - DNA, 14 bp, Homo sapiens
tcacctcctccact

SEQ ID NO: 1050754 - DNA, 12 bp, Homo sapiens
tcacctcctcta

SEQ ID NO: 1050755 - DNA, 19 bp, Homo sapiens
tcacctcctctgtgatttc

SEQ ID NO: 1050756 - DNA, 16 bp, Homo sapiens
tcacctcgtctccctg

SEQ ID NO: 1050757 - DNA, 17 bp, Homo sapiens
tcacctctactgtctcc

SEQ ID NO: 1050758 - DNA, 15 bp, Homo sapiens
tcacctctagcctta

SEQ ID NO: 1050759 - DNA, 12 bp, Homo sapiens
tcacctctatcc

SEQ ID NO: 1050760 - DNA, 23 bp, Homo sapiens
tcacctctattcttgggaaacac

SEQ ID NO: 1050761 - DNA, 15 bp, Homo sapiens
tcacctctgcctcaa

SEQ ID NO: 1050762 - DNA, 18 bp, Homo sapiens
tcacctgaaacactggac

SEQ ID NO: 1050763 - DNA, 19 bp, Homo sapiens
tcacctgaaacactggacc

SEQ ID NO: 1050764 - DNA, 22 bp, Homo sapiens
tcacctgaaacactggacctgg

SEQ ID NO: 1050765 - DNA, 22 bp, Homo sapiens
tcacctgagcccggatgcttct

SEQ ID NO: 1050766 - DNA, 15 bp, Homo sapiens
tcacctgaggtcggg

SEQ ID NO: 1050767 - DNA, 19 bp, Homo sapiens
tcacctgccccgtagagaa

SEQ ID NO: 1050768 - DNA, 20 bp, Homo sapiens
tcacctgccccgtagagaat

SEQ ID NO: 1050769 - DNA, 12 bp, Homo sapiens
tcacctgctcca

SEQ ID NO: 1050770 - DNA, 16 bp, Homo sapiens
tcacctgctccagaag

SEQ ID NO: 1050771 - DNA, 11 bp, Homo sapiens
tcacctgctgg

SEQ ID NO: 1050772 - DNA, 16 bp, Homo sapiens
tcacctgctggcccct

SEQ ID NO: 1050773 - DNA, 13 bp, Homo sapiens
tcacctggaagca

SEQ ID NO: 1050774 - DNA, 19 bp, Homo sapiens
tcacctggaagcatttgtt

SEQ ID NO: 1050775 - DNA, 23 bp, Homo sapiens
tcacctggaggcaagagggaggg

SEQ ID NO: 1050776 - DNA, 13 bp, Homo sapiens
tcacctggccctg

SEQ ID NO: 1050777 - DNA, 23 bp, Homo sapiens
tcacctggccctgcttcctgctt

SEQ ID NO: 1050778 - DNA, 16 bp, Homo sapiens
tcacctggctgctagg

SEQ ID NO: 1050779 - DNA, 14 bp, Homo sapiens
tcacctgggcacct

SEQ ID NO: 1050780 - DNA, 17 bp, Homo sapiens
tcacctgggcacctggg

SEQ ID NO: 1050781 - DNA, 20 bp, Homo sapiens
tcacctgggcacctggggag

SEQ ID NO: 1050782 - DNA, 15 bp, Homo sapiens
tcacctgggccctgg

SEQ ID NO: 1050783 - DNA, 21 bp, Homo sapiens
tcacctgggcctttcctgtgc

SEQ ID NO: 1050784 - DNA, 22 bp, Homo sapiens
tcacctgggcctttcctgtgcc

SEQ ID NO: 1050785 - DNA, 14 bp, Homo sapiens
tcacctgtaaaact

SEQ ID NO: 1050786 - DNA, 17 bp, Homo sapiens
tcacctgtaaaacttta

SEQ ID NO: 1050787 - DNA, 18 bp, Homo sapiens
tcacctgtaaaactttat

SEQ ID NO: 1050788 - DNA, 14 bp, Homo sapiens
tcacctgtgcttcg

SEQ ID NO: 1050789 - DNA, 15 bp, Homo sapiens
tcacctgttatgtat

SEQ ID NO: 1050790 - DNA, 18 bp, Homo sapiens
tcacctgtttttaagctg

SEQ ID NO: 1050791 - DNA, 19 bp, Homo sapiens
tcaccttccatgtcaggcc

SEQ ID NO: 1050792 - DNA, 11 bp, Homo sapiens
tcaccttccct

SEQ ID NO: 1050793 - DNA, 13 bp, Homo sapiens
tcaccttcctgtg

SEQ ID NO: 1050794 - DNA, 20 bp, Homo sapiens
tcaccttctagtcttggcca

SEQ ID NO: 1050795 - DNA, 19 bp, Homo sapiens
tcaccttgcaacacacaga

SEQ ID NO: 1050796 - DNA, 16 bp, Homo sapiens
tcaccttgcactcctc

SEQ ID NO: 1050797 - DNA, 23 bp, Homo sapiens
tcaccttgtattctctttacctt

SEQ ID NO: 1050798 - DNA, 11 bp, Homo sapiens
tcacctttctg

SEQ ID NO: 1050799 - DNA, 13 bp, Homo sapiens
tcacctttctggg

SEQ ID NO: 1050800 - DNA, 15 bp, Homo sapiens
tcacctttctgggct

SEQ ID NO: 1050801 - DNA, 16 bp, Homo sapiens
tcacctttggtgcaga

SEQ ID NO: 1050802 - DNA, 23 bp, Homo sapiens
tcacctttgtaagacatttgtat

SEQ ID NO: 1050803 - DNA, 14 bp, Homo sapiens
tcacctttgtgtat

SEQ ID NO: 1050804 - DNA, 16 bp, Homo sapiens
tcacctttgtgtattt

SEQ ID NO: 1050805 - DNA, 17 bp, Homo sapiens
tcaccttttcaggaaaa

SEQ ID NO: 1050806 - DNA, 21 bp, Homo sapiens
tcacctttttgacttttccaa

SEQ ID NO: 1050807 - DNA, 13 bp, Homo sapiens
tcacgactcttcc

SEQ ID NO: 1050808 - DNA, 17 bp, Homo sapiens
tcacgagatcttccttc

SEQ ID NO: 1050809 - DNA, 18 bp, Homo sapiens
tcacgcaggctgagtcca

SEQ ID NO: 1050810 - DNA, 16 bp, Homo sapiens
tcacgcatgcagtgtt

SEQ ID NO: 1050811 - DNA, 14 bp, Homo sapiens
tcacgccactgcac

SEQ ID NO: 1050812 - DNA, 16 bp, Homo sapiens
tcacgccactgcactc

SEQ ID NO: 1050813 - DNA, 14 bp, Homo sapiens
tcacgccccacact

SEQ ID NO: 1050814 - DNA, 16 bp, Homo sapiens
tcacgcccccaggaat

SEQ ID NO: 1050815 - DNA, 16 bp, Homo sapiens
tcacgcgttctgggag

SEQ ID NO: 1050816 - DNA, 21 bp, Homo sapiens
tcacgctcccccgcagtcccc

SEQ ID NO: 1050817 - DNA, 20 bp, Homo sapiens
tcacgctccctgacttctcc

SEQ ID NO: 1050818 - DNA, 23 bp, Homo sapiens
tcacgctccctgacttctccccc

SEQ ID NO: 1050819 - DNA, 16 bp, Homo sapiens
tcacgctctggacatg

SEQ ID NO: 1050820 - DNA, 12 bp, Homo sapiens
gcactccagctt

SEQ ID NO: 1050821 - DNA, 15 bp, Homo sapiens
gcactccatgcttag

SEQ ID NO: 1050822 - DNA, 16 bp, Homo sapiens
gcactcccgctgcaca

SEQ ID NO: 1050823 - DNA, 19 bp, Homo sapiens
gcactcccgctgcacacag

SEQ ID NO: 1050824 - DNA, 20 bp, Homo sapiens
gcactcccgctgcacacaga

SEQ ID NO: 1050825 - DNA, 22 bp, Homo sapiens
gcactcccgctgcacacagacg

SEQ ID NO: 1050826 - DNA, 19 bp, Homo sapiens
gcactccctaatttatgtg

SEQ ID NO: 1050827 - DNA, 14 bp, Homo sapiens
gcactccctggcct

SEQ ID NO: 1050828 - DNA, 18 bp, Homo sapiens
gcactccctggccttgcc

SEQ ID NO: 1050829 - DNA, 18 bp, Homo sapiens
gcactccgcgccgatgcc

SEQ ID NO: 1050830 - DNA, 23 bp, Homo sapiens
gcactccgcgccgatgccaccgg

SEQ ID NO: 1050831 - DNA, 16 bp, Homo sapiens
gcactcctttatctgt

SEQ ID NO: 1050832 - DNA, 21 bp, Homo sapiens
gcactcgagaccatcctggcc

SEQ ID NO: 1050833 - DNA, 21 bp, Homo sapiens
gcactcgtgtgcaacagacaa

SEQ ID NO: 1050834 - DNA, 22 bp, Homo sapiens
gcactctcaccccaagcggcct

SEQ ID NO: 1050835 - DNA, 14 bp, Homo sapiens
gcactctgccccca

SEQ ID NO: 1050836 - DNA, 19 bp, Homo sapiens
gcactctgttatttagact

SEQ ID NO: 1050837 - DNA, 16 bp, Homo sapiens
gcactcttaagcttcc

SEQ ID NO: 1050838 - DNA, 20 bp, Homo sapiens
gcactctttaacacattctt

SEQ ID NO: 1050839 - DNA, 19 bp, Homo sapiens
gcactgaaaacttagccag

SEQ ID NO: 1050840 - DNA, 12 bp, Homo sapiens
gcactgaaacct

SEQ ID NO: 1050841 - DNA, 16 bp, Homo sapiens
gcactgaaacctgaga

SEQ ID NO: 1050842 - DNA, 15 bp, Homo sapiens
gcactgaacagaatt

SEQ ID NO: 1050843 - DNA, 20 bp, Homo sapiens
gcactgaacaggctggggcc

SEQ ID NO: 1050844 - DNA, 23 bp, Homo sapiens
tcactgcgccactgctccgtgga

SEQ ID NO: 1050845 - DNA, 16 bp, Homo sapiens
tcactgctccttgctg

SEQ ID NO: 1050846 - DNA, 13 bp, Homo sapiens
tcactgctgaaga

SEQ ID NO: 1050847 - DNA, 19 bp, Homo sapiens
tcactgctgatcgtagaaa

SEQ ID NO: 1050848 - DNA, 12 bp, Homo sapiens
tcactgctgctc

SEQ ID NO: 1050849 - DNA, 14 bp, Homo sapiens
tcactgctggctgc

SEQ ID NO: 1050850 - DNA, 11 bp, Homo sapiens
tcactgctgta

SEQ ID NO: 1050851 - DNA, 21 bp, Homo sapiens
tcactgctgtgagtgcgcctc

SEQ ID NO: 1050852 - DNA, 14 bp, Homo sapiens
tcactgcttaactt

SEQ ID NO: 1050853 - DNA, 20 bp, Homo sapiens
tcactgcttaacttcacata

SEQ ID NO: 1050854 - DNA, 21 bp, Homo sapiens
tcactgcttgatgaagcaagg

SEQ ID NO: 1050855 - DNA, 18 bp, Homo sapiens
tcactggaaaggggagag

SEQ ID NO: 1050856 - DNA, 21 bp, Homo sapiens
tcactggaaaggggagagcct

SEQ ID NO: 1050857 - DNA, 16 bp, Homo sapiens
tcactggactgcatgg

SEQ ID NO: 1050858 - DNA, 17 bp, Homo sapiens
tcactggactgcatggg

SEQ ID NO: 1050859 - DNA, 12 bp, Homo sapiens
tcactggagccc

SEQ ID NO: 1050860 - DNA, 14 bp, Homo sapiens
tcactggagcccag

SEQ ID NO: 1050861 - DNA, 19 bp, Homo sapiens
tcactggaggagcagcttc

SEQ ID NO: 1050862 - DNA, 19 bp, Homo sapiens
tcactggatgaagattctc

SEQ ID NO: 1050863 - DNA, 14 bp, Homo sapiens
tcactggcagagca

SEQ ID NO: 1050864 - DNA, 22 bp, Homo sapiens
tcactggcagagcacagcccac

SEQ ID NO: 1050865 - DNA, 20 bp, Homo sapiens
tcactggcgacacgtagcag

SEQ ID NO: 1050866 - DNA, 16 bp, Homo sapiens
tcactggctcatgccc

SEQ ID NO: 1050867 - DNA, 11 bp, Homo sapiens
tcactggctct

SEQ ID NO: 1050868 - DNA, 12 bp, Homo sapiens
tcactggctctc

SEQ ID NO: 1050869 - DNA, 17 bp, Homo sapiens
tcactggctctccaagt

SEQ ID NO: 1050870 - DNA, 22 bp, Homo sapiens
tcactggctctccaagtgccag

SEQ ID NO: 1050871 - DNA, 14 bp, Homo sapiens
tcactggctgggag

SEQ ID NO: 1050872 - DNA, 13 bp, Homo sapiens
tcactggctgggg

SEQ ID NO: 1050873 - DNA, 14 bp, Homo sapiens
tcactgggaagaag

SEQ ID NO: 1050874 - DNA, 19 bp, Homo sapiens
tcactgggaagaagcaagg

SEQ ID NO: 1050875 - DNA, 21 bp, Homo sapiens
tcactgggaagctcccacccc

SEQ ID NO: 1050876 - DNA, 20 bp, Homo sapiens
tcactggggcatgagatttt

SEQ ID NO: 1050877 - DNA, 11 bp, Homo sapiens
tcactgggtgg

SEQ ID NO: 1050878 - DNA, 19 bp, Homo sapiens
tcactggtagaccaaaata

SEQ ID NO: 1050879 - DNA, 15 bp, Homo sapiens
tcactggtcagggca

SEQ ID NO: 1050880 - DNA, 16 bp, Homo sapiens
tcactggtcagggcag

SEQ ID NO: 1050881 - DNA, 20 bp, Homo sapiens
tcactggtcagggcagtggc

SEQ ID NO: 1050882 - DNA, 19 bp, Homo sapiens
tcactggtccaggtcttca

SEQ ID NO: 1050883 - DNA, 21 bp, Homo sapiens
tcactgtaacctcaaactctg

SEQ ID NO: 1050884 - DNA, 23 bp, Homo sapiens
tcactgtaagactcattccctag

SEQ ID NO: 1050885 - DNA, 12 bp, Homo sapiens
tcactgtactgc

SEQ ID NO: 1050886 - DNA, 17 bp, Homo sapiens
tcactgtactgcatgtg

SEQ ID NO: 1050887 - DNA, 20 bp, Homo sapiens
tcactgtactgcatgtgact

SEQ ID NO: 1050888 - DNA, 20 bp, Homo sapiens
tcactgtagaatgatttcat

SEQ ID NO: 1050889 - DNA, 21 bp, Homo sapiens
tcactgtagaatgatttcatg

SEQ ID NO: 1050890 - DNA, 16 bp, Homo sapiens
tcactgtatataaaca

SEQ ID NO: 1050891 - DNA, 11 bp, Homo sapiens
tcactgtcact

SEQ ID NO: 1050892 - DNA, 15 bp, Homo sapiens
tcactgtcctccaag

SEQ ID NO: 1050893 - DNA, 15 bp, Homo sapiens
tcactgtccttgaac

SEQ ID NO: 1050894 - DNA, 17 bp, Homo sapiens
tcactgtctaggctaca

SEQ ID NO: 1050895 - DNA, 19 bp, Homo sapiens
tcactgtctttaattctgt

SEQ ID NO: 1050896 - DNA, 11 bp, Homo sapiens
tcactgtgaaa

SEQ ID NO: 1050897 - DNA, 19 bp, Homo sapiens
tcactgtgttactgctttg

SEQ ID NO: 1050898 - DNA, 15 bp, Homo sapiens
tcactgttccctctg

SEQ ID NO: 1050899 - DNA, 17 bp, Homo sapiens
tcactgttccctctgct

SEQ ID NO: 1050900 - DNA, 21 bp, Homo sapiens
tcactgttccctctgctcctg

SEQ ID NO: 1050901 - DNA, 12 bp, Homo sapiens
tcactgttctgc

SEQ ID NO: 1050902 - DNA, 18 bp, Homo sapiens
tcactgtttctctgctgt

SEQ ID NO: 1050903 - DNA, 22 bp, Homo sapiens
tcactgtttgtttttaaaaagc

SEQ ID NO: 1050904 - DNA, 21 bp, Homo sapiens
tcactgtttttattccttcca

SEQ ID NO: 1050905 - DNA, 22 bp, Homo sapiens
tcactgtttttttcccaggtgt

SEQ ID NO: 1050906 - DNA, 15 bp, Homo sapiens
tcacttaatccattt

SEQ ID NO: 1050907 - DNA, 17 bp, Homo sapiens
tcacttaatgtttctta

SEQ ID NO: 1050908 - DNA, 20 bp, Homo sapiens
tcacttacataaagctccct

SEQ ID NO: 1050909 - DNA, 20 bp, Homo sapiens
tcacttacccattagccagg

SEQ ID NO: 1050910 - DNA, 21 bp, Homo sapiens
tcacttaggaaatggctttgt

SEQ ID NO: 1050911 - DNA, 17 bp, Homo sapiens
tcacttagtcctttatc

SEQ ID NO: 1050912 - DNA, 13 bp, Homo sapiens
tcacttataccaa

SEQ ID NO: 1050913 - DNA, 13 bp, Homo sapiens
tcacttatcagtt

SEQ ID NO: 1050914 - DNA, 14 bp, Homo sapiens
tcacttcatgtttt

SEQ ID NO: 1050915 - DNA, 13 bp, Homo sapiens
tcacttccagata

SEQ ID NO: 1050916 - DNA, 13 bp, Homo sapiens
tcacttccagtgt

SEQ ID NO: 1050917 - DNA, 19 bp, Homo sapiens
tcacttccatacagctcta

SEQ ID NO: 1050918 - DNA, 14 bp, Homo sapiens
tcacttccttgccc

SEQ ID NO: 1050919 - DNA, 22 bp, Homo sapiens
tcacttcgcgtgccctcgctgc

SEQ ID NO: 1050920 - DNA, 23 bp, Homo sapiens
tcacttcgcgtgccctcgctgct

SEQ ID NO: 1050921 - DNA, 23 bp, Homo sapiens
tcacttcgggctgtgtaaacaca

SEQ ID NO: 1050922 - DNA, 13 bp, Homo sapiens
tcacttctaaatg

SEQ ID NO: 1050923 - DNA, 17 bp, Homo sapiens
tcacttctccccgcagc

SEQ ID NO: 1050924 - DNA, 22 bp, Homo sapiens
tcacttctcctgctgctcctgt

SEQ ID NO: 1050925 - DNA, 13 bp, Homo sapiens
tcacttctgggaa

SEQ ID NO: 1050926 - DNA, 14 bp, Homo sapiens
tcacttctgggaaa

SEQ ID NO: 1050927 - DNA, 20 bp, Homo sapiens
tcacttcttcacctcttcca

SEQ ID NO: 1050928 - DNA, 16 bp, Homo sapiens
tcacttcttccactgt

SEQ ID NO: 1050929 - DNA, 12 bp, Homo sapiens
tcacttcttcct

SEQ ID NO: 1050930 - DNA, 17 bp, Homo sapiens
tcacttcttcctattgt

SEQ ID NO: 1050931 - DNA, 22 bp, Homo sapiens
tcacttgaggtcaggagttcct

SEQ ID NO: 1050932 - DNA, 18 bp, Homo sapiens
tcacttgagttggctgtg

SEQ ID NO: 1050933 - DNA, 20 bp, Homo sapiens
tcacttgatgatacaatgaa

SEQ ID NO: 1050934 - DNA, 19 bp, Homo sapiens
tcacttgattcatctctgg

SEQ ID NO: 1050935 - DNA, 13 bp, Homo sapiens
tcacttgccatgc

SEQ ID NO: 1050936 - DNA, 20 bp, Homo sapiens
tcacttgccattgccaggag

SEQ ID NO: 1050937 - DNA, 13 bp, Homo sapiens
tcacttgccttag

SEQ ID NO: 1050938 - DNA, 17 bp, Homo sapiens
tcacttgggagctgctg

SEQ ID NO: 1050939 - DNA, 21 bp, Homo sapiens
tcacttgggctctctctagct

SEQ ID NO: 1050940 - DNA, 17 bp, Homo sapiens
tcacttgtacaaaataa

SEQ ID NO: 1050941 - DNA, 12 bp, Homo sapiens
tcacttgtattg

SEQ ID NO: 1050942 - DNA, 19 bp, Homo sapiens
gcagagcaaatgagggagg

SEQ ID NO: 1050943 - DNA, 14 bp, Homo sapiens
gcagagcaataaca

SEQ ID NO: 1050944 - DNA, 18 bp, Homo sapiens
gcagagcacagcccacgg

SEQ ID NO: 1050945 - DNA, 21 bp, Homo sapiens
gcagagcacctttgcacagga

SEQ ID NO: 1050946 - DNA, 17 bp, Homo sapiens
gcagagccaaggccacc

SEQ ID NO: 1050947 - DNA, 19 bp, Homo sapiens
gcagagccaggctgttgga

SEQ ID NO: 1050948 - DNA, 14 bp, Homo sapiens
gcagagccatgggc

SEQ ID NO: 1050949 - DNA, 14 bp, Homo sapiens
gcagagcctcctgg

SEQ ID NO: 1050950 - DNA, 15 bp, Homo sapiens
gcagagcctcctggg

SEQ ID NO: 1050951 - DNA, 16 bp, Homo sapiens
gcagagcctcctggga

SEQ ID NO: 1050952 - DNA, 15 bp, Homo sapiens
gcagagcctctgaga

SEQ ID NO: 1050953 - DNA, 17 bp, Homo sapiens
gcagagcgggagggagt

SEQ ID NO: 1050954 - DNA, 20 bp, Homo sapiens
gcagagctctcccctcctgc

SEQ ID NO: 1050955 - DNA, 13 bp, Homo sapiens
gcagagctggagc

SEQ ID NO: 1050956 - DNA, 14 bp, Homo sapiens
gcagagctggctct

SEQ ID NO: 1050957 - DNA, 17 bp, Homo sapiens
gcagagctggctctgag

SEQ ID NO: 1050958 - DNA, 13 bp, Homo sapiens
gcagagctggggc

SEQ ID NO: 1050959 - DNA, 15 bp, Homo sapiens
gcagagcttttcaga

SEQ ID NO: 1050960 - DNA, 18 bp, Homo sapiens
gcagagcttttgcatttc

SEQ ID NO: 1050961 - DNA, 13 bp, Homo sapiens
gcagaggaccaca

SEQ ID NO: 1050962 - DNA, 21 bp, Homo sapiens
gcagaggaccacagtgggtgg

SEQ ID NO: 1050963 - DNA, 14 bp, Homo sapiens
gcagaggagcccag

SEQ ID NO: 1050964 - DNA, 14 bp, Homo sapiens
gcagaggagctgag

SEQ ID NO: 1050965 - DNA, 19 bp, Homo sapiens
gcagaggagctgagttggc

SEQ ID NO: 1050966 - DNA, 12 bp, Homo sapiens
gcagaggagggg

SEQ ID NO: 1050967 - DNA, 12 bp, Homo sapiens
gcagaggcagaa

SEQ ID NO: 1050968 - DNA, 14 bp, Homo sapiens
gcagaggcaggctg

SEQ ID NO: 1050969 - DNA, 16 bp, Homo sapiens
gcagaggcaggctggg

SEQ ID NO: 1050970 - DNA, 17 bp, Homo sapiens
gcagaggcagtggccac

SEQ ID NO: 1050971 - DNA, 17 bp, Homo sapiens
gcagaggcctgggctgg

SEQ ID NO: 1050972 - DNA, 20 bp, Homo sapiens
gcagaggcctgggctgggaa

SEQ ID NO: 1050973 - DNA, 11 bp, Homo sapiens
gcagaggctgg

SEQ ID NO: 1050974 - DNA, 19 bp, Homo sapiens
gcagaggctgtggctggtg

SEQ ID NO: 1050975 - DNA, 17 bp, Homo sapiens
gcagagggaatgttccc

SEQ ID NO: 1050976 - DNA, 17 bp, Homo sapiens
gcagagggctggaggcc

SEQ ID NO: 1050977 - DNA, 24 bp, Homo sapiens
gcagagggctggaggcccaggctg

SEQ ID NO: 1050978 - DNA, 13 bp, Homo sapiens
gcagaggggcagc

SEQ ID NO: 1050979 - DNA, 12 bp, Homo sapiens
tcagagacagat

SEQ ID NO: 1050980 - DNA, 15 bp, Homo sapiens
tcagagaccagcact

SEQ ID NO: 1050981 - DNA, 16 bp, Homo sapiens
tcagagaccagggctc

SEQ ID NO: 1050982 - DNA, 14 bp, Homo sapiens
tcagagactcaggg

SEQ ID NO: 1050983 - DNA, 20 bp, Homo sapiens
tcagagactcagggccccag

SEQ ID NO: 1050984 - DNA, 12 bp, Homo sapiens
tcagagactgcc

SEQ ID NO: 1050985 - DNA, 15 bp, Homo sapiens
tcagagagcaaggca

SEQ ID NO: 1050986 - DNA, 14 bp, Homo sapiens
tcagagagctggta

SEQ ID NO: 1050987 - DNA, 22 bp, Homo sapiens
tcagagaggccttttgtttaaa

SEQ ID NO: 1050988 - DNA, 15 bp, Homo sapiens
tcagagagtgtacat

SEQ ID NO: 1050989 - DNA, 15 bp, Homo sapiens
tcagagatgaaacta

SEQ ID NO: 1050990 - DNA, 18 bp, Homo sapiens
tcagagatgaacatctaa

SEQ ID NO: 1050991 - DNA, 16 bp, Homo sapiens
tcagagatgcaccacc

SEQ ID NO: 1050992 - DNA, 21 bp, Homo sapiens
tcagagatgcaccaccaagcc

SEQ ID NO: 1050993 - DNA, 22 bp, Homo sapiens
tcagagatgcaccaccaagcca

SEQ ID NO: 1050994 - DNA, 21 bp, Homo sapiens
tcagagcaggacctcccttcc

SEQ ID NO: 1050995 - DNA, 14 bp, Homo sapiens
tcagagcaggaggc

SEQ ID NO: 1050996 - DNA, 13 bp, Homo sapiens
tcagagccaagtc

SEQ ID NO: 1050997 - DNA, 13 bp, Homo sapiens
tcagagccagcct

SEQ ID NO: 1050998 - DNA, 15 bp, Homo sapiens
tcagagccagcctgg

SEQ ID NO: 1050999 - DNA, 14 bp, Homo sapiens
tcagagccagtgaa

SEQ ID NO: 1051000 - DNA, 18 bp, Homo sapiens
tcagagccagtgaaggag

SEQ ID NO: 1051001 - DNA, 15 bp, Homo sapiens
tcagagcccagggga

SEQ ID NO: 1051002 - DNA, 14 bp, Homo sapiens
tcagagcccatggt

SEQ ID NO: 1051003 - DNA, 18 bp, Homo sapiens
tcagagcccctacagcat

SEQ ID NO: 1051004 - DNA, 15 bp, Homo sapiens
tcagagcctaccttc

SEQ ID NO: 1051005 - DNA, 19 bp, Homo sapiens
tcagagcctaccttcacca

SEQ ID NO: 1051006 - DNA, 18 bp, Homo sapiens
tcagagccttaacaccag

SEQ ID NO: 1051007 - DNA, 17 bp, Homo sapiens
tcagagcctttcctcaa

SEQ ID NO: 1051008 - DNA, 22 bp, Homo sapiens
tcagagcggatgggcacacaca

SEQ ID NO: 1051009 - DNA, 22 bp, Homo sapiens
tcagagctaaactccttcctgg

SEQ ID NO: 1051010 - DNA, 23 bp, Homo sapiens
tcagagctaagggtgggtgctca

SEQ ID NO: 1051011 - DNA, 9 bp, Homo sapiens
tcagagctc

SEQ ID NO: 1051012 - DNA, 17 bp, Homo sapiens
tcagagctcttcaagct

SEQ ID NO: 1051013 - DNA, 21 bp, Homo sapiens
tcagagctcttcaagctgtcc

SEQ ID NO: 1051014 - DNA, 22 bp, Homo sapiens
tcagagctcttcaagctgtccc

SEQ ID NO: 1051015 - DNA, 14 bp, Homo sapiens
tcagagctgggagt

SEQ ID NO: 1051016 - DNA, 16 bp, Homo sapiens
tcagagctttaaaagt

SEQ ID NO: 1051017 - DNA, 23 bp, Homo sapiens
tcagagctttaaaagtatcttta

SEQ ID NO: 1051018 - DNA, 21 bp, Homo sapiens
tcagagctttgtcacttgcca

SEQ ID NO: 1051019 - DNA, 18 bp, Homo sapiens
tcagaggaccccagggtg

SEQ ID NO: 1051020 - DNA, 19 bp, Homo sapiens
tcagaggaccccagggtgg

SEQ ID NO: 1051021 - DNA, 14 bp, Homo sapiens
tcagaggagaagag

SEQ ID NO: 1051022 - DNA, 21 bp, Homo sapiens
tcagaggagtgattgaaccag

SEQ ID NO: 1051023 - DNA, 22 bp, Homo sapiens
tcagaggagtggatctgtagaa

SEQ ID NO: 1051024 - DNA, 16 bp, Homo sapiens
tcagaggcccccagtg

SEQ ID NO: 1051025 - DNA, 13 bp, Homo sapiens
tcagaggcctgct

SEQ ID NO: 1051026 - DNA, 16 bp, Homo sapiens
tcagaggcgcactgtg

SEQ ID NO: 1051027 - DNA, 18 bp, Homo sapiens
tcagaggctaagatgaga

SEQ ID NO: 1051028 - DNA, 15 bp, Homo sapiens
tcagaggctgaggtg

SEQ ID NO: 1051029 - DNA, 20 bp, Homo sapiens
tcagagggcccaaatggcag

SEQ ID NO: 1051030 - DNA, 14 bp, Homo sapiens
tcagaggtatctta

SEQ ID NO: 1051031 - DNA, 13 bp, Homo sapiens
tcagagtccaggc

SEQ ID NO: 1051032 - DNA, 20 bp, Homo sapiens
tcagagtccagtgctctgcc

SEQ ID NO: 1051033 - DNA, 23 bp, Homo sapiens
tcagagtccttgcaaaattgtct

SEQ ID NO: 1051034 - DNA, 17 bp, Homo sapiens
tcagagtctctgataca

SEQ ID NO: 1051035 - DNA, 14 bp, Homo sapiens
tcagagtgaagaat

SEQ ID NO: 1051036 - DNA, 16 bp, Homo sapiens
tcagagtgacagtcat

SEQ ID NO: 1051037 - DNA, 19 bp, Homo sapiens
tcagagtgaccctcagctg

SEQ ID NO: 1051038 - DNA, 20 bp, Homo sapiens
tcagagtgaccctcagctgt

SEQ ID NO: 1051039 - DNA, 20 bp, Homo sapiens
tcagagtgactacacacagt

SEQ ID NO: 1051040 - DNA, 16 bp, Homo sapiens
tcagagtggagttgaa

SEQ ID NO: 1051041 - DNA, 19 bp, Homo sapiens
tcagagtggcgtgagctgc

SEQ ID NO: 1051042 - DNA, 20 bp, Homo sapiens
tcagagttcccaagaaagga

SEQ ID NO: 1051043 - DNA, 17 bp, Homo sapiens
tcagagtttgtgtgtat

SEQ ID NO: 1051044 - DNA, 18 bp, Homo sapiens
tcagagtttgtgtgtatt

SEQ ID NO: 1051045 - DNA, 21 bp, Homo sapiens
tcagagtttgtgtgtatttgt

SEQ ID NO: 1051046 - DNA, 22 bp, Homo sapiens
tcagagtttgtgtgtatttgta

SEQ ID NO: 1051047 - DNA, 15 bp, Homo sapiens
tcagataagtgtaaa

SEQ ID NO: 1051048 - DNA, 16 bp, Homo sapiens
tcagataagtgtaaat

SEQ ID NO: 1051049 - DNA, 17 bp, Homo sapiens
tcagataagtgtaaata

SEQ ID NO: 1051050 - DNA, 15 bp, Homo sapiens
tcagataatatgttt

SEQ ID NO: 1051051 - DNA, 12 bp, Homo sapiens
tcagatacatca

SEQ ID NO: 1051052 - DNA, 14 bp, Homo sapiens
tcagatacatcact

SEQ ID NO: 1051053 - DNA, 15 bp, Homo sapiens
tcagatacatcactg

SEQ ID NO: 1051054 - DNA, 19 bp, Homo sapiens
tcagatacccagtggaatt

SEQ ID NO: 1051055 - DNA, 20 bp, Homo sapiens
tcagatataaaagactgacc

SEQ ID NO: 1051056 - DNA, 15 bp, Homo sapiens
tcagatataagagaa

SEQ ID NO: 1051057 - DNA, 16 bp, Homo sapiens
tcagatatatttttca

SEQ ID NO: 1051058 - DNA, 16 bp, Homo sapiens
tcagatatcaaaattc

SEQ ID NO: 1051059 - DNA, 21 bp, Homo sapiens
tcagatatcttggacaaatca

SEQ ID NO: 1051060 - DNA, 22 bp, Homo sapiens
tcagatatcttggacaaatcac

SEQ ID NO: 1051061 - DNA, 23 bp, Homo sapiens
tcagatatcttggacaaatcaca

SEQ ID NO: 1051062 - DNA, 15 bp, Homo sapiens
tcagatattctgctc

SEQ ID NO: 1051063 - DNA, 21 bp, Homo sapiens
tcagatatttatatttttatt

SEQ ID NO: 1051064 - DNA, 14 bp, Homo sapiens
tcagatatttctta

SEQ ID NO: 1051065 - DNA, 13 bp, Homo sapiens
gcagcacctttct

SEQ ID NO: 1051066 - DNA, 18 bp, Homo sapiens
gcagcacctttctctgag

SEQ ID NO: 1051067 - DNA, 16 bp, Homo sapiens
gcagcacgcggccttg

SEQ ID NO: 1051068 - DNA, 20 bp, Homo sapiens
gcagcacggcccggcccctc

SEQ ID NO: 1051069 - DNA, 23 bp, Homo sapiens
gcagcactcaaacctggagctga

SEQ ID NO: 1051070 - DNA, 15 bp, Homo sapiens
gcagcactcccgctg

SEQ ID NO: 1051071 - DNA, 20 bp, Homo sapiens
gcagcactcccgctgcacac

SEQ ID NO: 1051072 - DNA, 18 bp, Homo sapiens
gcagcactgggaagctgg

SEQ ID NO: 1051073 - DNA, 20 bp, Homo sapiens
gcagcagagagagaggacag

SEQ ID NO: 1051074 - DNA, 10 bp, Homo sapiens
gcagcagagg

SEQ ID NO: 1051075 - DNA, 12 bp, Homo sapiens
gcagcagaggag

SEQ ID NO: 1051076 - DNA, 13 bp, Homo sapiens
gcagcagaggtga

SEQ ID NO: 1051077 - DNA, 22 bp, Homo sapiens
gcagcagcacaaacattgctgc

SEQ ID NO: 1051078 - DNA, 15 bp, Homo sapiens
gcagcagcagccctg

SEQ ID NO: 1051079 - DNA, 15 bp, Homo sapiens
gcagcagcaggtgat

SEQ ID NO: 1051080 - DNA, 17 bp, Homo sapiens
gcagcagcatcccagcc

SEQ ID NO: 1051081 - DNA, 18 bp, Homo sapiens
gcagcagcatcccagcct

SEQ ID NO: 1051082 - DNA, 14 bp, Homo sapiens
gcagcagccagcac

SEQ ID NO: 1051083 - DNA, 22 bp, Homo sapiens
gcagcagccatcataggaaggg

SEQ ID NO: 1051084 - DNA, 13 bp, Homo sapiens
gcagcagcccaag

SEQ ID NO: 1051085 - DNA, 12 bp, Homo sapiens
gcagcagcccag

SEQ ID NO: 1051086 - DNA, 13 bp, Homo sapiens
gcagcagcccagc

SEQ ID NO: 1051087 - DNA, 14 bp, Homo sapiens
gcagcagcccagct

SEQ ID NO: 1051088 - DNA, 15 bp, Homo sapiens
gcagcagcccagctt

SEQ ID NO: 1051089 - DNA, 14 bp, Homo sapiens
gcagcagccctgcc

SEQ ID NO: 1051090 - DNA, 20 bp, Homo sapiens
gcagcagcgctcggcccgga

SEQ ID NO: 1051091 - DNA, 17 bp, Homo sapiens
gcagcagctaggactga

SEQ ID NO: 1051092 - DNA, 23 bp, Homo sapiens
gcagcagctaggactgaggagtg

SEQ ID NO: 1051093 - DNA, 15 bp, Homo sapiens
gcagcagctgggacc

SEQ ID NO: 1051094 - DNA, 21 bp, Homo sapiens
gcagcagctgggacccctccc

SEQ ID NO: 1051095 - DNA, 23 bp, Homo sapiens
gcagcagctgggacccctcccaa

SEQ ID NO: 1051096 - DNA, 16 bp, Homo sapiens
gcagcagcttggggag

SEQ ID NO: 1051097 - DNA, 23 bp, Homo sapiens
gcagcaggcctctggttgcctcc

SEQ ID NO: 1051098 - DNA, 14 bp, Homo sapiens
gcagcaggctcagg

SEQ ID NO: 1051099 - DNA, 16 bp, Homo sapiens
gcagcaggctcaggca

SEQ ID NO: 1051100 - DNA, 18 bp, Homo sapiens
gcagcagggagggcttct

SEQ ID NO: 1051101 - DNA, 19 bp, Homo sapiens
gcagcagggatgccctgga

SEQ ID NO: 1051102 - DNA, 20 bp, Homo sapiens
gcagcagggctaccctgagc

SEQ ID NO: 1051103 - DNA, 14 bp, Homo sapiens
gcagcagggctggg

SEQ ID NO: 1051104 - DNA, 13 bp, Homo sapiens
gcagcaggtgctg

SEQ ID NO: 1051105 - DNA, 16 bp, Homo sapiens
gcagcaggtgctgggc

SEQ ID NO: 1051106 - DNA, 17 bp, Homo sapiens
gcagcagtgagtctctt

SEQ ID NO: 1051107 - DNA, 18 bp, Homo sapiens
tcagattgtggaatgttg

SEQ ID NO: 1051108 - DNA, 18 bp, Homo sapiens
tcagattgttaagggcat

SEQ ID NO: 1051109 - DNA, 16 bp, Homo sapiens
tcagatttctgaggaa

SEQ ID NO: 1051110 - DNA, 12 bp, Homo sapiens
tcagatttctgg

SEQ ID NO: 1051111 - DNA, 14 bp, Homo sapiens
tcagatttctggtt

SEQ ID NO: 1051112 - DNA, 12 bp, Homo sapiens
tcagatttgaac

SEQ ID NO: 1051113 - DNA, 21 bp, Homo sapiens
tcagattttaaaaagtcttca

SEQ ID NO: 1051114 - DNA, 15 bp, Homo sapiens
tcagcaaaaagcaaa

SEQ ID NO: 1051115 - DNA, 20 bp, Homo sapiens
tcagcaaaaagcaaaatcat

SEQ ID NO: 1051116 - DNA, 21 bp, Homo sapiens
tcagcaaaaagcaaaatcatt

SEQ ID NO: 1051117 - DNA, 22 bp, Homo sapiens
tcagcaaaaatctcccagtgac

SEQ ID NO: 1051118 - DNA, 20 bp, Homo sapiens
tcagcaaaccatttttaaag

SEQ ID NO: 1051119 - DNA, 13 bp, Homo sapiens
tcagcaaagaaaa

SEQ ID NO: 1051120 - DNA, 17 bp, Homo sapiens
tcagcaaagctacagga

SEQ ID NO: 1051121 - DNA, 19 bp, Homo sapiens
tcagcaaagctacaggact

SEQ ID NO: 1051122 - DNA, 17 bp, Homo sapiens
tcagcaaatttaagaga

SEQ ID NO: 1051123 - DNA, 18 bp, Homo sapiens
tcagcaacaagactgcca

SEQ ID NO: 1051124 - DNA, 19 bp, Homo sapiens
tcagcaacaagactgccag

SEQ ID NO: 1051125 - DNA, 21 bp, Homo sapiens
tcagcaatactcatcagagca

SEQ ID NO: 1051126 - DNA, 17 bp, Homo sapiens
tcagcaatagggtgcag

SEQ ID NO: 1051127 - DNA, 16 bp, Homo sapiens
tcagcaatttcagaac

SEQ ID NO: 1051128 - DNA, 13 bp, Homo sapiens
tcagcacaaggcc

SEQ ID NO: 1051129 - DNA, 19 bp, Homo sapiens
tcagcacaaggccatctgg

SEQ ID NO: 1051130 - DNA, 14 bp, Homo sapiens
tcagcacaggaatt

SEQ ID NO: 1051131 - DNA, 19 bp, Homo sapiens
tcagcacaggaattctcaa

SEQ ID NO: 1051132 - DNA, 19 bp, Homo sapiens
tcagcaccacattgcctca

SEQ ID NO: 1051133 - DNA, 13 bp, Homo sapiens
tcagcaccaccct

SEQ ID NO: 1051134 - DNA, 18 bp, Homo sapiens
tcagcacccccacccacc

SEQ ID NO: 1051135 - DNA, 20 bp, Homo sapiens
tcagcacccccacccacctc

SEQ ID NO: 1051136 - DNA, 13 bp, Homo sapiens
tcagcaccctggg

SEQ ID NO: 1051137 - DNA, 15 bp, Homo sapiens
tcagcaccctgggtg

SEQ ID NO: 1051138 - DNA, 21 bp, Homo sapiens
tcagcaccttggcccaggagc

SEQ ID NO: 1051139 - DNA, 23 bp, Homo sapiens
tcagcaccttggcccaggagctc

SEQ ID NO: 1051140 - DNA, 15 bp, Homo sapiens
tcagcacgatttctg

SEQ ID NO: 1051141 - DNA, 17 bp, Homo sapiens
tcagcacgatttctgtt

SEQ ID NO: 1051142 - DNA, 19 bp, Homo sapiens
tcagcacgatttctgttta

SEQ ID NO: 1051143 - DNA, 17 bp, Homo sapiens
tcagcactgatttcaca

SEQ ID NO: 1051144 - DNA, 13 bp, Homo sapiens
tcagcactgtccc

SEQ ID NO: 1051145 - DNA, 21 bp, Homo sapiens
tcagcactgtcccttgcctca

SEQ ID NO: 1051146 - DNA, 20 bp, Homo sapiens
tcagcactttaaagaggctg

SEQ ID NO: 1051147 - DNA, 21 bp, Homo sapiens
tcagcactttaaagaggctgt

SEQ ID NO: 1051148 - DNA, 22 bp, Homo sapiens
tcagcactttaaagaggctgtg

SEQ ID NO: 1051149 - DNA, 19 bp, Homo sapiens
tcagcagaacctgcacaca

SEQ ID NO: 1051150 - DNA, 16 bp, Homo sapiens
tcagcagaggcagtgg

SEQ ID NO: 1051151 - DNA, 18 bp, Homo sapiens
tcagcagatgccagtgaa

SEQ ID NO: 1051152 - DNA, 19 bp, Homo sapiens
tcagcagcagagagccctg

SEQ ID NO: 1051153 - DNA, 15 bp, Homo sapiens
tcagcagccagtctc

SEQ ID NO: 1051154 - DNA, 17 bp, Homo sapiens
tcagcagccagtctcag

SEQ ID NO: 1051155 - DNA, 20 bp, Homo sapiens
tcagcagccagtctcagaga

SEQ ID NO: 1051156 - DNA, 12 bp, Homo sapiens
tcagcagccctc

SEQ ID NO: 1051157 - DNA, 15 bp, Homo sapiens
tcagcagccctcctc

SEQ ID NO: 1051158 - DNA, 17 bp, Homo sapiens
tcagcagccctcctcac

SEQ ID NO: 1051159 - DNA, 23 bp, Homo sapiens
tcagcagccgccttaagctgatc

SEQ ID NO: 1051160 - DNA, 17 bp, Homo sapiens
tcagcagcctccctgaa

SEQ ID NO: 1051161 - DNA, 19 bp, Homo sapiens
tcagcaggaagggtgggaa

SEQ ID NO: 1051162 - DNA, 21 bp, Homo sapiens
tcagcaggaagggtgggaagg

SEQ ID NO: 1051163 - DNA, 17 bp, Homo sapiens
tcagcagggactgtaaa

SEQ ID NO: 1051164 - DNA, 18 bp, Homo sapiens
tcagcagtcaatacaaat

SEQ ID NO: 1051165 - DNA, 14 bp, Homo sapiens
tcagcagttgacat

SEQ ID NO: 1051166 - DNA, 15 bp, Homo sapiens
tcagcagttgacatc

SEQ ID NO: 1051167 - DNA, 20 bp, Homo sapiens
tcagcagttgacatccaaat

SEQ ID NO: 1051168 - DNA, 12 bp, Homo sapiens
tcagcagtttta

SEQ ID NO: 1051169 - DNA, 13 bp, Homo sapiens
tcagcatatttgt

SEQ ID NO: 1051170 - DNA, 22 bp, Homo sapiens
tcagcatctggctgtctagaat

SEQ ID NO: 1051171 - DNA, 15 bp, Homo sapiens
tcagcatctgtgatg

SEQ ID NO: 1051172 - DNA, 20 bp, Homo sapiens
tcagcatgacaaaaataaca

SEQ ID NO: 1051173 - DNA, 18 bp, Homo sapiens
tcagcattagagaaatga

SEQ ID NO: 1051174 - DNA, 18 bp, Homo sapiens
tcagcattaggcttttaa

SEQ ID NO: 1051175 - DNA, 18 bp, Homo sapiens
tcagcattattcctccag

SEQ ID NO: 1051176 - DNA, 18 bp, Homo sapiens
tcagcattattcttcaga

SEQ ID NO: 1051177 - DNA, 17 bp, Homo sapiens
tcagcattctcactcct

SEQ ID NO: 1051178 - DNA, 23 bp, Homo sapiens
tcagcattctcactcctacctgg

SEQ ID NO: 1051179 - DNA, 19 bp, Homo sapiens
tcagcattgtttcaaaata

SEQ ID NO: 1051180 - DNA, 20 bp, Homo sapiens
tcagcattgtttcaaaatag

SEQ ID NO: 1051181 - DNA, 19 bp, Homo sapiens
tcagcatttcttttctggc

SEQ ID NO: 1051182 - DNA, 16 bp, Homo sapiens
tcagccaaatgtaatt

SEQ ID NO: 1051183 - DNA, 23 bp, Homo sapiens
tcagccaaatgtaattgaataaa

SEQ ID NO: 1051184 - DNA, 15 bp, Homo sapiens
tcagccaaggggctg

SEQ ID NO: 1051185 - DNA, 16 bp, Homo sapiens
tcagccaagttttata

SEQ ID NO: 1051186 - DNA, 17 bp, Homo sapiens
tcagccaatttgtctcc

SEQ ID NO: 1051187 - DNA, 15 bp, Homo sapiens
tcaggattgctagga

SEQ ID NO: 1051188 - DNA, 21 bp, Homo sapiens
tcaggcaagcccctcagccct

SEQ ID NO: 1051189 - DNA, 20 bp, Homo sapiens
tcaggcaattgattgtgaat

SEQ ID NO: 1051190 - DNA, 20 bp, Homo sapiens
tcaggcacacaaggggccct

SEQ ID NO: 1051191 - DNA, 21 bp, Homo sapiens
tcaggcacacaaggggccctt

SEQ ID NO: 1051192 - DNA, 13 bp, Homo sapiens
tcaggcacacagc

SEQ ID NO: 1051193 - DNA, 15 bp, Homo sapiens
tcaggcagacaagag

SEQ ID NO: 1051194 - DNA, 18 bp, Homo sapiens
tcaggcagaggcaactga

SEQ ID NO: 1051195 - DNA, 15 bp, Homo sapiens
tcaggcagcaccaca

SEQ ID NO: 1051196 - DNA, 12 bp, Homo sapiens
tcaggcagcctt

SEQ ID NO: 1051197 - DNA, 15 bp, Homo sapiens
tcaggcagccttcat

SEQ ID NO: 1051198 - DNA, 12 bp, Homo sapiens
tcaggcagctcg

SEQ ID NO: 1051199 - DNA, 13 bp, Homo sapiens
tcaggcaggaagg

SEQ ID NO: 1051200 - DNA, 14 bp, Homo sapiens
tcaggcaggtttgc

SEQ ID NO: 1051201 - DNA, 16 bp, Homo sapiens
tcaggcaggtttgcca

SEQ ID NO: 1051202 - DNA, 17 bp, Homo sapiens
tcaggcataggcctggg

SEQ ID NO: 1051203 - DNA, 19 bp, Homo sapiens
tcaggcataggcctgggtg

SEQ ID NO: 1051204 - DNA, 15 bp, Homo sapiens
tcaggcatgcctgtg

SEQ ID NO: 1051205 - DNA, 20 bp, Homo sapiens
tcaggcatggctcagagctt

SEQ ID NO: 1051206 - DNA, 23 bp, Homo sapiens
tcaggccacataattggactctg

SEQ ID NO: 1051207 - DNA, 15 bp, Homo sapiens
tcaggccagcccagc

SEQ ID NO: 1051208 - DNA, 15 bp, Homo sapiens
tcaggccagcctgtc

SEQ ID NO: 1051209 - DNA, 13 bp, Homo sapiens
tcaggccagggct

SEQ ID NO: 1051210 - DNA, 18 bp, Homo sapiens
tcaggccaggtgcagtgg

SEQ ID NO: 1051211 - DNA, 20 bp, Homo sapiens
tcaggccaggtgggcggaca

SEQ ID NO: 1051212 - DNA, 15 bp, Homo sapiens
tcaggccattcccca

SEQ ID NO: 1051213 - DNA, 15 bp, Homo sapiens
tcaggcccaggcact

SEQ ID NO: 1051214 - DNA, 21 bp, Homo sapiens
tcaggcccggcagggcgggca

SEQ ID NO: 1051215 - DNA, 22 bp, Homo sapiens
tcaggcccgtcggagctgcctg

SEQ ID NO: 1051216 - DNA, 14 bp, Homo sapiens
tcaggccctctgcc

SEQ ID NO: 1051217 - DNA, 17 bp, Homo sapiens
tcaggccctctgcctgc

SEQ ID NO: 1051218 - DNA, 14 bp, Homo sapiens
tcaggcctaggagg

SEQ ID NO: 1051219 - DNA, 15 bp, Homo sapiens
tcaggcctaggaggc

SEQ ID NO: 1051220 - DNA, 16 bp, Homo sapiens
tcaggcctgggcagga

SEQ ID NO: 1051221 - DNA, 13 bp, Homo sapiens
tcaggccttcttt

SEQ ID NO: 1051222 - DNA, 19 bp, Homo sapiens
tcaggctacctttttctgg

SEQ ID NO: 1051223 - DNA, 21 bp, Homo sapiens
tcaggctactcattcagtccc

SEQ ID NO: 1051224 - DNA, 11 bp, Homo sapiens
tcaggctccat

SEQ ID NO: 1051225 - DNA, 16 bp, Homo sapiens
tcaggctctgttcctc

SEQ ID NO: 1051226 - DNA, 16 bp, Homo sapiens
tcaggctcttctcctt

SEQ ID NO: 1051227 - DNA, 17 bp, Homo sapiens
tcaggctgcagaggcac

SEQ ID NO: 1051228 - DNA, 12 bp, Homo sapiens
tcaggctgcagc

SEQ ID NO: 1051229 - DNA, 19 bp, Homo sapiens
tcaggctgcagctggacag

SEQ ID NO: 1051230 - DNA, 20 bp, Homo sapiens
tcaggctgcagctggacaga

SEQ ID NO: 1051231 - DNA, 24 bp, Homo sapiens
tcaggctgctggggcctcagacga

SEQ ID NO: 1051232 - DNA, 14 bp, Homo sapiens
tcaggctgttatta

SEQ ID NO: 1051233 - DNA, 21 bp, Homo sapiens
tcaggctttcactatttcctt

SEQ ID NO: 1051234 - DNA, 22 bp, Homo sapiens
tcagggaatccagctccctaga

SEQ ID NO: 1051235 - DNA, 22 bp, Homo sapiens
tcagggaatttcaggaactaga

SEQ ID NO: 1051236 - DNA, 18 bp, Homo sapiens
tcagggacacatcccctt

SEQ ID NO: 1051237 - DNA, 14 bp, Homo sapiens
tcagggacagagcc

SEQ ID NO: 1051238 - DNA, 20 bp, Homo sapiens
tcagggaccaaggacccctc

SEQ ID NO: 1051239 - DNA, 23 bp, Homo sapiens
tcagggaccaaggacccctcacc

SEQ ID NO: 1051240 - DNA, 14 bp, Homo sapiens
tcagggacctcagg

SEQ ID NO: 1051241 - DNA, 16 bp, Homo sapiens
tcagggacctcagggg

SEQ ID NO: 1051242 - DNA, 17 bp, Homo sapiens
gcaggaccctgctgact

SEQ ID NO: 1051243 - DNA, 17 bp, Homo sapiens
gcaggaccctgtcctgc

SEQ ID NO: 1051244 - DNA, 20 bp, Homo sapiens
gcaggacctagctgttgtaa

SEQ ID NO: 1051245 - DNA, 14 bp, Homo sapiens
gcaggacctcagag

SEQ ID NO: 1051246 - DNA, 15 bp, Homo sapiens
gcaggacctcgtgcc

SEQ ID NO: 1051247 - DNA, 15 bp, Homo sapiens
gcaggacctgcctag

SEQ ID NO: 1051248 - DNA, 16 bp, Homo sapiens
gcaggacctgtgcttt

SEQ ID NO: 1051249 - DNA, 18 bp, Homo sapiens
gcaggacctgtgctttga

SEQ ID NO: 1051250 - DNA, 20 bp, Homo sapiens
gcaggacctgtgctttgaga

SEQ ID NO: 1051251 - DNA, 21 bp, Homo sapiens
gcaggaccttcgggctgtgcc

SEQ ID NO: 1051252 - DNA, 13 bp, Homo sapiens
gcaggaccttggg

SEQ ID NO: 1051253 - DNA, 16 bp, Homo sapiens
gcaggaccttgggcac

SEQ ID NO: 1051254 - DNA, 18 bp, Homo sapiens
gcaggactaggcatgtca

SEQ ID NO: 1051255 - DNA, 13 bp, Homo sapiens
gcaggactccagg

SEQ ID NO: 1051256 - DNA, 17 bp, Homo sapiens
gcaggactccaggccca

SEQ ID NO: 1051257 - DNA, 22 bp, Homo sapiens
gcaggactccaggcccaaggct

SEQ ID NO: 1051258 - DNA, 23 bp, Homo sapiens
gcaggactccaggcccaaggctc

SEQ ID NO: 1051259 - DNA, 19 bp, Homo sapiens
gcaggactttgaggcaagt

SEQ ID NO: 1051260 - DNA, 17 bp, Homo sapiens
gcaggagaatcagcctg

SEQ ID NO: 1051261 - DNA, 20 bp, Homo sapiens
gcaggagagtgtgtgggcag

SEQ ID NO: 1051262 - DNA, 23 bp, Homo sapiens
gcaggagagtgtgtgggcagggt

SEQ ID NO: 1051263 - DNA, 17 bp, Homo sapiens
gcaggagcagggcggct

SEQ ID NO: 1051264 - DNA, 22 bp, Homo sapiens
gcaggagcagtatcatgaagcc

SEQ ID NO: 1051265 - DNA, 17 bp, Homo sapiens
gcaggagcctccctgca

SEQ ID NO: 1051266 - DNA, 15 bp, Homo sapiens
gcaggaggagctgcc

SEQ ID NO: 1051267 - DNA, 23 bp, Homo sapiens
gcaggaggatcacttgagtccag

SEQ ID NO: 1051268 - DNA, 14 bp, Homo sapiens
gcaggaggattgct

SEQ ID NO: 1051269 - DNA, 23 bp, Homo sapiens
gcaggaggattgcttgagcccag

SEQ ID NO: 1051270 - DNA, 16 bp, Homo sapiens
gcaggaggcccctggc

SEQ ID NO: 1051271 - DNA, 22 bp, Homo sapiens
gcaggaggcccttgtcgtggga

SEQ ID NO: 1051272 - DNA, 17 bp, Homo sapiens
gcaggaggctcaggtga

SEQ ID NO: 1051273 - DNA, 13 bp, Homo sapiens
gcaggagggaggc

SEQ ID NO: 1051274 - DNA, 20 bp, Homo sapiens
gcaggagggaggcggggagg

SEQ ID NO: 1051275 - DNA, 18 bp, Homo sapiens
gcaggaggggggctgggt

SEQ ID NO: 1051276 - DNA, 21 bp, Homo sapiens
gcaggaggttctgggcctctg

SEQ ID NO: 1051277 - DNA, 16 bp, Homo sapiens
gcaggagtctctgcca

SEQ ID NO: 1051278 - DNA, 18 bp, Homo sapiens
gcaggagtctctgccacc

SEQ ID NO: 1051279 - DNA, 21 bp, Homo sapiens
gcaggagtctctgccacccac

SEQ ID NO: 1051280 - DNA, 13 bp, Homo sapiens
gcaggagtgccag

SEQ ID NO: 1051281 - DNA, 16 bp, Homo sapiens
gcaggagtgccaggac

SEQ ID NO: 1051282 - DNA, 19 bp, Homo sapiens
gcaggagtgccaggaccag

SEQ ID NO: 1051283 - DNA, 21 bp, Homo sapiens
gcaggagtgccaggaccagcc

SEQ ID NO: 1051284 - DNA, 23 bp, Homo sapiens
gcaggagtgccaggaccagcctg

SEQ ID NO: 1051285 - DNA, 17 bp, Homo sapiens
gcaggagtggaaggtga

SEQ ID NO: 1051286 - DNA, 21 bp, Homo sapiens
gcaggagtggaaggtgaggcg

SEQ ID NO: 1051287 - DNA, 18 bp, Homo sapiens
gcaggatccgctgccacc

SEQ ID NO: 1051288 - DNA, 20 bp, Homo sapiens
gcaggatctcaagccagccc

SEQ ID NO: 1051289 - DNA, 20 bp, Homo sapiens
gcaggatgaccacgcacctc

SEQ ID NO: 1051290 - DNA, 14 bp, Homo sapiens
gcaggatggaacta

SEQ ID NO: 1051291 - DNA, 15 bp, Homo sapiens
gcaggatgggctgag

SEQ ID NO: 1051292 - DNA, 16 bp, Homo sapiens
gcaggattcccttctg

SEQ ID NO: 1051293 - DNA, 17 bp, Homo sapiens
gcaggattcccttctgg

SEQ ID NO: 1051294 - DNA, 18 bp, Homo sapiens
gcaggattcccttctggg

SEQ ID NO: 1051295 - DNA, 21 bp, Homo sapiens
gcaggattcccttctgggctt

SEQ ID NO: 1051296 - DNA, 18 bp, Homo sapiens
gcaggcaaaaaagggaca

SEQ ID NO: 1051297 - DNA, 16 bp, Homo sapiens
gcaggcacacagcagc

SEQ ID NO: 1051298 - DNA, 18 bp, Homo sapiens
gcaggcacacagcagccc

SEQ ID NO: 1051299 - DNA, 15 bp, Homo sapiens
gcaggcacatggagg

SEQ ID NO: 1051300 - DNA, 10 bp, Homo sapiens
gcaggcacca

SEQ ID NO: 1051301 - DNA, 23 bp, Homo sapiens
gcaggcaccgccacgtcccagca

SEQ ID NO: 1051302 - DNA, 18 bp, Homo sapiens
gcaggcacgggtggtccc

SEQ ID NO: 1051303 - DNA, 16 bp, Homo sapiens
gcaggcactgtggccc

SEQ ID NO: 1051304 - DNA, 12 bp, Homo sapiens
gcaggcagacac

SEQ ID NO: 1051305 - DNA, 11 bp, Homo sapiens
gcaggcagaga

SEQ ID NO: 1051306 - DNA, 18 bp, Homo sapiens
gcaggcaggcggctcctc

SEQ ID NO: 1051307 - DNA, 15 bp, Homo sapiens
gcaggcaggctgggg

SEQ ID NO: 1051308 - DNA, 14 bp, Homo sapiens
gcaggcaggggcat

SEQ ID NO: 1051309 - DNA, 16 bp, Homo sapiens
tcataagtaaacctag

SEQ ID NO: 1051310 - DNA, 20 bp, Homo sapiens
tcataagtaaacctagtaaa

SEQ ID NO: 1051311 - DNA, 20 bp, Homo sapiens
tcataataaagttgttttat

SEQ ID NO: 1051312 - DNA, 14 bp, Homo sapiens
tcataatcagtaaa

SEQ ID NO: 1051313 - DNA, 13 bp, Homo sapiens
tcataattacatt

SEQ ID NO: 1051314 - DNA, 12 bp, Homo sapiens
tcataattacca

SEQ ID NO: 1051315 - DNA, 16 bp, Homo sapiens
tcataattattttgtt

SEQ ID NO: 1051316 - DNA, 20 bp, Homo sapiens
tcataattcctacagcacta

SEQ ID NO: 1051317 - DNA, 15 bp, Homo sapiens
tcataattctgaaac

SEQ ID NO: 1051318 - DNA, 18 bp, Homo sapiens
tcatacacagttaaataa

SEQ ID NO: 1051319 - DNA, 17 bp, Homo sapiens
tcatacagttttcattg

SEQ ID NO: 1051320 - DNA, 22 bp, Homo sapiens
tcatacatatatatatttgtaa

SEQ ID NO: 1051321 - DNA, 23 bp, Homo sapiens
tcatacatatatatatttgtaac

SEQ ID NO: 1051322 - DNA, 14 bp, Homo sapiens
tcatacctcagaat

SEQ ID NO: 1051323 - DNA, 17 bp, Homo sapiens
tcatacgcatcccatct

SEQ ID NO: 1051324 - DNA, 23 bp, Homo sapiens
tcatacgcatcccatctctccca

SEQ ID NO: 1051325 - DNA, 14 bp, Homo sapiens
tcatactgcctact

SEQ ID NO: 1051326 - DNA, 21 bp, Homo sapiens
tcatactgcctactgttactc

SEQ ID NO: 1051327 - DNA, 18 bp, Homo sapiens
tcatactgtctgggatta

SEQ ID NO: 1051328 - DNA, 13 bp, Homo sapiens
tcatacttaaaaa

SEQ ID NO: 1051329 - DNA, 14 bp, Homo sapiens
tcatacttaaaaat

SEQ ID NO: 1051330 - DNA, 12 bp, Homo sapiens
tcatacttttct

SEQ ID NO: 1051331 - DNA, 13 bp, Homo sapiens
tcatacttttctt

SEQ ID NO: 1051332 - DNA, 16 bp, Homo sapiens
tcatacttttcttact

SEQ ID NO: 1051333 - DNA, 23 bp, Homo sapiens
tcatagaaatgtaacttttgtaa

SEQ ID NO: 1051334 - DNA, 14 bp, Homo sapiens
tcatagagatttgt

SEQ ID NO: 1051335 - DNA, 19 bp, Homo sapiens
tcatagaggtgagaaaact

SEQ ID NO: 1051336 - DNA, 15 bp, Homo sapiens
tcatagatagataag

SEQ ID NO: 1051337 - DNA, 22 bp, Homo sapiens
tcatagcaataacattcccact

SEQ ID NO: 1051338 - DNA, 19 bp, Homo sapiens
tcatagcattaactaatct

SEQ ID NO: 1051339 - DNA, 17 bp, Homo sapiens
tcatagccaaagccagg

SEQ ID NO: 1051340 - DNA, 17 bp, Homo sapiens
tcatagccataaatgat

SEQ ID NO: 1051341 - DNA, 20 bp, Homo sapiens
tcatagctcactgcagcctc

SEQ ID NO: 1051342 - DNA, 20 bp, Homo sapiens
tcataggaaaagtacattta

SEQ ID NO: 1051343 - DNA, 18 bp, Homo sapiens
tcataggaagtggctggt

SEQ ID NO: 1051344 - DNA, 14 bp, Homo sapiens
tcataggagactgc

SEQ ID NO: 1051345 - DNA, 20 bp, Homo sapiens
tcataggcggtcatgtgtgc

SEQ ID NO: 1051346 - DNA, 21 bp, Homo sapiens
tcataggcggtcatgtgtgca

SEQ ID NO: 1051347 - DNA, 17 bp, Homo sapiens
tcatagggatgctgtga

SEQ ID NO: 1051348 - DNA, 22 bp, Homo sapiens
tcatagggattgtccctgtgtt

SEQ ID NO: 1051349 - DNA, 16 bp, Homo sapiens
tcatagggtgctctga

SEQ ID NO: 1051350 - DNA, 23 bp, Homo sapiens
tcataggtagaaacaaatacttg

SEQ ID NO: 1051351 - DNA, 17 bp, Homo sapiens
tcataggtatgattttt

SEQ ID NO: 1051352 - DNA, 16 bp, Homo sapiens
tcataggtatttcaaa

SEQ ID NO: 1051353 - DNA, 18 bp, Homo sapiens
tcataggtcactggctct

SEQ ID NO: 1051354 - DNA, 14 bp, Homo sapiens
tcataggtctgaaa

SEQ ID NO: 1051355 - DNA, 14 bp, Homo sapiens
tcataggttaaaaa

SEQ ID NO: 1051356 - DNA, 15 bp, Homo sapiens
tcataggttaaaaaa

SEQ ID NO: 1051357 - DNA, 20 bp, Homo sapiens
tcataggttaaaaaaaaaag

SEQ ID NO: 1051358 - DNA, 14 bp, Homo sapiens
tcatagtaacttct

SEQ ID NO: 1051359 - DNA, 21 bp, Homo sapiens
tcatagtaacttcttatggaa

SEQ ID NO: 1051360 - DNA, 17 bp, Homo sapiens
tcatagtaataagatgg

SEQ ID NO: 1051361 - DNA, 24 bp, Homo sapiens
tcatagtatccatattttattact

SEQ ID NO: 1051362 - DNA, 11 bp, Homo sapiens
tcatagtgcct

SEQ ID NO: 1051363 - DNA, 14 bp, Homo sapiens
tcatagtgcctttt

SEQ ID NO: 1051364 - DNA, 15 bp, Homo sapiens
tcatagtgccttttt

SEQ ID NO: 1051365 - DNA, 18 bp, Homo sapiens
tcatagtgcctttttcct

SEQ ID NO: 1051366 - DNA, 13 bp, Homo sapiens
tcatagttcagaa

SEQ ID NO: 1051367 - DNA, 14 bp, Homo sapiens
tcatagttcagaat

SEQ ID NO: 1051368 - DNA, 16 bp, Homo sapiens
tcatagttcagaattt

SEQ ID NO: 1051369 - DNA, 18 bp, Homo sapiens
tcatagttcagaatttag

SEQ ID NO: 1051370 - DNA, 15 bp, Homo sapiens
tcatataaaaagcag

SEQ ID NO: 1051371 - DNA, 20 bp, Homo sapiens
tcatataaaaagcagcagag

SEQ ID NO: 1051372 - DNA, 15 bp, Homo sapiens
tcatataaactcatt

SEQ ID NO: 1051373 - DNA, 16 bp, Homo sapiens
tcatataaagtatcat

SEQ ID NO: 1051374 - DNA, 12 bp, Homo sapiens
tcatataagaca

SEQ ID NO: 1051375 - DNA, 18 bp, Homo sapiens
tcatataagattcatatt

SEQ ID NO: 1051376 - DNA, 16 bp, Homo sapiens
tcatataataaatgta

SEQ ID NO: 1051377 - DNA, 16 bp, Homo sapiens
tcatataccagcaata

SEQ ID NO: 1051378 - DNA, 14 bp, Homo sapiens
tcatatacgtgaaa

SEQ ID NO: 1051379 - DNA, 14 bp, Homo sapiens
tcatatactataat

SEQ ID NO: 1051380 - DNA, 13 bp, Homo sapiens
tcatatatttaag

SEQ ID NO: 1051381 - DNA, 18 bp, Homo sapiens
tcatatcactaaataaac

SEQ ID NO: 1051382 - DNA, 13 bp, Homo sapiens
gcagttttaagaa

SEQ ID NO: 1051383 - DNA, 16 bp, Homo sapiens
gcagttttaagaattg

SEQ ID NO: 1051384 - DNA, 14 bp, Homo sapiens
gcataaaaaaatga

SEQ ID NO: 1051385 - DNA, 19 bp, Homo sapiens
gcataaagctcaaatgaaa

SEQ ID NO: 1051386 - DNA, 16 bp, Homo sapiens
gcataacaattcctct

SEQ ID NO: 1051387 - DNA, 14 bp, Homo sapiens
gcataacctgtctc

SEQ ID NO: 1051388 - DNA, 16 bp, Homo sapiens
gcataagattaaagga

SEQ ID NO: 1051389 - DNA, 18 bp, Homo sapiens
gcataataagctaaagag

SEQ ID NO: 1051390 - DNA, 16 bp, Homo sapiens
gcataatagtcaattt

SEQ ID NO: 1051391 - DNA, 18 bp, Homo sapiens
gcataatatgaagccttt

SEQ ID NO: 1051392 - DNA, 15 bp, Homo sapiens
gcataatgataaaat

SEQ ID NO: 1051393 - DNA, 17 bp, Homo sapiens
gcataatgataaaataa

SEQ ID NO: 1051394 - DNA, 22 bp, Homo sapiens
gcataatgctcccatctcctga

SEQ ID NO: 1051395 - DNA, 22 bp, Homo sapiens
gcataatgttaagctttattgt

SEQ ID NO: 1051396 - DNA, 21 bp, Homo sapiens
gcataattccgaaacaaaact

SEQ ID NO: 1051397 - DNA, 16 bp, Homo sapiens
gcataatttaaaaata

SEQ ID NO: 1051398 - DNA, 19 bp, Homo sapiens
gcataatttaaaaatatat

SEQ ID NO: 1051399 - DNA, 15 bp, Homo sapiens
gcataatttgtctta

SEQ ID NO: 1051400 - DNA, 19 bp, Homo sapiens
gcataatttgtttaaaatt

SEQ ID NO: 1051401 - DNA, 20 bp, Homo sapiens
gcataatttgtttaaaattc

SEQ ID NO: 1051402 - DNA, 22 bp, Homo sapiens
gcataatttgtttaaaattctc

SEQ ID NO: 1051403 - DNA, 23 bp, Homo sapiens
gcataatttgtttaaaattctct

SEQ ID NO: 1051404 - DNA, 14 bp, Homo sapiens
gcatacaaaatatt

SEQ ID NO: 1051405 - DNA, 20 bp, Homo sapiens
gcatacaagtttcattctcc

SEQ ID NO: 1051406 - DNA, 16 bp, Homo sapiens
gcatacaataaaagag

SEQ ID NO: 1051407 - DNA, 19 bp, Homo sapiens
gcatacaataaaagagctt

SEQ ID NO: 1051408 - DNA, 22 bp, Homo sapiens
gcatacaataaaagagctttat

SEQ ID NO: 1051409 - DNA, 13 bp, Homo sapiens
gcatacaatctga

SEQ ID NO: 1051410 - DNA, 23 bp, Homo sapiens
gcatacaccactgcaaaatgtct

SEQ ID NO: 1051411 - DNA, 14 bp, Homo sapiens
gcatacagttttct

SEQ ID NO: 1051412 - DNA, 15 bp, Homo sapiens
gcataccacttttgt

SEQ ID NO: 1051413 - DNA, 16 bp, Homo sapiens
gcatacgtacacattt

SEQ ID NO: 1051414 - DNA, 19 bp, Homo sapiens
gcatacgtacacattttat

SEQ ID NO: 1051415 - DNA, 13 bp, Homo sapiens
gcatactgtgtat

SEQ ID NO: 1051416 - DNA, 18 bp, Homo sapiens
gcatactgttgatacaaa

SEQ ID NO: 1051417 - DNA, 20 bp, Homo sapiens
gcatactgttgatacaaacc

SEQ ID NO: 1051418 - DNA, 22 bp, Homo sapiens
gcatagaggcttctccgccagc

SEQ ID NO: 1051419 - DNA, 20 bp, Homo sapiens
gcatagcagtatatgttaat

SEQ ID NO: 1051420 - DNA, 23 bp, Homo sapiens
gcatagccagcattcagcacaca

SEQ ID NO: 1051421 - DNA, 15 bp, Homo sapiens
gcatagcgtcctgcc

SEQ ID NO: 1051422 - DNA, 16 bp, Homo sapiens
gcatagcgtcctgccc

SEQ ID NO: 1051423 - DNA, 20 bp, Homo sapiens
gcatagcgtcctgccctgcc

SEQ ID NO: 1051424 - DNA, 15 bp, Homo sapiens
gcatagctctggggt

SEQ ID NO: 1051425 - DNA, 17 bp, Homo sapiens
gcatagctgttttagct

SEQ ID NO: 1051426 - DNA, 18 bp, Homo sapiens
gcataggagtttggagga

SEQ ID NO: 1051427 - DNA, 14 bp, Homo sapiens
gcataggcccagcc

SEQ ID NO: 1051428 - DNA, 12 bp, Homo sapiens
gcataggcctgg

SEQ ID NO: 1051429 - DNA, 12 bp, Homo sapiens
gcatagggggga

SEQ ID NO: 1051430 - DNA, 19 bp, Homo sapiens
gcatagggtcactttgcca

SEQ ID NO: 1051431 - DNA, 14 bp, Homo sapiens
tcatctgggaaaga

SEQ ID NO: 1051432 - DNA, 20 bp, Homo sapiens
tcatctggttgaactctggt

SEQ ID NO: 1051433 - DNA, 22 bp, Homo sapiens
tcatctgtaagagcttgctcca

SEQ ID NO: 1051434 - DNA, 17 bp, Homo sapiens
tcatctgtccctccggg

SEQ ID NO: 1051435 - DNA, 22 bp, Homo sapiens
tcatctgtctttcactggaatg

SEQ ID NO: 1051436 - DNA, 12 bp, Homo sapiens
tcatctgtgcac

SEQ ID NO: 1051437 - DNA, 14 bp, Homo sapiens
tcatctgtggagct

SEQ ID NO: 1051438 - DNA, 16 bp, Homo sapiens
tcatctgtggagctgc

SEQ ID NO: 1051439 - DNA, 19 bp, Homo sapiens
tcatctgtggagctgccac

SEQ ID NO: 1051440 - DNA, 16 bp, Homo sapiens
tcatctgttagggcct

SEQ ID NO: 1051441 - DNA, 17 bp, Homo sapiens
tcatctgtttttctttt

SEQ ID NO: 1051442 - DNA, 21 bp, Homo sapiens
tcatcttacatttctcaccct

SEQ ID NO: 1051443 - DNA, 18 bp, Homo sapiens
tcatcttagactttgcaa

SEQ ID NO: 1051444 - DNA, 15 bp, Homo sapiens
tcatcttctggaata

SEQ ID NO: 1051445 - DNA, 17 bp, Homo sapiens
tcatcttgcaagcaaat

SEQ ID NO: 1051446 - DNA, 18 bp, Homo sapiens
tcatcttgctaccagtat

SEQ ID NO: 1051447 - DNA, 15 bp, Homo sapiens
tcatctttttctaga

SEQ ID NO: 1051448 - DNA, 16 bp, Homo sapiens
tcatgaacttggctgt

SEQ ID NO: 1051449 - DNA, 12 bp, Homo sapiens
tcatgaagccca

SEQ ID NO: 1051450 - DNA, 13 bp, Homo sapiens
tcatgaagcccaa

SEQ ID NO: 1051451 - DNA, 15 bp, Homo sapiens
tcatgaatctttcat

SEQ ID NO: 1051452 - DNA, 23 bp, Homo sapiens
tcatgaatctttcatacatatat

SEQ ID NO: 1051453 - DNA, 15 bp, Homo sapiens
tcatgaatgctttta

SEQ ID NO: 1051454 - DNA, 21 bp, Homo sapiens
tcatgaatgcttttagtgtgt

SEQ ID NO: 1051455 - DNA, 11 bp, Homo sapiens
tcatgaatgtg

SEQ ID NO: 1051456 - DNA, 21 bp, Homo sapiens
tcatgaatgtgctggtgaaca

SEQ ID NO: 1051457 - DNA, 19 bp, Homo sapiens
tcatgaattcccttttaat

SEQ ID NO: 1051458 - DNA, 20 bp, Homo sapiens
tcatgaattcttatgcttat

SEQ ID NO: 1051459 - DNA, 16 bp, Homo sapiens
tcatgacaagcatttt

SEQ ID NO: 1051460 - DNA, 19 bp, Homo sapiens
tcatgacatgttatatatt

SEQ ID NO: 1051461 - DNA, 19 bp, Homo sapiens
tcatgaccactgggcctgc

SEQ ID NO: 1051462 - DNA, 16 bp, Homo sapiens
tcatgaccagcaaata

SEQ ID NO: 1051463 - DNA, 17 bp, Homo sapiens
tcatgaccattagaata

SEQ ID NO: 1051464 - DNA, 19 bp, Homo sapiens
tcatgagcctgctggaagc

SEQ ID NO: 1051465 - DNA, 20 bp, Homo sapiens
tcatgataccacctttactg

SEQ ID NO: 1051466 - DNA, 21 bp, Homo sapiens
tcatgataccacctttactgt

SEQ ID NO: 1051467 - DNA, 17 bp, Homo sapiens
tcatgatagacttgtta

SEQ ID NO: 1051468 - DNA, 16 bp, Homo sapiens
tcatgatccaactaat

SEQ ID NO: 1051469 - DNA, 18 bp, Homo sapiens
tcatgatctccctgccgc

SEQ ID NO: 1051470 - DNA, 16 bp, Homo sapiens
tcatgatcttgtgaca

SEQ ID NO: 1051471 - DNA, 19 bp, Homo sapiens
tcatgatggtcctaaataa

SEQ ID NO: 1051472 - DNA, 22 bp, Homo sapiens
tcatgattatagcaactaatgt

SEQ ID NO: 1051473 - DNA, 22 bp, Homo sapiens
tcatgattggcttaaagtgaag

SEQ ID NO: 1051474 - DNA, 17 bp, Homo sapiens
tcatgatttcatttcaa

SEQ ID NO: 1051475 - DNA, 23 bp, Homo sapiens
tcatgatttcatttcaactgttt

SEQ ID NO: 1051476 - DNA, 19 bp, Homo sapiens
tcatgcaaactgctttatt

SEQ ID NO: 1051477 - DNA, 16 bp, Homo sapiens
tcatgcacttaaagaa

SEQ ID NO: 1051478 - DNA, 18 bp, Homo sapiens
tcatgcatgtcctgtaaa

SEQ ID NO: 1051479 - DNA, 15 bp, Homo sapiens
tcatgcatttcaagc

SEQ ID NO: 1051480 - DNA, 22 bp, Homo sapiens
tcatgccaccatggccagccaa

SEQ ID NO: 1051481 - DNA, 23 bp, Homo sapiens
tcatgccagctacttcctcctcc

SEQ ID NO: 1051482 - DNA, 11 bp, Homo sapiens
tcatgccatct

SEQ ID NO: 1051483 - DNA, 18 bp, Homo sapiens
tcatgccatctgttttca

SEQ ID NO: 1051484 - DNA, 15 bp, Homo sapiens
tcatgcccagctctc

SEQ ID NO: 1051485 - DNA, 18 bp, Homo sapiens
tcatgcccagctctctga

SEQ ID NO: 1051486 - DNA, 19 bp, Homo sapiens
tcatgcccagctctctgac

SEQ ID NO: 1051487 - DNA, 20 bp, Homo sapiens
tcatgcccagctctctgacg

SEQ ID NO: 1051488 - DNA, 13 bp, Homo sapiens
tcatgcccccctc

SEQ ID NO: 1051489 - DNA, 18 bp, Homo sapiens
tcatgccccctttcagat

SEQ ID NO: 1051490 - DNA, 16 bp, Homo sapiens
tcatgcccctggctgg

SEQ ID NO: 1051491 - DNA, 13 bp, Homo sapiens
tcatgccctcctc

SEQ ID NO: 1051492 - DNA, 14 bp, Homo sapiens
tcatgccctcctct

SEQ ID NO: 1051493 - DNA, 21 bp, Homo sapiens
tcatgccctgccaagcagcag

SEQ ID NO: 1051494 - DNA, 16 bp, Homo sapiens
tcatgcggtgggtgct

SEQ ID NO: 1051495 - DNA, 18 bp, Homo sapiens
tcatgcgtgttttacctt

SEQ ID NO: 1051496 - DNA, 21 bp, Homo sapiens
tcatgcgttttatatcttcct

SEQ ID NO: 1051497 - DNA, 16 bp, Homo sapiens
tcatgctccaagactt

SEQ ID NO: 1051498 - DNA, 20 bp, Homo sapiens
tcatgctggaacctgcaaaa

SEQ ID NO: 1051499 - DNA, 17 bp, Homo sapiens
tcatgctggagggaggc

SEQ ID NO: 1051500 - DNA, 13 bp, Homo sapiens
tcatgctggtggg

SEQ ID NO: 1051501 - DNA, 23 bp, Homo sapiens
tcatgctgttgctgctactgtct

SEQ ID NO: 1051502 - DNA, 18 bp, Homo sapiens
tcatgcttgtgttataac

SEQ ID NO: 1051503 - DNA, 15 bp, Homo sapiens
tcatggaatcttgct

SEQ ID NO: 1051504 - DNA, 17 bp, Homo sapiens
tcatggaatggacatcc

SEQ ID NO: 1051505 - DNA, 20 bp, Homo sapiens
tcatggaatggcaggtgtca

SEQ ID NO: 1051506 - DNA, 21 bp, Homo sapiens
tcatggaccaaatgtgccata

SEQ ID NO: 1051507 - DNA, 22 bp, Homo sapiens
tcatggattacttctctataaa

SEQ ID NO: 1051508 - DNA, 22 bp, Homo sapiens
tcatggcagaaggcaaacccat

SEQ ID NO: 1051509 - DNA, 13 bp, Homo sapiens
tcatggcccctct

SEQ ID NO: 1051510 - DNA, 18 bp, Homo sapiens
tcatggcccctctgacct

SEQ ID NO: 1051511 - DNA, 20 bp, Homo sapiens
tcatggcctattatattaaa

SEQ ID NO: 1051512 - DNA, 16 bp, Homo sapiens
tcatggccttgaaaca

SEQ ID NO: 1051513 - DNA, 23 bp, Homo sapiens
tcatggccttgaaacagttccat

SEQ ID NO: 1051514 - DNA, 14 bp, Homo sapiens
tcatggcttaatgt

SEQ ID NO: 1051515 - DNA, 16 bp, Homo sapiens
gcatgctcagtgcctt

SEQ ID NO: 1051516 - DNA, 17 bp, Homo sapiens
gcatgctcagtgccttt

SEQ ID NO: 1051517 - DNA, 14 bp, Homo sapiens
gcatgctccctcct

SEQ ID NO: 1051518 - DNA, 17 bp, Homo sapiens
gcatgctctctgcagcc

SEQ ID NO: 1051519 - DNA, 14 bp, Homo sapiens
gcatgctctggaag

SEQ ID NO: 1051520 - DNA, 20 bp, Homo sapiens
gcatgctctggaagcctgga

SEQ ID NO: 1051521 - DNA, 20 bp, Homo sapiens
gcatgctgataatcattttg

SEQ ID NO: 1051522 - DNA, 14 bp, Homo sapiens
gcatgctgctttgc

SEQ ID NO: 1051523 - DNA, 16 bp, Homo sapiens
gcatgctggggcaagt

SEQ ID NO: 1051524 - DNA, 14 bp, Homo sapiens
gcatgctgtagctg

SEQ ID NO: 1051525 - DNA, 14 bp, Homo sapiens
gcatgcttaaattt

SEQ ID NO: 1051526 - DNA, 13 bp, Homo sapiens
gcatgcttagagc

SEQ ID NO: 1051527 - DNA, 22 bp, Homo sapiens
gcatgcttcctttctctcctgg

SEQ ID NO: 1051528 - DNA, 23 bp, Homo sapiens
gcatgcttcctttctctcctggc

SEQ ID NO: 1051529 - DNA, 15 bp, Homo sapiens
gcatgcttgggctga

SEQ ID NO: 1051530 - DNA, 22 bp, Homo sapiens
gcatgcttgggctgacccagca

SEQ ID NO: 1051531 - DNA, 17 bp, Homo sapiens
gcatgctttgctgctat

SEQ ID NO: 1051532 - DNA, 14 bp, Homo sapiens
gcatggaaaaatgg

SEQ ID NO: 1051533 - DNA, 16 bp, Homo sapiens
gcatggaaatcagcca

SEQ ID NO: 1051534 - DNA, 19 bp, Homo sapiens
gcatggaaatttaaagcag

SEQ ID NO: 1051535 - DNA, 19 bp, Homo sapiens
gcatggacaccttgtgttt

SEQ ID NO: 1051536 - DNA, 14 bp, Homo sapiens
gcatggacagggcc

SEQ ID NO: 1051537 - DNA, 22 bp, Homo sapiens
gcatggacagggccagggttgc

SEQ ID NO: 1051538 - DNA, 20 bp, Homo sapiens
gcatggacatttagaagaaa

SEQ ID NO: 1051539 - DNA, 17 bp, Homo sapiens
gcatggacctaacattc

SEQ ID NO: 1051540 - DNA, 15 bp, Homo sapiens
gcatggactctgggt

SEQ ID NO: 1051541 - DNA, 12 bp, Homo sapiens
gcatggagaagg

SEQ ID NO: 1051542 - DNA, 20 bp, Homo sapiens
gcatggagaagggttctgcc

SEQ ID NO: 1051543 - DNA, 15 bp, Homo sapiens
gcatggagaataaac

SEQ ID NO: 1051544 - DNA, 13 bp, Homo sapiens
gcatggagcctgg

SEQ ID NO: 1051545 - DNA, 21 bp, Homo sapiens
gcatggcaaatcaggggccag

SEQ ID NO: 1051546 - DNA, 21 bp, Homo sapiens
gcatggcaagtcacatgcgta

SEQ ID NO: 1051547 - DNA, 13 bp, Homo sapiens
gcatggcaggctg

SEQ ID NO: 1051548 - DNA, 12 bp, Homo sapiens
gcatggccctgg

SEQ ID NO: 1051549 - DNA, 22 bp, Homo sapiens
gcatggccctggggtcccacga

SEQ ID NO: 1051550 - DNA, 16 bp, Homo sapiens
gcatggcgtggaggag

SEQ ID NO: 1051551 - DNA, 15 bp, Homo sapiens
gcatggctcagagct

SEQ ID NO: 1051552 - DNA, 23 bp, Homo sapiens
gcatggctcagagcttgaagatt

SEQ ID NO: 1051553 - DNA, 22 bp, Homo sapiens
tcattgcctgtgtatggaaaaa

SEQ ID NO: 1051554 - DNA, 23 bp, Homo sapiens
tcattgcctgtgtatggaaaaac

SEQ ID NO: 1051555 - DNA, 17 bp, Homo sapiens
tcattgccttcgctcca

SEQ ID NO: 1051556 - DNA, 15 bp, Homo sapiens
tcattgctaaaaaat

SEQ ID NO: 1051557 - DNA, 16 bp, Homo sapiens
tcattgctgagcctct

SEQ ID NO: 1051558 - DNA, 22 bp, Homo sapiens
tcattgctgagcctctgctccc

SEQ ID NO: 1051559 - DNA, 23 bp, Homo sapiens
tcattgctgagcctctgctcccc

SEQ ID NO: 1051560 - DNA, 20 bp, Homo sapiens
tcattggcagctcaaagact

SEQ ID NO: 1051561 - DNA, 18 bp, Homo sapiens
tcattgtactgtttttaa

SEQ ID NO: 1051562 - DNA, 16 bp, Homo sapiens
tcattgtatatatgtg

SEQ ID NO: 1051563 - DNA, 23 bp, Homo sapiens
tcattgtatgatgtgttgtgata

SEQ ID NO: 1051564 - DNA, 15 bp, Homo sapiens
tcattgtatgttatt

SEQ ID NO: 1051565 - DNA, 16 bp, Homo sapiens
tcattgtattcagata

SEQ ID NO: 1051566 - DNA, 18 bp, Homo sapiens
tcattgtattcagataat

SEQ ID NO: 1051567 - DNA, 21 bp, Homo sapiens
tcattgtcttgttatgtacaa

SEQ ID NO: 1051568 - DNA, 15 bp, Homo sapiens
tcattgtgccaagcc

SEQ ID NO: 1051569 - DNA, 20 bp, Homo sapiens
tcattgtgccaagccttctg

SEQ ID NO: 1051570 - DNA, 21 bp, Homo sapiens
tcattgtgccaagccttctgt

SEQ ID NO: 1051571 - DNA, 23 bp, Homo sapiens
tcattgtgccaagccttctgtga

SEQ ID NO: 1051572 - DNA, 15 bp, Homo sapiens
tcattgttataaaga

SEQ ID NO: 1051573 - DNA, 22 bp, Homo sapiens
tcattgttatttatacaagatt

SEQ ID NO: 1051574 - DNA, 24 bp, Homo sapiens
tcattgtttgtttgtaagtttgaa

SEQ ID NO: 1051575 - DNA, 12 bp, Homo sapiens
tcatttaaaaca

SEQ ID NO: 1051576 - DNA, 17 bp, Homo sapiens
tcatttaaaatgattag

SEQ ID NO: 1051577 - DNA, 15 bp, Homo sapiens
tcatttaaactaaat

SEQ ID NO: 1051578 - DNA, 16 bp, Homo sapiens
tcatttaaactaaatt

SEQ ID NO: 1051579 - DNA, 14 bp, Homo sapiens
tcatttaagggaaa

SEQ ID NO: 1051580 - DNA, 15 bp, Homo sapiens
tcatttaagggaaaa

SEQ ID NO: 1051581 - DNA, 23 bp, Homo sapiens
tcatttaagtttcaaacttacta

SEQ ID NO: 1051582 - DNA, 12 bp, Homo sapiens
tcatttacacac

SEQ ID NO: 1051583 - DNA, 17 bp, Homo sapiens
tcatttagataatttga

SEQ ID NO: 1051584 - DNA, 18 bp, Homo sapiens
tcatttagataatttgaa

SEQ ID NO: 1051585 - DNA, 16 bp, Homo sapiens
tcatttatctataatt

SEQ ID NO: 1051586 - DNA, 15 bp, Homo sapiens
tcatttatgaaaaga

SEQ ID NO: 1051587 - DNA, 11 bp, Homo sapiens
tcatttatgat

SEQ ID NO: 1051588 - DNA, 14 bp, Homo sapiens
tcatttcactgtct

SEQ ID NO: 1051589 - DNA, 21 bp, Homo sapiens
tcatttcagaagttagtttgt

SEQ ID NO: 1051590 - DNA, 14 bp, Homo sapiens
tcatttcagccaaa

SEQ ID NO: 1051591 - DNA, 19 bp, Homo sapiens
tcatttcagggtcttggct

SEQ ID NO: 1051592 - DNA, 11 bp, Homo sapiens
tcatttcatct

SEQ ID NO: 1051593 - DNA, 15 bp, Homo sapiens
tcatttcatctcatt

SEQ ID NO: 1051594 - DNA, 18 bp, Homo sapiens
tcatttcatctcatttaa

SEQ ID NO: 1051595 - DNA, 20 bp, Homo sapiens
tcatttcatctcatttaagg

SEQ ID NO: 1051596 - DNA, 16 bp, Homo sapiens
tcatttcattcctaac

SEQ ID NO: 1051597 - DNA, 14 bp, Homo sapiens
tcatttcattgtat

SEQ ID NO: 1051598 - DNA, 13 bp, Homo sapiens
tcatttccgtccc

SEQ ID NO: 1051599 - DNA, 13 bp, Homo sapiens
tcatttcctgccc

SEQ ID NO: 1051600 - DNA, 15 bp, Homo sapiens
tcatttcctgccctt

SEQ ID NO: 1051601 - DNA, 15 bp, Homo sapiens
tcatttctactgtga

SEQ ID NO: 1051602 - DNA, 13 bp, Homo sapiens
tcatttctatttc

SEQ ID NO: 1051603 - DNA, 17 bp, Homo sapiens
tcatttctatttctcct

SEQ ID NO: 1051604 - DNA, 14 bp, Homo sapiens
tcatttctcaggtg

SEQ ID NO: 1051605 - DNA, 20 bp, Homo sapiens
tcatttctgtctttaagaac

SEQ ID NO: 1051606 - DNA, 20 bp, Homo sapiens
tcatttcttatcacataaga

SEQ ID NO: 1051607 - DNA, 16 bp, Homo sapiens
tcatttcttcctctgc

SEQ ID NO: 1051608 - DNA, 13 bp, Homo sapiens
tcatttcttgggc

SEQ ID NO: 1051609 - DNA, 23 bp, Homo sapiens
tcatttctttgtctttttcctac

SEQ ID NO: 1051610 - DNA, 17 bp, Homo sapiens
tcatttgaggaagctct

SEQ ID NO: 1051611 - DNA, 16 bp, Homo sapiens
tcatttgagtctctta

SEQ ID NO: 1051612 - DNA, 18 bp, Homo sapiens
tcatttgcaattcatgta

SEQ ID NO: 1051613 - DNA, 17 bp, Homo sapiens
tcatttggcttgctgtt

SEQ ID NO: 1051614 - DNA, 15 bp, Homo sapiens
tcatttggtctgcca

SEQ ID NO: 1051615 - DNA, 17 bp, Homo sapiens
tcatttggtctgccaga

SEQ ID NO: 1051616 - DNA, 18 bp, Homo sapiens
tcatttggtgttcctgga

SEQ ID NO: 1051617 - DNA, 21 bp, Homo sapiens
tcatttggtgttcctggaagc

SEQ ID NO: 1051618 - DNA, 13 bp, Homo sapiens
tcatttggttaaa

SEQ ID NO: 1051619 - DNA, 18 bp, Homo sapiens
tcatttggttcattaatt

SEQ ID NO: 1051620 - DNA, 12 bp, Homo sapiens
tcatttgtacaa

SEQ ID NO: 1051621 - DNA, 13 bp, Homo sapiens
tcatttgtacaag

SEQ ID NO: 1051622 - DNA, 16 bp, Homo sapiens
tcatttgtatgtcaaa

SEQ ID NO: 1051623 - DNA, 16 bp, Homo sapiens
tcatttgtattgctta

SEQ ID NO: 1051624 - DNA, 18 bp, Homo sapiens
tcatttgtattgcttatt

SEQ ID NO: 1051625 - DNA, 14 bp, Homo sapiens
tcatttgtgaagaa

SEQ ID NO: 1051626 - DNA, 12 bp, Homo sapiens
tcatttgtgtca

SEQ ID NO: 1051627 - DNA, 13 bp, Homo sapiens
tcatttgtgtcaa

SEQ ID NO: 1051628 - DNA, 21 bp, Homo sapiens
tcatttgtttaaaaaggcagt

SEQ ID NO: 1051629 - DNA, 14 bp, Homo sapiens
tcatttgtttaaac

SEQ ID NO: 1051630 - DNA, 21 bp, Homo sapiens
tcatttgtttaaacaatcttt

SEQ ID NO: 1051631 - DNA, 18 bp, Homo sapiens
tcatttgtttacatttga

SEQ ID NO: 1051632 - DNA, 15 bp, Homo sapiens
tcatttgttttgctt

SEQ ID NO: 1051633 - DNA, 17 bp, Homo sapiens
tcattttaaaaacttta

SEQ ID NO: 1051634 - DNA, 16 bp, Homo sapiens
tcattttaaattccac

SEQ ID NO: 1051635 - DNA, 14 bp, Homo sapiens
tcattttaattatt

SEQ ID NO: 1051636 - DNA, 16 bp, Homo sapiens
tcattttacagtatct

SEQ ID NO: 1051637 - DNA, 21 bp, Homo sapiens
tcattttatatgtcaaagcag

SEQ ID NO: 1051638 - DNA, 13 bp, Homo sapiens
tcattttattctt

SEQ ID NO: 1051639 - DNA, 10 bp, Homo sapiens
tcattttcct

SEQ ID NO: 1051640 - DNA, 20 bp, Homo sapiens
tcattttctagatacaataa

SEQ ID NO: 1051641 - DNA, 23 bp, Homo sapiens
tcattttctagatacaataaatt

SEQ ID NO: 1051642 - DNA, 13 bp, Homo sapiens
tcattttctctaa

SEQ ID NO: 1051643 - DNA, 21 bp, Homo sapiens
tcattttctttaggacataaa

SEQ ID NO: 1051644 - DNA, 19 bp, Homo sapiens
tcattttgacaaagtgcct

SEQ ID NO: 1051645 - DNA, 18 bp, Homo sapiens
tcattttgagtattttta

SEQ ID NO: 1051646 - DNA, 20 bp, Homo sapiens
tcattttgagtttgcctcag

SEQ ID NO: 1051647 - DNA, 23 bp, Homo sapiens
gcattttcctcgcctaggcctgt

SEQ ID NO: 1051648 - DNA, 18 bp, Homo sapiens
gcattttcttcacagtgc

SEQ ID NO: 1051649 - DNA, 14 bp, Homo sapiens
gcattttcttcaga

SEQ ID NO: 1051650 - DNA, 14 bp, Homo sapiens
gcattttgctattg

SEQ ID NO: 1051651 - DNA, 19 bp, Homo sapiens
gcattttgctattgtaaat

SEQ ID NO: 1051652 - DNA, 22 bp, Homo sapiens
gcattttgggggtttttaatct

SEQ ID NO: 1051653 - DNA, 18 bp, Homo sapiens
gcattttgtttctgtata

SEQ ID NO: 1051654 - DNA, 20 bp, Homo sapiens
gcatttttaaacttgaaata

SEQ ID NO: 1051655 - DNA, 16 bp, Homo sapiens
gcatttttgcaggagc

SEQ ID NO: 1051656 - DNA, 21 bp, Homo sapiens
gcatttttgttttgaaagttt

SEQ ID NO: 1051657 - DNA, 16 bp, Homo sapiens
gccaaaaaaaaataca

SEQ ID NO: 1051658 - DNA, 16 bp, Homo sapiens
gccaaaaaaagacagg

SEQ ID NO: 1051659 - DNA, 13 bp, Homo sapiens
gccaaaaaggata

SEQ ID NO: 1051660 - DNA, 13 bp, Homo sapiens
gccaaaaatagct

SEQ ID NO: 1051661 - DNA, 17 bp, Homo sapiens
gccaaaacaagccaaag

SEQ ID NO: 1051662 - DNA, 19 bp, Homo sapiens
gccaaaacaagccaaagag

SEQ ID NO: 1051663 - DNA, 23 bp, Homo sapiens
gccaaaacaatgtttaaaccttt

SEQ ID NO: 1051664 - DNA, 17 bp, Homo sapiens
gccaaaaccaatgctga

SEQ ID NO: 1051665 - DNA, 13 bp, Homo sapiens
gccaaaaccacat

SEQ ID NO: 1051666 - DNA, 15 bp, Homo sapiens
gccaaaaccacatgg

SEQ ID NO: 1051667 - DNA, 17 bp, Homo sapiens
gccaaaaccacatgggc

SEQ ID NO: 1051668 - DNA, 20 bp, Homo sapiens
gccaaaaccacatgggctgg

SEQ ID NO: 1051669 - DNA, 17 bp, Homo sapiens
gccaaaataccaaatgc

SEQ ID NO: 1051670 - DNA, 22 bp, Homo sapiens
gccaaaataccaaatgcctgtt

SEQ ID NO: 1051671 - DNA, 16 bp, Homo sapiens
gccaaaatgttggctg

SEQ ID NO: 1051672 - DNA, 17 bp, Homo sapiens
gccaaaattcatttcta

SEQ ID NO: 1051673 - DNA, 11 bp, Homo sapiens
gccaaacaaaa

SEQ ID NO: 1051674 - DNA, 15 bp, Homo sapiens
gccaaacaaaactga

SEQ ID NO: 1051675 - DNA, 18 bp, Homo sapiens
gccaaaccaggaccctgt

SEQ ID NO: 1051676 - DNA, 18 bp, Homo sapiens
tccaaaaagctctgaaaa

SEQ ID NO: 1051677 - DNA, 21 bp, Homo sapiens
tccaaaaatgtgtaagaacaa

SEQ ID NO: 1051678 - DNA, 20 bp, Homo sapiens
tccaaaacatttctggacag

SEQ ID NO: 1051679 - DNA, 22 bp, Homo sapiens
tccaaaacatttctggacagta

SEQ ID NO: 1051680 - DNA, 19 bp, Homo sapiens
tccaaaacctgcttccttc

SEQ ID NO: 1051681 - DNA, 21 bp, Homo sapiens
tccaaaacctgcttccttcag

SEQ ID NO: 1051682 - DNA, 19 bp, Homo sapiens
tccaaaagattgctgaaat

SEQ ID NO: 1051683 - DNA, 13 bp, Homo sapiens
tccaaaagctttt

SEQ ID NO: 1051684 - DNA, 18 bp, Homo sapiens
tccaaaataaaacttttt

SEQ ID NO: 1051685 - DNA, 22 bp, Homo sapiens
tccaaaatgaatgcaaaattgt

SEQ ID NO: 1051686 - DNA, 12 bp, Homo sapiens
tccaaaatgctt

SEQ ID NO: 1051687 - DNA, 19 bp, Homo sapiens
tccaaaatgtgtatttctt

SEQ ID NO: 1051688 - DNA, 19 bp, Homo sapiens
tccaaacagtgtgttggtg

SEQ ID NO: 1051689 - DNA, 14 bp, Homo sapiens
tccaaaccaaattt

SEQ ID NO: 1051690 - DNA, 21 bp, Homo sapiens
tccaaacccttcaactcctgg

SEQ ID NO: 1051691 - DNA, 22 bp, Homo sapiens
tccaaacccttcaactcctggc

SEQ ID NO: 1051692 - DNA, 23 bp, Homo sapiens
tccaaacccttcaactcctggct

SEQ ID NO: 1051693 - DNA, 14 bp, Homo sapiens
tccaaacctccagc

SEQ ID NO: 1051694 - DNA, 20 bp, Homo sapiens
tccaaacctccagcctccct

SEQ ID NO: 1051695 - DNA, 21 bp, Homo sapiens
tccaaacctccagcctccctg

SEQ ID NO: 1051696 - DNA, 22 bp, Homo sapiens
tccaaagaacttgatttgcatg

SEQ ID NO: 1051697 - DNA, 17 bp, Homo sapiens
tccaaagactgtactgg

SEQ ID NO: 1051698 - DNA, 22 bp, Homo sapiens
tccaaagactgtactggccagt

SEQ ID NO: 1051699 - DNA, 13 bp, Homo sapiens
tccaaagaggctg

SEQ ID NO: 1051700 - DNA, 11 bp, Homo sapiens
tccaaagcaaa

SEQ ID NO: 1051701 - DNA, 14 bp, Homo sapiens
tccaaagcagacag

SEQ ID NO: 1051702 - DNA, 13 bp, Homo sapiens
tccaaagctttat

SEQ ID NO: 1051703 - DNA, 21 bp, Homo sapiens
tccaaagctttattaccagtg

SEQ ID NO: 1051704 - DNA, 22 bp, Homo sapiens
tccaaagggaatactcacattt

SEQ ID NO: 1051705 - DNA, 19 bp, Homo sapiens
tccaaaggggctgctgggg

SEQ ID NO: 1051706 - DNA, 12 bp, Homo sapiens
tccaaaggttcc

SEQ ID NO: 1051707 - DNA, 15 bp, Homo sapiens
tccaaagtaaaattg

SEQ ID NO: 1051708 - DNA, 18 bp, Homo sapiens
tccaaatacccaaatgtc

SEQ ID NO: 1051709 - DNA, 17 bp, Homo sapiens
tccaaatataagacatt

SEQ ID NO: 1051710 - DNA, 22 bp, Homo sapiens
tccaaatataagacatttgttt

SEQ ID NO: 1051711 - DNA, 16 bp, Homo sapiens
tccaaatattattcaa

SEQ ID NO: 1051712 - DNA, 18 bp, Homo sapiens
tccaaatccaaggaaaca

SEQ ID NO: 1051713 - DNA, 21 bp, Homo sapiens
tccaaatcctggaaggacaca

SEQ ID NO: 1051714 - DNA, 22 bp, Homo sapiens
tccaaatcctggaaggacacag

SEQ ID NO: 1051715 - DNA, 17 bp, Homo sapiens
tccaaatctgtcctctg

SEQ ID NO: 1051716 - DNA, 20 bp, Homo sapiens
tccaaatcttgaatttctgc

SEQ ID NO: 1051717 - DNA, 20 bp, Homo sapiens
tccaaatgaatgttgtctgt

SEQ ID NO: 1051718 - DNA, 19 bp, Homo sapiens
tccaaatggagaagctgca

SEQ ID NO: 1051719 - DNA, 23 bp, Homo sapiens
tccaaatggctattataaaaatg

SEQ ID NO: 1051720 - DNA, 13 bp, Homo sapiens
tccaaatgtccct

SEQ ID NO: 1051721 - DNA, 16 bp, Homo sapiens
tccaaatgtccctcca

SEQ ID NO: 1051722 - DNA, 21 bp, Homo sapiens
tccaaatgtccctccaacaca

SEQ ID NO: 1051723 - DNA, 17 bp, Homo sapiens
tccaaatgtcctccaga

SEQ ID NO: 1051724 - DNA, 20 bp, Homo sapiens
tccaaatgtcctccagaagc

SEQ ID NO: 1051725 - DNA, 13 bp, Homo sapiens
tccaaatgtttat

SEQ ID NO: 1051726 - DNA, 14 bp, Homo sapiens
tccaaatgtttata

SEQ ID NO: 1051727 - DNA, 17 bp, Homo sapiens
tccaaattaaaacaaat

SEQ ID NO: 1051728 - DNA, 18 bp, Homo sapiens
tccaaattaaaacaaata

SEQ ID NO: 1051729 - DNA, 13 bp, Homo sapiens
tccaaattattaa

SEQ ID NO: 1051730 - DNA, 22 bp, Homo sapiens
tccaaattattaattgtcctgt

SEQ ID NO: 1051731 - DNA, 13 bp, Homo sapiens
tccaaattcacaa

SEQ ID NO: 1051732 - DNA, 12 bp, Homo sapiens
tccaaattcagt

SEQ ID NO: 1051733 - DNA, 14 bp, Homo sapiens
tccaaattcagttt

SEQ ID NO: 1051734 - DNA, 18 bp, Homo sapiens
tccaaattgtttgtacag

SEQ ID NO: 1051735 - DNA, 19 bp, Homo sapiens
tccaaatttaaccataaat

SEQ ID NO: 1051736 - DNA, 23 bp, Homo sapiens
tccaaatttaaccataaatcaat

SEQ ID NO: 1051737 - DNA, 15 bp, Homo sapiens
tccaaatttctcatg

SEQ ID NO: 1051738 - DNA, 16 bp, Homo sapiens
tccaacaataaacagg

SEQ ID NO: 1051739 - DNA, 18 bp, Homo sapiens
tccaacaccacagacaca

SEQ ID NO: 1051740 - DNA, 20 bp, Homo sapiens
tccaacaccacagacacaca

SEQ ID NO: 1051741 - DNA, 21 bp, Homo sapiens
tccaacactttgagcattttt

SEQ ID NO: 1051742 - DNA, 20 bp, Homo sapiens
tccaacatcacagcccagcc

SEQ ID NO: 1051743 - DNA, 11 bp, Homo sapiens
tccaaccactg

SEQ ID NO: 1051744 - DNA, 12 bp, Homo sapiens
tccaaccactgt

SEQ ID NO: 1051745 - DNA, 15 bp, Homo sapiens
tccaaccactgtaca

SEQ ID NO: 1051746 - DNA, 17 bp, Homo sapiens
tccaaccactgtgccac

SEQ ID NO: 1051747 - DNA, 14 bp, Homo sapiens
tccaaccagacttt

SEQ ID NO: 1051748 - DNA, 16 bp, Homo sapiens
tccaaccagactttga

SEQ ID NO: 1051749 - DNA, 23 bp, Homo sapiens
tccaaccaggagctgatggcagc

SEQ ID NO: 1051750 - DNA, 16 bp, Homo sapiens
tccaaccattttcatt

SEQ ID NO: 1051751 - DNA, 14 bp, Homo sapiens
tccaacccagccac

SEQ ID NO: 1051752 - DNA, 20 bp, Homo sapiens
tccaaccccggggcatggac

SEQ ID NO: 1051753 - DNA, 15 bp, Homo sapiens
tccaaccctagcaaa

SEQ ID NO: 1051754 - DNA, 22 bp, Homo sapiens
tccaaccctgccgtcaccacca

SEQ ID NO: 1051755 - DNA, 20 bp, Homo sapiens
tccaacctaacccctttcct

SEQ ID NO: 1051756 - DNA, 20 bp, Homo sapiens
tccaacctctcggccccatc

SEQ ID NO: 1051757 - DNA, 14 bp, Homo sapiens
tccaacgcccctgt

SEQ ID NO: 1051758 - DNA, 19 bp, Homo sapiens
tccaactaatgccttactc

SEQ ID NO: 1051759 - DNA, 22 bp, Homo sapiens
tccaactaatgccttactcttc

SEQ ID NO: 1051760 - DNA, 18 bp, Homo sapiens
tccaactcacttccagtg

SEQ ID NO: 1051761 - DNA, 17 bp, Homo sapiens
tccaactggaaattcca

SEQ ID NO: 1051762 - DNA, 21 bp, Homo sapiens
tccaactggattataaataaa

SEQ ID NO: 1051763 - DNA, 16 bp, Homo sapiens
tccaactggcactctg

SEQ ID NO: 1051764 - DNA, 15 bp, Homo sapiens
tccaacttgaaggat

SEQ ID NO: 1051765 - DNA, 18 bp, Homo sapiens
tccaacttgatgtcaagc

SEQ ID NO: 1051766 - DNA, 13 bp, Homo sapiens
tccaagaaaatat

SEQ ID NO: 1051767 - DNA, 17 bp, Homo sapiens
tccaagaaactgaatga

SEQ ID NO: 1051768 - DNA, 17 bp, Homo sapiens
tccaagaaagatccacc

SEQ ID NO: 1051769 - DNA, 23 bp, Homo sapiens
tccaagaacttgggataagagtg

SEQ ID NO: 1051770 - DNA, 17 bp, Homo sapiens
tccaagaatggaagcct

SEQ ID NO: 1051771 - DNA, 22 bp, Homo sapiens
tccaagacatgtctgttctaca

SEQ ID NO: 1051772 - DNA, 16 bp, Homo sapiens
tccaagacattgtcaa

SEQ ID NO: 1051773 - DNA, 14 bp, Homo sapiens
gccaagcttcctgt

SEQ ID NO: 1051774 - DNA, 16 bp, Homo sapiens
gccaagcttcctgtgc

SEQ ID NO: 1051775 - DNA, 16 bp, Homo sapiens
gccaaggaatgtgtcc

SEQ ID NO: 1051776 - DNA, 11 bp, Homo sapiens
gccaaggagct

SEQ ID NO: 1051777 - DNA, 15 bp, Homo sapiens
gccaaggagctgcta

SEQ ID NO: 1051778 - DNA, 22 bp, Homo sapiens
gccaaggataccggacacacct

SEQ ID NO: 1051779 - DNA, 11 bp, Homo sapiens
gccaaggccac

SEQ ID NO: 1051780 - DNA, 19 bp, Homo sapiens
gccaaggccgaagctctgg

SEQ ID NO: 1051781 - DNA, 20 bp, Homo sapiens
gccaaggccgaagctctggc

SEQ ID NO: 1051782 - DNA, 19 bp, Homo sapiens
gccaaggccgccagcgtgt

SEQ ID NO: 1051783 - DNA, 22 bp, Homo sapiens
gccaagggaaaggggtgctttt

SEQ ID NO: 1051784 - DNA, 15 bp, Homo sapiens
gccaagggagggaag

SEQ ID NO: 1051785 - DNA, 18 bp, Homo sapiens
gccaagggagggaagggc

SEQ ID NO: 1051786 - DNA, 23 bp, Homo sapiens
gccaagggagggaagggccaccc

SEQ ID NO: 1051787 - DNA, 18 bp, Homo sapiens
gccaagggccccaggggc

SEQ ID NO: 1051788 - DNA, 19 bp, Homo sapiens
gccaagggccccaggggca

SEQ ID NO: 1051789 - DNA, 16 bp, Homo sapiens
gccaagggctttgttt

SEQ ID NO: 1051790 - DNA, 22 bp, Homo sapiens
gccaaggggctgcgctagcagc

SEQ ID NO: 1051791 - DNA, 17 bp, Homo sapiens
gccaagggggtgactgg

SEQ ID NO: 1051792 - DNA, 21 bp, Homo sapiens
gccaaggtgaatagcacaggt

SEQ ID NO: 1051793 - DNA, 16 bp, Homo sapiens
gccaaggtggagggaa

SEQ ID NO: 1051794 - DNA, 14 bp, Homo sapiens
gccaaggtgggcgg

SEQ ID NO: 1051795 - DNA, 23 bp, Homo sapiens
gccaaggtgggctgagccctggc

SEQ ID NO: 1051796 - DNA, 22 bp, Homo sapiens
gccaagtaaaatgttttttaaa

SEQ ID NO: 1051797 - DNA, 21 bp, Homo sapiens
tccaccaaccccgcggcccag

SEQ ID NO: 1051798 - DNA, 22 bp, Homo sapiens
tccaccaaccccgcggcccaga

SEQ ID NO: 1051799 - DNA, 17 bp, Homo sapiens
tccaccaagacagtgct

SEQ ID NO: 1051800 - DNA, 14 bp, Homo sapiens
tccaccaaggggct

SEQ ID NO: 1051801 - DNA, 18 bp, Homo sapiens
tccaccacatctgccaga

SEQ ID NO: 1051802 - DNA, 21 bp, Homo sapiens
tccaccacatctgccagacct

SEQ ID NO: 1051803 - DNA, 21 bp, Homo sapiens
tccaccaccactggccaccag

SEQ ID NO: 1051804 - DNA, 22 bp, Homo sapiens
tccaccaccactggccaccagg

SEQ ID NO: 1051805 - DNA, 23 bp, Homo sapiens
tccaccacccaacccaaaccatg

SEQ ID NO: 1051806 - DNA, 17 bp, Homo sapiens
tccaccacctccctcac

SEQ ID NO: 1051807 - DNA, 18 bp, Homo sapiens
tccaccacctccctcacc

SEQ ID NO: 1051808 - DNA, 17 bp, Homo sapiens
tccaccagacgccttcc

SEQ ID NO: 1051809 - DNA, 21 bp, Homo sapiens
tccaccagccctactcctgcg

SEQ ID NO: 1051810 - DNA, 16 bp, Homo sapiens
tccaccagcctgctga

SEQ ID NO: 1051811 - DNA, 20 bp, Homo sapiens
tccaccaggccgtgccttgt

SEQ ID NO: 1051812 - DNA, 17 bp, Homo sapiens
tccaccagtgtgtgggg

SEQ ID NO: 1051813 - DNA, 19 bp, Homo sapiens
tccaccagtttatacagaa

SEQ ID NO: 1051814 - DNA, 12 bp, Homo sapiens
tccaccatcccc

SEQ ID NO: 1051815 - DNA, 19 bp, Homo sapiens
tccaccatccccaccccac

SEQ ID NO: 1051816 - DNA, 16 bp, Homo sapiens
tccaccatccccagct

SEQ ID NO: 1051817 - DNA, 20 bp, Homo sapiens
tccacccagcaggcagagtg

SEQ ID NO: 1051818 - DNA, 21 bp, Homo sapiens
tccacccagcaggcagagtgg

SEQ ID NO: 1051819 - DNA, 11 bp, Homo sapiens
tccacccagcc

SEQ ID NO: 1051820 - DNA, 13 bp, Homo sapiens
tccacccagccca

SEQ ID NO: 1051821 - DNA, 14 bp, Homo sapiens
tccacccagcccct

SEQ ID NO: 1051822 - DNA, 16 bp, Homo sapiens
tccacccagcccctgg

SEQ ID NO: 1051823 - DNA, 17 bp, Homo sapiens
tccacccaggctgcact

SEQ ID NO: 1051824 - DNA, 19 bp, Homo sapiens
tccacccaggctgcactgc

SEQ ID NO: 1051825 - DNA, 21 bp, Homo sapiens
tccacccaggctgcactgcag

SEQ ID NO: 1051826 - DNA, 13 bp, Homo sapiens
tccacccagtgct

SEQ ID NO: 1051827 - DNA, 17 bp, Homo sapiens
tccacccatccagtgga

SEQ ID NO: 1051828 - DNA, 13 bp, Homo sapiens
tccacccattccc

SEQ ID NO: 1051829 - DNA, 12 bp, Homo sapiens
tccaccccagga

SEQ ID NO: 1051830 - DNA, 13 bp, Homo sapiens
tccaccccaggac

SEQ ID NO: 1051831 - DNA, 22 bp, Homo sapiens
tccaccccatccctccccagtt

SEQ ID NO: 1051832 - DNA, 14 bp, Homo sapiens
tccacccccaggtg

SEQ ID NO: 1051833 - DNA, 16 bp, Homo sapiens
tccacccccaggtgca

SEQ ID NO: 1051834 - DNA, 14 bp, Homo sapiens
tccacccccatgtg

SEQ ID NO: 1051835 - DNA, 15 bp, Homo sapiens
tccaccccccactca

SEQ ID NO: 1051836 - DNA, 16 bp, Homo sapiens
tccaccccccactcag

SEQ ID NO: 1051837 - DNA, 19 bp, Homo sapiens
tccaccccccactcagtgc

SEQ ID NO: 1051838 - DNA, 19 bp, Homo sapiens
tccaccccctccctggcct

SEQ ID NO: 1051839 - DNA, 21 bp, Homo sapiens
tccacccctttctagaccaat

SEQ ID NO: 1051840 - DNA, 21 bp, Homo sapiens
tccacccgctgcccctccccg

SEQ ID NO: 1051841 - DNA, 23 bp, Homo sapiens
tccaccctcaaatgtcagagcta

SEQ ID NO: 1051842 - DNA, 14 bp, Homo sapiens
tccaccctccacct

SEQ ID NO: 1051843 - DNA, 15 bp, Homo sapiens
tccaccctccacctt

SEQ ID NO: 1051844 - DNA, 21 bp, Homo sapiens
tccaccctgcattttcctctt

SEQ ID NO: 1051845 - DNA, 14 bp, Homo sapiens
tccaccctgccaag

SEQ ID NO: 1051846 - DNA, 22 bp, Homo sapiens
tccaccctggccgagtccaagc

SEQ ID NO: 1051847 - DNA, 12 bp, Homo sapiens
tccaccctgtcc

SEQ ID NO: 1051848 - DNA, 14 bp, Homo sapiens
tccaccctgtcccc

SEQ ID NO: 1051849 - DNA, 22 bp, Homo sapiens
tccaccctgtcccccagctctg

SEQ ID NO: 1051850 - DNA, 21 bp, Homo sapiens
tccaccctgttagttttgtaa

SEQ ID NO: 1051851 - DNA, 12 bp, Homo sapiens
tccacccttcca

SEQ ID NO: 1051852 - DNA, 13 bp, Homo sapiens
tccacccttccat

SEQ ID NO: 1051853 - DNA, 16 bp, Homo sapiens
tccacccttccatcag

SEQ ID NO: 1051854 - DNA, 13 bp, Homo sapiens
tccacccttggcc

SEQ ID NO: 1051855 - DNA, 14 bp, Homo sapiens
tccacccttggcct

SEQ ID NO: 1051856 - DNA, 16 bp, Homo sapiens
tccacccttggcctgt

SEQ ID NO: 1051857 - DNA, 13 bp, Homo sapiens
tccaccgctgcct

SEQ ID NO: 1051858 - DNA, 15 bp, Homo sapiens
tccaccgctgcctaa

SEQ ID NO: 1051859 - DNA, 23 bp, Homo sapiens
tccaccgtctttcttttatactg

SEQ ID NO: 1051860 - DNA, 18 bp, Homo sapiens
tccacctcaagaccccca

SEQ ID NO: 1051861 - DNA, 12 bp, Homo sapiens
tccacctcagcc

SEQ ID NO: 1051862 - DNA, 15 bp, Homo sapiens
tccacctcagcctcc

SEQ ID NO: 1051863 - DNA, 16 bp, Homo sapiens
tccacctcagccttgg

SEQ ID NO: 1051864 - DNA, 17 bp, Homo sapiens
tccacctcatcactgga

SEQ ID NO: 1051865 - DNA, 18 bp, Homo sapiens
tccacctcatcactggac

SEQ ID NO: 1051866 - DNA, 15 bp, Homo sapiens
tccacctccacccac

SEQ ID NO: 1051867 - DNA, 20 bp, Homo sapiens
tccacctcctagaggtgggc

SEQ ID NO: 1051868 - DNA, 20 bp, Homo sapiens
tccacctctcacgggccctg

SEQ ID NO: 1051869 - DNA, 23 bp, Homo sapiens
tccacctctcacgggccctgccc

SEQ ID NO: 1051870 - DNA, 12 bp, Homo sapiens
tccacctctggt

SEQ ID NO: 1051871 - DNA, 13 bp, Homo sapiens
tccacctctggtg

SEQ ID NO: 1051872 - DNA, 19 bp, Homo sapiens
tccacctctggtggctcct

SEQ ID NO: 1051873 - DNA, 24 bp, Homo sapiens
tccacctctggtggctcctcctag

SEQ ID NO: 1051874 - DNA, 13 bp, Homo sapiens
tccacctgccaca

SEQ ID NO: 1051875 - DNA, 23 bp, Homo sapiens
tccacctgccacaaaccaccagg

SEQ ID NO: 1051876 - DNA, 20 bp, Homo sapiens
tccacctgccttggcctccc

SEQ ID NO: 1051877 - DNA, 15 bp, Homo sapiens
tccacctgtgccctc

SEQ ID NO: 1051878 - DNA, 13 bp, Homo sapiens
tccacctgtgggt

SEQ ID NO: 1051879 - DNA, 18 bp, Homo sapiens
tccaccttcccatgccct

SEQ ID NO: 1051880 - DNA, 13 bp, Homo sapiens
tccaccttgctct

SEQ ID NO: 1051881 - DNA, 14 bp, Homo sapiens
tccacgactgtctc

SEQ ID NO: 1051882 - DNA, 19 bp, Homo sapiens
tccacgactgtctccatgg

SEQ ID NO: 1051883 - DNA, 17 bp, Homo sapiens
tccacgccactgcctcc

SEQ ID NO: 1051884 - DNA, 20 bp, Homo sapiens
tccacgcctcctggccagac

SEQ ID NO: 1051885 - DNA, 20 bp, Homo sapiens
tccacgctgtctccagaccc

SEQ ID NO: 1051886 - DNA, 15 bp, Homo sapiens
tccacggaaacagaa

SEQ ID NO: 1051887 - DNA, 16 bp, Homo sapiens
tccacggaaacagaac

SEQ ID NO: 1051888 - DNA, 18 bp, Homo sapiens
tccacggaaacagaactc

SEQ ID NO: 1051889 - DNA, 23 bp, Homo sapiens
tccacggcatcgcatccgtcctg

SEQ ID NO: 1051890 - DNA, 21 bp, Homo sapiens
tccacggtccgcggcctgcac

SEQ ID NO: 1051891 - DNA, 23 bp, Homo sapiens
tccacggtgcgtggctgtggcac

SEQ ID NO: 1051892 - DNA, 20 bp, Homo sapiens
tccacgtcctccaagctcac

SEQ ID NO: 1051893 - DNA, 18 bp, Homo sapiens
tccacgtctttcctgcta

SEQ ID NO: 1051894 - DNA, 22 bp, Homo sapiens
tccacgtgtggcctccgtcctg

SEQ ID NO: 1051895 - DNA, 14 bp, Homo sapiens
tccactaatccatt

SEQ ID NO: 1051896 - DNA, 13 bp, Homo sapiens
tccactactgcta

SEQ ID NO: 1051897 - DNA, 19 bp, Homo sapiens
tccactatgacatctaagt

SEQ ID NO: 1051898 - DNA, 15 bp, Homo sapiens
tccactattttcaaa

SEQ ID NO: 1051899 - DNA, 17 bp, Homo sapiens
tccactattttcaaaga

SEQ ID NO: 1051900 - DNA, 12 bp, Homo sapiens
tccactcactcc

SEQ ID NO: 1051901 - DNA, 14 bp, Homo sapiens
tccactcactccag

SEQ ID NO: 1051902 - DNA, 18 bp, Homo sapiens
tccactcactccagccca

SEQ ID NO: 1051903 - DNA, 21 bp, Homo sapiens
tccactcactccagcccaaca

SEQ ID NO: 1051904 - DNA, 14 bp, Homo sapiens
tccactcactgctg

SEQ ID NO: 1051905 - DNA, 14 bp, Homo sapiens
gccactgaagctgg

SEQ ID NO: 1051906 - DNA, 17 bp, Homo sapiens
gccactgaagctgggat

SEQ ID NO: 1051907 - DNA, 18 bp, Homo sapiens
gccactgacccacctgcg

SEQ ID NO: 1051908 - DNA, 23 bp, Homo sapiens
gccactgaccgggatccagttcc

SEQ ID NO: 1051909 - DNA, 16 bp, Homo sapiens
gccactgacttgctgt

SEQ ID NO: 1051910 - DNA, 14 bp, Homo sapiens
gccactgcacctga

SEQ ID NO: 1051911 - DNA, 19 bp, Homo sapiens
gccactgcacctgcccagc

SEQ ID NO: 1051912 - DNA, 12 bp, Homo sapiens
gccactgcactc

SEQ ID NO: 1051913 - DNA, 19 bp, Homo sapiens
gccactgcactccaatctg

SEQ ID NO: 1051914 - DNA, 21 bp, Homo sapiens
gccactgccaagcttcctgtg

SEQ ID NO: 1051915 - DNA, 17 bp, Homo sapiens
gccactgccaggcacct

SEQ ID NO: 1051916 - DNA, 21 bp, Homo sapiens
gccactgccaggcacctggcc

SEQ ID NO: 1051917 - DNA, 22 bp, Homo sapiens
gccactgccaggcacctggcct

SEQ ID NO: 1051918 - DNA, 13 bp, Homo sapiens
gccactgcccccc

SEQ ID NO: 1051919 - DNA, 14 bp, Homo sapiens
tccagattctgatg

SEQ ID NO: 1051920 - DNA, 17 bp, Homo sapiens
tccagattctgatgcat

SEQ ID NO: 1051921 - DNA, 18 bp, Homo sapiens
tccagattctgatgcata

SEQ ID NO: 1051922 - DNA, 20 bp, Homo sapiens
tccagatttacactgggaga

SEQ ID NO: 1051923 - DNA, 22 bp, Homo sapiens
tccagattttttacagctgcct

SEQ ID NO: 1051924 - DNA, 14 bp, Homo sapiens
tccagcaaaatgga

SEQ ID NO: 1051925 - DNA, 15 bp, Homo sapiens
tccagcaaaatggaa

SEQ ID NO: 1051926 - DNA, 15 bp, Homo sapiens
tccagcaactgccct

SEQ ID NO: 1051927 - DNA, 15 bp, Homo sapiens
tccagcaataagaaa

SEQ ID NO: 1051928 - DNA, 16 bp, Homo sapiens
tccagcaataagaaat

SEQ ID NO: 1051929 - DNA, 18 bp, Homo sapiens
tccagcaataagaaatga

SEQ ID NO: 1051930 - DNA, 20 bp, Homo sapiens
tccagcacctgtggctgacg

SEQ ID NO: 1051931 - DNA, 17 bp, Homo sapiens
tccagcagaagacaaaa

SEQ ID NO: 1051932 - DNA, 13 bp, Homo sapiens
tccagcagctgca

SEQ ID NO: 1051933 - DNA, 14 bp, Homo sapiens
tccagcagctgcgg

SEQ ID NO: 1051934 - DNA, 15 bp, Homo sapiens
tccagcagctgcggg

SEQ ID NO: 1051935 - DNA, 15 bp, Homo sapiens
tccagcagtgaatgc

SEQ ID NO: 1051936 - DNA, 14 bp, Homo sapiens
tccagcagttttca

SEQ ID NO: 1051937 - DNA, 19 bp, Homo sapiens
tccagcatccagcctgtgt

SEQ ID NO: 1051938 - DNA, 16 bp, Homo sapiens
tccagcattgaagaga

SEQ ID NO: 1051939 - DNA, 13 bp, Homo sapiens
tccagccaacccc

SEQ ID NO: 1051940 - DNA, 14 bp, Homo sapiens
tccagccaacccct

SEQ ID NO: 1051941 - DNA, 23 bp, Homo sapiens
tccagccaacccctgtggagccc

SEQ ID NO: 1051942 - DNA, 12 bp, Homo sapiens
tccagccacccc

SEQ ID NO: 1051943 - DNA, 16 bp, Homo sapiens
tccagccacggaggga

SEQ ID NO: 1051944 - DNA, 23 bp, Homo sapiens
tccagccagcaatgatgtccaga

SEQ ID NO: 1051945 - DNA, 18 bp, Homo sapiens
tccagccagcgcctccct

SEQ ID NO: 1051946 - DNA, 22 bp, Homo sapiens
tccagccagcgcctccctccac

SEQ ID NO: 1051947 - DNA, 14 bp, Homo sapiens
tccagccaggccca

SEQ ID NO: 1051948 - DNA, 20 bp, Homo sapiens
tccagccaggcccaggccag

SEQ ID NO: 1051949 - DNA, 20 bp, Homo sapiens
tccagccatcaagagactga

SEQ ID NO: 1051950 - DNA, 21 bp, Homo sapiens
tccagccatcaagagactgag

SEQ ID NO: 1051951 - DNA, 15 bp, Homo sapiens
tccagccatctcatg

SEQ ID NO: 1051952 - DNA, 21 bp, Homo sapiens
tccagcccagacccccagtgt

SEQ ID NO: 1051953 - DNA, 15 bp, Homo sapiens
tccagcccctctggt

SEQ ID NO: 1051954 - DNA, 23 bp, Homo sapiens
tccagcccctctggtcgctcctg

SEQ ID NO: 1051955 - DNA, 18 bp, Homo sapiens
tccagcccctcttggaga

SEQ ID NO: 1051956 - DNA, 20 bp, Homo sapiens
tccagcccctcttggagaag

SEQ ID NO: 1051957 - DNA, 21 bp, Homo sapiens
tccagcccctggacccctggg

SEQ ID NO: 1051958 - DNA, 22 bp, Homo sapiens
tccagcccctggacccctgggg

SEQ ID NO: 1051959 - DNA, 20 bp, Homo sapiens
tccagcccctttgcctctgt

SEQ ID NO: 1051960 - DNA, 18 bp, Homo sapiens
tccagcccgggagcctag

SEQ ID NO: 1051961 - DNA, 20 bp, Homo sapiens
tccagcccgggagcctagga

SEQ ID NO: 1051962 - DNA, 23 bp, Homo sapiens
tccagcccgggagcctaggacca

SEQ ID NO: 1051963 - DNA, 16 bp, Homo sapiens
tccagcctcccctccc

SEQ ID NO: 1051964 - DNA, 16 bp, Homo sapiens
tccagcctccctgtct

SEQ ID NO: 1051965 - DNA, 21 bp, Homo sapiens
tccagcctccctgtctccagc

SEQ ID NO: 1051966 - DNA, 13 bp, Homo sapiens
tccagcctctccc

SEQ ID NO: 1051967 - DNA, 21 bp, Homo sapiens
tccagcctctcccggctgcct

SEQ ID NO: 1051968 - DNA, 19 bp, Homo sapiens
tccagcctgcctggcaggc

SEQ ID NO: 1051969 - DNA, 13 bp, Homo sapiens
tccagcctgggac

SEQ ID NO: 1051970 - DNA, 14 bp, Homo sapiens
tccagcctgggaca

SEQ ID NO: 1051971 - DNA, 15 bp, Homo sapiens
tccagcctgggacac

SEQ ID NO: 1051972 - DNA, 16 bp, Homo sapiens
tccagcctgggacaca

SEQ ID NO: 1051973 - DNA, 17 bp, Homo sapiens
tccagcctgggacacac

SEQ ID NO: 1051974 - DNA, 18 bp, Homo sapiens
tccagcctgggacacaca

SEQ ID NO: 1051975 - DNA, 12 bp, Homo sapiens
tccagcctgggc

SEQ ID NO: 1051976 - DNA, 13 bp, Homo sapiens
tccagcctgggca

SEQ ID NO: 1051977 - DNA, 22 bp, Homo sapiens
tccagcctgggcagccaggctg

SEQ ID NO: 1051978 - DNA, 12 bp, Homo sapiens
tccagcctgggt

SEQ ID NO: 1051979 - DNA, 13 bp, Homo sapiens
tccagcctgggtg

SEQ ID NO: 1051980 - DNA, 20 bp, Homo sapiens
tccagccttatgtgttacat

SEQ ID NO: 1051981 - DNA, 15 bp, Homo sapiens
tccagcctttccaag

SEQ ID NO: 1051982 - DNA, 14 bp, Homo sapiens
tccagcctttgctc

SEQ ID NO: 1051983 - DNA, 22 bp, Homo sapiens
tccagcgagagagtttcaaaag

SEQ ID NO: 1051984 - DNA, 23 bp, Homo sapiens
tccagctagtgccaaataattga

SEQ ID NO: 1051985 - DNA, 15 bp, Homo sapiens
tccagctcagaaccc

SEQ ID NO: 1051986 - DNA, 17 bp, Homo sapiens
tccagctcagaacccag

SEQ ID NO: 1051987 - DNA, 20 bp, Homo sapiens
tccagctcagaacccagggc

SEQ ID NO: 1051988 - DNA, 18 bp, Homo sapiens
tccagctccccccaagat

SEQ ID NO: 1051989 - DNA, 16 bp, Homo sapiens
tccagctccctagact

SEQ ID NO: 1051990 - DNA, 14 bp, Homo sapiens
tccagctcgtgtgt

SEQ ID NO: 1051991 - DNA, 12 bp, Homo sapiens
tccagctctgac

SEQ ID NO: 1051992 - DNA, 13 bp, Homo sapiens
tccagctctgccc

SEQ ID NO: 1051993 - DNA, 22 bp, Homo sapiens
tccagctctggcttcctgctga

SEQ ID NO: 1051994 - DNA, 21 bp, Homo sapiens
tccagctgactaaactttttt

SEQ ID NO: 1051995 - DNA, 13 bp, Homo sapiens
tccagctgcccct

SEQ ID NO: 1051996 - DNA, 16 bp, Homo sapiens
tccagctgcctgggcc

SEQ ID NO: 1051997 - DNA, 21 bp, Homo sapiens
tccagctggccgggagcctga

SEQ ID NO: 1051998 - DNA, 22 bp, Homo sapiens
tccagctggccgggagcctgat

SEQ ID NO: 1051999 - DNA, 19 bp, Homo sapiens
tccagctgggaagcccttt

SEQ ID NO: 1052000 - DNA, 21 bp, Homo sapiens
tccagctgggaagcccttttt

SEQ ID NO: 1052001 - DNA, 20 bp, Homo sapiens
tccagctggggccagaggct

SEQ ID NO: 1052002 - DNA, 18 bp, Homo sapiens
tccagctgtcgtctgact

SEQ ID NO: 1052003 - DNA, 17 bp, Homo sapiens
tccagctgttcagctgg

SEQ ID NO: 1052004 - DNA, 14 bp, Homo sapiens
tccagcttccaaag

SEQ ID NO: 1052005 - DNA, 20 bp, Homo sapiens
tccagcttctggtactctcc

SEQ ID NO: 1052006 - DNA, 21 bp, Homo sapiens
tccagcttctggtactctcct

SEQ ID NO: 1052007 - DNA, 15 bp, Homo sapiens
tccagcttgctcttc

SEQ ID NO: 1052008 - DNA, 16 bp, Homo sapiens
tccagcttgctcttca

SEQ ID NO: 1052009 - DNA, 12 bp, Homo sapiens
tccaggaaaaaa

SEQ ID NO: 1052010 - DNA, 21 bp, Homo sapiens
tccaggaaaaaataaaaagag

SEQ ID NO: 1052011 - DNA, 22 bp, Homo sapiens
tccaggaaagtggccaagaagc

SEQ ID NO: 1052012 - DNA, 14 bp, Homo sapiens
tccaggaagatcca

SEQ ID NO: 1052013 - DNA, 13 bp, Homo sapiens
tccaggaaggcag

SEQ ID NO: 1052014 - DNA, 23 bp, Homo sapiens
tccaggaaggcagctgctcttag

SEQ ID NO: 1052015 - DNA, 19 bp, Homo sapiens
tccaggaagggagtgaggg

SEQ ID NO: 1052016 - DNA, 18 bp, Homo sapiens
tccaggaatgctgggccc

SEQ ID NO: 1052017 - DNA, 21 bp, Homo sapiens
tccaggaattcctcttttgct

SEQ ID NO: 1052018 - DNA, 23 bp, Homo sapiens
tccaggacaccacgattctccca

SEQ ID NO: 1052019 - DNA, 15 bp, Homo sapiens
tccaggaccaggggc

SEQ ID NO: 1052020 - DNA, 16 bp, Homo sapiens
tccaggactctttgaa

SEQ ID NO: 1052021 - DNA, 21 bp, Homo sapiens
tccaggagaaagccgggggag

SEQ ID NO: 1052022 - DNA, 16 bp, Homo sapiens
tccaggagaaggccaa

SEQ ID NO: 1052023 - DNA, 15 bp, Homo sapiens
tccaggagagcctgg

SEQ ID NO: 1052024 - DNA, 23 bp, Homo sapiens
tccaggagattggatttgctgtg

SEQ ID NO: 1052025 - DNA, 15 bp, Homo sapiens
tccaggagcctgtgc

SEQ ID NO: 1052026 - DNA, 17 bp, Homo sapiens
tccaggagctaatctga

SEQ ID NO: 1052027 - DNA, 15 bp, Homo sapiens
tccaggaggggcctg

SEQ ID NO: 1052028 - DNA, 20 bp, Homo sapiens
tccaggaggggcctgggcag

SEQ ID NO: 1052029 - DNA, 21 bp, Homo sapiens
tccaggaggggcctgggcagc

SEQ ID NO: 1052030 - DNA, 23 bp, Homo sapiens
tccaggaggggcctgggcagccc

SEQ ID NO: 1052031 - DNA, 14 bp, Homo sapiens
tccaggatcctgca

SEQ ID NO: 1052032 - DNA, 19 bp, Homo sapiens
tccaggatgctaacatcta

SEQ ID NO: 1052033 - DNA, 22 bp, Homo sapiens
tccaggatgctaacatctaaaa

SEQ ID NO: 1052034 - DNA, 17 bp, Homo sapiens
tccaggcaccctcaggg

SEQ ID NO: 1052035 - DNA, 19 bp, Homo sapiens
tccaggcaccctcagggag

SEQ ID NO: 1052036 - DNA, 16 bp, Homo sapiens
tccaggcacccttctt

SEQ ID NO: 1052037 - DNA, 19 bp, Homo sapiens
tccaggcacccttctttcc

SEQ ID NO: 1052038 - DNA, 21 bp, Homo sapiens
ctctgcctccctcaccctgag

SEQ ID NO: 1052039 - DNA, 17 bp, Homo sapiens
tttcagtatcatctcca

SEQ ID NO: 1052040 - DNA, 15 bp, Homo sapiens
tttcagtcaaaactt

SEQ ID NO: 1052041 - DNA, 16 bp, Homo sapiens
tttcagtcaaaacttt

SEQ ID NO: 1052042 - DNA, 21 bp, Homo sapiens
tttcagtcaattctgatgtta

SEQ ID NO: 1052043 - DNA, 15 bp, Homo sapiens
tttgattatttgcat

SEQ ID NO: 1052044 - DNA, 17 bp, Homo sapiens
tttgattatttgcatgt

SEQ ID NO: 1052045 - DNA, 21 bp, Homo sapiens
tttgattcagctcattatgaa

SEQ ID NO: 1052046 - DNA, 15 bp, Homo sapiens
tttgattcatagtaa

SEQ ID NO: 1052047 - DNA, 13 bp, Homo sapiens
tttgattcatttt

SEQ ID NO: 1052048 - DNA, 22 bp, Homo sapiens
tttgattccaatccaattatca

SEQ ID NO: 1052049 - DNA, 18 bp, Homo sapiens
tttgattcgccctcctcc

SEQ ID NO: 1052050 - DNA, 15 bp, Homo sapiens
tttgatttacagcaa

SEQ ID NO: 1052051 - DNA, 18 bp, Homo sapiens
tttgatttacagcaagta

SEQ ID NO: 1052052 - DNA, 14 bp, Homo sapiens
tttgatttcattaa

SEQ ID NO: 1052053 - DNA, 18 bp, Homo sapiens
tttgatttctaattgtaa

SEQ ID NO: 1052054 - DNA, 22 bp, Homo sapiens
tttgatttttatccatttcttt

SEQ ID NO: 1052055 - DNA, 16 bp, Homo sapiens
tttgcaaaatgagact

SEQ ID NO: 1052056 - DNA, 23 bp, Homo sapiens
tttgcaaaccctttgtattataa

SEQ ID NO: 1052057 - DNA, 14 bp, Homo sapiens
tttgcaaagtgcaa

SEQ ID NO: 1052058 - DNA, 13 bp, Homo sapiens
tttgcaaataagt

SEQ ID NO: 1052059 - DNA, 20 bp, Homo sapiens
tttgcaacaggggaggaaaa

SEQ ID NO: 1052060 - DNA, 15 bp, Homo sapiens
tttgcaaccaggaac

SEQ ID NO: 1052061 - DNA, 23 bp, Homo sapiens
tttgcaacttcaagggacaagta

SEQ ID NO: 1052062 - DNA, 20 bp, Homo sapiens
tttgcaagggaaaagtctct

SEQ ID NO: 1052063 - DNA, 24 bp, Homo sapiens
tttgcaaggtgcatttttactatt

SEQ ID NO: 1052064 - DNA, 15 bp, Homo sapiens
tttgcaagtgaaggt

SEQ ID NO: 1052065 - DNA, 21 bp, Homo sapiens
tttgcaagtgaaggtttacaa

SEQ ID NO: 1052066 - DNA, 15 bp, Homo sapiens
tttgcaataacagct

SEQ ID NO: 1052067 - DNA, 20 bp, Homo sapiens
tttgcaataacttctatatt

SEQ ID NO: 1052068 - DNA, 12 bp, Homo sapiens
tttgcacagctc

SEQ ID NO: 1052069 - DNA, 16 bp, Homo sapiens
tttgcacagctctccg

SEQ ID NO: 1052070 - DNA, 20 bp, Homo sapiens
tttgcacaggaaagagtcac

SEQ ID NO: 1052071 - DNA, 12 bp, Homo sapiens
tttgcacatgtg

SEQ ID NO: 1052072 - DNA, 13 bp, Homo sapiens
tttgcaccaaaga

SEQ ID NO: 1052073 - DNA, 14 bp, Homo sapiens
tttgcaccaaagac

SEQ ID NO: 1052074 - DNA, 13 bp, Homo sapiens
tttgcacccctcc

SEQ ID NO: 1052075 - DNA, 19 bp, Homo sapiens
tttgcacccctttcctccc

SEQ ID NO: 1052076 - DNA, 21 bp, Homo sapiens
tttgcacccctttcctcccca

SEQ ID NO: 1052077 - DNA, 16 bp, Homo sapiens
tttgcacctgctctct

SEQ ID NO: 1052078 - DNA, 13 bp, Homo sapiens
tttgcacctgtcc

SEQ ID NO: 1052079 - DNA, 20 bp, Homo sapiens
tttgcacctttctagttgaa

SEQ ID NO: 1052080 - DNA, 20 bp, Homo sapiens
tttgcacgacgccctctccc

SEQ ID NO: 1052081 - DNA, 21 bp, Homo sapiens
tttgcacgacgccctctcccc

SEQ ID NO: 1052082 - DNA, 14 bp, Homo sapiens
tttgcactaaatca

SEQ ID NO: 1052083 - DNA, 20 bp, Homo sapiens
tttgcagaaaagcacctgcc

SEQ ID NO: 1052084 - DNA, 22 bp, Homo sapiens
tttgcagaaaagcacctgccga

SEQ ID NO: 1052085 - DNA, 18 bp, Homo sapiens
tttgcagataattctgga

SEQ ID NO: 1052086 - DNA, 21 bp, Homo sapiens
tttgcagcagtgagtctcttc

SEQ ID NO: 1052087 - DNA, 21 bp, Homo sapiens
tttgcaggattcccttctggg

SEQ ID NO: 1052088 - DNA, 13 bp, Homo sapiens
tttgcaggctctg

SEQ ID NO: 1052089 - DNA, 12 bp, Homo sapiens
tttgcagtaact

SEQ ID NO: 1052090 - DNA, 14 bp, Homo sapiens
tttgcagtaactgt

SEQ ID NO: 1052091 - DNA, 17 bp, Homo sapiens
tttgcagtaactgtttt

SEQ ID NO: 1052092 - DNA, 15 bp, Homo sapiens
tttgcataaattaat

SEQ ID NO: 1052093 - DNA, 16 bp, Homo sapiens
tttgcataacaattcc

SEQ ID NO: 1052094 - DNA, 22 bp, Homo sapiens
tttgcatacttacctagtgaaa

SEQ ID NO: 1052095 - DNA, 23 bp, Homo sapiens
tttgcatagctctccttccccct

SEQ ID NO: 1052096 - DNA, 23 bp, Homo sapiens
tttgcatagtaccaatcatttta

SEQ ID NO: 1052097 - DNA, 13 bp, Homo sapiens
tttgcatatttat

SEQ ID NO: 1052098 - DNA, 13 bp, Homo sapiens
tttgcatctcagt

SEQ ID NO: 1052099 - DNA, 17 bp, Homo sapiens
tttgcatgatatcttca

SEQ ID NO: 1052100 - DNA, 22 bp, Homo sapiens
tttgcatggctccagaaatgtc

SEQ ID NO: 1052101 - DNA, 18 bp, Homo sapiens
tttgcatgtcgcacaatg

SEQ ID NO: 1052102 - DNA, 22 bp, Homo sapiens
tttgcattaaattcacaaactt

SEQ ID NO: 1052103 - DNA, 18 bp, Homo sapiens
tttgcattaatctaagaa

SEQ ID NO: 1052104 - DNA, 18 bp, Homo sapiens
tttgcattatgtatttat

SEQ ID NO: 1052105 - DNA, 15 bp, Homo sapiens
tttgcattcaaatta

SEQ ID NO: 1052106 - DNA, 16 bp, Homo sapiens
tttgcatttaaaacag

SEQ ID NO: 1052107 - DNA, 19 bp, Homo sapiens
tttgcatttaaaacagaca

SEQ ID NO: 1052108 - DNA, 23 bp, Homo sapiens
tttgcatttaaaacagacactgg

SEQ ID NO: 1052109 - DNA, 17 bp, Homo sapiens
tttgcatttagttttat

SEQ ID NO: 1052110 - DNA, 20 bp, Homo sapiens
tttgcatttcctgtgtttgt

SEQ ID NO: 1052111 - DNA, 23 bp, Homo sapiens
tttgccaaaattcatttctaatt

SEQ ID NO: 1052112 - DNA, 18 bp, Homo sapiens
tttgccaagctgaagcta

SEQ ID NO: 1052113 - DNA, 20 bp, Homo sapiens
tttgccaaggctctcccctc

SEQ ID NO: 1052114 - DNA, 15 bp, Homo sapiens
tttgccacagctttt

SEQ ID NO: 1052115 - DNA, 18 bp, Homo sapiens
tttgccacagcttttgca

SEQ ID NO: 1052116 - DNA, 18 bp, Homo sapiens
tttgccaccactagagct

SEQ ID NO: 1052117 - DNA, 19 bp, Homo sapiens
tttgccaccactagagctg

SEQ ID NO: 1052118 - DNA, 16 bp, Homo sapiens
tttgccagacttaaat

SEQ ID NO: 1052119 - DNA, 23 bp, Homo sapiens
tttgccagagccaaattttatct

SEQ ID NO: 1052120 - DNA, 14 bp, Homo sapiens
tttgccagtcttta

SEQ ID NO: 1052121 - DNA, 21 bp, Homo sapiens
tttgcccaaaatttattttat

SEQ ID NO: 1052122 - DNA, 18 bp, Homo sapiens
tttgcccaattccaggtg

SEQ ID NO: 1052123 - DNA, 13 bp, Homo sapiens
tttgcccagtcct

SEQ ID NO: 1052124 - DNA, 16 bp, Homo sapiens
tttgccccctcccttc

SEQ ID NO: 1052125 - DNA, 23 bp, Homo sapiens
tttgccccgggatattatagaaa

SEQ ID NO: 1052126 - DNA, 10 bp, Homo sapiens
tttgcctaaa

SEQ ID NO: 1052127 - DNA, 16 bp, Homo sapiens
tttgcctaattcctgg

SEQ ID NO: 1052128 - DNA, 11 bp, Homo sapiens
tttgcctcctg

SEQ ID NO: 1052129 - DNA, 20 bp, Homo sapiens
tttgcctcttttctctgtgc

SEQ ID NO: 1052130 - DNA, 16 bp, Homo sapiens
tttgcctgaggctgta

SEQ ID NO: 1052131 - DNA, 14 bp, Homo sapiens
tttgcctgcagttt

SEQ ID NO: 1052132 - DNA, 15 bp, Homo sapiens
tttgcctgcagtttc

SEQ ID NO: 1052133 - DNA, 19 bp, Homo sapiens
tttgcctgcctggtgtgcc

SEQ ID NO: 1052134 - DNA, 13 bp, Homo sapiens
tttgcctgctgta

SEQ ID NO: 1052135 - DNA, 22 bp, Homo sapiens
tttgcctggctgtggaggcctg

SEQ ID NO: 1052136 - DNA, 12 bp, Homo sapiens
tttgcctgtaac

SEQ ID NO: 1052137 - DNA, 13 bp, Homo sapiens
tttgcctgtaaca

SEQ ID NO: 1052138 - DNA, 14 bp, Homo sapiens
tttgcctgtaacaa

SEQ ID NO: 1052139 - DNA, 13 bp, Homo sapiens
tttgcctgtaaga

SEQ ID NO: 1052140 - DNA, 15 bp, Homo sapiens
tttgcctgtaagaaa

SEQ ID NO: 1052141 - DNA, 11 bp, Homo sapiens
tttgcctgtgc

SEQ ID NO: 1052142 - DNA, 22 bp, Homo sapiens
tttgccttcctttctccaggac

SEQ ID NO: 1052143 - DNA, 22 bp, Homo sapiens
tttgccttctggttatttatgg

SEQ ID NO: 1052144 - DNA, 16 bp, Homo sapiens
tttgccttgcagaact

SEQ ID NO: 1052145 - DNA, 19 bp, Homo sapiens
tttgccttgcagaactgcc

SEQ ID NO: 1052146 - DNA, 16 bp, Homo sapiens
tttgcgaaaagataaa

SEQ ID NO: 1052147 - DNA, 19 bp, Homo sapiens
tttgcgtgggagtgtgtgc

SEQ ID NO: 1052148 - DNA, 12 bp, Homo sapiens
tttgctaaaaga

SEQ ID NO: 1052149 - DNA, 14 bp, Homo sapiens
tttgctaaaagaag

SEQ ID NO: 1052150 - DNA, 17 bp, Homo sapiens
tttgctaaaagaagaga

SEQ ID NO: 1052151 - DNA, 20 bp, Homo sapiens
tttgctaattaactgaaaca

SEQ ID NO: 1052152 - DNA, 14 bp, Homo sapiens
tttgctaattttta

SEQ ID NO: 1052153 - DNA, 14 bp, Homo sapiens
tttgctacaaattt

SEQ ID NO: 1052154 - DNA, 17 bp, Homo sapiens
tttgctacaaatttatg

SEQ ID NO: 1052155 - DNA, 18 bp, Homo sapiens
tttgctacaaatttatgc

SEQ ID NO: 1052156 - DNA, 19 bp, Homo sapiens
tttgctacaaatttatgca

SEQ ID NO: 1052157 - DNA, 24 bp, Homo sapiens
tttgctagcagtaaaagatgaagt

SEQ ID NO: 1052158 - DNA, 16 bp, Homo sapiens
tttgctagtgcatttc

SEQ ID NO: 1052159 - DNA, 15 bp, Homo sapiens
tttgctataatcatt

SEQ ID NO: 1052160 - DNA, 13 bp, Homo sapiens
tttgctattcaaa

SEQ ID NO: 1052161 - DNA, 23 bp, Homo sapiens
tttgctattcccattgtgacagc

SEQ ID NO: 1052162 - DNA, 13 bp, Homo sapiens
tttgctattgaca

SEQ ID NO: 1052163 - DNA, 20 bp, Homo sapiens
tttgctattgacaagtcatt

SEQ ID NO: 1052164 - DNA, 13 bp, Homo sapiens
tttgctcatgtaa

SEQ ID NO: 1052165 - DNA, 19 bp, Homo sapiens
gtgtccgccatccagggtc

SEQ ID NO: 1052166 - DNA, 16 bp, Homo sapiens
gtgtccgtccaccctt

SEQ ID NO: 1052167 - DNA, 19 bp, Homo sapiens
gtgtccgtccacccttcca

SEQ ID NO: 1052168 - DNA, 12 bp, Homo sapiens
gtgtcctccctc

SEQ ID NO: 1052169 - DNA, 21 bp, Homo sapiens
gtgtcctctctgtgtccctgc

SEQ ID NO: 1052170 - DNA, 18 bp, Homo sapiens
gtgtcctcttccctctct

SEQ ID NO: 1052171 - DNA, 20 bp, Homo sapiens
gtgtcctgaaacgctccttt

SEQ ID NO: 1052172 - DNA, 21 bp, Homo sapiens
gtgtcctgaaacgctcctttg

SEQ ID NO: 1052173 - DNA, 16 bp, Homo sapiens
gtgtcctgaccaccct

SEQ ID NO: 1052174 - DNA, 21 bp, Homo sapiens
gtgtcctgcccaccctaccag

SEQ ID NO: 1052175 - DNA, 17 bp, Homo sapiens
gtgtcctgcctgtctgc

SEQ ID NO: 1052176 - DNA, 13 bp, Homo sapiens
gtgtcctgctctg

SEQ ID NO: 1052177 - DNA, 16 bp, Homo sapiens
gtgtcctggtgctctc

SEQ ID NO: 1052178 - DNA, 16 bp, Homo sapiens
gtgtcctgtgctttct

SEQ ID NO: 1052179 - DNA, 20 bp, Homo sapiens
gtgtcctgtgctttctgcat

SEQ ID NO: 1052180 - DNA, 19 bp, Homo sapiens
gtgtccttcctccacaagg

SEQ ID NO: 1052181 - DNA, 13 bp, Homo sapiens
gtgtccttgaact

SEQ ID NO: 1052182 - DNA, 19 bp, Homo sapiens
gtgtccttgcacctgcatc

SEQ ID NO: 1052183 - DNA, 23 bp, Homo sapiens
gtgtcgctctgctggcctggccg

SEQ ID NO: 1052184 - DNA, 14 bp, Homo sapiens
gtgtctaaaaacac

SEQ ID NO: 1052185 - DNA, 17 bp, Homo sapiens
gtgtctaaaaacaccaa

SEQ ID NO: 1052186 - DNA, 13 bp, Homo sapiens
gtgtctaaactgc

SEQ ID NO: 1052187 - DNA, 14 bp, Homo sapiens
gtgtctcagcctct

SEQ ID NO: 1052188 - DNA, 18 bp, Homo sapiens
gtgtctcagcctctgcca

SEQ ID NO: 1052189 - DNA, 15 bp, Homo sapiens
gtgtctcccaacatg

SEQ ID NO: 1052190 - DNA, 11 bp, Homo sapiens
gtgtctccctc

SEQ ID NO: 1052191 - DNA, 14 bp, Homo sapiens
gtgtctctgctttc

SEQ ID NO: 1052192 - DNA, 22 bp, Homo sapiens
gtgtctctgctttccttttctc

SEQ ID NO: 1052193 - DNA, 15 bp, Homo sapiens
gtgtctctgggcctg

SEQ ID NO: 1052194 - DNA, 14 bp, Homo sapiens
gtgtctctggtctt

SEQ ID NO: 1052195 - DNA, 19 bp, Homo sapiens
gtgtctggaattgtggcta

SEQ ID NO: 1052196 - DNA, 23 bp, Homo sapiens
gtgtctggaattgtggctatcct

SEQ ID NO: 1052197 - DNA, 16 bp, Homo sapiens
gtgtctggatcagtaa

SEQ ID NO: 1052198 - DNA, 15 bp, Homo sapiens
gtgtctgggagagcc

SEQ ID NO: 1052199 - DNA, 18 bp, Homo sapiens
gtgtctgggagagcctgg

SEQ ID NO: 1052200 - DNA, 20 bp, Homo sapiens
gtgtctgtaggtgtctctgg

SEQ ID NO: 1052201 - DNA, 12 bp, Homo sapiens
gtgtctgtcaca

SEQ ID NO: 1052202 - DNA, 22 bp, Homo sapiens
gtgtctgtcacaggctgggtca

SEQ ID NO: 1052203 - DNA, 23 bp, Homo sapiens
gtgtctgtccatctgtctgtcct

SEQ ID NO: 1052204 - DNA, 13 bp, Homo sapiens
gtgtctgtctttg

SEQ ID NO: 1052205 - DNA, 15 bp, Homo sapiens
gtgtctgtctttgtg

SEQ ID NO: 1052206 - DNA, 20 bp, Homo sapiens
gtgtctgtgccctccaaaga

SEQ ID NO: 1052207 - DNA, 14 bp, Homo sapiens
gtgtctgtgtttaa

SEQ ID NO: 1052208 - DNA, 14 bp, Homo sapiens
gtgtcttaattatt

SEQ ID NO: 1052209 - DNA, 13 bp, Homo sapiens
gtgtcttccataa

SEQ ID NO: 1052210 - DNA, 16 bp, Homo sapiens
gtgtcttgggcagagc

SEQ ID NO: 1052211 - DNA, 19 bp, Homo sapiens
gtgtctttagatagccctg

SEQ ID NO: 1052212 - DNA, 18 bp, Homo sapiens
gtgtctttcacagctcct

SEQ ID NO: 1052213 - DNA, 21 bp, Homo sapiens
gtgtctttctaagaaatcaag

SEQ ID NO: 1052214 - DNA, 12 bp, Homo sapiens
gtgtctttggag

SEQ ID NO: 1052215 - DNA, 15 bp, Homo sapiens
gtgtctttgtctggc

SEQ ID NO: 1052216 - DNA, 17 bp, Homo sapiens
gtgtcttttccactcct

SEQ ID NO: 1052217 - DNA, 14 bp, Homo sapiens
gtgtcttttgacat

SEQ ID NO: 1052218 - DNA, 21 bp, Homo sapiens
gtgtgaaaggaagctccactg

SEQ ID NO: 1052219 - DNA, 22 bp, Homo sapiens
gtgtgaactcaccctgggagcc

SEQ ID NO: 1052220 - DNA, 14 bp, Homo sapiens
gtgtgaactgggca

SEQ ID NO: 1052221 - DNA, 17 bp, Homo sapiens
gtgtgaagttacacaat

SEQ ID NO: 1052222 - DNA, 15 bp, Homo sapiens
gtgtgaatagcctgg

SEQ ID NO: 1052223 - DNA, 19 bp, Homo sapiens
gtgtgaatattcctttatt

SEQ ID NO: 1052224 - DNA, 12 bp, Homo sapiens
gtgtgaatgtag

SEQ ID NO: 1052225 - DNA, 21 bp, Homo sapiens
gtgtgaatgtgggcactggcc

SEQ ID NO: 1052226 - DNA, 13 bp, Homo sapiens
gtgtgacagggcc

SEQ ID NO: 1052227 - DNA, 14 bp, Homo sapiens
gtgtgacagggcca

SEQ ID NO: 1052228 - DNA, 18 bp, Homo sapiens
gtgtgacagggccagtgg

SEQ ID NO: 1052229 - DNA, 15 bp, Homo sapiens
gtgtgacatcagtgg

SEQ ID NO: 1052230 - DNA, 14 bp, Homo sapiens
gtgtgacattccag

SEQ ID NO: 1052231 - DNA, 15 bp, Homo sapiens
gtgtgacattccagg

SEQ ID NO: 1052232 - DNA, 19 bp, Homo sapiens
gtgtgacatttggagaggg

SEQ ID NO: 1052233 - DNA, 14 bp, Homo sapiens
gtgtgaccaactgt

SEQ ID NO: 1052234 - DNA, 19 bp, Homo sapiens
gtgtgactaactatgcaat

SEQ ID NO: 1052235 - DNA, 19 bp, Homo sapiens
gtgtgactcgggagctgca

SEQ ID NO: 1052236 - DNA, 23 bp, Homo sapiens
gtgtgactctcttggattattta

SEQ ID NO: 1052237 - DNA, 15 bp, Homo sapiens
gtgtgagagagactg

SEQ ID NO: 1052238 - DNA, 13 bp, Homo sapiens
gtgtgagcagtga

SEQ ID NO: 1052239 - DNA, 14 bp, Homo sapiens
gtgtgagcgtggcc

SEQ ID NO: 1052240 - DNA, 19 bp, Homo sapiens
gtgtgagcgtggccttggg

SEQ ID NO: 1052241 - DNA, 19 bp, Homo sapiens
gtgtgaggagctgctggct

SEQ ID NO: 1052242 - DNA, 12 bp, Homo sapiens
gtgtgaggccag

SEQ ID NO: 1052243 - DNA, 13 bp, Homo sapiens
gtgtgagggcagc

SEQ ID NO: 1052244 - DNA, 17 bp, Homo sapiens
gtgtgagggtcctgcag

SEQ ID NO: 1052245 - DNA, 20 bp, Homo sapiens
gtgtgagtggcagccatgcc

SEQ ID NO: 1052246 - DNA, 14 bp, Homo sapiens
gtgtgagtgtgatg

SEQ ID NO: 1052247 - DNA, 17 bp, Homo sapiens
gtgtgatcccaagtgcc

SEQ ID NO: 1052248 - DNA, 19 bp, Homo sapiens
gtgtgatcccaagtgccag

SEQ ID NO: 1052249 - DNA, 18 bp, Homo sapiens
gtgtgatccggtttcttt

SEQ ID NO: 1052250 - DNA, 22 bp, Homo sapiens
gtgtgatcttaatatatttgaa

SEQ ID NO: 1052251 - DNA, 22 bp, Homo sapiens
gtgtgatgaactttctcttcat

SEQ ID NO: 1052252 - DNA, 15 bp, Homo sapiens
gtgtgattgcacaga

SEQ ID NO: 1052253 - DNA, 20 bp, Homo sapiens
gtgtgatttcctaaacataa

SEQ ID NO: 1052254 - DNA, 16 bp, Homo sapiens
gtgtgcaactggccag

SEQ ID NO: 1052255 - DNA, 16 bp, Homo sapiens
gtgtgcaagtatgtga

SEQ ID NO: 1052256 - DNA, 19 bp, Homo sapiens
gtgtgcaatgtctgagtga

SEQ ID NO: 1052257 - DNA, 20 bp, Homo sapiens
gtgtgcacaaatatttattt

SEQ ID NO: 1052258 - DNA, 22 bp, Homo sapiens
gtgtgcacacacaccacacata

SEQ ID NO: 1052259 - DNA, 16 bp, Homo sapiens
gtgtgcaccagggttg

SEQ ID NO: 1052260 - DNA, 22 bp, Homo sapiens
gtgtgcaccttaccaactttct

SEQ ID NO: 1052261 - DNA, 15 bp, Homo sapiens
gtgtgcacgagtggg

SEQ ID NO: 1052262 - DNA, 17 bp, Homo sapiens
gtgtgcactaaggggcc

SEQ ID NO: 1052263 - DNA, 23 bp, Homo sapiens
gtgtgcactaaggggcccggcca

SEQ ID NO: 1052264 - DNA, 13 bp, Homo sapiens
gtgtgcagacagc

SEQ ID NO: 1052265 - DNA, 14 bp, Homo sapiens
gtgtgcaggagcct

SEQ ID NO: 1052266 - DNA, 18 bp, Homo sapiens
gtgtgcaggagcctccct

SEQ ID NO: 1052267 - DNA, 13 bp, Homo sapiens
gtgtgcatatttg

SEQ ID NO: 1052268 - DNA, 21 bp, Homo sapiens
gtgtgcatcatgtttctgaga

SEQ ID NO: 1052269 - DNA, 22 bp, Homo sapiens
gtgtgcatggaggccctcctgt

SEQ ID NO: 1052270 - DNA, 12 bp, Homo sapiens
gtgtgcatgtgt

SEQ ID NO: 1052271 - DNA, 19 bp, Homo sapiens
gtgtgcatgtgtgtgtctg

SEQ ID NO: 1052272 - DNA, 12 bp, Homo sapiens
gtgtgccacacc

SEQ ID NO: 1052273 - DNA, 21 bp, Homo sapiens
gtgtgccatagagtttaacac

SEQ ID NO: 1052274 - DNA, 21 bp, Homo sapiens
gtgtgcccaagtgggcagtca

SEQ ID NO: 1052275 - DNA, 12 bp, Homo sapiens
gtgtgccctggg

SEQ ID NO: 1052276 - DNA, 16 bp, Homo sapiens
gtgtgccctgggccag

SEQ ID NO: 1052277 - DNA, 17 bp, Homo sapiens
gtgtgccctgggccagg

SEQ ID NO: 1052278 - DNA, 19 bp, Homo sapiens
gtgtgccctgggccaggca

SEQ ID NO: 1052279 - DNA, 20 bp, Homo sapiens
gtgtgccctgggccaggcag

SEQ ID NO: 1052280 - DNA, 14 bp, Homo sapiens
gtgtgcccttgggg

SEQ ID NO: 1052281 - DNA, 19 bp, Homo sapiens
gtgtgcctcagtatattta

SEQ ID NO: 1052282 - DNA, 13 bp, Homo sapiens
gtgtgcctgcagc

SEQ ID NO: 1052283 - DNA, 13 bp, Homo sapiens
gtgtgcctgccct

SEQ ID NO: 1052284 - DNA, 22 bp, Homo sapiens
gtgtgcctgtctgttacactgg

SEQ ID NO: 1052285 - DNA, 16 bp, Homo sapiens
gtgtgcctgtggcaga

SEQ ID NO: 1052286 - DNA, 17 bp, Homo sapiens
gtgtgcgtggcgtggcc

SEQ ID NO: 1052287 - DNA, 22 bp, Homo sapiens
gtgtgctctccccggcaggcct

SEQ ID NO: 1052288 - DNA, 14 bp, Homo sapiens
gtgtgctgacaact

SEQ ID NO: 1052289 - DNA, 16 bp, Homo sapiens
gtgtgctgaggtgtta

SEQ ID NO: 1052290 - DNA, 23 bp, Homo sapiens
tatcacataagagagatgagaaa

SEQ ID NO: 1052291 - DNA, 21 bp, Homo sapiens
tatcacatcaagcatgcaata

SEQ ID NO: 1052292 - DNA, 20 bp, Homo sapiens
tatcacattggagtcactgc

SEQ ID NO: 1052293 - DNA, 16 bp, Homo sapiens
tatcaccatagttttg

SEQ ID NO: 1052294 - DNA, 19 bp, Homo sapiens
tatcacccagaagaaaata

SEQ ID NO: 1052295 - DNA, 19 bp, Homo sapiens
tatcaccgtgggctccctg

SEQ ID NO: 1052296 - DNA, 20 bp, Homo sapiens
tatcacctcccctccttgcc

SEQ ID NO: 1052297 - DNA, 17 bp, Homo sapiens
tatcacctctcttcagc

SEQ ID NO: 1052298 - DNA, 17 bp, Homo sapiens
tatcactaatttcttct

SEQ ID NO: 1052299 - DNA, 18 bp, Homo sapiens
tatcagaatctgtgtgaa

SEQ ID NO: 1052300 - DNA, 13 bp, Homo sapiens
tatcagaatttgt

SEQ ID NO: 1052301 - DNA, 13 bp, Homo sapiens
tatcagacaagca

SEQ ID NO: 1052302 - DNA, 14 bp, Homo sapiens
tatcagacaagcac

SEQ ID NO: 1052303 - DNA, 20 bp, Homo sapiens
tatcagacaagcactatttt

SEQ ID NO: 1052304 - DNA, 18 bp, Homo sapiens
tatcagacgtgctccctc

SEQ ID NO: 1052305 - DNA, 15 bp, Homo sapiens
tatcagagctcttaa

SEQ ID NO: 1052306 - DNA, 15 bp, Homo sapiens
tatcagcaatactca

SEQ ID NO: 1052307 - DNA, 15 bp, Homo sapiens
tatcagctctctgct

SEQ ID NO: 1052308 - DNA, 16 bp, Homo sapiens
tatcagctctctgctg

SEQ ID NO: 1052309 - DNA, 18 bp, Homo sapiens
tatcagctctctgctggg

SEQ ID NO: 1052310 - DNA, 19 bp, Homo sapiens
tatcagctctctgctgggt

SEQ ID NO: 1052311 - DNA, 14 bp, Homo sapiens
tatcaggggtgcat

SEQ ID NO: 1052312 - DNA, 23 bp, Homo sapiens
tatcaggtctcccacgtgggaga

SEQ ID NO: 1052313 - DNA, 17 bp, Homo sapiens
tatcagtagtgtacatt

SEQ ID NO: 1052314 - DNA, 13 bp, Homo sapiens
tatcagtattctg

SEQ ID NO: 1052315 - DNA, 11 bp, Homo sapiens
tatcagtgctt

SEQ ID NO: 1052316 - DNA, 21 bp, Homo sapiens
tatcagttaaaatcacatttt

SEQ ID NO: 1052317 - DNA, 18 bp, Homo sapiens
tatcagttactcagccct

SEQ ID NO: 1052318 - DNA, 20 bp, Homo sapiens
tatcagttactcagccctgg

SEQ ID NO: 1052319 - DNA, 19 bp, Homo sapiens
tatgatttataaacagaca

SEQ ID NO: 1052320 - DNA, 18 bp, Homo sapiens
tatgatttatagtttgta

SEQ ID NO: 1052321 - DNA, 12 bp, Homo sapiens
tatgatttcatt

SEQ ID NO: 1052322 - DNA, 16 bp, Homo sapiens
tatgatttcttgcttt

SEQ ID NO: 1052323 - DNA, 17 bp, Homo sapiens
tatgatttcttgctttg

SEQ ID NO: 1052324 - DNA, 17 bp, Homo sapiens
tatgatttttttttcat

SEQ ID NO: 1052325 - DNA, 23 bp, Homo sapiens
tatgcaaaagtacaagggctgag

SEQ ID NO: 1052326 - DNA, 17 bp, Homo sapiens
tatgcaaacctcatctt

SEQ ID NO: 1052327 - DNA, 19 bp, Homo sapiens
tatgcaaagcactctctgc

SEQ ID NO: 1052328 - DNA, 13 bp, Homo sapiens
tatgcaaagtcta

SEQ ID NO: 1052329 - DNA, 23 bp, Homo sapiens
tatgcaaataaaacccaatactt

SEQ ID NO: 1052330 - DNA, 14 bp, Homo sapiens
tatgcaagcagctt

SEQ ID NO: 1052331 - DNA, 20 bp, Homo sapiens
tatgcaatgtatagtgtcta

SEQ ID NO: 1052332 - DNA, 21 bp, Homo sapiens
tatgcacacagagatttgaga

SEQ ID NO: 1052333 - DNA, 14 bp, Homo sapiens
tatgcacacatttt

SEQ ID NO: 1052334 - DNA, 14 bp, Homo sapiens
tatgcacagcctag

SEQ ID NO: 1052335 - DNA, 17 bp, Homo sapiens
tatgcacagtctatttt

SEQ ID NO: 1052336 - DNA, 21 bp, Homo sapiens
tatgcaccaggtctcaaggtt

SEQ ID NO: 1052337 - DNA, 16 bp, Homo sapiens
tatgcactgtggtttc

SEQ ID NO: 1052338 - DNA, 22 bp, Homo sapiens
tatgcactgtggtttcagatgt

SEQ ID NO: 1052339 - DNA, 23 bp, Homo sapiens
tatgcactgtggtttcagatgtg

SEQ ID NO: 1052340 - DNA, 19 bp, Homo sapiens
tatgcacttataattttcc

SEQ ID NO: 1052341 - DNA, 12 bp, Homo sapiens
tatgcactttta

SEQ ID NO: 1052342 - DNA, 13 bp, Homo sapiens
tatgcacttttag

SEQ ID NO: 1052343 - DNA, 23 bp, Homo sapiens
tatgcacttttagaaatgcatat

SEQ ID NO: 1052344 - DNA, 21 bp, Homo sapiens
tatgcagaaatagacaaaaag

SEQ ID NO: 1052345 - DNA, 21 bp, Homo sapiens
tatgcagaacgtatttagcca

SEQ ID NO: 1052346 - DNA, 19 bp, Homo sapiens
tatgcagaatggcatttgc

SEQ ID NO: 1052347 - DNA, 16 bp, Homo sapiens
tatgcagacagtctgt

SEQ ID NO: 1052348 - DNA, 13 bp, Homo sapiens
tatgcagccaacc

SEQ ID NO: 1052349 - DNA, 16 bp, Homo sapiens
tatgcagggagcactg

SEQ ID NO: 1052350 - DNA, 18 bp, Homo sapiens
tatgcagtgtagatttta

SEQ ID NO: 1052351 - DNA, 21 bp, Homo sapiens
tatgcatcagataacaactgt

SEQ ID NO: 1052352 - DNA, 14 bp, Homo sapiens
tatgcatgccaggc

SEQ ID NO: 1052353 - DNA, 16 bp, Homo sapiens
tatgcatgtgaagaaa

SEQ ID NO: 1052354 - DNA, 23 bp, Homo sapiens
tatgcattcacatttagaaaagt

SEQ ID NO: 1052355 - DNA, 11 bp, Homo sapiens
tatgcattttc

SEQ ID NO: 1052356 - DNA, 16 bp, Homo sapiens
tatgcattttcttcac

SEQ ID NO: 1052357 - DNA, 20 bp, Homo sapiens
tatgcattttcttcacagtg

SEQ ID NO: 1052358 - DNA, 15 bp, Homo sapiens
tatgccaaatgttaa

SEQ ID NO: 1052359 - DNA, 19 bp, Homo sapiens
tatgccaaatgttaactgc

SEQ ID NO: 1052360 - DNA, 21 bp, Homo sapiens
tatgccaccaacttacaaaaa

SEQ ID NO: 1052361 - DNA, 21 bp, Homo sapiens
tatgccaccccatgtgccttt

SEQ ID NO: 1052362 - DNA, 14 bp, Homo sapiens
tatgccagctcagt

SEQ ID NO: 1052363 - DNA, 17 bp, Homo sapiens
tatgccatgatggaaat

SEQ ID NO: 1052364 - DNA, 20 bp, Homo sapiens
tatgccatttcttctctctg

SEQ ID NO: 1052365 - DNA, 18 bp, Homo sapiens
tatgcccaggtaccaccc

SEQ ID NO: 1052366 - DNA, 23 bp, Homo sapiens
tatgccccttcttgggccccaga

SEQ ID NO: 1052367 - DNA, 16 bp, Homo sapiens
tatgccctgcagagca

SEQ ID NO: 1052368 - DNA, 17 bp, Homo sapiens
tatgccctgcagagcaa

SEQ ID NO: 1052369 - DNA, 18 bp, Homo sapiens
tatgccctgcagagcaat

SEQ ID NO: 1052370 - DNA, 21 bp, Homo sapiens
tatgccctgcagagcaataac

SEQ ID NO: 1052371 - DNA, 22 bp, Homo sapiens
tatgccctgcagagcaataaca

SEQ ID NO: 1052372 - DNA, 19 bp, Homo sapiens
tatgccctgcccttcctca

SEQ ID NO: 1052373 - DNA, 18 bp, Homo sapiens
tatgcctacagccctcac

SEQ ID NO: 1052374 - DNA, 22 bp, Homo sapiens
tatgcctctgacagtccacagg

SEQ ID NO: 1052375 - DNA, 17 bp, Homo sapiens
tatgcctgcactgggaa

SEQ ID NO: 1052376 - DNA, 21 bp, Homo sapiens
tatgcctgcactgggaaggaa

SEQ ID NO: 1052377 - DNA, 14 bp, Homo sapiens
tatgccttcttatt

SEQ ID NO: 1052378 - DNA, 14 bp, Homo sapiens
tatgccttgtataa

SEQ ID NO: 1052379 - DNA, 13 bp, Homo sapiens
tatgcggttaatt

SEQ ID NO: 1052380 - DNA, 17 bp, Homo sapiens
tatgcgtaatttaatgg

SEQ ID NO: 1052381 - DNA, 20 bp, Homo sapiens
tatgctaaacctcctgcctc

SEQ ID NO: 1052382 - DNA, 15 bp, Homo sapiens
tatgctattgacaat

SEQ ID NO: 1052383 - DNA, 18 bp, Homo sapiens
tatgctattgacaataaa

SEQ ID NO: 1052384 - DNA, 13 bp, Homo sapiens
tatgctatttctg

SEQ ID NO: 1052385 - DNA, 18 bp, Homo sapiens
tatgctctcactgtttgt

SEQ ID NO: 1052386 - DNA, 22 bp, Homo sapiens
tatgctgatcatcgccagaggt

SEQ ID NO: 1052387 - DNA, 21 bp, Homo sapiens
tatgctgatcttttaaaatca

SEQ ID NO: 1052388 - DNA, 19 bp, Homo sapiens
tatgctgcaacaaaatgta

SEQ ID NO: 1052389 - DNA, 16 bp, Homo sapiens
tatgctgccaaatttt

SEQ ID NO: 1052390 - DNA, 11 bp, Homo sapiens
tatgctgctgt

SEQ ID NO: 1052391 - DNA, 12 bp, Homo sapiens
tatgctggccag

SEQ ID NO: 1052392 - DNA, 18 bp, Homo sapiens
tatgctggccagcaccct

SEQ ID NO: 1052393 - DNA, 18 bp, Homo sapiens
tatgctggcttgtacata

SEQ ID NO: 1052394 - DNA, 21 bp, Homo sapiens
tatgctggggtacacagtgag

SEQ ID NO: 1052395 - DNA, 22 bp, Homo sapiens
tatgctggggtacacagtgaga

SEQ ID NO: 1052396 - DNA, 15 bp, Homo sapiens
tatgctggtggttaa

SEQ ID NO: 1052397 - DNA, 16 bp, Homo sapiens
tatgctgtatttcttt

SEQ ID NO: 1052398 - DNA, 13 bp, Homo sapiens
tatgctgtatttt

SEQ ID NO: 1052399 - DNA, 14 bp, Homo sapiens
tatgctgtatttta

SEQ ID NO: 1052400 - DNA, 13 bp, Homo sapiens
tatgcttaaaata

SEQ ID NO: 1052401 - DNA, 19 bp, Homo sapiens
tatgcttactaaatcttca

SEQ ID NO: 1052402 - DNA, 22 bp, Homo sapiens
tatgcttactaaatcttcagca

SEQ ID NO: 1052403 - DNA, 16 bp, Homo sapiens
tatgcttactgatata

SEQ ID NO: 1052404 - DNA, 22 bp, Homo sapiens
tatgcttatacacttacacttt

SEQ ID NO: 1052405 - DNA, 18 bp, Homo sapiens
tatgcttccacaggcaaa

SEQ ID NO: 1052406 - DNA, 20 bp, Homo sapiens
tatgcttgtaactaaaataa

SEQ ID NO: 1052407 - DNA, 13 bp, Homo sapiens
tatgctttgaatg

SEQ ID NO: 1052408 - DNA, 18 bp, Homo sapiens
tatgctttgaatgcaaaa

SEQ ID NO: 1052409 - DNA, 19 bp, Homo sapiens
tatgcttttagagttgcaa

SEQ ID NO: 1052410 - DNA, 21 bp, Homo sapiens
tatggaaaaattgacaaaaaa

SEQ ID NO: 1052411 - DNA, 23 bp, Homo sapiens
tatggaaaagggtcttcttggca

SEQ ID NO: 1052412 - DNA, 19 bp, Homo sapiens
tatggaaatgtgagaaatg

SEQ ID NO: 1052413 - DNA, 20 bp, Homo sapiens
tatggaaatgtgagaaatgt

SEQ ID NO: 1052414 - DNA, 13 bp, Homo sapiens
tatggaacttcta

SEQ ID NO: 1052415 - DNA, 14 bp, Homo sapiens
tatggaagaaagta

SEQ ID NO: 1052416 - DNA, 22 bp, Homo sapiens
tatggaagggtttgtggctggg

SEQ ID NO: 1052417 - DNA, 14 bp, Homo sapiens
tatggaataacaac

SEQ ID NO: 1052418 - DNA, 14 bp, Homo sapiens
tatggaatacagtg

SEQ ID NO: 1052419 - DNA, 11 bp, Homo sapiens
tatggaattga

SEQ ID NO: 1052420 - DNA, 19 bp, Homo sapiens
tatggaattgatttgcatt

SEQ ID NO: 1052421 - DNA, 15 bp, Homo sapiens
tatggaattttgcaa

SEQ ID NO: 1052422 - DNA, 13 bp, Homo sapiens
tatggactatctg

SEQ ID NO: 1052423 - DNA, 21 bp, Homo sapiens
tatggactatctgtctggtgg

SEQ ID NO: 1052424 - DNA, 19 bp, Homo sapiens
tatggagaaacaaaatcct

SEQ ID NO: 1052425 - DNA, 14 bp, Homo sapiens
tatggaggattctt

SEQ ID NO: 1052426 - DNA, 22 bp, Homo sapiens
tatggagtgagtcacctgctcc

SEQ ID NO: 1052427 - DNA, 21 bp, Homo sapiens
tatggatcagaggagtaaata

SEQ ID NO: 1052428 - DNA, 20 bp, Homo sapiens
tatggatgattcagaaattg

SEQ ID NO: 1052429 - DNA, 15 bp, Homo sapiens
tatggatgttactct

SEQ ID NO: 1052430 - DNA, 13 bp, Homo sapiens
tatggattctaaa

SEQ ID NO: 1052431 - DNA, 21 bp, Homo sapiens
tatggattttctattgttact

SEQ ID NO: 1052432 - DNA, 14 bp, Homo sapiens
tatggcaaaaatgg

SEQ ID NO: 1052433 - DNA, 11 bp, Homo sapiens
tatggcaaggg

SEQ ID NO: 1052434 - DNA, 17 bp, Homo sapiens
tatggcagagttgtaaa

SEQ ID NO: 1052435 - DNA, 21 bp, Homo sapiens
tatggcagagttgtaaatata

SEQ ID NO: 1052436 - DNA, 20 bp, Homo sapiens
tatggcagcccggctgctgc

SEQ ID NO: 1052437 - DNA, 15 bp, Homo sapiens
tatggcaggactcct

SEQ ID NO: 1052438 - DNA, 17 bp, Homo sapiens
tatggcaggactcctgg

SEQ ID NO: 1052439 - DNA, 17 bp, Homo sapiens
tatggcaggataagaaa

SEQ ID NO: 1052440 - DNA, 15 bp, Homo sapiens
tatggcatgatttat

SEQ ID NO: 1052441 - DNA, 19 bp, Homo sapiens
tatgtgacaattttgtaca

SEQ ID NO: 1052442 - DNA, 18 bp, Homo sapiens
tatgtgacattttacatt

SEQ ID NO: 1052443 - DNA, 17 bp, Homo sapiens
tatgtgacttgcaataa

SEQ ID NO: 1052444 - DNA, 20 bp, Homo sapiens
tatgtgagaaatcagaattg

SEQ ID NO: 1052445 - DNA, 15 bp, Homo sapiens
tatgtgagctgtaaa

SEQ ID NO: 1052446 - DNA, 19 bp, Homo sapiens
tatgtgagctgtaaaaatg

SEQ ID NO: 1052447 - DNA, 16 bp, Homo sapiens
tatgtgagtgcctttt

SEQ ID NO: 1052448 - DNA, 23 bp, Homo sapiens
tatgtgagtgccttttgcagaag

SEQ ID NO: 1052449 - DNA, 21 bp, Homo sapiens
tattaagacagtgtacaaaac

SEQ ID NO: 1052450 - DNA, 20 bp, Homo sapiens
tattaagaggtaagacttag

SEQ ID NO: 1052451 - DNA, 18 bp, Homo sapiens
tattaagatggattctca

SEQ ID NO: 1052452 - DNA, 14 bp, Homo sapiens
tattaagattggaa

SEQ ID NO: 1052453 - DNA, 17 bp, Homo sapiens
tattaagattggaaatg

SEQ ID NO: 1052454 - DNA, 23 bp, Homo sapiens
tattaagcagactggaaaagtga

SEQ ID NO: 1052455 - DNA, 20 bp, Homo sapiens
tattaagccaggaaacatga

SEQ ID NO: 1052456 - DNA, 21 bp, Homo sapiens
tattaagcccacagtatattt

SEQ ID NO: 1052457 - DNA, 19 bp, Homo sapiens
tattaagcctaccgtattt

SEQ ID NO: 1052458 - DNA, 22 bp, Homo sapiens
tattaagcctaccgtatttcag

SEQ ID NO: 1052459 - DNA, 23 bp, Homo sapiens
tattaagcctaccgtatttcagc

SEQ ID NO: 1052460 - DNA, 19 bp, Homo sapiens
tattaagtgactgaccatg

SEQ ID NO: 1052461 - DNA, 21 bp, Homo sapiens
tattaataaaactttatgtac

SEQ ID NO: 1052462 - DNA, 12 bp, Homo sapiens
tattaataaagc

SEQ ID NO: 1052463 - DNA, 15 bp, Homo sapiens
tattaataaagcatt

SEQ ID NO: 1052464 - DNA, 19 bp, Homo sapiens
tattaataaagcattcttt

SEQ ID NO: 1052465 - DNA, 18 bp, Homo sapiens
tattaatagtaatttgta

SEQ ID NO: 1052466 - DNA, 20 bp, Homo sapiens
tattaatagtaatttgtaaa

SEQ ID NO: 1052467 - DNA, 17 bp, Homo sapiens
tattaatatcaactctg

SEQ ID NO: 1052468 - DNA, 12 bp, Homo sapiens
tattaatcaaaa

SEQ ID NO: 1052469 - DNA, 20 bp, Homo sapiens
tattaatcaagagaaacttc

SEQ ID NO: 1052470 - DNA, 20 bp, Homo sapiens
tattaatcatacaaactctc

SEQ ID NO: 1052471 - DNA, 20 bp, Homo sapiens
tattaatccccatcattact

SEQ ID NO: 1052472 - DNA, 19 bp, Homo sapiens
tattaatgaggtctttaaa

SEQ ID NO: 1052473 - DNA, 20 bp, Homo sapiens
tattaatgcactttctatcc

SEQ ID NO: 1052474 - DNA, 14 bp, Homo sapiens
tattaatgccttta

SEQ ID NO: 1052475 - DNA, 22 bp, Homo sapiens
tattaatgcctttaaagtatga

SEQ ID NO: 1052476 - DNA, 23 bp, Homo sapiens
tattaatgcctttaaagtatgaa

SEQ ID NO: 1052477 - DNA, 13 bp, Homo sapiens
tattaattcttca

SEQ ID NO: 1052478 - DNA, 14 bp, Homo sapiens
tattaatttattgg

SEQ ID NO: 1052479 - DNA, 15 bp, Homo sapiens
tattacaaatgcaaa

SEQ ID NO: 1052480 - DNA, 21 bp, Homo sapiens
tattacaaatgcaaatttcta

SEQ ID NO: 1052481 - DNA, 19 bp, Homo sapiens
tattacaaattttcactgc

SEQ ID NO: 1052482 - DNA, 14 bp, Homo sapiens
tattacaagatctt

SEQ ID NO: 1052483 - DNA, 14 bp, Homo sapiens
tattacaatgatca

SEQ ID NO: 1052484 - DNA, 19 bp, Homo sapiens
tattacactctgtaattga

SEQ ID NO: 1052485 - DNA, 16 bp, Homo sapiens
tattacagtgtttatc

SEQ ID NO: 1052486 - DNA, 14 bp, Homo sapiens
tattacataaataa

SEQ ID NO: 1052487 - DNA, 15 bp, Homo sapiens
tattacatctaatgc

SEQ ID NO: 1052488 - DNA, 16 bp, Homo sapiens
tattacatgactgttt

SEQ ID NO: 1052489 - DNA, 18 bp, Homo sapiens
tattacatgactgtttct

SEQ ID NO: 1052490 - DNA, 19 bp, Homo sapiens
tattacatgactgtttctt

SEQ ID NO: 1052491 - DNA, 20 bp, Homo sapiens
tattaccagcaagaataaaa

SEQ ID NO: 1052492 - DNA, 21 bp, Homo sapiens
tattacctattaggtggaaat

SEQ ID NO: 1052493 - DNA, 16 bp, Homo sapiens
tattacggtttgcccc

SEQ ID NO: 1052494 - DNA, 14 bp, Homo sapiens
tattactaattcta

SEQ ID NO: 1052495 - DNA, 19 bp, Homo sapiens
tattactaattctatttct

SEQ ID NO: 1052496 - DNA, 22 bp, Homo sapiens
tattactatgactgctccccag

SEQ ID NO: 1052497 - DNA, 20 bp, Homo sapiens
tattactcccctaagtcttt

SEQ ID NO: 1052498 - DNA, 19 bp, Homo sapiens
tattactgaataatatcaa

SEQ ID NO: 1052499 - DNA, 21 bp, Homo sapiens
tattactgaataatatcaaat

SEQ ID NO: 1052500 - DNA, 23 bp, Homo sapiens
tattactgaataatatcaaataa

SEQ ID NO: 1052501 - DNA, 17 bp, Homo sapiens
tattactgctgctgtgc

SEQ ID NO: 1052502 - DNA, 18 bp, Homo sapiens
tattactgctgctgtgct

SEQ ID NO: 1052503 - DNA, 23 bp, Homo sapiens
tattactgtctggttttaacaat

SEQ ID NO: 1052504 - DNA, 20 bp, Homo sapiens
tattactgttgcatttactt

SEQ ID NO: 1052505 - DNA, 15 bp, Homo sapiens
tattactgtttatta

SEQ ID NO: 1052506 - DNA, 18 bp, Homo sapiens
tattactgttttgggcct

SEQ ID NO: 1052507 - DNA, 15 bp, Homo sapiens
tattacttccatgaa

SEQ ID NO: 1052508 - DNA, 19 bp, Homo sapiens
tattacttccatgaatttt

SEQ ID NO: 1052509 - DNA, 17 bp, Homo sapiens
tattacttttgtaaata

SEQ ID NO: 1052510 - DNA, 23 bp, Homo sapiens
tattacttttgtaaatattcttg

SEQ ID NO: 1052511 - DNA, 23 bp, Homo sapiens
tattagaaattagaaaaaaatta

SEQ ID NO: 1052512 - DNA, 23 bp, Homo sapiens
tattagaatcaaacattttgaaa

SEQ ID NO: 1052513 - DNA, 13 bp, Homo sapiens
tattagacatcaa

SEQ ID NO: 1052514 - DNA, 23 bp, Homo sapiens
tattagacatcaatcctggtaac

SEQ ID NO: 1052515 - DNA, 18 bp, Homo sapiens
tattagagtatttccctt

SEQ ID NO: 1052516 - DNA, 19 bp, Homo sapiens
tattagagtatttcccttc

SEQ ID NO: 1052517 - DNA, 15 bp, Homo sapiens
tattagagtgtcttt

SEQ ID NO: 1052518 - DNA, 15 bp, Homo sapiens
tattagatgcactta

SEQ ID NO: 1052519 - DNA, 19 bp, Homo sapiens
tattagcagggattctctc

SEQ ID NO: 1052520 - DNA, 15 bp, Homo sapiens
tattagccacaaaat

SEQ ID NO: 1052521 - DNA, 16 bp, Homo sapiens
tattagccctgcattt

SEQ ID NO: 1052522 - DNA, 13 bp, Homo sapiens
tattagctcactg

SEQ ID NO: 1052523 - DNA, 15 bp, Homo sapiens
tattagctgggttcc

SEQ ID NO: 1052524 - DNA, 22 bp, Homo sapiens
tattaggatctgcaaacaatga

SEQ ID NO: 1052525 - DNA, 16 bp, Homo sapiens
tattagggagaaaatt

SEQ ID NO: 1052526 - DNA, 16 bp, Homo sapiens
tattaggtcttaaagt

SEQ ID NO: 1052527 - DNA, 16 bp, Homo sapiens
tattaggtggaaattt

SEQ ID NO: 1052528 - DNA, 14 bp, Homo sapiens
tattagtaccatag

SEQ ID NO: 1052529 - DNA, 21 bp, Homo sapiens
tattagtactgctcttgtttc

SEQ ID NO: 1052530 - DNA, 15 bp, Homo sapiens
tattagtattgttgt

SEQ ID NO: 1052531 - DNA, 17 bp, Homo sapiens
tattagtattgttgtcc

SEQ ID NO: 1052532 - DNA, 20 bp, Homo sapiens
tattagtattgttgtccttt

SEQ ID NO: 1052533 - DNA, 21 bp, Homo sapiens
tattagtgaagatggtttcaa

SEQ ID NO: 1052534 - DNA, 17 bp, Homo sapiens
tattataaaaatattaa

SEQ ID NO: 1052535 - DNA, 19 bp, Homo sapiens
tattataaaaatgtcagaa

SEQ ID NO: 1052536 - DNA, 11 bp, Homo sapiens
tattataaaag

SEQ ID NO: 1052537 - DNA, 22 bp, Homo sapiens
tattataaaagctcagatgaca

SEQ ID NO: 1052538 - DNA, 24 bp, Homo sapiens
tattataaaagggggtccgtggaa

SEQ ID NO: 1052539 - DNA, 14 bp, Homo sapiens
tattataaactata

SEQ ID NO: 1052540 - DNA, 16 bp, Homo sapiens
tattataaaggataaa

SEQ ID NO: 1052541 - DNA, 19 bp, Homo sapiens
tattataacaagtgtgtct

SEQ ID NO: 1052542 - DNA, 20 bp, Homo sapiens
tattataacaagtgtgtctt

SEQ ID NO: 1052543 - DNA, 21 bp, Homo sapiens
tattataagggagagctgagc

SEQ ID NO: 1052544 - DNA, 19 bp, Homo sapiens
tattataagtcttacataa

SEQ ID NO: 1052545 - DNA, 14 bp, Homo sapiens
tattataatcttat

SEQ ID NO: 1052546 - DNA, 17 bp, Homo sapiens
tattataattgttgata

SEQ ID NO: 1052547 - DNA, 20 bp, Homo sapiens
tattataccagatgaacatt

SEQ ID NO: 1052548 - DNA, 14 bp, Homo sapiens
tattataccttttt

SEQ ID NO: 1052549 - DNA, 15 bp, Homo sapiens
tattatactaagaaa

SEQ ID NO: 1052550 - DNA, 18 bp, Homo sapiens
tattatactaagaaaaga

SEQ ID NO: 1052551 - DNA, 19 bp, Homo sapiens
tattatactaagaaaagat

SEQ ID NO: 1052552 - DNA, 15 bp, Homo sapiens
tattatatatttaca

SEQ ID NO: 1052553 - DNA, 14 bp, Homo sapiens
tattatcacatcaa

SEQ ID NO: 1052554 - DNA, 13 bp, Homo sapiens
tattatcacatta

SEQ ID NO: 1052555 - DNA, 22 bp, Homo sapiens
tattatcacattaatctcaaag

SEQ ID NO: 1052556 - DNA, 22 bp, Homo sapiens
tattatcagttaaaatcacatt

SEQ ID NO: 1052557 - DNA, 23 bp, Homo sapiens
tattatcagttaaaatcacattt

SEQ ID NO: 1052558 - DNA, 22 bp, Homo sapiens
tattatcatgcaaatgctgtat

SEQ ID NO: 1052559 - DNA, 20 bp, Homo sapiens
tattatcattgctcccctga

SEQ ID NO: 1052560 - DNA, 15 bp, Homo sapiens
tattatctaaatgaa

SEQ ID NO: 1052561 - DNA, 18 bp, Homo sapiens
tattatcttgttcaggaa

SEQ ID NO: 1052562 - DNA, 16 bp, Homo sapiens
tattatgaaaaagatt

SEQ ID NO: 1052563 - DNA, 19 bp, Homo sapiens
tattatgaaggaatttgat

SEQ ID NO: 1052564 - DNA, 12 bp, Homo sapiens
tattatgagcca

SEQ ID NO: 1052565 - DNA, 18 bp, Homo sapiens
tattatgagctacaacaa

SEQ ID NO: 1052566 - DNA, 19 bp, Homo sapiens
tattatgaggctattaaaa

SEQ ID NO: 1052567 - DNA, 19 bp, Homo sapiens
tattatgatgttagaagaa

SEQ ID NO: 1052568 - DNA, 12 bp, Homo sapiens
tattatgcaaca

SEQ ID NO: 1052569 - DNA, 20 bp, Homo sapiens
tattatggaaaactgtgttg

SEQ ID NO: 1052570 - DNA, 23 bp, Homo sapiens
tattatggcaagtgatatcacct

SEQ ID NO: 1052571 - DNA, 18 bp, Homo sapiens
tattatgtaacatccaga

SEQ ID NO: 1052572 - DNA, 12 bp, Homo sapiens
tatgtgcactgt

SEQ ID NO: 1052573 - DNA, 17 bp, Homo sapiens
tatgtgcactgtcactt

SEQ ID NO: 1052574 - DNA, 21 bp, Homo sapiens
tatgtgcactgtcactttgct

SEQ ID NO: 1052575 - DNA, 19 bp, Homo sapiens
tatgtgccaaagctttact

SEQ ID NO: 1052576 - DNA, 13 bp, Homo sapiens
tatgtgccaggct

SEQ ID NO: 1052577 - DNA, 18 bp, Homo sapiens
tatgtgccaggcttgcct

SEQ ID NO: 1052578 - DNA, 19 bp, Homo sapiens
tatgtgccaggcttgcctg

SEQ ID NO: 1052579 - DNA, 17 bp, Homo sapiens
tatgtgccagttcctgt

SEQ ID NO: 1052580 - DNA, 18 bp, Homo sapiens
tatgtgcgtctctctttc

SEQ ID NO: 1052581 - DNA, 17 bp, Homo sapiens
tatgtggaagtatacct

SEQ ID NO: 1052582 - DNA, 19 bp, Homo sapiens
tatgtggtttccacgatga

SEQ ID NO: 1052583 - DNA, 14 bp, Homo sapiens
tatgtgtaaataca

SEQ ID NO: 1052584 - DNA, 13 bp, Homo sapiens
tatgtgtaataaa

SEQ ID NO: 1052585 - DNA, 15 bp, Homo sapiens
tatgtgtatgcaagt

SEQ ID NO: 1052586 - DNA, 14 bp, Homo sapiens
tatgtgtgaaacaa

SEQ ID NO: 1052587 - DNA, 13 bp, Homo sapiens
tatgtgtggctgt

SEQ ID NO: 1052588 - DNA, 14 bp, Homo sapiens
tatgtgtgtagaca

SEQ ID NO: 1052589 - DNA, 11 bp, Homo sapiens
tatgtgtgtgt

SEQ ID NO: 1052590 - DNA, 21 bp, Homo sapiens
tatgtgtgtttaaataaagta

SEQ ID NO: 1052591 - DNA, 15 bp, Homo sapiens
tatgtgttatgaaca

SEQ ID NO: 1052592 - DNA, 18 bp, Homo sapiens
tatgtgttatgaacatcc

SEQ ID NO: 1052593 - DNA, 21 bp, Homo sapiens
tatgtgtttctgtaacaaatt

SEQ ID NO: 1052594 - DNA, 17 bp, Homo sapiens
tatgtgtttggatacat

SEQ ID NO: 1052595 - DNA, 17 bp, Homo sapiens
tatgtgtttttctcata

SEQ ID NO: 1052596 - DNA, 19 bp, Homo sapiens
tatgttaaatactgtgcag

SEQ ID NO: 1052597 - DNA, 22 bp, Homo sapiens
tatgttaaatactgtgcagaat

SEQ ID NO: 1052598 - DNA, 22 bp, Homo sapiens
tatgttaacctcagtgtcattt

SEQ ID NO: 1052599 - DNA, 18 bp, Homo sapiens
tatgttaagctctttatg

SEQ ID NO: 1052600 - DNA, 22 bp, Homo sapiens
tatgttacatctgttttaaatt

SEQ ID NO: 1052601 - DNA, 15 bp, Homo sapiens
tatgttactattttc

SEQ ID NO: 1052602 - DNA, 23 bp, Homo sapiens
tatgttatacaaggcaagcattt

SEQ ID NO: 1052603 - DNA, 13 bp, Homo sapiens
tatgttattcctg

SEQ ID NO: 1052604 - DNA, 16 bp, Homo sapiens
tatgttattttgtgta

SEQ ID NO: 1052605 - DNA, 13 bp, Homo sapiens
tatgttcactgtc

SEQ ID NO: 1052606 - DNA, 21 bp, Homo sapiens
tatgttcagaaatgtaaatgt

SEQ ID NO: 1052607 - DNA, 20 bp, Homo sapiens
tatgttcagcttataatgaa

SEQ ID NO: 1052608 - DNA, 13 bp, Homo sapiens
tatgttcatttgt

SEQ ID NO: 1052609 - DNA, 19 bp, Homo sapiens
tatgttcctaacaaaatga

SEQ ID NO: 1052610 - DNA, 22 bp, Homo sapiens
tatgttctgcaagaattaaaac

SEQ ID NO: 1052611 - DNA, 13 bp, Homo sapiens
tatgttcttggct

SEQ ID NO: 1052612 - DNA, 23 bp, Homo sapiens
tatgttcttgggtggttcctaag

SEQ ID NO: 1052613 - DNA, 16 bp, Homo sapiens
tatgttgaaaaaattt

SEQ ID NO: 1052614 - DNA, 12 bp, Homo sapiens
tatgttgaatac

SEQ ID NO: 1052615 - DNA, 15 bp, Homo sapiens
tatgttgaatacttt

SEQ ID NO: 1052616 - DNA, 14 bp, Homo sapiens
tatgttgacatttt

SEQ ID NO: 1052617 - DNA, 12 bp, Homo sapiens
tatgttgctatt

SEQ ID NO: 1052618 - DNA, 17 bp, Homo sapiens
tatgttgctattgtaag

SEQ ID NO: 1052619 - DNA, 20 bp, Homo sapiens
tatgttgctcagtctccctt

SEQ ID NO: 1052620 - DNA, 16 bp, Homo sapiens
tatgttggtttcagtg

SEQ ID NO: 1052621 - DNA, 18 bp, Homo sapiens
tatgttgtcataacattt

SEQ ID NO: 1052622 - DNA, 21 bp, Homo sapiens
tatgttgtccaattgttgaca

SEQ ID NO: 1052623 - DNA, 18 bp, Homo sapiens
tatgttgtttataataaa

SEQ ID NO: 1052624 - DNA, 13 bp, Homo sapiens
tatgtttaaaata

SEQ ID NO: 1052625 - DNA, 13 bp, Homo sapiens
tatgtttaatgtt

SEQ ID NO: 1052626 - DNA, 15 bp, Homo sapiens
tatgtttacacaatt

SEQ ID NO: 1052627 - DNA, 14 bp, Homo sapiens
tatgtttacatatc

SEQ ID NO: 1052628 - DNA, 15 bp, Homo sapiens
tatgtttattacaat

SEQ ID NO: 1052629 - DNA, 22 bp, Homo sapiens
tatgtttctctttgattatttg

SEQ ID NO: 1052630 - DNA, 23 bp, Homo sapiens
tatgtttctctttgattatttgc

SEQ ID NO: 1052631 - DNA, 18 bp, Homo sapiens
tatgtttgctgattattt

SEQ ID NO: 1052632 - DNA, 17 bp, Homo sapiens
tatgtttgtatttggaa

SEQ ID NO: 1052633 - DNA, 12 bp, Homo sapiens
tatgtttttagg

SEQ ID NO: 1052634 - DNA, 19 bp, Homo sapiens
tatgtttttaggattcccc

SEQ ID NO: 1052635 - DNA, 17 bp, Homo sapiens
tatgtttttgactcttt

SEQ ID NO: 1052636 - DNA, 15 bp, Homo sapiens
tatgtttttgttcaa

SEQ ID NO: 1052637 - DNA, 17 bp, Homo sapiens
tatgttttttagatcaa

SEQ ID NO: 1052638 - DNA, 18 bp, Homo sapiens
tatgttttttgtaagata

SEQ ID NO: 1052639 - DNA, 14 bp, Homo sapiens
tattaaaaaaaaca

SEQ ID NO: 1052640 - DNA, 23 bp, Homo sapiens
tattaaaaaaaacaaaaagaaca

SEQ ID NO: 1052641 - DNA, 17 bp, Homo sapiens
tattaaaaaagagacat

SEQ ID NO: 1052642 - DNA, 22 bp, Homo sapiens
tattaaaaataaacaagcattt

SEQ ID NO: 1052643 - DNA, 12 bp, Homo sapiens
tattaaaaatat

SEQ ID NO: 1052644 - DNA, 19 bp, Homo sapiens
tattaaaaatataaaactg

SEQ ID NO: 1052645 - DNA, 22 bp, Homo sapiens
tattaaaaatataaaactgcgt

SEQ ID NO: 1052646 - DNA, 16 bp, Homo sapiens
tattaaaaatctcaaa

SEQ ID NO: 1052647 - DNA, 18 bp, Homo sapiens
tattaaaaatctcaaatt

SEQ ID NO: 1052648 - DNA, 17 bp, Homo sapiens
tattaaaaatgttctca

SEQ ID NO: 1052649 - DNA, 21 bp, Homo sapiens
tattaaaaatgttctcaaata

SEQ ID NO: 1052650 - DNA, 13 bp, Homo sapiens
tattaaaatagca

SEQ ID NO: 1052651 - DNA, 14 bp, Homo sapiens
tattaaaatatatt

SEQ ID NO: 1052652 - DNA, 22 bp, Homo sapiens
tattaaaatatggctataaata

SEQ ID NO: 1052653 - DNA, 13 bp, Homo sapiens
tattaaaatctta

SEQ ID NO: 1052654 - DNA, 19 bp, Homo sapiens
tattaaaattccaaattca

SEQ ID NO: 1052655 - DNA, 14 bp, Homo sapiens
tattaaaatttggt

SEQ ID NO: 1052656 - DNA, 12 bp, Homo sapiens
tattaaacaaag

SEQ ID NO: 1052657 - DNA, 18 bp, Homo sapiens
tattaaacaaagtttcag

SEQ ID NO: 1052658 - DNA, 16 bp, Homo sapiens
tattaaacaattttgt

SEQ ID NO: 1052659 - DNA, 20 bp, Homo sapiens
tattaaacagatttttacaa

SEQ ID NO: 1052660 - DNA, 20 bp, Homo sapiens
tattaaagattctctttaaa

SEQ ID NO: 1052661 - DNA, 18 bp, Homo sapiens
tattaaagggtctggaaa

SEQ ID NO: 1052662 - DNA, 14 bp, Homo sapiens
tattaaagtattct

SEQ ID NO: 1052663 - DNA, 14 bp, Homo sapiens
tattaaagtgactt

SEQ ID NO: 1052664 - DNA, 14 bp, Homo sapiens
tattaaataaaatg

SEQ ID NO: 1052665 - DNA, 16 bp, Homo sapiens
tattaaatacaaaact

SEQ ID NO: 1052666 - DNA, 18 bp, Homo sapiens
tattaaatacaaaacttc

SEQ ID NO: 1052667 - DNA, 17 bp, Homo sapiens
tattaaatacagacact

SEQ ID NO: 1052668 - DNA, 18 bp, Homo sapiens
tattaaatacagacacta

SEQ ID NO: 1052669 - DNA, 17 bp, Homo sapiens
tattaaatagttaatat

SEQ ID NO: 1052670 - DNA, 23 bp, Homo sapiens
tattaaatataaatatccccagg

SEQ ID NO: 1052671 - DNA, 20 bp, Homo sapiens
tattaaatcttaaacaatgt

SEQ ID NO: 1052672 - DNA, 21 bp, Homo sapiens
tattaaatcttaaacaatgta

SEQ ID NO: 1052673 - DNA, 22 bp, Homo sapiens
tattaaatcttaaacaatgtat

SEQ ID NO: 1052674 - DNA, 16 bp, Homo sapiens
tattaaatgagggttt

SEQ ID NO: 1052675 - DNA, 12 bp, Homo sapiens
tattaaatgcca

SEQ ID NO: 1052676 - DNA, 12 bp, Homo sapiens
tattaaattatg

SEQ ID NO: 1052677 - DNA, 22 bp, Homo sapiens
tattaaatttgttgacaaaatt

SEQ ID NO: 1052678 - DNA, 20 bp, Homo sapiens
tattaaattttttgttgaca

SEQ ID NO: 1052679 - DNA, 23 bp, Homo sapiens
tattaaattttttgttgacatta

SEQ ID NO: 1052680 - DNA, 23 bp, Homo sapiens
tattaacaaacatcactctgctg

SEQ ID NO: 1052681 - DNA, 18 bp, Homo sapiens
tattaacaaattatgtta

SEQ ID NO: 1052682 - DNA, 23 bp, Homo sapiens
tattaacaacaataacactgtct

SEQ ID NO: 1052683 - DNA, 14 bp, Homo sapiens
tattaacaattaat

SEQ ID NO: 1052684 - DNA, 15 bp, Homo sapiens
tattaacaattaatt

SEQ ID NO: 1052685 - DNA, 17 bp, Homo sapiens
tattctgtggttctata

SEQ ID NO: 1052686 - DNA, 18 bp, Homo sapiens
tattctgtgttgaacaca

SEQ ID NO: 1052687 - DNA, 11 bp, Homo sapiens
tattctgttcc

SEQ ID NO: 1052688 - DNA, 13 bp, Homo sapiens
tattctgttttct

SEQ ID NO: 1052689 - DNA, 17 bp, Homo sapiens
tattctgttttcttgtt

SEQ ID NO: 1052690 - DNA, 21 bp, Homo sapiens
tattctgttttgttaatatac

SEQ ID NO: 1052691 - DNA, 16 bp, Homo sapiens
tattcttaagcacttt

SEQ ID NO: 1052692 - DNA, 15 bp, Homo sapiens
tatttttttctctat

SEQ ID NO: 1052693 - DNA, 18 bp, Homo sapiens
tatttttttcttaccaaa

SEQ ID NO: 1052694 - DNA, 17 bp, Homo sapiens
tatttttttgcaagtga

SEQ ID NO: 1052695 - DNA, 19 bp, Homo sapiens
tatttttttgcaagtgaag

SEQ ID NO: 1052696 - DNA, 13 bp, Homo sapiens
tatttttttgtac

SEQ ID NO: 1052697 - DNA, 19 bp, Homo sapiens
tatttttttttctaagaga

SEQ ID NO: 1052698 - DNA, 22 bp, Homo sapiens
tcaaaaaaaaaaaaaaaagcct

SEQ ID NO: 1052699 - DNA, 21 bp, Homo sapiens
tcaaaaaaaaaaaaaaagact

SEQ ID NO: 1052700 - DNA, 20 bp, Homo sapiens
tcaaaaaaaaaaaaatgcac

SEQ ID NO: 1052701 - DNA, 14 bp, Homo sapiens
tcaaaaaaacaaaa

SEQ ID NO: 1052702 - DNA, 14 bp, Homo sapiens
tcaaaaaacaaaaa

SEQ ID NO: 1052703 - DNA, 16 bp, Homo sapiens
tcaaaaaacctttaca

SEQ ID NO: 1052704 - DNA, 20 bp, Homo sapiens
tcaaaaaaggaaacttcctt

SEQ ID NO: 1052705 - DNA, 18 bp, Homo sapiens
tcaaaaaatcatgtttat

SEQ ID NO: 1052706 - DNA, 15 bp, Homo sapiens
tcaaaaacattctta

SEQ ID NO: 1052707 - DNA, 13 bp, Homo sapiens
tcaaaaactattt

SEQ ID NO: 1052708 - DNA, 18 bp, Homo sapiens
tcaaaaagccttattttt

SEQ ID NO: 1052709 - DNA, 18 bp, Homo sapiens
tcaaaaagctaatgtgca

SEQ ID NO: 1052710 - DNA, 21 bp, Homo sapiens
tcaaaaagtattatcattgct

SEQ ID NO: 1052711 - DNA, 12 bp, Homo sapiens
tcaaaaagtgtt

SEQ ID NO: 1052712 - DNA, 23 bp, Homo sapiens
tcaaaaagtgtttatttttcata

SEQ ID NO: 1052713 - DNA, 14 bp, Homo sapiens
tcaaaaataatgtg

SEQ ID NO: 1052714 - DNA, 13 bp, Homo sapiens
tcaaaaatataac

SEQ ID NO: 1052715 - DNA, 14 bp, Homo sapiens
tcaaaaatataact

SEQ ID NO: 1052716 - DNA, 21 bp, Homo sapiens
tcaaaacacatctttcctgtc

SEQ ID NO: 1052717 - DNA, 15 bp, Homo sapiens
tcaaaacactgtgga

SEQ ID NO: 1052718 - DNA, 20 bp, Homo sapiens
tcaaaacacttccagtctgg

SEQ ID NO: 1052719 - DNA, 20 bp, Homo sapiens
tcaaaacagaagcagcttct

SEQ ID NO: 1052720 - DNA, 14 bp, Homo sapiens
tcaaaacagattgt

SEQ ID NO: 1052721 - DNA, 19 bp, Homo sapiens
tcaaaacagattgtttgca

SEQ ID NO: 1052722 - DNA, 12 bp, Homo sapiens
tcaaaacattgt

SEQ ID NO: 1052723 - DNA, 18 bp, Homo sapiens
tcaaaacctgcagttaac

SEQ ID NO: 1052724 - DNA, 20 bp, Homo sapiens
tcaaaacctgcagttaacag

SEQ ID NO: 1052725 - DNA, 21 bp, Homo sapiens
tcaaaacctgtgccaggctga

SEQ ID NO: 1052726 - DNA, 20 bp, Homo sapiens
tcaaaacctttcaaatatca

SEQ ID NO: 1052727 - DNA, 18 bp, Homo sapiens
tcaaaacggggcagccaa

SEQ ID NO: 1052728 - DNA, 18 bp, Homo sapiens
tcaaaacgtgatgttttg

SEQ ID NO: 1052729 - DNA, 12 bp, Homo sapiens
tcaaaactggtt

SEQ ID NO: 1052730 - DNA, 16 bp, Homo sapiens
tcaaaactgtttgtta

SEQ ID NO: 1052731 - DNA, 13 bp, Homo sapiens
tcaaaacttaaga

SEQ ID NO: 1052732 - DNA, 21 bp, Homo sapiens
tcaaaacttggacccttggaa

SEQ ID NO: 1052733 - DNA, 22 bp, Homo sapiens
tcaaaacttggacccttggaaa

SEQ ID NO: 1052734 - DNA, 17 bp, Homo sapiens
tcaaaagaatctattag

SEQ ID NO: 1052735 - DNA, 15 bp, Homo sapiens
tcaaaagctggatta

SEQ ID NO: 1052736 - DNA, 17 bp, Homo sapiens
tcaaaaggaaaccaagt

SEQ ID NO: 1052737 - DNA, 16 bp, Homo sapiens
tcaaaagggaagagtt

SEQ ID NO: 1052738 - DNA, 15 bp, Homo sapiens
tcaaaagttgaaatt

SEQ ID NO: 1052739 - DNA, 12 bp, Homo sapiens
tcaaaataaaaa

SEQ ID NO: 1052740 - DNA, 20 bp, Homo sapiens
tcaaaataaaaagtgacaca

SEQ ID NO: 1052741 - DNA, 11 bp, Homo sapiens
tcaaaatacta

SEQ ID NO: 1052742 - DNA, 22 bp, Homo sapiens
tcaaaatagtttaggaaaatga

SEQ ID NO: 1052743 - DNA, 13 bp, Homo sapiens
tcaaaatattgag

SEQ ID NO: 1052744 - DNA, 12 bp, Homo sapiens
tcaaaatattta

SEQ ID NO: 1052745 - DNA, 14 bp, Homo sapiens
tcaaaatatttaaa

SEQ ID NO: 1052746 - DNA, 23 bp, Homo sapiens
tcaaaatatttaaaaatgtcttg

SEQ ID NO: 1052747 - DNA, 19 bp, Homo sapiens
tcaaaatatttgtacatag

SEQ ID NO: 1052748 - DNA, 18 bp, Homo sapiens
tcaaaatctttgtataaa

SEQ ID NO: 1052749 - DNA, 20 bp, Homo sapiens
tcaaaatctttgtataaata

SEQ ID NO: 1052750 - DNA, 17 bp, Homo sapiens
tcaaaatgctttttatt

SEQ ID NO: 1052751 - DNA, 19 bp, Homo sapiens
tcaaaatgctttttatttc

SEQ ID NO: 1052752 - DNA, 13 bp, Homo sapiens
tcaaaattacata

SEQ ID NO: 1052753 - DNA, 17 bp, Homo sapiens
tcaaaattctaaatgta

SEQ ID NO: 1052754 - DNA, 12 bp, Homo sapiens
tcaaaatttgca

SEQ ID NO: 1052755 - DNA, 17 bp, Homo sapiens
tcaaacacagttacact

SEQ ID NO: 1052756 - DNA, 15 bp, Homo sapiens
tcaaacagtaggttg

SEQ ID NO: 1052757 - DNA, 13 bp, Homo sapiens
tcaaacattttct

SEQ ID NO: 1052758 - DNA, 15 bp, Homo sapiens
tcaaacattttgaaa

SEQ ID NO: 1052759 - DNA, 13 bp, Homo sapiens
tcaaaccaaagct

SEQ ID NO: 1052760 - DNA, 18 bp, Homo sapiens
tcaaaccaaagctgcctg

SEQ ID NO: 1052761 - DNA, 19 bp, Homo sapiens
tcaaaccaaagctgcctgt

SEQ ID NO: 1052762 - DNA, 14 bp, Homo sapiens
tcaaaccaatttct

SEQ ID NO: 1052763 - DNA, 19 bp, Homo sapiens
tcaaaccacttgcctgggg

SEQ ID NO: 1052764 - DNA, 15 bp, Homo sapiens
tcaaaccagtcactt

SEQ ID NO: 1052765 - DNA, 17 bp, Homo sapiens
tcaaaccagtcactttt

SEQ ID NO: 1052766 - DNA, 20 bp, Homo sapiens
tcaaaccagtcacttttgtc

SEQ ID NO: 1052767 - DNA, 20 bp, Homo sapiens
tcaaaccccgaccacctgcc

SEQ ID NO: 1052768 - DNA, 15 bp, Homo sapiens
tcaaaccctagcctt

SEQ ID NO: 1052769 - DNA, 20 bp, Homo sapiens
tcaaaccgcactcacccatg

SEQ ID NO: 1052770 - DNA, 19 bp, Homo sapiens
tcaaacctggagctgagga

SEQ ID NO: 1052771 - DNA, 17 bp, Homo sapiens
tcaaacctttctggcct

SEQ ID NO: 1052772 - DNA, 18 bp, Homo sapiens
tcaaacctttctggcctg

SEQ ID NO: 1052773 - DNA, 22 bp, Homo sapiens
tcaaacctttctggcctgttat

SEQ ID NO: 1052774 - DNA, 18 bp, Homo sapiens
tcaaactacatattgtaa

SEQ ID NO: 1052775 - DNA, 20 bp, Homo sapiens
tcaaactcctgacctcaggt

SEQ ID NO: 1052776 - DNA, 23 bp, Homo sapiens
tcaaactctggggctcaagcagt

SEQ ID NO: 1052777 - DNA, 17 bp, Homo sapiens
tcaaactgaaattcaga

SEQ ID NO: 1052778 - DNA, 14 bp, Homo sapiens
tcaaactgcacatc

SEQ ID NO: 1052779 - DNA, 16 bp, Homo sapiens
tcaaactgcacatcta

SEQ ID NO: 1052780 - DNA, 20 bp, Homo sapiens
tcaaactgccttggcttcag

SEQ ID NO: 1052781 - DNA, 17 bp, Homo sapiens
tcaaactgctgcatact

SEQ ID NO: 1052782 - DNA, 16 bp, Homo sapiens
tcaaacttactatttt

SEQ ID NO: 1052783 - DNA, 22 bp, Homo sapiens
tcaaacttggatacttggattt

SEQ ID NO: 1052784 - DNA, 13 bp, Homo sapiens
tcaaactttacta

SEQ ID NO: 1052785 - DNA, 18 bp, Homo sapiens
tcaaactttttccagcaa

SEQ ID NO: 1052786 - DNA, 23 bp, Homo sapiens
tcaaagaaaaacaatgaaattga

SEQ ID NO: 1052787 - DNA, 14 bp, Homo sapiens
tcaaagaaaataga

SEQ ID NO: 1052788 - DNA, 12 bp, Homo sapiens
tcaaagaaagtg

SEQ ID NO: 1052789 - DNA, 15 bp, Homo sapiens
tcaaagaaagtgtat

SEQ ID NO: 1052790 - DNA, 16 bp, Homo sapiens
tcaaagaaagtgtatt

SEQ ID NO: 1052791 - DNA, 12 bp, Homo sapiens
tcaaagaaatcc

SEQ ID NO: 1052792 - DNA, 19 bp, Homo sapiens
tcaaagaaatgctgatgga

SEQ ID NO: 1052793 - DNA, 20 bp, Homo sapiens
tcaaagaaattcagaacagc

SEQ ID NO: 1052794 - DNA, 15 bp, Homo sapiens
tcaaagaacaaacat

SEQ ID NO: 1052795 - DNA, 15 bp, Homo sapiens
tcaaagaacagatgg

SEQ ID NO: 1052796 - DNA, 22 bp, Homo sapiens
tcaaagaaggtgctgatcctaa

SEQ ID NO: 1052797 - DNA, 23 bp, Homo sapiens
tcaaagaaggtttgtgtttttct

SEQ ID NO: 1052798 - DNA, 18 bp, Homo sapiens
tcaaagaattacagtaca

SEQ ID NO: 1052799 - DNA, 16 bp, Homo sapiens
tcaaagacagaatggt

SEQ ID NO: 1052800 - DNA, 14 bp, Homo sapiens
tcaaagagaagatg

SEQ ID NO: 1052801 - DNA, 15 bp, Homo sapiens
tcaaagagaagatgc

SEQ ID NO: 1052802 - DNA, 20 bp, Homo sapiens
tcaaagagatgggccttttc

SEQ ID NO: 1052803 - DNA, 23 bp, Homo sapiens
tcaaagagatgggccttttcttg

SEQ ID NO: 1052804 - DNA, 20 bp, Homo sapiens
tcaaagagggggctctgccc

SEQ ID NO: 1052805 - DNA, 23 bp, Homo sapiens
tcaaagaggtgaacattaaaata

SEQ ID NO: 1052806 - DNA, 23 bp, Homo sapiens
tcaaagaggttttaaaaaaatcc

SEQ ID NO: 1052807 - DNA, 19 bp, Homo sapiens
tcaaagatatagggtgtgg

SEQ ID NO: 1052808 - DNA, 13 bp, Homo sapiens
tcaaagatatttt

SEQ ID NO: 1052809 - DNA, 20 bp, Homo sapiens
tcaaagatattttgctttgt

SEQ ID NO: 1052810 - DNA, 17 bp, Homo sapiens
tcaaagatgcattttta

SEQ ID NO: 1052811 - DNA, 15 bp, Homo sapiens
tcaaagatgccccat

SEQ ID NO: 1052812 - DNA, 21 bp, Homo sapiens
tcaaagatgcgtttgcctcct

SEQ ID NO: 1052813 - DNA, 22 bp, Homo sapiens
tcaaagatgcgtttgcctcctg

SEQ ID NO: 1052814 - DNA, 13 bp, Homo sapiens
tcaaagcaagcat

SEQ ID NO: 1052815 - DNA, 19 bp, Homo sapiens
tcaaagcaagcattcagaa

SEQ ID NO: 1052816 - DNA, 19 bp, Homo sapiens
tcaaagcaagggctccagc

SEQ ID NO: 1052817 - DNA, 21 bp, Homo sapiens
tcaaggaatttcttaacttct

SEQ ID NO: 1052818 - DNA, 23 bp, Homo sapiens
tcaaggaatttcttaacttcttg

SEQ ID NO: 1052819 - DNA, 23 bp, Homo sapiens
tcaaggacagggctgagcgtgga

SEQ ID NO: 1052820 - DNA, 14 bp, Homo sapiens
tcaaggaccaagag

SEQ ID NO: 1052821 - DNA, 15 bp, Homo sapiens
tcaaggaccaagagc

SEQ ID NO: 1052822 - DNA, 23 bp, Homo sapiens
tcaaggaccaagagcaattgcag

SEQ ID NO: 1052823 - DNA, 16 bp, Homo sapiens
tcaaggagaatatgat

SEQ ID NO: 1052824 - DNA, 16 bp, Homo sapiens
tcaaggccacaaaaac

SEQ ID NO: 1052825 - DNA, 18 bp, Homo sapiens
tcaaggccacaaaaacaa

SEQ ID NO: 1052826 - DNA, 13 bp, Homo sapiens
tcaaggccacctt

SEQ ID NO: 1052827 - DNA, 20 bp, Homo sapiens
tcaaggccaccttggaggag

SEQ ID NO: 1052828 - DNA, 21 bp, Homo sapiens
tcaaggccctcggagctggct

SEQ ID NO: 1052829 - DNA, 22 bp, Homo sapiens
tcaaggccctcggagctggctg

SEQ ID NO: 1052830 - DNA, 17 bp, Homo sapiens
tcaaggccgagggccag

SEQ ID NO: 1052831 - DNA, 18 bp, Homo sapiens
tcaaggccgagggccagg

SEQ ID NO: 1052832 - DNA, 20 bp, Homo sapiens
tcaaggccgagggccaggca

SEQ ID NO: 1052833 - DNA, 22 bp, Homo sapiens
tcaaggcctccccaatccaggc

SEQ ID NO: 1052834 - DNA, 12 bp, Homo sapiens
tcaaggccttca

SEQ ID NO: 1052835 - DNA, 13 bp, Homo sapiens
tcaaggccttcag

SEQ ID NO: 1052836 - DNA, 14 bp, Homo sapiens
tcaaggccttcagt

SEQ ID NO: 1052837 - DNA, 13 bp, Homo sapiens
tcaaggccttcca

SEQ ID NO: 1052838 - DNA, 11 bp, Homo sapiens
tcaaggctcag

SEQ ID NO: 1052839 - DNA, 18 bp, Homo sapiens
tcaaggctgcttagaatc

SEQ ID NO: 1052840 - DNA, 16 bp, Homo sapiens
tcaaggctttaaaagt

SEQ ID NO: 1052841 - DNA, 13 bp, Homo sapiens
tcaagggaagaaa

SEQ ID NO: 1052842 - DNA, 18 bp, Homo sapiens
tcaagggtggcaggtcac

SEQ ID NO: 1052843 - DNA, 19 bp, Homo sapiens
tcaaggtcactgtttcctg

SEQ ID NO: 1052844 - DNA, 14 bp, Homo sapiens
tcaaggtccagtgg

SEQ ID NO: 1052845 - DNA, 18 bp, Homo sapiens
tcaaggtgagaattaagt

SEQ ID NO: 1052846 - DNA, 24 bp, Homo sapiens
tcaaggtgatatataatttcctca

SEQ ID NO: 1052847 - DNA, 13 bp, Homo sapiens
tcaaggtgtggaa

SEQ ID NO: 1052848 - DNA, 14 bp, Homo sapiens
tcaagtaacacttt

SEQ ID NO: 1052849 - DNA, 16 bp, Homo sapiens
tcaagtaagaagacat

SEQ ID NO: 1052850 - DNA, 22 bp, Homo sapiens
tcaagtaagaagacatgaacca

SEQ ID NO: 1052851 - DNA, 23 bp, Homo sapiens
tcaagtaagaagacatgaaccaa

SEQ ID NO: 1052852 - DNA, 23 bp, Homo sapiens
tcaagtaataggcattttaagta

SEQ ID NO: 1052853 - DNA, 18 bp, Homo sapiens
tcaagtaattttcatatt

SEQ ID NO: 1052854 - DNA, 16 bp, Homo sapiens
tcaagtatcttctatt

SEQ ID NO: 1052855 - DNA, 21 bp, Homo sapiens
tcaagtattatacctttttta

SEQ ID NO: 1052856 - DNA, 23 bp, Homo sapiens
tcaagtattataccttttttaga

SEQ ID NO: 1052857 - DNA, 15 bp, Homo sapiens
tcaagtcaaattaat

SEQ ID NO: 1052858 - DNA, 21 bp, Homo sapiens
tcaagtcatggcaggtacagt

SEQ ID NO: 1052859 - DNA, 13 bp, Homo sapiens
tcaagtcctctgg

SEQ ID NO: 1052860 - DNA, 21 bp, Homo sapiens
tcaagtgactctcctgcctca

SEQ ID NO: 1052861 - DNA, 15 bp, Homo sapiens
tcaagtgattctctt

SEQ ID NO: 1052862 - DNA, 19 bp, Homo sapiens
tcaagtgcatgctctctgc

SEQ ID NO: 1052863 - DNA, 21 bp, Homo sapiens
tcaagtgcatgctctctgcag

SEQ ID NO: 1052864 - DNA, 22 bp, Homo sapiens
tcaagtgcctcttgttgcagag

SEQ ID NO: 1052865 - DNA, 19 bp, Homo sapiens
tcaagtgcttaaaaatact

SEQ ID NO: 1052866 - DNA, 16 bp, Homo sapiens
tcaagtggggctcgcc

SEQ ID NO: 1052867 - DNA, 21 bp, Homo sapiens
tcaagtgttttggagaaaaaa

SEQ ID NO: 1052868 - DNA, 19 bp, Homo sapiens
tcaagttaacaaggaatgc

SEQ ID NO: 1052869 - DNA, 13 bp, Homo sapiens
tcaagttattgta

SEQ ID NO: 1052870 - DNA, 17 bp, Homo sapiens
tcaagttattgtacagc

SEQ ID NO: 1052871 - DNA, 13 bp, Homo sapiens
tcaagttcccaac

SEQ ID NO: 1052872 - DNA, 17 bp, Homo sapiens
tcaatgctttatttgta

SEQ ID NO: 1052873 - DNA, 19 bp, Homo sapiens
tcaatgctttatttgtaaa

SEQ ID NO: 1052874 - DNA, 20 bp, Homo sapiens
tcaatgctttatttgtaaat

SEQ ID NO: 1052875 - DNA, 21 bp, Homo sapiens
tcaatggcctaaaactggcct

SEQ ID NO: 1052876 - DNA, 14 bp, Homo sapiens
tcaatgggcaatga

SEQ ID NO: 1052877 - DNA, 17 bp, Homo sapiens
tcaatgggctcttccaa

SEQ ID NO: 1052878 - DNA, 16 bp, Homo sapiens
tcaatggtgcaaaaaa

SEQ ID NO: 1052879 - DNA, 20 bp, Homo sapiens
tcaatggtgcaaaaaaaaac

SEQ ID NO: 1052880 - DNA, 23 bp, Homo sapiens
tcaatggtgcaaaaaaaaactta

SEQ ID NO: 1052881 - DNA, 21 bp, Homo sapiens
tcaatggttgggacaatggca

SEQ ID NO: 1052882 - DNA, 18 bp, Homo sapiens
tcaatgtcagcctttgtt

SEQ ID NO: 1052883 - DNA, 13 bp, Homo sapiens
tcaatgtccagtg

SEQ ID NO: 1052884 - DNA, 14 bp, Homo sapiens
tcaatgtcttccca

SEQ ID NO: 1052885 - DNA, 11 bp, Homo sapiens
tcaatgtgaaa

SEQ ID NO: 1052886 - DNA, 14 bp, Homo sapiens
tcaatgtgtataaa

SEQ ID NO: 1052887 - DNA, 22 bp, Homo sapiens
tcaatgtgtataaattgtcttt

SEQ ID NO: 1052888 - DNA, 17 bp, Homo sapiens
tcaatgtgtctttctaa

SEQ ID NO: 1052889 - DNA, 14 bp, Homo sapiens
tcaatgttcattgt

SEQ ID NO: 1052890 - DNA, 24 bp, Homo sapiens
tcaatgttcattgtaatgttactg

SEQ ID NO: 1052891 - DNA, 12 bp, Homo sapiens
tcaatgttccat

SEQ ID NO: 1052892 - DNA, 14 bp, Homo sapiens
tcaatgtttttaaa

SEQ ID NO: 1052893 - DNA, 14 bp, Homo sapiens
tcaattaaaattac

SEQ ID NO: 1052894 - DNA, 19 bp, Homo sapiens
tcaattaaaattacaaaag

SEQ ID NO: 1052895 - DNA, 21 bp, Homo sapiens
tcaattaaagtctattcaaaa

SEQ ID NO: 1052896 - DNA, 14 bp, Homo sapiens
tcaattaaatgtag

SEQ ID NO: 1052897 - DNA, 11 bp, Homo sapiens
tcaattaataa

SEQ ID NO: 1052898 - DNA, 16 bp, Homo sapiens
tcaattactggtccaa

SEQ ID NO: 1052899 - DNA, 20 bp, Homo sapiens
tcaattactggtccaaaaga

SEQ ID NO: 1052900 - DNA, 19 bp, Homo sapiens
tcaattagaatagtgttct

SEQ ID NO: 1052901 - DNA, 19 bp, Homo sapiens
tcaattagtggtcataaaa

SEQ ID NO: 1052902 - DNA, 15 bp, Homo sapiens
tcaattcaatttgga

SEQ ID NO: 1052903 - DNA, 14 bp, Homo sapiens
tcaattccacctgc

SEQ ID NO: 1052904 - DNA, 13 bp, Homo sapiens
tcaattcctgggc

SEQ ID NO: 1052905 - DNA, 18 bp, Homo sapiens
tcaattctgtaattacat

SEQ ID NO: 1052906 - DNA, 17 bp, Homo sapiens
tcaattgcatctcccag

SEQ ID NO: 1052907 - DNA, 14 bp, Homo sapiens
tcaattgtaaattg

SEQ ID NO: 1052908 - DNA, 14 bp, Homo sapiens
tcaatttaagtgtt

SEQ ID NO: 1052909 - DNA, 21 bp, Homo sapiens
tcaatttaagtgttggaaaaa

SEQ ID NO: 1052910 - DNA, 16 bp, Homo sapiens
tcaatttatttgaatg

SEQ ID NO: 1052911 - DNA, 20 bp, Homo sapiens
tcaatttatttgaatgattt

SEQ ID NO: 1052912 - DNA, 19 bp, Homo sapiens
tcaatttctcccaaggcca

SEQ ID NO: 1052913 - DNA, 22 bp, Homo sapiens
tcactcagcccctacccctgcc

SEQ ID NO: 1052914 - DNA, 23 bp, Homo sapiens
tcactcagcccctacccctgccc

SEQ ID NO: 1052915 - DNA, 21 bp, Homo sapiens
tcactcagcttaattctcctt

SEQ ID NO: 1052916 - DNA, 21 bp, Homo sapiens
tcactcatcaatggggccagt

SEQ ID NO: 1052917 - DNA, 17 bp, Homo sapiens
tcactcattgctgagcc

SEQ ID NO: 1052918 - DNA, 14 bp, Homo sapiens
tcactccaaaaaca

SEQ ID NO: 1052919 - DNA, 15 bp, Homo sapiens
tcactccaaaaacag

SEQ ID NO: 1052920 - DNA, 17 bp, Homo sapiens
tcactccaagaccacca

SEQ ID NO: 1052921 - DNA, 22 bp, Homo sapiens
tcactccaagaccaccagggtc

SEQ ID NO: 1052922 - DNA, 13 bp, Homo sapiens
tcactccacagag

SEQ ID NO: 1052923 - DNA, 14 bp, Homo sapiens
tcactccacagagt

SEQ ID NO: 1052924 - DNA, 16 bp, Homo sapiens
tcactccaccacccaa

SEQ ID NO: 1052925 - DNA, 21 bp, Homo sapiens
tcactccaccatccccacccc

SEQ ID NO: 1052926 - DNA, 12 bp, Homo sapiens
tcactccagcca

SEQ ID NO: 1052927 - DNA, 14 bp, Homo sapiens
tcactccagccaaa

SEQ ID NO: 1052928 - DNA, 17 bp, Homo sapiens
tcactcccaagggacag

SEQ ID NO: 1052929 - DNA, 13 bp, Homo sapiens
tcactccccactc

SEQ ID NO: 1052930 - DNA, 14 bp, Homo sapiens
tcactccccaggga

SEQ ID NO: 1052931 - DNA, 17 bp, Homo sapiens
tcactccccagggagct

SEQ ID NO: 1052932 - DNA, 22 bp, Homo sapiens
tcactccccagggagctctggg

SEQ ID NO: 1052933 - DNA, 15 bp, Homo sapiens
tcactccctctgcag

SEQ ID NO: 1052934 - DNA, 20 bp, Homo sapiens
tcactccctctgcagaatcc

SEQ ID NO: 1052935 - DNA, 19 bp, Homo sapiens
tcactccggtgtgcctgca

SEQ ID NO: 1052936 - DNA, 15 bp, Homo sapiens
tcactcctacctggt

SEQ ID NO: 1052937 - DNA, 22 bp, Homo sapiens
tcactcctaggagagccaacct

SEQ ID NO: 1052938 - DNA, 21 bp, Homo sapiens
tcactcctgaattcagttgct

SEQ ID NO: 1052939 - DNA, 12 bp, Homo sapiens
tcactcctgctt

SEQ ID NO: 1052940 - DNA, 11 bp, Homo sapiens
tcactcctggg

SEQ ID NO: 1052941 - DNA, 14 bp, Homo sapiens
tcactccttttaaa

SEQ ID NO: 1052942 - DNA, 17 bp, Homo sapiens
tcactcggcaccctgca

SEQ ID NO: 1052943 - DNA, 21 bp, Homo sapiens
tcactctaagtcatgtatgtt

SEQ ID NO: 1052944 - DNA, 23 bp, Homo sapiens
tcactctctattgtcatggggat

SEQ ID NO: 1052945 - DNA, 15 bp, Homo sapiens
tcactctctgaagat

SEQ ID NO: 1052946 - DNA, 14 bp, Homo sapiens
tcactctgccctct

SEQ ID NO: 1052947 - DNA, 20 bp, Homo sapiens
tcactctgccctctgctgct

SEQ ID NO: 1052948 - DNA, 17 bp, Homo sapiens
tcactctgtcagccagc

SEQ ID NO: 1052949 - DNA, 20 bp, Homo sapiens
tcactctgtcagccagccgc

SEQ ID NO: 1052950 - DNA, 16 bp, Homo sapiens
tcactctgtcatcttt

SEQ ID NO: 1052951 - DNA, 14 bp, Homo sapiens
tcactcttcacttg

SEQ ID NO: 1052952 - DNA, 21 bp, Homo sapiens
tcactcttccagaatcccaag

SEQ ID NO: 1052953 - DNA, 16 bp, Homo sapiens
tcactcttggtccctg

SEQ ID NO: 1052954 - DNA, 14 bp, Homo sapiens
tcactctttagaaa

SEQ ID NO: 1052955 - DNA, 15 bp, Homo sapiens
tcactctttctccct

SEQ ID NO: 1052956 - DNA, 17 bp, Homo sapiens
tcactgaaaacatctgg

SEQ ID NO: 1052957 - DNA, 14 bp, Homo sapiens
tcactgaaacatgg

SEQ ID NO: 1052958 - DNA, 13 bp, Homo sapiens
tcactgaacaaaa

SEQ ID NO: 1052959 - DNA, 14 bp, Homo sapiens
tcactgaacatgcc

SEQ ID NO: 1052960 - DNA, 18 bp, Homo sapiens
tcactgaaccactgcttc

SEQ ID NO: 1052961 - DNA, 15 bp, Homo sapiens
tcactgaactccacc

SEQ ID NO: 1052962 - DNA, 19 bp, Homo sapiens
tcactgagaggcctggagc

SEQ ID NO: 1052963 - DNA, 18 bp, Homo sapiens
tcactgagagtcaggagt

SEQ ID NO: 1052964 - DNA, 18 bp, Homo sapiens
tcactgagccatcatttc

SEQ ID NO: 1052965 - DNA, 21 bp, Homo sapiens
tcactgaggccatcagggccc

SEQ ID NO: 1052966 - DNA, 18 bp, Homo sapiens
tcactgatgggaaaactg

SEQ ID NO: 1052967 - DNA, 14 bp, Homo sapiens
tcactgcaacctcc

SEQ ID NO: 1052968 - DNA, 18 bp, Homo sapiens
tcactgcaacctccgcct

SEQ ID NO: 1052969 - DNA, 17 bp, Homo sapiens
tcactgcaacctctgcc

SEQ ID NO: 1052970 - DNA, 15 bp, Homo sapiens
tcactgcacagtgca

SEQ ID NO: 1052971 - DNA, 22 bp, Homo sapiens
tcactgcacagtgcatctcagc

SEQ ID NO: 1052972 - DNA, 24 bp, Homo sapiens
tcactgcacagtgcatctcagccc

SEQ ID NO: 1052973 - DNA, 13 bp, Homo sapiens
tcactgcagaggg

SEQ ID NO: 1052974 - DNA, 14 bp, Homo sapiens
tcactgcagaggga

SEQ ID NO: 1052975 - DNA, 14 bp, Homo sapiens
tcactgcagcctca

SEQ ID NO: 1052976 - DNA, 22 bp, Homo sapiens
tcactgcagcctcaacctcctg

SEQ ID NO: 1052977 - DNA, 12 bp, Homo sapiens
tcactgccaaag

SEQ ID NO: 1052978 - DNA, 19 bp, Homo sapiens
tcactgccacactctccat

SEQ ID NO: 1052979 - DNA, 15 bp, Homo sapiens
tcactgccaggccag

SEQ ID NO: 1052980 - DNA, 11 bp, Homo sapiens
tcactgccatg

SEQ ID NO: 1052981 - DNA, 20 bp, Homo sapiens
tcactgccatgatagctggg

SEQ ID NO: 1052982 - DNA, 23 bp, Homo sapiens
tcactgccatggaattccctcct

SEQ ID NO: 1052983 - DNA, 20 bp, Homo sapiens
tcactgccccacttctggca

SEQ ID NO: 1052984 - DNA, 22 bp, Homo sapiens
tcactgccccacttctggcatg

SEQ ID NO: 1052985 - DNA, 22 bp, Homo sapiens
tcactgccctccctcggcccca

SEQ ID NO: 1052986 - DNA, 14 bp, Homo sapiens
tcactgcctgcaga

SEQ ID NO: 1052987 - DNA, 15 bp, Homo sapiens
tcactgcctgcagag

SEQ ID NO: 1052988 - DNA, 17 bp, Homo sapiens
tcactgccttggcccct

SEQ ID NO: 1052989 - DNA, 15 bp, Homo sapiens
tcactgctccttgct

SEQ ID NO: 1052990 - DNA, 14 bp, Homo sapiens
tcactgctgatttt

SEQ ID NO: 1052991 - DNA, 14 bp, Homo sapiens
tcactgctgctcct

SEQ ID NO: 1052992 - DNA, 15 bp, Homo sapiens
tcactgctgctcctc

SEQ ID NO: 1052993 - DNA, 12 bp, Homo sapiens
tcactgctggct

SEQ ID NO: 1052994 - DNA, 13 bp, Homo sapiens
tcactgctggctg

SEQ ID NO: 1052995 - DNA, 16 bp, Homo sapiens
tcactgctggctgcct

SEQ ID NO: 1052996 - DNA, 18 bp, Homo sapiens
tcactgctggctgcctta

SEQ ID NO: 1052997 - DNA, 22 bp, Homo sapiens
tcactgctggctgccttagaac

SEQ ID NO: 1052998 - DNA, 15 bp, Homo sapiens
tcactgcttgatgaa

SEQ ID NO: 1052999 - DNA, 15 bp, Homo sapiens
tcactggaaagggga

SEQ ID NO: 1053000 - DNA, 23 bp, Homo sapiens
tcactggaaaggggagagcctgc

SEQ ID NO: 1053001 - DNA, 14 bp, Homo sapiens
tcactggaatgaag

SEQ ID NO: 1053002 - DNA, 18 bp, Homo sapiens
tcactggaccactgggca

SEQ ID NO: 1053003 - DNA, 15 bp, Homo sapiens
tcactggactgcatg

SEQ ID NO: 1053004 - DNA, 13 bp, Homo sapiens
tcactggagccca

SEQ ID NO: 1053005 - DNA, 21 bp, Homo sapiens
tcactggaggagcagcttcct

SEQ ID NO: 1053006 - DNA, 16 bp, Homo sapiens
tcactggcaatgaaaa

SEQ ID NO: 1053007 - DNA, 13 bp, Homo sapiens
tcactggcagagc

SEQ ID NO: 1053008 - DNA, 18 bp, Homo sapiens
tcactggcagagcacagc

SEQ ID NO: 1053009 - DNA, 20 bp, Homo sapiens
tcactggcagagcacagccc

SEQ ID NO: 1053010 - DNA, 21 bp, Homo sapiens
tcactggcagagcacagccca

SEQ ID NO: 1053011 - DNA, 22 bp, Homo sapiens
tcactggcgacacgtagcagct

SEQ ID NO: 1053012 - DNA, 17 bp, Homo sapiens
tcactggctcatgcccc

SEQ ID NO: 1053013 - DNA, 13 bp, Homo sapiens
tcactggctctcc

SEQ ID NO: 1053014 - DNA, 15 bp, Homo sapiens
tcactggctctccaa

SEQ ID NO: 1053015 - DNA, 16 bp, Homo sapiens
tcactggctctccaag

SEQ ID NO: 1053016 - DNA, 19 bp, Homo sapiens
tcactggctctccaagtgc

SEQ ID NO: 1053017 - DNA, 17 bp, Homo sapiens
tcactggctctcctggc

SEQ ID NO: 1053018 - DNA, 18 bp, Homo sapiens
tcactggctctcctggcc

SEQ ID NO: 1053019 - DNA, 18 bp, Homo sapiens
tcactgggaagctcccac

SEQ ID NO: 1053020 - DNA, 17 bp, Homo sapiens
tcactggggatggtggc

SEQ ID NO: 1053021 - DNA, 20 bp, Homo sapiens
tcactggggatggtggcaca

SEQ ID NO: 1053022 - DNA, 23 bp, Homo sapiens
tcactggggatggtggcacaggc

SEQ ID NO: 1053023 - DNA, 17 bp, Homo sapiens
tcactggggcctacagc

SEQ ID NO: 1053024 - DNA, 17 bp, Homo sapiens
tcactggggtcctgggg

SEQ ID NO: 1053025 - DNA, 18 bp, Homo sapiens
tcactgggtggggtgagg

SEQ ID NO: 1053026 - DNA, 20 bp, Homo sapiens
tcactgggtggggtgaggac

SEQ ID NO: 1053027 - DNA, 17 bp, Homo sapiens
tcactggtcagggcagt

SEQ ID NO: 1053028 - DNA, 23 bp, Homo sapiens
tcactggtggatctaagaagggc

SEQ ID NO: 1053029 - DNA, 14 bp, Homo sapiens
tcactgtaaagaca

SEQ ID NO: 1053030 - DNA, 23 bp, Homo sapiens
tcactgtaaagacaaataaatga

SEQ ID NO: 1053031 - DNA, 17 bp, Homo sapiens
tcactgtagttttgagt

SEQ ID NO: 1053032 - DNA, 23 bp, Homo sapiens
tcagaacagcagactcagctctg

SEQ ID NO: 1053033 - DNA, 16 bp, Homo sapiens
tcagaacatactgatt

SEQ ID NO: 1053034 - DNA, 16 bp, Homo sapiens
tcagaacatgttaaga

SEQ ID NO: 1053035 - DNA, 23 bp, Homo sapiens
tcagaaccatttaagagactctt

SEQ ID NO: 1053036 - DNA, 17 bp, Homo sapiens
tcagaacctcttcccca

SEQ ID NO: 1053037 - DNA, 18 bp, Homo sapiens
tcagaacctcttccccag

SEQ ID NO: 1053038 - DNA, 20 bp, Homo sapiens
tcagaaccttgtcccagcca

SEQ ID NO: 1053039 - DNA, 22 bp, Homo sapiens
tcagaactaaatttttcataga

SEQ ID NO: 1053040 - DNA, 18 bp, Homo sapiens
tcagaacttgctgctgtc

SEQ ID NO: 1053041 - DNA, 18 bp, Homo sapiens
tcagaagaaaaagaagca

SEQ ID NO: 1053042 - DNA, 14 bp, Homo sapiens
tcagaagaaataaa

SEQ ID NO: 1053043 - DNA, 16 bp, Homo sapiens
tcagaagaaataaata

SEQ ID NO: 1053044 - DNA, 18 bp, Homo sapiens
tcagaagaacatgatttt

SEQ ID NO: 1053045 - DNA, 21 bp, Homo sapiens
tcagaagagaaatacagctgg

SEQ ID NO: 1053046 - DNA, 22 bp, Homo sapiens
tcagaagagaaatacagctggc

SEQ ID NO: 1053047 - DNA, 20 bp, Homo sapiens
tcagaagagactgatccaaa

SEQ ID NO: 1053048 - DNA, 14 bp, Homo sapiens
tcagaagatggtga

SEQ ID NO: 1053049 - DNA, 20 bp, Homo sapiens
tcagaagcacagaatatttt

SEQ ID NO: 1053050 - DNA, 12 bp, Homo sapiens
tcagaagcaggt

SEQ ID NO: 1053051 - DNA, 15 bp, Homo sapiens
tcagaaggagaagga

SEQ ID NO: 1053052 - DNA, 18 bp, Homo sapiens
tcagaaggagaaggaagg

SEQ ID NO: 1053053 - DNA, 19 bp, Homo sapiens
tcagaaggagaaggaagga

SEQ ID NO: 1053054 - DNA, 14 bp, Homo sapiens
tcagaaggccccag

SEQ ID NO: 1053055 - DNA, 15 bp, Homo sapiens
tcagaaggccccaga

SEQ ID NO: 1053056 - DNA, 15 bp, Homo sapiens
tcagaaggggacctg

SEQ ID NO: 1053057 - DNA, 18 bp, Homo sapiens
tcagaaggttcacccagc

SEQ ID NO: 1053058 - DNA, 17 bp, Homo sapiens
tcagaagtatatctgta

SEQ ID NO: 1053059 - DNA, 18 bp, Homo sapiens
tcagaagtcagcctacat

SEQ ID NO: 1053060 - DNA, 22 bp, Homo sapiens
tcagaagtcatcttgctaccag

SEQ ID NO: 1053061 - DNA, 21 bp, Homo sapiens
tcagaagtgagctttgctgct

SEQ ID NO: 1053062 - DNA, 12 bp, Homo sapiens
tcagaagtgatt

SEQ ID NO: 1053063 - DNA, 17 bp, Homo sapiens
tcagaagttagtttgta

SEQ ID NO: 1053064 - DNA, 20 bp, Homo sapiens
tcagaataaggcaggcattg

SEQ ID NO: 1053065 - DNA, 23 bp, Homo sapiens
tcagaatagctgttttgtgtata

SEQ ID NO: 1053066 - DNA, 22 bp, Homo sapiens
tcagaatagcttccaataaagc

SEQ ID NO: 1053067 - DNA, 14 bp, Homo sapiens
tcagaataggaaaa

SEQ ID NO: 1053068 - DNA, 15 bp, Homo sapiens
tcagaatcagaagat

SEQ ID NO: 1053069 - DNA, 17 bp, Homo sapiens
tcagaatcatggagaaa

SEQ ID NO: 1053070 - DNA, 22 bp, Homo sapiens
tcagaatcctttacattcaact

SEQ ID NO: 1053071 - DNA, 19 bp, Homo sapiens
tcagaatctaaacgtggtc

SEQ ID NO: 1053072 - DNA, 17 bp, Homo sapiens
tcagaatctttgttaag

SEQ ID NO: 1053073 - DNA, 23 bp, Homo sapiens
tcagaatgaaccctcctcctttt

SEQ ID NO: 1053074 - DNA, 15 bp, Homo sapiens
tcagaatgatttgta

SEQ ID NO: 1053075 - DNA, 18 bp, Homo sapiens
tcagaatgtaaaagaact

SEQ ID NO: 1053076 - DNA, 18 bp, Homo sapiens
tcagaattaaacttttaa

SEQ ID NO: 1053077 - DNA, 19 bp, Homo sapiens
tcagaattactgagttttt

SEQ ID NO: 1053078 - DNA, 22 bp, Homo sapiens
tcagaattagagcatgggaggt

SEQ ID NO: 1053079 - DNA, 14 bp, Homo sapiens
tcagaatttagtgt

SEQ ID NO: 1053080 - DNA, 22 bp, Homo sapiens
tcagaatttgtgttgaaggaac

SEQ ID NO: 1053081 - DNA, 21 bp, Homo sapiens
tcagacaaaatggatacataa

SEQ ID NO: 1053082 - DNA, 22 bp, Homo sapiens
tcagacaaaatggatacataaa

SEQ ID NO: 1053083 - DNA, 14 bp, Homo sapiens
tcagacaagcacta

SEQ ID NO: 1053084 - DNA, 18 bp, Homo sapiens
tcagacaagcactatttt

SEQ ID NO: 1053085 - DNA, 13 bp, Homo sapiens
tcagacacagatt

SEQ ID NO: 1053086 - DNA, 17 bp, Homo sapiens
tcagacaccctcaacct

SEQ ID NO: 1053087 - DNA, 22 bp, Homo sapiens
tcagacaccctcaacctcttct

SEQ ID NO: 1053088 - DNA, 23 bp, Homo sapiens
tcagacactgccgacatcagcat

SEQ ID NO: 1053089 - DNA, 18 bp, Homo sapiens
tcagacagaacccctaca

SEQ ID NO: 1053090 - DNA, 17 bp, Homo sapiens
tcagacagagaggactg

SEQ ID NO: 1053091 - DNA, 22 bp, Homo sapiens
tcagacagagaggactgtaggg

SEQ ID NO: 1053092 - DNA, 22 bp, Homo sapiens
tcagacagggtctgaaggactg

SEQ ID NO: 1053093 - DNA, 19 bp, Homo sapiens
tcagacatacagctgccta

SEQ ID NO: 1053094 - DNA, 22 bp, Homo sapiens
tcagacatacagctgcctacct

SEQ ID NO: 1053095 - DNA, 18 bp, Homo sapiens
tcagacatctccagtgtg

SEQ ID NO: 1053096 - DNA, 19 bp, Homo sapiens
tcagacatctccagtgtgc

SEQ ID NO: 1053097 - DNA, 22 bp, Homo sapiens
tcagacatctgaggttttattt

SEQ ID NO: 1053098 - DNA, 15 bp, Homo sapiens
tcagacatgttttcc

SEQ ID NO: 1053099 - DNA, 17 bp, Homo sapiens
tcagaccccagcggctg

SEQ ID NO: 1053100 - DNA, 15 bp, Homo sapiens
tcagaccccagttct

SEQ ID NO: 1053101 - DNA, 13 bp, Homo sapiens
tcagacccctgcc

SEQ ID NO: 1053102 - DNA, 14 bp, Homo sapiens
tcagacccctgcct

SEQ ID NO: 1053103 - DNA, 12 bp, Homo sapiens
tcagaccctgga

SEQ ID NO: 1053104 - DNA, 14 bp, Homo sapiens
tcagaccctggagg

SEQ ID NO: 1053105 - DNA, 22 bp, Homo sapiens
tcagacctgacaccgtccctca

SEQ ID NO: 1053106 - DNA, 13 bp, Homo sapiens
tcagacctgtctt

SEQ ID NO: 1053107 - DNA, 20 bp, Homo sapiens
tcagacctgtcttccaagga

SEQ ID NO: 1053108 - DNA, 23 bp, Homo sapiens
tcagacctgtcttccaaggagac

SEQ ID NO: 1053109 - DNA, 16 bp, Homo sapiens
tcagacgcctgaggaa

SEQ ID NO: 1053110 - DNA, 17 bp, Homo sapiens
tcagacgcctgaggaac

SEQ ID NO: 1053111 - DNA, 14 bp, Homo sapiens
tcagactagtgaca

SEQ ID NO: 1053112 - DNA, 15 bp, Homo sapiens
tcagactcaagtacc

SEQ ID NO: 1053113 - DNA, 19 bp, Homo sapiens
tcagactcaagtacccatt

SEQ ID NO: 1053114 - DNA, 11 bp, Homo sapiens
tcagactctgg

SEQ ID NO: 1053115 - DNA, 19 bp, Homo sapiens
tcagactgaacatgtacac

SEQ ID NO: 1053116 - DNA, 14 bp, Homo sapiens
tcagactgctggga

SEQ ID NO: 1053117 - DNA, 15 bp, Homo sapiens
tcagactgctgggac

SEQ ID NO: 1053118 - DNA, 16 bp, Homo sapiens
tcagactgctgggact

SEQ ID NO: 1053119 - DNA, 23 bp, Homo sapiens
tcagactgctgggactggccagg

SEQ ID NO: 1053120 - DNA, 20 bp, Homo sapiens
tcagactggctggctgcagt

SEQ ID NO: 1053121 - DNA, 21 bp, Homo sapiens
tcagactggctggctgcagtg

SEQ ID NO: 1053122 - DNA, 16 bp, Homo sapiens
tcagacttccaaatcc

SEQ ID NO: 1053123 - DNA, 23 bp, Homo sapiens
tcagacttccaaatcctggaagg

SEQ ID NO: 1053124 - DNA, 13 bp, Homo sapiens
tcagacttgtcaa

SEQ ID NO: 1053125 - DNA, 15 bp, Homo sapiens
tcagacttgtcaagc

SEQ ID NO: 1053126 - DNA, 17 bp, Homo sapiens
tcagactttcacaccat

SEQ ID NO: 1053127 - DNA, 12 bp, Homo sapiens
tcagactttgct

SEQ ID NO: 1053128 - DNA, 18 bp, Homo sapiens
tcagactttgctgcattt

SEQ ID NO: 1053129 - DNA, 19 bp, Homo sapiens
tcagactttgctgcatttt

SEQ ID NO: 1053130 - DNA, 23 bp, Homo sapiens
tcagactttgtgttcatttcatt

SEQ ID NO: 1053131 - DNA, 14 bp, Homo sapiens
tcagagaaaggact

SEQ ID NO: 1053132 - DNA, 12 bp, Homo sapiens
tcagagaatttc

SEQ ID NO: 1053133 - DNA, 13 bp, Homo sapiens
tcagagaatttct

SEQ ID NO: 1053134 - DNA, 23 bp, Homo sapiens
tcagagaatttctaccatttcag

SEQ ID NO: 1053135 - DNA, 15 bp, Homo sapiens
tcagagacagctgat

SEQ ID NO: 1053136 - DNA, 20 bp, Homo sapiens
tcagagacaggaagtcttca

SEQ ID NO: 1053137 - DNA, 23 bp, Homo sapiens
tcagagacaggaagtcttcaggg

SEQ ID NO: 1053138 - DNA, 19 bp, Homo sapiens
tcagagaccagcactcagc

SEQ ID NO: 1053139 - DNA, 20 bp, Homo sapiens
tcagagaccagggctccagc

SEQ ID NO: 1053140 - DNA, 17 bp, Homo sapiens
tcagagacctgaagtgt

SEQ ID NO: 1053141 - DNA, 19 bp, Homo sapiens
tcagagactgcccttctca

SEQ ID NO: 1053142 - DNA, 14 bp, Homo sapiens
tcagagagacctca

SEQ ID NO: 1053143 - DNA, 16 bp, Homo sapiens
tcagagagacctcatc

SEQ ID NO: 1053144 - DNA, 12 bp, Homo sapiens
tcagagagcagc

SEQ ID NO: 1053145 - DNA, 14 bp, Homo sapiens
tcagagagcctaga

SEQ ID NO: 1053146 - DNA, 16 bp, Homo sapiens
tcagagagctggtagt

SEQ ID NO: 1053147 - DNA, 19 bp, Homo sapiens
tcagatggaaaattcattt

SEQ ID NO: 1053148 - DNA, 21 bp, Homo sapiens
tcagatggaggttctcagagc

SEQ ID NO: 1053149 - DNA, 14 bp, Homo sapiens
tcagatgtaatgtt

SEQ ID NO: 1053150 - DNA, 17 bp, Homo sapiens
tcagatgtaatgttttc

SEQ ID NO: 1053151 - DNA, 14 bp, Homo sapiens
tcagatgtcccttg

SEQ ID NO: 1053152 - DNA, 23 bp, Homo sapiens
tcagatgtcccttgatgcacaga

SEQ ID NO: 1053153 - DNA, 13 bp, Homo sapiens
tcagatgtcttct

SEQ ID NO: 1053154 - DNA, 16 bp, Homo sapiens
tcagatgtcttctgcc

SEQ ID NO: 1053155 - DNA, 20 bp, Homo sapiens
tcagatgtcttctgcctgtt

SEQ ID NO: 1053156 - DNA, 17 bp, Homo sapiens
tcagatgtgttcctcca

SEQ ID NO: 1053157 - DNA, 16 bp, Homo sapiens
tcagatgttaaaataa

SEQ ID NO: 1053158 - DNA, 20 bp, Homo sapiens
tcagatgttaaaataaatgg

SEQ ID NO: 1053159 - DNA, 13 bp, Homo sapiens
tcagatgttttac

SEQ ID NO: 1053160 - DNA, 19 bp, Homo sapiens
tcagattcccagagcaaaa

SEQ ID NO: 1053161 - DNA, 21 bp, Homo sapiens
tcagattcccagagcaaaata

SEQ ID NO: 1053162 - DNA, 12 bp, Homo sapiens
tcagattgctga

SEQ ID NO: 1053163 - DNA, 13 bp, Homo sapiens
tcagattgctgaa

SEQ ID NO: 1053164 - DNA, 14 bp, Homo sapiens
tcagattgtcttgc

SEQ ID NO: 1053165 - DNA, 16 bp, Homo sapiens
tcagattgtcttgcaa

SEQ ID NO: 1053166 - DNA, 19 bp, Homo sapiens
tcagattgtcttgcaactt

SEQ ID NO: 1053167 - DNA, 23 bp, Homo sapiens
tcagattgttaagggcattttta

SEQ ID NO: 1053168 - DNA, 12 bp, Homo sapiens
tcagatttccat

SEQ ID NO: 1053169 - DNA, 13 bp, Homo sapiens
tcagatttccatt

SEQ ID NO: 1053170 - DNA, 21 bp, Homo sapiens
tcagatttgaactcttcaatc

SEQ ID NO: 1053171 - DNA, 16 bp, Homo sapiens
tcagatttgctgttca

SEQ ID NO: 1053172 - DNA, 19 bp, Homo sapiens
tcagattttaaaaagtctt

SEQ ID NO: 1053173 - DNA, 19 bp, Homo sapiens
tcagattttatattttcta

SEQ ID NO: 1053174 - DNA, 21 bp, Homo sapiens
tcagattttatattttctatt

SEQ ID NO: 1053175 - DNA, 21 bp, Homo sapiens
tcagattttctaagaaccaaa

SEQ ID NO: 1053176 - DNA, 17 bp, Homo sapiens
tcagattttttaaaatt

SEQ ID NO: 1053177 - DNA, 22 bp, Homo sapiens
tcagcaaaccatttttaaagta

SEQ ID NO: 1053178 - DNA, 15 bp, Homo sapiens
tcagcaaactctttt

SEQ ID NO: 1053179 - DNA, 14 bp, Homo sapiens
tcagcaaaggtctt

SEQ ID NO: 1053180 - DNA, 21 bp, Homo sapiens
tcagcaacctttcacctttgt

SEQ ID NO: 1053181 - DNA, 21 bp, Homo sapiens
tcagcaagttagaactagcca

SEQ ID NO: 1053182 - DNA, 18 bp, Homo sapiens
tcagcaatagggtgcagt

SEQ ID NO: 1053183 - DNA, 21 bp, Homo sapiens
tcagcacaggaattctcaaga

SEQ ID NO: 1053184 - DNA, 20 bp, Homo sapiens
tcagcaccacattgcctcat

SEQ ID NO: 1053185 - DNA, 12 bp, Homo sapiens
tcagcaccaccc

SEQ ID NO: 1053186 - DNA, 23 bp, Homo sapiens
tcagcaccaccctagtcccttcc

SEQ ID NO: 1053187 - DNA, 12 bp, Homo sapiens
tcagcaccccca

SEQ ID NO: 1053188 - DNA, 13 bp, Homo sapiens
tcagcacccccac

SEQ ID NO: 1053189 - DNA, 14 bp, Homo sapiens
tcagcacccccacc

SEQ ID NO: 1053190 - DNA, 13 bp, Homo sapiens
tcagcaccccttc

SEQ ID NO: 1053191 - DNA, 14 bp, Homo sapiens
tcagcaccccttcc

SEQ ID NO: 1053192 - DNA, 17 bp, Homo sapiens
tcagcaccctgggtgcc

SEQ ID NO: 1053193 - DNA, 19 bp, Homo sapiens
tcagcaccctgggtgccat

SEQ ID NO: 1053194 - DNA, 13 bp, Homo sapiens
tcagcaccttggc

SEQ ID NO: 1053195 - DNA, 18 bp, Homo sapiens
tcagcaccttggcccagg

SEQ ID NO: 1053196 - DNA, 12 bp, Homo sapiens
tcagcctcccct

SEQ ID NO: 1053197 - DNA, 21 bp, Homo sapiens
tcagcctcccgagtagctggg

SEQ ID NO: 1053198 - DNA, 20 bp, Homo sapiens
tcagcctccctagtagctgg

SEQ ID NO: 1053199 - DNA, 16 bp, Homo sapiens
tcagcctccctcagcc

SEQ ID NO: 1053200 - DNA, 17 bp, Homo sapiens
tcagcctcctgagcctg

SEQ ID NO: 1053201 - DNA, 14 bp, Homo sapiens
tcagcctctgcaac

SEQ ID NO: 1053202 - DNA, 12 bp, Homo sapiens
tcagcctcttaa

SEQ ID NO: 1053203 - DNA, 21 bp, Homo sapiens
tcagcctcttaaagctgcctg

SEQ ID NO: 1053204 - DNA, 22 bp, Homo sapiens
tcagcctcttaaagctgcctgt

SEQ ID NO: 1053205 - DNA, 14 bp, Homo sapiens
tcagcctcttctct

SEQ ID NO: 1053206 - DNA, 19 bp, Homo sapiens
tcagcctgagtctcctgtg

SEQ ID NO: 1053207 - DNA, 11 bp, Homo sapiens
tcagcctgccc

SEQ ID NO: 1053208 - DNA, 15 bp, Homo sapiens
tcagcctgcccacct

SEQ ID NO: 1053209 - DNA, 12 bp, Homo sapiens
tcagcctggaga

SEQ ID NO: 1053210 - DNA, 14 bp, Homo sapiens
tcagcctggagagg

SEQ ID NO: 1053211 - DNA, 17 bp, Homo sapiens
tcagcctggagaggcct

SEQ ID NO: 1053212 - DNA, 10 bp, Homo sapiens
tcagcctggg

SEQ ID NO: 1053213 - DNA, 22 bp, Homo sapiens
tcagcctggggctctctgaccc

SEQ ID NO: 1053214 - DNA, 23 bp, Homo sapiens
tcagcctggggctctctgacccg

SEQ ID NO: 1053215 - DNA, 17 bp, Homo sapiens
tcagcctggtgggcctc

SEQ ID NO: 1053216 - DNA, 19 bp, Homo sapiens
tcagcctggtgggcctcct

SEQ ID NO: 1053217 - DNA, 14 bp, Homo sapiens
tcagcctgtaccgg

SEQ ID NO: 1053218 - DNA, 17 bp, Homo sapiens
tcagccttaagaaccat

SEQ ID NO: 1053219 - DNA, 17 bp, Homo sapiens
tcagccttaccttgggg

SEQ ID NO: 1053220 - DNA, 23 bp, Homo sapiens
tcagccttcgtgtggctcctggt

SEQ ID NO: 1053221 - DNA, 12 bp, Homo sapiens
tcagccttctga

SEQ ID NO: 1053222 - DNA, 15 bp, Homo sapiens
tcagccttctttttc

SEQ ID NO: 1053223 - DNA, 18 bp, Homo sapiens
tcagccttctttttctgg

SEQ ID NO: 1053224 - DNA, 15 bp, Homo sapiens
tcagccttgcacacc

SEQ ID NO: 1053225 - DNA, 16 bp, Homo sapiens
tcagccttgtcctaat

SEQ ID NO: 1053226 - DNA, 21 bp, Homo sapiens
tcagcctttgttaaccttaaa

SEQ ID NO: 1053227 - DNA, 22 bp, Homo sapiens
tcagcctttgttaaccttaaat

SEQ ID NO: 1053228 - DNA, 17 bp, Homo sapiens
tcagcgaagtctcatgg

SEQ ID NO: 1053229 - DNA, 23 bp, Homo sapiens
tcagcgactccgttggccactcc

SEQ ID NO: 1053230 - DNA, 21 bp, Homo sapiens
tcagcgactggatgctcgcca

SEQ ID NO: 1053231 - DNA, 15 bp, Homo sapiens
tcagcgagaggcagc

SEQ ID NO: 1053232 - DNA, 16 bp, Homo sapiens
tcagcgagaggcagca

SEQ ID NO: 1053233 - DNA, 13 bp, Homo sapiens
tcagcgcaggctg

SEQ ID NO: 1053234 - DNA, 16 bp, Homo sapiens
tcagcgcaggctgcag

SEQ ID NO: 1053235 - DNA, 19 bp, Homo sapiens
tcagcgggcgctgctggga

SEQ ID NO: 1053236 - DNA, 15 bp, Homo sapiens
tcagctaaagaagtt

SEQ ID NO: 1053237 - DNA, 23 bp, Homo sapiens
tcagctaaagaagtttgaacatt

SEQ ID NO: 1053238 - DNA, 19 bp, Homo sapiens
tcagctaaatgcagggaaa

SEQ ID NO: 1053239 - DNA, 19 bp, Homo sapiens
tcagctacccactatcctt

SEQ ID NO: 1053240 - DNA, 15 bp, Homo sapiens
tcagctactaatgat

SEQ ID NO: 1053241 - DNA, 20 bp, Homo sapiens
tcagctactctagttctgtt

SEQ ID NO: 1053242 - DNA, 15 bp, Homo sapiens
tcaggacccagagga

SEQ ID NO: 1053243 - DNA, 16 bp, Homo sapiens
tcaggacccagaggaa

SEQ ID NO: 1053244 - DNA, 23 bp, Homo sapiens
tcaggacccaggccctccatggg

SEQ ID NO: 1053245 - DNA, 18 bp, Homo sapiens
tcaggaccccactggaga

SEQ ID NO: 1053246 - DNA, 17 bp, Homo sapiens
tcaggacctctgtaggc

SEQ ID NO: 1053247 - DNA, 23 bp, Homo sapiens
tcaggacctgggacctcccctga

SEQ ID NO: 1053248 - DNA, 16 bp, Homo sapiens
tcaggacggctcctca

SEQ ID NO: 1053249 - DNA, 18 bp, Homo sapiens
tcaggacggctcctcaga

SEQ ID NO: 1053250 - DNA, 12 bp, Homo sapiens
tcaggactctgc

SEQ ID NO: 1053251 - DNA, 16 bp, Homo sapiens
tcaggactctgcggga

SEQ ID NO: 1053252 - DNA, 21 bp, Homo sapiens
tcaggactctgcgggaggctg

SEQ ID NO: 1053253 - DNA, 15 bp, Homo sapiens
tcaggacttggtctg

SEQ ID NO: 1053254 - DNA, 20 bp, Homo sapiens
tcaggagaaagtaccctctt

SEQ ID NO: 1053255 - DNA, 20 bp, Homo sapiens
tcaggagaatagcttttact

SEQ ID NO: 1053256 - DNA, 19 bp, Homo sapiens
tcaggagactgggctctgg

SEQ ID NO: 1053257 - DNA, 15 bp, Homo sapiens
tcaggagaggggcag

SEQ ID NO: 1053258 - DNA, 18 bp, Homo sapiens
tcaggagcacaggcagct

SEQ ID NO: 1053259 - DNA, 10 bp, Homo sapiens
tcaggagccc

SEQ ID NO: 1053260 - DNA, 12 bp, Homo sapiens
tcaggagccccc

SEQ ID NO: 1053261 - DNA, 13 bp, Homo sapiens
tcaggagccccca

SEQ ID NO: 1053262 - DNA, 14 bp, Homo sapiens
tcaggagcttgggc

SEQ ID NO: 1053263 - DNA, 17 bp, Homo sapiens
tcaggaggaatactgaa

SEQ ID NO: 1053264 - DNA, 15 bp, Homo sapiens
tcaggaggaggctgc

SEQ ID NO: 1053265 - DNA, 20 bp, Homo sapiens
tcaggaggcagaggttgcag

SEQ ID NO: 1053266 - DNA, 23 bp, Homo sapiens
tcaggaggcagaggttgcagtga

SEQ ID NO: 1053267 - DNA, 15 bp, Homo sapiens
tcaggaggccctggt

SEQ ID NO: 1053268 - DNA, 22 bp, Homo sapiens
tcaggaggccctggtgtcaggc

SEQ ID NO: 1053269 - DNA, 17 bp, Homo sapiens
tcaggaggctgaggcac

SEQ ID NO: 1053270 - DNA, 18 bp, Homo sapiens
tcaggaggctgaggcaga

SEQ ID NO: 1053271 - DNA, 14 bp, Homo sapiens
tcaggagggcaggc

SEQ ID NO: 1053272 - DNA, 17 bp, Homo sapiens
tcaggagggcaggctga

SEQ ID NO: 1053273 - DNA, 21 bp, Homo sapiens
tcaggagggtcaccctggcct

SEQ ID NO: 1053274 - DNA, 19 bp, Homo sapiens
tcaggagggtgacgcccag

SEQ ID NO: 1053275 - DNA, 23 bp, Homo sapiens
tcaggagggtgacgcccagctcc

SEQ ID NO: 1053276 - DNA, 19 bp, Homo sapiens
tcaggagtcccaaggaaag

SEQ ID NO: 1053277 - DNA, 22 bp, Homo sapiens
tcaggagtctctggtagcctgc

SEQ ID NO: 1053278 - DNA, 20 bp, Homo sapiens
tcagggcctggggcctgaga

SEQ ID NO: 1053279 - DNA, 22 bp, Homo sapiens
tcagggcctggggcctgagaga

SEQ ID NO: 1053280 - DNA, 11 bp, Homo sapiens
tcagggccttg

SEQ ID NO: 1053281 - DNA, 15 bp, Homo sapiens
tcagggccttggccc

SEQ ID NO: 1053282 - DNA, 17 bp, Homo sapiens
tcagggcctttctcctc

SEQ ID NO: 1053283 - DNA, 19 bp, Homo sapiens
tcagggcctttctcctccc

SEQ ID NO: 1053284 - DNA, 20 bp, Homo sapiens
tcagggcctttctcctcccc

SEQ ID NO: 1053285 - DNA, 23 bp, Homo sapiens
tcagggcctttctcctccccacc

SEQ ID NO: 1053286 - DNA, 23 bp, Homo sapiens
tcagggcgataaaactaaatata

SEQ ID NO: 1053287 - DNA, 12 bp, Homo sapiens
tcagggctcaga

SEQ ID NO: 1053288 - DNA, 19 bp, Homo sapiens
tcagggctcagagtgaccc

SEQ ID NO: 1053289 - DNA, 18 bp, Homo sapiens
tcagggctcctcccagct

SEQ ID NO: 1053290 - DNA, 19 bp, Homo sapiens
tcagggctgagtgaatcaa

SEQ ID NO: 1053291 - DNA, 12 bp, Homo sapiens
tcagggctggag

SEQ ID NO: 1053292 - DNA, 14 bp, Homo sapiens
tcagggctggagcc

SEQ ID NO: 1053293 - DNA, 18 bp, Homo sapiens
tcagggctggagcctggg

SEQ ID NO: 1053294 - DNA, 15 bp, Homo sapiens
tcagggctgtcccag

SEQ ID NO: 1053295 - DNA, 18 bp, Homo sapiens
tcagggctgtcccagccc

SEQ ID NO: 1053296 - DNA, 19 bp, Homo sapiens
tcagggctgtcccagcccc

SEQ ID NO: 1053297 - DNA, 12 bp, Homo sapiens
tcaggggaaggg

SEQ ID NO: 1053298 - DNA, 16 bp, Homo sapiens
tcaggggactcagccc

SEQ ID NO: 1053299 - DNA, 14 bp, Homo sapiens
tcaggggcaggtgg

SEQ ID NO: 1053300 - DNA, 19 bp, Homo sapiens
tcaggggcaggtggtggag

SEQ ID NO: 1053301 - DNA, 12 bp, Homo sapiens
tcaggggccaga

SEQ ID NO: 1053302 - DNA, 14 bp, Homo sapiens
tcaggggccagaga

SEQ ID NO: 1053303 - DNA, 16 bp, Homo sapiens
tcaggggccagaggaa

SEQ ID NO: 1053304 - DNA, 15 bp, Homo sapiens
tcaggggcctctctc

SEQ ID NO: 1053305 - DNA, 18 bp, Homo sapiens
tcaggggcctctctcctg

SEQ ID NO: 1053306 - DNA, 15 bp, Homo sapiens
tcaggggctctgtgt

SEQ ID NO: 1053307 - DNA, 12 bp, Homo sapiens
tcaggggctggg

SEQ ID NO: 1053308 - DNA, 14 bp, Homo sapiens
tcaggggctgggca

SEQ ID NO: 1053309 - DNA, 17 bp, Homo sapiens
tcagtctaaggtctcat

SEQ ID NO: 1053310 - DNA, 18 bp, Homo sapiens
tcagtctcagaatgtcat

SEQ ID NO: 1053311 - DNA, 20 bp, Homo sapiens
tcagtctccctttcccttct

SEQ ID NO: 1053312 - DNA, 23 bp, Homo sapiens
tcagtctccctttcccttcttgg

SEQ ID NO: 1053313 - DNA, 12 bp, Homo sapiens
tcagtctcttcc

SEQ ID NO: 1053314 - DNA, 16 bp, Homo sapiens
tcagtctgcttagaaa

SEQ ID NO: 1053315 - DNA, 19 bp, Homo sapiens
tcagtctgcttagaaataa

SEQ ID NO: 1053316 - DNA, 12 bp, Homo sapiens
tcagtcttgtag

SEQ ID NO: 1053317 - DNA, 22 bp, Homo sapiens
tcagtctttcttagtgcctgtg

SEQ ID NO: 1053318 - DNA, 15 bp, Homo sapiens
tcagtctttgctcag

SEQ ID NO: 1053319 - DNA, 22 bp, Homo sapiens
tcagtgaaaagattttatttat

SEQ ID NO: 1053320 - DNA, 13 bp, Homo sapiens
tcagtgaactgtt

SEQ ID NO: 1053321 - DNA, 13 bp, Homo sapiens
tcagtgaagacta

SEQ ID NO: 1053322 - DNA, 16 bp, Homo sapiens
tcagtgaagtctagaa

SEQ ID NO: 1053323 - DNA, 12 bp, Homo sapiens
tcagtgaatttg

SEQ ID NO: 1053324 - DNA, 11 bp, Homo sapiens
tcagtgacaga

SEQ ID NO: 1053325 - DNA, 16 bp, Homo sapiens
tcagtgagcccctccc

SEQ ID NO: 1053326 - DNA, 19 bp, Homo sapiens
tcagtgagcccctccccag

SEQ ID NO: 1053327 - DNA, 20 bp, Homo sapiens
tcagtgagcctcctgtgcct

SEQ ID NO: 1053328 - DNA, 16 bp, Homo sapiens
tcagtgagctggggcc

SEQ ID NO: 1053329 - DNA, 14 bp, Homo sapiens
tcagtgaggcccag

SEQ ID NO: 1053330 - DNA, 14 bp, Homo sapiens
tcagtgatctatgt

SEQ ID NO: 1053331 - DNA, 21 bp, Homo sapiens
tcagtgatctatgtttgtgtg

SEQ ID NO: 1053332 - DNA, 23 bp, Homo sapiens
tcagtgatgccctcagagctctt

SEQ ID NO: 1053333 - DNA, 19 bp, Homo sapiens
tcagtgcaaattgtatctt

SEQ ID NO: 1053334 - DNA, 16 bp, Homo sapiens
tcagtgcacctgcctc

SEQ ID NO: 1053335 - DNA, 20 bp, Homo sapiens
tcagtgcacctgcctcagct

SEQ ID NO: 1053336 - DNA, 21 bp, Homo sapiens
tcagtgcagtgatacatgtac

SEQ ID NO: 1053337 - DNA, 12 bp, Homo sapiens
tcagtgcatcat

SEQ ID NO: 1053338 - DNA, 23 bp, Homo sapiens
tcagtgccacctatgcctgtggt

SEQ ID NO: 1053339 - DNA, 21 bp, Homo sapiens
tcagtgccacttgacattcct

SEQ ID NO: 1053340 - DNA, 18 bp, Homo sapiens
tcagtgccggaggccttg

SEQ ID NO: 1053341 - DNA, 14 bp, Homo sapiens
tcagtgccttcctc

SEQ ID NO: 1053342 - DNA, 14 bp, Homo sapiens
tcagtgccttttgg

SEQ ID NO: 1053343 - DNA, 20 bp, Homo sapiens
tcagtgctctcagctggcag

SEQ ID NO: 1053344 - DNA, 12 bp, Homo sapiens
tcagtgctgtgg

SEQ ID NO: 1053345 - DNA, 15 bp, Homo sapiens
tcagtgctgtggcct

SEQ ID NO: 1053346 - DNA, 16 bp, Homo sapiens
tcagtgcttgggctcc

SEQ ID NO: 1053347 - DNA, 15 bp, Homo sapiens
tcagtgctttttcct

SEQ ID NO: 1053348 - DNA, 19 bp, Homo sapiens
tcagtggaacacaaatgaa

SEQ ID NO: 1053349 - DNA, 23 bp, Homo sapiens
tcagtggaacacaaatgaaaatg

SEQ ID NO: 1053350 - DNA, 19 bp, Homo sapiens
tcagtggcatggctccagt

SEQ ID NO: 1053351 - DNA, 20 bp, Homo sapiens
tcagtggcatggctccagtc

SEQ ID NO: 1053352 - DNA, 16 bp, Homo sapiens
tcagtggctggaatta

SEQ ID NO: 1053353 - DNA, 12 bp, Homo sapiens
tcagtggcttcc

SEQ ID NO: 1053354 - DNA, 12 bp, Homo sapiens
tcagtgggagaa

SEQ ID NO: 1053355 - DNA, 14 bp, Homo sapiens
tcagtggtcttatt

SEQ ID NO: 1053356 - DNA, 14 bp, Homo sapiens
tcagtggtgggaga

SEQ ID NO: 1053357 - DNA, 20 bp, Homo sapiens
tcagtggttatttagggaac

SEQ ID NO: 1053358 - DNA, 16 bp, Homo sapiens
tcagtgtaaaaaggaa

SEQ ID NO: 1053359 - DNA, 18 bp, Homo sapiens
tcagtgtacacgtctgga

SEQ ID NO: 1053360 - DNA, 21 bp, Homo sapiens
tcagtgtatggaaataaatgt

SEQ ID NO: 1053361 - DNA, 22 bp, Homo sapiens
tcagtgtatggaaataaatgta

SEQ ID NO: 1053362 - DNA, 20 bp, Homo sapiens
tcagtgtcatttatgaaaag

SEQ ID NO: 1053363 - DNA, 15 bp, Homo sapiens
tcagtgtccagcttc

SEQ ID NO: 1053364 - DNA, 21 bp, Homo sapiens
tcagtgtccagcttccaaagc

SEQ ID NO: 1053365 - DNA, 21 bp, Homo sapiens
tcagtgtcccaggcagcacag

SEQ ID NO: 1053366 - DNA, 13 bp, Homo sapiens
tcagtgtcccggg

SEQ ID NO: 1053367 - DNA, 15 bp, Homo sapiens
tcagtgtctctgttt

SEQ ID NO: 1053368 - DNA, 16 bp, Homo sapiens
tcagtgtctctgtttt

SEQ ID NO: 1053369 - DNA, 13 bp, Homo sapiens
tcagtgtggagag

SEQ ID NO: 1053370 - DNA, 16 bp, Homo sapiens
tcagtgttacctgtgt

SEQ ID NO: 1053371 - DNA, 23 bp, Homo sapiens
tcagtgttactgcctataatctt

SEQ ID NO: 1053372 - DNA, 16 bp, Homo sapiens
tcagtgttagagaaat

SEQ ID NO: 1053373 - DNA, 11 bp, Homo sapiens
tcagtgtttaa

SEQ ID NO: 1053374 - DNA, 22 bp, Homo sapiens
tcagtgtttgggtcacccctcc

SEQ ID NO: 1053375 - DNA, 19 bp, Homo sapiens
tcagttaaaatcacatttt

SEQ ID NO: 1053376 - DNA, 16 bp, Homo sapiens
tcagttaactattgca

SEQ ID NO: 1053377 - DNA, 13 bp, Homo sapiens
tcagttaagaaat

SEQ ID NO: 1053378 - DNA, 23 bp, Homo sapiens
tcagttaattcaatgtgaacact

SEQ ID NO: 1053379 - DNA, 17 bp, Homo sapiens
tcagttaattcttagat

SEQ ID NO: 1053380 - DNA, 18 bp, Homo sapiens
tcagttaattcttagata

SEQ ID NO: 1053381 - DNA, 21 bp, Homo sapiens
tcagttaccaaacattacaaa

SEQ ID NO: 1053382 - DNA, 14 bp, Homo sapiens
tcagttactaagaa

SEQ ID NO: 1053383 - DNA, 16 bp, Homo sapiens
tcagttactcagccct

SEQ ID NO: 1053384 - DNA, 18 bp, Homo sapiens
tcagttactcagccctgg

SEQ ID NO: 1053385 - DNA, 19 bp, Homo sapiens
tcagttactcagccctggg

SEQ ID NO: 1053386 - DNA, 20 bp, Homo sapiens
tcagttatacagttataaaa

SEQ ID NO: 1053387 - DNA, 19 bp, Homo sapiens
tcagttatatgatattctt

SEQ ID NO: 1053388 - DNA, 17 bp, Homo sapiens
tcagttatcctttgtga

SEQ ID NO: 1053389 - DNA, 20 bp, Homo sapiens
tcagttcaccgctaaggaaa

SEQ ID NO: 1053390 - DNA, 16 bp, Homo sapiens
tcagttcatatgcaga

SEQ ID NO: 1053391 - DNA, 17 bp, Homo sapiens
tcagttcatatgcagaa

SEQ ID NO: 1053392 - DNA, 20 bp, Homo sapiens
tcagttccaggcctgatctt

SEQ ID NO: 1053393 - DNA, 17 bp, Homo sapiens
tcagttcccagctcccc

SEQ ID NO: 1053394 - DNA, 20 bp, Homo sapiens
tcagttcccggagcacagcc

SEQ ID NO: 1053395 - DNA, 13 bp, Homo sapiens
tcagttccctcct

SEQ ID NO: 1053396 - DNA, 15 bp, Homo sapiens
tcagttcccttggcc

SEQ ID NO: 1053397 - DNA, 16 bp, Homo sapiens
tcagttcccttggcct

SEQ ID NO: 1053398 - DNA, 18 bp, Homo sapiens
tcagttctctcccttcct

SEQ ID NO: 1053399 - DNA, 19 bp, Homo sapiens
tcagttctctcccttcctc

SEQ ID NO: 1053400 - DNA, 13 bp, Homo sapiens
tcagttctgatat

SEQ ID NO: 1053401 - DNA, 18 bp, Homo sapiens
tcagttcttggtgctctg

SEQ ID NO: 1053402 - DNA, 13 bp, Homo sapiens
tcagttgctttgc

SEQ ID NO: 1053403 - DNA, 12 bp, Homo sapiens
tcagttgtaata

SEQ ID NO: 1053404 - DNA, 20 bp, Homo sapiens
tcagttgtccttaaatttgt

SEQ ID NO: 1053405 - DNA, 13 bp, Homo sapiens
tcagttgtctctg

SEQ ID NO: 1053406 - DNA, 12 bp, Homo sapiens
tcagttgtgttt

SEQ ID NO: 1053407 - DNA, 18 bp, Homo sapiens
tcagttgtgttttttaag

SEQ ID NO: 1053408 - DNA, 19 bp, Homo sapiens
tcagttgtttgtttttgct

SEQ ID NO: 1053409 - DNA, 15 bp, Homo sapiens
tcagtttaatccttc

SEQ ID NO: 1053410 - DNA, 20 bp, Homo sapiens
tcagtttaatccttctagtt

SEQ ID NO: 1053411 - DNA, 17 bp, Homo sapiens
tcagtttcactccctct

SEQ ID NO: 1053412 - DNA, 20 bp, Homo sapiens
tcagtttccaattatttgac

SEQ ID NO: 1053413 - DNA, 13 bp, Homo sapiens
tcagtttcccctc

SEQ ID NO: 1053414 - DNA, 22 bp, Homo sapiens
tcagtttcttctgcgcctcagg

SEQ ID NO: 1053415 - DNA, 14 bp, Homo sapiens
tcagttttatcttt

SEQ ID NO: 1053416 - DNA, 12 bp, Homo sapiens
tcagttttcatt

SEQ ID NO: 1053417 - DNA, 22 bp, Homo sapiens
tcagttttgcttattgtgtgtt

SEQ ID NO: 1053418 - DNA, 16 bp, Homo sapiens
tcagtttttcatttgt

SEQ ID NO: 1053419 - DNA, 13 bp, Homo sapiens
tcagtttttgtat

SEQ ID NO: 1053420 - DNA, 17 bp, Homo sapiens
tcagtttttgtatcttg

SEQ ID NO: 1053421 - DNA, 18 bp, Homo sapiens
tcagtttttttaaatgcc

SEQ ID NO: 1053422 - DNA, 18 bp, Homo sapiens
tcagtttttttttttcca

SEQ ID NO: 1053423 - DNA, 16 bp, Homo sapiens
tcataaaaaataatgg

SEQ ID NO: 1053424 - DNA, 20 bp, Homo sapiens
tcataaaaagcaaaacaaaa

SEQ ID NO: 1053425 - DNA, 12 bp, Homo sapiens
tcataaaactca

SEQ ID NO: 1053426 - DNA, 21 bp, Homo sapiens
tcataaaatagaataattctt

SEQ ID NO: 1053427 - DNA, 11 bp, Homo sapiens
tcataaaatgc

SEQ ID NO: 1053428 - DNA, 21 bp, Homo sapiens
tcataaaatgcatactgttga

SEQ ID NO: 1053429 - DNA, 11 bp, Homo sapiens
tcataaacttt

SEQ ID NO: 1053430 - DNA, 16 bp, Homo sapiens
tcataaagatgttaaa

SEQ ID NO: 1053431 - DNA, 18 bp, Homo sapiens
tcataaagatgttaaatg

SEQ ID NO: 1053432 - DNA, 17 bp, Homo sapiens
tcataaagggttgaaaa

SEQ ID NO: 1053433 - DNA, 20 bp, Homo sapiens
tcataaagggttgaaaatgt

SEQ ID NO: 1053434 - DNA, 13 bp, Homo sapiens
tcataaagtgaga

SEQ ID NO: 1053435 - DNA, 18 bp, Homo sapiens
tcataaatcagaaagttt

SEQ ID NO: 1053436 - DNA, 12 bp, Homo sapiens
tcataaatgaag

SEQ ID NO: 1053437 - DNA, 16 bp, Homo sapiens
tcataacatttaaaga

SEQ ID NO: 1053438 - DNA, 13 bp, Homo sapiens
tcataaggcctgc

SEQ ID NO: 1053439 - DNA, 15 bp, Homo sapiens
tcataagtaaaccta

SEQ ID NO: 1053440 - DNA, 20 bp, Homo sapiens
tcataagtatttcaaattgg

SEQ ID NO: 1053441 - DNA, 13 bp, Homo sapiens
tcataataaagtt

SEQ ID NO: 1053442 - DNA, 17 bp, Homo sapiens
tcataataaagttgttt

SEQ ID NO: 1053443 - DNA, 19 bp, Homo sapiens
tcataataaagttgtttta

SEQ ID NO: 1053444 - DNA, 19 bp, Homo sapiens
tcataataaatatctgtac

SEQ ID NO: 1053445 - DNA, 15 bp, Homo sapiens
tcataataggtagtt

SEQ ID NO: 1053446 - DNA, 21 bp, Homo sapiens
tcataataggtagtttggata

SEQ ID NO: 1053447 - DNA, 20 bp, Homo sapiens
tcataatcagtaaatagtgt

SEQ ID NO: 1053448 - DNA, 12 bp, Homo sapiens
tcataatgaaaa

SEQ ID NO: 1053449 - DNA, 12 bp, Homo sapiens
tcataattacat

SEQ ID NO: 1053450 - DNA, 23 bp, Homo sapiens
tcataattcctacagcactactg

SEQ ID NO: 1053451 - DNA, 14 bp, Homo sapiens
tcataattctgaaa

SEQ ID NO: 1053452 - DNA, 13 bp, Homo sapiens
tcataattggaat

SEQ ID NO: 1053453 - DNA, 19 bp, Homo sapiens
tcataatttgtttccagca

SEQ ID NO: 1053454 - DNA, 12 bp, Homo sapiens
tcatacatatat

SEQ ID NO: 1053455 - DNA, 20 bp, Homo sapiens
tcatacatatatatatttgt

SEQ ID NO: 1053456 - DNA, 22 bp, Homo sapiens
tcataccacttgaatttattga

SEQ ID NO: 1053457 - DNA, 18 bp, Homo sapiens
tcataccgcctcgtgcca

SEQ ID NO: 1053458 - DNA, 20 bp, Homo sapiens
tcataccgcctcgtgccagc

SEQ ID NO: 1053459 - DNA, 22 bp, Homo sapiens
tcataccgcctcgtgccagcag

SEQ ID NO: 1053460 - DNA, 24 bp, Homo sapiens
tcataccgcctcgtgccagcagcc

SEQ ID NO: 1053461 - DNA, 18 bp, Homo sapiens
tcatacctcagaatgtaa

SEQ ID NO: 1053462 - DNA, 14 bp, Homo sapiens
tcatacgcatccca

SEQ ID NO: 1053463 - DNA, 16 bp, Homo sapiens
tcatacgggtcagtag

SEQ ID NO: 1053464 - DNA, 20 bp, Homo sapiens
tcatactactgaaacagatt

SEQ ID NO: 1053465 - DNA, 15 bp, Homo sapiens
tcatactcctgggct

SEQ ID NO: 1053466 - DNA, 18 bp, Homo sapiens
tcatactgcctactgtta

SEQ ID NO: 1053467 - DNA, 20 bp, Homo sapiens
tcatactgttttgaataaat

SEQ ID NO: 1053468 - DNA, 22 bp, Homo sapiens
tcatactgttttgaataaattt

SEQ ID NO: 1053469 - DNA, 17 bp, Homo sapiens
tcatagaaaattgaaac

SEQ ID NO: 1053470 - DNA, 20 bp, Homo sapiens
tcatagaaacttcatggttt

SEQ ID NO: 1053471 - DNA, 13 bp, Homo sapiens
tcatagaaatgta

SEQ ID NO: 1053472 - DNA, 22 bp, Homo sapiens
tcatagaaatgtaacttttgta

SEQ ID NO: 1053473 - DNA, 15 bp, Homo sapiens
tcatagagaggcctg

SEQ ID NO: 1053474 - DNA, 20 bp, Homo sapiens
tcatagagatttgtctaatt

SEQ ID NO: 1053475 - DNA, 18 bp, Homo sapiens
tcatagaggtgagaaaac

SEQ ID NO: 1053476 - DNA, 19 bp, Homo sapiens
tcatagattattataaact

SEQ ID NO: 1053477 - DNA, 21 bp, Homo sapiens
tcatagattattataaactat

SEQ ID NO: 1053478 - DNA, 15 bp, Homo sapiens
tcatagattgcaaat

SEQ ID NO: 1053479 - DNA, 19 bp, Homo sapiens
tcatagatttgaaaaactt

SEQ ID NO: 1053480 - DNA, 20 bp, Homo sapiens
tcatagatttgaaaaacttt

SEQ ID NO: 1053481 - DNA, 17 bp, Homo sapiens
tcatagcatagccagca

SEQ ID NO: 1053482 - DNA, 14 bp, Homo sapiens
tcatagcattaact

SEQ ID NO: 1053483 - DNA, 21 bp, Homo sapiens
tcatagcccagatcagctcct

SEQ ID NO: 1053484 - DNA, 22 bp, Homo sapiens
tcatagccctcagacatttata

SEQ ID NO: 1053485 - DNA, 16 bp, Homo sapiens
tcataggaagtggctg

SEQ ID NO: 1053486 - DNA, 23 bp, Homo sapiens
tcataggaagtggctggtctgga

SEQ ID NO: 1053487 - DNA, 13 bp, Homo sapiens
tcataggagactg

SEQ ID NO: 1053488 - DNA, 18 bp, Homo sapiens
tcataggcggtcatgtgt

SEQ ID NO: 1053489 - DNA, 22 bp, Homo sapiens
tcataggcggtcatgtgtgcat

SEQ ID NO: 1053490 - DNA, 23 bp, Homo sapiens
tcataggcggtcatgtgtgcatg

SEQ ID NO: 1053491 - DNA, 21 bp, Homo sapiens
tcatagggaaaggttttgtat

SEQ ID NO: 1053492 - DNA, 17 bp, Homo sapiens
tcatagggtctcttcag

SEQ ID NO: 1053493 - DNA, 18 bp, Homo sapiens
tcatagggtctcttcagg

SEQ ID NO: 1053494 - DNA, 22 bp, Homo sapiens
tcataggtagaaacaaatactt

SEQ ID NO: 1053495 - DNA, 15 bp, Homo sapiens
tcataggtctgaaat

SEQ ID NO: 1053496 - DNA, 23 bp, Homo sapiens
tcataggttaaaaaaaaaagtca

SEQ ID NO: 1053497 - DNA, 16 bp, Homo sapiens
tcatagtaacttctta

SEQ ID NO: 1053498 - DNA, 22 bp, Homo sapiens
tcatagtactctttgtagcaaa

SEQ ID NO: 1053499 - DNA, 22 bp, Homo sapiens
tcatagtagtttttacagctgt

SEQ ID NO: 1053500 - DNA, 12 bp, Homo sapiens
tcatagtgcctt

SEQ ID NO: 1053501 - DNA, 16 bp, Homo sapiens
tcatagtgcctttttc

SEQ ID NO: 1053502 - DNA, 15 bp, Homo sapiens
tcatataaaaacaca

SEQ ID NO: 1053503 - DNA, 18 bp, Homo sapiens
tcatataaagtatcatca

SEQ ID NO: 1053504 - DNA, 12 bp, Homo sapiens
tcatatacttat

SEQ ID NO: 1053505 - DNA, 22 bp, Homo sapiens
tcatatatggggggccaacacc

SEQ ID NO: 1053506 - DNA, 17 bp, Homo sapiens
tcatatcactaaataaa

SEQ ID NO: 1053507 - DNA, 19 bp, Homo sapiens
tcatatcatttcactgtct

SEQ ID NO: 1053508 - DNA, 14 bp, Homo sapiens
tcatatcatttctt

SEQ ID NO: 1053509 - DNA, 15 bp, Homo sapiens
tcatatccagctgag

SEQ ID NO: 1053510 - DNA, 20 bp, Homo sapiens
tcatatctcttgcccttcct

SEQ ID NO: 1053511 - DNA, 18 bp, Homo sapiens
tcatatctggctcaacat

SEQ ID NO: 1053512 - DNA, 19 bp, Homo sapiens
tcatatgccaccccatgtg

SEQ ID NO: 1053513 - DNA, 21 bp, Homo sapiens
tcatatggagctcatgtcagc

SEQ ID NO: 1053514 - DNA, 22 bp, Homo sapiens
tcatatggttgaataaataatt

SEQ ID NO: 1053515 - DNA, 19 bp, Homo sapiens
tcatgctccaagactttag

SEQ ID NO: 1053516 - DNA, 14 bp, Homo sapiens
tcatgctccttaat

SEQ ID NO: 1053517 - DNA, 14 bp, Homo sapiens
tcatgctgggattt

SEQ ID NO: 1053518 - DNA, 15 bp, Homo sapiens
tcatgcttcttctca

SEQ ID NO: 1053519 - DNA, 20 bp, Homo sapiens
tcatggaatggacatcctgt

SEQ ID NO: 1053520 - DNA, 17 bp, Homo sapiens
tcatggacactttgaaa

SEQ ID NO: 1053521 - DNA, 16 bp, Homo sapiens
tcatggaccaaatgtg

SEQ ID NO: 1053522 - DNA, 20 bp, Homo sapiens
tcatggagaagtgaaggcat

SEQ ID NO: 1053523 - DNA, 20 bp, Homo sapiens
tcatggagacctcatgccat

SEQ ID NO: 1053524 - DNA, 20 bp, Homo sapiens
tcatggattcattacagctt

SEQ ID NO: 1053525 - DNA, 15 bp, Homo sapiens
tcatggattgccaca

SEQ ID NO: 1053526 - DNA, 18 bp, Homo sapiens
tcatggattgccacagct

SEQ ID NO: 1053527 - DNA, 11 bp, Homo sapiens
tcatggcagct

SEQ ID NO: 1053528 - DNA, 13 bp, Homo sapiens
tcatggcagctgt

SEQ ID NO: 1053529 - DNA, 22 bp, Homo sapiens
tcatggcagctgtttctcatga

SEQ ID NO: 1053530 - DNA, 18 bp, Homo sapiens
tcatggcgtaatgggcct

SEQ ID NO: 1053531 - DNA, 20 bp, Homo sapiens
tcatggcgtaatgggcctgc

SEQ ID NO: 1053532 - DNA, 13 bp, Homo sapiens
tcatggctgaagt

SEQ ID NO: 1053533 - DNA, 15 bp, Homo sapiens
tcatggctgaagttg

SEQ ID NO: 1053534 - DNA, 18 bp, Homo sapiens
tcatggctgtgtccactg

SEQ ID NO: 1053535 - DNA, 18 bp, Homo sapiens
tcatggcttaatgtttat

SEQ ID NO: 1053536 - DNA, 21 bp, Homo sapiens
tcatgggaaaagaccagggct

SEQ ID NO: 1053537 - DNA, 17 bp, Homo sapiens
tcatgggaacgcagcct

SEQ ID NO: 1053538 - DNA, 17 bp, Homo sapiens
tcatgggagcatgctta

SEQ ID NO: 1053539 - DNA, 14 bp, Homo sapiens
tcatggggtccaag

SEQ ID NO: 1053540 - DNA, 14 bp, Homo sapiens
tcatgggtcctagc

SEQ ID NO: 1053541 - DNA, 23 bp, Homo sapiens
tcatgggtcctagcccttccctg

SEQ ID NO: 1053542 - DNA, 16 bp, Homo sapiens
tcatggtaatgacaga

SEQ ID NO: 1053543 - DNA, 21 bp, Homo sapiens
tcatggtgaccaccccctgtt

SEQ ID NO: 1053544 - DNA, 23 bp, Homo sapiens
tcatggtgggttcaggggactca

SEQ ID NO: 1053545 - DNA, 17 bp, Homo sapiens
tcatgtaaactgtgcac

SEQ ID NO: 1053546 - DNA, 14 bp, Homo sapiens
tcatgtaaataaat

SEQ ID NO: 1053547 - DNA, 14 bp, Homo sapiens
tcatgtaaatgctc

SEQ ID NO: 1053548 - DNA, 13 bp, Homo sapiens
tcatgtaaattga

SEQ ID NO: 1053549 - DNA, 11 bp, Homo sapiens
tcatgtaacat

SEQ ID NO: 1053550 - DNA, 13 bp, Homo sapiens
tcatgtaacattg

SEQ ID NO: 1053551 - DNA, 16 bp, Homo sapiens
tcatgtaatgtggtca

SEQ ID NO: 1053552 - DNA, 17 bp, Homo sapiens
tcatgtaatttgcatta

SEQ ID NO: 1053553 - DNA, 13 bp, Homo sapiens
tcatgtaatttta

SEQ ID NO: 1053554 - DNA, 16 bp, Homo sapiens
tcatgtacaagatgaa

SEQ ID NO: 1053555 - DNA, 17 bp, Homo sapiens
tcatgtacaagatgaag

SEQ ID NO: 1053556 - DNA, 18 bp, Homo sapiens
tcatgtacaagatgaagg

SEQ ID NO: 1053557 - DNA, 15 bp, Homo sapiens
tcatgtaccatcaat

SEQ ID NO: 1053558 - DNA, 17 bp, Homo sapiens
tcattatctgagttgca

SEQ ID NO: 1053559 - DNA, 17 bp, Homo sapiens
tcattatgaaaaacatc

SEQ ID NO: 1053560 - DNA, 13 bp, Homo sapiens
tcattatgctttg

SEQ ID NO: 1053561 - DNA, 14 bp, Homo sapiens
tcattatgctttga

SEQ ID NO: 1053562 - DNA, 15 bp, Homo sapiens
tcattatgctttgaa

SEQ ID NO: 1053563 - DNA, 13 bp, Homo sapiens
tcattattcaaga

SEQ ID NO: 1053564 - DNA, 18 bp, Homo sapiens
tcattattcaagaatgaa

SEQ ID NO: 1053565 - DNA, 13 bp, Homo sapiens
tcattattcctca

SEQ ID NO: 1053566 - DNA, 21 bp, Homo sapiens
tcattattggaattaacctgg

SEQ ID NO: 1053567 - DNA, 14 bp, Homo sapiens
tcattattggaggg

SEQ ID NO: 1053568 - DNA, 14 bp, Homo sapiens
tcattatttcagtg

SEQ ID NO: 1053569 - DNA, 15 bp, Homo sapiens
tcattatttcagtgt

SEQ ID NO: 1053570 - DNA, 13 bp, Homo sapiens
tcattatttgtca

SEQ ID NO: 1053571 - DNA, 19 bp, Homo sapiens
tcattatttgtcaaattgt

SEQ ID NO: 1053572 - DNA, 15 bp, Homo sapiens
tcattattttgtggt

SEQ ID NO: 1053573 - DNA, 22 bp, Homo sapiens
tcattatttttgttagcaaaga

SEQ ID NO: 1053574 - DNA, 16 bp, Homo sapiens
tcattcaaaagttgaa

SEQ ID NO: 1053575 - DNA, 18 bp, Homo sapiens
tcattcaaaagttgaaat

SEQ ID NO: 1053576 - DNA, 21 bp, Homo sapiens
tcattcaaatcagtgatctat

SEQ ID NO: 1053577 - DNA, 16 bp, Homo sapiens
tcattcaagctattta

SEQ ID NO: 1053578 - DNA, 22 bp, Homo sapiens
tcattcaagtgtaaaatatttt

SEQ ID NO: 1053579 - DNA, 14 bp, Homo sapiens
tcattcactgtgca

SEQ ID NO: 1053580 - DNA, 20 bp, Homo sapiens
tcattcagagactgcccttc

SEQ ID NO: 1053581 - DNA, 19 bp, Homo sapiens
tcattcagcagcaaatttt

SEQ ID NO: 1053582 - DNA, 23 bp, Homo sapiens
tcattcagcagcaaattttcagc

SEQ ID NO: 1053583 - DNA, 17 bp, Homo sapiens
tcattcagtattaaagg

SEQ ID NO: 1053584 - DNA, 10 bp, Homo sapiens
tcattcatat

SEQ ID NO: 1053585 - DNA, 14 bp, Homo sapiens
tcattcatccagga

SEQ ID NO: 1053586 - DNA, 20 bp, Homo sapiens
tcattcatccaggactgaga

SEQ ID NO: 1053587 - DNA, 15 bp, Homo sapiens
tcattcatcttgcaa

SEQ ID NO: 1053588 - DNA, 14 bp, Homo sapiens
tcattcatttttgt

SEQ ID NO: 1053589 - DNA, 12 bp, Homo sapiens
tcattccaaata

SEQ ID NO: 1053590 - DNA, 17 bp, Homo sapiens
tcattccaacagtgagt

SEQ ID NO: 1053591 - DNA, 21 bp, Homo sapiens
tcattccaacttcccagttca

SEQ ID NO: 1053592 - DNA, 16 bp, Homo sapiens
tcattccaattctaaa

SEQ ID NO: 1053593 - DNA, 23 bp, Homo sapiens
tcattccaccttcccatgccctg

SEQ ID NO: 1053594 - DNA, 13 bp, Homo sapiens
tcattccagcagc

SEQ ID NO: 1053595 - DNA, 14 bp, Homo sapiens
tcattccagcagct

SEQ ID NO: 1053596 - DNA, 13 bp, Homo sapiens
tcattccagtgct

SEQ ID NO: 1053597 - DNA, 14 bp, Homo sapiens
tcattccagtgcta

SEQ ID NO: 1053598 - DNA, 20 bp, Homo sapiens
tcattccagtgctagaaaat

SEQ ID NO: 1053599 - DNA, 14 bp, Homo sapiens
tcattccattgcct

SEQ ID NO: 1053600 - DNA, 12 bp, Homo sapiens
tcattccccagg

SEQ ID NO: 1053601 - DNA, 17 bp, Homo sapiens
tcattccggccacatca

SEQ ID NO: 1053602 - DNA, 19 bp, Homo sapiens
tcattccggccacatcatt

SEQ ID NO: 1053603 - DNA, 17 bp, Homo sapiens
tcattcctaacacagca

SEQ ID NO: 1053604 - DNA, 18 bp, Homo sapiens
tcattcctaacacagcat

SEQ ID NO: 1053605 - DNA, 21 bp, Homo sapiens
tcattcctgaaagaaacagtt

SEQ ID NO: 1053606 - DNA, 22 bp, Homo sapiens
tcattcctgaaagaaacagtta

SEQ ID NO: 1053607 - DNA, 17 bp, Homo sapiens
tcattccttcagatttg

SEQ ID NO: 1053608 - DNA, 22 bp, Homo sapiens
tcattctacagaataatccagt

SEQ ID NO: 1053609 - DNA, 18 bp, Homo sapiens
tcattctactaatgtgat

SEQ ID NO: 1053610 - DNA, 18 bp, Homo sapiens
tcattctcataattccta

SEQ ID NO: 1053611 - DNA, 16 bp, Homo sapiens
tcattctctgtctcat

SEQ ID NO: 1053612 - DNA, 15 bp, Homo sapiens
tcattctgaggcctg

SEQ ID NO: 1053613 - DNA, 13 bp, Homo sapiens
tcattctgcattg

SEQ ID NO: 1053614 - DNA, 12 bp, Homo sapiens
tcattctgcctg

SEQ ID NO: 1053615 - DNA, 18 bp, Homo sapiens
tcattctgctacttcact

SEQ ID NO: 1053616 - DNA, 20 bp, Homo sapiens
tcattctggaaacttttgtt

SEQ ID NO: 1053617 - DNA, 13 bp, Homo sapiens
tcattctgtgtct

SEQ ID NO: 1053618 - DNA, 15 bp, Homo sapiens
tcattcttactaaaa

SEQ ID NO: 1053619 - DNA, 16 bp, Homo sapiens
tcattcttgtgggaga

SEQ ID NO: 1053620 - DNA, 19 bp, Homo sapiens
tcattcttgtgggagacag

SEQ ID NO: 1053621 - DNA, 22 bp, Homo sapiens
tcattcttgtgggagacagcag

SEQ ID NO: 1053622 - DNA, 13 bp, Homo sapiens
tcattctttgaac

SEQ ID NO: 1053623 - DNA, 18 bp, Homo sapiens
tcattgaaatacttttta

SEQ ID NO: 1053624 - DNA, 21 bp, Homo sapiens
tcattgaagtatattcttatt

SEQ ID NO: 1053625 - DNA, 14 bp, Homo sapiens
tcattgaagtattt

SEQ ID NO: 1053626 - DNA, 14 bp, Homo sapiens
tcattgacatgata

SEQ ID NO: 1053627 - DNA, 14 bp, Homo sapiens
tcattgagagtttt

SEQ ID NO: 1053628 - DNA, 19 bp, Homo sapiens
tcattgagagttttgtctt

SEQ ID NO: 1053629 - DNA, 18 bp, Homo sapiens
tcattgattgtcagctac

SEQ ID NO: 1053630 - DNA, 12 bp, Homo sapiens
tcattgatttta

SEQ ID NO: 1053631 - DNA, 20 bp, Homo sapiens
tcattgattttataattggt

SEQ ID NO: 1053632 - DNA, 11 bp, Homo sapiens
tcattgcattt

SEQ ID NO: 1053633 - DNA, 18 bp, Homo sapiens
tcattgcctttccagggt

SEQ ID NO: 1053634 - DNA, 16 bp, Homo sapiens
tcattgctaaaaaata

SEQ ID NO: 1053635 - DNA, 17 bp, Homo sapiens
tcattgctaaaaaataa

SEQ ID NO: 1053636 - DNA, 20 bp, Homo sapiens
tcattgctaaaaaataaata

SEQ ID NO: 1053637 - DNA, 18 bp, Homo sapiens
tcattgctgaaaatggta

SEQ ID NO: 1053638 - DNA, 16 bp, Homo sapiens
tcattgctgtcttgcc

SEQ ID NO: 1053639 - DNA, 23 bp, Homo sapiens
tcattgctttgaagcagttgtgt

SEQ ID NO: 1053640 - DNA, 19 bp, Homo sapiens
tcattggcagctcaaagac

SEQ ID NO: 1053641 - DNA, 22 bp, Homo sapiens
tcattgggtttttcctctgtta

SEQ ID NO: 1053642 - DNA, 14 bp, Homo sapiens
tcattgtaaacaaa

SEQ ID NO: 1053643 - DNA, 21 bp, Homo sapiens
tcattgtaaacaaactcttga

SEQ ID NO: 1053644 - DNA, 20 bp, Homo sapiens
tcattgtaatgttactgatc

SEQ ID NO: 1053645 - DNA, 12 bp, Homo sapiens
tcattgtagaaa

SEQ ID NO: 1053646 - DNA, 17 bp, Homo sapiens
tcattgtatatatgtgt

SEQ ID NO: 1053647 - DNA, 15 bp, Homo sapiens
tcattgtatgatgtg

SEQ ID NO: 1053648 - DNA, 14 bp, Homo sapiens
tcattgtatgtggt

SEQ ID NO: 1053649 - DNA, 12 bp, Homo sapiens
tcattgtattca

SEQ ID NO: 1053650 - DNA, 15 bp, Homo sapiens
tcattgtccagctgg

SEQ ID NO: 1053651 - DNA, 13 bp, Homo sapiens
tcattgtccctct

SEQ ID NO: 1053652 - DNA, 20 bp, Homo sapiens
tcattgtccctcttcactcc

SEQ ID NO: 1053653 - DNA, 21 bp, Homo sapiens
tcattgtccctcttcactccc

SEQ ID NO: 1053654 - DNA, 16 bp, Homo sapiens
tcattgtcgctcagca

SEQ ID NO: 1053655 - DNA, 21 bp, Homo sapiens
tcattgttaaccacagctgtg

SEQ ID NO: 1053656 - DNA, 15 bp, Homo sapiens
tcattgttatttata

SEQ ID NO: 1053657 - DNA, 23 bp, Homo sapiens
tcatttaaaaaaaaaatttgttt

SEQ ID NO: 1053658 - DNA, 22 bp, Homo sapiens
tcatttaaaaaggtttaaaact

SEQ ID NO: 1053659 - DNA, 15 bp, Homo sapiens
tcatttaaaatgatt

SEQ ID NO: 1053660 - DNA, 18 bp, Homo sapiens
tcatttaaagctaaattt

SEQ ID NO: 1053661 - DNA, 19 bp, Homo sapiens
tcatttaaagctaaatttt

SEQ ID NO: 1053662 - DNA, 20 bp, Homo sapiens
tcatttaaagctaaattttg

SEQ ID NO: 1053663 - DNA, 16 bp, Homo sapiens
tcatttaagggaaaaa

SEQ ID NO: 1053664 - DNA, 17 bp, Homo sapiens
tcatttaagggaaaaat

SEQ ID NO: 1053665 - DNA, 16 bp, Homo sapiens
tcatttaatcccagga

SEQ ID NO: 1053666 - DNA, 20 bp, Homo sapiens
tcatttagataatttgaaaa

SEQ ID NO: 1053667 - DNA, 17 bp, Homo sapiens
tcatttagcatgttgtt

SEQ ID NO: 1053668 - DNA, 18 bp, Homo sapiens
tcatttagtcatgtgacc

SEQ ID NO: 1053669 - DNA, 15 bp, Homo sapiens
tcatttagtgctaaa

SEQ ID NO: 1053670 - DNA, 18 bp, Homo sapiens
tcatttagtgctaaacaa

SEQ ID NO: 1053671 - DNA, 19 bp, Homo sapiens
tcatttatatcgctggcca

SEQ ID NO: 1053672 - DNA, 17 bp, Homo sapiens
tcatttatgatacaaaa

SEQ ID NO: 1053673 - DNA, 14 bp, Homo sapiens
tcatttatttcatg

SEQ ID NO: 1053674 - DNA, 19 bp, Homo sapiens
tcatttcaaatacatcttt

SEQ ID NO: 1053675 - DNA, 16 bp, Homo sapiens
tcatttcagccaaagt

SEQ ID NO: 1053676 - DNA, 20 bp, Homo sapiens
tcatttcagtatcatctcca

SEQ ID NO: 1053677 - DNA, 14 bp, Homo sapiens
tcatttcatctcat

SEQ ID NO: 1053678 - DNA, 18 bp, Homo sapiens
tcatttccccataactca

SEQ ID NO: 1053679 - DNA, 12 bp, Homo sapiens
tcatttcctgcc

SEQ ID NO: 1053680 - DNA, 14 bp, Homo sapiens
tcatttcctgccct

SEQ ID NO: 1053681 - DNA, 18 bp, Homo sapiens
tcatttcctgggagaaag

SEQ ID NO: 1053682 - DNA, 12 bp, Homo sapiens
tcatttctctgc

SEQ ID NO: 1053683 - DNA, 16 bp, Homo sapiens
tcatttctctgcatgg

SEQ ID NO: 1053684 - DNA, 13 bp, Homo sapiens
tcatttctgcaga

SEQ ID NO: 1053685 - DNA, 16 bp, Homo sapiens
tcatttctgccatgat

SEQ ID NO: 1053686 - DNA, 23 bp, Homo sapiens
tcatttgacacaaagcttctaaa

SEQ ID NO: 1053687 - DNA, 18 bp, Homo sapiens
tcatttgactgtctcact

SEQ ID NO: 1053688 - DNA, 22 bp, Homo sapiens
tcatttgactgtctcacttttt

SEQ ID NO: 1053689 - DNA, 22 bp, Homo sapiens
tcatttgaggaagctctccctt

SEQ ID NO: 1053690 - DNA, 16 bp, Homo sapiens
tcatttgatgctaaat

SEQ ID NO: 1053691 - DNA, 21 bp, Homo sapiens
tcatttgcccttaaggacaaa

SEQ ID NO: 1053692 - DNA, 21 bp, Homo sapiens
tcatttgctaagtgtatgatg

SEQ ID NO: 1053693 - DNA, 13 bp, Homo sapiens
tcatttgcttttt

SEQ ID NO: 1053694 - DNA, 16 bp, Homo sapiens
tcatttggcttgctgt

SEQ ID NO: 1053695 - DNA, 20 bp, Homo sapiens
tcatttggtgttcctggaag

SEQ ID NO: 1053696 - DNA, 15 bp, Homo sapiens
tcatttgttggaatg

SEQ ID NO: 1053697 - DNA, 12 bp, Homo sapiens
tcatttgtttaa

SEQ ID NO: 1053698 - DNA, 13 bp, Homo sapiens
tcatttgtttaaa

SEQ ID NO: 1053699 - DNA, 17 bp, Homo sapiens
tcatttgtttaaaaagg

SEQ ID NO: 1053700 - DNA, 12 bp, Homo sapiens
tcatttgtttac

SEQ ID NO: 1053701 - DNA, 14 bp, Homo sapiens
tcatttgttttgct

SEQ ID NO: 1053702 - DNA, 19 bp, Homo sapiens
tcattttaaaaactttatt

SEQ ID NO: 1053703 - DNA, 17 bp, Homo sapiens
tcattttaaaatctgat

SEQ ID NO: 1053704 - DNA, 21 bp, Homo sapiens
tcattttaaactcctgaaatt

SEQ ID NO: 1053705 - DNA, 20 bp, Homo sapiens
tcattttaacatgatttcaa

SEQ ID NO: 1053706 - DNA, 19 bp, Homo sapiens
tcattttaagaagacatga

SEQ ID NO: 1053707 - DNA, 18 bp, Homo sapiens
tcattttacccttggctc

SEQ ID NO: 1053708 - DNA, 19 bp, Homo sapiens
tcattttaggaataataaa

SEQ ID NO: 1053709 - DNA, 15 bp, Homo sapiens
tcattttagtgactg

SEQ ID NO: 1053710 - DNA, 16 bp, Homo sapiens
tcattttagtgactgt

SEQ ID NO: 1053711 - DNA, 16 bp, Homo sapiens
tcattttatatgtcaa

SEQ ID NO: 1053712 - DNA, 18 bp, Homo sapiens
tcattttcatcactggga

SEQ ID NO: 1053713 - DNA, 15 bp, Homo sapiens
tcattttccccccac

SEQ ID NO: 1053714 - DNA, 23 bp, Homo sapiens
tcccatcattacccttccctgca

SEQ ID NO: 1053715 - DNA, 11 bp, Homo sapiens
tcccatccagc

SEQ ID NO: 1053716 - DNA, 14 bp, Homo sapiens
tcccatccaggcag

SEQ ID NO: 1053717 - DNA, 13 bp, Homo sapiens
tcccatccagggc

SEQ ID NO: 1053718 - DNA, 14 bp, Homo sapiens
tcccatccccaggt

SEQ ID NO: 1053719 - DNA, 22 bp, Homo sapiens
tcccatcccctcaacaccctgc

SEQ ID NO: 1053720 - DNA, 13 bp, Homo sapiens
tcccatcccctgg

SEQ ID NO: 1053721 - DNA, 20 bp, Homo sapiens
tcccatcctaccctcgggcc

SEQ ID NO: 1053722 - DNA, 17 bp, Homo sapiens
tcccatcctcacccaga

SEQ ID NO: 1053723 - DNA, 17 bp, Homo sapiens
tcccatcctccagccct

SEQ ID NO: 1053724 - DNA, 15 bp, Homo sapiens
tcccatcctggggca

SEQ ID NO: 1053725 - DNA, 16 bp, Homo sapiens
tcccatctccagggaa

SEQ ID NO: 1053726 - DNA, 22 bp, Homo sapiens
tcccatctcctgatttctctga

SEQ ID NO: 1053727 - DNA, 20 bp, Homo sapiens
tcccatctccttacctctgg

SEQ ID NO: 1053728 - DNA, 22 bp, Homo sapiens
tcccatctccttacctctggaa

SEQ ID NO: 1053729 - DNA, 16 bp, Homo sapiens
tcccatctctcccact

SEQ ID NO: 1053730 - DNA, 15 bp, Homo sapiens
tcccatctcttcctt

SEQ ID NO: 1053731 - DNA, 19 bp, Homo sapiens
tcccatctgcaccccttct

SEQ ID NO: 1053732 - DNA, 15 bp, Homo sapiens
tcccatctgccctcc

SEQ ID NO: 1053733 - DNA, 19 bp, Homo sapiens
tcccatctgggagtcccct

SEQ ID NO: 1053734 - DNA, 23 bp, Homo sapiens
tcccatctgggagtccccttttc

SEQ ID NO: 1053735 - DNA, 15 bp, Homo sapiens
tcccatcttccaagg

SEQ ID NO: 1053736 - DNA, 20 bp, Homo sapiens
tcccatcttggcctcccaga

SEQ ID NO: 1053737 - DNA, 17 bp, Homo sapiens
tcccatgaacacactgt

SEQ ID NO: 1053738 - DNA, 16 bp, Homo sapiens
tcccatgacccacccc

SEQ ID NO: 1053739 - DNA, 18 bp, Homo sapiens
tcccatgacccacccctg

SEQ ID NO: 1053740 - DNA, 20 bp, Homo sapiens
tcccatgacccacccctgtg

SEQ ID NO: 1053741 - DNA, 22 bp, Homo sapiens
tcccatgacccacccctgtgct

SEQ ID NO: 1053742 - DNA, 21 bp, Homo sapiens
tcccatgactgcacccagctc

SEQ ID NO: 1053743 - DNA, 23 bp, Homo sapiens
tcccatgactgcacccagctcca

SEQ ID NO: 1053744 - DNA, 16 bp, Homo sapiens
tcccatgcctgtctct

SEQ ID NO: 1053745 - DNA, 21 bp, Homo sapiens
tcccatggctgaagctggagc

SEQ ID NO: 1053746 - DNA, 23 bp, Homo sapiens
tcccatggctgaagctggagcag

SEQ ID NO: 1053747 - DNA, 13 bp, Homo sapiens
tcccatgtatgga

SEQ ID NO: 1053748 - DNA, 15 bp, Homo sapiens
tcccatgtcactgca

SEQ ID NO: 1053749 - DNA, 18 bp, Homo sapiens
tcccattattatttctgt

SEQ ID NO: 1053750 - DNA, 22 bp, Homo sapiens
tcccattattatttctgttctt

SEQ ID NO: 1053751 - DNA, 17 bp, Homo sapiens
tcccattcactcttcca

SEQ ID NO: 1053752 - DNA, 19 bp, Homo sapiens
tcccattcactcttccaga

SEQ ID NO: 1053753 - DNA, 14 bp, Homo sapiens
tcccattccctggg

SEQ ID NO: 1053754 - DNA, 13 bp, Homo sapiens
tcccattctagat

SEQ ID NO: 1053755 - DNA, 20 bp, Homo sapiens
tcccattctagatcctgcac

SEQ ID NO: 1053756 - DNA, 14 bp, Homo sapiens
tcccattgccctgg

SEQ ID NO: 1053757 - DNA, 13 bp, Homo sapiens
tcccattgtccct

SEQ ID NO: 1053758 - DNA, 15 bp, Homo sapiens
tcccattgtgacagc

SEQ ID NO: 1053759 - DNA, 19 bp, Homo sapiens
tcccattgtgcagaaaagc

SEQ ID NO: 1053760 - DNA, 16 bp, Homo sapiens
tcccattgtggctcct

SEQ ID NO: 1053761 - DNA, 15 bp, Homo sapiens
tcccatttagtgtga

SEQ ID NO: 1053762 - DNA, 20 bp, Homo sapiens
tcccatttagtgtgaatatt

SEQ ID NO: 1053763 - DNA, 16 bp, Homo sapiens
tcccatttatcgcaga

SEQ ID NO: 1053764 - DNA, 12 bp, Homo sapiens
tcccatttcctg

SEQ ID NO: 1053765 - DNA, 19 bp, Homo sapiens
tccccagagcccagctctt

SEQ ID NO: 1053766 - DNA, 16 bp, Homo sapiens
tccccagagctgtgcc

SEQ ID NO: 1053767 - DNA, 17 bp, Homo sapiens
tccccagagctgtgcca

SEQ ID NO: 1053768 - DNA, 22 bp, Homo sapiens
tccccagcagggtcttttcatc

SEQ ID NO: 1053769 - DNA, 23 bp, Homo sapiens
tccccagcagggtcttttcatct

SEQ ID NO: 1053770 - DNA, 15 bp, Homo sapiens
tccccagcaggtggg

SEQ ID NO: 1053771 - DNA, 19 bp, Homo sapiens
tccccagcaggtggggagg

SEQ ID NO: 1053772 - DNA, 21 bp, Homo sapiens
tccccagccagcccttccctg

SEQ ID NO: 1053773 - DNA, 14 bp, Homo sapiens
tccccagcccaggg

SEQ ID NO: 1053774 - DNA, 15 bp, Homo sapiens
tccccagcccagggt

SEQ ID NO: 1053775 - DNA, 14 bp, Homo sapiens
tccccagccctgtc

SEQ ID NO: 1053776 - DNA, 18 bp, Homo sapiens
tccccagccctgtcctgg

SEQ ID NO: 1053777 - DNA, 12 bp, Homo sapiens
tccccagccctt

SEQ ID NO: 1053778 - DNA, 11 bp, Homo sapiens
tccccagccta

SEQ ID NO: 1053779 - DNA, 14 bp, Homo sapiens
tccccagcctgggc

SEQ ID NO: 1053780 - DNA, 14 bp, Homo sapiens
tccccagctccagc

SEQ ID NO: 1053781 - DNA, 19 bp, Homo sapiens
tccccagctcccttgggaa

SEQ ID NO: 1053782 - DNA, 20 bp, Homo sapiens
tccccagctggtggccctgt

SEQ ID NO: 1053783 - DNA, 15 bp, Homo sapiens
tccccagctgtttat

SEQ ID NO: 1053784 - DNA, 16 bp, Homo sapiens
tccccaggcacctcac

SEQ ID NO: 1053785 - DNA, 14 bp, Homo sapiens
tccccaggccaggc

SEQ ID NO: 1053786 - DNA, 16 bp, Homo sapiens
tccccaggccaggcca

SEQ ID NO: 1053787 - DNA, 15 bp, Homo sapiens
tccccaggcccacca

SEQ ID NO: 1053788 - DNA, 21 bp, Homo sapiens
tccccaggcccagccctcctt

SEQ ID NO: 1053789 - DNA, 15 bp, Homo sapiens
tccccaggcctccag

SEQ ID NO: 1053790 - DNA, 17 bp, Homo sapiens
tccccaggcctccagcc

SEQ ID NO: 1053791 - DNA, 18 bp, Homo sapiens
tccccaggcctccagcct

SEQ ID NO: 1053792 - DNA, 15 bp, Homo sapiens
tccccaggcctggct

SEQ ID NO: 1053793 - DNA, 17 bp, Homo sapiens
tccccaggcctggctcc

SEQ ID NO: 1053794 - DNA, 16 bp, Homo sapiens
tccccagggaaggaaa

SEQ ID NO: 1053795 - DNA, 19 bp, Homo sapiens
tccccagggagctctgggg

SEQ ID NO: 1053796 - DNA, 12 bp, Homo sapiens
tccccagggccc

SEQ ID NO: 1053797 - DNA, 14 bp, Homo sapiens
tccccagggcccct

SEQ ID NO: 1053798 - DNA, 15 bp, Homo sapiens
tccccagggcccctc

SEQ ID NO: 1053799 - DNA, 20 bp, Homo sapiens
tccccaggggtcccagccac

SEQ ID NO: 1053800 - DNA, 23 bp, Homo sapiens
tccccaggtccagctctggaggg

SEQ ID NO: 1053801 - DNA, 18 bp, Homo sapiens
tccccaggtccccaaact

SEQ ID NO: 1053802 - DNA, 22 bp, Homo sapiens
tccccaggtggctgacccagtc

SEQ ID NO: 1053803 - DNA, 20 bp, Homo sapiens
tccccagtagctgggattac

SEQ ID NO: 1053804 - DNA, 15 bp, Homo sapiens
tccccagtccccagc

SEQ ID NO: 1053805 - DNA, 16 bp, Homo sapiens
tccccagtgcctgcca

SEQ ID NO: 1053806 - DNA, 11 bp, Homo sapiens
tccccatacac

SEQ ID NO: 1053807 - DNA, 15 bp, Homo sapiens
tccccatatccaagt

SEQ ID NO: 1053808 - DNA, 14 bp, Homo sapiens
tccccatcatccca

SEQ ID NO: 1053809 - DNA, 17 bp, Homo sapiens
tccccatcatcccagct

SEQ ID NO: 1053810 - DNA, 19 bp, Homo sapiens
tccccatcatcccagctgc

SEQ ID NO: 1053811 - DNA, 19 bp, Homo sapiens
tccccatccagcgagagag

SEQ ID NO: 1053812 - DNA, 14 bp, Homo sapiens
tccccatccccacc

SEQ ID NO: 1053813 - DNA, 14 bp, Homo sapiens
tccccatcctccag

SEQ ID NO: 1053814 - DNA, 17 bp, Homo sapiens
tccccatcctccagctt

SEQ ID NO: 1053815 - DNA, 16 bp, Homo sapiens
tccccatcggccctgt

SEQ ID NO: 1053816 - DNA, 19 bp, Homo sapiens
tccccatcggccctgtccc

SEQ ID NO: 1053817 - DNA, 22 bp, Homo sapiens
tccccatcggccctgtcccctg

SEQ ID NO: 1053818 - DNA, 22 bp, Homo sapiens
tccccatctccctgcctggccc

SEQ ID NO: 1053819 - DNA, 14 bp, Homo sapiens
tccccatctctgtc

SEQ ID NO: 1053820 - DNA, 15 bp, Homo sapiens
tccccatctctgtct

SEQ ID NO: 1053821 - DNA, 18 bp, Homo sapiens
tccccatctctgtctggg

SEQ ID NO: 1053822 - DNA, 19 bp, Homo sapiens
tccccatctctgtctgggg

SEQ ID NO: 1053823 - DNA, 21 bp, Homo sapiens
tccccatctctgtctggggct

SEQ ID NO: 1053824 - DNA, 14 bp, Homo sapiens
tccccatctgtcca

SEQ ID NO: 1053825 - DNA, 18 bp, Homo sapiens
tcccgcctccctctcaga

SEQ ID NO: 1053826 - DNA, 19 bp, Homo sapiens
tcccgcctcttcttcttca

SEQ ID NO: 1053827 - DNA, 21 bp, Homo sapiens
tcccgcctcttcttcttcaga

SEQ ID NO: 1053828 - DNA, 23 bp, Homo sapiens
tcccgcgggttccgcaggcagac

SEQ ID NO: 1053829 - DNA, 15 bp, Homo sapiens
tcccgctcagccctc

SEQ ID NO: 1053830 - DNA, 16 bp, Homo sapiens
tcccgctgcctcctgc

SEQ ID NO: 1053831 - DNA, 17 bp, Homo sapiens
tcccgctgcctcctgct

SEQ ID NO: 1053832 - DNA, 13 bp, Homo sapiens
tcccgctgctgct

SEQ ID NO: 1053833 - DNA, 15 bp, Homo sapiens
tcccgctgctgctgc

SEQ ID NO: 1053834 - DNA, 14 bp, Homo sapiens
tcccgctgctgtgc

SEQ ID NO: 1053835 - DNA, 15 bp, Homo sapiens
tcccgctgctgtgct

SEQ ID NO: 1053836 - DNA, 16 bp, Homo sapiens
tcccgcttagcctgcc

SEQ ID NO: 1053837 - DNA, 20 bp, Homo sapiens
tcccgcttagcctgcctcac

SEQ ID NO: 1053838 - DNA, 23 bp, Homo sapiens
tcccgcttagcgctctggacaga

SEQ ID NO: 1053839 - DNA, 15 bp, Homo sapiens
tcccggagcacagcc

SEQ ID NO: 1053840 - DNA, 19 bp, Homo sapiens
tcccggagcacagccctgg

SEQ ID NO: 1053841 - DNA, 22 bp, Homo sapiens
tcccggagcacagccctgggag

SEQ ID NO: 1053842 - DNA, 18 bp, Homo sapiens
tcccggaggttgggtggg

SEQ ID NO: 1053843 - DNA, 13 bp, Homo sapiens
tcccggcctcttc

SEQ ID NO: 1053844 - DNA, 16 bp, Homo sapiens
tcccggctcccctccc

SEQ ID NO: 1053845 - DNA, 12 bp, Homo sapiens
tcccggctgcct

SEQ ID NO: 1053846 - DNA, 13 bp, Homo sapiens
tcccggctgcctg

SEQ ID NO: 1053847 - DNA, 14 bp, Homo sapiens
tcccgggccacgcc

SEQ ID NO: 1053848 - DNA, 17 bp, Homo sapiens
tcccgggccacgcccca

SEQ ID NO: 1053849 - DNA, 19 bp, Homo sapiens
tcccgggccacgccccagc

SEQ ID NO: 1053850 - DNA, 16 bp, Homo sapiens
tcccgggccagggctg

SEQ ID NO: 1053851 - DNA, 14 bp, Homo sapiens
tcccgggccctccc

SEQ ID NO: 1053852 - DNA, 23 bp, Homo sapiens
tcccggggcccaggactctggct

SEQ ID NO: 1053853 - DNA, 22 bp, Homo sapiens
tcccggtcatgcttttgccact

SEQ ID NO: 1053854 - DNA, 15 bp, Homo sapiens
tcccggttcaccttg

SEQ ID NO: 1053855 - DNA, 19 bp, Homo sapiens
tcccggttcagacccctgc

SEQ ID NO: 1053856 - DNA, 20 bp, Homo sapiens
tcccgtacctcttcccatga

SEQ ID NO: 1053857 - DNA, 21 bp, Homo sapiens
tcccgtacgtgttcattttat

SEQ ID NO: 1053858 - DNA, 17 bp, Homo sapiens
tcccgtagtctcctggg

SEQ ID NO: 1053859 - DNA, 17 bp, Homo sapiens
tcccgtatcacagtgtt

SEQ ID NO: 1053860 - DNA, 20 bp, Homo sapiens
tcccgtcacccctgtttctg

SEQ ID NO: 1053861 - DNA, 20 bp, Homo sapiens
tcccgtcagggcccaagtcc

SEQ ID NO: 1053862 - DNA, 23 bp, Homo sapiens
tcccgtcagggcccaagtccctg

SEQ ID NO: 1053863 - DNA, 21 bp, Homo sapiens
tcccgtcccatatcctgcctc

SEQ ID NO: 1053864 - DNA, 14 bp, Homo sapiens
tcccgtcgtgcagt

SEQ ID NO: 1053865 - DNA, 13 bp, Homo sapiens
tcccgtctcagaa

SEQ ID NO: 1053866 - DNA, 20 bp, Homo sapiens
tcccgtgcatcccccctgct

SEQ ID NO: 1053867 - DNA, 14 bp, Homo sapiens
tcccgtgtgtattt

SEQ ID NO: 1053868 - DNA, 20 bp, Homo sapiens
tcccgtgtgtggttggaaaa

SEQ ID NO: 1053869 - DNA, 15 bp, Homo sapiens
tcccgtgttctcctt

SEQ ID NO: 1053870 - DNA, 23 bp, Homo sapiens
tccctaaaatggcgaacatgtgt

SEQ ID NO: 1053871 - DNA, 20 bp, Homo sapiens
tccctaaactgcagcctctc

SEQ ID NO: 1053872 - DNA, 22 bp, Homo sapiens
tccctaaactgcagcctctctg

SEQ ID NO: 1053873 - DNA, 16 bp, Homo sapiens
tccctaactctcggga

SEQ ID NO: 1053874 - DNA, 12 bp, Homo sapiens
tccctaacttct

SEQ ID NO: 1053875 - DNA, 17 bp, Homo sapiens
tccctaagccagcctgg

SEQ ID NO: 1053876 - DNA, 18 bp, Homo sapiens
tccctaaggaatctgaaa

SEQ ID NO: 1053877 - DNA, 22 bp, Homo sapiens
tccctaagtaagtttcttcctg

SEQ ID NO: 1053878 - DNA, 22 bp, Homo sapiens
tccctaagttgctgggattaca

SEQ ID NO: 1053879 - DNA, 16 bp, Homo sapiens
tccctaatctatggtc

SEQ ID NO: 1053880 - DNA, 20 bp, Homo sapiens
tccctaatttaacccagctc

SEQ ID NO: 1053881 - DNA, 17 bp, Homo sapiens
tccctaatttatgtgct

SEQ ID NO: 1053882 - DNA, 18 bp, Homo sapiens
tccctaatttatgtgcta

SEQ ID NO: 1053883 - DNA, 19 bp, Homo sapiens
tccctaatttatgtgctat

SEQ ID NO: 1053884 - DNA, 18 bp, Homo sapiens
tccctacagaaaagaaat

SEQ ID NO: 1053885 - DNA, 18 bp, Homo sapiens
tccctaccaaaaattgcc

SEQ ID NO: 1053886 - DNA, 22 bp, Homo sapiens
tccctaccaaaaattgccaagt

SEQ ID NO: 1053887 - DNA, 18 bp, Homo sapiens
tccctacccaatgtctcc

SEQ ID NO: 1053888 - DNA, 19 bp, Homo sapiens
tccctacccaatgtctccc

SEQ ID NO: 1053889 - DNA, 13 bp, Homo sapiens
tccctacccacaa

SEQ ID NO: 1053890 - DNA, 16 bp, Homo sapiens
tccctaccccatttgt

SEQ ID NO: 1053891 - DNA, 14 bp, Homo sapiens
tccctaccctgcaa

SEQ ID NO: 1053892 - DNA, 13 bp, Homo sapiens
tccctacctcagg

SEQ ID NO: 1053893 - DNA, 18 bp, Homo sapiens
tccctacctccctcctca

SEQ ID NO: 1053894 - DNA, 14 bp, Homo sapiens
tccctacctgcttc

SEQ ID NO: 1053895 - DNA, 14 bp, Homo sapiens
tccctacttccaag

SEQ ID NO: 1053896 - DNA, 17 bp, Homo sapiens
tccctacttcctgtgac

SEQ ID NO: 1053897 - DNA, 15 bp, Homo sapiens
tccctacttgcagcg

SEQ ID NO: 1053898 - DNA, 22 bp, Homo sapiens
tccctagaagagcacagagccc

SEQ ID NO: 1053899 - DNA, 18 bp, Homo sapiens
tccctagactgcatcccg

SEQ ID NO: 1053900 - DNA, 18 bp, Homo sapiens
tccctagagggttcctgt

SEQ ID NO: 1053901 - DNA, 16 bp, Homo sapiens
tccctagatctttcta

SEQ ID NO: 1053902 - DNA, 23 bp, Homo sapiens
tccctagatctttctattccaaa

SEQ ID NO: 1053903 - DNA, 14 bp, Homo sapiens
tccctagcccttcc

SEQ ID NO: 1053904 - DNA, 19 bp, Homo sapiens
tccctagcccttccagcct

SEQ ID NO: 1053905 - DNA, 22 bp, Homo sapiens
tccctagcccttccagcctggg

SEQ ID NO: 1053906 - DNA, 15 bp, Homo sapiens
tccctaggagaccaa

SEQ ID NO: 1053907 - DNA, 20 bp, Homo sapiens
tccctagtagctgggattac

SEQ ID NO: 1053908 - DNA, 12 bp, Homo sapiens
tccctagtcatt

SEQ ID NO: 1053909 - DNA, 17 bp, Homo sapiens
tccctagtctccacctg

SEQ ID NO: 1053910 - DNA, 17 bp, Homo sapiens
tccctatagtttcacca

SEQ ID NO: 1053911 - DNA, 19 bp, Homo sapiens
tccctatatgcacccctgg

SEQ ID NO: 1053912 - DNA, 19 bp, Homo sapiens
tccctatctattaaagtga

SEQ ID NO: 1053913 - DNA, 20 bp, Homo sapiens
tccctatctattaaagtgac

SEQ ID NO: 1053914 - DNA, 21 bp, Homo sapiens
tccctatctattaaagtgact

SEQ ID NO: 1053915 - DNA, 15 bp, Homo sapiens
tccctatgctaccct

SEQ ID NO: 1053916 - DNA, 18 bp, Homo sapiens
tccctatgtatttgcagt

SEQ ID NO: 1053917 - DNA, 19 bp, Homo sapiens
tccctcaaatgacccaaag

SEQ ID NO: 1053918 - DNA, 18 bp, Homo sapiens
tccctcaactgaaggggt

SEQ ID NO: 1053919 - DNA, 12 bp, Homo sapiens
tccctcaccccc

SEQ ID NO: 1053920 - DNA, 18 bp, Homo sapiens
tccctcacccccaggtgt

SEQ ID NO: 1053921 - DNA, 17 bp, Homo sapiens
tccctcaccccctccca

SEQ ID NO: 1053922 - DNA, 21 bp, Homo sapiens
tccctcaccctgagccccttc

SEQ ID NO: 1053923 - DNA, 22 bp, Homo sapiens
tccctcaccctgagccccttcc

SEQ ID NO: 1053924 - DNA, 12 bp, Homo sapiens
tccctcacctgt

SEQ ID NO: 1053925 - DNA, 14 bp, Homo sapiens
tccctcacctgtag

SEQ ID NO: 1053926 - DNA, 17 bp, Homo sapiens
tccctcactcttcctca

SEQ ID NO: 1053927 - DNA, 16 bp, Homo sapiens
tccctcagcccccagg

SEQ ID NO: 1053928 - DNA, 14 bp, Homo sapiens
tccctcagcccctc

SEQ ID NO: 1053929 - DNA, 16 bp, Homo sapiens
tccctcagcccctctt

SEQ ID NO: 1053930 - DNA, 13 bp, Homo sapiens
tccctcagcctcc

SEQ ID NO: 1053931 - DNA, 18 bp, Homo sapiens
tccctcagcctccccttc

SEQ ID NO: 1053932 - DNA, 20 bp, Homo sapiens
tccctcagcctccccttctt

SEQ ID NO: 1053933 - DNA, 15 bp, Homo sapiens
tccctcagggagcga

SEQ ID NO: 1053934 - DNA, 13 bp, Homo sapiens
tccctcaggggca

SEQ ID NO: 1053935 - DNA, 20 bp, Homo sapiens
tccctcaggttcctttttca

SEQ ID NO: 1053936 - DNA, 16 bp, Homo sapiens
tccctcagtgccctca

SEQ ID NO: 1053937 - DNA, 15 bp, Homo sapiens
tccctcattcatctt

SEQ ID NO: 1053938 - DNA, 17 bp, Homo sapiens
tccctccaacacagatc

SEQ ID NO: 1053939 - DNA, 13 bp, Homo sapiens
tccctccaagcct

SEQ ID NO: 1053940 - DNA, 14 bp, Homo sapiens
tccctccaagcctg

SEQ ID NO: 1053941 - DNA, 17 bp, Homo sapiens
tccctccaagcctggca

SEQ ID NO: 1053942 - DNA, 19 bp, Homo sapiens
tccctccaattccccctta

SEQ ID NO: 1053943 - DNA, 14 bp, Homo sapiens
tccctccaccagcc

SEQ ID NO: 1053944 - DNA, 22 bp, Homo sapiens
tccctccaccagcctgctgaca

SEQ ID NO: 1053945 - DNA, 15 bp, Homo sapiens
tccctccaccccagg

SEQ ID NO: 1053946 - DNA, 18 bp, Homo sapiens
tccctccaccccaggacg

SEQ ID NO: 1053947 - DNA, 20 bp, Homo sapiens
tccctccacctcaagacccc

SEQ ID NO: 1053948 - DNA, 17 bp, Homo sapiens
tccctcccacacttccc

SEQ ID NO: 1053949 - DNA, 23 bp, Homo sapiens
tccctcccagaggagccaccagt

SEQ ID NO: 1053950 - DNA, 12 bp, Homo sapiens
tccctcccagcg

SEQ ID NO: 1053951 - DNA, 17 bp, Homo sapiens
tccctcccagctgcact

SEQ ID NO: 1053952 - DNA, 14 bp, Homo sapiens
tccctcccatcctc

SEQ ID NO: 1053953 - DNA, 14 bp, Homo sapiens
tccctccccaaatg

SEQ ID NO: 1053954 - DNA, 20 bp, Homo sapiens
tccctccccaaatggctgct

SEQ ID NO: 1053955 - DNA, 14 bp, Homo sapiens
tccctcccccagcc

SEQ ID NO: 1053956 - DNA, 17 bp, Homo sapiens
tccctcccccagccacc

SEQ ID NO: 1053957 - DNA, 17 bp, Homo sapiens
tccctccccctccttgt

SEQ ID NO: 1053958 - DNA, 21 bp, Homo sapiens
tccctccccgctgccctttgg

SEQ ID NO: 1053959 - DNA, 22 bp, Homo sapiens
tccctccccgctgccctttggc

SEQ ID NO: 1053960 - DNA, 23 bp, Homo sapiens
tccctccccgctgccctttggcc

SEQ ID NO: 1053961 - DNA, 16 bp, Homo sapiens
tccctcccctctcaga

SEQ ID NO: 1053962 - DNA, 13 bp, Homo sapiens
tccctcccctgcc

SEQ ID NO: 1053963 - DNA, 14 bp, Homo sapiens
tccctcccctgccc

SEQ ID NO: 1053964 - DNA, 16 bp, Homo sapiens
tccctcccctgccctg

SEQ ID NO: 1053965 - DNA, 17 bp, Homo sapiens
tccctcccctgccctgg

SEQ ID NO: 1053966 - DNA, 19 bp, Homo sapiens
tccctcccctgccctggtc

SEQ ID NO: 1053967 - DNA, 12 bp, Homo sapiens
tccctcccggct

SEQ ID NO: 1053968 - DNA, 17 bp, Homo sapiens
tccctcccggctgcccc

SEQ ID NO: 1053969 - DNA, 17 bp, Homo sapiens
tccctcccgtgtgtggt

SEQ ID NO: 1053970 - DNA, 15 bp, Homo sapiens
tccctccctctctca

SEQ ID NO: 1053971 - DNA, 17 bp, Homo sapiens
tccctccctctttccca

SEQ ID NO: 1053972 - DNA, 14 bp, Homo sapiens
tccctcccttgggg

SEQ ID NO: 1053973 - DNA, 16 bp, Homo sapiens
tccctccgagcttggg

SEQ ID NO: 1053974 - DNA, 15 bp, Homo sapiens
tccctccgatccttc

SEQ ID NO: 1053975 - DNA, 18 bp, Homo sapiens
tccctccgatccttcctc

SEQ ID NO: 1053976 - DNA, 13 bp, Homo sapiens
tccctccgcctcc

SEQ ID NO: 1053977 - DNA, 18 bp, Homo sapiens
tccctccgcctcccatcc

SEQ ID NO: 1053978 - DNA, 22 bp, Homo sapiens
tccctccgccttctcccacatg

SEQ ID NO: 1053979 - DNA, 12 bp, Homo sapiens
tccctcctagct

SEQ ID NO: 1053980 - DNA, 15 bp, Homo sapiens
tccctcctagctctc

SEQ ID NO: 1053981 - DNA, 13 bp, Homo sapiens
tccctcctcacct

SEQ ID NO: 1053982 - DNA, 17 bp, Homo sapiens
tccctcctcacctctgg

SEQ ID NO: 1053983 - DNA, 18 bp, Homo sapiens
tccctcctcacctctgga

SEQ ID NO: 1053984 - DNA, 17 bp, Homo sapiens
tccctcctccaggcctg

SEQ ID NO: 1053985 - DNA, 13 bp, Homo sapiens
tccctcctctggc

SEQ ID NO: 1053986 - DNA, 17 bp, Homo sapiens
tccctcctctggcaggc

SEQ ID NO: 1053987 - DNA, 15 bp, Homo sapiens
tccctcctgcccagg

SEQ ID NO: 1053988 - DNA, 21 bp, Homo sapiens
tccctcctgccgactcctggg

SEQ ID NO: 1053989 - DNA, 13 bp, Homo sapiens
tccctcctggagc

SEQ ID NO: 1053990 - DNA, 16 bp, Homo sapiens
tccctcctggagcatc

SEQ ID NO: 1053991 - DNA, 21 bp, Homo sapiens
tccctcctggagctctgtggg

SEQ ID NO: 1053992 - DNA, 15 bp, Homo sapiens
tccctcctggtcctg

SEQ ID NO: 1053993 - DNA, 20 bp, Homo sapiens
tccctcctggtcctggacac

SEQ ID NO: 1053994 - DNA, 14 bp, Homo sapiens
tccctcggaagccg

SEQ ID NO: 1053995 - DNA, 24 bp, Homo sapiens
tccctcggaagccgtctgactcca

SEQ ID NO: 1053996 - DNA, 15 bp, Homo sapiens
tccctcggacccacc

SEQ ID NO: 1053997 - DNA, 18 bp, Homo sapiens
tccctcgtccacaggggc

SEQ ID NO: 1053998 - DNA, 19 bp, Homo sapiens
tccctctaatgagactgac

SEQ ID NO: 1053999 - DNA, 16 bp, Homo sapiens
tccctctaatttatct

SEQ ID NO: 1054000 - DNA, 21 bp, Homo sapiens
tccctctacagagcttccctg

SEQ ID NO: 1054001 - DNA, 22 bp, Homo sapiens
tccctctacagagcttccctga

SEQ ID NO: 1054002 - DNA, 17 bp, Homo sapiens
tccctctactcttcctg

SEQ ID NO: 1054003 - DNA, 19 bp, Homo sapiens
tccctctactgagtaaacc

SEQ ID NO: 1054004 - DNA, 16 bp, Homo sapiens
tccctctcagaggcct

SEQ ID NO: 1054005 - DNA, 19 bp, Homo sapiens
tccctctcagaggcctgct

SEQ ID NO: 1054006 - DNA, 14 bp, Homo sapiens
tccctctcagatac

SEQ ID NO: 1054007 - DNA, 18 bp, Homo sapiens
tccctctcagatacccag

SEQ ID NO: 1054008 - DNA, 21 bp, Homo sapiens
tccctctcagatacccagtgg

SEQ ID NO: 1054009 - DNA, 19 bp, Homo sapiens
tccctctcaggcatgcctg

SEQ ID NO: 1054010 - DNA, 23 bp, Homo sapiens
tccctctcaggcatgcctgtgtg

SEQ ID NO: 1054011 - DNA, 17 bp, Homo sapiens
tccctctcatctcaggt

SEQ ID NO: 1054012 - DNA, 17 bp, Homo sapiens
tccctctcatgtccctc

SEQ ID NO: 1054013 - DNA, 19 bp, Homo sapiens
tccctctcatgtccctcca

SEQ ID NO: 1054014 - DNA, 21 bp, Homo sapiens
tccctctcatgtccctccagg

SEQ ID NO: 1054015 - DNA, 15 bp, Homo sapiens
tccctctccactctt

SEQ ID NO: 1054016 - DNA, 22 bp, Homo sapiens
tccctctccactcttctctcct

SEQ ID NO: 1054017 - DNA, 20 bp, Homo sapiens
tccctctccgcgggagaccc

SEQ ID NO: 1054018 - DNA, 14 bp, Homo sapiens
tccctctcctgcct

SEQ ID NO: 1054019 - DNA, 16 bp, Homo sapiens
tccctctcctgcctac

SEQ ID NO: 1054020 - DNA, 17 bp, Homo sapiens
tccctctctcatgagaa

SEQ ID NO: 1054021 - DNA, 21 bp, Homo sapiens
tccctctctcccatttcagga

SEQ ID NO: 1054022 - DNA, 20 bp, Homo sapiens
tccctctctcttctgctcca

SEQ ID NO: 1054023 - DNA, 21 bp, Homo sapiens
tccctctctcttctgctccac

SEQ ID NO: 1054024 - DNA, 19 bp, Homo sapiens
tccctctctgatgtcccag

SEQ ID NO: 1054025 - DNA, 18 bp, Homo sapiens
tccctctgacctgcaggc

SEQ ID NO: 1054026 - DNA, 11 bp, Homo sapiens
tccctctgccc

SEQ ID NO: 1054027 - DNA, 15 bp, Homo sapiens
tccccatctgtccag

SEQ ID NO: 1054028 - DNA, 16 bp, Homo sapiens
tccccatctgtccagc

SEQ ID NO: 1054029 - DNA, 14 bp, Homo sapiens
tccccatcttctaa

SEQ ID NO: 1054030 - DNA, 19 bp, Homo sapiens
tccccatcttctaaaccca

SEQ ID NO: 1054031 - DNA, 22 bp, Homo sapiens
tccccatgccacgttccacagt

SEQ ID NO: 1054032 - DNA, 15 bp, Homo sapiens
tccccatggagccag

SEQ ID NO: 1054033 - DNA, 19 bp, Homo sapiens
tccccatgggctcccactg

SEQ ID NO: 1054034 - DNA, 21 bp, Homo sapiens
tccccattagagtcagccttc

SEQ ID NO: 1054035 - DNA, 16 bp, Homo sapiens
tccccatttcccatct

SEQ ID NO: 1054036 - DNA, 17 bp, Homo sapiens
tccccatttcccatctg

SEQ ID NO: 1054037 - DNA, 18 bp, Homo sapiens
tccccatttcccatctgc

SEQ ID NO: 1054038 - DNA, 19 bp, Homo sapiens
tccccatttctgcctcgct

SEQ ID NO: 1054039 - DNA, 19 bp, Homo sapiens
tcccccaacacctgctgcg

SEQ ID NO: 1054040 - DNA, 14 bp, Homo sapiens
tcccccaaccaagg

SEQ ID NO: 1054041 - DNA, 15 bp, Homo sapiens
tcccccaaccaagga

SEQ ID NO: 1054042 - DNA, 19 bp, Homo sapiens
tcccccaaccaaggaagga

SEQ ID NO: 1054043 - DNA, 20 bp, Homo sapiens
tcccccaaccaaggaaggag

SEQ ID NO: 1054044 - DNA, 23 bp, Homo sapiens
tcccccaaccaaggaaggagccc

SEQ ID NO: 1054045 - DNA, 16 bp, Homo sapiens
tcccccaacccccacc

SEQ ID NO: 1054046 - DNA, 14 bp, Homo sapiens
tcccccaacttgag

SEQ ID NO: 1054047 - DNA, 14 bp, Homo sapiens
tcccccacccacct

SEQ ID NO: 1054048 - DNA, 16 bp, Homo sapiens
tcccccacccacctcc

SEQ ID NO: 1054049 - DNA, 19 bp, Homo sapiens
tcccccaccccctccccag

SEQ ID NO: 1054050 - DNA, 19 bp, Homo sapiens
tcccccaccggtccagctg

SEQ ID NO: 1054051 - DNA, 23 bp, Homo sapiens
tcccccacctgacaatggcagct

SEQ ID NO: 1054052 - DNA, 14 bp, Homo sapiens
tcccccactctctc

SEQ ID NO: 1054053 - DNA, 21 bp, Homo sapiens
tcccccactctctcacccacc

SEQ ID NO: 1054054 - DNA, 23 bp, Homo sapiens
tcccccactctctcacccaccag

SEQ ID NO: 1054055 - DNA, 14 bp, Homo sapiens
tcccccactgccat

SEQ ID NO: 1054056 - DNA, 12 bp, Homo sapiens
tcccccactgct

SEQ ID NO: 1054057 - DNA, 13 bp, Homo sapiens
tcccccagagtgc

SEQ ID NO: 1054058 - DNA, 21 bp, Homo sapiens
tcccccagagtgctgtcggga

SEQ ID NO: 1054059 - DNA, 21 bp, Homo sapiens
tcccccagcatcgggggcctg

SEQ ID NO: 1054060 - DNA, 20 bp, Homo sapiens
tcccccagccatgccagctg

SEQ ID NO: 1054061 - DNA, 11 bp, Homo sapiens
tcccccagccc

SEQ ID NO: 1054062 - DNA, 17 bp, Homo sapiens
tcccccagccctgtgga

SEQ ID NO: 1054063 - DNA, 14 bp, Homo sapiens
tcccccaggctgga

SEQ ID NO: 1054064 - DNA, 20 bp, Homo sapiens
tcccccaggggcgtgaggct

SEQ ID NO: 1054065 - DNA, 19 bp, Homo sapiens
tcccccaggtgttgtaaca

SEQ ID NO: 1054066 - DNA, 16 bp, Homo sapiens
tcccccagtacctcca

SEQ ID NO: 1054067 - DNA, 20 bp, Homo sapiens
tcccccatcccctttcctcc

SEQ ID NO: 1054068 - DNA, 18 bp, Homo sapiens
tcccccatccctaccact

SEQ ID NO: 1054069 - DNA, 22 bp, Homo sapiens
tcccccatccctaccactgtgg

SEQ ID NO: 1054070 - DNA, 17 bp, Homo sapiens
tcccccatcctcccctt

SEQ ID NO: 1054071 - DNA, 18 bp, Homo sapiens
tcccccatcctccccttc

SEQ ID NO: 1054072 - DNA, 19 bp, Homo sapiens
tcccccatcctccccttcc

SEQ ID NO: 1054073 - DNA, 17 bp, Homo sapiens
tcccccatctcttctgg

SEQ ID NO: 1054074 - DNA, 14 bp, Homo sapiens
tcccccatgggctg

SEQ ID NO: 1054075 - DNA, 14 bp, Homo sapiens
tccccccacccgac

SEQ ID NO: 1054076 - DNA, 12 bp, Homo sapiens
tccccccaccgc

SEQ ID NO: 1054077 - DNA, 21 bp, Homo sapiens
tccccccactctccccacact

SEQ ID NO: 1054078 - DNA, 13 bp, Homo sapiens
tccccccactgca

SEQ ID NO: 1054079 - DNA, 18 bp, Homo sapiens
tccccccactgcaggccc

SEQ ID NO: 1054080 - DNA, 19 bp, Homo sapiens
tccccccagctccctgcac

SEQ ID NO: 1054081 - DNA, 12 bp, Homo sapiens
tccccccatccc

SEQ ID NO: 1054082 - DNA, 13 bp, Homo sapiens
tccccccatccca

SEQ ID NO: 1054083 - DNA, 15 bp, Homo sapiens
tccccccatctctga

SEQ ID NO: 1054084 - DNA, 17 bp, Homo sapiens
tccccccatctctgagt

SEQ ID NO: 1054085 - DNA, 12 bp, Homo sapiens
tccccccatctt

SEQ ID NO: 1054086 - DNA, 22 bp, Homo sapiens
tccccccatcttgcttccctaa

SEQ ID NO: 1054087 - DNA, 13 bp, Homo sapiens
tcccctccctgcc

SEQ ID NO: 1054088 - DNA, 14 bp, Homo sapiens
tcccctccctgcct

SEQ ID NO: 1054089 - DNA, 16 bp, Homo sapiens
tcccctccctgcctgc

SEQ ID NO: 1054090 - DNA, 13 bp, Homo sapiens
tcccctccctggc

SEQ ID NO: 1054091 - DNA, 15 bp, Homo sapiens
tcccctccctggctc

SEQ ID NO: 1054092 - DNA, 19 bp, Homo sapiens
tcccctccctggctcccat

SEQ ID NO: 1054093 - DNA, 16 bp, Homo sapiens
tcccctccctgggttc

SEQ ID NO: 1054094 - DNA, 13 bp, Homo sapiens
tcccctccctgta

SEQ ID NO: 1054095 - DNA, 13 bp, Homo sapiens
tcccctccctgtc

SEQ ID NO: 1054096 - DNA, 20 bp, Homo sapiens
tcccctcctcttcccttagc

SEQ ID NO: 1054097 - DNA, 18 bp, Homo sapiens
tcccctcctgcacacagg

SEQ ID NO: 1054098 - DNA, 20 bp, Homo sapiens
tcccctccttgcctcctgtg

SEQ ID NO: 1054099 - DNA, 21 bp, Homo sapiens
tcccctccttgcctcctgtgt

SEQ ID NO: 1054100 - DNA, 22 bp, Homo sapiens
tcccctccttgcctcctgtgta

SEQ ID NO: 1054101 - DNA, 12 bp, Homo sapiens
tcccctccttgg

SEQ ID NO: 1054102 - DNA, 15 bp, Homo sapiens
tcccctcctttgtct

SEQ ID NO: 1054103 - DNA, 16 bp, Homo sapiens
tcccctcctttgtctt

SEQ ID NO: 1054104 - DNA, 18 bp, Homo sapiens
tcccctcctttgtctttt

SEQ ID NO: 1054105 - DNA, 23 bp, Homo sapiens
tcccctcgtcctgtcccagaggt

SEQ ID NO: 1054106 - DNA, 22 bp, Homo sapiens
tcccctctcatccccctgtgga

SEQ ID NO: 1054107 - DNA, 14 bp, Homo sapiens
tcccctctcccctt

SEQ ID NO: 1054108 - DNA, 16 bp, Homo sapiens
tcccctctccccttgg

SEQ ID NO: 1054109 - DNA, 15 bp, Homo sapiens
tcccctctcctccgc

SEQ ID NO: 1054110 - DNA, 14 bp, Homo sapiens
tcccctctcctgcc

SEQ ID NO: 1054111 - DNA, 15 bp, Homo sapiens
tcccctctccttcct

SEQ ID NO: 1054112 - DNA, 16 bp, Homo sapiens
tcccctctccttcctg

SEQ ID NO: 1054113 - DNA, 18 bp, Homo sapiens
tcccctctcgccccatcc

SEQ ID NO: 1054114 - DNA, 12 bp, Homo sapiens
tcccctctctgc

SEQ ID NO: 1054115 - DNA, 21 bp, Homo sapiens
tcccctctcttcgtcctgatc

SEQ ID NO: 1054116 - DNA, 20 bp, Homo sapiens
tcccctctgctgctgtccct

SEQ ID NO: 1054117 - DNA, 14 bp, Homo sapiens
tcccctctggaatc

SEQ ID NO: 1054118 - DNA, 22 bp, Homo sapiens
tcccctctggaatcttccccaa

SEQ ID NO: 1054119 - DNA, 14 bp, Homo sapiens
tcccctctgtgctt

SEQ ID NO: 1054120 - DNA, 23 bp, Homo sapiens
tcccctctgtgcttcgactactg

SEQ ID NO: 1054121 - DNA, 12 bp, Homo sapiens
tcccctcttcct

SEQ ID NO: 1054122 - DNA, 23 bp, Homo sapiens
tcccctcttttgttaaataatat

SEQ ID NO: 1054123 - DNA, 12 bp, Homo sapiens
tcccctgacagg

SEQ ID NO: 1054124 - DNA, 12 bp, Homo sapiens
tcccctgaggct

SEQ ID NO: 1054125 - DNA, 14 bp, Homo sapiens
tcccctgcacctgg

SEQ ID NO: 1054126 - DNA, 17 bp, Homo sapiens
tcccctgcactaggcag

SEQ ID NO: 1054127 - DNA, 19 bp, Homo sapiens
tcccctgcactaggcaggt

SEQ ID NO: 1054128 - DNA, 15 bp, Homo sapiens
tcccctgcactcccg

SEQ ID NO: 1054129 - DNA, 17 bp, Homo sapiens
tcccctgcagcctgggt

SEQ ID NO: 1054130 - DNA, 14 bp, Homo sapiens
tcccctgccaccag

SEQ ID NO: 1054131 - DNA, 13 bp, Homo sapiens
tcccctgcccggt

SEQ ID NO: 1054132 - DNA, 12 bp, Homo sapiens
tcccctgccctg

SEQ ID NO: 1054133 - DNA, 23 bp, Homo sapiens
tcccctgccctgctgccgcctcc

SEQ ID NO: 1054134 - DNA, 12 bp, Homo sapiens
tcccctgcctcc

SEQ ID NO: 1054135 - DNA, 13 bp, Homo sapiens
tcccctgcctcct

SEQ ID NO: 1054136 - DNA, 16 bp, Homo sapiens
tcccctgcctcctgcc

SEQ ID NO: 1054137 - DNA, 19 bp, Homo sapiens
tcccctgctactcctgtgc

SEQ ID NO: 1054138 - DNA, 14 bp, Homo sapiens
tcccctgctgacct

SEQ ID NO: 1054139 - DNA, 15 bp, Homo sapiens
tcccctggactggga

SEQ ID NO: 1054140 - DNA, 16 bp, Homo sapiens
tcccctggactgggag

SEQ ID NO: 1054141 - DNA, 12 bp, Homo sapiens
tcccctggcctt

SEQ ID NO: 1054142 - DNA, 20 bp, Homo sapiens
tcccctgggatgctgaccca

SEQ ID NO: 1054143 - DNA, 13 bp, Homo sapiens
tcccctgggcagg

SEQ ID NO: 1054144 - DNA, 20 bp, Homo sapiens
tcccctgggggtttcacctg

SEQ ID NO: 1054145 - DNA, 22 bp, Homo sapiens
tcccctgtcagtttcccctctc

SEQ ID NO: 1054146 - DNA, 19 bp, Homo sapiens
tcccctgtcccaccaactc

SEQ ID NO: 1054147 - DNA, 20 bp, Homo sapiens
tcccctgtggtgatgtgcct

SEQ ID NO: 1054148 - DNA, 16 bp, Homo sapiens
tcccctgttaaacagt

SEQ ID NO: 1054149 - DNA, 19 bp, Homo sapiens
tcccctgttcccctctccc

SEQ ID NO: 1054150 - DNA, 19 bp, Homo sapiens
tcccctgttgattatcttc

SEQ ID NO: 1054151 - DNA, 22 bp, Homo sapiens
tcccctgttgattatcttcagc

SEQ ID NO: 1054152 - DNA, 20 bp, Homo sapiens
tccccttagaggacctgagt

SEQ ID NO: 1054153 - DNA, 17 bp, Homo sapiens
tccccttatctttctaa

SEQ ID NO: 1054154 - DNA, 16 bp, Homo sapiens
tccccttcaccgctcc

SEQ ID NO: 1054155 - DNA, 13 bp, Homo sapiens
tccccttccactg

SEQ ID NO: 1054156 - DNA, 21 bp, Homo sapiens
tccccttcccccatccctacc

SEQ ID NO: 1054157 - DNA, 19 bp, Homo sapiens
tccccttccccgtcccctg

SEQ ID NO: 1054158 - DNA, 12 bp, Homo sapiens
tccccttcccct

SEQ ID NO: 1054159 - DNA, 11 bp, Homo sapiens
tccccttccct

SEQ ID NO: 1054160 - DNA, 15 bp, Homo sapiens
tccccttccctgggg

SEQ ID NO: 1054161 - DNA, 17 bp, Homo sapiens
tccctgtgttctgggct

SEQ ID NO: 1054162 - DNA, 14 bp, Homo sapiens
tccctgttctccct

SEQ ID NO: 1054163 - DNA, 23 bp, Homo sapiens
tccctgttctggtatttcccctg

SEQ ID NO: 1054164 - DNA, 16 bp, Homo sapiens
tccctgtttaatattt

SEQ ID NO: 1054165 - DNA, 19 bp, Homo sapiens
tccctgttttctgagcccg

SEQ ID NO: 1054166 - DNA, 21 bp, Homo sapiens
tccctgttttctgagcccggg

SEQ ID NO: 1054167 - DNA, 22 bp, Homo sapiens
tccctgttttctgagcccgggc

SEQ ID NO: 1054168 - DNA, 23 bp, Homo sapiens
tccctgttttctgagcccgggct

SEQ ID NO: 1054169 - DNA, 22 bp, Homo sapiens
tcccttaacagttgtatttaac

SEQ ID NO: 1054170 - DNA, 13 bp, Homo sapiens
tcccttaactcca

SEQ ID NO: 1054171 - DNA, 15 bp, Homo sapiens
tcccttaactccaag

SEQ ID NO: 1054172 - DNA, 16 bp, Homo sapiens
tcccttaactccaaga

SEQ ID NO: 1054173 - DNA, 17 bp, Homo sapiens
tcccttaactccaagaa

SEQ ID NO: 1054174 - DNA, 21 bp, Homo sapiens
tcccttaactctaaccctgtg

SEQ ID NO: 1054175 - DNA, 22 bp, Homo sapiens
tcccttaactctaaccctgtgg

SEQ ID NO: 1054176 - DNA, 16 bp, Homo sapiens
tcccttaacttttcct

SEQ ID NO: 1054177 - DNA, 18 bp, Homo sapiens
tcccttaacttttccttg

SEQ ID NO: 1054178 - DNA, 14 bp, Homo sapiens
tcccttaagaagtt

SEQ ID NO: 1054179 - DNA, 22 bp, Homo sapiens
tcccttaataaaaatatatatt

SEQ ID NO: 1054180 - DNA, 18 bp, Homo sapiens
tcccttaataaaatattc

SEQ ID NO: 1054181 - DNA, 14 bp, Homo sapiens
tcccttaatatcct

SEQ ID NO: 1054182 - DNA, 20 bp, Homo sapiens
tcccttaatattgaggctgc

SEQ ID NO: 1054183 - DNA, 18 bp, Homo sapiens
tcccttaccctcctctgc

SEQ ID NO: 1054184 - DNA, 19 bp, Homo sapiens
tcccttaccctcctctgct

SEQ ID NO: 1054185 - DNA, 21 bp, Homo sapiens
tcccttactttacctctctgt

SEQ ID NO: 1054186 - DNA, 18 bp, Homo sapiens
tcccttaggcattattta

SEQ ID NO: 1054187 - DNA, 16 bp, Homo sapiens
tcccttattgcctccc

SEQ ID NO: 1054188 - DNA, 19 bp, Homo sapiens
tcccttcacaggggtacag

SEQ ID NO: 1054189 - DNA, 20 bp, Homo sapiens
tcccttcagggattccctgt

SEQ ID NO: 1054190 - DNA, 19 bp, Homo sapiens
tcccttcagtaccctctca

SEQ ID NO: 1054191 - DNA, 12 bp, Homo sapiens
tcccttccaaag

SEQ ID NO: 1054192 - DNA, 20 bp, Homo sapiens
tcccttcccacatgcctgcg

SEQ ID NO: 1054193 - DNA, 21 bp, Homo sapiens
tcccttcccacctactgcact

SEQ ID NO: 1054194 - DNA, 12 bp, Homo sapiens
tcccttcccctc

SEQ ID NO: 1054195 - DNA, 21 bp, Homo sapiens
tcccttcccgacccagccagc

SEQ ID NO: 1054196 - DNA, 22 bp, Homo sapiens
tcccttcccgacccagccagct

SEQ ID NO: 1054197 - DNA, 10 bp, Homo sapiens
tcccttccct

SEQ ID NO: 1054198 - DNA, 14 bp, Homo sapiens
tcccttccctcacc

SEQ ID NO: 1054199 - DNA, 19 bp, Homo sapiens
tcccttccctcacccctga

SEQ ID NO: 1054200 - DNA, 15 bp, Homo sapiens
tcccttccctcctcc

SEQ ID NO: 1054201 - DNA, 20 bp, Homo sapiens
tcccttcccttgagatgagt

SEQ ID NO: 1054202 - DNA, 22 bp, Homo sapiens
tcccttccgtccatcccccttc

SEQ ID NO: 1054203 - DNA, 14 bp, Homo sapiens
tcccttcctattct

SEQ ID NO: 1054204 - DNA, 14 bp, Homo sapiens
tcccttcctcggtg

SEQ ID NO: 1054205 - DNA, 18 bp, Homo sapiens
tcccttcctcggtggctc

SEQ ID NO: 1054206 - DNA, 20 bp, Homo sapiens
tcccttcctcggtggctctg

SEQ ID NO: 1054207 - DNA, 21 bp, Homo sapiens
tcccttcctcggtggctctgg

SEQ ID NO: 1054208 - DNA, 13 bp, Homo sapiens
tcccttcctcttc

SEQ ID NO: 1054209 - DNA, 14 bp, Homo sapiens
tcccttcctcttcc

SEQ ID NO: 1054210 - DNA, 22 bp, Homo sapiens
tcccttcctcttcctgcccttg

SEQ ID NO: 1054211 - DNA, 14 bp, Homo sapiens
tcccttcctcttcg

SEQ ID NO: 1054212 - DNA, 22 bp, Homo sapiens
tcccttcctgttccctcctggt

SEQ ID NO: 1054213 - DNA, 16 bp, Homo sapiens
tcccttccttgggcag

SEQ ID NO: 1054214 - DNA, 14 bp, Homo sapiens
tcccttctccccct

SEQ ID NO: 1054215 - DNA, 20 bp, Homo sapiens
tcccttctgctactggcaaa

SEQ ID NO: 1054216 - DNA, 17 bp, Homo sapiens
tcccttgaaattttaaa

SEQ ID NO: 1054217 - DNA, 13 bp, Homo sapiens
tcccttgaccatt

SEQ ID NO: 1054218 - DNA, 19 bp, Homo sapiens
tcccttgagacctcagcca

SEQ ID NO: 1054219 - DNA, 20 bp, Homo sapiens
tcccttgagatgagtttctg

SEQ ID NO: 1054220 - DNA, 18 bp, Homo sapiens
tcccttgccccaggccag

SEQ ID NO: 1054221 - DNA, 20 bp, Homo sapiens
tcccttgcctttcgaggcct

SEQ ID NO: 1054222 - DNA, 17 bp, Homo sapiens
tcccttgctcagtgcct

SEQ ID NO: 1054223 - DNA, 19 bp, Homo sapiens
tcccttgctcagtgcctcc

SEQ ID NO: 1054224 - DNA, 20 bp, Homo sapiens
tcccttgctcagtgcctcct

SEQ ID NO: 1054225 - DNA, 15 bp, Homo sapiens
tcccttgctggcccc

SEQ ID NO: 1054226 - DNA, 19 bp, Homo sapiens
tcccttgcttagcctgtgc

SEQ ID NO: 1054227 - DNA, 13 bp, Homo sapiens
tcccttgctttgt

SEQ ID NO: 1054228 - DNA, 21 bp, Homo sapiens
tcccttgcttttccctctttt

SEQ ID NO: 1054229 - DNA, 18 bp, Homo sapiens
tcccttggaaacctgccc

SEQ ID NO: 1054230 - DNA, 14 bp, Homo sapiens
tcccttggcctcag

SEQ ID NO: 1054231 - DNA, 16 bp, Homo sapiens
tcccttggcctcagaa

SEQ ID NO: 1054232 - DNA, 22 bp, Homo sapiens
tcccttgggaaggacacagcag

SEQ ID NO: 1054233 - DNA, 14 bp, Homo sapiens
tcccttgggctccc

SEQ ID NO: 1054234 - DNA, 18 bp, Homo sapiens
tcccttgggctggaagaa

SEQ ID NO: 1054235 - DNA, 16 bp, Homo sapiens
tcccttgtgcgtgggt

SEQ ID NO: 1054236 - DNA, 15 bp, Homo sapiens
tcccttgtgtgtgtg

SEQ ID NO: 1054237 - DNA, 14 bp, Homo sapiens
tccctttaaagaga

SEQ ID NO: 1054238 - DNA, 13 bp, Homo sapiens
tccctttagaacg

SEQ ID NO: 1054239 - DNA, 22 bp, Homo sapiens
tccctttagaacggttgcccca

SEQ ID NO: 1054240 - DNA, 13 bp, Homo sapiens
tccctttccctac

SEQ ID NO: 1054241 - DNA, 16 bp, Homo sapiens
tccctttccctacctt

SEQ ID NO: 1054242 - DNA, 13 bp, Homo sapiens
tccctttcccttc

SEQ ID NO: 1054243 - DNA, 13 bp, Homo sapiens
tccctttcctggt

SEQ ID NO: 1054244 - DNA, 19 bp, Homo sapiens
tccctttccttccatccct

SEQ ID NO: 1054245 - DNA, 13 bp, Homo sapiens
tccctttctcttc

SEQ ID NO: 1054246 - DNA, 17 bp, Homo sapiens
tccctttcttggccagt

SEQ ID NO: 1054247 - DNA, 15 bp, Homo sapiens
tccctttgacttcag

SEQ ID NO: 1054248 - DNA, 17 bp, Homo sapiens
tccctttgacttcagct

SEQ ID NO: 1054249 - DNA, 17 bp, Homo sapiens
tccctttgcacctgaga

SEQ ID NO: 1054250 - DNA, 13 bp, Homo sapiens
tcccttttctgtt

SEQ ID NO: 1054251 - DNA, 16 bp, Homo sapiens
tcccttttctgttcta

SEQ ID NO: 1054252 - DNA, 19 bp, Homo sapiens
tccgaaagaagacacagaa

SEQ ID NO: 1054253 - DNA, 23 bp, Homo sapiens
tccgcactttccacttcttcctt

SEQ ID NO: 1054254 - DNA, 22 bp, Homo sapiens
tccgcagactgcttggccagat

SEQ ID NO: 1054255 - DNA, 23 bp, Homo sapiens
tccgcagactgcttggccagatg

SEQ ID NO: 1054256 - DNA, 17 bp, Homo sapiens
tccgcagtgtctccacc

SEQ ID NO: 1054257 - DNA, 19 bp, Homo sapiens
tccgcagtgtggccaggct

SEQ ID NO: 1054258 - DNA, 11 bp, Homo sapiens
tccgccactca

SEQ ID NO: 1054259 - DNA, 15 bp, Homo sapiens
tccgccactcagcca

SEQ ID NO: 1054260 - DNA, 21 bp, Homo sapiens
tccgccagaccccgtggctct

SEQ ID NO: 1054261 - DNA, 16 bp, Homo sapiens
tccgccagacctcaac

SEQ ID NO: 1054262 - DNA, 13 bp, Homo sapiens
tccgccagcctcc

SEQ ID NO: 1054263 - DNA, 15 bp, Homo sapiens
tccgccagcctcctc

SEQ ID NO: 1054264 - DNA, 16 bp, Homo sapiens
tccgccagcctcctct

SEQ ID NO: 1054265 - DNA, 15 bp, Homo sapiens
tccgccatccagggt

SEQ ID NO: 1054266 - DNA, 18 bp, Homo sapiens
tccgccatccagggtctg

SEQ ID NO: 1054267 - DNA, 21 bp, Homo sapiens
tccgccatggggtcggctcct

SEQ ID NO: 1054268 - DNA, 15 bp, Homo sapiens
tccgccattccaagt

SEQ ID NO: 1054269 - DNA, 13 bp, Homo sapiens
tccgcccagcctc

SEQ ID NO: 1054270 - DNA, 19 bp, Homo sapiens
tccgccctgctcctccctg

SEQ ID NO: 1054271 - DNA, 20 bp, Homo sapiens
tccgccctgctcctccctgg

SEQ ID NO: 1054272 - DNA, 16 bp, Homo sapiens
tccgcctcccatcccg

SEQ ID NO: 1054273 - DNA, 20 bp, Homo sapiens
tccgcctgcgcctccatcca

SEQ ID NO: 1054274 - DNA, 21 bp, Homo sapiens
tccgcctgctgggaagagctc

SEQ ID NO: 1054275 - DNA, 15 bp, Homo sapiens
tccgcgcccagcgct

SEQ ID NO: 1054276 - DNA, 20 bp, Homo sapiens
tccgcgccctccgacctctc

SEQ ID NO: 1054277 - DNA, 13 bp, Homo sapiens
tccgcggcctgca

SEQ ID NO: 1054278 - DNA, 12 bp, Homo sapiens
tccgcggggacc

SEQ ID NO: 1054279 - DNA, 15 bp, Homo sapiens
tccgctcccaccgcc

SEQ ID NO: 1054280 - DNA, 17 bp, Homo sapiens
tccgctcccaccgcccc

SEQ ID NO: 1054281 - DNA, 23 bp, Homo sapiens
tccgctcccaccgcccccacccc

SEQ ID NO: 1054282 - DNA, 15 bp, Homo sapiens
tccgctctcttcctg

SEQ ID NO: 1054283 - DNA, 14 bp, Homo sapiens
tccgctctgaggca

SEQ ID NO: 1054284 - DNA, 12 bp, Homo sapiens
tccgctgccacc

SEQ ID NO: 1054285 - DNA, 22 bp, Homo sapiens
tccgctgccaccacgtctgcca

SEQ ID NO: 1054286 - DNA, 16 bp, Homo sapiens
tccgctgctccttggc

SEQ ID NO: 1054287 - DNA, 20 bp, Homo sapiens
tccgctgtcgccccaggccc

SEQ ID NO: 1054288 - DNA, 15 bp, Homo sapiens
tccgcttatcctgct

SEQ ID NO: 1054289 - DNA, 23 bp, Homo sapiens
tccgcttctctcttttaaagtat

SEQ ID NO: 1054290 - DNA, 12 bp, Homo sapiens
tccggaaagaag

SEQ ID NO: 1054291 - DNA, 17 bp, Homo sapiens
tccggaggactgagccc

SEQ ID NO: 1054292 - DNA, 20 bp, Homo sapiens
tccggaggagcagcctcgag

SEQ ID NO: 1054293 - DNA, 20 bp, Homo sapiens
tccggaggggacccagctcc

SEQ ID NO: 1054294 - DNA, 21 bp, Homo sapiens
tccggaggggacccagctcct

SEQ ID NO: 1054295 - DNA, 16 bp, Homo sapiens
tccggagggggtcctc

SEQ ID NO: 1054296 - DNA, 18 bp, Homo sapiens
tccggagggggtcctcct

SEQ ID NO: 1054297 - DNA, 21 bp, Homo sapiens
tccggatttctaacagtcctt

SEQ ID NO: 1054298 - DNA, 21 bp, Homo sapiens
tccggccacatcattctgtgt

SEQ ID NO: 1054299 - DNA, 13 bp, Homo sapiens
tccggcccagtgc

SEQ ID NO: 1054300 - DNA, 16 bp, Homo sapiens
tccggcccagtgccac

SEQ ID NO: 1054301 - DNA, 22 bp, Homo sapiens
tccggcccagtgccactgcccc

SEQ ID NO: 1054302 - DNA, 19 bp, Homo sapiens
tccggcccagtgccagctc

SEQ ID NO: 1054303 - DNA, 20 bp, Homo sapiens
tccggcccagtgccagctcc

SEQ ID NO: 1054304 - DNA, 21 bp, Homo sapiens
tccggcccagtgccagctcca

SEQ ID NO: 1054305 - DNA, 21 bp, Homo sapiens
tccggccctcctaccctgcgc

SEQ ID NO: 1054306 - DNA, 21 bp, Homo sapiens
tccggcctgatgacagagcga

SEQ ID NO: 1054307 - DNA, 15 bp, Homo sapiens
tccggcctgcgtctc

SEQ ID NO: 1054308 - DNA, 21 bp, Homo sapiens
tccggcgccccgcacccccgc

SEQ ID NO: 1054309 - DNA, 14 bp, Homo sapiens
tccggctgcctagc

SEQ ID NO: 1054310 - DNA, 20 bp, Homo sapiens
tccggctgctcctccagccc

SEQ ID NO: 1054311 - DNA, 21 bp, Homo sapiens
tccggctgctcctccagccct

SEQ ID NO: 1054312 - DNA, 23 bp, Homo sapiens
tccgggaccattgacctcagctg

SEQ ID NO: 1054313 - DNA, 19 bp, Homo sapiens
tccgggagagcggctgccc

SEQ ID NO: 1054314 - DNA, 12 bp, Homo sapiens
tccgggagctgg

SEQ ID NO: 1054315 - DNA, 19 bp, Homo sapiens
tccgggcaaatgccagggc

SEQ ID NO: 1054316 - DNA, 12 bp, Homo sapiens
tccgggcagaaa

SEQ ID NO: 1054317 - DNA, 11 bp, Homo sapiens
tccgggcaggg

SEQ ID NO: 1054318 - DNA, 23 bp, Homo sapiens
tccgggctgggggggctgcctcc

SEQ ID NO: 1054319 - DNA, 20 bp, Homo sapiens
tccggggtctgtgctgtgcc

SEQ ID NO: 1054320 - DNA, 14 bp, Homo sapiens
tccgggtctcgcag

SEQ ID NO: 1054321 - DNA, 18 bp, Homo sapiens
tccgggtctcgcagcctg

SEQ ID NO: 1054322 - DNA, 15 bp, Homo sapiens
tccgggtgtggcctc

SEQ ID NO: 1054323 - DNA, 18 bp, Homo sapiens
tccgggtgtggcctcagc

SEQ ID NO: 1054324 - DNA, 19 bp, Homo sapiens
tccggtcccctgcctggaa

SEQ ID NO: 1054325 - DNA, 17 bp, Homo sapiens
tccggtgtgcctgcagc

SEQ ID NO: 1054326 - DNA, 20 bp, Homo sapiens
tccgtagggtctttcttggg

SEQ ID NO: 1054327 - DNA, 21 bp, Homo sapiens
tccgtagggtctttcttggga

SEQ ID NO: 1054328 - DNA, 22 bp, Homo sapiens
tccgtaggtagatgtgtaacct

SEQ ID NO: 1054329 - DNA, 14 bp, Homo sapiens
tccgtagttccctg

SEQ ID NO: 1054330 - DNA, 15 bp, Homo sapiens
tccgtagttccctga

SEQ ID NO: 1054331 - DNA, 15 bp, Homo sapiens
tccgtatctccctgg

SEQ ID NO: 1054332 - DNA, 11 bp, Homo sapiens
tccgtcatcca

SEQ ID NO: 1054333 - DNA, 17 bp, Homo sapiens
tccgtcattgctgctgc

SEQ ID NO: 1054334 - DNA, 13 bp, Homo sapiens
tccgtccacccag

SEQ ID NO: 1054335 - DNA, 16 bp, Homo sapiens
tccgtccacccttcca

SEQ ID NO: 1054336 - DNA, 19 bp, Homo sapiens
tccgtccacccttccatca

SEQ ID NO: 1054337 - DNA, 18 bp, Homo sapiens
tccgtccccccccaggcc

SEQ ID NO: 1054338 - DNA, 16 bp, Homo sapiens
tccgtctctgtcctcg

SEQ ID NO: 1054339 - DNA, 21 bp, Homo sapiens
tccgtctgtctcgatgcctga

SEQ ID NO: 1054340 - DNA, 23 bp, Homo sapiens
tccgtctgtctgtcgcccttctc

SEQ ID NO: 1054341 - DNA, 19 bp, Homo sapiens
tccgtgatccatccatctc

SEQ ID NO: 1054342 - DNA, 13 bp, Homo sapiens
tccgtgcccaggc

SEQ ID NO: 1054343 - DNA, 16 bp, Homo sapiens
tccgtgcccaggccct

SEQ ID NO: 1054344 - DNA, 17 bp, Homo sapiens
tccgtgcctccaccacc

SEQ ID NO: 1054345 - DNA, 16 bp, Homo sapiens
tccgtggactgcagtc

SEQ ID NO: 1054346 - DNA, 21 bp, Homo sapiens
tccgtgggccgtatctgtcac

SEQ ID NO: 1054347 - DNA, 12 bp, Homo sapiens
tccgtggtttgt

SEQ ID NO: 1054348 - DNA, 18 bp, Homo sapiens
tccgtggtttgtactcaa

SEQ ID NO: 1054349 - DNA, 21 bp, Homo sapiens
tccgtgtctcgcgcgactgag

SEQ ID NO: 1054350 - DNA, 13 bp, Homo sapiens
tccgtgtggagca

SEQ ID NO: 1054351 - DNA, 21 bp, Homo sapiens
tccgtgtggagcacgtggaga

SEQ ID NO: 1054352 - DNA, 15 bp, Homo sapiens
tccgtgtgtcccaga

SEQ ID NO: 1054353 - DNA, 20 bp, Homo sapiens
tccgtgtgtcccagatgctg

SEQ ID NO: 1054354 - DNA, 13 bp, Homo sapiens
tccgttaaaatac

SEQ ID NO: 1054355 - DNA, 16 bp, Homo sapiens
tccgttagctcctgtg

SEQ ID NO: 1054356 - DNA, 16 bp, Homo sapiens
tccgttcacatgtgtg

SEQ ID NO: 1054357 - DNA, 15 bp, Homo sapiens
tccgttggccactcc

SEQ ID NO: 1054358 - DNA, 15 bp, Homo sapiens
tcctaaaacaaatag

SEQ ID NO: 1054359 - DNA, 13 bp, Homo sapiens
tcctaaaacaaca

SEQ ID NO: 1054360 - DNA, 16 bp, Homo sapiens
tcctaaaacaacagat

SEQ ID NO: 1054361 - DNA, 11 bp, Homo sapiens
tcctaaacata

SEQ ID NO: 1054362 - DNA, 17 bp, Homo sapiens
tcctaaactctctagct

SEQ ID NO: 1054363 - DNA, 18 bp, Homo sapiens
tcctaaagagagtatttt

SEQ ID NO: 1054364 - DNA, 19 bp, Homo sapiens
tcctaaagccatcatgcct

SEQ ID NO: 1054365 - DNA, 21 bp, Homo sapiens
tcctaaagccatcatgccttg

SEQ ID NO: 1054366 - DNA, 23 bp, Homo sapiens
tcctaaatattttcaagaaaaga

SEQ ID NO: 1054367 - DNA, 13 bp, Homo sapiens
tcctaacttcctt

SEQ ID NO: 1054368 - DNA, 14 bp, Homo sapiens
tcctaacttttcaa

SEQ ID NO: 1054369 - DNA, 20 bp, Homo sapiens
tcctaagaaagaggagtgct

SEQ ID NO: 1054370 - DNA, 17 bp, Homo sapiens
tcctaagagtgctgggc

SEQ ID NO: 1054371 - DNA, 20 bp, Homo sapiens
tcctaagatgtgttcttatt

SEQ ID NO: 1054372 - DNA, 19 bp, Homo sapiens
tcctatatctgtttgtata

SEQ ID NO: 1054373 - DNA, 18 bp, Homo sapiens
tcctatattgttttcagt

SEQ ID NO: 1054374 - DNA, 20 bp, Homo sapiens
tcctatcaagccagtacgtg

SEQ ID NO: 1054375 - DNA, 17 bp, Homo sapiens
tcctatcacctcccctc

SEQ ID NO: 1054376 - DNA, 17 bp, Homo sapiens
tcctatcagaagtttct

SEQ ID NO: 1054377 - DNA, 19 bp, Homo sapiens
tcctatccttggagagcag

SEQ ID NO: 1054378 - DNA, 15 bp, Homo sapiens
tcctatctagcattt

SEQ ID NO: 1054379 - DNA, 17 bp, Homo sapiens
tcctatctatcttccaa

SEQ ID NO: 1054380 - DNA, 17 bp, Homo sapiens
tcctatctccagcggcc

SEQ ID NO: 1054381 - DNA, 14 bp, Homo sapiens
tcctatctgtgttt

SEQ ID NO: 1054382 - DNA, 18 bp, Homo sapiens
tcctatctttcctcccta

SEQ ID NO: 1054383 - DNA, 19 bp, Homo sapiens
tcctatgatggatggcaga

SEQ ID NO: 1054384 - DNA, 22 bp, Homo sapiens
tcctatgcttaataaaagaaca

SEQ ID NO: 1054385 - DNA, 13 bp, Homo sapiens
tcctatggaaaca

SEQ ID NO: 1054386 - DNA, 18 bp, Homo sapiens
tcctatgtcaatttgtat

SEQ ID NO: 1054387 - DNA, 11 bp, Homo sapiens
tcctatgtttg

SEQ ID NO: 1054388 - DNA, 15 bp, Homo sapiens
tcctattctcaccag

SEQ ID NO: 1054389 - DNA, 20 bp, Homo sapiens
tcctattctcaccaggaagg

SEQ ID NO: 1054390 - DNA, 14 bp, Homo sapiens
tcctattctcctgc

SEQ ID NO: 1054391 - DNA, 15 bp, Homo sapiens
tcctattctcctgcc

SEQ ID NO: 1054392 - DNA, 21 bp, Homo sapiens
tcctattgtgcaatgtaaata

SEQ ID NO: 1054393 - DNA, 13 bp, Homo sapiens
tcctcaaaccact

SEQ ID NO: 1054394 - DNA, 18 bp, Homo sapiens
tcctcaaaccacttgcct

SEQ ID NO: 1054395 - DNA, 23 bp, Homo sapiens
tcctcaaaccacttgcctggggc

SEQ ID NO: 1054396 - DNA, 18 bp, Homo sapiens
tcctcaaacgacagagga

SEQ ID NO: 1054397 - DNA, 19 bp, Homo sapiens
tcctcaaagaaagtgtatt

SEQ ID NO: 1054398 - DNA, 18 bp, Homo sapiens
tcctcaaataagtcttcc

SEQ ID NO: 1054399 - DNA, 14 bp, Homo sapiens
tcctcaacactatt

SEQ ID NO: 1054400 - DNA, 16 bp, Homo sapiens
tcctcaagactttgat

SEQ ID NO: 1054401 - DNA, 22 bp, Homo sapiens
tcctcaagactttgatccttgg

SEQ ID NO: 1054402 - DNA, 16 bp, Homo sapiens
tcctcaagcaataatt

SEQ ID NO: 1054403 - DNA, 23 bp, Homo sapiens
tcctcaagcaataattgtttcca

SEQ ID NO: 1054404 - DNA, 13 bp, Homo sapiens
tcctcaagcctgt

SEQ ID NO: 1054405 - DNA, 15 bp, Homo sapiens
tcctcaagcctgtgg

SEQ ID NO: 1054406 - DNA, 18 bp, Homo sapiens
tcctcaagcctgtgggca

SEQ ID NO: 1054407 - DNA, 18 bp, Homo sapiens
tcctcaagtccccaagat

SEQ ID NO: 1054408 - DNA, 13 bp, Homo sapiens
tcctcaatccagc

SEQ ID NO: 1054409 - DNA, 14 bp, Homo sapiens
tcctcaatccagct

SEQ ID NO: 1054410 - DNA, 20 bp, Homo sapiens
tcctcacaagcctcttctga

SEQ ID NO: 1054411 - DNA, 19 bp, Homo sapiens
tcctcacacaccctgaggt

SEQ ID NO: 1054412 - DNA, 17 bp, Homo sapiens
tcctcacactgctgtcc

SEQ ID NO: 1054413 - DNA, 21 bp, Homo sapiens
tcctcacactgctgtcctctc

SEQ ID NO: 1054414 - DNA, 22 bp, Homo sapiens
tcctcacacttttggaaccatg

SEQ ID NO: 1054415 - DNA, 15 bp, Homo sapiens
tcctcacataaaaaa

SEQ ID NO: 1054416 - DNA, 18 bp, Homo sapiens
tcctcacatacccacaca

SEQ ID NO: 1054417 - DNA, 15 bp, Homo sapiens
tcctcaccatccaca

SEQ ID NO: 1054418 - DNA, 16 bp, Homo sapiens
tcctcacccacctctg

SEQ ID NO: 1054419 - DNA, 17 bp, Homo sapiens
tcctcacccacctctgg

SEQ ID NO: 1054420 - DNA, 16 bp, Homo sapiens
tcctcacccccagctt

SEQ ID NO: 1054421 - DNA, 18 bp, Homo sapiens
tcctcacccctgtaggga

SEQ ID NO: 1054422 - DNA, 21 bp, Homo sapiens
tcctcacctctggactggcta

SEQ ID NO: 1054423 - DNA, 22 bp, Homo sapiens
tcctcacctctggactggctag

SEQ ID NO: 1054424 - DNA, 23 bp, Homo sapiens
tcctcacctctggactggctaga

SEQ ID NO: 1054425 - DNA, 12 bp, Homo sapiens
tcctcacctggt

SEQ ID NO: 1054426 - DNA, 17 bp, Homo sapiens
tcctcacgccttggcct

SEQ ID NO: 1054427 - DNA, 23 bp, Homo sapiens
tcctcactggaggagcagcttcc

SEQ ID NO: 1054428 - DNA, 16 bp, Homo sapiens
tcctcactgtcctgtt

SEQ ID NO: 1054429 - DNA, 24 bp, Homo sapiens
tcctcacttttcaatttgtcatgt

SEQ ID NO: 1054430 - DNA, 17 bp, Homo sapiens
tcctcagaacccacagt

SEQ ID NO: 1054431 - DNA, 17 bp, Homo sapiens
tcctcagaatgatttgt

SEQ ID NO: 1054432 - DNA, 20 bp, Homo sapiens
tcctcagagcaggggccaga

SEQ ID NO: 1054433 - DNA, 17 bp, Homo sapiens
tcctcagagcgccagga

SEQ ID NO: 1054434 - DNA, 19 bp, Homo sapiens
tcctcagaggctgagccct

SEQ ID NO: 1054435 - DNA, 13 bp, Homo sapiens
tcctcagatgggg

SEQ ID NO: 1054436 - DNA, 15 bp, Homo sapiens
tcctcagatggggca

SEQ ID NO: 1054437 - DNA, 19 bp, Homo sapiens
tcctcagcatttcttttct

SEQ ID NO: 1054438 - DNA, 12 bp, Homo sapiens
tcctcagccagt

SEQ ID NO: 1054439 - DNA, 21 bp, Homo sapiens
tcctcagccatgggaacctca

SEQ ID NO: 1054440 - DNA, 12 bp, Homo sapiens
tcctcagccccc

SEQ ID NO: 1054441 - DNA, 18 bp, Homo sapiens
tcctcagcccctccagtc

SEQ ID NO: 1054442 - DNA, 15 bp, Homo sapiens
tcctcagcctctgca

SEQ ID NO: 1054443 - DNA, 17 bp, Homo sapiens
tcctcagcctctgcaac

SEQ ID NO: 1054444 - DNA, 18 bp, Homo sapiens
tcctcagcgagaggcagc

SEQ ID NO: 1054445 - DNA, 23 bp, Homo sapiens
tcctcagctgcatggagcctgga

SEQ ID NO: 1054446 - DNA, 15 bp, Homo sapiens
tcctcagctgctccc

SEQ ID NO: 1054447 - DNA, 16 bp, Homo sapiens
tcctcagctgctccca

SEQ ID NO: 1054448 - DNA, 15 bp, Homo sapiens
tcctcagcttgggct

SEQ ID NO: 1054449 - DNA, 20 bp, Homo sapiens
tcctcagcttgggcttcttc

SEQ ID NO: 1054450 - DNA, 13 bp, Homo sapiens
tcctcaggacaag

SEQ ID NO: 1054451 - DNA, 15 bp, Homo sapiens
tcctcaggaccctca

SEQ ID NO: 1054452 - DNA, 22 bp, Homo sapiens
tcctcaggaccctcagccctgg

SEQ ID NO: 1054453 - DNA, 22 bp, Homo sapiens
tcctcaggcacacagctactct

SEQ ID NO: 1054454 - DNA, 16 bp, Homo sapiens
tcctcagggacagaga

SEQ ID NO: 1054455 - DNA, 17 bp, Homo sapiens
tcctcaggggtggagaa

SEQ ID NO: 1054456 - DNA, 14 bp, Homo sapiens
tcctcaggtcagct

SEQ ID NO: 1054457 - DNA, 20 bp, Homo sapiens
tcctcaggtcagctgggagc

SEQ ID NO: 1054458 - DNA, 22 bp, Homo sapiens
tcctcaggtggccagcctggat

SEQ ID NO: 1054459 - DNA, 18 bp, Homo sapiens
tcctcaggtggccatgcc

SEQ ID NO: 1054460 - DNA, 20 bp, Homo sapiens
tcctcagtttaatccttcta

SEQ ID NO: 1054461 - DNA, 16 bp, Homo sapiens
tcctcagtttacatct

SEQ ID NO: 1054462 - DNA, 13 bp, Homo sapiens
tcctcatcagtgt

SEQ ID NO: 1054463 - DNA, 21 bp, Homo sapiens
tcctcatcagtgtgtaaataa

SEQ ID NO: 1054464 - DNA, 15 bp, Homo sapiens
tcctcatcccctcgt

SEQ ID NO: 1054465 - DNA, 14 bp, Homo sapiens
tcctcatccctgac

SEQ ID NO: 1054466 - DNA, 13 bp, Homo sapiens
tcctcatgtaaca

SEQ ID NO: 1054467 - DNA, 17 bp, Homo sapiens
tcctcattaaattacct

SEQ ID NO: 1054468 - DNA, 18 bp, Homo sapiens
tcctcattagcattttgc

SEQ ID NO: 1054469 - DNA, 19 bp, Homo sapiens
tcctcattgcctcctgttc

SEQ ID NO: 1054470 - DNA, 23 bp, Homo sapiens
tcctcattgttggagtgtaaacc

SEQ ID NO: 1054471 - DNA, 20 bp, Homo sapiens
tcctccaaatctgatttcat

SEQ ID NO: 1054472 - DNA, 17 bp, Homo sapiens
tcctccaacaccaagca

SEQ ID NO: 1054473 - DNA, 12 bp, Homo sapiens
tcctccaagcca

SEQ ID NO: 1054474 - DNA, 15 bp, Homo sapiens
tcctccaatgtcctg

SEQ ID NO: 1054475 - DNA, 13 bp, Homo sapiens
tcctccacagtgc

SEQ ID NO: 1054476 - DNA, 22 bp, Homo sapiens
tcctccagaagcctctggctag

SEQ ID NO: 1054477 - DNA, 12 bp, Homo sapiens
tcctccagacca

SEQ ID NO: 1054478 - DNA, 12 bp, Homo sapiens
tcctccagcagg

SEQ ID NO: 1054479 - DNA, 20 bp, Homo sapiens
tcctccagcagggaaaatgc

SEQ ID NO: 1054480 - DNA, 11 bp, Homo sapiens
tcctccagccc

SEQ ID NO: 1054481 - DNA, 15 bp, Homo sapiens
tcctccagcccctgt

SEQ ID NO: 1054482 - DNA, 16 bp, Homo sapiens
tcctccagccctgccc

SEQ ID NO: 1054483 - DNA, 18 bp, Homo sapiens
tcctccagccctgcccac

SEQ ID NO: 1054484 - DNA, 13 bp, Homo sapiens
tcctccagctgca

SEQ ID NO: 1054485 - DNA, 21 bp, Homo sapiens
tcctccagggaaggtggccac

SEQ ID NO: 1054486 - DNA, 19 bp, Homo sapiens
tcctccagggccacgtgcc

SEQ ID NO: 1054487 - DNA, 20 bp, Homo sapiens
tcctccagggccacgtgcca

SEQ ID NO: 1054488 - DNA, 23 bp, Homo sapiens
tcctccagggccacgtgccaggc

SEQ ID NO: 1054489 - DNA, 20 bp, Homo sapiens
tcctccagggtggcagcaac

SEQ ID NO: 1054490 - DNA, 21 bp, Homo sapiens
tcctccagggtggcagcaaca

SEQ ID NO: 1054491 - DNA, 17 bp, Homo sapiens
tcctccagtaccttgct

SEQ ID NO: 1054492 - DNA, 21 bp, Homo sapiens
tcctccatctttctacagaga

SEQ ID NO: 1054493 - DNA, 12 bp, Homo sapiens
tcctccatggtg

SEQ ID NO: 1054494 - DNA, 15 bp, Homo sapiens
tcctccatggtggaa

SEQ ID NO: 1054495 - DNA, 22 bp, Homo sapiens
tcctcccaaccaaccagcaggg

SEQ ID NO: 1054496 - DNA, 21 bp, Homo sapiens
tcctcccaggcgccccttccc

SEQ ID NO: 1054497 - DNA, 17 bp, Homo sapiens
tcctgtgcttgcttaga

SEQ ID NO: 1054498 - DNA, 14 bp, Homo sapiens
tcctgtgctttctg

SEQ ID NO: 1054499 - DNA, 20 bp, Homo sapiens
tcctgtgctttctgcatgct

SEQ ID NO: 1054500 - DNA, 21 bp, Homo sapiens
tcctgtggaaggcagagaaat

SEQ ID NO: 1054501 - DNA, 22 bp, Homo sapiens
tcctgtggaaggcagagaaatc

SEQ ID NO: 1054502 - DNA, 23 bp, Homo sapiens
tcctgtggaaggcagagaaatct

SEQ ID NO: 1054503 - DNA, 18 bp, Homo sapiens
tcctgtggagatgacttg

SEQ ID NO: 1054504 - DNA, 21 bp, Homo sapiens
tcctgtggatgggatcctctc

SEQ ID NO: 1054505 - DNA, 13 bp, Homo sapiens
tcctgtggccagg

SEQ ID NO: 1054506 - DNA, 12 bp, Homo sapiens
tcctgtggcccc

SEQ ID NO: 1054507 - DNA, 23 bp, Homo sapiens
tcctgtggccccaccctgggccc

SEQ ID NO: 1054508 - DNA, 12 bp, Homo sapiens
tcctgtggctcc

SEQ ID NO: 1054509 - DNA, 18 bp, Homo sapiens
tcctgtgtaatcatttct

SEQ ID NO: 1054510 - DNA, 23 bp, Homo sapiens
tcctgtgtaatcatttcttgggc

SEQ ID NO: 1054511 - DNA, 14 bp, Homo sapiens
tcctgtgtcccctg

SEQ ID NO: 1054512 - DNA, 22 bp, Homo sapiens
tcctgtgtcccctgacctgtcc

SEQ ID NO: 1054513 - DNA, 15 bp, Homo sapiens
tcctgtgtttgtcct

SEQ ID NO: 1054514 - DNA, 19 bp, Homo sapiens
tcctgtgtttgtcctgggt

SEQ ID NO: 1054515 - DNA, 20 bp, Homo sapiens
tcctgtgtttgtcctgggtt

SEQ ID NO: 1054516 - DNA, 21 bp, Homo sapiens
tcctgtgtttgtcctgggttc

SEQ ID NO: 1054517 - DNA, 13 bp, Homo sapiens
tcctgttccctac

SEQ ID NO: 1054518 - DNA, 14 bp, Homo sapiens
tcctgttccctcct

SEQ ID NO: 1054519 - DNA, 21 bp, Homo sapiens
tcctgttccctcctggtcctg

SEQ ID NO: 1054520 - DNA, 19 bp, Homo sapiens
tcctgttcttaagacgtga

SEQ ID NO: 1054521 - DNA, 14 bp, Homo sapiens
tcctgttcttcctt

SEQ ID NO: 1054522 - DNA, 18 bp, Homo sapiens
tcctgttcttccttccta

SEQ ID NO: 1054523 - DNA, 20 bp, Homo sapiens
tcctgttcttccttcctaga

SEQ ID NO: 1054524 - DNA, 13 bp, Homo sapiens
tcctgttgaagac

SEQ ID NO: 1054525 - DNA, 14 bp, Homo sapiens
tcctgttgaagact

SEQ ID NO: 1054526 - DNA, 13 bp, Homo sapiens
tcctgttgacctt

SEQ ID NO: 1054527 - DNA, 18 bp, Homo sapiens
tcctgtttattcccatct

SEQ ID NO: 1054528 - DNA, 18 bp, Homo sapiens
tcctgtttcagacccccc

SEQ ID NO: 1054529 - DNA, 18 bp, Homo sapiens
tcctgtttcctagctgtg

SEQ ID NO: 1054530 - DNA, 18 bp, Homo sapiens
tcctgtttgaaatatcat

SEQ ID NO: 1054531 - DNA, 13 bp, Homo sapiens
tcctgtttggaac

SEQ ID NO: 1054532 - DNA, 23 bp, Homo sapiens
tcctgtttggtggggtggcacct

SEQ ID NO: 1054533 - DNA, 17 bp, Homo sapiens
tcctgtttgtctgatgt

SEQ ID NO: 1054534 - DNA, 20 bp, Homo sapiens
tcctgttttataatgaaccc

SEQ ID NO: 1054535 - DNA, 16 bp, Homo sapiens
tcctgttttctccctc

SEQ ID NO: 1054536 - DNA, 18 bp, Homo sapiens
tcctgttttctccctctc

SEQ ID NO: 1054537 - DNA, 20 bp, Homo sapiens
tccttaaaaaaaaaaaaatt

SEQ ID NO: 1054538 - DNA, 14 bp, Homo sapiens
tccttaaacatgaa

SEQ ID NO: 1054539 - DNA, 16 bp, Homo sapiens
tccttaaactgtgtgg

SEQ ID NO: 1054540 - DNA, 23 bp, Homo sapiens
tccttaaataaactcaatgagct

SEQ ID NO: 1054541 - DNA, 15 bp, Homo sapiens
tccttaaatcttaat

SEQ ID NO: 1054542 - DNA, 17 bp, Homo sapiens
tccttaaatcttaatgt

SEQ ID NO: 1054543 - DNA, 22 bp, Homo sapiens
tccttaaatgacttttcttaag

SEQ ID NO: 1054544 - DNA, 16 bp, Homo sapiens
tccttaagaacacaaa

SEQ ID NO: 1054545 - DNA, 18 bp, Homo sapiens
tccttaatcccagtacga

SEQ ID NO: 1054546 - DNA, 21 bp, Homo sapiens
tccttaatgaaaaatacatat

SEQ ID NO: 1054547 - DNA, 18 bp, Homo sapiens
tccttaatggtgttctct

SEQ ID NO: 1054548 - DNA, 19 bp, Homo sapiens
tccttaattcactcccaca

SEQ ID NO: 1054549 - DNA, 17 bp, Homo sapiens
tccttaatttaattgct

SEQ ID NO: 1054550 - DNA, 18 bp, Homo sapiens
tccttaatttaattgctt

SEQ ID NO: 1054551 - DNA, 22 bp, Homo sapiens
tccttaatttaattgctttgaa

SEQ ID NO: 1054552 - DNA, 22 bp, Homo sapiens
tccttacaagttagaaaacata

SEQ ID NO: 1054553 - DNA, 18 bp, Homo sapiens
tccttacctatttcctca

SEQ ID NO: 1054554 - DNA, 18 bp, Homo sapiens
tccttacctcggggagag

SEQ ID NO: 1054555 - DNA, 15 bp, Homo sapiens
tccttacctctggaa

SEQ ID NO: 1054556 - DNA, 16 bp, Homo sapiens
tccttacctctggaac

SEQ ID NO: 1054557 - DNA, 14 bp, Homo sapiens
tccttacctcttcc

SEQ ID NO: 1054558 - DNA, 14 bp, Homo sapiens
tccttactctgagc

SEQ ID NO: 1054559 - DNA, 14 bp, Homo sapiens
tccttacttgcact

SEQ ID NO: 1054560 - DNA, 15 bp, Homo sapiens
tccttacttgcactg

SEQ ID NO: 1054561 - DNA, 19 bp, Homo sapiens
tccttagaaaaaaaattat

SEQ ID NO: 1054562 - DNA, 20 bp, Homo sapiens
tccttagaacattttaattc

SEQ ID NO: 1054563 - DNA, 18 bp, Homo sapiens
tccttagacctgagggac

SEQ ID NO: 1054564 - DNA, 19 bp, Homo sapiens
tccttagagaagtttgtgg

SEQ ID NO: 1054565 - DNA, 18 bp, Homo sapiens
tccttagcttagacctca

SEQ ID NO: 1054566 - DNA, 21 bp, Homo sapiens
tccttagcttagacctcagcc

SEQ ID NO: 1054567 - DNA, 23 bp, Homo sapiens
tccttaggaaaatgcttctgttg

SEQ ID NO: 1054568 - DNA, 17 bp, Homo sapiens
tccttagtcttctcata

SEQ ID NO: 1054569 - DNA, 22 bp, Homo sapiens
tccttagtcttctcatagcatt

SEQ ID NO: 1054570 - DNA, 12 bp, Homo sapiens
tccttagtgtat

SEQ ID NO: 1054571 - DNA, 14 bp, Homo sapiens
tccttatcaaagga

SEQ ID NO: 1054572 - DNA, 21 bp, Homo sapiens
tccttatcactgacacaaaaa

SEQ ID NO: 1054573 - DNA, 19 bp, Homo sapiens
tccttatcctacagtacaa

SEQ ID NO: 1054574 - DNA, 23 bp, Homo sapiens
tccttatgccacccccgctggag

SEQ ID NO: 1054575 - DNA, 15 bp, Homo sapiens
tccttattcttctca

SEQ ID NO: 1054576 - DNA, 20 bp, Homo sapiens
tccttatttcaagggttgct

SEQ ID NO: 1054577 - DNA, 23 bp, Homo sapiens
tccttatttcaagggttgcttct

SEQ ID NO: 1054578 - DNA, 17 bp, Homo sapiens
tccttatttctctctcc

SEQ ID NO: 1054579 - DNA, 20 bp, Homo sapiens
tccttatttctctctcctgg

SEQ ID NO: 1054580 - DNA, 13 bp, Homo sapiens
tccttattttgta

SEQ ID NO: 1054581 - DNA, 18 bp, Homo sapiens
tccttcaaagtctcaatg

SEQ ID NO: 1054582 - DNA, 12 bp, Homo sapiens
tccttcaaataa

SEQ ID NO: 1054583 - DNA, 15 bp, Homo sapiens
tccttcaaataaaga

SEQ ID NO: 1054584 - DNA, 17 bp, Homo sapiens
tccttcaaataaagaaa

SEQ ID NO: 1054585 - DNA, 20 bp, Homo sapiens
tccttcaaataaagaaattt

SEQ ID NO: 1054586 - DNA, 20 bp, Homo sapiens
tccttcaagaactctgggct

SEQ ID NO: 1054587 - DNA, 19 bp, Homo sapiens
tccttcaagttagctcagg

SEQ ID NO: 1054588 - DNA, 20 bp, Homo sapiens
tccttcaagttagctcagga

SEQ ID NO: 1054589 - DNA, 14 bp, Homo sapiens
tccttcacatcctg

SEQ ID NO: 1054590 - DNA, 16 bp, Homo sapiens
tccttcactcatccag

SEQ ID NO: 1054591 - DNA, 12 bp, Homo sapiens
tccttcactgcc

SEQ ID NO: 1054592 - DNA, 12 bp, Homo sapiens
tccttcactgtt

SEQ ID NO: 1054593 - DNA, 20 bp, Homo sapiens
tccttcactgttccctctgg

SEQ ID NO: 1054594 - DNA, 13 bp, Homo sapiens
tccttcactgttt

SEQ ID NO: 1054595 - DNA, 15 bp, Homo sapiens
tccttcactgtttca

SEQ ID NO: 1054596 - DNA, 13 bp, Homo sapiens
tccttcagacacc

SEQ ID NO: 1054597 - DNA, 13 bp, Homo sapiens
tccttcagagctc

SEQ ID NO: 1054598 - DNA, 18 bp, Homo sapiens
tccttcagtgagcccctc

SEQ ID NO: 1054599 - DNA, 20 bp, Homo sapiens
tccttcagtgagcccctccc

SEQ ID NO: 1054600 - DNA, 21 bp, Homo sapiens
tccttcagtgagcccctcccc

SEQ ID NO: 1054601 - DNA, 19 bp, Homo sapiens
tccttcatgacagcctcca

SEQ ID NO: 1054602 - DNA, 15 bp, Homo sapiens
tccttcattcatagg

SEQ ID NO: 1054603 - DNA, 18 bp, Homo sapiens
tccttcatttccaccagg

SEQ ID NO: 1054604 - DNA, 19 bp, Homo sapiens
tccttcatttccaccaggc

SEQ ID NO: 1054605 - DNA, 18 bp, Homo sapiens
tccttccaaaaaattaaa

SEQ ID NO: 1054606 - DNA, 15 bp, Homo sapiens
tccttccacatgtac

SEQ ID NO: 1054607 - DNA, 16 bp, Homo sapiens
tccttccaggccccca

SEQ ID NO: 1054608 - DNA, 21 bp, Homo sapiens
tccttccaggcccccaccact

SEQ ID NO: 1054609 - DNA, 21 bp, Homo sapiens
tccttccagtgtccttagaac

SEQ ID NO: 1054610 - DNA, 15 bp, Homo sapiens
tccttccatcaaata

SEQ ID NO: 1054611 - DNA, 22 bp, Homo sapiens
tccttccatctagcagctggcc

SEQ ID NO: 1054612 - DNA, 14 bp, Homo sapiens
tccttccatcttgt

SEQ ID NO: 1054613 - DNA, 17 bp, Homo sapiens
tccttccatcttgtggg

SEQ ID NO: 1054614 - DNA, 22 bp, Homo sapiens
tccttccatcttgtggggccag

SEQ ID NO: 1054615 - DNA, 16 bp, Homo sapiens
tccttccattcagatg

SEQ ID NO: 1054616 - DNA, 16 bp, Homo sapiens
tccttcccaggacccc

SEQ ID NO: 1054617 - DNA, 18 bp, Homo sapiens
tcgactggtccagctctg

SEQ ID NO: 1054618 - DNA, 14 bp, Homo sapiens
tcgacttatttctt

SEQ ID NO: 1054619 - DNA, 21 bp, Homo sapiens
tcgacttgaccctttcctccc

SEQ ID NO: 1054620 - DNA, 14 bp, Homo sapiens
tcgagaagggtgga

SEQ ID NO: 1054621 - DNA, 19 bp, Homo sapiens
tcgagaccagcctggccaa

SEQ ID NO: 1054622 - DNA, 16 bp, Homo sapiens
tcgagaccatcctggc

SEQ ID NO: 1054623 - DNA, 19 bp, Homo sapiens
tcgagaccatcctggcccc

SEQ ID NO: 1054624 - DNA, 23 bp, Homo sapiens
tcgagaccatcctggcccctcca

SEQ ID NO: 1054625 - DNA, 18 bp, Homo sapiens
tcgagaccatcctggcta

SEQ ID NO: 1054626 - DNA, 18 bp, Homo sapiens
tcgagacccaaaccccca

SEQ ID NO: 1054627 - DNA, 21 bp, Homo sapiens
tcgagagctggccaaagagcc

SEQ ID NO: 1054628 - DNA, 21 bp, Homo sapiens
tcgagatggcagattcccact

SEQ ID NO: 1054629 - DNA, 19 bp, Homo sapiens
tcgagattatcgttttctt

SEQ ID NO: 1054630 - DNA, 16 bp, Homo sapiens
tcgagattgcactgct

SEQ ID NO: 1054631 - DNA, 16 bp, Homo sapiens
tcgagatttgggagct

SEQ ID NO: 1054632 - DNA, 17 bp, Homo sapiens
tcgagcagcattttatt

SEQ ID NO: 1054633 - DNA, 17 bp, Homo sapiens
tcgagcagtcctgcctc

SEQ ID NO: 1054634 - DNA, 16 bp, Homo sapiens
tcgagcccagatggaa

SEQ ID NO: 1054635 - DNA, 14 bp, Homo sapiens
tcgagccccctgga

SEQ ID NO: 1054636 - DNA, 15 bp, Homo sapiens
tcgagccccctggat

SEQ ID NO: 1054637 - DNA, 22 bp, Homo sapiens
tcgagccccctggatgtcccct

SEQ ID NO: 1054638 - DNA, 21 bp, Homo sapiens
tcgctctgttgcccaggctgg

SEQ ID NO: 1054639 - DNA, 16 bp, Homo sapiens
tcgctgacttcatgga

SEQ ID NO: 1054640 - DNA, 19 bp, Homo sapiens
tcgctgccatcaccgctgg

SEQ ID NO: 1054641 - DNA, 21 bp, Homo sapiens
tcgctgctctagctggcagga

SEQ ID NO: 1054642 - DNA, 14 bp, Homo sapiens
tcgctgctgctact

SEQ ID NO: 1054643 - DNA, 18 bp, Homo sapiens
tcgctgttggagcaaacc

SEQ ID NO: 1054644 - DNA, 15 bp, Homo sapiens
tcgcttcttgcctct

SEQ ID NO: 1054645 - DNA, 17 bp, Homo sapiens
tcgcttcttgcctctgt

SEQ ID NO: 1054646 - DNA, 15 bp, Homo sapiens
tcgcttgagcccagg

SEQ ID NO: 1054647 - DNA, 18 bp, Homo sapiens
tcgcttgagcccaggagt

SEQ ID NO: 1054648 - DNA, 19 bp, Homo sapiens
tcgctttattggctgagat

SEQ ID NO: 1054649 - DNA, 16 bp, Homo sapiens
tcggaaaaaaaaaaag

SEQ ID NO: 1054650 - DNA, 19 bp, Homo sapiens
tcggaaaaaaaaaaagaaa

SEQ ID NO: 1054651 - DNA, 21 bp, Homo sapiens
tcggaaaaaaaaaaagaaaaa

SEQ ID NO: 1054652 - DNA, 20 bp, Homo sapiens
tcggaacccaagcttagaac

SEQ ID NO: 1054653 - DNA, 20 bp, Homo sapiens
tcggaaccgctcacctagag

SEQ ID NO: 1054654 - DNA, 20 bp, Homo sapiens
tcggaagccgtctgactcca

SEQ ID NO: 1054655 - DNA, 15 bp, Homo sapiens
tcggaagcctgtcct

SEQ ID NO: 1054656 - DNA, 13 bp, Homo sapiens
tcggaatggtaac

SEQ ID NO: 1054657 - DNA, 22 bp, Homo sapiens
tcggacatgcttttctgccact

SEQ ID NO: 1054658 - DNA, 21 bp, Homo sapiens
tcggacccaccaaactgcaca

SEQ ID NO: 1054659 - DNA, 23 bp, Homo sapiens
tcggaccgcttgtggggacccag

SEQ ID NO: 1054660 - DNA, 22 bp, Homo sapiens
tcggacggccaatggtgcttcc

SEQ ID NO: 1054661 - DNA, 15 bp, Homo sapiens
tcggactccatggct

SEQ ID NO: 1054662 - DNA, 20 bp, Homo sapiens
tcggagcgttctctgtccta

SEQ ID NO: 1054663 - DNA, 14 bp, Homo sapiens
tcggagctgcctgc

SEQ ID NO: 1054664 - DNA, 12 bp, Homo sapiens
tcggagctggct

SEQ ID NO: 1054665 - DNA, 12 bp, Homo sapiens
tcggaggaagcc

SEQ ID NO: 1054666 - DNA, 15 bp, Homo sapiens
tctaacgctgaactg

SEQ ID NO: 1054667 - DNA, 16 bp, Homo sapiens
tctaactcagaattat

SEQ ID NO: 1054668 - DNA, 21 bp, Homo sapiens
tctaactgatgagtaaactga

SEQ ID NO: 1054669 - DNA, 22 bp, Homo sapiens
tctaactgatgagtaaactgag

SEQ ID NO: 1054670 - DNA, 19 bp, Homo sapiens
tctaactgtggaatataaa

SEQ ID NO: 1054671 - DNA, 21 bp, Homo sapiens
tctaactgtggaatataaata

SEQ ID NO: 1054672 - DNA, 16 bp, Homo sapiens
tctaacttcaccatat

SEQ ID NO: 1054673 - DNA, 13 bp, Homo sapiens
tctaagaaaatgt

SEQ ID NO: 1054674 - DNA, 23 bp, Homo sapiens
tctaagaaatatctgtgaaatat

SEQ ID NO: 1054675 - DNA, 13 bp, Homo sapiens
tctaagaaatcaa

SEQ ID NO: 1054676 - DNA, 13 bp, Homo sapiens
tctaagaagacat

SEQ ID NO: 1054677 - DNA, 14 bp, Homo sapiens
tctaagaagacatt

SEQ ID NO: 1054678 - DNA, 23 bp, Homo sapiens
tctaagaagttactttttgtaga

SEQ ID NO: 1054679 - DNA, 20 bp, Homo sapiens
tctaagaatttctgctaaat

SEQ ID NO: 1054680 - DNA, 12 bp, Homo sapiens
tctaagagaagt

SEQ ID NO: 1054681 - DNA, 20 bp, Homo sapiens
tctaagagcgaacttcacat

SEQ ID NO: 1054682 - DNA, 13 bp, Homo sapiens
tctaagatacact

SEQ ID NO: 1054683 - DNA, 14 bp, Homo sapiens
tctaagatacactg

SEQ ID NO: 1054684 - DNA, 14 bp, Homo sapiens
tctaagatttggtt

SEQ ID NO: 1054685 - DNA, 21 bp, Homo sapiens
tctaagcagctggtcttttct

SEQ ID NO: 1054686 - DNA, 14 bp, Homo sapiens
tctaagcctgaagg

SEQ ID NO: 1054687 - DNA, 15 bp, Homo sapiens
tctaagcctgaaggg

SEQ ID NO: 1054688 - DNA, 17 bp, Homo sapiens
tctaagcgtgctgacat

SEQ ID NO: 1054689 - DNA, 21 bp, Homo sapiens
tctaagctggagctcttggaa

SEQ ID NO: 1054690 - DNA, 12 bp, Homo sapiens
tctaagctgttt

SEQ ID NO: 1054691 - DNA, 18 bp, Homo sapiens
tctaagctgtttgccaag

SEQ ID NO: 1054692 - DNA, 20 bp, Homo sapiens
tctaaggagcgctagtgcct

SEQ ID NO: 1054693 - DNA, 15 bp, Homo sapiens
tctaaggcaggatgt

SEQ ID NO: 1054694 - DNA, 18 bp, Homo sapiens
tctaaggttctcatagga

SEQ ID NO: 1054695 - DNA, 16 bp, Homo sapiens
tctaagtaaatacaat

SEQ ID NO: 1054696 - DNA, 21 bp, Homo sapiens
tctaagtatttaaatgttcta

SEQ ID NO: 1054697 - DNA, 16 bp, Homo sapiens
tctaagtatttgaaac

SEQ ID NO: 1054698 - DNA, 18 bp, Homo sapiens
tctaagtcatgtatgttt

SEQ ID NO: 1054699 - DNA, 19 bp, Homo sapiens
tctaagtcatgtatgtttc

SEQ ID NO: 1054700 - DNA, 14 bp, Homo sapiens
tctaagtctttcca

SEQ ID NO: 1054701 - DNA, 13 bp, Homo sapiens
tctaagtgatata

SEQ ID NO: 1054702 - DNA, 19 bp, Homo sapiens
tctaagtgtaacctcagta

SEQ ID NO: 1054703 - DNA, 21 bp, Homo sapiens
tctaagtgttcgtctttagtt

SEQ ID NO: 1054704 - DNA, 14 bp, Homo sapiens
tctaagttaattta

SEQ ID NO: 1054705 - DNA, 18 bp, Homo sapiens
tctaagttaatttaaagt

SEQ ID NO: 1054706 - DNA, 20 bp, Homo sapiens
tctaagttcatgtttgtaaa

SEQ ID NO: 1054707 - DNA, 16 bp, Homo sapiens
tctaataaacttggat

SEQ ID NO: 1054708 - DNA, 16 bp, Homo sapiens
tctaataaagtagtta

SEQ ID NO: 1054709 - DNA, 18 bp, Homo sapiens
tctaataaagtcatttgt

SEQ ID NO: 1054710 - DNA, 11 bp, Homo sapiens
tctaataataa

SEQ ID NO: 1054711 - DNA, 13 bp, Homo sapiens
tctaataataaat

SEQ ID NO: 1054712 - DNA, 22 bp, Homo sapiens
tctaataataaatagttcttct

SEQ ID NO: 1054713 - DNA, 14 bp, Homo sapiens
tctaatagagagat

SEQ ID NO: 1054714 - DNA, 15 bp, Homo sapiens
tctaatagaggcagt

SEQ ID NO: 1054715 - DNA, 16 bp, Homo sapiens
tctaatagaggcagtg

SEQ ID NO: 1054716 - DNA, 12 bp, Homo sapiens
tctaatagtctt

SEQ ID NO: 1054717 - DNA, 13 bp, Homo sapiens
tctaatagtgctt

SEQ ID NO: 1054718 - DNA, 20 bp, Homo sapiens
tctaatatggcaaaaatggc

SEQ ID NO: 1054719 - DNA, 18 bp, Homo sapiens
tctaatattaaaaatatg

SEQ ID NO: 1054720 - DNA, 22 bp, Homo sapiens
tctaatattagttggctttcat

SEQ ID NO: 1054721 - DNA, 15 bp, Homo sapiens
tctaatatttctagt

SEQ ID NO: 1054722 - DNA, 14 bp, Homo sapiens
tctaatcacagtgt

SEQ ID NO: 1054723 - DNA, 12 bp, Homo sapiens
tctaatctgaac

SEQ ID NO: 1054724 - DNA, 22 bp, Homo sapiens
tctaatgaggagagaaaatata

SEQ ID NO: 1054725 - DNA, 24 bp, Homo sapiens
tctaatgaggagagaaaatatatg

SEQ ID NO: 1054726 - DNA, 20 bp, Homo sapiens
tctaatgattcaaatgtttt

SEQ ID NO: 1054727 - DNA, 12 bp, Homo sapiens
tctaatgcaaca

SEQ ID NO: 1054728 - DNA, 14 bp, Homo sapiens
tctaatgtagctat

SEQ ID NO: 1054729 - DNA, 16 bp, Homo sapiens
tctaatgtctcttcct

SEQ ID NO: 1054730 - DNA, 19 bp, Homo sapiens
tctaatgtctcttcctctg

SEQ ID NO: 1054731 - DNA, 20 bp, Homo sapiens
tctaatgtggttatttctct

SEQ ID NO: 1054732 - DNA, 23 bp, Homo sapiens
tctaattaaccttactaattata

SEQ ID NO: 1054733 - DNA, 18 bp, Homo sapiens
tctaattagagaactgga

SEQ ID NO: 1054734 - DNA, 18 bp, Homo sapiens
tctaattagtctatcaaa

SEQ ID NO: 1054735 - DNA, 16 bp, Homo sapiens
tctaattcacagtgct

SEQ ID NO: 1054736 - DNA, 13 bp, Homo sapiens
tctaattcagaca

SEQ ID NO: 1054737 - DNA, 19 bp, Homo sapiens
tctaattcccattttgcaa

SEQ ID NO: 1054738 - DNA, 17 bp, Homo sapiens
tctaattgcatctcaaa

SEQ ID NO: 1054739 - DNA, 22 bp, Homo sapiens
tctaattggaagaaattcctgt

SEQ ID NO: 1054740 - DNA, 22 bp, Homo sapiens
tctaattgtaagtgaaattaag

SEQ ID NO: 1054741 - DNA, 19 bp, Homo sapiens
tctaatttcaaaaatataa

SEQ ID NO: 1054742 - DNA, 14 bp, Homo sapiens
tctaatttgaactg

SEQ ID NO: 1054743 - DNA, 15 bp, Homo sapiens
tctaattttggatgg

SEQ ID NO: 1054744 - DNA, 14 bp, Homo sapiens
tctaatttttaaga

SEQ ID NO: 1054745 - DNA, 23 bp, Homo sapiens
tctacaaaagtgaaccatctcag

SEQ ID NO: 1054746 - DNA, 16 bp, Homo sapiens
tctacaactggagttt

SEQ ID NO: 1054747 - DNA, 17 bp, Homo sapiens
tctacaagcatatttga

SEQ ID NO: 1054748 - DNA, 17 bp, Homo sapiens
tctacaatgtgaacttt

SEQ ID NO: 1054749 - DNA, 14 bp, Homo sapiens
tctacacagagcag

SEQ ID NO: 1054750 - DNA, 14 bp, Homo sapiens
tctacacatacaga

SEQ ID NO: 1054751 - DNA, 16 bp, Homo sapiens
tctacacatgtaaaat

SEQ ID NO: 1054752 - DNA, 21 bp, Homo sapiens
tctacacggactgaggtgcct

SEQ ID NO: 1054753 - DNA, 15 bp, Homo sapiens
tctacactcatctta

SEQ ID NO: 1054754 - DNA, 14 bp, Homo sapiens
tctacactgtgaac

SEQ ID NO: 1054755 - DNA, 12 bp, Homo sapiens
tctacagaaaat

SEQ ID NO: 1054756 - DNA, 21 bp, Homo sapiens
tctacagaaaatgctggctga

SEQ ID NO: 1054757 - DNA, 20 bp, Homo sapiens
tctacagaaataacagctgg

SEQ ID NO: 1054758 - DNA, 17 bp, Homo sapiens
tctacagaacctgaggg

SEQ ID NO: 1054759 - DNA, 15 bp, Homo sapiens
tctacagaagccaag

SEQ ID NO: 1054760 - DNA, 17 bp, Homo sapiens
tctacagaataatccag

SEQ ID NO: 1054761 - DNA, 16 bp, Homo sapiens
tctacagacttctcca

SEQ ID NO: 1054762 - DNA, 17 bp, Homo sapiens
tctacagacttctccag

SEQ ID NO: 1054763 - DNA, 14 bp, Homo sapiens
tctacagagaaaat

SEQ ID NO: 1054764 - DNA, 18 bp, Homo sapiens
tctacagatgagtcacac

SEQ ID NO: 1054765 - DNA, 13 bp, Homo sapiens
tctacagtgtcct

SEQ ID NO: 1054766 - DNA, 12 bp, Homo sapiens
tctacatcactc

SEQ ID NO: 1054767 - DNA, 16 bp, Homo sapiens
tctacatcttctgcct

SEQ ID NO: 1054768 - DNA, 13 bp, Homo sapiens
tctacatgactgg

SEQ ID NO: 1054769 - DNA, 15 bp, Homo sapiens
tctacatgactgggc

SEQ ID NO: 1054770 - DNA, 18 bp, Homo sapiens
tctacattttttaaaact

SEQ ID NO: 1054771 - DNA, 15 bp, Homo sapiens
tctaccatttcagag

SEQ ID NO: 1054772 - DNA, 17 bp, Homo sapiens
tctacccatgagcctgc

SEQ ID NO: 1054773 - DNA, 18 bp, Homo sapiens
tctacccatgagcctgcc

SEQ ID NO: 1054774 - DNA, 21 bp, Homo sapiens
tctacccatgagcctgcccgc

SEQ ID NO: 1054775 - DNA, 23 bp, Homo sapiens
tctacccatgagcctgcccgctg

SEQ ID NO: 1054776 - DNA, 16 bp, Homo sapiens
tctaccccaaggccag

SEQ ID NO: 1054777 - DNA, 16 bp, Homo sapiens
tctaccccagactaga

SEQ ID NO: 1054778 - DNA, 21 bp, Homo sapiens
tctaccccagactagatgtag

SEQ ID NO: 1054779 - DNA, 23 bp, Homo sapiens
tctaccccagactagatgtagta

SEQ ID NO: 1054780 - DNA, 21 bp, Homo sapiens
tctaccccagggagaatctga

SEQ ID NO: 1054781 - DNA, 13 bp, Homo sapiens
tctacccctttct

SEQ ID NO: 1054782 - DNA, 16 bp, Homo sapiens
tctaccctcccacccc

SEQ ID NO: 1054783 - DNA, 21 bp, Homo sapiens
tctaccctcttagaaaaacca

SEQ ID NO: 1054784 - DNA, 12 bp, Homo sapiens
tctacctctctt

SEQ ID NO: 1054785 - DNA, 16 bp, Homo sapiens
tctacctctctttctc

SEQ ID NO: 1054786 - DNA, 14 bp, Homo sapiens
tctacctgagcatt

SEQ ID NO: 1054787 - DNA, 12 bp, Homo sapiens
tctacctgccct

SEQ ID NO: 1054788 - DNA, 23 bp, Homo sapiens
tctacctgtgtttttttctaaaa

SEQ ID NO: 1054789 - DNA, 18 bp, Homo sapiens
tctaccttcctgtccctg

SEQ ID NO: 1054790 - DNA, 17 bp, Homo sapiens
tctaccttgaggtcttt

SEQ ID NO: 1054791 - DNA, 21 bp, Homo sapiens
tctacgtcatgtattttatga

SEQ ID NO: 1054792 - DNA, 19 bp, Homo sapiens
tctactaagtgatgctgtg

SEQ ID NO: 1054793 - DNA, 20 bp, Homo sapiens
tctactatgatcagaagaac

SEQ ID NO: 1054794 - DNA, 22 bp, Homo sapiens
tctactcaacccattgttgtca

SEQ ID NO: 1054795 - DNA, 19 bp, Homo sapiens
tctactcctacctcagcct

SEQ ID NO: 1054796 - DNA, 19 bp, Homo sapiens
tctactccttgtaaagact

SEQ ID NO: 1054797 - DNA, 13 bp, Homo sapiens
tctactcttcctg

SEQ ID NO: 1054798 - DNA, 16 bp, Homo sapiens
tctactcttgtcattt

SEQ ID NO: 1054799 - DNA, 15 bp, Homo sapiens
tctactctttttgtt

SEQ ID NO: 1054800 - DNA, 18 bp, Homo sapiens
tctactgaggtgctatgt

SEQ ID NO: 1054801 - DNA, 19 bp, Homo sapiens
tctactgaggtgctatgtt

SEQ ID NO: 1054802 - DNA, 22 bp, Homo sapiens
tctactggaaaaaaatacaaaa

SEQ ID NO: 1054803 - DNA, 20 bp, Homo sapiens
tctactggaaatgtagcact

SEQ ID NO: 1054804 - DNA, 22 bp, Homo sapiens
tctactggaaatgtagcactta

SEQ ID NO: 1054805 - DNA, 18 bp, Homo sapiens
tctactggagtggaaggt

SEQ ID NO: 1054806 - DNA, 16 bp, Homo sapiens
tctactggtcttgtgg

SEQ ID NO: 1054807 - DNA, 23 bp, Homo sapiens
tctactggtcttgtggaattggg

SEQ ID NO: 1054808 - DNA, 15 bp, Homo sapiens
tctactgtacttttt

SEQ ID NO: 1054809 - DNA, 22 bp, Homo sapiens
tctactgtcaaatgatgtgcaa

SEQ ID NO: 1054810 - DNA, 21 bp, Homo sapiens
tctacttaatccaatgggttt

SEQ ID NO: 1054811 - DNA, 13 bp, Homo sapiens
tctacttcagctt

SEQ ID NO: 1054812 - DNA, 19 bp, Homo sapiens
tctacttccaaactaattt

SEQ ID NO: 1054813 - DNA, 22 bp, Homo sapiens
tctacttccaaactaattttta

SEQ ID NO: 1054814 - DNA, 14 bp, Homo sapiens
tctacttcccctgg

SEQ ID NO: 1054815 - DNA, 16 bp, Homo sapiens
tctacttcccctggga

SEQ ID NO: 1054816 - DNA, 19 bp, Homo sapiens
tctacttcccctgggatgc

SEQ ID NO: 1054817 - DNA, 20 bp, Homo sapiens
tctacttccccttcttgcca

SEQ ID NO: 1054818 - DNA, 22 bp, Homo sapiens
tctacttccccttcttgccatt

SEQ ID NO: 1054819 - DNA, 20 bp, Homo sapiens
tctacttctctgttgtcaaa

SEQ ID NO: 1054820 - DNA, 22 bp, Homo sapiens
tctacttgccagaaccaaatta

SEQ ID NO: 1054821 - DNA, 14 bp, Homo sapiens
tctacttggtggtt

SEQ ID NO: 1054822 - DNA, 15 bp, Homo sapiens
tctacttgtcatatc

SEQ ID NO: 1054823 - DNA, 16 bp, Homo sapiens
tctactttcatcttaa

SEQ ID NO: 1054824 - DNA, 23 bp, Homo sapiens
tctactttttgtatttagtagtt

SEQ ID NO: 1054825 - DNA, 18 bp, Homo sapiens
tctactttttttttaatt

SEQ ID NO: 1054826 - DNA, 12 bp, Homo sapiens
tctatgtttgta

SEQ ID NO: 1054827 - DNA, 19 bp, Homo sapiens
tctatgtttgtatttggaa

SEQ ID NO: 1054828 - DNA, 15 bp, Homo sapiens
tctatgtttgtgtga

SEQ ID NO: 1054829 - DNA, 18 bp, Homo sapiens
tctatgtttgtgtgattt

SEQ ID NO: 1054830 - DNA, 22 bp, Homo sapiens
tctatgtttgtgtgatttccta

SEQ ID NO: 1054831 - DNA, 20 bp, Homo sapiens
tctattaaagtgactttcta

SEQ ID NO: 1054832 - DNA, 10 bp, Homo sapiens
tctattaata

SEQ ID NO: 1054833 - DNA, 16 bp, Homo sapiens
tctattaatatatgta

SEQ ID NO: 1054834 - DNA, 21 bp, Homo sapiens
tctattaatatatgtattatt

SEQ ID NO: 1054835 - DNA, 21 bp, Homo sapiens
tctattaatatcaactctgaa

SEQ ID NO: 1054836 - DNA, 19 bp, Homo sapiens
tctattaatcacctctctg

SEQ ID NO: 1054837 - DNA, 20 bp, Homo sapiens
tctattaatgaggtctttaa

SEQ ID NO: 1054838 - DNA, 21 bp, Homo sapiens
tctattacttttgcaaactgt

SEQ ID NO: 1054839 - DNA, 18 bp, Homo sapiens
tctattagactttagaaa

SEQ ID NO: 1054840 - DNA, 16 bp, Homo sapiens
tctattagctgggttc

SEQ ID NO: 1054841 - DNA, 14 bp, Homo sapiens
tctattatttggag

SEQ ID NO: 1054842 - DNA, 16 bp, Homo sapiens
tctattcagacaagca

SEQ ID NO: 1054843 - DNA, 17 bp, Homo sapiens
tctattctctgcaattt

SEQ ID NO: 1054844 - DNA, 18 bp, Homo sapiens
tctattctgtcagtgtta

SEQ ID NO: 1054845 - DNA, 13 bp, Homo sapiens
tctattctttaac

SEQ ID NO: 1054846 - DNA, 17 bp, Homo sapiens
tctattgactttcttaa

SEQ ID NO: 1054847 - DNA, 20 bp, Homo sapiens
tctattgactttcttaaaaa

SEQ ID NO: 1054848 - DNA, 15 bp, Homo sapiens
tctattgcttggact

SEQ ID NO: 1054849 - DNA, 20 bp, Homo sapiens
tctattggaggtgagatcac

SEQ ID NO: 1054850 - DNA, 15 bp, Homo sapiens
tctattgggttcatt

SEQ ID NO: 1054851 - DNA, 22 bp, Homo sapiens
tctattgggttcattattggaa

SEQ ID NO: 1054852 - DNA, 14 bp, Homo sapiens
tctattgtagcatt

SEQ ID NO: 1054853 - DNA, 15 bp, Homo sapiens
tctattgtccaaagt

SEQ ID NO: 1054854 - DNA, 16 bp, Homo sapiens
tctattgttaagtatt

SEQ ID NO: 1054855 - DNA, 12 bp, Homo sapiens
tctattgtttac

SEQ ID NO: 1054856 - DNA, 14 bp, Homo sapiens
tctatttcatgttt

SEQ ID NO: 1054857 - DNA, 15 bp, Homo sapiens
tctatttccactgaa

SEQ ID NO: 1054858 - DNA, 16 bp, Homo sapiens
tctatttctcctccat

SEQ ID NO: 1054859 - DNA, 20 bp, Homo sapiens
tctatttctcctccatggga

SEQ ID NO: 1054860 - DNA, 18 bp, Homo sapiens
tctatttgaattatttct

SEQ ID NO: 1054861 - DNA, 16 bp, Homo sapiens
tctatttgtacaattt

SEQ ID NO: 1054862 - DNA, 13 bp, Homo sapiens
tctattttacttt

SEQ ID NO: 1054863 - DNA, 16 bp, Homo sapiens
tctattttactttgta

SEQ ID NO: 1054864 - DNA, 15 bp, Homo sapiens
tctattttggattgt

SEQ ID NO: 1054865 - DNA, 17 bp, Homo sapiens
tctattttgtgatgatg

SEQ ID NO: 1054866 - DNA, 11 bp, Homo sapiens
tctatttttgt

SEQ ID NO: 1054867 - DNA, 17 bp, Homo sapiens
tctatttttgtccttgc

SEQ ID NO: 1054868 - DNA, 18 bp, Homo sapiens
tctatttttgtccttgca

SEQ ID NO: 1054869 - DNA, 17 bp, Homo sapiens
tctattttttaaagact

SEQ ID NO: 1054870 - DNA, 16 bp, Homo sapiens
tctatttttttaactg

SEQ ID NO: 1054871 - DNA, 23 bp, Homo sapiens
tctcaaaaaaaagaaaatgtctt

SEQ ID NO: 1054872 - DNA, 17 bp, Homo sapiens
tctcaaaagtctatttt

SEQ ID NO: 1054873 - DNA, 15 bp, Homo sapiens
tctcaaaatctttgt

SEQ ID NO: 1054874 - DNA, 15 bp, Homo sapiens
tctcaaactcctgac

SEQ ID NO: 1054875 - DNA, 19 bp, Homo sapiens
tctcaaactcctgacctca

SEQ ID NO: 1054876 - DNA, 18 bp, Homo sapiens
tctcaaagagggggctct

SEQ ID NO: 1054877 - DNA, 21 bp, Homo sapiens
tctcaaagagggggctctgcc

SEQ ID NO: 1054878 - DNA, 22 bp, Homo sapiens
tctcaaagagggggctctgccc

SEQ ID NO: 1054879 - DNA, 23 bp, Homo sapiens
tctcaaagagggggctctgccca

SEQ ID NO: 1054880 - DNA, 22 bp, Homo sapiens
tctcaaagcctcttatttttct

SEQ ID NO: 1054881 - DNA, 11 bp, Homo sapiens
tctcaaaggag

SEQ ID NO: 1054882 - DNA, 20 bp, Homo sapiens
tctcaaagtataatctttct

SEQ ID NO: 1054883 - DNA, 17 bp, Homo sapiens
tctcaaattctcaacct

SEQ ID NO: 1054884 - DNA, 21 bp, Homo sapiens
tctcaacaaagcacagtgtta

SEQ ID NO: 1054885 - DNA, 18 bp, Homo sapiens
tctcaacatgtgtttctg

SEQ ID NO: 1054886 - DNA, 22 bp, Homo sapiens
tctcaacctaccaccccttcct

SEQ ID NO: 1054887 - DNA, 16 bp, Homo sapiens
tctcaactgcctcagc

SEQ ID NO: 1054888 - DNA, 22 bp, Homo sapiens
tctcaagactttagcttttcct

SEQ ID NO: 1054889 - DNA, 17 bp, Homo sapiens
tctcaagagggcactgg

SEQ ID NO: 1054890 - DNA, 13 bp, Homo sapiens
tctcaagccagcc

SEQ ID NO: 1054891 - DNA, 20 bp, Homo sapiens
tctcaagctaagtaaaaata

SEQ ID NO: 1054892 - DNA, 17 bp, Homo sapiens
tctcaagctagccagag

SEQ ID NO: 1054893 - DNA, 23 bp, Homo sapiens
tctcaagctagtgtttctagcta

SEQ ID NO: 1054894 - DNA, 20 bp, Homo sapiens
tctcaagggtggcaggtcac

SEQ ID NO: 1054895 - DNA, 16 bp, Homo sapiens
tctcaaggttctcatt

SEQ ID NO: 1054896 - DNA, 13 bp, Homo sapiens
tctcaagtgtttt

SEQ ID NO: 1054897 - DNA, 16 bp, Homo sapiens
tctcaatatttattat

SEQ ID NO: 1054898 - DNA, 22 bp, Homo sapiens
tctcaatcctaatttctcctcc

SEQ ID NO: 1054899 - DNA, 23 bp, Homo sapiens
tctcaatcctaatttctcctccc

SEQ ID NO: 1054900 - DNA, 12 bp, Homo sapiens
tctcaatgaaaa

SEQ ID NO: 1054901 - DNA, 14 bp, Homo sapiens
tctcaatgaaatag

SEQ ID NO: 1054902 - DNA, 23 bp, Homo sapiens
tctcaatgtcttcccacaaatgg

SEQ ID NO: 1054903 - DNA, 13 bp, Homo sapiens
tctcaatttttgg

SEQ ID NO: 1054904 - DNA, 12 bp, Homo sapiens
tctcacaccagt

SEQ ID NO: 1054905 - DNA, 23 bp, Homo sapiens
tctcacacccaccgtccgccctg

SEQ ID NO: 1054906 - DNA, 18 bp, Homo sapiens
tctcacactctaactgta

SEQ ID NO: 1054907 - DNA, 19 bp, Homo sapiens
tctcacactggtctgctgt

SEQ ID NO: 1054908 - DNA, 21 bp, Homo sapiens
tctcacactggttctcaatga

SEQ ID NO: 1054909 - DNA, 22 bp, Homo sapiens
tctcacactggttctcaatgaa

SEQ ID NO: 1054910 - DNA, 23 bp, Homo sapiens
tctcacactggttctcaatgaaa

SEQ ID NO: 1054911 - DNA, 21 bp, Homo sapiens
tctcaccacataccatgtgga

SEQ ID NO: 1054912 - DNA, 15 bp, Homo sapiens
tctcaccaggaaggg

SEQ ID NO: 1054913 - DNA, 15 bp, Homo sapiens
tctcacccaccagct

SEQ ID NO: 1054914 - DNA, 14 bp, Homo sapiens
tctcacccaggcaa

SEQ ID NO: 1054915 - DNA, 21 bp, Homo sapiens
tctcaccccatcccacaccct

SEQ ID NO: 1054916 - DNA, 13 bp, Homo sapiens
tctcacctggact

SEQ ID NO: 1054917 - DNA, 12 bp, Homo sapiens
tctcacctggcc

SEQ ID NO: 1054918 - DNA, 14 bp, Homo sapiens
tctcacctggccct

SEQ ID NO: 1054919 - DNA, 15 bp, Homo sapiens
tctcaccttccaaat

SEQ ID NO: 1054920 - DNA, 21 bp, Homo sapiens
tctcacgggcatgggcactcc

SEQ ID NO: 1054921 - DNA, 23 bp, Homo sapiens
tctcacgggcatgggcactccct

SEQ ID NO: 1054922 - DNA, 18 bp, Homo sapiens
tctcacgggccctgcccc

SEQ ID NO: 1054923 - DNA, 15 bp, Homo sapiens
tctcacgggctctat

SEQ ID NO: 1054924 - DNA, 13 bp, Homo sapiens
tctcactaaactt

SEQ ID NO: 1054925 - DNA, 21 bp, Homo sapiens
tctcactaggctaaactcaag

SEQ ID NO: 1054926 - DNA, 13 bp, Homo sapiens
tctcactccagcc

SEQ ID NO: 1054927 - DNA, 15 bp, Homo sapiens
tctcactccagccaa

SEQ ID NO: 1054928 - DNA, 19 bp, Homo sapiens
tctcactccagccaaagaa

SEQ ID NO: 1054929 - DNA, 18 bp, Homo sapiens
tctcactccccagcctgg

SEQ ID NO: 1054930 - DNA, 17 bp, Homo sapiens
tctcactcctacctggt

SEQ ID NO: 1054931 - DNA, 13 bp, Homo sapiens
tctcactcctgaa

SEQ ID NO: 1054932 - DNA, 23 bp, Homo sapiens
tctcactccttttggtgtgttgg

SEQ ID NO: 1054933 - DNA, 16 bp, Homo sapiens
tctcactctctgggga

SEQ ID NO: 1054934 - DNA, 20 bp, Homo sapiens
tctcactctgttgcccaggc

SEQ ID NO: 1054935 - DNA, 21 bp, Homo sapiens
tctcactgagaagattgtgaa

SEQ ID NO: 1054936 - DNA, 22 bp, Homo sapiens
tctcactgagaagattgtgaat

SEQ ID NO: 1054937 - DNA, 14 bp, Homo sapiens
tctcactgcagtct

SEQ ID NO: 1054938 - DNA, 11 bp, Homo sapiens
tctcactgcca

SEQ ID NO: 1054939 - DNA, 14 bp, Homo sapiens
tctcactgcttgaa

SEQ ID NO: 1054940 - DNA, 18 bp, Homo sapiens
tctcactgcttgaactag

SEQ ID NO: 1054941 - DNA, 20 bp, Homo sapiens
tctcactgtgggaaggccag

SEQ ID NO: 1054942 - DNA, 21 bp, Homo sapiens
tctcactgtgggaaggccagc

SEQ ID NO: 1054943 - DNA, 15 bp, Homo sapiens
tctcactgtgtgtct

SEQ ID NO: 1054944 - DNA, 23 bp, Homo sapiens
tctcactgtgttactgctttgca

SEQ ID NO: 1054945 - DNA, 22 bp, Homo sapiens
tctcactgttccctctgctcct

SEQ ID NO: 1054946 - DNA, 13 bp, Homo sapiens
tctcactgttctg

SEQ ID NO: 1054947 - DNA, 14 bp, Homo sapiens
tctcactgttctgc

SEQ ID NO: 1054948 - DNA, 11 bp, Homo sapiens
tctcctctctc

SEQ ID NO: 1054949 - DNA, 18 bp, Homo sapiens
tctcctctctctctttgt

SEQ ID NO: 1054950 - DNA, 15 bp, Homo sapiens
tctcctctctgcttc

SEQ ID NO: 1054951 - DNA, 16 bp, Homo sapiens
tctcctctctgggcct

SEQ ID NO: 1054952 - DNA, 20 bp, Homo sapiens
tctcctctctgggcctttgt

SEQ ID NO: 1054953 - DNA, 14 bp, Homo sapiens
tctcctctgctatg

SEQ ID NO: 1054954 - DNA, 14 bp, Homo sapiens
tctcctcttaaaaa

SEQ ID NO: 1054955 - DNA, 22 bp, Homo sapiens
tctcctcttcatggcatcttca

SEQ ID NO: 1054956 - DNA, 16 bp, Homo sapiens
tctcctcttgccactg

SEQ ID NO: 1054957 - DNA, 17 bp, Homo sapiens
tctcctcttgccactgc

SEQ ID NO: 1054958 - DNA, 15 bp, Homo sapiens
tctcctcttgtaaat

SEQ ID NO: 1054959 - DNA, 15 bp, Homo sapiens
tctcctgacagaagg

SEQ ID NO: 1054960 - DNA, 16 bp, Homo sapiens
tctcctgacccagtcc

SEQ ID NO: 1054961 - DNA, 14 bp, Homo sapiens
tctcctgaccctcc

SEQ ID NO: 1054962 - DNA, 23 bp, Homo sapiens
tctcctgaccctcccactcccat

SEQ ID NO: 1054963 - DNA, 18 bp, Homo sapiens
tctcctgatttctctgaa

SEQ ID NO: 1054964 - DNA, 20 bp, Homo sapiens
tctcctgccctctgctctgc

SEQ ID NO: 1054965 - DNA, 12 bp, Homo sapiens
tctcctgcctac

SEQ ID NO: 1054966 - DNA, 14 bp, Homo sapiens
tctcctgcctactc

SEQ ID NO: 1054967 - DNA, 15 bp, Homo sapiens
tctcctgcctgccct

SEQ ID NO: 1054968 - DNA, 20 bp, Homo sapiens
tctcctgcctgtagcagtga

SEQ ID NO: 1054969 - DNA, 22 bp, Homo sapiens
tctcctgcctgtagcagtgaga

SEQ ID NO: 1054970 - DNA, 17 bp, Homo sapiens
tctcctgccttcctcct

SEQ ID NO: 1054971 - DNA, 18 bp, Homo sapiens
tctcctgccttcctcctg

SEQ ID NO: 1054972 - DNA, 18 bp, Homo sapiens
tctcctgctctttctaca

SEQ ID NO: 1054973 - DNA, 16 bp, Homo sapiens
tctcctgctgatttca

SEQ ID NO: 1054974 - DNA, 15 bp, Homo sapiens
tctcctgctgccttt

SEQ ID NO: 1054975 - DNA, 16 bp, Homo sapiens
tctcctgctgctcctg

SEQ ID NO: 1054976 - DNA, 14 bp, Homo sapiens
tctcctgcttgtac

SEQ ID NO: 1054977 - DNA, 22 bp, Homo sapiens
tctcctgcttgtactaagccag

SEQ ID NO: 1054978 - DNA, 22 bp, Homo sapiens
tctcctggaccttgacagagca

SEQ ID NO: 1054979 - DNA, 23 bp, Homo sapiens
tctcctggaccttgacagagcag

SEQ ID NO: 1054980 - DNA, 18 bp, Homo sapiens
tctcctggagatagctgg

SEQ ID NO: 1054981 - DNA, 19 bp, Homo sapiens
tctcctggagatagctggg

SEQ ID NO: 1054982 - DNA, 21 bp, Homo sapiens
tctcctggagatagctggggc

SEQ ID NO: 1054983 - DNA, 16 bp, Homo sapiens
tctcctggcctggcca

SEQ ID NO: 1054984 - DNA, 21 bp, Homo sapiens
tctcctggcctggccatctcc

SEQ ID NO: 1054985 - DNA, 20 bp, Homo sapiens
tctcctgggggtggcaggca

SEQ ID NO: 1054986 - DNA, 20 bp, Homo sapiens
tctcctggtgactcaaataa

SEQ ID NO: 1054987 - DNA, 16 bp, Homo sapiens
tctcctggtgtgggta

SEQ ID NO: 1054988 - DNA, 17 bp, Homo sapiens
tctcctgtacctcttga

SEQ ID NO: 1054989 - DNA, 20 bp, Homo sapiens
tctcctgtctgccctctggg

SEQ ID NO: 1054990 - DNA, 10 bp, Homo sapiens
tctcctgtgc

SEQ ID NO: 1054991 - DNA, 11 bp, Homo sapiens
tctcctgtgcc

SEQ ID NO: 1054992 - DNA, 13 bp, Homo sapiens
tctcctgtgccca

SEQ ID NO: 1054993 - DNA, 15 bp, Homo sapiens
tctcctgtgcccaca

SEQ ID NO: 1054994 - DNA, 19 bp, Homo sapiens
tctcctgtttattcccatc

SEQ ID NO: 1054995 - DNA, 14 bp, Homo sapiens
tctcctgtttggaa

SEQ ID NO: 1054996 - DNA, 17 bp, Homo sapiens
tctcctgtttttctggg

SEQ ID NO: 1054997 - DNA, 16 bp, Homo sapiens
tctccttactctgagc

SEQ ID NO: 1054998 - DNA, 14 bp, Homo sapiens
tctccttagtcttc

SEQ ID NO: 1054999 - DNA, 17 bp, Homo sapiens
tctccttcccagataag

SEQ ID NO: 1055000 - DNA, 17 bp, Homo sapiens
tctccttccctgcagag

SEQ ID NO: 1055001 - DNA, 13 bp, Homo sapiens
tctccttcctgtg

SEQ ID NO: 1055002 - DNA, 13 bp, Homo sapiens
tctccttctcctt

SEQ ID NO: 1055003 - DNA, 17 bp, Homo sapiens
tctccttctccttccca

SEQ ID NO: 1055004 - DNA, 13 bp, Homo sapiens
tctccttgaagca

SEQ ID NO: 1055005 - DNA, 16 bp, Homo sapiens
tctccttgccttgctt

SEQ ID NO: 1055006 - DNA, 19 bp, Homo sapiens
tctccttgccttgcttctc

SEQ ID NO: 1055007 - DNA, 14 bp, Homo sapiens
tctccttggccaca

SEQ ID NO: 1055008 - DNA, 17 bp, Homo sapiens
tctccttggctgtctgt

SEQ ID NO: 1055009 - DNA, 14 bp, Homo sapiens
tctccttgggctcc

SEQ ID NO: 1055010 - DNA, 16 bp, Homo sapiens
tctccttgggctggga

SEQ ID NO: 1055011 - DNA, 17 bp, Homo sapiens
tctcctttaattgtaaa

SEQ ID NO: 1055012 - DNA, 17 bp, Homo sapiens
tctcctttgcactgagg

SEQ ID NO: 1055013 - DNA, 19 bp, Homo sapiens
tctcctttgcactgagggc

SEQ ID NO: 1055014 - DNA, 23 bp, Homo sapiens
tctcctttgcactgagggccaca

SEQ ID NO: 1055015 - DNA, 12 bp, Homo sapiens
tctccttttgaa

SEQ ID NO: 1055016 - DNA, 19 bp, Homo sapiens
tctcgaactcctgacctca

SEQ ID NO: 1055017 - DNA, 22 bp, Homo sapiens
tctcgaccttctggtatcttgt

SEQ ID NO: 1055018 - DNA, 14 bp, Homo sapiens
tctcgactgctttt

SEQ ID NO: 1055019 - DNA, 13 bp, Homo sapiens
tctcgatctcctg

SEQ ID NO: 1055020 - DNA, 15 bp, Homo sapiens
tctcgcacaatgcat

SEQ ID NO: 1055021 - DNA, 19 bp, Homo sapiens
tctcgcacaatgcatgtgc

SEQ ID NO: 1055022 - DNA, 18 bp, Homo sapiens
tctcgcagcctgaagcct

SEQ ID NO: 1055023 - DNA, 14 bp, Homo sapiens
tctcgccccatccc

SEQ ID NO: 1055024 - DNA, 17 bp, Homo sapiens
tctcgcctcactttcca

SEQ ID NO: 1055025 - DNA, 22 bp, Homo sapiens
tctcggatgacaccctggcctg

SEQ ID NO: 1055026 - DNA, 14 bp, Homo sapiens
tctcggccctgaac

SEQ ID NO: 1055027 - DNA, 16 bp, Homo sapiens
tctcggccctgaacca

SEQ ID NO: 1055028 - DNA, 18 bp, Homo sapiens
tctcggccctgaaccacg

SEQ ID NO: 1055029 - DNA, 18 bp, Homo sapiens
tctcggccttcacaatct

SEQ ID NO: 1055030 - DNA, 19 bp, Homo sapiens
tctcggctggaagaacatc

SEQ ID NO: 1055031 - DNA, 14 bp, Homo sapiens
tctcggggcccttg

SEQ ID NO: 1055032 - DNA, 20 bp, Homo sapiens
tctcggggcccttggggcct

SEQ ID NO: 1055033 - DNA, 12 bp, Homo sapiens
tctcgtccccct

SEQ ID NO: 1055034 - DNA, 14 bp, Homo sapiens
tctcgtccccctcc

SEQ ID NO: 1055035 - DNA, 20 bp, Homo sapiens
tctcgtccccctccctgccc

SEQ ID NO: 1055036 - DNA, 21 bp, Homo sapiens
tctcgtccccctccctgccca

SEQ ID NO: 1055037 - DNA, 19 bp, Homo sapiens
tctcgtcttccgtctcccc

SEQ ID NO: 1055038 - DNA, 20 bp, Homo sapiens
tctcgtggtagaagccagta

SEQ ID NO: 1055039 - DNA, 19 bp, Homo sapiens
tctcgtggtaggactgtag

SEQ ID NO: 1055040 - DNA, 21 bp, Homo sapiens
tctcgtggtaggactgtagaa

SEQ ID NO: 1055041 - DNA, 15 bp, Homo sapiens
tctcgtggtatgtat

SEQ ID NO: 1055042 - DNA, 18 bp, Homo sapiens
tctcgtgtacagctccct

SEQ ID NO: 1055043 - DNA, 13 bp, Homo sapiens
tctcgtgtttgct

SEQ ID NO: 1055044 - DNA, 21 bp, Homo sapiens
tctctaaagagtttattttaa

SEQ ID NO: 1055045 - DNA, 23 bp, Homo sapiens
tctctaaatgaggggcctcaggt

SEQ ID NO: 1055046 - DNA, 16 bp, Homo sapiens
tctctaaccattcaaa

SEQ ID NO: 1055047 - DNA, 18 bp, Homo sapiens
tctctaactcagaaacat

SEQ ID NO: 1055048 - DNA, 22 bp, Homo sapiens
tctctaacttcaaggcccatat

SEQ ID NO: 1055049 - DNA, 20 bp, Homo sapiens
tctctaagccacagcttctt

SEQ ID NO: 1055050 - DNA, 11 bp, Homo sapiens
tctctaataat

SEQ ID NO: 1055051 - DNA, 12 bp, Homo sapiens
tctctaataata

SEQ ID NO: 1055052 - DNA, 14 bp, Homo sapiens
tctctaataataaa

SEQ ID NO: 1055053 - DNA, 17 bp, Homo sapiens
tctctaataataaatag

SEQ ID NO: 1055054 - DNA, 18 bp, Homo sapiens
tctctaataataaatagt

SEQ ID NO: 1055055 - DNA, 11 bp, Homo sapiens
tctctaatatg

SEQ ID NO: 1055056 - DNA, 17 bp, Homo sapiens
tctctacagaggtgaaa

SEQ ID NO: 1055057 - DNA, 15 bp, Homo sapiens
tctctacatgctctt

SEQ ID NO: 1055058 - DNA, 16 bp, Homo sapiens
tctctacattaatgtc

SEQ ID NO: 1055059 - DNA, 18 bp, Homo sapiens
tctctaccagtctatttc

SEQ ID NO: 1055060 - DNA, 23 bp, Homo sapiens
tctctacccatcttaaaaacaac

SEQ ID NO: 1055061 - DNA, 16 bp, Homo sapiens
tctctacccctttctt

SEQ ID NO: 1055062 - DNA, 15 bp, Homo sapiens
tctctacctccaccc

SEQ ID NO: 1055063 - DNA, 20 bp, Homo sapiens
tctctactaaaaataagaaa

SEQ ID NO: 1055064 - DNA, 15 bp, Homo sapiens
tctctactaaaaatg

SEQ ID NO: 1055065 - DNA, 19 bp, Homo sapiens
tctctactaccacaaggaa

SEQ ID NO: 1055066 - DNA, 22 bp, Homo sapiens
tctctagaattttaagtgcttt

SEQ ID NO: 1055067 - DNA, 13 bp, Homo sapiens
tctctagcacaat

SEQ ID NO: 1055068 - DNA, 14 bp, Homo sapiens
tctctagctgttct

SEQ ID NO: 1055069 - DNA, 18 bp, Homo sapiens
tctctaggcctctccagt

SEQ ID NO: 1055070 - DNA, 19 bp, Homo sapiens
tctctagtgctgtgaaaaa

SEQ ID NO: 1055071 - DNA, 15 bp, Homo sapiens
tctctagtgtagctg

SEQ ID NO: 1055072 - DNA, 19 bp, Homo sapiens
tctctagtttgattaaatt

SEQ ID NO: 1055073 - DNA, 16 bp, Homo sapiens
tctctataaaaaatat

SEQ ID NO: 1055074 - DNA, 16 bp, Homo sapiens
tctctattagctgggt

SEQ ID NO: 1055075 - DNA, 13 bp, Homo sapiens
tctctattctctg

SEQ ID NO: 1055076 - DNA, 21 bp, Homo sapiens
tctctattggaggtgagatca

SEQ ID NO: 1055077 - DNA, 18 bp, Homo sapiens
tctctattggctcccttt

SEQ ID NO: 1055078 - DNA, 13 bp, Homo sapiens
tctctatttgaga

SEQ ID NO: 1055079 - DNA, 13 bp, Homo sapiens
tctctattttcat

SEQ ID NO: 1055080 - DNA, 17 bp, Homo sapiens
tctctcacccaccagct

SEQ ID NO: 1055081 - DNA, 21 bp, Homo sapiens
tctctcagccagctgtttaag

SEQ ID NO: 1055082 - DNA, 22 bp, Homo sapiens
tctctcaggagcacaggcagct

SEQ ID NO: 1055083 - DNA, 13 bp, Homo sapiens
tctctcatattcg

SEQ ID NO: 1055084 - DNA, 23 bp, Homo sapiens
tctctcatcctccagtaccttgc

SEQ ID NO: 1055085 - DNA, 15 bp, Homo sapiens
tctctcatctgatca

SEQ ID NO: 1055086 - DNA, 14 bp, Homo sapiens
tctctccacagtgt

SEQ ID NO: 1055087 - DNA, 14 bp, Homo sapiens
tctctccagaaaca

SEQ ID NO: 1055088 - DNA, 18 bp, Homo sapiens
tctctccagaaacagctg

SEQ ID NO: 1055089 - DNA, 19 bp, Homo sapiens
tctctccagaaacagctgc

SEQ ID NO: 1055090 - DNA, 16 bp, Homo sapiens
tctctccagatgtttc

SEQ ID NO: 1055091 - DNA, 17 bp, Homo sapiens
tctctccagctaattca

SEQ ID NO: 1055092 - DNA, 15 bp, Homo sapiens
tctctccagctgact

SEQ ID NO: 1055093 - DNA, 19 bp, Homo sapiens
tctctccagctgactaaac

SEQ ID NO: 1055094 - DNA, 12 bp, Homo sapiens
tctctccagggt

SEQ ID NO: 1055095 - DNA, 21 bp, Homo sapiens
tctctccatgttggcctgtca

SEQ ID NO: 1055096 - DNA, 17 bp, Homo sapiens
tctctccccctctgtct

SEQ ID NO: 1055097 - DNA, 22 bp, Homo sapiens
tctctccccggtaatgtcactg

SEQ ID NO: 1055098 - DNA, 23 bp, Homo sapiens
tctctcccctcacatcctcctgc

SEQ ID NO: 1055099 - DNA, 13 bp, Homo sapiens
tctctccctacct

SEQ ID NO: 1055100 - DNA, 21 bp, Homo sapiens
tctctccctcccctgccattt

SEQ ID NO: 1055101 - DNA, 21 bp, Homo sapiens
tctctccctccctctctcatg

SEQ ID NO: 1055102 - DNA, 24 bp, Homo sapiens
tctctccctccctctctcatgaga

SEQ ID NO: 1055103 - DNA, 15 bp, Homo sapiens
tctctccctccttct

SEQ ID NO: 1055104 - DNA, 23 bp, Homo sapiens
tctctccctctgtcttttctcct

SEQ ID NO: 1055105 - DNA, 13 bp, Homo sapiens
tctctccctgcct

SEQ ID NO: 1055106 - DNA, 16 bp, Homo sapiens
tctctccctggtctct

SEQ ID NO: 1055107 - DNA, 16 bp, Homo sapiens
tctctccctgtcacac

SEQ ID NO: 1055108 - DNA, 21 bp, Homo sapiens
tctctccctgtcacacactgg

SEQ ID NO: 1055109 - DNA, 22 bp, Homo sapiens
tctctccctgtcacacactgga

SEQ ID NO: 1055110 - DNA, 12 bp, Homo sapiens
tctctcctagcc

SEQ ID NO: 1055111 - DNA, 17 bp, Homo sapiens
tctctcctagcccctct

SEQ ID NO: 1055112 - DNA, 14 bp, Homo sapiens
tctctcctcaggac

SEQ ID NO: 1055113 - DNA, 12 bp, Homo sapiens
tctctcctctcc

SEQ ID NO: 1055114 - DNA, 12 bp, Homo sapiens
tctctcctctct

SEQ ID NO: 1055115 - DNA, 13 bp, Homo sapiens
tctctcctctctc

SEQ ID NO: 1055116 - DNA, 15 bp, Homo sapiens
tctctcctctctgct

SEQ ID NO: 1055117 - DNA, 16 bp, Homo sapiens
tctctcctctctgctt

SEQ ID NO: 1055118 - DNA, 16 bp, Homo sapiens
tctctcctggcctatc

SEQ ID NO: 1055119 - DNA, 13 bp, Homo sapiens
tctctcctggctc

SEQ ID NO: 1055120 - DNA, 14 bp, Homo sapiens
tctctcctgtacct

SEQ ID NO: 1055121 - DNA, 14 bp, Homo sapiens
tctctcctgtactt

SEQ ID NO: 1055122 - DNA, 14 bp, Homo sapiens
tctctcctgtccaa

SEQ ID NO: 1055123 - DNA, 14 bp, Homo sapiens
tctctccttggcca

SEQ ID NO: 1055124 - DNA, 17 bp, Homo sapiens
tctctccttggccacag

SEQ ID NO: 1055125 - DNA, 15 bp, Homo sapiens
tctctcctttctccc

SEQ ID NO: 1055126 - DNA, 23 bp, Homo sapiens
tctctcggctccccatgtgtcct

SEQ ID NO: 1055127 - DNA, 15 bp, Homo sapiens
tctctcggttccacg

SEQ ID NO: 1055128 - DNA, 14 bp, Homo sapiens
tctctctacctcca

SEQ ID NO: 1055129 - DNA, 22 bp, Homo sapiens
tctctctatgcaaaatgtctgt

SEQ ID NO: 1055130 - DNA, 13 bp, Homo sapiens
tctctctccagaa

SEQ ID NO: 1055131 - DNA, 23 bp, Homo sapiens
tctctctccagaaacagctgctt

SEQ ID NO: 1055132 - DNA, 13 bp, Homo sapiens
tctctctccctct

SEQ ID NO: 1055133 - DNA, 17 bp, Homo sapiens
tctctctccctgccttt

SEQ ID NO: 1055134 - DNA, 15 bp, Homo sapiens
tctctctccctgtca

SEQ ID NO: 1055135 - DNA, 21 bp, Homo sapiens
tctctctccctgtcacacact

SEQ ID NO: 1055136 - DNA, 15 bp, Homo sapiens
tctctctcctcagga

SEQ ID NO: 1055137 - DNA, 11 bp, Homo sapiens
tctctctcctg

SEQ ID NO: 1055138 - DNA, 15 bp, Homo sapiens
tctctctcctggtgt

SEQ ID NO: 1055139 - DNA, 13 bp, Homo sapiens
tctctctcctgtc

SEQ ID NO: 1055140 - DNA, 17 bp, Homo sapiens
tctctctcgaccttctg

SEQ ID NO: 1055141 - DNA, 13 bp, Homo sapiens
tctctctctacaa

SEQ ID NO: 1055142 - DNA, 14 bp, Homo sapiens
tctctctctacaaa

SEQ ID NO: 1055143 - DNA, 14 bp, Homo sapiens
tctctctctcctca

SEQ ID NO: 1055144 - DNA, 13 bp, Homo sapiens
tctctctctctcc

SEQ ID NO: 1055145 - DNA, 14 bp, Homo sapiens
tctctctctctcct

SEQ ID NO: 1055146 - DNA, 12 bp, Homo sapiens
tctctctgcagc

SEQ ID NO: 1055147 - DNA, 12 bp, Homo sapiens
tctctctgctcc

SEQ ID NO: 1055148 - DNA, 13 bp, Homo sapiens
tctctctgctcca

SEQ ID NO: 1055149 - DNA, 11 bp, Homo sapiens
tctctctggag

SEQ ID NO: 1055150 - DNA, 13 bp, Homo sapiens
tctctctggagcc

SEQ ID NO: 1055151 - DNA, 19 bp, Homo sapiens
tctctctggggccctgggc

SEQ ID NO: 1055152 - DNA, 13 bp, Homo sapiens
tctctctgtgaat

SEQ ID NO: 1055153 - DNA, 20 bp, Homo sapiens
tctctctgtgaatacaatta

SEQ ID NO: 1055154 - DNA, 17 bp, Homo sapiens
tctctctgttcccttcc

SEQ ID NO: 1055155 - DNA, 15 bp, Homo sapiens
tctctcttctcagag

SEQ ID NO: 1055156 - DNA, 14 bp, Homo sapiens
tctctcttctgcct

SEQ ID NO: 1055157 - DNA, 14 bp, Homo sapiens
tctctcttctgctc

SEQ ID NO: 1055158 - DNA, 20 bp, Homo sapiens
tctctcttctgctccaccct

SEQ ID NO: 1055159 - DNA, 18 bp, Homo sapiens
tctctctttaaccctccc

SEQ ID NO: 1055160 - DNA, 21 bp, Homo sapiens
tctctgaactgcaacactgga

SEQ ID NO: 1055161 - DNA, 20 bp, Homo sapiens
tctctgaagcgactctcctg

SEQ ID NO: 1055162 - DNA, 22 bp, Homo sapiens
tctctgaaggtaagatcattta

SEQ ID NO: 1055163 - DNA, 16 bp, Homo sapiens
tctctgacctctgctg

SEQ ID NO: 1055164 - DNA, 14 bp, Homo sapiens
tctctgacttctgc

SEQ ID NO: 1055165 - DNA, 17 bp, Homo sapiens
tctctgacttctgcctg

SEQ ID NO: 1055166 - DNA, 19 bp, Homo sapiens
tctctgacttctgcctgga

SEQ ID NO: 1055167 - DNA, 14 bp, Homo sapiens
tctctgagcagtga

SEQ ID NO: 1055168 - DNA, 21 bp, Homo sapiens
tctctgaggggctaccaggaa

SEQ ID NO: 1055169 - DNA, 14 bp, Homo sapiens
tctctgagggtgat

SEQ ID NO: 1055170 - DNA, 16 bp, Homo sapiens
tctctgatgcagaaat

SEQ ID NO: 1055171 - DNA, 15 bp, Homo sapiens
tctctgatgcagctt

SEQ ID NO: 1055172 - DNA, 15 bp, Homo sapiens
tctctgatgtcccag

SEQ ID NO: 1055173 - DNA, 17 bp, Homo sapiens
tctctgatgtcccagtg

SEQ ID NO: 1055174 - DNA, 23 bp, Homo sapiens
tctctgcaatttgtttaaagaat

SEQ ID NO: 1055175 - DNA, 11 bp, Homo sapiens
tctctgcaccc

SEQ ID NO: 1055176 - DNA, 10 bp, Homo sapiens
tctctgcagt

SEQ ID NO: 1055177 - DNA, 19 bp, Homo sapiens
tctctgcagtaaaacacat

SEQ ID NO: 1055178 - DNA, 21 bp, Homo sapiens
tctctgcagtaaaacacattt

SEQ ID NO: 1055179 - DNA, 22 bp, Homo sapiens
tctctgcatccatttgaacaca

SEQ ID NO: 1055180 - DNA, 21 bp, Homo sapiens
tctctgcatctactcccaagt

SEQ ID NO: 1055181 - DNA, 17 bp, Homo sapiens
tctctgcatctgaccac

SEQ ID NO: 1055182 - DNA, 14 bp, Homo sapiens
tctctgccacccac

SEQ ID NO: 1055183 - DNA, 18 bp, Homo sapiens
tctctgccacccactcag

SEQ ID NO: 1055184 - DNA, 18 bp, Homo sapiens
tctctgccatatcagtga

SEQ ID NO: 1055185 - DNA, 17 bp, Homo sapiens
tctctgcccacagtctt

SEQ ID NO: 1055186 - DNA, 23 bp, Homo sapiens
tctctgcccctaaagatgggagg

SEQ ID NO: 1055187 - DNA, 12 bp, Homo sapiens
tctctgccctgt

SEQ ID NO: 1055188 - DNA, 22 bp, Homo sapiens
tctctgcccttgatcagcccca

SEQ ID NO: 1055189 - DNA, 19 bp, Homo sapiens
tctctgccggctctttcct

SEQ ID NO: 1055190 - DNA, 17 bp, Homo sapiens
tctctgccgtctctcct

SEQ ID NO: 1055191 - DNA, 21 bp, Homo sapiens
tctctgcctctcccaggctgt

SEQ ID NO: 1055192 - DNA, 14 bp, Homo sapiens
tctctgcctctctt

SEQ ID NO: 1055193 - DNA, 17 bp, Homo sapiens
tctctgcctctgggcag

SEQ ID NO: 1055194 - DNA, 12 bp, Homo sapiens
tctctgcctggg

SEQ ID NO: 1055195 - DNA, 15 bp, Homo sapiens
tctctgctcatgggt

SEQ ID NO: 1055196 - DNA, 11 bp, Homo sapiens
tctctgctcca

SEQ ID NO: 1055197 - DNA, 14 bp, Homo sapiens
tctctgctccacca

SEQ ID NO: 1055198 - DNA, 13 bp, Homo sapiens
tctctgctccaga

SEQ ID NO: 1055199 - DNA, 17 bp, Homo sapiens
tctctgctcgccctcct

SEQ ID NO: 1055200 - DNA, 13 bp, Homo sapiens
tctctgctctagc

SEQ ID NO: 1055201 - DNA, 15 bp, Homo sapiens
tctctgctctagcca

SEQ ID NO: 1055202 - DNA, 18 bp, Homo sapiens
tctctgctctagccagga

SEQ ID NO: 1055203 - DNA, 18 bp, Homo sapiens
tctctgctctgcgtgtca

SEQ ID NO: 1055204 - DNA, 21 bp, Homo sapiens
tctctgctcttgtttcactcc

SEQ ID NO: 1055205 - DNA, 15 bp, Homo sapiens
tctctgctgagctgg

SEQ ID NO: 1055206 - DNA, 19 bp, Homo sapiens
tctctgctgagctgggccc

SEQ ID NO: 1055207 - DNA, 14 bp, Homo sapiens
tctctgctgcatct

SEQ ID NO: 1055208 - DNA, 15 bp, Homo sapiens
tctctgctggcccag

SEQ ID NO: 1055209 - DNA, 16 bp, Homo sapiens
tctctgctgggtctcc

SEQ ID NO: 1055210 - DNA, 11 bp, Homo sapiens
tctctgctgta

SEQ ID NO: 1055211 - DNA, 18 bp, Homo sapiens
tctctgcttacccttcac

SEQ ID NO: 1055212 - DNA, 22 bp, Homo sapiens
tctctgcttccatggcttcctg

SEQ ID NO: 1055213 - DNA, 22 bp, Homo sapiens
tctctggaaaggggggagctgg

SEQ ID NO: 1055214 - DNA, 23 bp, Homo sapiens
tctctggaaatttagagttctag

SEQ ID NO: 1055215 - DNA, 20 bp, Homo sapiens
tctctggaaggggcagccct

SEQ ID NO: 1055216 - DNA, 11 bp, Homo sapiens
tctctggagcc

SEQ ID NO: 1055217 - DNA, 18 bp, Homo sapiens
tctctggagccaagtcca

SEQ ID NO: 1055218 - DNA, 20 bp, Homo sapiens
tctctggagccaagtccaga

SEQ ID NO: 1055219 - DNA, 22 bp, Homo sapiens
tctctggagccaagtccagatt

SEQ ID NO: 1055220 - DNA, 14 bp, Homo sapiens
tctctggagccaga

SEQ ID NO: 1055221 - DNA, 23 bp, Homo sapiens
tctctggaggtactgagacaggg

SEQ ID NO: 1055222 - DNA, 20 bp, Homo sapiens
tctctggagtgatggtgtcc

SEQ ID NO: 1055223 - DNA, 21 bp, Homo sapiens
tctctggagtgatggtgtcct

SEQ ID NO: 1055224 - DNA, 15 bp, Homo sapiens
tctctggcaaacttt

SEQ ID NO: 1055225 - DNA, 18 bp, Homo sapiens
tctctggcaaacttttct

SEQ ID NO: 1055226 - DNA, 15 bp, Homo sapiens
tctctggcaccacac

SEQ ID NO: 1055227 - DNA, 14 bp, Homo sapiens
tctctggcatttgt

SEQ ID NO: 1055228 - DNA, 18 bp, Homo sapiens
tctctggcccagaaagcc

SEQ ID NO: 1055229 - DNA, 22 bp, Homo sapiens
tctctggcccagaaagcctctc

SEQ ID NO: 1055230 - DNA, 15 bp, Homo sapiens
tctctggcctcccac

SEQ ID NO: 1055231 - DNA, 19 bp, Homo sapiens
tctctggcctcccacccga

SEQ ID NO: 1055232 - DNA, 22 bp, Homo sapiens
tctctggctgagggatgactta

SEQ ID NO: 1055233 - DNA, 14 bp, Homo sapiens
tctctgggactctc

SEQ ID NO: 1055234 - DNA, 19 bp, Homo sapiens
tctctgggactctcctcct

SEQ ID NO: 1055235 - DNA, 14 bp, Homo sapiens
tctctgggagaaaa

SEQ ID NO: 1055236 - DNA, 22 bp, Homo sapiens
tctctgggagaaaatcatcaag

SEQ ID NO: 1055237 - DNA, 16 bp, Homo sapiens
tctctgggcctgtgtg

SEQ ID NO: 1055238 - DNA, 12 bp, Homo sapiens
tctctgggctgc

SEQ ID NO: 1055239 - DNA, 21 bp, Homo sapiens
tctctgggcttggggcttcct

SEQ ID NO: 1055240 - DNA, 18 bp, Homo sapiens
tctctggggaccctccag

SEQ ID NO: 1055241 - DNA, 20 bp, Homo sapiens
tctctggggaccctccagag

SEQ ID NO: 1055242 - DNA, 14 bp, Homo sapiens
tctctggggccctg

SEQ ID NO: 1055243 - DNA, 22 bp, Homo sapiens
tctctggggccctgggcctcag

SEQ ID NO: 1055244 - DNA, 15 bp, Homo sapiens
tctctgggtcccggg

SEQ ID NO: 1055245 - DNA, 21 bp, Homo sapiens
tctctgtaagtgtagctcaaa

SEQ ID NO: 1055246 - DNA, 19 bp, Homo sapiens
tctctgtcccattccctgg

SEQ ID NO: 1055247 - DNA, 14 bp, Homo sapiens
tctctgtcccttgc

SEQ ID NO: 1055248 - DNA, 17 bp, Homo sapiens
tctctgtcccttgctgt

SEQ ID NO: 1055249 - DNA, 16 bp, Homo sapiens
tctctgtcctacttct

SEQ ID NO: 1055250 - DNA, 17 bp, Homo sapiens
tctctgtcgtggagcca

SEQ ID NO: 1055251 - DNA, 15 bp, Homo sapiens
tctctgtctcatcca

SEQ ID NO: 1055252 - DNA, 15 bp, Homo sapiens
tctctgtctctgtgg

SEQ ID NO: 1055253 - DNA, 13 bp, Homo sapiens
tctctgtctgggg

SEQ ID NO: 1055254 - DNA, 14 bp, Homo sapiens
tctctgtctggggc

SEQ ID NO: 1055255 - DNA, 19 bp, Homo sapiens
tctctgtcttctctccact

SEQ ID NO: 1055256 - DNA, 22 bp, Homo sapiens
tctctgtgaacgatttagaaag

SEQ ID NO: 1055257 - DNA, 18 bp, Homo sapiens
tctctgtgaatacaatta

SEQ ID NO: 1055258 - DNA, 19 bp, Homo sapiens
tctctgtgaatacaattaa

SEQ ID NO: 1055259 - DNA, 21 bp, Homo sapiens
tctctgtgctttgactcacct

SEQ ID NO: 1055260 - DNA, 11 bp, Homo sapiens
tctctgtgtat

SEQ ID NO: 1055261 - DNA, 19 bp, Homo sapiens
tctctgtgtatttatataa

SEQ ID NO: 1055262 - DNA, 18 bp, Homo sapiens
tctctgtgtgcacaaata

SEQ ID NO: 1055263 - DNA, 12 bp, Homo sapiens
tctctgttccct

SEQ ID NO: 1055264 - DNA, 16 bp, Homo sapiens
tctctgttcccttcct

SEQ ID NO: 1055265 - DNA, 13 bp, Homo sapiens
tctctgttgtcgt

SEQ ID NO: 1055266 - DNA, 15 bp, Homo sapiens
tctctgtttcctgaa

SEQ ID NO: 1055267 - DNA, 16 bp, Homo sapiens
tctcttaaataaaaat

SEQ ID NO: 1055268 - DNA, 22 bp, Homo sapiens
tctcttaagacagcatgtgtta

SEQ ID NO: 1055269 - DNA, 20 bp, Homo sapiens
tctcttaccgcgagactgag

SEQ ID NO: 1055270 - DNA, 20 bp, Homo sapiens
tctcttatagaatatttatt

SEQ ID NO: 1055271 - DNA, 21 bp, Homo sapiens
tctcttatagaatatttatta

SEQ ID NO: 1055272 - DNA, 16 bp, Homo sapiens
tctcttatcttacgaa

SEQ ID NO: 1055273 - DNA, 14 bp, Homo sapiens
tctcttattctaat

SEQ ID NO: 1055274 - DNA, 16 bp, Homo sapiens
tctcttcaatctctgg

SEQ ID NO: 1055275 - DNA, 13 bp, Homo sapiens
tctcttcaatgaa

SEQ ID NO: 1055276 - DNA, 23 bp, Homo sapiens
tctcttcacccctacactgtgaa

SEQ ID NO: 1055277 - DNA, 15 bp, Homo sapiens
tctcttcaggttctt

SEQ ID NO: 1055278 - DNA, 16 bp, Homo sapiens
tctcttcaggttctta

SEQ ID NO: 1055279 - DNA, 23 bp, Homo sapiens
tctcttcaggttcttagtgtcac

SEQ ID NO: 1055280 - DNA, 15 bp, Homo sapiens
tctggctcacaggaa

SEQ ID NO: 1055281 - DNA, 12 bp, Homo sapiens
tctggctcagcc

SEQ ID NO: 1055282 - DNA, 23 bp, Homo sapiens
tctggctcagggtcaaagacaga

SEQ ID NO: 1055283 - DNA, 15 bp, Homo sapiens
tctggctccagagga

SEQ ID NO: 1055284 - DNA, 18 bp, Homo sapiens
tctggctccagaggacct

SEQ ID NO: 1055285 - DNA, 15 bp, Homo sapiens
tctggctccagctgg

SEQ ID NO: 1055286 - DNA, 16 bp, Homo sapiens
tctggctccctgcccc

SEQ ID NO: 1055287 - DNA, 17 bp, Homo sapiens
tctggctccctgcccct

SEQ ID NO: 1055288 - DNA, 19 bp, Homo sapiens
tctgggtcatgcactgagg

SEQ ID NO: 1055289 - DNA, 16 bp, Homo sapiens
tctgggtccctgctcc

SEQ ID NO: 1055290 - DNA, 22 bp, Homo sapiens
tctgggtctgattttctcactg

SEQ ID NO: 1055291 - DNA, 18 bp, Homo sapiens
tctgggtcttggccatga

SEQ ID NO: 1055292 - DNA, 23 bp, Homo sapiens
tctgggtgaaagggatactttta

SEQ ID NO: 1055293 - DNA, 21 bp, Homo sapiens
tctgggtgtccgccatccagg

SEQ ID NO: 1055294 - DNA, 23 bp, Homo sapiens
tctgggtgtccgccatccagggt

SEQ ID NO: 1055295 - DNA, 16 bp, Homo sapiens
tctgggttccttcctc

SEQ ID NO: 1055296 - DNA, 23 bp, Homo sapiens
tctgggttccttcctctgagcct

SEQ ID NO: 1055297 - DNA, 18 bp, Homo sapiens
tctgggttcgttggggac

SEQ ID NO: 1055298 - DNA, 19 bp, Homo sapiens
tctgggttcgttggggaca

SEQ ID NO: 1055299 - DNA, 15 bp, Homo sapiens
tctgggttgccttta

SEQ ID NO: 1055300 - DNA, 13 bp, Homo sapiens
tctgggtttggat

SEQ ID NO: 1055301 - DNA, 16 bp, Homo sapiens
tctgggtttggcccaa

SEQ ID NO: 1055302 - DNA, 21 bp, Homo sapiens
tctgtcccaatcttaccagat

SEQ ID NO: 1055303 - DNA, 17 bp, Homo sapiens
tctgtcccattccctgg

SEQ ID NO: 1055304 - DNA, 24 bp, Homo sapiens
tctgtcccattccctgggatctgg

SEQ ID NO: 1055305 - DNA, 15 bp, Homo sapiens
tctgtccccaggtcc

SEQ ID NO: 1055306 - DNA, 23 bp, Homo sapiens
tctgtccccaggtcctgtctctg

SEQ ID NO: 1055307 - DNA, 16 bp, Homo sapiens
tctgtcccccaggctg

SEQ ID NO: 1055308 - DNA, 20 bp, Homo sapiens
tctgtcccggttcaccttgc

SEQ ID NO: 1055309 - DNA, 14 bp, Homo sapiens
tctgtccctgtccc

SEQ ID NO: 1055310 - DNA, 19 bp, Homo sapiens
tctgtccctgtccttccct

SEQ ID NO: 1055311 - DNA, 20 bp, Homo sapiens
tctgtcccttaataaaaata

SEQ ID NO: 1055312 - DNA, 14 bp, Homo sapiens
tctgtcccttgctg

SEQ ID NO: 1055313 - DNA, 17 bp, Homo sapiens
tctgtcccttttctttg

SEQ ID NO: 1055314 - DNA, 13 bp, Homo sapiens
tctgtcctacttc

SEQ ID NO: 1055315 - DNA, 13 bp, Homo sapiens
tctgtcctcaccc

SEQ ID NO: 1055316 - DNA, 20 bp, Homo sapiens
tctgtcctcaccctgtggga

SEQ ID NO: 1055317 - DNA, 12 bp, Homo sapiens
tctgtcctctgt

SEQ ID NO: 1055318 - DNA, 20 bp, Homo sapiens
tctgtccttcagatggaaac

SEQ ID NO: 1055319 - DNA, 13 bp, Homo sapiens
tctgtccttctga

SEQ ID NO: 1055320 - DNA, 18 bp, Homo sapiens
tctgtccttgaaggacta

SEQ ID NO: 1055321 - DNA, 16 bp, Homo sapiens
tctgtcgcccttctcc

SEQ ID NO: 1055322 - DNA, 23 bp, Homo sapiens
tctgtcgcccttctcccggccct

SEQ ID NO: 1055323 - DNA, 15 bp, Homo sapiens
tctgtcgctcaggct

SEQ ID NO: 1055324 - DNA, 16 bp, Homo sapiens
tctgtcgctcaggctg

SEQ ID NO: 1055325 - DNA, 17 bp, Homo sapiens
tctgtcgtggagccatt

SEQ ID NO: 1055326 - DNA, 18 bp, Homo sapiens
tctgtcgtggagccattg

SEQ ID NO: 1055327 - DNA, 17 bp, Homo sapiens
tctgtctactgtggtga

SEQ ID NO: 1055328 - DNA, 23 bp, Homo sapiens
tctgtctaggactgcagtgtgga

SEQ ID NO: 1055329 - DNA, 19 bp, Homo sapiens
tctgtctcatcctcctgga

SEQ ID NO: 1055330 - DNA, 17 bp, Homo sapiens
tctgtctccaagacctt

SEQ ID NO: 1055331 - DNA, 16 bp, Homo sapiens
tctgtctcccaggctg

SEQ ID NO: 1055332 - DNA, 23 bp, Homo sapiens
tctgtctccctcccctctcagaa

SEQ ID NO: 1055333 - DNA, 15 bp, Homo sapiens
tctgtctcctccgtg

SEQ ID NO: 1055334 - DNA, 16 bp, Homo sapiens
tctgtctcgatgcctg

SEQ ID NO: 1055335 - DNA, 23 bp, Homo sapiens
tctgtctctaaccattcaaatga

SEQ ID NO: 1055336 - DNA, 14 bp, Homo sapiens
tctgtctctgtgga

SEQ ID NO: 1055337 - DNA, 22 bp, Homo sapiens
tctgtctcttggctttgtcact

SEQ ID NO: 1055338 - DNA, 12 bp, Homo sapiens
tctgtctgcttt

SEQ ID NO: 1055339 - DNA, 12 bp, Homo sapiens
tctgtctggatc

SEQ ID NO: 1055340 - DNA, 17 bp, Homo sapiens
tctgtctggtggccccg

SEQ ID NO: 1055341 - DNA, 16 bp, Homo sapiens
tctgtctgtcctaccc

SEQ ID NO: 1055342 - DNA, 16 bp, Homo sapiens
tctgtctgtcgccctt

SEQ ID NO: 1055343 - DNA, 17 bp, Homo sapiens
tctgtctgtgggcttca

SEQ ID NO: 1055344 - DNA, 22 bp, Homo sapiens
tctgtcttaaatgagaagtact

SEQ ID NO: 1055345 - DNA, 12 bp, Homo sapiens
tctgtcttcagc

SEQ ID NO: 1055346 - DNA, 14 bp, Homo sapiens
tctgtcttcccaaa

SEQ ID NO: 1055347 - DNA, 22 bp, Homo sapiens
tctgtcttcccaaacccagtct

SEQ ID NO: 1055348 - DNA, 17 bp, Homo sapiens
tctgtcttctctccact

SEQ ID NO: 1055349 - DNA, 13 bp, Homo sapiens
tctgtcttggcat

SEQ ID NO: 1055350 - DNA, 15 bp, Homo sapiens
tctgtcttggcatta

SEQ ID NO: 1055351 - DNA, 15 bp, Homo sapiens
tctgtctttaagaac

SEQ ID NO: 1055352 - DNA, 12 bp, Homo sapiens
tctgtctttcca

SEQ ID NO: 1055353 - DNA, 13 bp, Homo sapiens
tctgtctttgtgg

SEQ ID NO: 1055354 - DNA, 15 bp, Homo sapiens
tctgtctttgtggga

SEQ ID NO: 1055355 - DNA, 17 bp, Homo sapiens
tctgtcttttctcctcc

SEQ ID NO: 1055356 - DNA, 22 bp, Homo sapiens
tctgtgaaaacatatttgtgaa

SEQ ID NO: 1055357 - DNA, 12 bp, Homo sapiens
tctgtgaaatat

SEQ ID NO: 1055358 - DNA, 14 bp, Homo sapiens
tctgtgaaatataa

SEQ ID NO: 1055359 - DNA, 17 bp, Homo sapiens
tctgtgaaatgctggca

SEQ ID NO: 1055360 - DNA, 20 bp, Homo sapiens
tctgtgaaatgctggcattt

SEQ ID NO: 1055361 - DNA, 22 bp, Homo sapiens
tctgtgaagaggaacagtgtgg

SEQ ID NO: 1055362 - DNA, 18 bp, Homo sapiens
tctgtgaagcctctctcc

SEQ ID NO: 1055363 - DNA, 12 bp, Homo sapiens
tctgtgaagcta

SEQ ID NO: 1055364 - DNA, 20 bp, Homo sapiens
tctgtgaagtagttctgttt

SEQ ID NO: 1055365 - DNA, 12 bp, Homo sapiens
tctgtgaataca

SEQ ID NO: 1055366 - DNA, 20 bp, Homo sapiens
tctgtgaatacaattaaagg

SEQ ID NO: 1055367 - DNA, 22 bp, Homo sapiens
tctgtgaattaaaaaagctcaa

SEQ ID NO: 1055368 - DNA, 15 bp, Homo sapiens
tctgtgaccaaaata

SEQ ID NO: 1055369 - DNA, 20 bp, Homo sapiens
tctgtgaccaaaataccttg

SEQ ID NO: 1055370 - DNA, 21 bp, Homo sapiens
tctgtgaccaaaataccttgg

SEQ ID NO: 1055371 - DNA, 23 bp, Homo sapiens
tctgtgaccaaaataccttggtc

SEQ ID NO: 1055372 - DNA, 18 bp, Homo sapiens
tctgtgagtacctggtca

SEQ ID NO: 1055373 - DNA, 22 bp, Homo sapiens
tctgtgatcaccctctcggcct

SEQ ID NO: 1055374 - DNA, 15 bp, Homo sapiens
tctgtgatcttttaa

SEQ ID NO: 1055375 - DNA, 16 bp, Homo sapiens
tctgtgattacataga

SEQ ID NO: 1055376 - DNA, 22 bp, Homo sapiens
tctgtgattacatagatcagcc

SEQ ID NO: 1055377 - DNA, 16 bp, Homo sapiens
tctgtgattgggtggg

SEQ ID NO: 1055378 - DNA, 17 bp, Homo sapiens
tctgtgcactagcctgt

SEQ ID NO: 1055379 - DNA, 19 bp, Homo sapiens
tctgtgcactagcctgtga

SEQ ID NO: 1055380 - DNA, 22 bp, Homo sapiens
tctgtgcactagcctgtgatta

SEQ ID NO: 1055381 - DNA, 22 bp, Homo sapiens
tctgtgccagaaacagtgggag

SEQ ID NO: 1055382 - DNA, 21 bp, Homo sapiens
tctgtgccagacattgctctc

SEQ ID NO: 1055383 - DNA, 15 bp, Homo sapiens
tctgtgcccagggtg

SEQ ID NO: 1055384 - DNA, 18 bp, Homo sapiens
tctgtgccctccaaagag

SEQ ID NO: 1055385 - DNA, 14 bp, Homo sapiens
tctgtgcctccagg

SEQ ID NO: 1055386 - DNA, 16 bp, Homo sapiens
tctgtgcctgcactga

SEQ ID NO: 1055387 - DNA, 13 bp, Homo sapiens
tctgtgcctggga

SEQ ID NO: 1055388 - DNA, 22 bp, Homo sapiens
tctgtgccttcttttgattatg

SEQ ID NO: 1055389 - DNA, 22 bp, Homo sapiens
tctgtgctcttttggtggggag

SEQ ID NO: 1055390 - DNA, 12 bp, Homo sapiens
tctgtgctgtgt

SEQ ID NO: 1055391 - DNA, 14 bp, Homo sapiens
tctgtgcttctaat

SEQ ID NO: 1055392 - DNA, 20 bp, Homo sapiens
tctgtgctttgactcacctg

SEQ ID NO: 1055393 - DNA, 18 bp, Homo sapiens
tctgtggagatggactca

SEQ ID NO: 1055394 - DNA, 23 bp, Homo sapiens
tctgtggagctgccacagagaag

SEQ ID NO: 1055395 - DNA, 20 bp, Homo sapiens
tctgtggagggagggcagct

SEQ ID NO: 1055396 - DNA, 19 bp, Homo sapiens
tctgtggaggtggaaaagc

SEQ ID NO: 1055397 - DNA, 18 bp, Homo sapiens
tctgtggagttcctgctc

SEQ ID NO: 1055398 - DNA, 21 bp, Homo sapiens
tctgtggagttcctgctccgt

SEQ ID NO: 1055399 - DNA, 17 bp, Homo sapiens
tctgtggatacagtgcc

SEQ ID NO: 1055400 - DNA, 20 bp, Homo sapiens
tctgtggatacagtgcccac

SEQ ID NO: 1055401 - DNA, 18 bp, Homo sapiens
tctgtggatggtcattgc

SEQ ID NO: 1055402 - DNA, 13 bp, Homo sapiens
tctgtggccgcca

SEQ ID NO: 1055403 - DNA, 14 bp, Homo sapiens
tctgtggctggctc

SEQ ID NO: 1055404 - DNA, 22 bp, Homo sapiens
tctgtggctttttgttcagaat

SEQ ID NO: 1055405 - DNA, 23 bp, Homo sapiens
tctgtgggatgggatggtggagg

SEQ ID NO: 1055406 - DNA, 17 bp, Homo sapiens
tctgtgggcatggccgc

SEQ ID NO: 1055407 - DNA, 15 bp, Homo sapiens
tctgtgtcctctgcc

SEQ ID NO: 1055408 - DNA, 22 bp, Homo sapiens
tctgtgtgcaagtgtgtgcaca

SEQ ID NO: 1055409 - DNA, 18 bp, Homo sapiens
tctgtgtgcaccttacca

SEQ ID NO: 1055410 - DNA, 15 bp, Homo sapiens
tctgtgtgcatattt

SEQ ID NO: 1055411 - DNA, 15 bp, Homo sapiens
tctgtgtgtatattg

SEQ ID NO: 1055412 - DNA, 19 bp, Homo sapiens
tctgtgtgtcagttttcat

SEQ ID NO: 1055413 - DNA, 20 bp, Homo sapiens
tctgtgttaattgcgtagag

SEQ ID NO: 1055414 - DNA, 13 bp, Homo sapiens
tctgtgttgaaca

SEQ ID NO: 1055415 - DNA, 14 bp, Homo sapiens
tctgtgttttgaat

SEQ ID NO: 1055416 - DNA, 15 bp, Homo sapiens
tctgtgtttttgaaa

SEQ ID NO: 1055417 - DNA, 13 bp, Homo sapiens
tctgttaagaaag

SEQ ID NO: 1055418 - DNA, 18 bp, Homo sapiens
tctgttaagaaaggatat

SEQ ID NO: 1055419 - DNA, 16 bp, Homo sapiens
tctgttaggtccattt

SEQ ID NO: 1055420 - DNA, 23 bp, Homo sapiens
tctgttatgatttccttcaatgt

SEQ ID NO: 1055421 - DNA, 21 bp, Homo sapiens
tctgttatgcactgtggtttc

SEQ ID NO: 1055422 - DNA, 14 bp, Homo sapiens
tctgttattgtatt

SEQ ID NO: 1055423 - DNA, 18 bp, Homo sapiens
tctgttatttagactcat

SEQ ID NO: 1055424 - DNA, 23 bp, Homo sapiens
tctgttatttattattaatttat

SEQ ID NO: 1055425 - DNA, 19 bp, Homo sapiens
tctgttatttttaagcttt

SEQ ID NO: 1055426 - DNA, 17 bp, Homo sapiens
tctgttcaacctcagta

SEQ ID NO: 1055427 - DNA, 22 bp, Homo sapiens
tctgttcacaaactacctctgg

SEQ ID NO: 1055428 - DNA, 22 bp, Homo sapiens
tctgttcacttttcctccctca

SEQ ID NO: 1055429 - DNA, 19 bp, Homo sapiens
tctgttcatttcacacagt

SEQ ID NO: 1055430 - DNA, 13 bp, Homo sapiens
tctgttccaaatg

SEQ ID NO: 1055431 - DNA, 19 bp, Homo sapiens
tctgttccaaattcagttt

SEQ ID NO: 1055432 - DNA, 16 bp, Homo sapiens
tctgttccattttaac

SEQ ID NO: 1055433 - DNA, 11 bp, Homo sapiens
tctgttctctc

SEQ ID NO: 1055434 - DNA, 20 bp, Homo sapiens
tctgttctctcccctcacat

SEQ ID NO: 1055435 - DNA, 12 bp, Homo sapiens
tctgttctctgc

SEQ ID NO: 1055436 - DNA, 12 bp, Homo sapiens
tctgttctgctc

SEQ ID NO: 1055437 - DNA, 16 bp, Homo sapiens
tctgttctgctcccag

SEQ ID NO: 1055438 - DNA, 14 bp, Homo sapiens
tctgttctggggga

SEQ ID NO: 1055439 - DNA, 13 bp, Homo sapiens
tctgttctgttga

SEQ ID NO: 1055440 - DNA, 17 bp, Homo sapiens
tctgttctgtttggcac

SEQ ID NO: 1055441 - DNA, 15 bp, Homo sapiens
tctgttcttacaaat

SEQ ID NO: 1055442 - DNA, 14 bp, Homo sapiens
tctgttcttgctac

SEQ ID NO: 1055443 - DNA, 13 bp, Homo sapiens
tctgttctttacc

SEQ ID NO: 1055444 - DNA, 13 bp, Homo sapiens
tctgttctttcca

SEQ ID NO: 1055445 - DNA, 18 bp, Homo sapiens
tctgttgcaagcccctct

SEQ ID NO: 1055446 - DNA, 19 bp, Homo sapiens
tctgttgccagtcagcaac

SEQ ID NO: 1055447 - DNA, 17 bp, Homo sapiens
tctgttgccttatttct

SEQ ID NO: 1055448 - DNA, 17 bp, Homo sapiens
tctgttgctggaggggc

SEQ ID NO: 1055449 - DNA, 17 bp, Homo sapiens
tctgttggtccactgtg

SEQ ID NO: 1055450 - DNA, 21 bp, Homo sapiens
tctgttggtccactgtgttta

SEQ ID NO: 1055451 - DNA, 15 bp, Homo sapiens
tctgttgtaagaata

SEQ ID NO: 1055452 - DNA, 21 bp, Homo sapiens
tctgttgtcctccccttgggc

SEQ ID NO: 1055453 - DNA, 15 bp, Homo sapiens
tctgttgttccattt

SEQ ID NO: 1055454 - DNA, 17 bp, Homo sapiens
tctgttgttccatttta

SEQ ID NO: 1055455 - DNA, 14 bp, Homo sapiens
tctgttgttctgtg

SEQ ID NO: 1055456 - DNA, 15 bp, Homo sapiens
tctgttgttctgtgg

SEQ ID NO: 1055457 - DNA, 23 bp, Homo sapiens
tctgttgttctgtggtcacagtg

SEQ ID NO: 1055458 - DNA, 13 bp, Homo sapiens
tctgttgttttgt

SEQ ID NO: 1055459 - DNA, 17 bp, Homo sapiens
tctgttgttttgtgtat

SEQ ID NO: 1055460 - DNA, 19 bp, Homo sapiens
tctgttgttttgtgtatat

SEQ ID NO: 1055461 - DNA, 13 bp, Homo sapiens
tctgtttaaagtg

SEQ ID NO: 1055462 - DNA, 13 bp, Homo sapiens
tctgtttagataa

SEQ ID NO: 1055463 - DNA, 23 bp, Homo sapiens
tctgtttatggccacatttaata

SEQ ID NO: 1055464 - DNA, 20 bp, Homo sapiens
tctgtttattcttccagaat

SEQ ID NO: 1055465 - DNA, 17 bp, Homo sapiens
tctgtttccaaatccct

SEQ ID NO: 1055466 - DNA, 20 bp, Homo sapiens
tctgtttcctgacattgtct

SEQ ID NO: 1055467 - DNA, 18 bp, Homo sapiens
tctgtttctctgctgtca

SEQ ID NO: 1055468 - DNA, 11 bp, Homo sapiens
tctgtttcttg

SEQ ID NO: 1055469 - DNA, 13 bp, Homo sapiens
tctgtttcttgct

SEQ ID NO: 1055470 - DNA, 13 bp, Homo sapiens
tctgtttgattct

SEQ ID NO: 1055471 - DNA, 13 bp, Homo sapiens
tctgtttgccact

SEQ ID NO: 1055472 - DNA, 21 bp, Homo sapiens
tctgtttggactgcagaagca

SEQ ID NO: 1055473 - DNA, 14 bp, Homo sapiens
tctgtttggcactt

SEQ ID NO: 1055474 - DNA, 16 bp, Homo sapiens
tctgtttggcacttgt

SEQ ID NO: 1055475 - DNA, 18 bp, Homo sapiens
tctgtttggcacttgtat

SEQ ID NO: 1055476 - DNA, 19 bp, Homo sapiens
tctgtttggcacttgtatt

SEQ ID NO: 1055477 - DNA, 21 bp, Homo sapiens
tctgtttggcacttgtattta

SEQ ID NO: 1055478 - DNA, 15 bp, Homo sapiens
tctgtttgtaaatta

SEQ ID NO: 1055479 - DNA, 17 bp, Homo sapiens
tctgtttgtaaattatt

SEQ ID NO: 1055480 - DNA, 19 bp, Homo sapiens
tctgtttgtaaattatttg

SEQ ID NO: 1055481 - DNA, 21 bp, Homo sapiens
tctgtttgtaaattatttgct

SEQ ID NO: 1055482 - DNA, 13 bp, Homo sapiens
tctgtttgtatat

SEQ ID NO: 1055483 - DNA, 18 bp, Homo sapiens
tctgtttgtatatttgca

SEQ ID NO: 1055484 - DNA, 18 bp, Homo sapiens
tctgtttgtctgaacaaa

SEQ ID NO: 1055485 - DNA, 16 bp, Homo sapiens
tctgtttgtgggactg

SEQ ID NO: 1055486 - DNA, 13 bp, Homo sapiens
tctgtttgttaaa

SEQ ID NO: 1055487 - DNA, 14 bp, Homo sapiens
tctgtttgtttaag

SEQ ID NO: 1055488 - DNA, 13 bp, Homo sapiens
tctgttttcaagt

SEQ ID NO: 1055489 - DNA, 19 bp, Homo sapiens
tctgttttctgtttgtaaa

SEQ ID NO: 1055490 - DNA, 11 bp, Homo sapiens
tctgttttctt

SEQ ID NO: 1055491 - DNA, 17 bp, Homo sapiens
tctgttttgaaggcaaa

SEQ ID NO: 1055492 - DNA, 18 bp, Homo sapiens
tctgttttggtcccctcc

SEQ ID NO: 1055493 - DNA, 17 bp, Homo sapiens
tctgttttgtatatgat

SEQ ID NO: 1055494 - DNA, 15 bp, Homo sapiens
tctgtttttgtatct

SEQ ID NO: 1055495 - DNA, 23 bp, Homo sapiens
tctgtttttgtatctttatgctg

SEQ ID NO: 1055496 - DNA, 17 bp, Homo sapiens
tcttaaaaaatgtgaaa

SEQ ID NO: 1055497 - DNA, 21 bp, Homo sapiens
tcttaaaaaatgtgaaatgct

SEQ ID NO: 1055498 - DNA, 14 bp, Homo sapiens
tcttaaaaactgtg

SEQ ID NO: 1055499 - DNA, 17 bp, Homo sapiens
tcttaaaaactgtgtat

SEQ ID NO: 1055500 - DNA, 19 bp, Homo sapiens
tcttaaaaactgtgtatca

SEQ ID NO: 1055501 - DNA, 16 bp, Homo sapiens
tcttaaaaagacactt

SEQ ID NO: 1055502 - DNA, 19 bp, Homo sapiens
tcttaaaaatttatacacc

SEQ ID NO: 1055503 - DNA, 19 bp, Homo sapiens
tcttaaaacagtgtgtgcc

SEQ ID NO: 1055504 - DNA, 23 bp, Homo sapiens
tcttaaaaccagagaatcttaag

SEQ ID NO: 1055505 - DNA, 20 bp, Homo sapiens
tcttaaaatacccattgccc

SEQ ID NO: 1055506 - DNA, 16 bp, Homo sapiens
tcttaaaatatcttcc

SEQ ID NO: 1055507 - DNA, 21 bp, Homo sapiens
tcttatggaattgatttgcat

SEQ ID NO: 1055508 - DNA, 16 bp, Homo sapiens
tcttatggtccagaaa

SEQ ID NO: 1055509 - DNA, 14 bp, Homo sapiens
tcttatgtaaagta

SEQ ID NO: 1055510 - DNA, 20 bp, Homo sapiens
tcttatgtaaagtatgtttt

SEQ ID NO: 1055511 - DNA, 14 bp, Homo sapiens
tcttatgtgtgcct

SEQ ID NO: 1055512 - DNA, 17 bp, Homo sapiens
tcttattaaagtattct

SEQ ID NO: 1055513 - DNA, 20 bp, Homo sapiens
tcttattaatcatacaaact

SEQ ID NO: 1055514 - DNA, 22 bp, Homo sapiens
tcttattagttccccaaataca

SEQ ID NO: 1055515 - DNA, 13 bp, Homo sapiens
tcttattataaaa

SEQ ID NO: 1055516 - DNA, 16 bp, Homo sapiens
tcttattcccaaacta

SEQ ID NO: 1055517 - DNA, 12 bp, Homo sapiens
tcttattccgag

SEQ ID NO: 1055518 - DNA, 21 bp, Homo sapiens
tcttattccgagcattccagt

SEQ ID NO: 1055519 - DNA, 13 bp, Homo sapiens
tcttattctaata

SEQ ID NO: 1055520 - DNA, 22 bp, Homo sapiens
tcttattgcaaaatagcatttg

SEQ ID NO: 1055521 - DNA, 22 bp, Homo sapiens
tcttattgcaaggcagtctcta

SEQ ID NO: 1055522 - DNA, 17 bp, Homo sapiens
tcttattgcgctgctac

SEQ ID NO: 1055523 - DNA, 16 bp, Homo sapiens
tcttattggaaatgta

SEQ ID NO: 1055524 - DNA, 21 bp, Homo sapiens
tcttattgggatatcatttta

SEQ ID NO: 1055525 - DNA, 14 bp, Homo sapiens
tcttatttaagtat

SEQ ID NO: 1055526 - DNA, 18 bp, Homo sapiens
tcttattttgtgaactat

SEQ ID NO: 1055527 - DNA, 18 bp, Homo sapiens
tcttcaaactttcacttt

SEQ ID NO: 1055528 - DNA, 19 bp, Homo sapiens
tcttcaaactttcactttg

SEQ ID NO: 1055529 - DNA, 18 bp, Homo sapiens
tcttcaaatctcagcaaa

SEQ ID NO: 1055530 - DNA, 21 bp, Homo sapiens
tcttcaaatgggagactcttt

SEQ ID NO: 1055531 - DNA, 20 bp, Homo sapiens
tcttcaaattagaagacatt

SEQ ID NO: 1055532 - DNA, 24 bp, Homo sapiens
tcttcaacatcaatgttcattgta

SEQ ID NO: 1055533 - DNA, 11 bp, Homo sapiens
tcttcaagagg

SEQ ID NO: 1055534 - DNA, 15 bp, Homo sapiens
tcttcaagctgtccc

SEQ ID NO: 1055535 - DNA, 13 bp, Homo sapiens
tcttcaatctctg

SEQ ID NO: 1055536 - DNA, 14 bp, Homo sapiens
tcttcaatctctgt

SEQ ID NO: 1055537 - DNA, 17 bp, Homo sapiens
tcttcaatctctgttct

SEQ ID NO: 1055538 - DNA, 15 bp, Homo sapiens
tcttcacagtgcagc

SEQ ID NO: 1055539 - DNA, 14 bp, Homo sapiens
tcttcacattgtgt

SEQ ID NO: 1055540 - DNA, 16 bp, Homo sapiens
tcttcaccaaatcttg

SEQ ID NO: 1055541 - DNA, 18 bp, Homo sapiens
tcttcacccctacactgt

SEQ ID NO: 1055542 - DNA, 18 bp, Homo sapiens
tcttcacctcttccactc

SEQ ID NO: 1055543 - DNA, 12 bp, Homo sapiens
tcttcacctgtt

SEQ ID NO: 1055544 - DNA, 17 bp, Homo sapiens
tcttcactacaaacacg

SEQ ID NO: 1055545 - DNA, 18 bp, Homo sapiens
tcttcactcttcacttga

SEQ ID NO: 1055546 - DNA, 16 bp, Homo sapiens
tcttcactgtggccac

SEQ ID NO: 1055547 - DNA, 21 bp, Homo sapiens
tcttcagaacacacagacttt

SEQ ID NO: 1055548 - DNA, 20 bp, Homo sapiens
tcttcagaactgcccttgct

SEQ ID NO: 1055549 - DNA, 13 bp, Homo sapiens
tcttcagaagaca

SEQ ID NO: 1055550 - DNA, 18 bp, Homo sapiens
tcttcagaagacactgca

SEQ ID NO: 1055551 - DNA, 20 bp, Homo sapiens
tcttcagacggagctgcgct

SEQ ID NO: 1055552 - DNA, 16 bp, Homo sapiens
tcttcagagcaggggt

SEQ ID NO: 1055553 - DNA, 14 bp, Homo sapiens
tcttcagatctcta

SEQ ID NO: 1055554 - DNA, 23 bp, Homo sapiens
tcttcagatctctaacttcacca

SEQ ID NO: 1055555 - DNA, 23 bp, Homo sapiens
tcttcagcctagccgacctcagc

SEQ ID NO: 1055556 - DNA, 14 bp, Homo sapiens
tcttcagcctccct

SEQ ID NO: 1055557 - DNA, 16 bp, Homo sapiens
tcttcaggaggccctg

SEQ ID NO: 1055558 - DNA, 15 bp, Homo sapiens
tcttcaggtaacact

SEQ ID NO: 1055559 - DNA, 20 bp, Homo sapiens
tcttcaggtgaacacttagt

SEQ ID NO: 1055560 - DNA, 18 bp, Homo sapiens
tcttcagtgcaaattgta

SEQ ID NO: 1055561 - DNA, 21 bp, Homo sapiens
tcttcagtgcaaattgtatct

SEQ ID NO: 1055562 - DNA, 19 bp, Homo sapiens
tcttcagttaattcttaga

SEQ ID NO: 1055563 - DNA, 16 bp, Homo sapiens
tcttcagttgtctctg

SEQ ID NO: 1055564 - DNA, 19 bp, Homo sapiens
tcttcagttttatctttaa

SEQ ID NO: 1055565 - DNA, 20 bp, Homo sapiens
tcttcataacaattttagga

SEQ ID NO: 1055566 - DNA, 15 bp, Homo sapiens
tcttcatactttttt

SEQ ID NO: 1055567 - DNA, 22 bp, Homo sapiens
tcttcatactttttttcacagt

SEQ ID NO: 1055568 - DNA, 23 bp, Homo sapiens
tcttcataggtagaaacaaatac

SEQ ID NO: 1055569 - DNA, 23 bp, Homo sapiens
tcttcatcacttcttccactgtg

SEQ ID NO: 1055570 - DNA, 17 bp, Homo sapiens
tcttcatccaacttcca

SEQ ID NO: 1055571 - DNA, 13 bp, Homo sapiens
tcttcatctccct

SEQ ID NO: 1055572 - DNA, 19 bp, Homo sapiens
tcttcatctccctgccatc

SEQ ID NO: 1055573 - DNA, 21 bp, Homo sapiens
tcttcatctccctgccatccc

SEQ ID NO: 1055574 - DNA, 14 bp, Homo sapiens
tcttcatgcaatga

SEQ ID NO: 1055575 - DNA, 15 bp, Homo sapiens
tcttcatgcttgaca

SEQ ID NO: 1055576 - DNA, 22 bp, Homo sapiens
tcttcatggcatcttcaatatg

SEQ ID NO: 1055577 - DNA, 20 bp, Homo sapiens
tcttcatgtaaattgactgt

SEQ ID NO: 1055578 - DNA, 24 bp, Homo sapiens
tcttcatttcattgtatgatgtgt

SEQ ID NO: 1055579 - DNA, 21 bp, Homo sapiens
tcttcatttttttttcaatca

SEQ ID NO: 1055580 - DNA, 13 bp, Homo sapiens
tcttccaaagctc

SEQ ID NO: 1055581 - DNA, 15 bp, Homo sapiens
tcttccaaaggcata

SEQ ID NO: 1055582 - DNA, 22 bp, Homo sapiens
tcttccaaatgcagttcattgc

SEQ ID NO: 1055583 - DNA, 17 bp, Homo sapiens
tcttccaaggtagctct

SEQ ID NO: 1055584 - DNA, 21 bp, Homo sapiens
tcttccactccttctctcact

SEQ ID NO: 1055585 - DNA, 13 bp, Homo sapiens
tcttccactttgc

SEQ ID NO: 1055586 - DNA, 17 bp, Homo sapiens
tcttccagaatgctgaa

SEQ ID NO: 1055587 - DNA, 21 bp, Homo sapiens
tcttccagtcttcctgacact

SEQ ID NO: 1055588 - DNA, 18 bp, Homo sapiens
tcttccatcatcactgta

SEQ ID NO: 1055589 - DNA, 13 bp, Homo sapiens
tcttccatcatgg

SEQ ID NO: 1055590 - DNA, 17 bp, Homo sapiens
tcttccatctgcatctt

SEQ ID NO: 1055591 - DNA, 19 bp, Homo sapiens
tcttccatctgcatcttaa

SEQ ID NO: 1055592 - DNA, 16 bp, Homo sapiens
tcttccatgtatcttt

SEQ ID NO: 1055593 - DNA, 14 bp, Homo sapiens
tcttcccacaggag

SEQ ID NO: 1055594 - DNA, 12 bp, Homo sapiens
tcttcccaggcc

SEQ ID NO: 1055595 - DNA, 13 bp, Homo sapiens
tcttcccaggcct

SEQ ID NO: 1055596 - DNA, 16 bp, Homo sapiens
tcttcccaggcctttg

SEQ ID NO: 1055597 - DNA, 15 bp, Homo sapiens
tcttcccatgactgc

SEQ ID NO: 1055598 - DNA, 13 bp, Homo sapiens
tcttccccaaggg

SEQ ID NO: 1055599 - DNA, 14 bp, Homo sapiens
tcttccccagagag

SEQ ID NO: 1055600 - DNA, 22 bp, Homo sapiens
tcttcccctagacctccccctc

SEQ ID NO: 1055601 - DNA, 15 bp, Homo sapiens
tcttccccttcctgt

SEQ ID NO: 1055602 - DNA, 22 bp, Homo sapiens
tcttccccttgcccttgccctg

SEQ ID NO: 1055603 - DNA, 18 bp, Homo sapiens
tcttcccctttgtcctgc

SEQ ID NO: 1055604 - DNA, 15 bp, Homo sapiens
tcttcccgtgtgtat

SEQ ID NO: 1055605 - DNA, 19 bp, Homo sapiens
tcttccctacagttgaaaa

SEQ ID NO: 1055606 - DNA, 20 bp, Homo sapiens
tcttccctagagggttcctg

SEQ ID NO: 1055607 - DNA, 11 bp, Homo sapiens
tcttccctcag

SEQ ID NO: 1055608 - DNA, 16 bp, Homo sapiens
tcttccctcggggagc

SEQ ID NO: 1055609 - DNA, 18 bp, Homo sapiens
tcttccctcggggagcca

SEQ ID NO: 1055610 - DNA, 16 bp, Homo sapiens
tcttccctctctgcag

SEQ ID NO: 1055611 - DNA, 21 bp, Homo sapiens
tcttccctctgatttttcctt

SEQ ID NO: 1055612 - DNA, 23 bp, Homo sapiens
tcttccctgaacgttttcttctt

SEQ ID NO: 1055613 - DNA, 19 bp, Homo sapiens
tcttccctgaagagacagg

SEQ ID NO: 1055614 - DNA, 17 bp, Homo sapiens
tcttccctgtcagcctg

SEQ ID NO: 1055615 - DNA, 16 bp, Homo sapiens
tcttcccttaactcca

SEQ ID NO: 1055616 - DNA, 14 bp, Homo sapiens
tcttcccttagcct

SEQ ID NO: 1055617 - DNA, 20 bp, Homo sapiens
tcttcccttagcctctccca

SEQ ID NO: 1055618 - DNA, 15 bp, Homo sapiens
tcttcccttcctcca

SEQ ID NO: 1055619 - DNA, 21 bp, Homo sapiens
tcttccgaaaaatcctcttcc

SEQ ID NO: 1055620 - DNA, 21 bp, Homo sapiens
tcttccgaatgggttttctat

SEQ ID NO: 1055621 - DNA, 16 bp, Homo sapiens
tcttccgcagcccctt

SEQ ID NO: 1055622 - DNA, 18 bp, Homo sapiens
tcttccgcccctgcctgc

SEQ ID NO: 1055623 - DNA, 23 bp, Homo sapiens
tcttccgcccctgcctgccatgt

SEQ ID NO: 1055624 - DNA, 15 bp, Homo sapiens
tcttccggagatgta

SEQ ID NO: 1055625 - DNA, 14 bp, Homo sapiens
tcttccgtctcccc

SEQ ID NO: 1055626 - DNA, 20 bp, Homo sapiens
tcttcgctgctagagaaggg

SEQ ID NO: 1055627 - DNA, 13 bp, Homo sapiens
tcttcgctgctct

SEQ ID NO: 1055628 - DNA, 22 bp, Homo sapiens
tcttcggccctcagatgtccct

SEQ ID NO: 1055629 - DNA, 23 bp, Homo sapiens
tcttcggccctcagatgtccctt

SEQ ID NO: 1055630 - DNA, 13 bp, Homo sapiens
tcttcgtatatac

SEQ ID NO: 1055631 - DNA, 16 bp, Homo sapiens
tcttcgtccttttggt

SEQ ID NO: 1055632 - DNA, 22 bp, Homo sapiens
tcttctaaacttccccatcttc

SEQ ID NO: 1055633 - DNA, 16 bp, Homo sapiens
tcttctaacacaaaat

SEQ ID NO: 1055634 - DNA, 15 bp, Homo sapiens
tcttctaagaagaca

SEQ ID NO: 1055635 - DNA, 18 bp, Homo sapiens
tcttctaagaagacattt

SEQ ID NO: 1055636 - DNA, 21 bp, Homo sapiens
tcttctacttgtaaaatgctt

SEQ ID NO: 1055637 - DNA, 23 bp, Homo sapiens
tcttctagatgattttttgaaag

SEQ ID NO: 1055638 - DNA, 23 bp, Homo sapiens
tcttctagctgcagatgcctctg

SEQ ID NO: 1055639 - DNA, 20 bp, Homo sapiens
tcttctaggcccattgtcct

SEQ ID NO: 1055640 - DNA, 17 bp, Homo sapiens
tcttctaggttctaaaa

SEQ ID NO: 1055641 - DNA, 21 bp, Homo sapiens
tcttctagtatttttttctta

SEQ ID NO: 1055642 - DNA, 10 bp, Homo sapiens
tcttctatta

SEQ ID NO: 1055643 - DNA, 15 bp, Homo sapiens
tcttctcaagtgcct

SEQ ID NO: 1055644 - DNA, 16 bp, Homo sapiens
tcttctcaagtgcctt

SEQ ID NO: 1055645 - DNA, 17 bp, Homo sapiens
tcttctcaagtgcctta

SEQ ID NO: 1055646 - DNA, 14 bp, Homo sapiens
tcttctcagagtgg

SEQ ID NO: 1055647 - DNA, 16 bp, Homo sapiens
tcttctcagctcttcc

SEQ ID NO: 1055648 - DNA, 15 bp, Homo sapiens
tcttctcataaatct

SEQ ID NO: 1055649 - DNA, 21 bp, Homo sapiens
tcttctcataaatctttttac

SEQ ID NO: 1055650 - DNA, 18 bp, Homo sapiens
tcttctcatagcattaac

SEQ ID NO: 1055651 - DNA, 19 bp, Homo sapiens
tcttctcatagcattaact

SEQ ID NO: 1055652 - DNA, 16 bp, Homo sapiens
tcttctccaattctga

SEQ ID NO: 1055653 - DNA, 23 bp, Homo sapiens
tcttctccaattctgaaatactt

SEQ ID NO: 1055654 - DNA, 14 bp, Homo sapiens
tcttctccacgtct

SEQ ID NO: 1055655 - DNA, 21 bp, Homo sapiens
tcttctcccagaatcccagcc

SEQ ID NO: 1055656 - DNA, 16 bp, Homo sapiens
tcttctcccttgtcct

SEQ ID NO: 1055657 - DNA, 13 bp, Homo sapiens
tcttctcctttca

SEQ ID NO: 1055658 - DNA, 14 bp, Homo sapiens
tcttctcctttcac

SEQ ID NO: 1055659 - DNA, 14 bp, Homo sapiens
tcttctctccagct

SEQ ID NO: 1055660 - DNA, 21 bp, Homo sapiens
tcttctctggcgacagttttc

SEQ ID NO: 1055661 - DNA, 13 bp, Homo sapiens
tcttctctgtgaa

SEQ ID NO: 1055662 - DNA, 13 bp, Homo sapiens
tcttctcttcctg

SEQ ID NO: 1055663 - DNA, 21 bp, Homo sapiens
tcttctcttccttttatcagt

SEQ ID NO: 1055664 - DNA, 18 bp, Homo sapiens
tcttctcttgacagtctg

SEQ ID NO: 1055665 - DNA, 19 bp, Homo sapiens
tcttctcttggtgaaataa

SEQ ID NO: 1055666 - DNA, 13 bp, Homo sapiens
tcttctctttagt

SEQ ID NO: 1055667 - DNA, 16 bp, Homo sapiens
tcttctgaatatttta

SEQ ID NO: 1055668 - DNA, 16 bp, Homo sapiens
tcttctgagcactgtt

SEQ ID NO: 1055669 - DNA, 21 bp, Homo sapiens
tcttctgagctatttcatcta

SEQ ID NO: 1055670 - DNA, 22 bp, Homo sapiens
tcttctgccacttctgcgggct

SEQ ID NO: 1055671 - DNA, 20 bp, Homo sapiens
tcttctgccctttcctaggc

SEQ ID NO: 1055672 - DNA, 17 bp, Homo sapiens
tcttctgcgcctcaggc

SEQ ID NO: 1055673 - DNA, 14 bp, Homo sapiens
tcttctgctccacc

SEQ ID NO: 1055674 - DNA, 16 bp, Homo sapiens
tcttctgctccaccct

SEQ ID NO: 1055675 - DNA, 12 bp, Homo sapiens
tcttctggagtt

SEQ ID NO: 1055676 - DNA, 18 bp, Homo sapiens
tcttctggctcaaaaaga

SEQ ID NO: 1055677 - DNA, 11 bp, Homo sapiens
tcttctggctt

SEQ ID NO: 1055678 - DNA, 23 bp, Homo sapiens
tcttctgggagggcagcagggct

SEQ ID NO: 1055679 - DNA, 21 bp, Homo sapiens
tcttctgggcagagcctgtcc

SEQ ID NO: 1055680 - DNA, 12 bp, Homo sapiens
tcttctgggcta

SEQ ID NO: 1055681 - DNA, 18 bp, Homo sapiens
tcttctggggcaggctgg

SEQ ID NO: 1055682 - DNA, 20 bp, Homo sapiens
tcttctgggtagtcccctgt

SEQ ID NO: 1055683 - DNA, 21 bp, Homo sapiens
tcttctgggtagtcccctgtt

SEQ ID NO: 1055684 - DNA, 23 bp, Homo sapiens
tcttctgggtgtgctttttggga

SEQ ID NO: 1055685 - DNA, 14 bp, Homo sapiens
tcttctgtatttct

SEQ ID NO: 1055686 - DNA, 22 bp, Homo sapiens
tcttctgtatttctaggcacaa

SEQ ID NO: 1055687 - DNA, 22 bp, Homo sapiens
tcttctgtatttttttttctaa

SEQ ID NO: 1055688 - DNA, 16 bp, Homo sapiens
tcttctgtccatcagt

SEQ ID NO: 1055689 - DNA, 13 bp, Homo sapiens
tcttctgtccctg

SEQ ID NO: 1055690 - DNA, 15 bp, Homo sapiens
tcttctgtccctgtt

SEQ ID NO: 1055691 - DNA, 13 bp, Homo sapiens
tcttcttaaacca

SEQ ID NO: 1055692 - DNA, 18 bp, Homo sapiens
tcttcttaagacttttgg

SEQ ID NO: 1055693 - DNA, 23 bp, Homo sapiens
tcttcttcatccaacttccaaga

SEQ ID NO: 1055694 - DNA, 14 bp, Homo sapiens
tcttcttctaagaa

SEQ ID NO: 1055695 - DNA, 14 bp, Homo sapiens
tcttcttcttttct

SEQ ID NO: 1055696 - DNA, 20 bp, Homo sapiens
tcttcttgagcagaccgtga

SEQ ID NO: 1055697 - DNA, 15 bp, Homo sapiens
tcttcttgcatctaa

SEQ ID NO: 1055698 - DNA, 21 bp, Homo sapiens
tcttcttgctacacccctttt

SEQ ID NO: 1055699 - DNA, 20 bp, Homo sapiens
tcttcttgggagtatgttgt

SEQ ID NO: 1055700 - DNA, 16 bp, Homo sapiens
tcttcttgtgtcctga

SEQ ID NO: 1055701 - DNA, 19 bp, Homo sapiens
tcttcttgttgaccctttt

SEQ ID NO: 1055702 - DNA, 14 bp, Homo sapiens
tcttcttgtttctc

SEQ ID NO: 1055703 - DNA, 13 bp, Homo sapiens
tcttctttattgc

SEQ ID NO: 1055704 - DNA, 16 bp, Homo sapiens
tcttctttattgcact

SEQ ID NO: 1055705 - DNA, 22 bp, Homo sapiens
tcttctttccctggacaggcag

SEQ ID NO: 1055706 - DNA, 19 bp, Homo sapiens
tcttctttcctttactcct

SEQ ID NO: 1055707 - DNA, 22 bp, Homo sapiens
tcttcttttgtgtcctgctctg

SEQ ID NO: 1055708 - DNA, 18 bp, Homo sapiens
tcttctttttttgtgatg

SEQ ID NO: 1055709 - DNA, 12 bp, Homo sapiens
tcttgaaaaaga

SEQ ID NO: 1055710 - DNA, 22 bp, Homo sapiens
tcttgagtttgtcgctcatgtg

SEQ ID NO: 1055711 - DNA, 20 bp, Homo sapiens
tcttgataaatgactgtttt

SEQ ID NO: 1055712 - DNA, 18 bp, Homo sapiens
tcttgatacattcaaatt

SEQ ID NO: 1055713 - DNA, 19 bp, Homo sapiens
tcttgatacattcaaattt

SEQ ID NO: 1055714 - DNA, 17 bp, Homo sapiens
tcttgatacccccctct

SEQ ID NO: 1055715 - DNA, 21 bp, Homo sapiens
tcttgatacccccctctgtct

SEQ ID NO: 1055716 - DNA, 14 bp, Homo sapiens
tcttgatcctccaa

SEQ ID NO: 1055717 - DNA, 16 bp, Homo sapiens
tcttgatcctccaatg

SEQ ID NO: 1055718 - DNA, 21 bp, Homo sapiens
tcttgatcctccaatgtctaa

SEQ ID NO: 1055719 - DNA, 12 bp, Homo sapiens
tcttgatctcta

SEQ ID NO: 1055720 - DNA, 13 bp, Homo sapiens
tcttgatctctaa

SEQ ID NO: 1055721 - DNA, 12 bp, Homo sapiens
tcttgatgacca

SEQ ID NO: 1055722 - DNA, 13 bp, Homo sapiens
tcttgatgtcatg

SEQ ID NO: 1055723 - DNA, 16 bp, Homo sapiens
tcttgatgttgcttag

SEQ ID NO: 1055724 - DNA, 14 bp, Homo sapiens
tcttgattataaat

SEQ ID NO: 1055725 - DNA, 15 bp, Homo sapiens
tcttgattataaatg

SEQ ID NO: 1055726 - DNA, 16 bp, Homo sapiens
tcttgattataaatgt

SEQ ID NO: 1055727 - DNA, 17 bp, Homo sapiens
tcttgattataaatgtt

SEQ ID NO: 1055728 - DNA, 14 bp, Homo sapiens
tcttgattatccat

SEQ ID NO: 1055729 - DNA, 15 bp, Homo sapiens
tcttgattcctggtt

SEQ ID NO: 1055730 - DNA, 20 bp, Homo sapiens
tcttgcaaagcgacagattc

SEQ ID NO: 1055731 - DNA, 13 bp, Homo sapiens
tcttgcaacagtg

SEQ ID NO: 1055732 - DNA, 14 bp, Homo sapiens
tcttgcaacttcag

SEQ ID NO: 1055733 - DNA, 16 bp, Homo sapiens
tcttgcaacttcagtt

SEQ ID NO: 1055734 - DNA, 17 bp, Homo sapiens
tcttgcaacttcagttt

SEQ ID NO: 1055735 - DNA, 16 bp, Homo sapiens
tcttgcaccaaattat

SEQ ID NO: 1055736 - DNA, 14 bp, Homo sapiens
tcttgcacccgcct

SEQ ID NO: 1055737 - DNA, 20 bp, Homo sapiens
tcttgcacccgcctctcccg

SEQ ID NO: 1055738 - DNA, 16 bp, Homo sapiens
tcttgcactccttccc

SEQ ID NO: 1055739 - DNA, 13 bp, Homo sapiens
tcttgcactgaat

SEQ ID NO: 1055740 - DNA, 19 bp, Homo sapiens
tcttgcagattctatttcc

SEQ ID NO: 1055741 - DNA, 23 bp, Homo sapiens
tcttgcatggcaaggactgcagg

SEQ ID NO: 1055742 - DNA, 16 bp, Homo sapiens
tcttgccaccctctgg

SEQ ID NO: 1055743 - DNA, 17 bp, Homo sapiens
tcttgccaccctctggg

SEQ ID NO: 1055744 - DNA, 21 bp, Homo sapiens
tcttgccaccctctgggagtc

SEQ ID NO: 1055745 - DNA, 17 bp, Homo sapiens
tcttgccactgcctctt

SEQ ID NO: 1055746 - DNA, 16 bp, Homo sapiens
tcttgccagcctcctt

SEQ ID NO: 1055747 - DNA, 23 bp, Homo sapiens
tcttgccagcctccttgctgacc

SEQ ID NO: 1055748 - DNA, 18 bp, Homo sapiens
tcttgcccatcctgactg

SEQ ID NO: 1055749 - DNA, 20 bp, Homo sapiens
tcttgccccactccctggcc

SEQ ID NO: 1055750 - DNA, 13 bp, Homo sapiens
tcttgccccagtt

SEQ ID NO: 1055751 - DNA, 19 bp, Homo sapiens
tcttgccccagtttggggt

SEQ ID NO: 1055752 - DNA, 12 bp, Homo sapiens
tcttgcccccca

SEQ ID NO: 1055753 - DNA, 23 bp, Homo sapiens
tcttgccccctttgaccttcccc

SEQ ID NO: 1055754 - DNA, 15 bp, Homo sapiens
tcttgccccttgtcc

SEQ ID NO: 1055755 - DNA, 13 bp, Homo sapiens
tcttgcccttccc

SEQ ID NO: 1055756 - DNA, 15 bp, Homo sapiens
tcttgcccttccctg

SEQ ID NO: 1055757 - DNA, 16 bp, Homo sapiens
tcttgcccttccctgt

SEQ ID NO: 1055758 - DNA, 21 bp, Homo sapiens
tcttgcccttcctactcctca

SEQ ID NO: 1055759 - DNA, 16 bp, Homo sapiens
tcttgcctaaatccca

SEQ ID NO: 1055760 - DNA, 13 bp, Homo sapiens
tcttgcctaggcc

SEQ ID NO: 1055761 - DNA, 13 bp, Homo sapiens
tcttgcctctctc

SEQ ID NO: 1055762 - DNA, 15 bp, Homo sapiens
tcttgcgggcctgga

SEQ ID NO: 1055763 - DNA, 13 bp, Homo sapiens
tcttgctaccagt

SEQ ID NO: 1055764 - DNA, 14 bp, Homo sapiens
tcttgctaccagta

SEQ ID NO: 1055765 - DNA, 14 bp, Homo sapiens
tcttgctcctgggg

SEQ ID NO: 1055766 - DNA, 11 bp, Homo sapiens
tcttgctctct

SEQ ID NO: 1055767 - DNA, 22 bp, Homo sapiens
tcttgctctctctccctgcctt

SEQ ID NO: 1055768 - DNA, 22 bp, Homo sapiens
tcttgctctgtctcccaggctg

SEQ ID NO: 1055769 - DNA, 14 bp, Homo sapiens
tcttgctctttcta

SEQ ID NO: 1055770 - DNA, 13 bp, Homo sapiens
tcttgctgagcac

SEQ ID NO: 1055771 - DNA, 19 bp, Homo sapiens
tcttgctgatggctgctag

SEQ ID NO: 1055772 - DNA, 13 bp, Homo sapiens
tcttgctgcaggc

SEQ ID NO: 1055773 - DNA, 21 bp, Homo sapiens
tcttgctgcaggccctccctc

SEQ ID NO: 1055774 - DNA, 22 bp, Homo sapiens
tcttgctgcaggccctccctct

SEQ ID NO: 1055775 - DNA, 18 bp, Homo sapiens
tcttgctggattaatgtt

SEQ ID NO: 1055776 - DNA, 19 bp, Homo sapiens
tcttgctggattaatgttt

SEQ ID NO: 1055777 - DNA, 11 bp, Homo sapiens
tcttgctggct

SEQ ID NO: 1055778 - DNA, 23 bp, Homo sapiens
tcttgctggctacgcctcttctg

SEQ ID NO: 1055779 - DNA, 18 bp, Homo sapiens
tcttgctggctctgagaa

SEQ ID NO: 1055780 - DNA, 16 bp, Homo sapiens
tcttgctgtctctgct

SEQ ID NO: 1055781 - DNA, 20 bp, Homo sapiens
tcttgctgttcagtgctttt

SEQ ID NO: 1055782 - DNA, 12 bp, Homo sapiens
tcttgcttcaga

SEQ ID NO: 1055783 - DNA, 11 bp, Homo sapiens
tcttgcttctt

SEQ ID NO: 1055784 - DNA, 17 bp, Homo sapiens
tcttgcttctttctaga

SEQ ID NO: 1055785 - DNA, 13 bp, Homo sapiens
tcttgctttctat

SEQ ID NO: 1055786 - DNA, 22 bp, Homo sapiens
tcttggacccctgaattcaatg

SEQ ID NO: 1055787 - DNA, 23 bp, Homo sapiens
tcttggacctctgctctgaggct

SEQ ID NO: 1055788 - DNA, 15 bp, Homo sapiens
tcttggagctgtgag

SEQ ID NO: 1055789 - DNA, 23 bp, Homo sapiens
tcttggagctgtgagttctccct

SEQ ID NO: 1055790 - DNA, 19 bp, Homo sapiens
tcttggagctttttcaaaa

SEQ ID NO: 1055791 - DNA, 20 bp, Homo sapiens
tcttggataccagctcaggg

SEQ ID NO: 1055792 - DNA, 20 bp, Homo sapiens
tcttggcattttcctcgcct

SEQ ID NO: 1055793 - DNA, 14 bp, Homo sapiens
tcttggccagccaa

SEQ ID NO: 1055794 - DNA, 14 bp, Homo sapiens
tcttggcctcccag

SEQ ID NO: 1055795 - DNA, 15 bp, Homo sapiens
tcttggcggcagcag

SEQ ID NO: 1055796 - DNA, 14 bp, Homo sapiens
tcttggctcactgc

SEQ ID NO: 1055797 - DNA, 19 bp, Homo sapiens
tcttggcttaatcattttc

SEQ ID NO: 1055798 - DNA, 19 bp, Homo sapiens
tcttggcttctcagcccct

SEQ ID NO: 1055799 - DNA, 16 bp, Homo sapiens
tcttggcttcttaaaa

SEQ ID NO: 1055800 - DNA, 17 bp, Homo sapiens
tcttggcttcttaaaaa

SEQ ID NO: 1055801 - DNA, 19 bp, Homo sapiens
tcttggcttcttaaaaact

SEQ ID NO: 1055802 - DNA, 22 bp, Homo sapiens
tcttggcttcttaaaaactgtg

SEQ ID NO: 1055803 - DNA, 23 bp, Homo sapiens
tcttggcttcttaaaaactgtgt

SEQ ID NO: 1055804 - DNA, 13 bp, Homo sapiens
tcttgggaaacac

SEQ ID NO: 1055805 - DNA, 19 bp, Homo sapiens
tcttgggaaatatgaatgc

SEQ ID NO: 1055806 - DNA, 20 bp, Homo sapiens
tcttgggagtatgttgtcat

SEQ ID NO: 1055807 - DNA, 16 bp, Homo sapiens
tcttgggagtcttggg

SEQ ID NO: 1055808 - DNA, 20 bp, Homo sapiens
tcttgggatagtgttctgct

SEQ ID NO: 1055809 - DNA, 19 bp, Homo sapiens
tcttgggcagagctggctc

SEQ ID NO: 1055810 - DNA, 15 bp, Homo sapiens
tcttgggccccagac

SEQ ID NO: 1055811 - DNA, 18 bp, Homo sapiens
tcttgggctactggcagc

SEQ ID NO: 1055812 - DNA, 21 bp, Homo sapiens
tcttgggctactggcagctcc

SEQ ID NO: 1055813 - DNA, 22 bp, Homo sapiens
tcttgggctactggcagctcct

SEQ ID NO: 1055814 - DNA, 19 bp, Homo sapiens
tcttgggctgagtgcagcc

SEQ ID NO: 1055815 - DNA, 20 bp, Homo sapiens
tcttgggctgagtgcagcca

SEQ ID NO: 1055816 - DNA, 21 bp, Homo sapiens
tcttggggacatctctttgaa

SEQ ID NO: 1055817 - DNA, 20 bp, Homo sapiens
tcttggggactaacccaatg

SEQ ID NO: 1055818 - DNA, 13 bp, Homo sapiens
tcttggggctcgc

SEQ ID NO: 1055819 - DNA, 18 bp, Homo sapiens
tcttgggggaggccaccc

SEQ ID NO: 1055820 - DNA, 19 bp, Homo sapiens
tcttgggggggtggccgct

SEQ ID NO: 1055821 - DNA, 22 bp, Homo sapiens
tcttggggtcatgaagggctgg

SEQ ID NO: 1055822 - DNA, 18 bp, Homo sapiens
tcttgggtctgccctgcc

SEQ ID NO: 1055823 - DNA, 20 bp, Homo sapiens
tcttgggtctgccctgccca

SEQ ID NO: 1055824 - DNA, 18 bp, Homo sapiens
tcttgggtgtattctctg

SEQ ID NO: 1055825 - DNA, 21 bp, Homo sapiens
tcttgggtgtattctctgtaa

SEQ ID NO: 1055826 - DNA, 14 bp, Homo sapiens
tcttggtaaaacat

SEQ ID NO: 1055827 - DNA, 22 bp, Homo sapiens
tcttggtagttctgtgcctccc

SEQ ID NO: 1055828 - DNA, 16 bp, Homo sapiens
tcttggtatgcatctt

SEQ ID NO: 1055829 - DNA, 18 bp, Homo sapiens
tcttggtccctggaagct

SEQ ID NO: 1055830 - DNA, 19 bp, Homo sapiens
tcttggtgaaataataaaa

SEQ ID NO: 1055831 - DNA, 16 bp, Homo sapiens
tcttggtgactgtccc

SEQ ID NO: 1055832 - DNA, 15 bp, Homo sapiens
tcttggtgctctgtg

SEQ ID NO: 1055833 - DNA, 19 bp, Homo sapiens
tcttggtgggtgtggccag

SEQ ID NO: 1055834 - DNA, 13 bp, Homo sapiens
tcttggtgtctgg

SEQ ID NO: 1055835 - DNA, 18 bp, Homo sapiens
tcttggttcataaatgaa

SEQ ID NO: 1055836 - DNA, 12 bp, Homo sapiens
tcttggttcctg

SEQ ID NO: 1055837 - DNA, 15 bp, Homo sapiens
tcttggttcctggga

SEQ ID NO: 1055838 - DNA, 16 bp, Homo sapiens
tcttggttcctgggat

SEQ ID NO: 1055839 - DNA, 14 bp, Homo sapiens
tcttggttctaaag

SEQ ID NO: 1055840 - DNA, 14 bp, Homo sapiens
tcttggttcttatt

SEQ ID NO: 1055841 - DNA, 20 bp, Homo sapiens
tcttggttcttttttcagtt

SEQ ID NO: 1055842 - DNA, 19 bp, Homo sapiens
tcttggttgaaaataaaaa

SEQ ID NO: 1055843 - DNA, 13 bp, Homo sapiens
tcttggttgagga

SEQ ID NO: 1055844 - DNA, 15 bp, Homo sapiens
tcttggttgaggaaa

SEQ ID NO: 1055845 - DNA, 15 bp, Homo sapiens
tcttggtttcagcca

SEQ ID NO: 1055846 - DNA, 14 bp, Homo sapiens
tcttggtttccaaa

SEQ ID NO: 1055847 - DNA, 22 bp, Homo sapiens
tcttggtttctggataaaccac

SEQ ID NO: 1055848 - DNA, 14 bp, Homo sapiens
tcttggtttgtaaa

SEQ ID NO: 1055849 - DNA, 20 bp, Homo sapiens
tcttggttttccctttgcct

SEQ ID NO: 1055850 - DNA, 16 bp, Homo sapiens
tcttggttttctctct

SEQ ID NO: 1055851 - DNA, 19 bp, Homo sapiens
tcttggttttctctctgga

SEQ ID NO: 1055852 - DNA, 21 bp, Homo sapiens
tcttggttttctctctggatg

SEQ ID NO: 1055853 - DNA, 14 bp, Homo sapiens
tcttgtaaagactg

SEQ ID NO: 1055854 - DNA, 17 bp, Homo sapiens
tcttgtaaagactggtt

SEQ ID NO: 1055855 - DNA, 13 bp, Homo sapiens
tcttgtaaataaa

SEQ ID NO: 1055856 - DNA, 18 bp, Homo sapiens
tcttgtaaataaagccct

SEQ ID NO: 1055857 - DNA, 23 bp, Homo sapiens
tcttgtaatttaaacaggcccag

SEQ ID NO: 1055858 - DNA, 13 bp, Homo sapiens
tcttgtaatttta

SEQ ID NO: 1055859 - DNA, 16 bp, Homo sapiens
tcttgtaccatagaaa

SEQ ID NO: 1055860 - DNA, 17 bp, Homo sapiens
tcttgtacttctgtgtt

SEQ ID NO: 1055861 - DNA, 16 bp, Homo sapiens
tcttgtagtagtctca

SEQ ID NO: 1055862 - DNA, 16 bp, Homo sapiens
tcttgtattaagttgt

SEQ ID NO: 1055863 - DNA, 18 bp, Homo sapiens
tcttgtattaagttgtta

SEQ ID NO: 1055864 - DNA, 22 bp, Homo sapiens
tcttgtattaagttgttaataa

SEQ ID NO: 1055865 - DNA, 15 bp, Homo sapiens
tcttgtatttattgg

SEQ ID NO: 1055866 - DNA, 20 bp, Homo sapiens
tcttgtatttgggccaaggt

SEQ ID NO: 1055867 - DNA, 21 bp, Homo sapiens
tcttgtatttgggccaaggtg

SEQ ID NO: 1055868 - DNA, 16 bp, Homo sapiens
tcttgtcaacatgcat

SEQ ID NO: 1055869 - DNA, 17 bp, Homo sapiens
tcttgtccacattctac

SEQ ID NO: 1055870 - DNA, 22 bp, Homo sapiens
tcttgtccatgtggttcttcaa

SEQ ID NO: 1055871 - DNA, 23 bp, Homo sapiens
tcttgtccatgtggttcttcaaa

SEQ ID NO: 1055872 - DNA, 23 bp, Homo sapiens
tcttgtcccctcttgacccatct

SEQ ID NO: 1055873 - DNA, 13 bp, Homo sapiens
tcttgtcccttgg

SEQ ID NO: 1055874 - DNA, 20 bp, Homo sapiens
tcttgtcctcattcttgcct

SEQ ID NO: 1055875 - DNA, 21 bp, Homo sapiens
tcttgtcctgtgatctgtgta

SEQ ID NO: 1055876 - DNA, 13 bp, Homo sapiens
tcttgtctataaa

SEQ ID NO: 1055877 - DNA, 15 bp, Homo sapiens
tcttgtctcccctgt

SEQ ID NO: 1055878 - DNA, 14 bp, Homo sapiens
tcttgtctctgggc

SEQ ID NO: 1055879 - DNA, 15 bp, Homo sapiens
tcttgtctctgggct

SEQ ID NO: 1055880 - DNA, 13 bp, Homo sapiens
tcttgtctgtgtg

SEQ ID NO: 1055881 - DNA, 16 bp, Homo sapiens
tcttgtctgtgtgatt

SEQ ID NO: 1055882 - DNA, 12 bp, Homo sapiens
tcttgtctttat

SEQ ID NO: 1055883 - DNA, 14 bp, Homo sapiens
tcttgtctttcctc

SEQ ID NO: 1055884 - DNA, 15 bp, Homo sapiens
tcttgtgaaggcagg

SEQ ID NO: 1055885 - DNA, 17 bp, Homo sapiens
tcttgtgatttggttgc

SEQ ID NO: 1055886 - DNA, 11 bp, Homo sapiens
tcttgtgcata

SEQ ID NO: 1055887 - DNA, 15 bp, Homo sapiens
tcttgtgcatgttta

SEQ ID NO: 1055888 - DNA, 15 bp, Homo sapiens
tcttgtgccctgggc

SEQ ID NO: 1055889 - DNA, 20 bp, Homo sapiens
tcttgtgccctgggccaaaa

SEQ ID NO: 1055890 - DNA, 19 bp, Homo sapiens
tcttgtgctagaatacttt

SEQ ID NO: 1055891 - DNA, 18 bp, Homo sapiens
tcttgtgctcacgctccc

SEQ ID NO: 1055892 - DNA, 18 bp, Homo sapiens
tcttgtggaggatgaata

SEQ ID NO: 1055893 - DNA, 20 bp, Homo sapiens
tcttgtgggagacagcagcc

SEQ ID NO: 1055894 - DNA, 13 bp, Homo sapiens
tcttgtggtgagg

SEQ ID NO: 1055895 - DNA, 13 bp, Homo sapiens
tcttgtgtcctga

SEQ ID NO: 1055896 - DNA, 16 bp, Homo sapiens
tcttgtgtttgagaac

SEQ ID NO: 1055897 - DNA, 18 bp, Homo sapiens
tcttgttaatgtcattgc

SEQ ID NO: 1055898 - DNA, 17 bp, Homo sapiens
tcttgttagaaaacaaa

SEQ ID NO: 1055899 - DNA, 15 bp, Homo sapiens
tcttgttatgtacaa

SEQ ID NO: 1055900 - DNA, 17 bp, Homo sapiens
tcttgttatgtacaaac

SEQ ID NO: 1055901 - DNA, 21 bp, Homo sapiens
tcttgttattgaagtgttctg

SEQ ID NO: 1055902 - DNA, 15 bp, Homo sapiens
tcttgttcaggaaaa

SEQ ID NO: 1055903 - DNA, 20 bp, Homo sapiens
tcttgttctgagattcaata

SEQ ID NO: 1055904 - DNA, 14 bp, Homo sapiens
tcttgttgataaaa

SEQ ID NO: 1055905 - DNA, 21 bp, Homo sapiens
tcttgttgctcaaaaaatgag

SEQ ID NO: 1055906 - DNA, 24 bp, Homo sapiens
tcttgttggtacctttctagcctt

SEQ ID NO: 1055907 - DNA, 15 bp, Homo sapiens
tcttgtttcactcca

SEQ ID NO: 1055908 - DNA, 18 bp, Homo sapiens
tcttgtttcactccacca

SEQ ID NO: 1055909 - DNA, 21 bp, Homo sapiens
tcttgtttctgggtccctgct

SEQ ID NO: 1055910 - DNA, 14 bp, Homo sapiens
tcttgtttctgtgc

SEQ ID NO: 1055911 - DNA, 13 bp, Homo sapiens
tcttgttttgaaa

SEQ ID NO: 1055912 - DNA, 16 bp, Homo sapiens
tcttgttttgaaaata

SEQ ID NO: 1055913 - DNA, 22 bp, Homo sapiens
tcttgttttgtcttgaaagtgg

SEQ ID NO: 1055914 - DNA, 17 bp, Homo sapiens
tcttgtttttattaatt

SEQ ID NO: 1055915 - DNA, 13 bp, Homo sapiens
tcttgtttttcca

SEQ ID NO: 1055916 - DNA, 21 bp, Homo sapiens
tcttgtttttccactactgct

SEQ ID NO: 1055917 - DNA, 16 bp, Homo sapiens
tctttaaaaaagactg

SEQ ID NO: 1055918 - DNA, 14 bp, Homo sapiens
tctttaaaaactgt

SEQ ID NO: 1055919 - DNA, 15 bp, Homo sapiens
tctttaaaagaatga

SEQ ID NO: 1055920 - DNA, 17 bp, Homo sapiens
tctttaaaagaatgact

SEQ ID NO: 1055921 - DNA, 16 bp, Homo sapiens
tctttaaaatatttgt

SEQ ID NO: 1055922 - DNA, 21 bp, Homo sapiens
tctttaaaatttaagtatctt

SEQ ID NO: 1055923 - DNA, 19 bp, Homo sapiens
tctttaaacaaatatgaaa

SEQ ID NO: 1055924 - DNA, 23 bp, Homo sapiens
tctttaaacaaatatgaaaaatg

SEQ ID NO: 1055925 - DNA, 23 bp, Homo sapiens
tctttaaacagtatttcattgcc

SEQ ID NO: 1055926 - DNA, 12 bp, Homo sapiens
tctttaaaccac

SEQ ID NO: 1055927 - DNA, 21 bp, Homo sapiens
tctttaaaccactaaaataca

SEQ ID NO: 1055928 - DNA, 13 bp, Homo sapiens
tctttaaagatgt

SEQ ID NO: 1055929 - DNA, 23 bp, Homo sapiens
tctttaaaggcccagcccctaga

SEQ ID NO: 1055930 - DNA, 14 bp, Homo sapiens
tctttaacaattgt

SEQ ID NO: 1055931 - DNA, 13 bp, Homo sapiens
tctttaacacatt

SEQ ID NO: 1055932 - DNA, 22 bp, Homo sapiens
tctttaacacattctttataaa

SEQ ID NO: 1055933 - DNA, 11 bp, Homo sapiens
tctttaactgc

SEQ ID NO: 1055934 - DNA, 20 bp, Homo sapiens
tctttaactgccgtaattta

SEQ ID NO: 1055935 - DNA, 14 bp, Homo sapiens
tctttaagaaagta

SEQ ID NO: 1055936 - DNA, 14 bp, Homo sapiens
tctttaagccatag

SEQ ID NO: 1055937 - DNA, 21 bp, Homo sapiens
tctttaagttttgattaatgt

SEQ ID NO: 1055938 - DNA, 14 bp, Homo sapiens
tctttaataaaaca

SEQ ID NO: 1055939 - DNA, 15 bp, Homo sapiens
tctttaatcttcagt

SEQ ID NO: 1055940 - DNA, 13 bp, Homo sapiens
tctttaatgctgt

SEQ ID NO: 1055941 - DNA, 17 bp, Homo sapiens
tctttaatgctgtcttt

SEQ ID NO: 1055942 - DNA, 20 bp, Homo sapiens
tctttaatgctgtctttgtg

SEQ ID NO: 1055943 - DNA, 22 bp, Homo sapiens
tctttacaaaacaaactcattc

SEQ ID NO: 1055944 - DNA, 13 bp, Homo sapiens
tctttacctgaga

SEQ ID NO: 1055945 - DNA, 23 bp, Homo sapiens
tctttaccttctaaaagccatta

SEQ ID NO: 1055946 - DNA, 19 bp, Homo sapiens
tctttacgtactgtaactg

SEQ ID NO: 1055947 - DNA, 21 bp, Homo sapiens
tctttactattaaaatatttt

SEQ ID NO: 1055948 - DNA, 16 bp, Homo sapiens
tctttactcccaagac

SEQ ID NO: 1055949 - DNA, 18 bp, Homo sapiens
tctttactcgtccccttt

SEQ ID NO: 1055950 - DNA, 14 bp, Homo sapiens
tctttacttaacat

SEQ ID NO: 1055951 - DNA, 23 bp, Homo sapiens
tctttacttaacatatctgatat

SEQ ID NO: 1055952 - DNA, 12 bp, Homo sapiens
tctttactttta

SEQ ID NO: 1055953 - DNA, 11 bp, Homo sapiens
tctttagaaca

SEQ ID NO: 1055954 - DNA, 12 bp, Homo sapiens
tctttagaattt

SEQ ID NO: 1055955 - DNA, 20 bp, Homo sapiens
tctttagagattataacaaa

SEQ ID NO: 1055956 - DNA, 20 bp, Homo sapiens
tctttagaggctttcaaatg

SEQ ID NO: 1055957 - DNA, 15 bp, Homo sapiens
tctttagatgccaaa

SEQ ID NO: 1055958 - DNA, 22 bp, Homo sapiens
tctttagcatttttatgcagac

SEQ ID NO: 1055959 - DNA, 21 bp, Homo sapiens
tctttataacccatattttcc

SEQ ID NO: 1055960 - DNA, 14 bp, Homo sapiens
tctttatacagatt

SEQ ID NO: 1055961 - DNA, 16 bp, Homo sapiens
tctttatacagatttt

SEQ ID NO: 1055962 - DNA, 14 bp, Homo sapiens
tctttatacagctg

SEQ ID NO: 1055963 - DNA, 16 bp, Homo sapiens
tctttatacagctgta

SEQ ID NO: 1055964 - DNA, 20 bp, Homo sapiens
tctttatagaaggaatttgt

SEQ ID NO: 1055965 - DNA, 21 bp, Homo sapiens
tctttatagaaggaatttgta

SEQ ID NO: 1055966 - DNA, 11 bp, Homo sapiens
tctttatatga

SEQ ID NO: 1055967 - DNA, 17 bp, Homo sapiens
tctttatgctgtatttt

SEQ ID NO: 1055968 - DNA, 16 bp, Homo sapiens
tctttattagctttct

SEQ ID NO: 1055969 - DNA, 17 bp, Homo sapiens
tctttattagctttctc

SEQ ID NO: 1055970 - DNA, 21 bp, Homo sapiens
tctttattattcctagtcttt

SEQ ID NO: 1055971 - DNA, 16 bp, Homo sapiens
tctttattctttacta

SEQ ID NO: 1055972 - DNA, 12 bp, Homo sapiens
tctttattgaaa

SEQ ID NO: 1055973 - DNA, 14 bp, Homo sapiens
tctttattgaaatt

SEQ ID NO: 1055974 - DNA, 21 bp, Homo sapiens
tctttattgaacttgaaatct

SEQ ID NO: 1055975 - DNA, 13 bp, Homo sapiens
tctttattgagaa

SEQ ID NO: 1055976 - DNA, 14 bp, Homo sapiens
tctttattgagaaa

SEQ ID NO: 1055977 - DNA, 12 bp, Homo sapiens
tctttattgtct

SEQ ID NO: 1055978 - DNA, 13 bp, Homo sapiens
tctttattgtctg

SEQ ID NO: 1055979 - DNA, 16 bp, Homo sapiens
tctttattgtctgtaa

SEQ ID NO: 1055980 - DNA, 17 bp, Homo sapiens
tctttattgtctgtaaa

SEQ ID NO: 1055981 - DNA, 23 bp, Homo sapiens
tctttattttaacctttgataga

SEQ ID NO: 1055982 - DNA, 15 bp, Homo sapiens
tctttatttttctct

SEQ ID NO: 1055983 - DNA, 19 bp, Homo sapiens
tctttatttttctctttct

SEQ ID NO: 1055984 - DNA, 22 bp, Homo sapiens
tctttatttttgttaatattaa

SEQ ID NO: 1055985 - DNA, 21 bp, Homo sapiens
tctttcaaaaccttttgaaat

SEQ ID NO: 1055986 - DNA, 21 bp, Homo sapiens
tctttcaaataacttagttct

SEQ ID NO: 1055987 - DNA, 15 bp, Homo sapiens
tctttcaacttgcat

SEQ ID NO: 1055988 - DNA, 15 bp, Homo sapiens
tctttcacaaaaaag

SEQ ID NO: 1055989 - DNA, 15 bp, Homo sapiens
tctttcacagctcct

SEQ ID NO: 1055990 - DNA, 12 bp, Homo sapiens
tctttcaccttt

SEQ ID NO: 1055991 - DNA, 17 bp, Homo sapiens
tctttcactggaatgaa

SEQ ID NO: 1055992 - DNA, 14 bp, Homo sapiens
tctttcacttgaaa

SEQ ID NO: 1055993 - DNA, 20 bp, Homo sapiens
tctttcaggggggttgtgag

SEQ ID NO: 1055994 - DNA, 16 bp, Homo sapiens
tctttcatacatatat

SEQ ID NO: 1055995 - DNA, 13 bp, Homo sapiens
tctttcatccact

SEQ ID NO: 1055996 - DNA, 14 bp, Homo sapiens
tctttcatctcctg

SEQ ID NO: 1055997 - DNA, 15 bp, Homo sapiens
tctttccaaaacatt

SEQ ID NO: 1055998 - DNA, 17 bp, Homo sapiens
tctttccaaataaaatg

SEQ ID NO: 1055999 - DNA, 15 bp, Homo sapiens
tctttccaaattaaa

SEQ ID NO: 1056000 - DNA, 14 bp, Homo sapiens
tctttccaaattat

SEQ ID NO: 1056001 - DNA, 19 bp, Homo sapiens
tctttccaaattatttctt

SEQ ID NO: 1056002 - DNA, 23 bp, Homo sapiens
tctttccacggagccactcctct

SEQ ID NO: 1056003 - DNA, 13 bp, Homo sapiens
tctttccactctg

SEQ ID NO: 1056004 - DNA, 16 bp, Homo sapiens
tctttccactctggat

SEQ ID NO: 1056005 - DNA, 10 bp, Homo sapiens
tctttccaga

SEQ ID NO: 1056006 - DNA, 16 bp, Homo sapiens
tctttccataataaaa

SEQ ID NO: 1056007 - DNA, 22 bp, Homo sapiens
tctttccattcttcttgctaca

SEQ ID NO: 1056008 - DNA, 20 bp, Homo sapiens
tctttccattggatctcatt

SEQ ID NO: 1056009 - DNA, 16 bp, Homo sapiens
tctttccatttgcatt

SEQ ID NO: 1056010 - DNA, 18 bp, Homo sapiens
tctttccccaaaaattga

SEQ ID NO: 1056011 - DNA, 12 bp, Homo sapiens
tctttccccaga

SEQ ID NO: 1056012 - DNA, 24 bp, Homo sapiens
tctttccccagcagtttctgtcct

SEQ ID NO: 1056013 - DNA, 17 bp, Homo sapiens
tctttcccctcctttgt

SEQ ID NO: 1056014 - DNA, 15 bp, Homo sapiens
tctttccctggacag

SEQ ID NO: 1056015 - DNA, 15 bp, Homo sapiens
tctttcctcacattt

SEQ ID NO: 1056016 - DNA, 11 bp, Homo sapiens
tctttcctctt

SEQ ID NO: 1056017 - DNA, 16 bp, Homo sapiens
tctttcctgaaccatg

SEQ ID NO: 1056018 - DNA, 14 bp, Homo sapiens
tctttcctgctaca

SEQ ID NO: 1056019 - DNA, 18 bp, Homo sapiens
tctttcctttactcctgg

SEQ ID NO: 1056020 - DNA, 19 bp, Homo sapiens
tctttcctttactcctggc

SEQ ID NO: 1056021 - DNA, 14 bp, Homo sapiens
tctttctaagaaat

SEQ ID NO: 1056022 - DNA, 16 bp, Homo sapiens
tctttctaatgtagct

SEQ ID NO: 1056023 - DNA, 21 bp, Homo sapiens
tctttctacatgactgggcct

SEQ ID NO: 1056024 - DNA, 19 bp, Homo sapiens
tctttctactctgaactaa

SEQ ID NO: 1056025 - DNA, 19 bp, Homo sapiens
tctttctagttcagctgcc

SEQ ID NO: 1056026 - DNA, 18 bp, Homo sapiens
tctttctcacccaggcaa

SEQ ID NO: 1056027 - DNA, 17 bp, Homo sapiens
tctttctcactaaatct

SEQ ID NO: 1056028 - DNA, 18 bp, Homo sapiens
tctttctcactaaatctt

SEQ ID NO: 1056029 - DNA, 13 bp, Homo sapiens
tctttctcccttt

SEQ ID NO: 1056030 - DNA, 17 bp, Homo sapiens
tctttctcctcaggaca

SEQ ID NO: 1056031 - DNA, 23 bp, Homo sapiens
tctttctcctcaggacaaggcct

SEQ ID NO: 1056032 - DNA, 13 bp, Homo sapiens
tctttctcctggt

SEQ ID NO: 1056033 - DNA, 14 bp, Homo sapiens
tctttctcctggtg

SEQ ID NO: 1056034 - DNA, 19 bp, Homo sapiens
tctttctcctggtgactca

SEQ ID NO: 1056035 - DNA, 18 bp, Homo sapiens
tctttctccttagtcttc

SEQ ID NO: 1056036 - DNA, 24 bp, Homo sapiens
tctttctccttagtcttctcatag

SEQ ID NO: 1056037 - DNA, 21 bp, Homo sapiens
tctttctccttgaatatcttt

SEQ ID NO: 1056038 - DNA, 16 bp, Homo sapiens
tctttctctactttga

SEQ ID NO: 1056039 - DNA, 11 bp, Homo sapiens
tctttctctca

SEQ ID NO: 1056040 - DNA, 12 bp, Homo sapiens
tctttctctcag

SEQ ID NO: 1056041 - DNA, 14 bp, Homo sapiens
tctttctctcccca

SEQ ID NO: 1056042 - DNA, 19 bp, Homo sapiens
tctttctctcctcagttta

SEQ ID NO: 1056043 - DNA, 14 bp, Homo sapiens
tctttctctcttcc

SEQ ID NO: 1056044 - DNA, 17 bp, Homo sapiens
tctttctctcttccctc

SEQ ID NO: 1056045 - DNA, 10 bp, Homo sapiens
tctttctctg

SEQ ID NO: 1056046 - DNA, 11 bp, Homo sapiens
tctttctctgc

SEQ ID NO: 1056047 - DNA, 12 bp, Homo sapiens
tctttctcttcc

SEQ ID NO: 1056048 - DNA, 16 bp, Homo sapiens
tctttctgaagatcaa

SEQ ID NO: 1056049 - DNA, 14 bp, Homo sapiens
tctttctgaaggaa

SEQ ID NO: 1056050 - DNA, 21 bp, Homo sapiens
tctttctgcagaaacagaaag

SEQ ID NO: 1056051 - DNA, 14 bp, Homo sapiens
tctttctgctctgc

SEQ ID NO: 1056052 - DNA, 20 bp, Homo sapiens
tctttctgctctgccatctt

SEQ ID NO: 1056053 - DNA, 13 bp, Homo sapiens
tctttctggagtc

SEQ ID NO: 1056054 - DNA, 16 bp, Homo sapiens
tctttctggcctgcct

SEQ ID NO: 1056055 - DNA, 18 bp, Homo sapiens
tctttctggctatgcatt

SEQ ID NO: 1056056 - DNA, 20 bp, Homo sapiens
tctttctggctatgcatttg

SEQ ID NO: 1056057 - DNA, 21 bp, Homo sapiens
tctttctggctatgcatttga

SEQ ID NO: 1056058 - DNA, 13 bp, Homo sapiens
tctttctgggagc

SEQ ID NO: 1056059 - DNA, 20 bp, Homo sapiens
tctttctgtgcttggatttg

SEQ ID NO: 1056060 - DNA, 22 bp, Homo sapiens
tctttcttccattccttcatgt

SEQ ID NO: 1056061 - DNA, 21 bp, Homo sapiens
tctttcttcccgtgtgtattt

SEQ ID NO: 1056062 - DNA, 14 bp, Homo sapiens
tctttcttcctctg

SEQ ID NO: 1056063 - DNA, 16 bp, Homo sapiens
tctttcttcctcttct

SEQ ID NO: 1056064 - DNA, 13 bp, Homo sapiens
tctttcttccttt

SEQ ID NO: 1056065 - DNA, 15 bp, Homo sapiens
tctttcttcctttac

SEQ ID NO: 1056066 - DNA, 12 bp, Homo sapiens
tctttcttggga

SEQ ID NO: 1056067 - DNA, 17 bp, Homo sapiens
tctttctttacctgaga

SEQ ID NO: 1056068 - DNA, 18 bp, Homo sapiens
tctttctttgtttctttc

SEQ ID NO: 1056069 - DNA, 24 bp, Homo sapiens
tctttcttttcttttttaaagtaa

SEQ ID NO: 1056070 - DNA, 22 bp, Homo sapiens
tctttcttttgattcttcctaa

SEQ ID NO: 1056071 - DNA, 14 bp, Homo sapiens
tctttctttttctg

SEQ ID NO: 1056072 - DNA, 18 bp, Homo sapiens
tctttctttttctggaaa

SEQ ID NO: 1056073 - DNA, 22 bp, Homo sapiens
tctttgaaatagtctgtgtgaa

SEQ ID NO: 1056074 - DNA, 18 bp, Homo sapiens
tctttgaaatgacatgtt

SEQ ID NO: 1056075 - DNA, 19 bp, Homo sapiens
tctttgaccagatctttct

SEQ ID NO: 1056076 - DNA, 12 bp, Homo sapiens
tctttgagaggg

SEQ ID NO: 1056077 - DNA, 18 bp, Homo sapiens
tctttgagatagaagaac

SEQ ID NO: 1056078 - DNA, 12 bp, Homo sapiens
tctttgagccca

SEQ ID NO: 1056079 - DNA, 15 bp, Homo sapiens
tctttgagcccattc

SEQ ID NO: 1056080 - DNA, 15 bp, Homo sapiens
tctttgatccttctg

SEQ ID NO: 1056081 - DNA, 12 bp, Homo sapiens
tctttgatggac

SEQ ID NO: 1056082 - DNA, 17 bp, Homo sapiens
tctttgattagaaaata

SEQ ID NO: 1056083 - DNA, 18 bp, Homo sapiens
tctttgattatttgcatg

SEQ ID NO: 1056084 - DNA, 16 bp, Homo sapiens
tctttgatttgtacca

SEQ ID NO: 1056085 - DNA, 18 bp, Homo sapiens
tctttgatttgtaccatt

SEQ ID NO: 1056086 - DNA, 22 bp, Homo sapiens
tgaagaattattcagtgaattt

SEQ ID NO: 1056087 - DNA, 23 bp, Homo sapiens
tgaagaattattcagtgaatttg

SEQ ID NO: 1056088 - DNA, 23 bp, Homo sapiens
tgaagacaatgacttactgtaca

SEQ ID NO: 1056089 - DNA, 23 bp, Homo sapiens
tgaagacaatttgatacataata

SEQ ID NO: 1056090 - DNA, 19 bp, Homo sapiens
tgaagacacagcctccccc

SEQ ID NO: 1056091 - DNA, 12 bp, Homo sapiens
tgaagacataaa

SEQ ID NO: 1056092 - DNA, 21 bp, Homo sapiens
tgaagacattttttgctataa

SEQ ID NO: 1056093 - DNA, 13 bp, Homo sapiens
tgaagaccaaaga

SEQ ID NO: 1056094 - DNA, 24 bp, Homo sapiens
tgaagacctccacattaagtggct

SEQ ID NO: 1056095 - DNA, 16 bp, Homo sapiens
tgaagacggaaaacaa

SEQ ID NO: 1056096 - DNA, 13 bp, Homo sapiens
tgaagacgtggac

SEQ ID NO: 1056097 - DNA, 17 bp, Homo sapiens
tgaagacgtggactcct

SEQ ID NO: 1056098 - DNA, 13 bp, Homo sapiens
tgaagactgagaa

SEQ ID NO: 1056099 - DNA, 23 bp, Homo sapiens
tgaagactgcacaggtgacaagc

SEQ ID NO: 1056100 - DNA, 18 bp, Homo sapiens
tgaagactggaagctaat

SEQ ID NO: 1056101 - DNA, 15 bp, Homo sapiens
tgaagacttcctctc

SEQ ID NO: 1056102 - DNA, 23 bp, Homo sapiens
tgaagagacagagacaagtaatt

SEQ ID NO: 1056103 - DNA, 22 bp, Homo sapiens
tgaagagcctgaagctggcctg

SEQ ID NO: 1056104 - DNA, 18 bp, Homo sapiens
tgaagagcgctcctctgc

SEQ ID NO: 1056105 - DNA, 17 bp, Homo sapiens
tgaagagctgtcttccc

SEQ ID NO: 1056106 - DNA, 22 bp, Homo sapiens
tgaagagctgtcttcccctgag

SEQ ID NO: 1056107 - DNA, 15 bp, Homo sapiens
tgaagagcttgcttt

SEQ ID NO: 1056108 - DNA, 17 bp, Homo sapiens
tgaagagcttgctttga

SEQ ID NO: 1056109 - DNA, 19 bp, Homo sapiens
tgaagagcttgctttgatt

SEQ ID NO: 1056110 - DNA, 13 bp, Homo sapiens
tgaagagcttgtg

SEQ ID NO: 1056111 - DNA, 13 bp, Homo sapiens
tgaagaggaaggg

SEQ ID NO: 1056112 - DNA, 17 bp, Homo sapiens
tgaagaggaggggaaga

SEQ ID NO: 1056113 - DNA, 18 bp, Homo sapiens
tgaagaggatcggaggct

SEQ ID NO: 1056114 - DNA, 18 bp, Homo sapiens
tgaagaggcgggccagcc

SEQ ID NO: 1056115 - DNA, 23 bp, Homo sapiens
tgaagaggggaggggcctaggga

SEQ ID NO: 1056116 - DNA, 14 bp, Homo sapiens
tgaagaggggcagc

SEQ ID NO: 1056117 - DNA, 19 bp, Homo sapiens
tgaagaggggcagcccttg

SEQ ID NO: 1056118 - DNA, 14 bp, Homo sapiens
tgaagagtcagaac

SEQ ID NO: 1056119 - DNA, 19 bp, Homo sapiens
tgaagagtgggtttcacaa

SEQ ID NO: 1056120 - DNA, 23 bp, Homo sapiens
tgaagataagtgtatttttcaat

SEQ ID NO: 1056121 - DNA, 20 bp, Homo sapiens
tgaagatatatttcactttt

SEQ ID NO: 1056122 - DNA, 16 bp, Homo sapiens
tgaagatcaatttctc

SEQ ID NO: 1056123 - DNA, 18 bp, Homo sapiens
tgaagatgcccctgctcc

SEQ ID NO: 1056124 - DNA, 19 bp, Homo sapiens
tgaagatgcccctgctccc

SEQ ID NO: 1056125 - DNA, 19 bp, Homo sapiens
tgaagatggcatcctgtga

SEQ ID NO: 1056126 - DNA, 13 bp, Homo sapiens
tgaagatggcttt

SEQ ID NO: 1056127 - DNA, 22 bp, Homo sapiens
tgaagatgtggatccctttaga

SEQ ID NO: 1056128 - DNA, 20 bp, Homo sapiens
tgaagattaggagaaacaca

SEQ ID NO: 1056129 - DNA, 18 bp, Homo sapiens
tgaagcaaatcagaaact

SEQ ID NO: 1056130 - DNA, 11 bp, Homo sapiens
tgaagcaataa

SEQ ID NO: 1056131 - DNA, 15 bp, Homo sapiens
tgaagcaataactcc

SEQ ID NO: 1056132 - DNA, 17 bp, Homo sapiens
tgaagcacttaagtctt

SEQ ID NO: 1056133 - DNA, 15 bp, Homo sapiens
tgaagcagcctctcc

SEQ ID NO: 1056134 - DNA, 19 bp, Homo sapiens
tgaagcagctttaaacaaa

SEQ ID NO: 1056135 - DNA, 12 bp, Homo sapiens
tgaagcaggagg

SEQ ID NO: 1056136 - DNA, 15 bp, Homo sapiens
tgaagcaggaggccc

SEQ ID NO: 1056137 - DNA, 17 bp, Homo sapiens
tgaagcagggtttcttt

SEQ ID NO: 1056138 - DNA, 13 bp, Homo sapiens
tgaagcagtcttg

SEQ ID NO: 1056139 - DNA, 17 bp, Homo sapiens
tgaagcagtcttgctct

SEQ ID NO: 1056140 - DNA, 20 bp, Homo sapiens
tgaagcagtcttgctctgtt

SEQ ID NO: 1056141 - DNA, 19 bp, Homo sapiens
tgaagcagtgcctcgaggc

SEQ ID NO: 1056142 - DNA, 14 bp, Homo sapiens
tgaagcagttgtgt

SEQ ID NO: 1056143 - DNA, 18 bp, Homo sapiens
tgaagcataaagttacct

SEQ ID NO: 1056144 - DNA, 12 bp, Homo sapiens
tgaagcataatt

SEQ ID NO: 1056145 - DNA, 19 bp, Homo sapiens
tgaagcataatttgtttaa

SEQ ID NO: 1056146 - DNA, 23 bp, Homo sapiens
tgaagcatgagttatctgatttt

SEQ ID NO: 1056147 - DNA, 14 bp, Homo sapiens
tgaagcatgtttca

SEQ ID NO: 1056148 - DNA, 16 bp, Homo sapiens
tgaagcatgtttcatg

SEQ ID NO: 1056149 - DNA, 19 bp, Homo sapiens
tgaagcatgtttcatgttt

SEQ ID NO: 1056150 - DNA, 18 bp, Homo sapiens
tgaagcattatggtctaa

SEQ ID NO: 1056151 - DNA, 22 bp, Homo sapiens
tgaagcatttcaaagccctgcc

SEQ ID NO: 1056152 - DNA, 16 bp, Homo sapiens
tgaagcattttctcag

SEQ ID NO: 1056153 - DNA, 22 bp, Homo sapiens
tgaagccaagtggggtgctggg

SEQ ID NO: 1056154 - DNA, 17 bp, Homo sapiens
tgaagccatgtagccac

SEQ ID NO: 1056155 - DNA, 21 bp, Homo sapiens
tgaagccatgtagccacccaa

SEQ ID NO: 1056156 - DNA, 16 bp, Homo sapiens
tgaagcccaagtgaaa

SEQ ID NO: 1056157 - DNA, 19 bp, Homo sapiens
tgaagcccaataaacctct

SEQ ID NO: 1056158 - DNA, 19 bp, Homo sapiens
tgaagcccaggctgatgct

SEQ ID NO: 1056159 - DNA, 16 bp, Homo sapiens
tgaagcccccctttgg

SEQ ID NO: 1056160 - DNA, 22 bp, Homo sapiens
tgaagccctccaaaagcactta

SEQ ID NO: 1056161 - DNA, 17 bp, Homo sapiens
tgaagccgactctggcc

SEQ ID NO: 1056162 - DNA, 19 bp, Homo sapiens
tgaagccgactctggccct

SEQ ID NO: 1056163 - DNA, 13 bp, Homo sapiens
tgaagcctctgcc

SEQ ID NO: 1056164 - DNA, 22 bp, Homo sapiens
tgaagcctgcgttggtccagag

SEQ ID NO: 1056165 - DNA, 23 bp, Homo sapiens
tgaagcctgcgttggtccagagc

SEQ ID NO: 1056166 - DNA, 17 bp, Homo sapiens
tgaagcctggattccag

SEQ ID NO: 1056167 - DNA, 22 bp, Homo sapiens
tgaagcctggattccagcagtg

SEQ ID NO: 1056168 - DNA, 14 bp, Homo sapiens
tgaagccttcttct

SEQ ID NO: 1056169 - DNA, 11 bp, Homo sapiens
tgaagcctttg

SEQ ID NO: 1056170 - DNA, 22 bp, Homo sapiens
tgaagcgcctcagttacacagg

SEQ ID NO: 1056171 - DNA, 21 bp, Homo sapiens
tgaagctaataaaattcgctt

SEQ ID NO: 1056172 - DNA, 23 bp, Homo sapiens
tctttgcaaagtattgtaaatta

SEQ ID NO: 1056173 - DNA, 15 bp, Homo sapiens
tctttgcacatgtga

SEQ ID NO: 1056174 - DNA, 16 bp, Homo sapiens
tctttgcaccaaagac

SEQ ID NO: 1056175 - DNA, 18 bp, Homo sapiens
tctttgcaccaaagacat

SEQ ID NO: 1056176 - DNA, 18 bp, Homo sapiens
tctttgcaccaaagatgt

SEQ ID NO: 1056177 - DNA, 22 bp, Homo sapiens
tctttgcaggaggcccaacctc

SEQ ID NO: 1056178 - DNA, 21 bp, Homo sapiens
tctttgccagtcattcagcag

SEQ ID NO: 1056179 - DNA, 21 bp, Homo sapiens
tctttgccttgggctgctcct

SEQ ID NO: 1056180 - DNA, 13 bp, Homo sapiens
tctttgctccaga

SEQ ID NO: 1056181 - DNA, 12 bp, Homo sapiens
tctttgctgcag

SEQ ID NO: 1056182 - DNA, 22 bp, Homo sapiens
tctttgctgcagtcatctactt

SEQ ID NO: 1056183 - DNA, 23 bp, Homo sapiens
tctttgctttgctttctgctcag

SEQ ID NO: 1056184 - DNA, 24 bp, Homo sapiens
tctttggaaggagtgagatcattt

SEQ ID NO: 1056185 - DNA, 20 bp, Homo sapiens
tctttggaatgaaattcctc

SEQ ID NO: 1056186 - DNA, 21 bp, Homo sapiens
tctttggaatgaaattcctcc

SEQ ID NO: 1056187 - DNA, 14 bp, Homo sapiens
tctttggagttaaa

SEQ ID NO: 1056188 - DNA, 21 bp, Homo sapiens
tctttggataataggaattca

SEQ ID NO: 1056189 - DNA, 19 bp, Homo sapiens
tctttggcctacattcttt

SEQ ID NO: 1056190 - DNA, 14 bp, Homo sapiens
tctttggctcccct

SEQ ID NO: 1056191 - DNA, 22 bp, Homo sapiens
tctttggctcccctgtaccttt

SEQ ID NO: 1056192 - DNA, 22 bp, Homo sapiens
tctttgggcctctcctgccctc

SEQ ID NO: 1056193 - DNA, 17 bp, Homo sapiens
tctttgggggtggaaaa

SEQ ID NO: 1056194 - DNA, 21 bp, Homo sapiens
tctttgggtgggggggagaag

SEQ ID NO: 1056195 - DNA, 23 bp, Homo sapiens
tctttgtaaatatcggatgggtg

SEQ ID NO: 1056196 - DNA, 14 bp, Homo sapiens
tctttgtaataaaa

SEQ ID NO: 1056197 - DNA, 23 bp, Homo sapiens
tctttgtaatgtcaccaccttcc

SEQ ID NO: 1056198 - DNA, 20 bp, Homo sapiens
tctttgtagaataaatggtt

SEQ ID NO: 1056199 - DNA, 14 bp, Homo sapiens
tctttgtataaata

SEQ ID NO: 1056200 - DNA, 19 bp, Homo sapiens
tctttgtataaataaatat

SEQ ID NO: 1056201 - DNA, 18 bp, Homo sapiens
tctttgtctgccttccca

SEQ ID NO: 1056202 - DNA, 17 bp, Homo sapiens
tctttgtctttttccta

SEQ ID NO: 1056203 - DNA, 22 bp, Homo sapiens
tctttgtgacaggaaagccctc

SEQ ID NO: 1056204 - DNA, 21 bp, Homo sapiens
tctttgtgataattctcagta

SEQ ID NO: 1056205 - DNA, 14 bp, Homo sapiens
tctttgtggccaag

SEQ ID NO: 1056206 - DNA, 21 bp, Homo sapiens
tctttgtgggttggccaggag

SEQ ID NO: 1056207 - DNA, 22 bp, Homo sapiens
tctttgtgggttggccaggagg

SEQ ID NO: 1056208 - DNA, 15 bp, Homo sapiens
tctttgtgtagcttt

SEQ ID NO: 1056209 - DNA, 13 bp, Homo sapiens
tctttgtgtatgg

SEQ ID NO: 1056210 - DNA, 16 bp, Homo sapiens
tctttgtgtgttatat

SEQ ID NO: 1056211 - DNA, 12 bp, Homo sapiens
tctttgtgtttt

SEQ ID NO: 1056212 - DNA, 18 bp, Homo sapiens
tctttgtgttttagggtg

SEQ ID NO: 1056213 - DNA, 16 bp, Homo sapiens
tctttgttcaagatga

SEQ ID NO: 1056214 - DNA, 23 bp, Homo sapiens
tctttgttcatagcccagtagac

SEQ ID NO: 1056215 - DNA, 22 bp, Homo sapiens
tctttgttctgttttgtgagaa

SEQ ID NO: 1056216 - DNA, 18 bp, Homo sapiens
tctttgttggaaaagaat

SEQ ID NO: 1056217 - DNA, 16 bp, Homo sapiens
tctttgtttaaatgcc

SEQ ID NO: 1056218 - DNA, 19 bp, Homo sapiens
tcttttaaaaattcaaatg

SEQ ID NO: 1056219 - DNA, 18 bp, Homo sapiens
tcttttaaaatatcctgt

SEQ ID NO: 1056220 - DNA, 12 bp, Homo sapiens
tcttttaaacat

SEQ ID NO: 1056221 - DNA, 14 bp, Homo sapiens
tcttttaagaatca

SEQ ID NO: 1056222 - DNA, 17 bp, Homo sapiens
tcttttaagcatttgta

SEQ ID NO: 1056223 - DNA, 18 bp, Homo sapiens
tcttttaagcatttgtat

SEQ ID NO: 1056224 - DNA, 19 bp, Homo sapiens
tcttttaagcatttgtata

SEQ ID NO: 1056225 - DNA, 21 bp, Homo sapiens
tcttttaagcatttgtatatt

SEQ ID NO: 1056226 - DNA, 21 bp, Homo sapiens
tcttttaatgaggaccaatgt

SEQ ID NO: 1056227 - DNA, 14 bp, Homo sapiens
tcttttacattctg

SEQ ID NO: 1056228 - DNA, 13 bp, Homo sapiens
tcttttaccctgt

SEQ ID NO: 1056229 - DNA, 17 bp, Homo sapiens
tcttttaccctgtgtca

SEQ ID NO: 1056230 - DNA, 17 bp, Homo sapiens
tcttttagctgatgaac

SEQ ID NO: 1056231 - DNA, 14 bp, Homo sapiens
tgaagctgctgtgt

SEQ ID NO: 1056232 - DNA, 16 bp, Homo sapiens
tgaagctggagcagcg

SEQ ID NO: 1056233 - DNA, 18 bp, Homo sapiens
tgaagctggcctggacca

SEQ ID NO: 1056234 - DNA, 12 bp, Homo sapiens
tgaagctgggct

SEQ ID NO: 1056235 - DNA, 15 bp, Homo sapiens
tgaagctgggctctt

SEQ ID NO: 1056236 - DNA, 14 bp, Homo sapiens
tgaagcttcatgca

SEQ ID NO: 1056237 - DNA, 21 bp, Homo sapiens
tgaagcttcatgcacttaaag

SEQ ID NO: 1056238 - DNA, 13 bp, Homo sapiens
tgaagctttacca

SEQ ID NO: 1056239 - DNA, 23 bp, Homo sapiens
tgaagctttatttgcatatttat

SEQ ID NO: 1056240 - DNA, 12 bp, Homo sapiens
tgaaggaaacag

SEQ ID NO: 1056241 - DNA, 14 bp, Homo sapiens
tgaaggaaacagtt

SEQ ID NO: 1056242 - DNA, 12 bp, Homo sapiens
tgaaggaaacat

SEQ ID NO: 1056243 - DNA, 20 bp, Homo sapiens
tgaaggaaatgagtggccag

SEQ ID NO: 1056244 - DNA, 21 bp, Homo sapiens
tgaaggaaatgagtggccagc

SEQ ID NO: 1056245 - DNA, 19 bp, Homo sapiens
tgaaggaacattccttagt

SEQ ID NO: 1056246 - DNA, 20 bp, Homo sapiens
tgaaggaacttgtctcttca

SEQ ID NO: 1056247 - DNA, 17 bp, Homo sapiens
tgaaggaatagccagag

SEQ ID NO: 1056248 - DNA, 13 bp, Homo sapiens
tgaaggaatatat

SEQ ID NO: 1056249 - DNA, 22 bp, Homo sapiens
tgaaggaatatatggcagagtt

SEQ ID NO: 1056250 - DNA, 19 bp, Homo sapiens
tgaaggaatcattccagtg

SEQ ID NO: 1056251 - DNA, 10 bp, Homo sapiens
tgaaggaatt

SEQ ID NO: 1056252 - DNA, 20 bp, Homo sapiens
tgaaggaatttgattgcttt

SEQ ID NO: 1056253 - DNA, 22 bp, Homo sapiens
tgaaggaatttgattgctttgc

SEQ ID NO: 1056254 - DNA, 20 bp, Homo sapiens
tgaaggacacttcctgccta

SEQ ID NO: 1056255 - DNA, 17 bp, Homo sapiens
tgaaggaggtgagggat

SEQ ID NO: 1056256 - DNA, 15 bp, Homo sapiens
tgaaggatgccaaga

SEQ ID NO: 1056257 - DNA, 16 bp, Homo sapiens
tgaaggcaaaattgca

SEQ ID NO: 1056258 - DNA, 18 bp, Homo sapiens
tgaaggcaaaattgcaaa

SEQ ID NO: 1056259 - DNA, 16 bp, Homo sapiens
tgaaggcagtctgaac

SEQ ID NO: 1056260 - DNA, 22 bp, Homo sapiens
tgaaggcccaagagcagagtct

SEQ ID NO: 1056261 - DNA, 13 bp, Homo sapiens
tgaaggcttctct

SEQ ID NO: 1056262 - DNA, 20 bp, Homo sapiens
tgaaggcttttggtctccct

SEQ ID NO: 1056263 - DNA, 13 bp, Homo sapiens
tgaagggaaagat

SEQ ID NO: 1056264 - DNA, 19 bp, Homo sapiens
tgaagggaactagaggtgt

SEQ ID NO: 1056265 - DNA, 16 bp, Homo sapiens
tgaagggagagccagc

SEQ ID NO: 1056266 - DNA, 22 bp, Homo sapiens
tgaaggggccaaggagggtgag

SEQ ID NO: 1056267 - DNA, 22 bp, Homo sapiens
tgaaggggctcttcatctgcct

SEQ ID NO: 1056268 - DNA, 16 bp, Homo sapiens
tgaagggggacactcc

SEQ ID NO: 1056269 - DNA, 20 bp, Homo sapiens
tgaaggggtgcacccacctg

SEQ ID NO: 1056270 - DNA, 15 bp, Homo sapiens
tgaagggttttgtgt

SEQ ID NO: 1056271 - DNA, 23 bp, Homo sapiens
tgaaggtagcattctttggagtt

SEQ ID NO: 1056272 - DNA, 20 bp, Homo sapiens
tgaaggtattggcctgttca

SEQ ID NO: 1056273 - DNA, 22 bp, Homo sapiens
tgaaggtcactcttcctgcaag

SEQ ID NO: 1056274 - DNA, 23 bp, Homo sapiens
tgaaggtctgtcataggactctg

SEQ ID NO: 1056275 - DNA, 18 bp, Homo sapiens
tgaaggtgataagggaaa

SEQ ID NO: 1056276 - DNA, 18 bp, Homo sapiens
tgaaggtgccattttaaa

SEQ ID NO: 1056277 - DNA, 13 bp, Homo sapiens
tgaaggtgggaaa

SEQ ID NO: 1056278 - DNA, 21 bp, Homo sapiens
tgaaggttttttttttaagtg

SEQ ID NO: 1056279 - DNA, 15 bp, Homo sapiens
tgaagtaaaagcaag

SEQ ID NO: 1056280 - DNA, 22 bp, Homo sapiens
tgaagtaaactttttgttctgg

SEQ ID NO: 1056281 - DNA, 21 bp, Homo sapiens
tgaagtaaattaaacattttt

SEQ ID NO: 1056282 - DNA, 18 bp, Homo sapiens
tgaagtaaattatgtaac

SEQ ID NO: 1056283 - DNA, 19 bp, Homo sapiens
tgaagtaactgtggaggga

SEQ ID NO: 1056284 - DNA, 20 bp, Homo sapiens
tgaagtaatatgcacacatt

SEQ ID NO: 1056285 - DNA, 13 bp, Homo sapiens
tgaagtacatatt

SEQ ID NO: 1056286 - DNA, 14 bp, Homo sapiens
tgaagtataaatct

SEQ ID NO: 1056287 - DNA, 14 bp, Homo sapiens
tgaagtatactttt

SEQ ID NO: 1056288 - DNA, 14 bp, Homo sapiens
tgaagtatattctt

SEQ ID NO: 1056289 - DNA, 21 bp, Homo sapiens
tgaagtatattcttattggaa

SEQ ID NO: 1056290 - DNA, 23 bp, Homo sapiens
tgaagtatattcttattggaaat

SEQ ID NO: 1056291 - DNA, 15 bp, Homo sapiens
tgaagtattaagcct

SEQ ID NO: 1056292 - DNA, 12 bp, Homo sapiens
tgaagtcaaatg

SEQ ID NO: 1056293 - DNA, 19 bp, Homo sapiens
tgaagtcaaatgtcacata

SEQ ID NO: 1056294 - DNA, 16 bp, Homo sapiens
tgaagtcactgcacag

SEQ ID NO: 1056295 - DNA, 19 bp, Homo sapiens
tgaagtcagccacactggg

SEQ ID NO: 1056296 - DNA, 22 bp, Homo sapiens
tgaagtcagccacactgggcct

SEQ ID NO: 1056297 - DNA, 20 bp, Homo sapiens
tgaagtccaaattgtttgta

SEQ ID NO: 1056298 - DNA, 22 bp, Homo sapiens
tgaagtcgagcactctaattag

SEQ ID NO: 1056299 - DNA, 18 bp, Homo sapiens
tgaagtgagcacagccta

SEQ ID NO: 1056300 - DNA, 16 bp, Homo sapiens
tgaagtgcgtgaatgt

SEQ ID NO: 1056301 - DNA, 13 bp, Homo sapiens
tgaagtgcttgga

SEQ ID NO: 1056302 - DNA, 13 bp, Homo sapiens
tgaagtggccctc

SEQ ID NO: 1056303 - DNA, 18 bp, Homo sapiens
tgaagtggccctccctca

SEQ ID NO: 1056304 - DNA, 19 bp, Homo sapiens
tgaagtggctggtagaaaa

SEQ ID NO: 1056305 - DNA, 18 bp, Homo sapiens
tgaagtggttgcattcta

SEQ ID NO: 1056306 - DNA, 16 bp, Homo sapiens
tgaagtgtacctgtgt

SEQ ID NO: 1056307 - DNA, 16 bp, Homo sapiens
tgaagtgtaggcagac

SEQ ID NO: 1056308 - DNA, 15 bp, Homo sapiens
tgaagtgtcttctgt

SEQ ID NO: 1056309 - DNA, 16 bp, Homo sapiens
tgaagtgtcttctgtt

SEQ ID NO: 1056310 - DNA, 16 bp, Homo sapiens
tgaagtgtggctggtg

SEQ ID NO: 1056311 - DNA, 19 bp, Homo sapiens
tgaagtgtggctggtgtcc

SEQ ID NO: 1056312 - DNA, 20 bp, Homo sapiens
tgaagtgttttgttctttct

SEQ ID NO: 1056313 - DNA, 20 bp, Homo sapiens
tgaagttacacaattaattg

SEQ ID NO: 1056314 - DNA, 18 bp, Homo sapiens
tgaagttagctttaactt

SEQ ID NO: 1056315 - DNA, 23 bp, Homo sapiens
tgaagttagctttaacttaaata

SEQ ID NO: 1056316 - DNA, 20 bp, Homo sapiens
tgaagttcatggtgatcagt

SEQ ID NO: 1056317 - DNA, 13 bp, Homo sapiens
tgaagttctgagc

SEQ ID NO: 1056318 - DNA, 14 bp, Homo sapiens
tgaagttgctgttt

SEQ ID NO: 1056319 - DNA, 16 bp, Homo sapiens
tgaagttgctgtttat

SEQ ID NO: 1056320 - DNA, 18 bp, Homo sapiens
tgaagttggcacatttca

SEQ ID NO: 1056321 - DNA, 24 bp, Homo sapiens
tgaagttggccaccttgcttgagg

SEQ ID NO: 1056322 - DNA, 18 bp, Homo sapiens
tgaagttgggtgtttcca

SEQ ID NO: 1056323 - DNA, 20 bp, Homo sapiens
tgaagttgggtgtttccaga

SEQ ID NO: 1056324 - DNA, 15 bp, Homo sapiens
tgaagttgttactaa

SEQ ID NO: 1056325 - DNA, 22 bp, Homo sapiens
tgaagttgttactaactaaact

SEQ ID NO: 1056326 - DNA, 14 bp, Homo sapiens
tgaagtttaaattc

SEQ ID NO: 1056327 - DNA, 17 bp, Homo sapiens
tgaagtttacaatcaaa

SEQ ID NO: 1056328 - DNA, 21 bp, Homo sapiens
tgaagtttcaagttttaaagt

SEQ ID NO: 1056329 - DNA, 22 bp, Homo sapiens
tgaagtttcaagttttaaagtt

SEQ ID NO: 1056330 - DNA, 18 bp, Homo sapiens
tgaagtttgaacttcata

SEQ ID NO: 1056331 - DNA, 17 bp, Homo sapiens
tgaagttttgatttatt

SEQ ID NO: 1056332 - DNA, 19 bp, Homo sapiens
tgaagttttggagagggaa

SEQ ID NO: 1056333 - DNA, 17 bp, Homo sapiens
tgaataaaaaagattct

SEQ ID NO: 1056334 - DNA, 20 bp, Homo sapiens
tgaataaaaaagattctact

SEQ ID NO: 1056335 - DNA, 23 bp, Homo sapiens
tgaataaaaaagattctactaac

SEQ ID NO: 1056336 - DNA, 14 bp, Homo sapiens
tgaataaaaaccct

SEQ ID NO: 1056337 - DNA, 14 bp, Homo sapiens
tgaataaaaagtga

SEQ ID NO: 1056338 - DNA, 19 bp, Homo sapiens
tgaataaaaatatgtacaa

SEQ ID NO: 1056339 - DNA, 15 bp, Homo sapiens
tgaataaaaatgcac

SEQ ID NO: 1056340 - DNA, 15 bp, Homo sapiens
tgaataaaaggctgg

SEQ ID NO: 1056341 - DNA, 16 bp, Homo sapiens
tgaataaaaggctgga

SEQ ID NO: 1056342 - DNA, 16 bp, Homo sapiens
tgaataaaagtgcaca

SEQ ID NO: 1056343 - DNA, 22 bp, Homo sapiens
tgaataaaccagtatcgttact

SEQ ID NO: 1056344 - DNA, 12 bp, Homo sapiens
tgaataaactga

SEQ ID NO: 1056345 - DNA, 16 bp, Homo sapiens
tgaataaagacaccta

SEQ ID NO: 1056346 - DNA, 17 bp, Homo sapiens
tgaataaagtgtaacaa

SEQ ID NO: 1056347 - DNA, 13 bp, Homo sapiens
tgaataaatacct

SEQ ID NO: 1056348 - DNA, 23 bp, Homo sapiens
tgaataaatacctcttagctgag

SEQ ID NO: 1056349 - DNA, 13 bp, Homo sapiens
tgaataaatgtct

SEQ ID NO: 1056350 - DNA, 15 bp, Homo sapiens
tgaataaattcagta

SEQ ID NO: 1056351 - DNA, 15 bp, Homo sapiens
tgaataaattttcaa

SEQ ID NO: 1056352 - DNA, 21 bp, Homo sapiens
tgaataaattttcaaatcctt

SEQ ID NO: 1056353 - DNA, 18 bp, Homo sapiens
tgaataacatttaaattc

SEQ ID NO: 1056354 - DNA, 15 bp, Homo sapiens
tgaataaccacttaa

SEQ ID NO: 1056355 - DNA, 21 bp, Homo sapiens
tgaatggtgttgtatgccttt

SEQ ID NO: 1056356 - DNA, 23 bp, Homo sapiens
tgaatggttccatgcctgagggt

SEQ ID NO: 1056357 - DNA, 14 bp, Homo sapiens
tgaatgtactatgt

SEQ ID NO: 1056358 - DNA, 19 bp, Homo sapiens
tgaatgtactatgtctgaa

SEQ ID NO: 1056359 - DNA, 15 bp, Homo sapiens
tgaatgtagcttcca

SEQ ID NO: 1056360 - DNA, 23 bp, Homo sapiens
tgaatgtaggctggctttcagag

SEQ ID NO: 1056361 - DNA, 16 bp, Homo sapiens
tgaatgtatcaggaaa

SEQ ID NO: 1056362 - DNA, 20 bp, Homo sapiens
tgaatgtatgtaatgtgtgg

SEQ ID NO: 1056363 - DNA, 15 bp, Homo sapiens
tgaatgtatttattt

SEQ ID NO: 1056364 - DNA, 20 bp, Homo sapiens
tgaatgtatttgatttataa

SEQ ID NO: 1056365 - DNA, 19 bp, Homo sapiens
tgaatgtattttggttgct

SEQ ID NO: 1056366 - DNA, 14 bp, Homo sapiens
tgaatgtcacaaat

SEQ ID NO: 1056367 - DNA, 15 bp, Homo sapiens
tgaatgtcacatttg

SEQ ID NO: 1056368 - DNA, 20 bp, Homo sapiens
tgaatgtcacatttgaattc

SEQ ID NO: 1056369 - DNA, 22 bp, Homo sapiens
tgaatgtcacatttgaattctt

SEQ ID NO: 1056370 - DNA, 22 bp, Homo sapiens
tgaatgtcttttttcaaacttt

SEQ ID NO: 1056371 - DNA, 17 bp, Homo sapiens
tgaatgtgctggtgaac

SEQ ID NO: 1056372 - DNA, 21 bp, Homo sapiens
tgaatgtgggcactggcccag

SEQ ID NO: 1056373 - DNA, 18 bp, Homo sapiens
tgaatgtgtctggacctc

SEQ ID NO: 1056374 - DNA, 20 bp, Homo sapiens
tgaatgttgcaatgtgaaaa

SEQ ID NO: 1056375 - DNA, 21 bp, Homo sapiens
tgaatgttgtctgtttgttct

SEQ ID NO: 1056376 - DNA, 19 bp, Homo sapiens
tgaatgtttattccttgat

SEQ ID NO: 1056377 - DNA, 21 bp, Homo sapiens
tgaatgtttccaacctggagt

SEQ ID NO: 1056378 - DNA, 20 bp, Homo sapiens
tgaatgttttatttatcaaa

SEQ ID NO: 1056379 - DNA, 14 bp, Homo sapiens
tgaattaaaatggt

SEQ ID NO: 1056380 - DNA, 13 bp, Homo sapiens
tgaattaaacatg

SEQ ID NO: 1056381 - DNA, 11 bp, Homo sapiens
tgaattaaatt

SEQ ID NO: 1056382 - DNA, 15 bp, Homo sapiens
tgaattaaatttaat

SEQ ID NO: 1056383 - DNA, 18 bp, Homo sapiens
tgaattaacacagtgttt

SEQ ID NO: 1056384 - DNA, 16 bp, Homo sapiens
tgacacaaagcttcta

SEQ ID NO: 1056385 - DNA, 22 bp, Homo sapiens
tgacacaactgtgtgattaaaa

SEQ ID NO: 1056386 - DNA, 17 bp, Homo sapiens
tgacacaagtggacctt

SEQ ID NO: 1056387 - DNA, 19 bp, Homo sapiens
tgacacacactgtctgggg

SEQ ID NO: 1056388 - DNA, 19 bp, Homo sapiens
tgacacacgtatttatatt

SEQ ID NO: 1056389 - DNA, 23 bp, Homo sapiens
tgacacacgtatttatatttgga

SEQ ID NO: 1056390 - DNA, 12 bp, Homo sapiens
tgacacactaac

SEQ ID NO: 1056391 - DNA, 20 bp, Homo sapiens
tgacacactaaccaagctga

SEQ ID NO: 1056392 - DNA, 18 bp, Homo sapiens
tgacacagaaaatgttga

SEQ ID NO: 1056393 - DNA, 23 bp, Homo sapiens
tgacacagaaaatgttgagaatc

SEQ ID NO: 1056394 - DNA, 12 bp, Homo sapiens
tgacacaggtca

SEQ ID NO: 1056395 - DNA, 15 bp, Homo sapiens
tgacacaggtcaggg

SEQ ID NO: 1056396 - DNA, 16 bp, Homo sapiens
tgacacaggtcagggc

SEQ ID NO: 1056397 - DNA, 19 bp, Homo sapiens
tgacacaggtcagggctca

SEQ ID NO: 1056398 - DNA, 18 bp, Homo sapiens
tgacacaggtctttccta

SEQ ID NO: 1056399 - DNA, 20 bp, Homo sapiens
tgacacatgcaaggtcattt

SEQ ID NO: 1056400 - DNA, 22 bp, Homo sapiens
tgacacatggcccctccccctg

SEQ ID NO: 1056401 - DNA, 16 bp, Homo sapiens
tgacacattaatgaat

SEQ ID NO: 1056402 - DNA, 17 bp, Homo sapiens
tgacacattaatgataa

SEQ ID NO: 1056403 - DNA, 18 bp, Homo sapiens
tgacaccaataaatgttt

SEQ ID NO: 1056404 - DNA, 23 bp, Homo sapiens
tgacaccaataaatgtttgttat

SEQ ID NO: 1056405 - DNA, 13 bp, Homo sapiens
tgacacccagacc

SEQ ID NO: 1056406 - DNA, 14 bp, Homo sapiens
tgacacccagacct

SEQ ID NO: 1056407 - DNA, 22 bp, Homo sapiens
tgacaccccctccccgcccctg

SEQ ID NO: 1056408 - DNA, 18 bp, Homo sapiens
tgacaccgtccctcagtg

SEQ ID NO: 1056409 - DNA, 19 bp, Homo sapiens
tgacaccgtccctcagtga

SEQ ID NO: 1056410 - DNA, 17 bp, Homo sapiens
tgacacctaccatgctg

SEQ ID NO: 1056411 - DNA, 18 bp, Homo sapiens
tgacacctaccatgctgc

SEQ ID NO: 1056412 - DNA, 12 bp, Homo sapiens
tgacacgcttca

SEQ ID NO: 1056413 - DNA, 17 bp, Homo sapiens
tgacactaaaacaagag

SEQ ID NO: 1056414 - DNA, 17 bp, Homo sapiens
tgacactaagaaaatag

SEQ ID NO: 1056415 - DNA, 15 bp, Homo sapiens
tgacactagaaaact

SEQ ID NO: 1056416 - DNA, 18 bp, Homo sapiens
tgacactagcccaatgaa

SEQ ID NO: 1056417 - DNA, 22 bp, Homo sapiens
tgacactctagtgacttcctgg

SEQ ID NO: 1056418 - DNA, 12 bp, Homo sapiens
tgacactctcgt

SEQ ID NO: 1056419 - DNA, 19 bp, Homo sapiens
tgacactgaaagttttgta

SEQ ID NO: 1056420 - DNA, 20 bp, Homo sapiens
tgacactgaaagttttgtaa

SEQ ID NO: 1056421 - DNA, 22 bp, Homo sapiens
tgacactgaaagttttgtaaaa

SEQ ID NO: 1056422 - DNA, 15 bp, Homo sapiens
tgacactgctctaac

SEQ ID NO: 1056423 - DNA, 21 bp, Homo sapiens
tgacactgctctaacagccct

SEQ ID NO: 1056424 - DNA, 13 bp, Homo sapiens
tgacactgttttc

SEQ ID NO: 1056425 - DNA, 17 bp, Homo sapiens
tgacacttcagagagct

SEQ ID NO: 1056426 - DNA, 18 bp, Homo sapiens
tgacacttcagagagctg

SEQ ID NO: 1056427 - DNA, 19 bp, Homo sapiens
tgacacttcagagagctgg

SEQ ID NO: 1056428 - DNA, 22 bp, Homo sapiens
tgacacttgattgtctcctaat

SEQ ID NO: 1056429 - DNA, 20 bp, Homo sapiens
tgacactttgccagaaagca

SEQ ID NO: 1056430 - DNA, 18 bp, Homo sapiens
tgacagaaccgagaaggg

SEQ ID NO: 1056431 - DNA, 17 bp, Homo sapiens
tgacagaaggtgccact

SEQ ID NO: 1056432 - DNA, 14 bp, Homo sapiens
tgacagactcctga

SEQ ID NO: 1056433 - DNA, 15 bp, Homo sapiens
tgacagactcctgag

SEQ ID NO: 1056434 - DNA, 22 bp, Homo sapiens
tgacagactttggacagtggcc

SEQ ID NO: 1056435 - DNA, 22 bp, Homo sapiens
tgacagagcaagtgagaccctg

SEQ ID NO: 1056436 - DNA, 13 bp, Homo sapiens
tgacagaggctgc

SEQ ID NO: 1056437 - DNA, 20 bp, Homo sapiens
tgacagaggctgcacccctg

SEQ ID NO: 1056438 - DNA, 21 bp, Homo sapiens
tgacagatcaagctgtgagac

SEQ ID NO: 1056439 - DNA, 23 bp, Homo sapiens
tgacagatgcaagttattttatt

SEQ ID NO: 1056440 - DNA, 19 bp, Homo sapiens
tgacagatggtgaagtaac

SEQ ID NO: 1056441 - DNA, 19 bp, Homo sapiens
tgacagatgttgaatgccc

SEQ ID NO: 1056442 - DNA, 14 bp, Homo sapiens
tgacagcaaaatgt

SEQ ID NO: 1056443 - DNA, 17 bp, Homo sapiens
tgacagcagcctgtgag

SEQ ID NO: 1056444 - DNA, 21 bp, Homo sapiens
tgacagcagcctgtgagggag

SEQ ID NO: 1056445 - DNA, 23 bp, Homo sapiens
tgacagcagcctgtgagggagtg

SEQ ID NO: 1056446 - DNA, 21 bp, Homo sapiens
tgacagcaggccactagtgac

SEQ ID NO: 1056447 - DNA, 22 bp, Homo sapiens
tgacagcaggccactagtgaca

SEQ ID NO: 1056448 - DNA, 18 bp, Homo sapiens
tgacagcatgtgccctcc

SEQ ID NO: 1056449 - DNA, 23 bp, Homo sapiens
tgacagcccaacttccagaggac

SEQ ID NO: 1056450 - DNA, 17 bp, Homo sapiens
tgacagcctcccacccc

SEQ ID NO: 1056451 - DNA, 20 bp, Homo sapiens
tgacagccttccccagctcc

SEQ ID NO: 1056452 - DNA, 14 bp, Homo sapiens
tgacagccttgccc

SEQ ID NO: 1056453 - DNA, 14 bp, Homo sapiens
tgacagccttgggc

SEQ ID NO: 1056454 - DNA, 20 bp, Homo sapiens
tgacagccttgggcctttca

SEQ ID NO: 1056455 - DNA, 15 bp, Homo sapiens
tgacagcgatggcag

SEQ ID NO: 1056456 - DNA, 17 bp, Homo sapiens
tgacagcgatggcaggc

SEQ ID NO: 1056457 - DNA, 21 bp, Homo sapiens
tgacagcgatggcaggcctga

SEQ ID NO: 1056458 - DNA, 23 bp, Homo sapiens
tgacagcgatggcaggcctgacc

SEQ ID NO: 1056459 - DNA, 12 bp, Homo sapiens
tgacagctgctc

SEQ ID NO: 1056460 - DNA, 13 bp, Homo sapiens
tgacagctgctcc

SEQ ID NO: 1056461 - DNA, 22 bp, Homo sapiens
tgacagctgctcctagagggag

SEQ ID NO: 1056462 - DNA, 23 bp, Homo sapiens
tgacagctgctcctagagggagg

SEQ ID NO: 1056463 - DNA, 16 bp, Homo sapiens
tgacagctgtccctgt

SEQ ID NO: 1056464 - DNA, 20 bp, Homo sapiens
tgacagctgtccctgtcacc

SEQ ID NO: 1056465 - DNA, 16 bp, Homo sapiens
tgacagctgtgctgta

SEQ ID NO: 1056466 - DNA, 20 bp, Homo sapiens
tgacagctttctgggatgtc

SEQ ID NO: 1056467 - DNA, 23 bp, Homo sapiens
tgacagctttctgggatgtcaca

SEQ ID NO: 1056468 - DNA, 13 bp, Homo sapiens
tgacagctttgct

SEQ ID NO: 1056469 - DNA, 17 bp, Homo sapiens
tgacagctttgctgctg

SEQ ID NO: 1056470 - DNA, 18 bp, Homo sapiens
tgacagctttgctgctga

SEQ ID NO: 1056471 - DNA, 18 bp, Homo sapiens
tgacaggaaagccctccc

SEQ ID NO: 1056472 - DNA, 19 bp, Homo sapiens
tgacaggaaagccctcccc

SEQ ID NO: 1056473 - DNA, 16 bp, Homo sapiens
tgacaggacgctgacc

SEQ ID NO: 1056474 - DNA, 20 bp, Homo sapiens
tgacaggcagcctggacata

SEQ ID NO: 1056475 - DNA, 15 bp, Homo sapiens
tgacaggcccagtgg

SEQ ID NO: 1056476 - DNA, 22 bp, Homo sapiens
tgacagggacatgccctgtgtg

SEQ ID NO: 1056477 - DNA, 12 bp, Homo sapiens
tgacagggcaga

SEQ ID NO: 1056478 - DNA, 11 bp, Homo sapiens
tgacagtggct

SEQ ID NO: 1056479 - DNA, 14 bp, Homo sapiens
tgacagtggtgggc

SEQ ID NO: 1056480 - DNA, 14 bp, Homo sapiens
tgacagtgttttta

SEQ ID NO: 1056481 - DNA, 20 bp, Homo sapiens
tgacagtttcttttgtgttc

SEQ ID NO: 1056482 - DNA, 23 bp, Homo sapiens
tgacagtttcttttgtgttccta

SEQ ID NO: 1056483 - DNA, 14 bp, Homo sapiens
tgacataaagttga

SEQ ID NO: 1056484 - DNA, 21 bp, Homo sapiens
tgacatacgcttttaatgaaa

SEQ ID NO: 1056485 - DNA, 18 bp, Homo sapiens
tgacatagagaaaaggct

SEQ ID NO: 1056486 - DNA, 13 bp, Homo sapiens
tgacatagcctca

SEQ ID NO: 1056487 - DNA, 14 bp, Homo sapiens
tgacatagcctcat

SEQ ID NO: 1056488 - DNA, 20 bp, Homo sapiens
tgacataggccaaggcccaa

SEQ ID NO: 1056489 - DNA, 13 bp, Homo sapiens
tgacatattcaag

SEQ ID NO: 1056490 - DNA, 15 bp, Homo sapiens
tgacatattcaagtg

SEQ ID NO: 1056491 - DNA, 13 bp, Homo sapiens
tgacatatttaat

SEQ ID NO: 1056492 - DNA, 14 bp, Homo sapiens
tgacatatttaatg

SEQ ID NO: 1056493 - DNA, 15 bp, Homo sapiens
tgacatatttaatgt

SEQ ID NO: 1056494 - DNA, 20 bp, Homo sapiens
tgacatatttaatgttttaa

SEQ ID NO: 1056495 - DNA, 18 bp, Homo sapiens
tgacatcacttgtacaaa

SEQ ID NO: 1056496 - DNA, 20 bp, Homo sapiens
tgacatcacttgtacaaaat

SEQ ID NO: 1056497 - DNA, 17 bp, Homo sapiens
tgacatcagattgttaa

SEQ ID NO: 1056498 - DNA, 14 bp, Homo sapiens
tgacatcagcctgc

SEQ ID NO: 1056499 - DNA, 12 bp, Homo sapiens
tgacatccaaat

SEQ ID NO: 1056500 - DNA, 17 bp, Homo sapiens
tgacatccagaaagctg

SEQ ID NO: 1056501 - DNA, 18 bp, Homo sapiens
tgacatccagagatgact

SEQ ID NO: 1056502 - DNA, 18 bp, Homo sapiens
tgacatcccttcctggaa

SEQ ID NO: 1056503 - DNA, 19 bp, Homo sapiens
tgacatcccttcctggaaa

SEQ ID NO: 1056504 - DNA, 21 bp, Homo sapiens
tgacatcccttcctggaaaca

SEQ ID NO: 1056505 - DNA, 23 bp, Homo sapiens
tgacatcccttcctggaaacagc

SEQ ID NO: 1056506 - DNA, 18 bp, Homo sapiens
tgacatctcaggggccag

SEQ ID NO: 1056507 - DNA, 19 bp, Homo sapiens
tgacatctcaggggccaga

SEQ ID NO: 1056508 - DNA, 21 bp, Homo sapiens
tgacatctcaggggccagagg

SEQ ID NO: 1056509 - DNA, 14 bp, Homo sapiens
tgacatctggaatc

SEQ ID NO: 1056510 - DNA, 16 bp, Homo sapiens
tgacatcttcaaagct

SEQ ID NO: 1056511 - DNA, 13 bp, Homo sapiens
tgacatgaagcat

SEQ ID NO: 1056512 - DNA, 15 bp, Homo sapiens
tgacatgaccctctg

SEQ ID NO: 1056513 - DNA, 16 bp, Homo sapiens
tgacatgatatacaat

SEQ ID NO: 1056514 - DNA, 15 bp, Homo sapiens
tgacatgatcgcttt

SEQ ID NO: 1056515 - DNA, 16 bp, Homo sapiens
tgacatgccctccctt

SEQ ID NO: 1056516 - DNA, 21 bp, Homo sapiens
tgacatgccctcccttctccc

SEQ ID NO: 1056517 - DNA, 15 bp, Homo sapiens
tgacatggaaatgaa

SEQ ID NO: 1056518 - DNA, 16 bp, Homo sapiens
tgacatggaaatgaag

SEQ ID NO: 1056519 - DNA, 15 bp, Homo sapiens
tgacatgggccttta

SEQ ID NO: 1056520 - DNA, 15 bp, Homo sapiens
tgacatggtgcctga

SEQ ID NO: 1056521 - DNA, 15 bp, Homo sapiens
tgacatggtgcctta

SEQ ID NO: 1056522 - DNA, 13 bp, Homo sapiens
tgacatgtaacag

SEQ ID NO: 1056523 - DNA, 19 bp, Homo sapiens
tgacatgtaagaaaatgtt

SEQ ID NO: 1056524 - DNA, 17 bp, Homo sapiens
tgacatgtccttctgag

SEQ ID NO: 1056525 - DNA, 16 bp, Homo sapiens
tgacatgtctactttt

SEQ ID NO: 1056526 - DNA, 14 bp, Homo sapiens
tgacatgtggaaag

SEQ ID NO: 1056527 - DNA, 20 bp, Homo sapiens
tgacatgtggggccaggtca

SEQ ID NO: 1056528 - DNA, 19 bp, Homo sapiens
tgacatgttcctttaaggt

SEQ ID NO: 1056529 - DNA, 14 bp, Homo sapiens
tgacattaacaaat

SEQ ID NO: 1056530 - DNA, 17 bp, Homo sapiens
tgacattaacagttttc

SEQ ID NO: 1056531 - DNA, 15 bp, Homo sapiens
tgacattcaaggcat

SEQ ID NO: 1056532 - DNA, 17 bp, Homo sapiens
tgacattcagaaaactt

SEQ ID NO: 1056533 - DNA, 11 bp, Homo sapiens
tgacattcctt

SEQ ID NO: 1056534 - DNA, 17 bp, Homo sapiens
tgacattccttgtcacc

SEQ ID NO: 1056535 - DNA, 19 bp, Homo sapiens
tgacattctgaatgcttct

SEQ ID NO: 1056536 - DNA, 22 bp, Homo sapiens
tgacattgtagagcttctggca

SEQ ID NO: 1056537 - DNA, 11 bp, Homo sapiens
tgacattgtct

SEQ ID NO: 1056538 - DNA, 12 bp, Homo sapiens
tgacatttaaat

SEQ ID NO: 1056539 - DNA, 23 bp, Homo sapiens
tgacatttacaggagggcccgga

SEQ ID NO: 1056540 - DNA, 16 bp, Homo sapiens
tgacatttagaacttt

SEQ ID NO: 1056541 - DNA, 19 bp, Homo sapiens
tgacatttaggattttgtg

SEQ ID NO: 1056542 - DNA, 16 bp, Homo sapiens
tgacatttatgtctca

SEQ ID NO: 1056543 - DNA, 21 bp, Homo sapiens
tgacatttatttttcatttag

SEQ ID NO: 1056544 - DNA, 18 bp, Homo sapiens
tgacatttcatctgggtg

SEQ ID NO: 1056545 - DNA, 19 bp, Homo sapiens
tgacatttcatctgggtgg

SEQ ID NO: 1056546 - DNA, 15 bp, Homo sapiens
tgacatttctaacat

SEQ ID NO: 1056547 - DNA, 20 bp, Homo sapiens
tgacatttctaacatatgta

SEQ ID NO: 1056548 - DNA, 22 bp, Homo sapiens
tgacatttctaacatatgtatt

SEQ ID NO: 1056549 - DNA, 15 bp, Homo sapiens
tgacatttggtggta

SEQ ID NO: 1056550 - DNA, 14 bp, Homo sapiens
tgacattttacatt

SEQ ID NO: 1056551 - DNA, 12 bp, Homo sapiens
tgacattttatt

SEQ ID NO: 1056552 - DNA, 20 bp, Homo sapiens
tgacattttctttttaaatt

SEQ ID NO: 1056553 - DNA, 14 bp, Homo sapiens
tgaccaaaccagcc

SEQ ID NO: 1056554 - DNA, 14 bp, Homo sapiens
tgaccaaagtcctt

SEQ ID NO: 1056555 - DNA, 17 bp, Homo sapiens
tgaccaacatggagaaa

SEQ ID NO: 1056556 - DNA, 13 bp, Homo sapiens
tgaccaactgtgt

SEQ ID NO: 1056557 - DNA, 15 bp, Homo sapiens
tgaccaactgtgttg

SEQ ID NO: 1056558 - DNA, 15 bp, Homo sapiens
tgaccaagaactgca

SEQ ID NO: 1056559 - DNA, 10 bp, Homo sapiens
tgaccaagac

SEQ ID NO: 1056560 - DNA, 22 bp, Homo sapiens
tgaccaagacaggttcaggtag

SEQ ID NO: 1056561 - DNA, 22 bp, Homo sapiens
tgaccaagactgagccagctta

SEQ ID NO: 1056562 - DNA, 15 bp, Homo sapiens
tgaccaagagagaaa

SEQ ID NO: 1056563 - DNA, 16 bp, Homo sapiens
tgaccaagagagaaag

SEQ ID NO: 1056564 - DNA, 23 bp, Homo sapiens
tgaccaagcggctcaagaataaa

SEQ ID NO: 1056565 - DNA, 18 bp, Homo sapiens
tgaccaagtataaacttt

SEQ ID NO: 1056566 - DNA, 18 bp, Homo sapiens
tgaccaatattgtacagt

SEQ ID NO: 1056567 - DNA, 18 bp, Homo sapiens
tgaccaatgatggtcacc

SEQ ID NO: 1056568 - DNA, 13 bp, Homo sapiens
tgaccaatgtctt

SEQ ID NO: 1056569 - DNA, 16 bp, Homo sapiens
tgaccaattgagtaag

SEQ ID NO: 1056570 - DNA, 16 bp, Homo sapiens
tgaccaattgtgctgc

SEQ ID NO: 1056571 - DNA, 17 bp, Homo sapiens
tgaccaattgtgctgcc

SEQ ID NO: 1056572 - DNA, 18 bp, Homo sapiens
tgaccaattgtgctgcca

SEQ ID NO: 1056573 - DNA, 23 bp, Homo sapiens
tgaccacacccgaagtcctgtca

SEQ ID NO: 1056574 - DNA, 16 bp, Homo sapiens
tgaccacagcacagcc

SEQ ID NO: 1056575 - DNA, 22 bp, Homo sapiens
tgaccacagcatcattttgcat

SEQ ID NO: 1056576 - DNA, 18 bp, Homo sapiens
tgaccacatagcatgagg

SEQ ID NO: 1056577 - DNA, 23 bp, Homo sapiens
tgaccaccaccccaacaaaccat

SEQ ID NO: 1056578 - DNA, 20 bp, Homo sapiens
tgaccaccccctgttccctg

SEQ ID NO: 1056579 - DNA, 12 bp, Homo sapiens
tgaccaccctcc

SEQ ID NO: 1056580 - DNA, 15 bp, Homo sapiens
tgaccaccctcccct

SEQ ID NO: 1056581 - DNA, 18 bp, Homo sapiens
tgaccaccctcccctctc

SEQ ID NO: 1056582 - DNA, 16 bp, Homo sapiens
tgaccaccttctattt

SEQ ID NO: 1056583 - DNA, 21 bp, Homo sapiens
tgaccaccttctgtccccagc

SEQ ID NO: 1056584 - DNA, 22 bp, Homo sapiens
tgaccaccttctgtccccagcc

SEQ ID NO: 1056585 - DNA, 14 bp, Homo sapiens
tgaccacgcacctc

SEQ ID NO: 1056586 - DNA, 15 bp, Homo sapiens
tgaccacgcacctcc

SEQ ID NO: 1056587 - DNA, 16 bp, Homo sapiens
tgaccacgcacctcca

SEQ ID NO: 1056588 - DNA, 21 bp, Homo sapiens
tgaccacggacgtttccatca

SEQ ID NO: 1056589 - DNA, 23 bp, Homo sapiens
tgaccacggacgtttccatcagg

SEQ ID NO: 1056590 - DNA, 21 bp, Homo sapiens
tgaccacgtgaaatttgcctc

SEQ ID NO: 1056591 - DNA, 11 bp, Homo sapiens
tgaccagaagc

SEQ ID NO: 1056592 - DNA, 16 bp, Homo sapiens
tgaccagaagccttgg

SEQ ID NO: 1056593 - DNA, 19 bp, Homo sapiens
tgaccagatctttctcttc

SEQ ID NO: 1056594 - DNA, 18 bp, Homo sapiens
tgaccagcactgtctcag

SEQ ID NO: 1056595 - DNA, 15 bp, Homo sapiens
tgaccagcagcagct

SEQ ID NO: 1056596 - DNA, 21 bp, Homo sapiens
tgaccagcctccatgctgcct

SEQ ID NO: 1056597 - DNA, 18 bp, Homo sapiens
tgaccagctggagtgagg

SEQ ID NO: 1056598 - DNA, 20 bp, Homo sapiens
tgactctttcctaaagccaa

SEQ ID NO: 1056599 - DNA, 22 bp, Homo sapiens
tgactctttttagggccaggca

SEQ ID NO: 1056600 - DNA, 15 bp, Homo sapiens
tgactgaaagaagaa

SEQ ID NO: 1056601 - DNA, 18 bp, Homo sapiens
tgactgaattctgccttg

SEQ ID NO: 1056602 - DNA, 13 bp, Homo sapiens
tgactgaatttct

SEQ ID NO: 1056603 - DNA, 16 bp, Homo sapiens
tgactgaccatgcact

SEQ ID NO: 1056604 - DNA, 19 bp, Homo sapiens
tgactgagcaagaccctgt

SEQ ID NO: 1056605 - DNA, 16 bp, Homo sapiens
tgactgagcaggctgt

SEQ ID NO: 1056606 - DNA, 21 bp, Homo sapiens
tgactgagggcagctttgcaa

SEQ ID NO: 1056607 - DNA, 22 bp, Homo sapiens
tgactgagggcagctttgcaaa

SEQ ID NO: 1056608 - DNA, 23 bp, Homo sapiens
tgactgatagcttacactgagga

SEQ ID NO: 1056609 - DNA, 16 bp, Homo sapiens
tgactgcagttgaaca

SEQ ID NO: 1056610 - DNA, 15 bp, Homo sapiens
tgactgccccaactc

SEQ ID NO: 1056611 - DNA, 16 bp, Homo sapiens
tgactgccccaactcc

SEQ ID NO: 1056612 - DNA, 21 bp, Homo sapiens
tgactgcccggcacagatgct

SEQ ID NO: 1056613 - DNA, 22 bp, Homo sapiens
tgactgcccggcacagatgctc

SEQ ID NO: 1056614 - DNA, 16 bp, Homo sapiens
tgactgcgatcttcag

SEQ ID NO: 1056615 - DNA, 22 bp, Homo sapiens
tgactgctcagaacttgctgct

SEQ ID NO: 1056616 - DNA, 16 bp, Homo sapiens
tgactggcaggtgcag

SEQ ID NO: 1056617 - DNA, 16 bp, Homo sapiens
tgactggctgtctgcc

SEQ ID NO: 1056618 - DNA, 18 bp, Homo sapiens
tgactggctgtctgcctg

SEQ ID NO: 1056619 - DNA, 12 bp, Homo sapiens
tgactgggaaag

SEQ ID NO: 1056620 - DNA, 20 bp, Homo sapiens
tgactgggcgtggtggctca

SEQ ID NO: 1056621 - DNA, 14 bp, Homo sapiens
tgactggggctggg

SEQ ID NO: 1056622 - DNA, 15 bp, Homo sapiens
tgactggggctgggg

SEQ ID NO: 1056623 - DNA, 17 bp, Homo sapiens
tgactggggtgggaggt

SEQ ID NO: 1056624 - DNA, 17 bp, Homo sapiens
tgactgggtcagccttc

SEQ ID NO: 1056625 - DNA, 21 bp, Homo sapiens
tgactgggtttctctgtatag

SEQ ID NO: 1056626 - DNA, 23 bp, Homo sapiens
tgactgggtttctctgtatagta

SEQ ID NO: 1056627 - DNA, 16 bp, Homo sapiens
tgactgtaagtagaca

SEQ ID NO: 1056628 - DNA, 16 bp, Homo sapiens
tgactgtacagagact

SEQ ID NO: 1056629 - DNA, 17 bp, Homo sapiens
tgactgtactcctccca

SEQ ID NO: 1056630 - DNA, 18 bp, Homo sapiens
tgactgtactcctcccag

SEQ ID NO: 1056631 - DNA, 21 bp, Homo sapiens
tgactgtatctaggcatttca

SEQ ID NO: 1056632 - DNA, 15 bp, Homo sapiens
tgactgtatctgtgt

SEQ ID NO: 1056633 - DNA, 17 bp, Homo sapiens
tgactgtcactgttcct

SEQ ID NO: 1056634 - DNA, 18 bp, Homo sapiens
tgactgtcagggagggcc

SEQ ID NO: 1056635 - DNA, 20 bp, Homo sapiens
tgactgtcagggagggccag

SEQ ID NO: 1056636 - DNA, 22 bp, Homo sapiens
tgactgtcagggagggccaggg

SEQ ID NO: 1056637 - DNA, 16 bp, Homo sapiens
tgactgtcccaccggg

SEQ ID NO: 1056638 - DNA, 20 bp, Homo sapiens
tgactgtctagccactccct

SEQ ID NO: 1056639 - DNA, 21 bp, Homo sapiens
tgactgtctagccactccctc

SEQ ID NO: 1056640 - DNA, 15 bp, Homo sapiens
tgactgtgctgtgca

SEQ ID NO: 1056641 - DNA, 13 bp, Homo sapiens
tgactgttgcccc

SEQ ID NO: 1056642 - DNA, 19 bp, Homo sapiens
tgactgttgtagcattttc

SEQ ID NO: 1056643 - DNA, 21 bp, Homo sapiens
tgactgtttcattcactgtgc

SEQ ID NO: 1056644 - DNA, 18 bp, Homo sapiens
tgactgtttcttttgtaa

SEQ ID NO: 1056645 - DNA, 18 bp, Homo sapiens
tgactgtttggcttataa

SEQ ID NO: 1056646 - DNA, 17 bp, Homo sapiens
tgactgtttttgtagtg

SEQ ID NO: 1056647 - DNA, 17 bp, Homo sapiens
tgacttaactttaactt

SEQ ID NO: 1056648 - DNA, 18 bp, Homo sapiens
tgacttacctgttcagta

SEQ ID NO: 1056649 - DNA, 16 bp, Homo sapiens
tgacttactgtacatg

SEQ ID NO: 1056650 - DNA, 13 bp, Homo sapiens
tgacttagatatt

SEQ ID NO: 1056651 - DNA, 16 bp, Homo sapiens
tgacttagatattaaa

SEQ ID NO: 1056652 - DNA, 17 bp, Homo sapiens
tgacttagatattaaaa

SEQ ID NO: 1056653 - DNA, 19 bp, Homo sapiens
tgacttaggtaaaataaaa

SEQ ID NO: 1056654 - DNA, 17 bp, Homo sapiens
tgacttatagtacatga

SEQ ID NO: 1056655 - DNA, 17 bp, Homo sapiens
tgacttatcccattttc

SEQ ID NO: 1056656 - DNA, 17 bp, Homo sapiens
tgacttatttatataaa

SEQ ID NO: 1056657 - DNA, 20 bp, Homo sapiens
tgacttatttatataaattt

SEQ ID NO: 1056658 - DNA, 13 bp, Homo sapiens
tgacttatttctg

SEQ ID NO: 1056659 - DNA, 18 bp, Homo sapiens
tgacttatttctgctctg

SEQ ID NO: 1056660 - DNA, 22 bp, Homo sapiens
tgacttattttgtcttattctt

SEQ ID NO: 1056661 - DNA, 23 bp, Homo sapiens
tgacttattttgtcttattctta

SEQ ID NO: 1056662 - DNA, 23 bp, Homo sapiens
tgacttcactgtatataaacata

SEQ ID NO: 1056663 - DNA, 12 bp, Homo sapiens
tgacttcaggtg

SEQ ID NO: 1056664 - DNA, 13 bp, Homo sapiens
tgacttcatggaa

SEQ ID NO: 1056665 - DNA, 13 bp, Homo sapiens
tgacttcatttgt

SEQ ID NO: 1056666 - DNA, 18 bp, Homo sapiens
tgacttccctggtcacca

SEQ ID NO: 1056667 - DNA, 19 bp, Homo sapiens
tgacttctaatttatatta

SEQ ID NO: 1056668 - DNA, 18 bp, Homo sapiens
tgacttctagcagagacc

SEQ ID NO: 1056669 - DNA, 14 bp, Homo sapiens
tgacttctccaggt

SEQ ID NO: 1056670 - DNA, 19 bp, Homo sapiens
tgacttctcccccgccctg

SEQ ID NO: 1056671 - DNA, 15 bp, Homo sapiens
tgacttctgcctgga

SEQ ID NO: 1056672 - DNA, 17 bp, Homo sapiens
tgacttctgctgaagga

SEQ ID NO: 1056673 - DNA, 20 bp, Homo sapiens
tgacttcttggtttggggag

SEQ ID NO: 1056674 - DNA, 21 bp, Homo sapiens
tgacttcttggtttggggaga

SEQ ID NO: 1056675 - DNA, 23 bp, Homo sapiens
tgacttcttggtttggggagaaa

SEQ ID NO: 1056676 - DNA, 20 bp, Homo sapiens
tgacttctttactaacactg

SEQ ID NO: 1056677 - DNA, 22 bp, Homo sapiens
tgacttctttactaacactggc

SEQ ID NO: 1056678 - DNA, 20 bp, Homo sapiens
tgacttgaaccacaagtgaa

SEQ ID NO: 1056679 - DNA, 23 bp, Homo sapiens
tgacttgaaccacaagtgaatct

SEQ ID NO: 1056680 - DNA, 13 bp, Homo sapiens
tgacttgagccac

SEQ ID NO: 1056681 - DNA, 16 bp, Homo sapiens
tgacttgcatgaagag

SEQ ID NO: 1056682 - DNA, 23 bp, Homo sapiens
tgacttgcatgaagagaagcaat

SEQ ID NO: 1056683 - DNA, 18 bp, Homo sapiens
tgacttgcgcttaatcca

SEQ ID NO: 1056684 - DNA, 16 bp, Homo sapiens
tgacttgctgtccagg

SEQ ID NO: 1056685 - DNA, 13 bp, Homo sapiens
tgacttggcactt

SEQ ID NO: 1056686 - DNA, 12 bp, Homo sapiens
tgacttggggga

SEQ ID NO: 1056687 - DNA, 19 bp, Homo sapiens
tgacttggttctgaagcca

SEQ ID NO: 1056688 - DNA, 12 bp, Homo sapiens
tgacttgtatat

SEQ ID NO: 1056689 - DNA, 16 bp, Homo sapiens
tgacttgttctgagta

SEQ ID NO: 1056690 - DNA, 15 bp, Homo sapiens
tgacttgtttgtctt

SEQ ID NO: 1056691 - DNA, 17 bp, Homo sapiens
tgactttaatttatgta

SEQ ID NO: 1056692 - DNA, 14 bp, Homo sapiens
tgactttacaggag

SEQ ID NO: 1056693 - DNA, 19 bp, Homo sapiens
tgactttagtctgcaaaat

SEQ ID NO: 1056694 - DNA, 14 bp, Homo sapiens
tgactttataaatt

SEQ ID NO: 1056695 - DNA, 15 bp, Homo sapiens
tgactttatgttgta

SEQ ID NO: 1056696 - DNA, 19 bp, Homo sapiens
tgactttatgttgtatgat

SEQ ID NO: 1056697 - DNA, 14 bp, Homo sapiens
tgactttatttttc

SEQ ID NO: 1056698 - DNA, 12 bp, Homo sapiens
tgactttcaggt

SEQ ID NO: 1056699 - DNA, 13 bp, Homo sapiens
tgactttcaggta

SEQ ID NO: 1056700 - DNA, 15 bp, Homo sapiens
tgactttctgattgg

SEQ ID NO: 1056701 - DNA, 18 bp, Homo sapiens
tgactttgacaattactc

SEQ ID NO: 1056702 - DNA, 20 bp, Homo sapiens
tgactttgcccccttgccca

SEQ ID NO: 1056703 - DNA, 13 bp, Homo sapiens
tgactttgcttgc

SEQ ID NO: 1056704 - DNA, 15 bp, Homo sapiens
tgacttttaaaaata

SEQ ID NO: 1056705 - DNA, 22 bp, Homo sapiens
tgacttttctgtccgagctttg

SEQ ID NO: 1056706 - DNA, 18 bp, Homo sapiens
tgactttttttggtataa

SEQ ID NO: 1056707 - DNA, 18 bp, Homo sapiens
tgagaaaaagctcctgtc

SEQ ID NO: 1056708 - DNA, 17 bp, Homo sapiens
tgagaaaacgaagtctt

SEQ ID NO: 1056709 - DNA, 14 bp, Homo sapiens
tgagaaaactgtga

SEQ ID NO: 1056710 - DNA, 22 bp, Homo sapiens
tgagaaaactgtgaccaagtat

SEQ ID NO: 1056711 - DNA, 15 bp, Homo sapiens
tgagaaaaggggcat

SEQ ID NO: 1056712 - DNA, 14 bp, Homo sapiens
tgagaaaagtagtc

SEQ ID NO: 1056713 - DNA, 23 bp, Homo sapiens
tgagaaaagtattctcaaagatg

SEQ ID NO: 1056714 - DNA, 12 bp, Homo sapiens
tgagaaaatata

SEQ ID NO: 1056715 - DNA, 21 bp, Homo sapiens
tgagaaactggcaaagcagaa

SEQ ID NO: 1056716 - DNA, 19 bp, Homo sapiens
tgagaaacttaaatgttat

SEQ ID NO: 1056717 - DNA, 18 bp, Homo sapiens
tgagaaagaataggggct

SEQ ID NO: 1056718 - DNA, 14 bp, Homo sapiens
tgagaaagagcact

SEQ ID NO: 1056719 - DNA, 21 bp, Homo sapiens
tgagaaagcccacctgggctg

SEQ ID NO: 1056720 - DNA, 18 bp, Homo sapiens
tgagaaagctaaaatggt

SEQ ID NO: 1056721 - DNA, 16 bp, Homo sapiens
tgagagggccctgcct

SEQ ID NO: 1056722 - DNA, 22 bp, Homo sapiens
tgagagggctcgaggggtgggc

SEQ ID NO: 1056723 - DNA, 11 bp, Homo sapiens
tgagaggggag

SEQ ID NO: 1056724 - DNA, 19 bp, Homo sapiens
tgagaggggagagtccagt

SEQ ID NO: 1056725 - DNA, 15 bp, Homo sapiens
tgagaggggagggag

SEQ ID NO: 1056726 - DNA, 16 bp, Homo sapiens
tgagaggggagggagg

SEQ ID NO: 1056727 - DNA, 20 bp, Homo sapiens
tgagaggggagggctcctgg

SEQ ID NO: 1056728 - DNA, 18 bp, Homo sapiens
tgagaggtgaaagcataa

SEQ ID NO: 1056729 - DNA, 14 bp, Homo sapiens
tgagaggtttgact

SEQ ID NO: 1056730 - DNA, 22 bp, Homo sapiens
tgagagtacaggtgcatattaa

SEQ ID NO: 1056731 - DNA, 21 bp, Homo sapiens
tgagagtactcacttttcact

SEQ ID NO: 1056732 - DNA, 14 bp, Homo sapiens
tgagagtcaggagt

SEQ ID NO: 1056733 - DNA, 19 bp, Homo sapiens
tgagagtctgaaagacaga

SEQ ID NO: 1056734 - DNA, 17 bp, Homo sapiens
tgagagtgtgagcaggg

SEQ ID NO: 1056735 - DNA, 19 bp, Homo sapiens
tgagagttccttctcactt

SEQ ID NO: 1056736 - DNA, 20 bp, Homo sapiens
tgagagttggctcaggcaga

SEQ ID NO: 1056737 - DNA, 20 bp, Homo sapiens
tgagagtttcctcagaaccc

SEQ ID NO: 1056738 - DNA, 21 bp, Homo sapiens
tgagagttttgtcttgaatgt

SEQ ID NO: 1056739 - DNA, 20 bp, Homo sapiens
tgagataaatgcacatttca

SEQ ID NO: 1056740 - DNA, 15 bp, Homo sapiens
tgagatagaagaact

SEQ ID NO: 1056741 - DNA, 21 bp, Homo sapiens
tgagatagaagaactgcaaag

SEQ ID NO: 1056742 - DNA, 19 bp, Homo sapiens
tgagatagtagcatacatt

SEQ ID NO: 1056743 - DNA, 15 bp, Homo sapiens
tgagatagttttcat

SEQ ID NO: 1056744 - DNA, 20 bp, Homo sapiens
tgagatatttattgtttatt

SEQ ID NO: 1056745 - DNA, 15 bp, Homo sapiens
tgagatcaaaacggt

SEQ ID NO: 1056746 - DNA, 20 bp, Homo sapiens
tgagatcacagcctccaggg

SEQ ID NO: 1056747 - DNA, 15 bp, Homo sapiens
tgagatcagcctggg

SEQ ID NO: 1056748 - DNA, 23 bp, Homo sapiens
tgagatcgtgctactgcactcca

SEQ ID NO: 1056749 - DNA, 23 bp, Homo sapiens
tgagatctaagcctttccataag

SEQ ID NO: 1056750 - DNA, 18 bp, Homo sapiens
tgagatctgtataaataa

SEQ ID NO: 1056751 - DNA, 23 bp, Homo sapiens
tgagatgagggatgggcctggca

SEQ ID NO: 1056752 - DNA, 16 bp, Homo sapiens
tgagatgatttccaag

SEQ ID NO: 1056753 - DNA, 16 bp, Homo sapiens
tgagatgatttggtca

SEQ ID NO: 1056754 - DNA, 15 bp, Homo sapiens
tgagatgcagctgga

SEQ ID NO: 1056755 - DNA, 16 bp, Homo sapiens
tgagatgcagctggaa

SEQ ID NO: 1056756 - DNA, 23 bp, Homo sapiens
tgagatgccccgagcccaggcag

SEQ ID NO: 1056757 - DNA, 17 bp, Homo sapiens
tgagatgctaatttatt

SEQ ID NO: 1056758 - DNA, 21 bp, Homo sapiens
tgagatgctaatttatttccc

SEQ ID NO: 1056759 - DNA, 14 bp, Homo sapiens
tgagatgctgggct

SEQ ID NO: 1056760 - DNA, 21 bp, Homo sapiens
tgagatggaaaagtgtccttc

SEQ ID NO: 1056761 - DNA, 17 bp, Homo sapiens
tgagatggtatgaaata

SEQ ID NO: 1056762 - DNA, 16 bp, Homo sapiens
tgagatggtgaggctg

SEQ ID NO: 1056763 - DNA, 13 bp, Homo sapiens
tgagatgtagagt

SEQ ID NO: 1056764 - DNA, 16 bp, Homo sapiens
tgagatgtagagtttt

SEQ ID NO: 1056765 - DNA, 15 bp, Homo sapiens
tgagatgtgtatcag

SEQ ID NO: 1056766 - DNA, 17 bp, Homo sapiens
tgagatgtgtatcagtg

SEQ ID NO: 1056767 - DNA, 20 bp, Homo sapiens
tgagatgttattactgtttt

SEQ ID NO: 1056768 - DNA, 17 bp, Homo sapiens
tgagatgttgtgtggca

SEQ ID NO: 1056769 - DNA, 19 bp, Homo sapiens
tgagattacagaggaagtt

SEQ ID NO: 1056770 - DNA, 17 bp, Homo sapiens
tgagattagagggaggt

SEQ ID NO: 1056771 - DNA, 18 bp, Homo sapiens
tgagattcaatattgaat

SEQ ID NO: 1056772 - DNA, 16 bp, Homo sapiens
tgagattggcatggct

SEQ ID NO: 1056773 - DNA, 14 bp, Homo sapiens
tgagatttccttat

SEQ ID NO: 1056774 - DNA, 15 bp, Homo sapiens
tgagatttgccagca

SEQ ID NO: 1056775 - DNA, 18 bp, Homo sapiens
tgagatttgccagcacag

SEQ ID NO: 1056776 - DNA, 12 bp, Homo sapiens
tgagattttcct

SEQ ID NO: 1056777 - DNA, 22 bp, Homo sapiens
tgagatttttaaaaaatatttt

SEQ ID NO: 1056778 - DNA, 14 bp, Homo sapiens
tgagatttttaaga

SEQ ID NO: 1056779 - DNA, 19 bp, Homo sapiens
tgagatttttaagaacttc

SEQ ID NO: 1056780 - DNA, 20 bp, Homo sapiens
tgagcaaaatatgccccttc

SEQ ID NO: 1056781 - DNA, 18 bp, Homo sapiens
tgagcaaactaacttgac

SEQ ID NO: 1056782 - DNA, 18 bp, Homo sapiens
tgagcaaatgtggctcct

SEQ ID NO: 1056783 - DNA, 23 bp, Homo sapiens
tgagcaaggtgctcttgaacctg

SEQ ID NO: 1056784 - DNA, 21 bp, Homo sapiens
tgagcaagtaacattaactca

SEQ ID NO: 1056785 - DNA, 12 bp, Homo sapiens
tgagcaataaag

SEQ ID NO: 1056786 - DNA, 17 bp, Homo sapiens
tgagcaataaagtggaa

SEQ ID NO: 1056787 - DNA, 20 bp, Homo sapiens
tgagcaataaagtggaaaca

SEQ ID NO: 1056788 - DNA, 15 bp, Homo sapiens
tgagcaataacttct

SEQ ID NO: 1056789 - DNA, 20 bp, Homo sapiens
tgagcaatggtaactgcacc

SEQ ID NO: 1056790 - DNA, 20 bp, Homo sapiens
tgagcaatgtctgtgctagg

SEQ ID NO: 1056791 - DNA, 17 bp, Homo sapiens
tgagcacagcctagggc

SEQ ID NO: 1056792 - DNA, 14 bp, Homo sapiens
tgagcacagtcagg

SEQ ID NO: 1056793 - DNA, 18 bp, Homo sapiens
tgagcacagtcaggggct

SEQ ID NO: 1056794 - DNA, 16 bp, Homo sapiens
tgagcacatctctctg

SEQ ID NO: 1056795 - DNA, 22 bp, Homo sapiens
tgagcacatctctctgccctct

SEQ ID NO: 1056796 - DNA, 23 bp, Homo sapiens
tgagcacatctctctgccctctc

SEQ ID NO: 1056797 - DNA, 15 bp, Homo sapiens
tgagcaccctctgga

SEQ ID NO: 1056798 - DNA, 17 bp, Homo sapiens
tgagcaccgtcatggct

SEQ ID NO: 1056799 - DNA, 21 bp, Homo sapiens
tgagcacctgcttcatgctca

SEQ ID NO: 1056800 - DNA, 19 bp, Homo sapiens
tgagcagaatactggtctc

SEQ ID NO: 1056801 - DNA, 16 bp, Homo sapiens
tgagcagaatgttgta

SEQ ID NO: 1056802 - DNA, 13 bp, Homo sapiens
tgagcagagggag

SEQ ID NO: 1056803 - DNA, 17 bp, Homo sapiens
tgagcagagggaggaag

SEQ ID NO: 1056804 - DNA, 15 bp, Homo sapiens
tgagcagccgccagc

SEQ ID NO: 1056805 - DNA, 16 bp, Homo sapiens
tgagcagccgccagct

SEQ ID NO: 1056806 - DNA, 21 bp, Homo sapiens
tgagcagcctctggacagcca

SEQ ID NO: 1056807 - DNA, 16 bp, Homo sapiens
tgagcagctactgtaa

SEQ ID NO: 1056808 - DNA, 17 bp, Homo sapiens
tgagcagctactgtaac

SEQ ID NO: 1056809 - DNA, 23 bp, Homo sapiens
tgagcagctactgtaactttttt

SEQ ID NO: 1056810 - DNA, 19 bp, Homo sapiens
tgagcaggacagccagcag

SEQ ID NO: 1056811 - DNA, 17 bp, Homo sapiens
tgagcagggcttgctcc

SEQ ID NO: 1056812 - DNA, 16 bp, Homo sapiens
tgagcaggggcaggcg

SEQ ID NO: 1056813 - DNA, 21 bp, Homo sapiens
tgagcaggggcaggcgcagag

SEQ ID NO: 1056814 - DNA, 22 bp, Homo sapiens
tgagcaggggcaggcgcagagg

SEQ ID NO: 1056815 - DNA, 21 bp, Homo sapiens
tgagcagggtcaagcctctta

SEQ ID NO: 1056816 - DNA, 18 bp, Homo sapiens
tgagcagggtggggtctg

SEQ ID NO: 1056817 - DNA, 21 bp, Homo sapiens
tgagcagggtggggtctggga

SEQ ID NO: 1056818 - DNA, 12 bp, Homo sapiens
tgagcagtggct

SEQ ID NO: 1056819 - DNA, 15 bp, Homo sapiens
tgagcagtggctggt

SEQ ID NO: 1056820 - DNA, 22 bp, Homo sapiens
tgagcagtggctggtccagggc

SEQ ID NO: 1056821 - DNA, 12 bp, Homo sapiens
tgagcatatctg

SEQ ID NO: 1056822 - DNA, 14 bp, Homo sapiens
tgagcatatctggt

SEQ ID NO: 1056823 - DNA, 23 bp, Homo sapiens
tgagcatattttcttacttttat

SEQ ID NO: 1056824 - DNA, 18 bp, Homo sapiens
tgagcatcaatcttgtta

SEQ ID NO: 1056825 - DNA, 20 bp, Homo sapiens
tgagcatcaatcttgttact

SEQ ID NO: 1056826 - DNA, 23 bp, Homo sapiens
tgagcatcctgagccccgccctc

SEQ ID NO: 1056827 - DNA, 15 bp, Homo sapiens
tgagcatcctgcaag

SEQ ID NO: 1056828 - DNA, 19 bp, Homo sapiens
tgagcatgacagcctgcag

SEQ ID NO: 1056829 - DNA, 21 bp, Homo sapiens
tgagcatgacagcctgcagca

SEQ ID NO: 1056830 - DNA, 19 bp, Homo sapiens
tgagcatgcacagctgctt

SEQ ID NO: 1056831 - DNA, 15 bp, Homo sapiens
tgagcattcttggtt

SEQ ID NO: 1056832 - DNA, 16 bp, Homo sapiens
tgagcatttagcacaa

SEQ ID NO: 1056833 - DNA, 17 bp, Homo sapiens
tgagcatttagcacaat

SEQ ID NO: 1056834 - DNA, 20 bp, Homo sapiens
tgagcatttgaaaggtgtgc

SEQ ID NO: 1056835 - DNA, 14 bp, Homo sapiens
tgagccaaaatgac

SEQ ID NO: 1056836 - DNA, 22 bp, Homo sapiens
tgagccatcactagaagaaaag

SEQ ID NO: 1056837 - DNA, 19 bp, Homo sapiens
tgagccatcatttcctggg

SEQ ID NO: 1056838 - DNA, 13 bp, Homo sapiens
tgagccatgcctc

SEQ ID NO: 1056839 - DNA, 18 bp, Homo sapiens
tgagccatgcctccctgg

SEQ ID NO: 1056840 - DNA, 19 bp, Homo sapiens
tgagccattgagtgctggg

SEQ ID NO: 1056841 - DNA, 19 bp, Homo sapiens
tgagcccaaccaggccctg

SEQ ID NO: 1056842 - DNA, 17 bp, Homo sapiens
tgagcccacaaagcctt

SEQ ID NO: 1056843 - DNA, 22 bp, Homo sapiens
tgagcccactgcccaccccctc

SEQ ID NO: 1056844 - DNA, 15 bp, Homo sapiens
tgagcccagagaaca

SEQ ID NO: 1056845 - DNA, 17 bp, Homo sapiens
tgagcccagctgggtca

SEQ ID NO: 1056846 - DNA, 19 bp, Homo sapiens
tgagcccattcttctgggt

SEQ ID NO: 1056847 - DNA, 22 bp, Homo sapiens
tgagccccaagtcctgaagagg

SEQ ID NO: 1056848 - DNA, 18 bp, Homo sapiens
tgagccccagggtgccca

SEQ ID NO: 1056849 - DNA, 20 bp, Homo sapiens
tgagccccagggtgcccaga

SEQ ID NO: 1056850 - DNA, 15 bp, Homo sapiens
tgagccccagtgctg

SEQ ID NO: 1056851 - DNA, 20 bp, Homo sapiens
tgagcccccaccggaactgg

SEQ ID NO: 1056852 - DNA, 15 bp, Homo sapiens
tgagcccccggctag

SEQ ID NO: 1056853 - DNA, 14 bp, Homo sapiens
tgagccccgccctc

SEQ ID NO: 1056854 - DNA, 16 bp, Homo sapiens
tgagcccctccccagc

SEQ ID NO: 1056855 - DNA, 22 bp, Homo sapiens
tgagcccctccccagccagccc

SEQ ID NO: 1056856 - DNA, 18 bp, Homo sapiens
tgagcccctggtcttctc

SEQ ID NO: 1056857 - DNA, 19 bp, Homo sapiens
tgagcccctggtcttctct

SEQ ID NO: 1056858 - DNA, 17 bp, Homo sapiens
tgagcccctgtctagag

SEQ ID NO: 1056859 - DNA, 13 bp, Homo sapiens
tgagccccttcct

SEQ ID NO: 1056860 - DNA, 14 bp, Homo sapiens
tgagccccttcctt

SEQ ID NO: 1056861 - DNA, 17 bp, Homo sapiens
tgagcccggatgcttct

SEQ ID NO: 1056862 - DNA, 13 bp, Homo sapiens
tgagcccgggctg

SEQ ID NO: 1056863 - DNA, 19 bp, Homo sapiens
tgagcccgggctgcctggg

SEQ ID NO: 1056864 - DNA, 20 bp, Homo sapiens
tgagcccgggctgcctgggc

SEQ ID NO: 1056865 - DNA, 17 bp, Homo sapiens
tgagccctctagggcag

SEQ ID NO: 1056866 - DNA, 22 bp, Homo sapiens
tgagccctctagggcagggtgg

SEQ ID NO: 1056867 - DNA, 17 bp, Homo sapiens
tgagccctctcactcca

SEQ ID NO: 1056868 - DNA, 22 bp, Homo sapiens
tgagccctctcactccagccaa

SEQ ID NO: 1056869 - DNA, 23 bp, Homo sapiens
tgagccctctcactccagccaaa

SEQ ID NO: 1056870 - DNA, 17 bp, Homo sapiens
tgagccctgtacccacc

SEQ ID NO: 1056871 - DNA, 19 bp, Homo sapiens
tgagccctgtacccacccc

SEQ ID NO: 1056872 - DNA, 21 bp, Homo sapiens
tgagccctgtacccaccccag

SEQ ID NO: 1056873 - DNA, 20 bp, Homo sapiens
tgagccgagatcgcgccact

SEQ ID NO: 1056874 - DNA, 16 bp, Homo sapiens
tgagccgccaggaacc

SEQ ID NO: 1056875 - DNA, 15 bp, Homo sapiens
tgagccgggcccctg

SEQ ID NO: 1056876 - DNA, 16 bp, Homo sapiens
tgagccgggcccctgg

SEQ ID NO: 1056877 - DNA, 19 bp, Homo sapiens
tgagccgggcccctgggct

SEQ ID NO: 1056878 - DNA, 23 bp, Homo sapiens
tgagcctcaatttcctcatctgg

SEQ ID NO: 1056879 - DNA, 16 bp, Homo sapiens
tgagcctcctgtgcct

SEQ ID NO: 1056880 - DNA, 18 bp, Homo sapiens
tgagcctcctgtgcctgg

SEQ ID NO: 1056881 - DNA, 16 bp, Homo sapiens
tgagcctcgtgtccag

SEQ ID NO: 1056882 - DNA, 14 bp, Homo sapiens
tgagcctctgctcc

SEQ ID NO: 1056883 - DNA, 17 bp, Homo sapiens
tgagcctctgctcccca

SEQ ID NO: 1056884 - DNA, 15 bp, Homo sapiens
tgagcctctttgtaa

SEQ ID NO: 1056885 - DNA, 15 bp, Homo sapiens
tgagcctgcccgctg

SEQ ID NO: 1056886 - DNA, 10 bp, Homo sapiens
tgagcctggc

SEQ ID NO: 1056887 - DNA, 11 bp, Homo sapiens
tgagcctggca

SEQ ID NO: 1056888 - DNA, 12 bp, Homo sapiens
tgagcctgggcc

SEQ ID NO: 1056889 - DNA, 13 bp, Homo sapiens
tgagcctgggcca

SEQ ID NO: 1056890 - DNA, 14 bp, Homo sapiens
tgagccttgaactt

SEQ ID NO: 1056891 - DNA, 15 bp, Homo sapiens
tgagccttgaacttt

SEQ ID NO: 1056892 - DNA, 17 bp, Homo sapiens
tgagccttgaactttga

SEQ ID NO: 1056893 - DNA, 23 bp, Homo sapiens
tgagccttgcagatatctgcatg

SEQ ID NO: 1056894 - DNA, 14 bp, Homo sapiens
tgagccttgcatgt

SEQ ID NO: 1056895 - DNA, 13 bp, Homo sapiens
tgagccttggccc

SEQ ID NO: 1056896 - DNA, 16 bp, Homo sapiens
tgagccttttccctct

SEQ ID NO: 1056897 - DNA, 15 bp, Homo sapiens
tgagcgatcatttat

SEQ ID NO: 1056898 - DNA, 17 bp, Homo sapiens
tgagcgatcatttattt

SEQ ID NO: 1056899 - DNA, 23 bp, Homo sapiens
tgagcgattattatctaaagtgt

SEQ ID NO: 1056900 - DNA, 12 bp, Homo sapiens
tgagcgccagga

SEQ ID NO: 1056901 - DNA, 18 bp, Homo sapiens
tgagcgcccccgagccct

SEQ ID NO: 1056902 - DNA, 22 bp, Homo sapiens
tgagcgcccccgagccctgact

SEQ ID NO: 1056903 - DNA, 23 bp, Homo sapiens
tgagcgcctccatccaaggccag

SEQ ID NO: 1056904 - DNA, 13 bp, Homo sapiens
tgagcgctgtgga

SEQ ID NO: 1056905 - DNA, 21 bp, Homo sapiens
tgagcgctgtggactgtcctg

SEQ ID NO: 1056906 - DNA, 18 bp, Homo sapiens
tgagcgcttctgcagcct

SEQ ID NO: 1056907 - DNA, 14 bp, Homo sapiens
tgagcggcaccctg

SEQ ID NO: 1056908 - DNA, 20 bp, Homo sapiens
tgagcggtgctgtcctcagg

SEQ ID NO: 1056909 - DNA, 21 bp, Homo sapiens
tgagcggtgctgtcctcaggt

SEQ ID NO: 1056910 - DNA, 22 bp, Homo sapiens
tgagcgtcactgcccaccaaag

SEQ ID NO: 1056911 - DNA, 16 bp, Homo sapiens
tgagcgtggccttggg

SEQ ID NO: 1056912 - DNA, 19 bp, Homo sapiens
tgagcgtggccttgggagg

SEQ ID NO: 1056913 - DNA, 20 bp, Homo sapiens
tgagcgtggccttgggagga

SEQ ID NO: 1056914 - DNA, 16 bp, Homo sapiens
tgagcgtttgcacggt

SEQ ID NO: 1056915 - DNA, 21 bp, Homo sapiens
tgagctaaataaagatattgt

SEQ ID NO: 1056916 - DNA, 15 bp, Homo sapiens
tgagctatttcatct

SEQ ID NO: 1056917 - DNA, 15 bp, Homo sapiens
tgagctattttcctc

SEQ ID NO: 1056918 - DNA, 17 bp, Homo sapiens
tgagctattttcctctg

SEQ ID NO: 1056919 - DNA, 20 bp, Homo sapiens
tgagctattttcctctggcc

SEQ ID NO: 1056920 - DNA, 23 bp, Homo sapiens
tgagctattttcctctggccgca

SEQ ID NO: 1056921 - DNA, 22 bp, Homo sapiens
tgagctcagacccccactctca

SEQ ID NO: 1056922 - DNA, 11 bp, Homo sapiens
tgagctcagga

SEQ ID NO: 1056923 - DNA, 19 bp, Homo sapiens
tgagctcaggagtttgaga

SEQ ID NO: 1056924 - DNA, 13 bp, Homo sapiens
tgagctccacctc

SEQ ID NO: 1056925 - DNA, 21 bp, Homo sapiens
tgagctccagacccccagcaa

SEQ ID NO: 1056926 - DNA, 16 bp, Homo sapiens
tgagctccatgtgccc

SEQ ID NO: 1056927 - DNA, 20 bp, Homo sapiens
tgagctcccacctcccttcc

SEQ ID NO: 1056928 - DNA, 14 bp, Homo sapiens
tgagctcctctggg

SEQ ID NO: 1056929 - DNA, 14 bp, Homo sapiens
tgagctcggtggac

SEQ ID NO: 1056930 - DNA, 14 bp, Homo sapiens
tgagctctccaggc

SEQ ID NO: 1056931 - DNA, 13 bp, Homo sapiens
tgagctctctgcc

SEQ ID NO: 1056932 - DNA, 12 bp, Homo sapiens
tgagctgaatgt

SEQ ID NO: 1056933 - DNA, 14 bp, Homo sapiens
tgagctgagtggcc

SEQ ID NO: 1056934 - DNA, 15 bp, Homo sapiens
tgagctgcagaaacg

SEQ ID NO: 1056935 - DNA, 12 bp, Homo sapiens
tgagctgcaggt

SEQ ID NO: 1056936 - DNA, 16 bp, Homo sapiens
tgagctgccagaatca

SEQ ID NO: 1056937 - DNA, 23 bp, Homo sapiens
tgagctgcccggcgcctgccctg

SEQ ID NO: 1056938 - DNA, 12 bp, Homo sapiens
tgagctgccttc

SEQ ID NO: 1056939 - DNA, 12 bp, Homo sapiens
tgagctgctcat

SEQ ID NO: 1056940 - DNA, 18 bp, Homo sapiens
tgagctgctgtgcccagc

SEQ ID NO: 1056941 - DNA, 21 bp, Homo sapiens
tgagctggaaggagtgagagg

SEQ ID NO: 1056942 - DNA, 19 bp, Homo sapiens
tgagctggaaggggccacg

SEQ ID NO: 1056943 - DNA, 20 bp, Homo sapiens
tgagctggatagacttggga

SEQ ID NO: 1056944 - DNA, 10 bp, Homo sapiens
tgagctggcc

SEQ ID NO: 1056945 - DNA, 12 bp, Homo sapiens
tgagctggcctg

SEQ ID NO: 1056946 - DNA, 21 bp, Homo sapiens
tgagctgggaagctgtactca

SEQ ID NO: 1056947 - DNA, 13 bp, Homo sapiens
tgagctgggccca

SEQ ID NO: 1056948 - DNA, 16 bp, Homo sapiens
tgagctgggcccagcc

SEQ ID NO: 1056949 - DNA, 18 bp, Homo sapiens
tgagctgggcccagcccc

SEQ ID NO: 1056950 - DNA, 17 bp, Homo sapiens
tgagctggggactcagg

SEQ ID NO: 1056951 - DNA, 17 bp, Homo sapiens
tgagctggggaggtggg

SEQ ID NO: 1056952 - DNA, 21 bp, Homo sapiens
tgagctggggaggtgggaggc

SEQ ID NO: 1056953 - DNA, 23 bp, Homo sapiens
tgagctggggaggtgggaggcca

SEQ ID NO: 1056954 - DNA, 13 bp, Homo sapiens
tgagctggggccg

SEQ ID NO: 1056955 - DNA, 19 bp, Homo sapiens
tgagctgtaaaaatgttac

SEQ ID NO: 1056956 - DNA, 22 bp, Homo sapiens
tgagctgtaatttcgccttaaa

SEQ ID NO: 1056957 - DNA, 21 bp, Homo sapiens
tgagctgtgactgctttgctg

SEQ ID NO: 1056958 - DNA, 16 bp, Homo sapiens
tgagctgtgcgctgct

SEQ ID NO: 1056959 - DNA, 15 bp, Homo sapiens
tgagctgttgcctca

SEQ ID NO: 1056960 - DNA, 19 bp, Homo sapiens
tgagcttaaaatacaagac

SEQ ID NO: 1056961 - DNA, 21 bp, Homo sapiens
tgagcttagccttgtgccctg

SEQ ID NO: 1056962 - DNA, 22 bp, Homo sapiens
tgagcttagccttgtgccctgc

SEQ ID NO: 1056963 - DNA, 18 bp, Homo sapiens
tgagcttcaatataagaa

SEQ ID NO: 1056964 - DNA, 21 bp, Homo sapiens
tgagcttcaatataagaagca

SEQ ID NO: 1056965 - DNA, 17 bp, Homo sapiens
tgagcttcggttctcca

SEQ ID NO: 1056966 - DNA, 19 bp, Homo sapiens
tgagcttggcagctgaact

SEQ ID NO: 1056967 - DNA, 15 bp, Homo sapiens
tgagctttgctgcta

SEQ ID NO: 1056968 - DNA, 13 bp, Homo sapiens
tgagcttttctag

SEQ ID NO: 1056969 - DNA, 17 bp, Homo sapiens
tgaggaacaggttcctg

SEQ ID NO: 1056970 - DNA, 24 bp, Homo sapiens
tgaggaagaagggataatagacac

SEQ ID NO: 1056971 - DNA, 20 bp, Homo sapiens
tgaggaagcagttggggccc

SEQ ID NO: 1056972 - DNA, 23 bp, Homo sapiens
tgaggaagccaggtccacggtct

SEQ ID NO: 1056973 - DNA, 19 bp, Homo sapiens
tgaggaatagcaaaattcc

SEQ ID NO: 1056974 - DNA, 20 bp, Homo sapiens
tgaggaatagttgagcccca

SEQ ID NO: 1056975 - DNA, 18 bp, Homo sapiens
tgaggaatgctctgtgcc

SEQ ID NO: 1056976 - DNA, 17 bp, Homo sapiens
tgaggaatgtatatgtt

SEQ ID NO: 1056977 - DNA, 21 bp, Homo sapiens
tgaggaatttcacctgtaaac

SEQ ID NO: 1056978 - DNA, 22 bp, Homo sapiens
tgaggaatttcacctgtaaacc

SEQ ID NO: 1056979 - DNA, 22 bp, Homo sapiens
tgaggacaaagtggaggagggc

SEQ ID NO: 1056980 - DNA, 16 bp, Homo sapiens
tgaggacagctgtcct

SEQ ID NO: 1056981 - DNA, 18 bp, Homo sapiens
tgaggacagctgtcctct

SEQ ID NO: 1056982 - DNA, 18 bp, Homo sapiens
tgaggacaggctctagag

SEQ ID NO: 1056983 - DNA, 17 bp, Homo sapiens
tgaggaccagggtggag

SEQ ID NO: 1056984 - DNA, 20 bp, Homo sapiens
tgaggaccagggtggagctg

SEQ ID NO: 1056985 - DNA, 16 bp, Homo sapiens
tgaggaccatgaaaca

SEQ ID NO: 1056986 - DNA, 18 bp, Homo sapiens
tgaggaccatgaaacatt

SEQ ID NO: 1056987 - DNA, 15 bp, Homo sapiens
tgaggacctttatat

SEQ ID NO: 1056988 - DNA, 18 bp, Homo sapiens
tgaggacctttatatctg

SEQ ID NO: 1056989 - DNA, 21 bp, Homo sapiens
tgaggacgtgtctgttatttc

SEQ ID NO: 1056990 - DNA, 20 bp, Homo sapiens
tgaggactcatatatttaag

SEQ ID NO: 1056991 - DNA, 21 bp, Homo sapiens
tgaggactcatatatttaagc

SEQ ID NO: 1056992 - DNA, 19 bp, Homo sapiens
tgaggactcggccactgtg

SEQ ID NO: 1056993 - DNA, 22 bp, Homo sapiens
tgaggactcggccactgtgtct

SEQ ID NO: 1056994 - DNA, 17 bp, Homo sapiens
tgaggactgatttcaga

SEQ ID NO: 1056995 - DNA, 13 bp, Homo sapiens
tgaggactgtcct

SEQ ID NO: 1056996 - DNA, 14 bp, Homo sapiens
tgaggagaatgaaa

SEQ ID NO: 1056997 - DNA, 15 bp, Homo sapiens
tgaggagacacacct

SEQ ID NO: 1056998 - DNA, 23 bp, Homo sapiens
tgaggagacgaagtgaaaacaaa

SEQ ID NO: 1056999 - DNA, 17 bp, Homo sapiens
tgaggagagaaaatata

SEQ ID NO: 1057000 - DNA, 15 bp, Homo sapiens
tgaggagagggactg

SEQ ID NO: 1057001 - DNA, 16 bp, Homo sapiens
tgaggagatgaccagg

SEQ ID NO: 1057002 - DNA, 13 bp, Homo sapiens
tgaggagcagctg

SEQ ID NO: 1057003 - DNA, 19 bp, Homo sapiens
tgaggagcattaaggtatt

SEQ ID NO: 1057004 - DNA, 15 bp, Homo sapiens
tgaggagccaggccg

SEQ ID NO: 1057005 - DNA, 20 bp, Homo sapiens
tgaggagcccatactcagcc

SEQ ID NO: 1057006 - DNA, 16 bp, Homo sapiens
tgaggagccccagcta

SEQ ID NO: 1057007 - DNA, 16 bp, Homo sapiens
tgaggagccctgagga

SEQ ID NO: 1057008 - DNA, 18 bp, Homo sapiens
tgaggagccctgaggacc

SEQ ID NO: 1057009 - DNA, 14 bp, Homo sapiens
tgaggagctgcact

SEQ ID NO: 1057010 - DNA, 14 bp, Homo sapiens
tgaggagctgctgg

SEQ ID NO: 1057011 - DNA, 16 bp, Homo sapiens
tgaggagctgctggct

SEQ ID NO: 1057012 - DNA, 13 bp, Homo sapiens
tgaggaggaaaag

SEQ ID NO: 1057013 - DNA, 18 bp, Homo sapiens
tgaggaggaaaaggaaaa

SEQ ID NO: 1057014 - DNA, 22 bp, Homo sapiens
tgaggaggatgtccctgggcca

SEQ ID NO: 1057015 - DNA, 12 bp, Homo sapiens
tgaggaggggag

SEQ ID NO: 1057016 - DNA, 20 bp, Homo sapiens
tgaggaggggagcgtctggg

SEQ ID NO: 1057017 - DNA, 13 bp, Homo sapiens
tgaggaggggagg

SEQ ID NO: 1057018 - DNA, 19 bp, Homo sapiens
tgaggaggggcaggtaaac

SEQ ID NO: 1057019 - DNA, 17 bp, Homo sapiens
tgaggagggtggaggaa

SEQ ID NO: 1057020 - DNA, 15 bp, Homo sapiens
tgaggagtaagtgta

SEQ ID NO: 1057021 - DNA, 20 bp, Homo sapiens
tgaggataaaaaggaaggag

SEQ ID NO: 1057022 - DNA, 18 bp, Homo sapiens
tgaggatataatgtgtgc

SEQ ID NO: 1057023 - DNA, 22 bp, Homo sapiens
tgaggatgattattttcaaggc

SEQ ID NO: 1057024 - DNA, 23 bp, Homo sapiens
tgaggatgctgcagtgaggctgt

SEQ ID NO: 1057025 - DNA, 23 bp, Homo sapiens
tgaggatgggatgtatttttctt

SEQ ID NO: 1057026 - DNA, 18 bp, Homo sapiens
tgaggatgggtcagagct

SEQ ID NO: 1057027 - DNA, 14 bp, Homo sapiens
tgaggattccaaaa

SEQ ID NO: 1057028 - DNA, 21 bp, Homo sapiens
tgaggcaaccccctcggagcc

SEQ ID NO: 1057029 - DNA, 22 bp, Homo sapiens
tgaggcaaccccctcggagcct

SEQ ID NO: 1057030 - DNA, 15 bp, Homo sapiens
tgaggcaagtgtggg

SEQ ID NO: 1057031 - DNA, 16 bp, Homo sapiens
tgaggcaagtgtgggc

SEQ ID NO: 1057032 - DNA, 15 bp, Homo sapiens
tgaggcactggcgag

SEQ ID NO: 1057033 - DNA, 12 bp, Homo sapiens
tgaggcagacag

SEQ ID NO: 1057034 - DNA, 15 bp, Homo sapiens
tgaggcagacagcag

SEQ ID NO: 1057035 - DNA, 12 bp, Homo sapiens
tgaggcaggaga

SEQ ID NO: 1057036 - DNA, 15 bp, Homo sapiens
tgaggcaggggcgga

SEQ ID NO: 1057037 - DNA, 23 bp, Homo sapiens
tgaggcatcgcaatgtaagactc

SEQ ID NO: 1057038 - DNA, 19 bp, Homo sapiens
tgaggcattcggggaagct

SEQ ID NO: 1057039 - DNA, 12 bp, Homo sapiens
tgaggccacact

SEQ ID NO: 1057040 - DNA, 13 bp, Homo sapiens
tgaggccacactc

SEQ ID NO: 1057041 - DNA, 16 bp, Homo sapiens
tgaggccacccagagg

SEQ ID NO: 1057042 - DNA, 13 bp, Homo sapiens
tgaggccagacca

SEQ ID NO: 1057043 - DNA, 16 bp, Homo sapiens
tgaggccatcagggcc

SEQ ID NO: 1057044 - DNA, 17 bp, Homo sapiens
tgaggccatcagggccc

SEQ ID NO: 1057045 - DNA, 18 bp, Homo sapiens
tgaggccatcagggccct

SEQ ID NO: 1057046 - DNA, 21 bp, Homo sapiens
tgaggccatcagggccctgcc

SEQ ID NO: 1057047 - DNA, 15 bp, Homo sapiens
tgaggccatctcagg

SEQ ID NO: 1057048 - DNA, 13 bp, Homo sapiens
tgaggcccagcct

SEQ ID NO: 1057049 - DNA, 16 bp, Homo sapiens
tgaggcccagcctgtc

SEQ ID NO: 1057050 - DNA, 14 bp, Homo sapiens
tgaggccctgccca

SEQ ID NO: 1057051 - DNA, 14 bp, Homo sapiens
tgaggccctgggct

SEQ ID NO: 1057052 - DNA, 21 bp, Homo sapiens
tgaggccctgggctgggtgct

SEQ ID NO: 1057053 - DNA, 18 bp, Homo sapiens
tgaggccgcggcctcccc

SEQ ID NO: 1057054 - DNA, 20 bp, Homo sapiens
tgaggccgcggcctccccga

SEQ ID NO: 1057055 - DNA, 16 bp, Homo sapiens
tgaggccgctagaggc

SEQ ID NO: 1057056 - DNA, 17 bp, Homo sapiens
tgaggccgctagaggcc

SEQ ID NO: 1057057 - DNA, 19 bp, Homo sapiens
tgaggccgctagaggcctg

SEQ ID NO: 1057058 - DNA, 20 bp, Homo sapiens
tgaggccgctagaggcctga

SEQ ID NO: 1057059 - DNA, 19 bp, Homo sapiens
tgaggcctaaaagtaaaca

SEQ ID NO: 1057060 - DNA, 14 bp, Homo sapiens
tgaggcctcatccc

SEQ ID NO: 1057061 - DNA, 18 bp, Homo sapiens
tgaggcctcatccctcgg

SEQ ID NO: 1057062 - DNA, 22 bp, Homo sapiens
tgaggcctccagcttcaggcag

SEQ ID NO: 1057063 - DNA, 14 bp, Homo sapiens
tgaggcctcttgga

SEQ ID NO: 1057064 - DNA, 20 bp, Homo sapiens
tgctcagctctgggccattc

SEQ ID NO: 1057065 - DNA, 16 bp, Homo sapiens
tgctcagctgtcaagg

SEQ ID NO: 1057066 - DNA, 14 bp, Homo sapiens
tgctcaggcctccc

SEQ ID NO: 1057067 - DNA, 15 bp, Homo sapiens
tgctcaggcctccct

SEQ ID NO: 1057068 - DNA, 22 bp, Homo sapiens
tgctcaggctgcagctggacag

SEQ ID NO: 1057069 - DNA, 19 bp, Homo sapiens
tgctcaggggcgtgtggct

SEQ ID NO: 1057070 - DNA, 23 bp, Homo sapiens
tgctcaggtgctatgtcccaaga

SEQ ID NO: 1057071 - DNA, 14 bp, Homo sapiens
tgctcagtctccct

SEQ ID NO: 1057072 - DNA, 13 bp, Homo sapiens
tgctcagtgcctt

SEQ ID NO: 1057073 - DNA, 15 bp, Homo sapiens
tgctcagtgcttggg

SEQ ID NO: 1057074 - DNA, 18 bp, Homo sapiens
tgctcagtgcttgggctc

SEQ ID NO: 1057075 - DNA, 15 bp, Homo sapiens
tgctcagtgtccagc

SEQ ID NO: 1057076 - DNA, 17 bp, Homo sapiens
tgctcagtgtccagctt

SEQ ID NO: 1057077 - DNA, 22 bp, Homo sapiens
tgctcagtgtccagcttccaaa

SEQ ID NO: 1057078 - DNA, 21 bp, Homo sapiens
tgctcatattgtgattctgcc

SEQ ID NO: 1057079 - DNA, 23 bp, Homo sapiens
tgctcatattgtgattctgcctt

SEQ ID NO: 1057080 - DNA, 20 bp, Homo sapiens
tgctcatcatattccaaccc

SEQ ID NO: 1057081 - DNA, 22 bp, Homo sapiens
tgctcatcattccttgagaaaa

SEQ ID NO: 1057082 - DNA, 15 bp, Homo sapiens
tgctcatcattctct

SEQ ID NO: 1057083 - DNA, 20 bp, Homo sapiens
tgctcatcattctctgtctc

SEQ ID NO: 1057084 - DNA, 13 bp, Homo sapiens
tgctcatctgctg

SEQ ID NO: 1057085 - DNA, 18 bp, Homo sapiens
tgctcatctgctggtccg

SEQ ID NO: 1057086 - DNA, 15 bp, Homo sapiens
tgctcatgccctgcc

SEQ ID NO: 1057087 - DNA, 13 bp, Homo sapiens
tgctcatgggtgg

SEQ ID NO: 1057088 - DNA, 19 bp, Homo sapiens
tgctcatgtatatttagtt

SEQ ID NO: 1057089 - DNA, 22 bp, Homo sapiens
tgctcatgtccctgtccccagg

SEQ ID NO: 1057090 - DNA, 23 bp, Homo sapiens
tgctcatgtccctgtccccaggc

SEQ ID NO: 1057091 - DNA, 15 bp, Homo sapiens
tgctcattaaactga

SEQ ID NO: 1057092 - DNA, 23 bp, Homo sapiens
tgctcattaaactgattccagga

SEQ ID NO: 1057093 - DNA, 19 bp, Homo sapiens
tgctcattacagttctttc

SEQ ID NO: 1057094 - DNA, 20 bp, Homo sapiens
tgctcattacagttctttcc

SEQ ID NO: 1057095 - DNA, 17 bp, Homo sapiens
tgctcattcttgaggag

SEQ ID NO: 1057096 - DNA, 19 bp, Homo sapiens
tgctcattcttgaggagca

SEQ ID NO: 1057097 - DNA, 22 bp, Homo sapiens
tgctcattcttgaggagcatta

SEQ ID NO: 1057098 - DNA, 19 bp, Homo sapiens
tgctcattttctggtttgg

SEQ ID NO: 1057099 - DNA, 13 bp, Homo sapiens
tgctcattttctt

SEQ ID NO: 1057100 - DNA, 15 bp, Homo sapiens
tgctccttgggccct

SEQ ID NO: 1057101 - DNA, 18 bp, Homo sapiens
tgctccttgggccctttg

SEQ ID NO: 1057102 - DNA, 23 bp, Homo sapiens
tgctcgagtcacattctgcttaa

SEQ ID NO: 1057103 - DNA, 18 bp, Homo sapiens
tgctcgcccagacaccat

SEQ ID NO: 1057104 - DNA, 18 bp, Homo sapiens
tgctcggcttcttggacc

SEQ ID NO: 1057105 - DNA, 16 bp, Homo sapiens
tgctcgtggactgtgc

SEQ ID NO: 1057106 - DNA, 16 bp, Homo sapiens
tgctctaacagccctc

SEQ ID NO: 1057107 - DNA, 18 bp, Homo sapiens
tgctctaatgagcatttc

SEQ ID NO: 1057108 - DNA, 19 bp, Homo sapiens
tgctctaatgagcatttcc

SEQ ID NO: 1057109 - DNA, 20 bp, Homo sapiens
tgctctacccatgagcctgc

SEQ ID NO: 1057110 - DNA, 12 bp, Homo sapiens
tgctctagccag

SEQ ID NO: 1057111 - DNA, 14 bp, Homo sapiens
tgctctagccagga

SEQ ID NO: 1057112 - DNA, 19 bp, Homo sapiens
tgctctagccaggagtctg

SEQ ID NO: 1057113 - DNA, 23 bp, Homo sapiens
tgctctagccaggagtctgtgct

SEQ ID NO: 1057114 - DNA, 13 bp, Homo sapiens
tgctctaggaaga

SEQ ID NO: 1057115 - DNA, 20 bp, Homo sapiens
tgctctagggaatctggatt

SEQ ID NO: 1057116 - DNA, 20 bp, Homo sapiens
tgctctattaagattggaaa

SEQ ID NO: 1057117 - DNA, 15 bp, Homo sapiens
tgctctcaattaaag

SEQ ID NO: 1057118 - DNA, 18 bp, Homo sapiens
tgctctccccggcaggcc

SEQ ID NO: 1057119 - DNA, 20 bp, Homo sapiens
tgctctcccggttcttccag

SEQ ID NO: 1057120 - DNA, 21 bp, Homo sapiens
tgctctccctcttctcaagtg

SEQ ID NO: 1057121 - DNA, 19 bp, Homo sapiens
tgctctcgcacctttccaa

SEQ ID NO: 1057122 - DNA, 11 bp, Homo sapiens
tgctctctctc

SEQ ID NO: 1057123 - DNA, 13 bp, Homo sapiens
tgctctctctccc

SEQ ID NO: 1057124 - DNA, 13 bp, Homo sapiens
tgctctctgcagc

SEQ ID NO: 1057125 - DNA, 17 bp, Homo sapiens
tgctctctgcagccagc

SEQ ID NO: 1057126 - DNA, 16 bp, Homo sapiens
tgctctctgctcatgg

SEQ ID NO: 1057127 - DNA, 13 bp, Homo sapiens
tgctctctgggct

SEQ ID NO: 1057128 - DNA, 14 bp, Homo sapiens
tgctctctgggctt

SEQ ID NO: 1057129 - DNA, 12 bp, Homo sapiens
tgctctctgtgg

SEQ ID NO: 1057130 - DNA, 17 bp, Homo sapiens
tgctctgaatctgtaca

SEQ ID NO: 1057131 - DNA, 23 bp, Homo sapiens
tgctctgaatctgtacatgttct

SEQ ID NO: 1057132 - DNA, 20 bp, Homo sapiens
tgctctgaatgggagccaga

SEQ ID NO: 1057133 - DNA, 20 bp, Homo sapiens
tgctctgaccctgggctttc

SEQ ID NO: 1057134 - DNA, 19 bp, Homo sapiens
tgctctgaccttccagagc

SEQ ID NO: 1057135 - DNA, 20 bp, Homo sapiens
tgctctgaccttccagagcc

SEQ ID NO: 1057136 - DNA, 16 bp, Homo sapiens
tgctctgaggcttcca

SEQ ID NO: 1057137 - DNA, 17 bp, Homo sapiens
tgctctgaggcttccag

SEQ ID NO: 1057138 - DNA, 16 bp, Homo sapiens
tgctctgatttccttc

SEQ ID NO: 1057139 - DNA, 23 bp, Homo sapiens
tgctctgcaggctggggaggtgc

SEQ ID NO: 1057140 - DNA, 18 bp, Homo sapiens
tgctctgcatgttacata

SEQ ID NO: 1057141 - DNA, 16 bp, Homo sapiens
tgctctgccatcttca

SEQ ID NO: 1057142 - DNA, 17 bp, Homo sapiens
tgctctgccatcttcag

SEQ ID NO: 1057143 - DNA, 18 bp, Homo sapiens
tgctctgccatcttcagg

SEQ ID NO: 1057144 - DNA, 20 bp, Homo sapiens
tgctctgccccttgggcatc

SEQ ID NO: 1057145 - DNA, 17 bp, Homo sapiens
tgctctgcctcagacgt

SEQ ID NO: 1057146 - DNA, 13 bp, Homo sapiens
tgctctgcctgga

SEQ ID NO: 1057147 - DNA, 23 bp, Homo sapiens
tgctctgcgtgtcacctgtgctt

SEQ ID NO: 1057148 - DNA, 16 bp, Homo sapiens
tgctctggaagagagg

SEQ ID NO: 1057149 - DNA, 13 bp, Homo sapiens
tgctctggaagcc

SEQ ID NO: 1057150 - DNA, 23 bp, Homo sapiens
tgctctggaataaagttgcagat

SEQ ID NO: 1057151 - DNA, 15 bp, Homo sapiens
tgctctggacacttg

SEQ ID NO: 1057152 - DNA, 18 bp, Homo sapiens
tgctctggagcagccaag

SEQ ID NO: 1057153 - DNA, 16 bp, Homo sapiens
tgctctggcggcttcc

SEQ ID NO: 1057154 - DNA, 18 bp, Homo sapiens
tgctctggcggcttcctg

SEQ ID NO: 1057155 - DNA, 11 bp, Homo sapiens
tgctctggctt

SEQ ID NO: 1057156 - DNA, 21 bp, Homo sapiens
tgctctggcttgccccaggac

SEQ ID NO: 1057157 - DNA, 20 bp, Homo sapiens
tgctctggggatttctggga

SEQ ID NO: 1057158 - DNA, 15 bp, Homo sapiens
tgctctggtgcacgc

SEQ ID NO: 1057159 - DNA, 12 bp, Homo sapiens
tgctctgtactg

SEQ ID NO: 1057160 - DNA, 18 bp, Homo sapiens
tgctctgtcccccaggct

SEQ ID NO: 1057161 - DNA, 19 bp, Homo sapiens
tgctctgtcccccaggctg

SEQ ID NO: 1057162 - DNA, 20 bp, Homo sapiens
tgctctgtcccccaggctgg

SEQ ID NO: 1057163 - DNA, 19 bp, Homo sapiens
tgctctgtctcccaggctg

SEQ ID NO: 1057164 - DNA, 17 bp, Homo sapiens
tgctctgtgttcccaga

SEQ ID NO: 1057165 - DNA, 20 bp, Homo sapiens
tgctcttaaaatatcttcct

SEQ ID NO: 1057166 - DNA, 22 bp, Homo sapiens
tgctcttagattgggccatggc

SEQ ID NO: 1057167 - DNA, 18 bp, Homo sapiens
tgctcttagtgcccgcct

SEQ ID NO: 1057168 - DNA, 13 bp, Homo sapiens
tgctcttcagtgg

SEQ ID NO: 1057169 - DNA, 13 bp, Homo sapiens
tgctcttctccac

SEQ ID NO: 1057170 - DNA, 16 bp, Homo sapiens
tgctcttgaaatattc

SEQ ID NO: 1057171 - DNA, 18 bp, Homo sapiens
tgctcttgaacctgtgct

SEQ ID NO: 1057172 - DNA, 20 bp, Homo sapiens
tgctcttgaccttgtagaga

SEQ ID NO: 1057173 - DNA, 16 bp, Homo sapiens
tgctcttgcagttgct

SEQ ID NO: 1057174 - DNA, 17 bp, Homo sapiens
tgctcttggaaagctga

SEQ ID NO: 1057175 - DNA, 18 bp, Homo sapiens
tgctcttggctgacccct

SEQ ID NO: 1057176 - DNA, 23 bp, Homo sapiens
tgctcttgtttttattaatttat

SEQ ID NO: 1057177 - DNA, 18 bp, Homo sapiens
tgctctttcatctctgct

SEQ ID NO: 1057178 - DNA, 13 bp, Homo sapiens
tgctctttctctg

SEQ ID NO: 1057179 - DNA, 14 bp, Homo sapiens
tgctctttctctgc

SEQ ID NO: 1057180 - DNA, 16 bp, Homo sapiens
tgctctttctctgcca

SEQ ID NO: 1057181 - DNA, 22 bp, Homo sapiens
tgctctttctctgccagtgaca

SEQ ID NO: 1057182 - DNA, 22 bp, Homo sapiens
tgctctttcttggattggacag

SEQ ID NO: 1057183 - DNA, 20 bp, Homo sapiens
tgctctttgacaactaaaat

SEQ ID NO: 1057184 - DNA, 23 bp, Homo sapiens
tgctcttttaagcagtctcactg

SEQ ID NO: 1057185 - DNA, 13 bp, Homo sapiens
tgctcttttctcc

SEQ ID NO: 1057186 - DNA, 23 bp, Homo sapiens
tgctcttttctcctcactgtatc

SEQ ID NO: 1057187 - DNA, 20 bp, Homo sapiens
tgctcttttggtggggagca

SEQ ID NO: 1057188 - DNA, 16 bp, Homo sapiens
tgctctttttttaaaa

SEQ ID NO: 1057189 - DNA, 17 bp, Homo sapiens
tgctgaaaaatatagcc

SEQ ID NO: 1057190 - DNA, 14 bp, Homo sapiens
tgctgaaaacatta

SEQ ID NO: 1057191 - DNA, 20 bp, Homo sapiens
tgctgaaaacattacatgct

SEQ ID NO: 1057192 - DNA, 14 bp, Homo sapiens
tgctgaaaatgatt

SEQ ID NO: 1057193 - DNA, 16 bp, Homo sapiens
tgctgaacgcagaaga

SEQ ID NO: 1057194 - DNA, 20 bp, Homo sapiens
tgctgaacgcagaagaaagg

SEQ ID NO: 1057195 - DNA, 14 bp, Homo sapiens
tgctgaactgtgca

SEQ ID NO: 1057196 - DNA, 16 bp, Homo sapiens
tgctgaagacattcaa

SEQ ID NO: 1057197 - DNA, 22 bp, Homo sapiens
tgctgaaggtggggattgccca

SEQ ID NO: 1057198 - DNA, 17 bp, Homo sapiens
tgctgaagttctgagcc

SEQ ID NO: 1057199 - DNA, 17 bp, Homo sapiens
tgctgaatatctgttca

SEQ ID NO: 1057200 - DNA, 17 bp, Homo sapiens
tgctgaatcccatcagg

SEQ ID NO: 1057201 - DNA, 22 bp, Homo sapiens
tgctgaatggttttcaaaataa

SEQ ID NO: 1057202 - DNA, 13 bp, Homo sapiens
tgctgaattcctt

SEQ ID NO: 1057203 - DNA, 17 bp, Homo sapiens
tgctgaatttcaggcat

SEQ ID NO: 1057204 - DNA, 14 bp, Homo sapiens
tgctgaatttctaa

SEQ ID NO: 1057205 - DNA, 19 bp, Homo sapiens
tgctgaatttgtagttgtt

SEQ ID NO: 1057206 - DNA, 19 bp, Homo sapiens
tgctgacaacttagctcag

SEQ ID NO: 1057207 - DNA, 13 bp, Homo sapiens
tgctgacagacac

SEQ ID NO: 1057208 - DNA, 13 bp, Homo sapiens
tgctgacagctct

SEQ ID NO: 1057209 - DNA, 15 bp, Homo sapiens
tgctgacagctgctc

SEQ ID NO: 1057210 - DNA, 15 bp, Homo sapiens
tgctgacaggtgatg

SEQ ID NO: 1057211 - DNA, 22 bp, Homo sapiens
tgctgacaggtgatgctctggc

SEQ ID NO: 1057212 - DNA, 13 bp, Homo sapiens
tgctgacatcaga

SEQ ID NO: 1057213 - DNA, 22 bp, Homo sapiens
tgctgaccaattgtgctgccat

SEQ ID NO: 1057214 - DNA, 23 bp, Homo sapiens
tgctgaccaattgtgctgccatt

SEQ ID NO: 1057215 - DNA, 18 bp, Homo sapiens
tgctgaccagctggagtg

SEQ ID NO: 1057216 - DNA, 21 bp, Homo sapiens
tgctgaccagctggagtgagg

SEQ ID NO: 1057217 - DNA, 13 bp, Homo sapiens
tgctgacccagga

SEQ ID NO: 1057218 - DNA, 16 bp, Homo sapiens
tgctgacccaggaata

SEQ ID NO: 1057219 - DNA, 19 bp, Homo sapiens
tgctgaccccaggtcagcc

SEQ ID NO: 1057220 - DNA, 19 bp, Homo sapiens
tgctggagtgatttatact

SEQ ID NO: 1057221 - DNA, 13 bp, Homo sapiens
tgctggagtgcag

SEQ ID NO: 1057222 - DNA, 23 bp, Homo sapiens
tgctggagttccggcctgggcac

SEQ ID NO: 1057223 - DNA, 17 bp, Homo sapiens
tgctggataaaatgagg

SEQ ID NO: 1057224 - DNA, 17 bp, Homo sapiens
tgctggatactggacac

SEQ ID NO: 1057225 - DNA, 22 bp, Homo sapiens
tgctggatattttcaaattgta

SEQ ID NO: 1057226 - DNA, 22 bp, Homo sapiens
tgctggatcacagctgctttct

SEQ ID NO: 1057227 - DNA, 22 bp, Homo sapiens
tgctggatggtattaatcttgt

SEQ ID NO: 1057228 - DNA, 15 bp, Homo sapiens
tgctggattaatgtt

SEQ ID NO: 1057229 - DNA, 13 bp, Homo sapiens
tgctggcagggcc

SEQ ID NO: 1057230 - DNA, 19 bp, Homo sapiens
tgctggcagggccagggca

SEQ ID NO: 1057231 - DNA, 20 bp, Homo sapiens
tgctggcagggccagggcaa

SEQ ID NO: 1057232 - DNA, 13 bp, Homo sapiens
tgctggccaaata

SEQ ID NO: 1057233 - DNA, 12 bp, Homo sapiens
tgctggccagca

SEQ ID NO: 1057234 - DNA, 18 bp, Homo sapiens
tgctggccagcaccctct

SEQ ID NO: 1057235 - DNA, 22 bp, Homo sapiens
tgctggccagcaccctctcctg

SEQ ID NO: 1057236 - DNA, 22 bp, Homo sapiens
tgctggccatgaatctctgcct

SEQ ID NO: 1057237 - DNA, 14 bp, Homo sapiens
tgctggccccagcc

SEQ ID NO: 1057238 - DNA, 18 bp, Homo sapiens
tgctggccccagccctgc

SEQ ID NO: 1057239 - DNA, 22 bp, Homo sapiens
tgctggccccagccctgctggg

SEQ ID NO: 1057240 - DNA, 12 bp, Homo sapiens
tgctggcccctc

SEQ ID NO: 1057241 - DNA, 24 bp, Homo sapiens
tgctggcccctcacctgggcacct

SEQ ID NO: 1057242 - DNA, 18 bp, Homo sapiens
tgctggccgacccactga

SEQ ID NO: 1057243 - DNA, 17 bp, Homo sapiens
tgctggcctgactggtt

SEQ ID NO: 1057244 - DNA, 23 bp, Homo sapiens
tgctggccttggtatgtgccagg

SEQ ID NO: 1057245 - DNA, 14 bp, Homo sapiens
tgctggcctttgct

SEQ ID NO: 1057246 - DNA, 21 bp, Homo sapiens
tgctggcgacactcagggcag

SEQ ID NO: 1057247 - DNA, 22 bp, Homo sapiens
tgctggcgacactcagggcagc

SEQ ID NO: 1057248 - DNA, 20 bp, Homo sapiens
tgctggcggcgcagagggaa

SEQ ID NO: 1057249 - DNA, 19 bp, Homo sapiens
tgctggctcacagtacagc

SEQ ID NO: 1057250 - DNA, 18 bp, Homo sapiens
tgctggctgacctgggcc

SEQ ID NO: 1057251 - DNA, 15 bp, Homo sapiens
tgctggctgagctga

SEQ ID NO: 1057252 - DNA, 14 bp, Homo sapiens
tgctggctgcctta

SEQ ID NO: 1057253 - DNA, 14 bp, Homo sapiens
tgctggctgcggcc

SEQ ID NO: 1057254 - DNA, 13 bp, Homo sapiens
tgctggcttcagg

SEQ ID NO: 1057255 - DNA, 16 bp, Homo sapiens
tgctggcttcagggag

SEQ ID NO: 1057256 - DNA, 18 bp, Homo sapiens
tgctggcttcagggaggg

SEQ ID NO: 1057257 - DNA, 18 bp, Homo sapiens
tgctgggaaatgcagaaa

SEQ ID NO: 1057258 - DNA, 19 bp, Homo sapiens
tgctgggaaccccgcagcc

SEQ ID NO: 1057259 - DNA, 22 bp, Homo sapiens
tgctgggactcagccttcagac

SEQ ID NO: 1057260 - DNA, 14 bp, Homo sapiens
tgctgggagcctct

SEQ ID NO: 1057261 - DNA, 16 bp, Homo sapiens
tgctgggagctccact

SEQ ID NO: 1057262 - DNA, 18 bp, Homo sapiens
tgctgggagctccactct

SEQ ID NO: 1057263 - DNA, 21 bp, Homo sapiens
tgctgggagctccactctgct

SEQ ID NO: 1057264 - DNA, 22 bp, Homo sapiens
tgctgggagctccactctgctt

SEQ ID NO: 1057265 - DNA, 18 bp, Homo sapiens
tgctgggagctgaaaaat

SEQ ID NO: 1057266 - DNA, 20 bp, Homo sapiens
tgctgggaggagggagaggg

SEQ ID NO: 1057267 - DNA, 21 bp, Homo sapiens
tgctgggataactggccagcc

SEQ ID NO: 1057268 - DNA, 21 bp, Homo sapiens
tgctgggatgtgtgctttccc

SEQ ID NO: 1057269 - DNA, 16 bp, Homo sapiens
tgctgggattacagac

SEQ ID NO: 1057270 - DNA, 14 bp, Homo sapiens
tgctgggatttcca

SEQ ID NO: 1057271 - DNA, 21 bp, Homo sapiens
tgctgggcactgctccaaggg

SEQ ID NO: 1057272 - DNA, 22 bp, Homo sapiens
tgctgggcactgctccaaggga

SEQ ID NO: 1057273 - DNA, 14 bp, Homo sapiens
tgctgggcagcccg

SEQ ID NO: 1057274 - DNA, 12 bp, Homo sapiens
tgctgggccagg

SEQ ID NO: 1057275 - DNA, 14 bp, Homo sapiens
tgctgggccaggga

SEQ ID NO: 1057276 - DNA, 19 bp, Homo sapiens
tgctgggcccccagcctgg

SEQ ID NO: 1057277 - DNA, 16 bp, Homo sapiens
tgctgggcctctgcct

SEQ ID NO: 1057278 - DNA, 18 bp, Homo sapiens
tgctgggcgtctgttctt

SEQ ID NO: 1057279 - DNA, 13 bp, Homo sapiens
tgctgggctctgc

SEQ ID NO: 1057280 - DNA, 14 bp, Homo sapiens
tgctgggctggact

SEQ ID NO: 1057281 - DNA, 15 bp, Homo sapiens
tgctgggctggactg

SEQ ID NO: 1057282 - DNA, 19 bp, Homo sapiens
tgctgggctggactggcca

SEQ ID NO: 1057283 - DNA, 13 bp, Homo sapiens
tgctgggctgggc

SEQ ID NO: 1057284 - DNA, 14 bp, Homo sapiens
tgctgggctgggcc

SEQ ID NO: 1057285 - DNA, 18 bp, Homo sapiens
tgctgggctgtctctccc

SEQ ID NO: 1057286 - DNA, 19 bp, Homo sapiens
tgctgggctgtctctccct

SEQ ID NO: 1057287 - DNA, 17 bp, Homo sapiens
tgctgggcttgtctgta

SEQ ID NO: 1057288 - DNA, 21 bp, Homo sapiens
tgctggggcatgtgtgcctgt

SEQ ID NO: 1057289 - DNA, 22 bp, Homo sapiens
tgctggggcatgtgtgcctgtg

SEQ ID NO: 1057290 - DNA, 14 bp, Homo sapiens
tgctgggggaatga

SEQ ID NO: 1057291 - DNA, 22 bp, Homo sapiens
tgctgggggaatgagcccagag

SEQ ID NO: 1057292 - DNA, 19 bp, Homo sapiens
tgctgggggcacagctgtc

SEQ ID NO: 1057293 - DNA, 14 bp, Homo sapiens
tgctgtctatgtgg

SEQ ID NO: 1057294 - DNA, 13 bp, Homo sapiens
tgctgtctctctg

SEQ ID NO: 1057295 - DNA, 16 bp, Homo sapiens
tgctgtctctctgggc

SEQ ID NO: 1057296 - DNA, 14 bp, Homo sapiens
tgctgtctctgctc

SEQ ID NO: 1057297 - DNA, 15 bp, Homo sapiens
tgctgtctctgctcg

SEQ ID NO: 1057298 - DNA, 16 bp, Homo sapiens
tgctgtctctgctcgc

SEQ ID NO: 1057299 - DNA, 17 bp, Homo sapiens
tgctgtctggccctggg

SEQ ID NO: 1057300 - DNA, 22 bp, Homo sapiens
tgctgtctggtgaggtggccca

SEQ ID NO: 1057301 - DNA, 23 bp, Homo sapiens
tgctgtctggtgaggtggcccag

SEQ ID NO: 1057302 - DNA, 14 bp, Homo sapiens
tgctgtcttaaact

SEQ ID NO: 1057303 - DNA, 22 bp, Homo sapiens
tgctgtcttgatgactgctgat

SEQ ID NO: 1057304 - DNA, 18 bp, Homo sapiens
tgctgtcttgccccagtt

SEQ ID NO: 1057305 - DNA, 18 bp, Homo sapiens
tgctgtgaaccctggggc

SEQ ID NO: 1057306 - DNA, 22 bp, Homo sapiens
tgctgtgaaccctggggcctga

SEQ ID NO: 1057307 - DNA, 19 bp, Homo sapiens
tgctgtgaccatttataat

SEQ ID NO: 1057308 - DNA, 19 bp, Homo sapiens
tgctgtgaggaatgctctg

SEQ ID NO: 1057309 - DNA, 17 bp, Homo sapiens
tgctgtgaggctgtcct

SEQ ID NO: 1057310 - DNA, 20 bp, Homo sapiens
tgctgtgccatgctgggcca

SEQ ID NO: 1057311 - DNA, 17 bp, Homo sapiens
tgctgtgcccagcctcc

SEQ ID NO: 1057312 - DNA, 13 bp, Homo sapiens
tgctgtgccccac

SEQ ID NO: 1057313 - DNA, 23 bp, Homo sapiens
tgctgtgcctcgcatcctatgct

SEQ ID NO: 1057314 - DNA, 13 bp, Homo sapiens
tgctgtgctctgg

SEQ ID NO: 1057315 - DNA, 23 bp, Homo sapiens
tgctgtgctctggggatttctgg

SEQ ID NO: 1057316 - DNA, 12 bp, Homo sapiens
tgctgtgctgct

SEQ ID NO: 1057317 - DNA, 14 bp, Homo sapiens
tgctgtgctgctca

SEQ ID NO: 1057318 - DNA, 14 bp, Homo sapiens
tgctgtggcctggg

SEQ ID NO: 1057319 - DNA, 16 bp, Homo sapiens
tgctgtggcctgggca

SEQ ID NO: 1057320 - DNA, 14 bp, Homo sapiens
tgctgtgggagagc

SEQ ID NO: 1057321 - DNA, 11 bp, Homo sapiens
tgctgtgggca

SEQ ID NO: 1057322 - DNA, 13 bp, Homo sapiens
tgctgtgggcagc

SEQ ID NO: 1057323 - DNA, 16 bp, Homo sapiens
tgctgtgggcagcacc

SEQ ID NO: 1057324 - DNA, 19 bp, Homo sapiens
tgctgtgggcagcaccctc

SEQ ID NO: 1057325 - DNA, 13 bp, Homo sapiens
tgctgtgggcctc

SEQ ID NO: 1057326 - DNA, 22 bp, Homo sapiens
tgctgtggggcgaattcatccc

SEQ ID NO: 1057327 - DNA, 23 bp, Homo sapiens
tgctgtggggcgaattcatcccc

SEQ ID NO: 1057328 - DNA, 15 bp, Homo sapiens
tgctgtggtctataa

SEQ ID NO: 1057329 - DNA, 23 bp, Homo sapiens
tgctgtggtgtgtccccctctgt

SEQ ID NO: 1057330 - DNA, 19 bp, Homo sapiens
tgctgtgtgaccctgggca

SEQ ID NO: 1057331 - DNA, 13 bp, Homo sapiens
tgctgtgtgccca

SEQ ID NO: 1057332 - DNA, 20 bp, Homo sapiens
tgctgtgtgcccaagtgggc

SEQ ID NO: 1057333 - DNA, 21 bp, Homo sapiens
tgctgtgtgcccaagtgggca

SEQ ID NO: 1057334 - DNA, 16 bp, Homo sapiens
tgctgtgtgtgagcag

SEQ ID NO: 1057335 - DNA, 20 bp, Homo sapiens
tgctgtgtgtgagcagtgga

SEQ ID NO: 1057336 - DNA, 17 bp, Homo sapiens
tgctgtgttaagaggac

SEQ ID NO: 1057337 - DNA, 15 bp, Homo sapiens
tgctgttaaagacat

SEQ ID NO: 1057338 - DNA, 19 bp, Homo sapiens
tgctgttactgcttctctt

SEQ ID NO: 1057339 - DNA, 22 bp, Homo sapiens
tgctgttactgcttctctttgt

SEQ ID NO: 1057340 - DNA, 17 bp, Homo sapiens
tgctgttcctgctccat

SEQ ID NO: 1057341 - DNA, 24 bp, Homo sapiens
tgctgttctcaggacagcatccct

SEQ ID NO: 1057342 - DNA, 22 bp, Homo sapiens
tgctgttcttcacttctgggaa

SEQ ID NO: 1057343 - DNA, 21 bp, Homo sapiens
tgctgttgacatatttaatgt

SEQ ID NO: 1057344 - DNA, 19 bp, Homo sapiens
tgctgttgatttctttcca

SEQ ID NO: 1057345 - DNA, 22 bp, Homo sapiens
tgctgttgctgctactgtctta

SEQ ID NO: 1057346 - DNA, 21 bp, Homo sapiens
tgctgttggtcctctctctgt

SEQ ID NO: 1057347 - DNA, 16 bp, Homo sapiens
tgctgttgtgaagcta

SEQ ID NO: 1057348 - DNA, 18 bp, Homo sapiens
tgctgtttagcttcctcc

SEQ ID NO: 1057349 - DNA, 13 bp, Homo sapiens
tgctgtttcacaa

SEQ ID NO: 1057350 - DNA, 18 bp, Homo sapiens
tgctgtttcacaatacct

SEQ ID NO: 1057351 - DNA, 23 bp, Homo sapiens
tgctgtttcccggggaggaaaca

SEQ ID NO: 1057352 - DNA, 12 bp, Homo sapiens
tgctgtttctaa

SEQ ID NO: 1057353 - DNA, 15 bp, Homo sapiens
tgctgtttgaaaata

SEQ ID NO: 1057354 - DNA, 16 bp, Homo sapiens
tgctgtttgtagtgaa

SEQ ID NO: 1057355 - DNA, 14 bp, Homo sapiens
tgctgttttcctcc

SEQ ID NO: 1057356 - DNA, 21 bp, Homo sapiens
tgctgttttcctcccttctgc

SEQ ID NO: 1057357 - DNA, 18 bp, Homo sapiens
tgctgttttgatttgtac

SEQ ID NO: 1057358 - DNA, 13 bp, Homo sapiens
tgctgttttgtta

SEQ ID NO: 1057359 - DNA, 16 bp, Homo sapiens
tgctgttttgttatat

SEQ ID NO: 1057360 - DNA, 15 bp, Homo sapiens
tgctgttttgttctg

SEQ ID NO: 1057361 - DNA, 16 bp, Homo sapiens
tgcttaaaaatacttc

SEQ ID NO: 1057362 - DNA, 14 bp, Homo sapiens
tgcttaaaagacat

SEQ ID NO: 1057363 - DNA, 14 bp, Homo sapiens
tgcttaaaataagc

SEQ ID NO: 1057364 - DNA, 17 bp, Homo sapiens
tgcttaaaataagcagg

SEQ ID NO: 1057365 - DNA, 19 bp, Homo sapiens
tgcttaaaataagcaggtg

SEQ ID NO: 1057366 - DNA, 13 bp, Homo sapiens
tgcttaaaatatg

SEQ ID NO: 1057367 - DNA, 15 bp, Homo sapiens
tgcttaaaatatgta

SEQ ID NO: 1057368 - DNA, 13 bp, Homo sapiens
tgcttaaactaaa

SEQ ID NO: 1057369 - DNA, 15 bp, Homo sapiens
tgcttaaagcttccc

SEQ ID NO: 1057370 - DNA, 22 bp, Homo sapiens
tgcttaaagttggtattaataa

SEQ ID NO: 1057371 - DNA, 16 bp, Homo sapiens
tgcttaaagttgtaac

SEQ ID NO: 1057372 - DNA, 17 bp, Homo sapiens
tgcttaaattccaagtc

SEQ ID NO: 1057373 - DNA, 22 bp, Homo sapiens
tgcttaaatttcttatgtgaca

SEQ ID NO: 1057374 - DNA, 20 bp, Homo sapiens
tgcttaacattagatgtcat

SEQ ID NO: 1057375 - DNA, 14 bp, Homo sapiens
tgcttaacttcaca

SEQ ID NO: 1057376 - DNA, 17 bp, Homo sapiens
tgcttaacttcacatat

SEQ ID NO: 1057377 - DNA, 18 bp, Homo sapiens
tgcttaacttcacatatt

SEQ ID NO: 1057378 - DNA, 18 bp, Homo sapiens
tgcttaataaaagaacat

SEQ ID NO: 1057379 - DNA, 18 bp, Homo sapiens
tgcttaatttccttctgt

SEQ ID NO: 1057380 - DNA, 20 bp, Homo sapiens
tgcttaatttccttctgtta

SEQ ID NO: 1057381 - DNA, 16 bp, Homo sapiens
tgcttaatttctgcct

SEQ ID NO: 1057382 - DNA, 18 bp, Homo sapiens
tgcttacaattccctgct

SEQ ID NO: 1057383 - DNA, 21 bp, Homo sapiens
tgcttacaattccctgctgtc

SEQ ID NO: 1057384 - DNA, 22 bp, Homo sapiens
tgcttacaattccctgctgtcg

SEQ ID NO: 1057385 - DNA, 16 bp, Homo sapiens
tgcttacattttaata

SEQ ID NO: 1057386 - DNA, 14 bp, Homo sapiens
tgcttacattttta

SEQ ID NO: 1057387 - DNA, 18 bp, Homo sapiens
tgcttacatttttacaat

SEQ ID NO: 1057388 - DNA, 17 bp, Homo sapiens
tgcttacccttcacctt

SEQ ID NO: 1057389 - DNA, 16 bp, Homo sapiens
tgcttaccttctgctg

SEQ ID NO: 1057390 - DNA, 14 bp, Homo sapiens
tgcttacttatgcc

SEQ ID NO: 1057391 - DNA, 19 bp, Homo sapiens
tgcttagaatccaaacttg

SEQ ID NO: 1057392 - DNA, 16 bp, Homo sapiens
tgcttagagtgcccag

SEQ ID NO: 1057393 - DNA, 21 bp, Homo sapiens
tgcttagatgagggtgactgt

SEQ ID NO: 1057394 - DNA, 20 bp, Homo sapiens
tgcttaggaaacctcacgac

SEQ ID NO: 1057395 - DNA, 15 bp, Homo sapiens
tgcttaggagacaga

SEQ ID NO: 1057396 - DNA, 23 bp, Homo sapiens
tgcttaggagacagatcactcct

SEQ ID NO: 1057397 - DNA, 14 bp, Homo sapiens
tgcttaggatgttt

SEQ ID NO: 1057398 - DNA, 18 bp, Homo sapiens
tgcttagtcactgcctgc

SEQ ID NO: 1057399 - DNA, 21 bp, Homo sapiens
tgcttagtcacttatttcata

SEQ ID NO: 1057400 - DNA, 21 bp, Homo sapiens
tgcttataagagagagttaaa

SEQ ID NO: 1057401 - DNA, 14 bp, Homo sapiens
tgcttataatgtgt

SEQ ID NO: 1057402 - DNA, 19 bp, Homo sapiens
tgcttatgaatatttataa

SEQ ID NO: 1057403 - DNA, 19 bp, Homo sapiens
tgcttatgttaaactctgt

SEQ ID NO: 1057404 - DNA, 13 bp, Homo sapiens
tgcttattgatat

SEQ ID NO: 1057405 - DNA, 14 bp, Homo sapiens
tgcttattgttcca

SEQ ID NO: 1057406 - DNA, 23 bp, Homo sapiens
tgcttatttgacaacgtttcagc

SEQ ID NO: 1057407 - DNA, 15 bp, Homo sapiens
tgcttattttattat

SEQ ID NO: 1057408 - DNA, 16 bp, Homo sapiens
tgcttatttttataat

SEQ ID NO: 1057409 - DNA, 18 bp, Homo sapiens
tgcttatttttataatta

SEQ ID NO: 1057410 - DNA, 22 bp, Homo sapiens
tgcttatttttataattaaaga

SEQ ID NO: 1057411 - DNA, 17 bp, Homo sapiens
tgcttcaaatccatcca

SEQ ID NO: 1057412 - DNA, 22 bp, Homo sapiens
tgcttcaacaactttgtgcttt

SEQ ID NO: 1057413 - DNA, 16 bp, Homo sapiens
tgcttcaataaatctt

SEQ ID NO: 1057414 - DNA, 22 bp, Homo sapiens
tgcttcaataaatctttggaaa

SEQ ID NO: 1057415 - DNA, 16 bp, Homo sapiens
tgcttcaattaaaatt

SEQ ID NO: 1057416 - DNA, 19 bp, Homo sapiens
tgcttcaattaaaattaca

SEQ ID NO: 1057417 - DNA, 21 bp, Homo sapiens
tgcttcaccatggccttatga

SEQ ID NO: 1057418 - DNA, 21 bp, Homo sapiens
tgcttcactcatgcaaactgc

SEQ ID NO: 1057419 - DNA, 16 bp, Homo sapiens
tgcttcagccctggcc

SEQ ID NO: 1057420 - DNA, 18 bp, Homo sapiens
tgcttcagccctggcccc

SEQ ID NO: 1057421 - DNA, 18 bp, Homo sapiens
tgcttcatagtattggag

SEQ ID NO: 1057422 - DNA, 19 bp, Homo sapiens
tgcttcatagtattggagc

SEQ ID NO: 1057423 - DNA, 21 bp, Homo sapiens
tgcttcatagtattggagcac

SEQ ID NO: 1057424 - DNA, 17 bp, Homo sapiens
tgcttcatcattccctc

SEQ ID NO: 1057425 - DNA, 15 bp, Homo sapiens
tgcttcattcaatat

SEQ ID NO: 1057426 - DNA, 18 bp, Homo sapiens
tgcttcattctttgcagg

SEQ ID NO: 1057427 - DNA, 20 bp, Homo sapiens
tgcttcatttgtatgtcaaa

SEQ ID NO: 1057428 - DNA, 15 bp, Homo sapiens
tgcttcattttggag

SEQ ID NO: 1057429 - DNA, 16 bp, Homo sapiens
tgcttcattttggagc

SEQ ID NO: 1057430 - DNA, 17 bp, Homo sapiens
tgcttcattttggagct

SEQ ID NO: 1057431 - DNA, 19 bp, Homo sapiens
tgcttccaacaaggacagc

SEQ ID NO: 1057432 - DNA, 16 bp, Homo sapiens
tgcttccaggaaactc

SEQ ID NO: 1057433 - DNA, 19 bp, Homo sapiens
tgcttccaggaaactccac

SEQ ID NO: 1057434 - DNA, 13 bp, Homo sapiens
tgcttccattatt

SEQ ID NO: 1057435 - DNA, 14 bp, Homo sapiens
tgcttcccatccta

SEQ ID NO: 1057436 - DNA, 16 bp, Homo sapiens
tgcttcccatcctacc

SEQ ID NO: 1057437 - DNA, 20 bp, Homo sapiens
tgcttcccccacccctccac

SEQ ID NO: 1057438 - DNA, 18 bp, Homo sapiens
tgcttccccttttgccaa

SEQ ID NO: 1057439 - DNA, 13 bp, Homo sapiens
tgcttccctctgc

SEQ ID NO: 1057440 - DNA, 15 bp, Homo sapiens
tgcttccctctgcct

SEQ ID NO: 1057441 - DNA, 21 bp, Homo sapiens
tgcttccctctgcctgtccct

SEQ ID NO: 1057442 - DNA, 14 bp, Homo sapiens
tgcttccgccactc

SEQ ID NO: 1057443 - DNA, 23 bp, Homo sapiens
tgcttcctcccaacaagcagctg

SEQ ID NO: 1057444 - DNA, 18 bp, Homo sapiens
tgcttcctcctcaggccc

SEQ ID NO: 1057445 - DNA, 13 bp, Homo sapiens
tgcttcctgatta

SEQ ID NO: 1057446 - DNA, 14 bp, Homo sapiens
tgcttcctgctgta

SEQ ID NO: 1057447 - DNA, 16 bp, Homo sapiens
tgcttcctgctgtatg

SEQ ID NO: 1057448 - DNA, 22 bp, Homo sapiens
tgcttcctgtcttatcctccac

SEQ ID NO: 1057449 - DNA, 15 bp, Homo sapiens
tgcttcgggcccttc

SEQ ID NO: 1057450 - DNA, 18 bp, Homo sapiens
tgcttctaaatgcccagt

SEQ ID NO: 1057451 - DNA, 16 bp, Homo sapiens
tgcttctaagtaaata

SEQ ID NO: 1057452 - DNA, 19 bp, Homo sapiens
tgcttctaagtaaatacaa

SEQ ID NO: 1057453 - DNA, 22 bp, Homo sapiens
tgcttctagaaactctggctca

SEQ ID NO: 1057454 - DNA, 21 bp, Homo sapiens
tgcttctataattttgccttt

SEQ ID NO: 1057455 - DNA, 22 bp, Homo sapiens
tgcttctcagatttctgaggaa

SEQ ID NO: 1057456 - DNA, 18 bp, Homo sapiens
tgcttctcatcccaacct

SEQ ID NO: 1057457 - DNA, 17 bp, Homo sapiens
tgcttctccaacactga

SEQ ID NO: 1057458 - DNA, 21 bp, Homo sapiens
tgcttctccagtttttgagga

SEQ ID NO: 1057459 - DNA, 16 bp, Homo sapiens
tgcttctcccatttcc

SEQ ID NO: 1057460 - DNA, 13 bp, Homo sapiens
tgcttctcccggg

SEQ ID NO: 1057461 - DNA, 23 bp, Homo sapiens
tgcttctctagctctctaggcct

SEQ ID NO: 1057462 - DNA, 19 bp, Homo sapiens
tgcttctctcagccagctg

SEQ ID NO: 1057463 - DNA, 17 bp, Homo sapiens
tgcttctctgacttctg

SEQ ID NO: 1057464 - DNA, 20 bp, Homo sapiens
tgcttctctgacttctgcct

SEQ ID NO: 1057465 - DNA, 18 bp, Homo sapiens
tgcttctcttctttccat

SEQ ID NO: 1057466 - DNA, 11 bp, Homo sapiens
tgcttctcttt

SEQ ID NO: 1057467 - DNA, 17 bp, Homo sapiens
tgcttctctttgtgcag

SEQ ID NO: 1057468 - DNA, 18 bp, Homo sapiens
tgcttctctttgtgcagt

SEQ ID NO: 1057469 - DNA, 13 bp, Homo sapiens
tgcttctgctcca

SEQ ID NO: 1057470 - DNA, 16 bp, Homo sapiens
tgcttctgctgcctag

SEQ ID NO: 1057471 - DNA, 20 bp, Homo sapiens
tgcttctgtagtactcctta

SEQ ID NO: 1057472 - DNA, 15 bp, Homo sapiens
tgcttctgtccagga

SEQ ID NO: 1057473 - DNA, 23 bp, Homo sapiens
tgcttctgttgtaatagtccatg

SEQ ID NO: 1057474 - DNA, 15 bp, Homo sapiens
tgcttcttactgata

SEQ ID NO: 1057475 - DNA, 21 bp, Homo sapiens
tgcttcttggagctttggaat

SEQ ID NO: 1057476 - DNA, 23 bp, Homo sapiens
tgcttgaaattactgtgtaaata

SEQ ID NO: 1057477 - DNA, 20 bp, Homo sapiens
tgcttgagcctggctgtcca

SEQ ID NO: 1057478 - DNA, 15 bp, Homo sapiens
tgcttgataatatat

SEQ ID NO: 1057479 - DNA, 17 bp, Homo sapiens
tgcttgataatatataa

SEQ ID NO: 1057480 - DNA, 14 bp, Homo sapiens
tgcttgatgaagca

SEQ ID NO: 1057481 - DNA, 17 bp, Homo sapiens
tgcttgatgaagcaagg

SEQ ID NO: 1057482 - DNA, 12 bp, Homo sapiens
tgcttgattttt

SEQ ID NO: 1057483 - DNA, 20 bp, Homo sapiens
tgcttgcaatctaatctgaa

SEQ ID NO: 1057484 - DNA, 15 bp, Homo sapiens
tgcttgcacacttcc

SEQ ID NO: 1057485 - DNA, 18 bp, Homo sapiens
tgcttgcacacttcccca

SEQ ID NO: 1057486 - DNA, 21 bp, Homo sapiens
tgcttgcacacttccccatct

SEQ ID NO: 1057487 - DNA, 22 bp, Homo sapiens
tgcttgcactttgtaacatgtt

SEQ ID NO: 1057488 - DNA, 16 bp, Homo sapiens
tgcttgcagccaggag

SEQ ID NO: 1057489 - DNA, 16 bp, Homo sapiens
tgcttgcataagagct

SEQ ID NO: 1057490 - DNA, 17 bp, Homo sapiens
tgcttgcataagagctt

SEQ ID NO: 1057491 - DNA, 17 bp, Homo sapiens
tgcttgcatcctatttg

SEQ ID NO: 1057492 - DNA, 15 bp, Homo sapiens
tgcttgccaaagtac

SEQ ID NO: 1057493 - DNA, 15 bp, Homo sapiens
tgcttgcccgctccc

SEQ ID NO: 1057494 - DNA, 14 bp, Homo sapiens
tgcttgccgagcct

SEQ ID NO: 1057495 - DNA, 20 bp, Homo sapiens
tgcttgccgagcctaatgaa

SEQ ID NO: 1057496 - DNA, 19 bp, Homo sapiens
tgcttgcctagggcctggt

SEQ ID NO: 1057497 - DNA, 12 bp, Homo sapiens
tgcttgcctgaa

SEQ ID NO: 1057498 - DNA, 15 bp, Homo sapiens
tgcttgcctgaagct

SEQ ID NO: 1057499 - DNA, 18 bp, Homo sapiens
tgcttgcggcaaaaggaa

SEQ ID NO: 1057500 - DNA, 18 bp, Homo sapiens
tgcttgctcatatgcatg

SEQ ID NO: 1057501 - DNA, 24 bp, Homo sapiens
tgcttgcttagagtgcccagcaga

SEQ ID NO: 1057502 - DNA, 13 bp, Homo sapiens
tgcttgcttgggg

SEQ ID NO: 1057503 - DNA, 19 bp, Homo sapiens
tgcttgctttcttttttaa

SEQ ID NO: 1057504 - DNA, 22 bp, Homo sapiens
tgcttgcttttgcctctgccca

SEQ ID NO: 1057505 - DNA, 14 bp, Homo sapiens
tgcttggaagccag

SEQ ID NO: 1057506 - DNA, 16 bp, Homo sapiens
tgcttggaagccaggt

SEQ ID NO: 1057507 - DNA, 21 bp, Homo sapiens
tgcttggattctctgagaaat

SEQ ID NO: 1057508 - DNA, 12 bp, Homo sapiens
tgcttggccaga

SEQ ID NO: 1057509 - DNA, 18 bp, Homo sapiens
tgcttgggaccagaagtg

SEQ ID NO: 1057510 - DNA, 13 bp, Homo sapiens
tgcttgggctcca

SEQ ID NO: 1057511 - DNA, 14 bp, Homo sapiens
tgcttgggctccac

SEQ ID NO: 1057512 - DNA, 21 bp, Homo sapiens
tgcttgggctgacccagcatc

SEQ ID NO: 1057513 - DNA, 15 bp, Homo sapiens
tgcttggtggggctc

SEQ ID NO: 1057514 - DNA, 18 bp, Homo sapiens
tgcttggttggctggcag

SEQ ID NO: 1057515 - DNA, 19 bp, Homo sapiens
tgcttgtaacaagaaaaca

SEQ ID NO: 1057516 - DNA, 15 bp, Homo sapiens
tgcttgtaactaaaa

SEQ ID NO: 1057517 - DNA, 19 bp, Homo sapiens
tgcttgtattgtaaatgtg

SEQ ID NO: 1057518 - DNA, 13 bp, Homo sapiens
tgcttgtcagtgg

SEQ ID NO: 1057519 - DNA, 21 bp, Homo sapiens
tgcttgtcatctgcatgtcta

SEQ ID NO: 1057520 - DNA, 16 bp, Homo sapiens
tgcttgtcattccaga

SEQ ID NO: 1057521 - DNA, 16 bp, Homo sapiens
tgcttgtcctgggcct

SEQ ID NO: 1057522 - DNA, 12 bp, Homo sapiens
tgcttgtgcctc

SEQ ID NO: 1057523 - DNA, 14 bp, Homo sapiens
tgcttgtgcctccc

SEQ ID NO: 1057524 - DNA, 18 bp, Homo sapiens
tgcttgtgcctcccttcc

SEQ ID NO: 1057525 - DNA, 14 bp, Homo sapiens
tgcttgttggattt

SEQ ID NO: 1057526 - DNA, 15 bp, Homo sapiens
tgcttgttgggattc

SEQ ID NO: 1057527 - DNA, 13 bp, Homo sapiens
tgcttgtttatga

SEQ ID NO: 1057528 - DNA, 14 bp, Homo sapiens
tgcttgtttatgat

SEQ ID NO: 1057529 - DNA, 18 bp, Homo sapiens
tgcttgtttatgatattt

SEQ ID NO: 1057530 - DNA, 20 bp, Homo sapiens
tgcttgtttatgatatttct

SEQ ID NO: 1057531 - DNA, 19 bp, Homo sapiens
tgctttaaagggcctgcct

SEQ ID NO: 1057532 - DNA, 20 bp, Homo sapiens
tgctttaaagggcctgcctg

SEQ ID NO: 1057533 - DNA, 23 bp, Homo sapiens
tgctttaattaattaagtatctg

SEQ ID NO: 1057534 - DNA, 21 bp, Homo sapiens
tgctttaccttttcagggctg

SEQ ID NO: 1057535 - DNA, 22 bp, Homo sapiens
tgctttacttaaagttgatttt

SEQ ID NO: 1057536 - DNA, 15 bp, Homo sapiens
tgctttagaaaacat

SEQ ID NO: 1057537 - DNA, 13 bp, Homo sapiens
tgctttagcttga

SEQ ID NO: 1057538 - DNA, 18 bp, Homo sapiens
tgctttagtatgctggct

SEQ ID NO: 1057539 - DNA, 18 bp, Homo sapiens
tgctttattgaattagaa

SEQ ID NO: 1057540 - DNA, 19 bp, Homo sapiens
tgctttattgaattagaaa

SEQ ID NO: 1057541 - DNA, 16 bp, Homo sapiens
tgctttattgcttttt

SEQ ID NO: 1057542 - DNA, 24 bp, Homo sapiens
tggaaacctgccctgcctgagggc

SEQ ID NO: 1057543 - DNA, 18 bp, Homo sapiens
tggaaacggtatcctccc

SEQ ID NO: 1057544 - DNA, 21 bp, Homo sapiens
tggaaactatgtgtttttctc

SEQ ID NO: 1057545 - DNA, 19 bp, Homo sapiens
tggaaactgctaaattcta

SEQ ID NO: 1057546 - DNA, 20 bp, Homo sapiens
tggaaactgctaaattctat

SEQ ID NO: 1057547 - DNA, 21 bp, Homo sapiens
tggaaactgctaaattctatg

SEQ ID NO: 1057548 - DNA, 14 bp, Homo sapiens
tggaaactgctccc

SEQ ID NO: 1057549 - DNA, 14 bp, Homo sapiens
tggaaactgtaaaa

SEQ ID NO: 1057550 - DNA, 22 bp, Homo sapiens
tggaaacttttgttagggctgc

SEQ ID NO: 1057551 - DNA, 22 bp, Homo sapiens
tggaaagacgtttttgtgctgt

SEQ ID NO: 1057552 - DNA, 13 bp, Homo sapiens
tggaaagagacca

SEQ ID NO: 1057553 - DNA, 15 bp, Homo sapiens
tggaaagcaaagggc

SEQ ID NO: 1057554 - DNA, 20 bp, Homo sapiens
tggaaagcatcacctcaggc

SEQ ID NO: 1057555 - DNA, 16 bp, Homo sapiens
tggaaagcctctgctg

SEQ ID NO: 1057556 - DNA, 18 bp, Homo sapiens
tggaaagcctctgctgcc

SEQ ID NO: 1057557 - DNA, 13 bp, Homo sapiens
tggaaaggggaga

SEQ ID NO: 1057558 - DNA, 21 bp, Homo sapiens
tggaaaggggagagcctgctg

SEQ ID NO: 1057559 - DNA, 13 bp, Homo sapiens
tggaaagtcagaa

SEQ ID NO: 1057560 - DNA, 20 bp, Homo sapiens
tggaaagtgaatttgaatga

SEQ ID NO: 1057561 - DNA, 12 bp, Homo sapiens
tggaaataaagt

SEQ ID NO: 1057562 - DNA, 15 bp, Homo sapiens
tggaaataaatgtat

SEQ ID NO: 1057563 - DNA, 15 bp, Homo sapiens
tggaaatacacagtg

SEQ ID NO: 1057564 - DNA, 22 bp, Homo sapiens
tggaaatagaaagaagccatat

SEQ ID NO: 1057565 - DNA, 16 bp, Homo sapiens
tggaaatagcatgaca

SEQ ID NO: 1057566 - DNA, 20 bp, Homo sapiens
tggaaatattaagaaagact

SEQ ID NO: 1057567 - DNA, 23 bp, Homo sapiens
tggaaatattcatgcttcttcct

SEQ ID NO: 1057568 - DNA, 16 bp, Homo sapiens
tggaaatgtagcactt

SEQ ID NO: 1057569 - DNA, 13 bp, Homo sapiens
tggaaatgtctgc

SEQ ID NO: 1057570 - DNA, 16 bp, Homo sapiens
tggaaatgtctgctgg

SEQ ID NO: 1057571 - DNA, 17 bp, Homo sapiens
tggaaatgtctgctggt

SEQ ID NO: 1057572 - DNA, 18 bp, Homo sapiens
tggaaatgtctgctggta

SEQ ID NO: 1057573 - DNA, 22 bp, Homo sapiens
tggaaattaggttgaaacatat

SEQ ID NO: 1057574 - DNA, 13 bp, Homo sapiens
tggaaatttaaag

SEQ ID NO: 1057575 - DNA, 14 bp, Homo sapiens
tggaaatttaaagc

SEQ ID NO: 1057576 - DNA, 21 bp, Homo sapiens
tggaaatttgttataatgaat

SEQ ID NO: 1057577 - DNA, 13 bp, Homo sapiens
tggaaattttagt

SEQ ID NO: 1057578 - DNA, 18 bp, Homo sapiens
tggaaattttagttatag

SEQ ID NO: 1057579 - DNA, 21 bp, Homo sapiens
tggaaattttatatgtaaatg

SEQ ID NO: 1057580 - DNA, 23 bp, Homo sapiens
tggaaattttatatgtaaatgtg

SEQ ID NO: 1057581 - DNA, 21 bp, Homo sapiens
tggaacaaaagttcgaaagaa

SEQ ID NO: 1057582 - DNA, 16 bp, Homo sapiens
tggaacaagacagcct

SEQ ID NO: 1057583 - DNA, 18 bp, Homo sapiens
tggaacaagacagccttc

SEQ ID NO: 1057584 - DNA, 13 bp, Homo sapiens
tggaacagcggga

SEQ ID NO: 1057585 - DNA, 20 bp, Homo sapiens
tggaacagtcacccttctgg

SEQ ID NO: 1057586 - DNA, 18 bp, Homo sapiens
tggaacataaaaaggaca

SEQ ID NO: 1057587 - DNA, 15 bp, Homo sapiens
tggaataacatgtaa

SEQ ID NO: 1057588 - DNA, 14 bp, Homo sapiens
tggaataactatct

SEQ ID NO: 1057589 - DNA, 14 bp, Homo sapiens
tggaataagacaga

SEQ ID NO: 1057590 - DNA, 18 bp, Homo sapiens
tggaataaggcatggctc

SEQ ID NO: 1057591 - DNA, 15 bp, Homo sapiens
tggaataagttcaaa

SEQ ID NO: 1057592 - DNA, 19 bp, Homo sapiens
tggaataatatgatgccac

SEQ ID NO: 1057593 - DNA, 14 bp, Homo sapiens
tggaataatgtaaa

SEQ ID NO: 1057594 - DNA, 15 bp, Homo sapiens
tggaataatttctat

SEQ ID NO: 1057595 - DNA, 15 bp, Homo sapiens
tggaataatttgtaa

SEQ ID NO: 1057596 - DNA, 13 bp, Homo sapiens
tggaatacttttt

SEQ ID NO: 1057597 - DNA, 15 bp, Homo sapiens
tggaatataaaacag

SEQ ID NO: 1057598 - DNA, 22 bp, Homo sapiens
tggaatataattgttttatctg

SEQ ID NO: 1057599 - DNA, 15 bp, Homo sapiens
tggaatatataacca

SEQ ID NO: 1057600 - DNA, 16 bp, Homo sapiens
tggaatatataaccag

SEQ ID NO: 1057601 - DNA, 23 bp, Homo sapiens
tggaatatcttatattgggcgat

SEQ ID NO: 1057602 - DNA, 13 bp, Homo sapiens
tggaatattaaaa

SEQ ID NO: 1057603 - DNA, 15 bp, Homo sapiens
tggaatattgtccat

SEQ ID NO: 1057604 - DNA, 20 bp, Homo sapiens
tggaatattgtccattgtcc

SEQ ID NO: 1057605 - DNA, 14 bp, Homo sapiens
tggaatatttgaat

SEQ ID NO: 1057606 - DNA, 16 bp, Homo sapiens
tggaatattttatcct

SEQ ID NO: 1057607 - DNA, 18 bp, Homo sapiens
tggaatattttatcctgt

SEQ ID NO: 1057608 - DNA, 19 bp, Homo sapiens
tggaatattttatcctgta

SEQ ID NO: 1057609 - DNA, 22 bp, Homo sapiens
tggaatcaggaatattttccaa

SEQ ID NO: 1057610 - DNA, 19 bp, Homo sapiens
tggaatcagtatttccttc

SEQ ID NO: 1057611 - DNA, 22 bp, Homo sapiens
tggaatcgaagtgtttatgtaa

SEQ ID NO: 1057612 - DNA, 18 bp, Homo sapiens
tggaatcgatttcctccc

SEQ ID NO: 1057613 - DNA, 17 bp, Homo sapiens
tggaatctaagctgttt

SEQ ID NO: 1057614 - DNA, 16 bp, Homo sapiens
tggaatctacaagcca

SEQ ID NO: 1057615 - DNA, 18 bp, Homo sapiens
tggaatcttcacctcaga

SEQ ID NO: 1057616 - DNA, 20 bp, Homo sapiens
tggaatcttcacctcagagt

SEQ ID NO: 1057617 - DNA, 20 bp, Homo sapiens
tggaatcttctctttgacaa

SEQ ID NO: 1057618 - DNA, 22 bp, Homo sapiens
tggaatcttctctttgacaatt

SEQ ID NO: 1057619 - DNA, 13 bp, Homo sapiens
tggaatcttgctg

SEQ ID NO: 1057620 - DNA, 15 bp, Homo sapiens
tggaatcttgctgca

SEQ ID NO: 1057621 - DNA, 22 bp, Homo sapiens
tggaatcttgctgcaggccctc

SEQ ID NO: 1057622 - DNA, 16 bp, Homo sapiens
tggaatgaagaaattg

SEQ ID NO: 1057623 - DNA, 18 bp, Homo sapiens
tggaatgaattaaataaa

SEQ ID NO: 1057624 - DNA, 20 bp, Homo sapiens
tggaatgcagaggtctccaa

SEQ ID NO: 1057625 - DNA, 17 bp, Homo sapiens
tggaatgcccttcactg

SEQ ID NO: 1057626 - DNA, 13 bp, Homo sapiens
tggaatggaaaag

SEQ ID NO: 1057627 - DNA, 21 bp, Homo sapiens
tggaatggaactactgtactt

SEQ ID NO: 1057628 - DNA, 15 bp, Homo sapiens
tggaatggacatcct

SEQ ID NO: 1057629 - DNA, 13 bp, Homo sapiens
tggaatgtgccac

SEQ ID NO: 1057630 - DNA, 18 bp, Homo sapiens
tggaatgtgcccctggcc

SEQ ID NO: 1057631 - DNA, 18 bp, Homo sapiens
tggaattaaaacaaaaca

SEQ ID NO: 1057632 - DNA, 18 bp, Homo sapiens
tggaattaaccatttaat

SEQ ID NO: 1057633 - DNA, 16 bp, Homo sapiens
tggaattaacctggtg

SEQ ID NO: 1057634 - DNA, 20 bp, Homo sapiens
tggaattaacctggtgctgg

SEQ ID NO: 1057635 - DNA, 19 bp, Homo sapiens
tggaattacaagccctggg

SEQ ID NO: 1057636 - DNA, 23 bp, Homo sapiens
tggaattattgtaccattttcta

SEQ ID NO: 1057637 - DNA, 17 bp, Homo sapiens
tggaattattgtagaca

SEQ ID NO: 1057638 - DNA, 16 bp, Homo sapiens
tggaattcacaaagta

SEQ ID NO: 1057639 - DNA, 13 bp, Homo sapiens
tggaattcagcac

SEQ ID NO: 1057640 - DNA, 15 bp, Homo sapiens
tggaattccctcctg

SEQ ID NO: 1057641 - DNA, 17 bp, Homo sapiens
tggaattccctcctgag

SEQ ID NO: 1057642 - DNA, 21 bp, Homo sapiens
tggaattcgtgttatgaatct

SEQ ID NO: 1057643 - DNA, 13 bp, Homo sapiens
tggaattctaaca

SEQ ID NO: 1057644 - DNA, 22 bp, Homo sapiens
tggaattcttagtcacaaaata

SEQ ID NO: 1057645 - DNA, 13 bp, Homo sapiens
tggaattcttcct

SEQ ID NO: 1057646 - DNA, 15 bp, Homo sapiens
tggaattcttcctcc

SEQ ID NO: 1057647 - DNA, 19 bp, Homo sapiens
tggaattcttcctcctctg

SEQ ID NO: 1057648 - DNA, 15 bp, Homo sapiens
tggaattgatttgca

SEQ ID NO: 1057649 - DNA, 16 bp, Homo sapiens
tggaattgatttgcat

SEQ ID NO: 1057650 - DNA, 18 bp, Homo sapiens
tggaattgatttgcattg

SEQ ID NO: 1057651 - DNA, 19 bp, Homo sapiens
tggaattgatttgcattga

SEQ ID NO: 1057652 - DNA, 22 bp, Homo sapiens
tggaattgatttgcattgaaca

SEQ ID NO: 1057653 - DNA, 23 bp, Homo sapiens
tggaattgatttgcattgaacac

SEQ ID NO: 1057654 - DNA, 16 bp, Homo sapiens
tggaattgcttaccaa

SEQ ID NO: 1057655 - DNA, 18 bp, Homo sapiens
tggaattgcttaccaaag

SEQ ID NO: 1057656 - DNA, 18 bp, Homo sapiens
tggaattgcttctgtgta

SEQ ID NO: 1057657 - DNA, 19 bp, Homo sapiens
tggaattggtgtatatcat

SEQ ID NO: 1057658 - DNA, 13 bp, Homo sapiens
tggaattgtggct

SEQ ID NO: 1057659 - DNA, 19 bp, Homo sapiens
tggaatttaccagttaatt

SEQ ID NO: 1057660 - DNA, 23 bp, Homo sapiens
tggaatttacctccccttttcta

SEQ ID NO: 1057661 - DNA, 23 bp, Homo sapiens
tggaatttattggcagccaagga

SEQ ID NO: 1057662 - DNA, 17 bp, Homo sapiens
tggaattttgagaaaaa

SEQ ID NO: 1057663 - DNA, 15 bp, Homo sapiens
tggaattttgcaaag

SEQ ID NO: 1057664 - DNA, 20 bp, Homo sapiens
tggacaaagaattccaaagc

SEQ ID NO: 1057665 - DNA, 22 bp, Homo sapiens
tggacaaatcacatattttaaa

SEQ ID NO: 1057666 - DNA, 13 bp, Homo sapiens
tggacaacactga

SEQ ID NO: 1057667 - DNA, 14 bp, Homo sapiens
tggacaacactgat

SEQ ID NO: 1057668 - DNA, 22 bp, Homo sapiens
tggacaagcagaggtggccaga

SEQ ID NO: 1057669 - DNA, 22 bp, Homo sapiens
tggacaagcagtgtctgtcagc

SEQ ID NO: 1057670 - DNA, 17 bp, Homo sapiens
tggacaagccaacttgt

SEQ ID NO: 1057671 - DNA, 16 bp, Homo sapiens
tggacaatcatgaaat

SEQ ID NO: 1057672 - DNA, 18 bp, Homo sapiens
tggacaatctcacacctt

SEQ ID NO: 1057673 - DNA, 23 bp, Homo sapiens
tggacacaataggtctttctctc

SEQ ID NO: 1057674 - DNA, 14 bp, Homo sapiens
tgctttatttgtaa

SEQ ID NO: 1057675 - DNA, 14 bp, Homo sapiens
tgctttcattatgt

SEQ ID NO: 1057676 - DNA, 12 bp, Homo sapiens
tgctttccaagc

SEQ ID NO: 1057677 - DNA, 20 bp, Homo sapiens
tgctttcccctgtggggatc

SEQ ID NO: 1057678 - DNA, 20 bp, Homo sapiens
tgctttccgtggcactgcat

SEQ ID NO: 1057679 - DNA, 15 bp, Homo sapiens
tgctttcctatctag

SEQ ID NO: 1057680 - DNA, 16 bp, Homo sapiens
tgctttcctgggcctt

SEQ ID NO: 1057681 - DNA, 18 bp, Homo sapiens
tgctttccttttctctgc

SEQ ID NO: 1057682 - DNA, 20 bp, Homo sapiens
tgctttcgtctccagcccct

SEQ ID NO: 1057683 - DNA, 23 bp, Homo sapiens
tgctttctgaagctttaccagct

SEQ ID NO: 1057684 - DNA, 16 bp, Homo sapiens
tgctttctgcatgctt

SEQ ID NO: 1057685 - DNA, 14 bp, Homo sapiens
tgctttctgctcag

SEQ ID NO: 1057686 - DNA, 15 bp, Homo sapiens
tgctttctgctcagc

SEQ ID NO: 1057687 - DNA, 19 bp, Homo sapiens
tgctttctgctcagcttct

SEQ ID NO: 1057688 - DNA, 13 bp, Homo sapiens
tgctttcttgtct

SEQ ID NO: 1057689 - DNA, 22 bp, Homo sapiens
tgctttctttccgtcaccctgg

SEQ ID NO: 1057690 - DNA, 15 bp, Homo sapiens
tgctttctttcgttt

SEQ ID NO: 1057691 - DNA, 18 bp, Homo sapiens
tgctttgaactttagttt

SEQ ID NO: 1057692 - DNA, 15 bp, Homo sapiens
tgctttgaagcagtt

SEQ ID NO: 1057693 - DNA, 13 bp, Homo sapiens
tgctttgatattt

SEQ ID NO: 1057694 - DNA, 17 bp, Homo sapiens
tgctttgatatttcaat

SEQ ID NO: 1057695 - DNA, 14 bp, Homo sapiens
tgctttgcacagga

SEQ ID NO: 1057696 - DNA, 14 bp, Homo sapiens
tgctttgcattact

SEQ ID NO: 1057697 - DNA, 12 bp, Homo sapiens
tgctttgcattt

SEQ ID NO: 1057698 - DNA, 15 bp, Homo sapiens
tgctttgcattttct

SEQ ID NO: 1057699 - DNA, 21 bp, Homo sapiens
tgctttgccaagttgctgtca

SEQ ID NO: 1057700 - DNA, 17 bp, Homo sapiens
tgctttgccagagcagg

SEQ ID NO: 1057701 - DNA, 15 bp, Homo sapiens
tgctttgcccaagat

SEQ ID NO: 1057702 - DNA, 13 bp, Homo sapiens
tgctttgctcttg

SEQ ID NO: 1057703 - DNA, 20 bp, Homo sapiens
tgctttgctgcacagcagga

SEQ ID NO: 1057704 - DNA, 12 bp, Homo sapiens
tgctttgctgct

SEQ ID NO: 1057705 - DNA, 21 bp, Homo sapiens
tgctttgctgctatgaaaatg

SEQ ID NO: 1057706 - DNA, 12 bp, Homo sapiens
tgctttggaaac

SEQ ID NO: 1057707 - DNA, 18 bp, Homo sapiens
tgctttggacctaaatgg

SEQ ID NO: 1057708 - DNA, 22 bp, Homo sapiens
tgctttggacctaaatggcctc

SEQ ID NO: 1057709 - DNA, 19 bp, Homo sapiens
tgctttgggaggccaaggc

SEQ ID NO: 1057710 - DNA, 15 bp, Homo sapiens
tgctttgggctgccc

SEQ ID NO: 1057711 - DNA, 17 bp, Homo sapiens
tgctttgggctgccctg

SEQ ID NO: 1057712 - DNA, 19 bp, Homo sapiens
tgctttgggctgccctggt

SEQ ID NO: 1057713 - DNA, 18 bp, Homo sapiens
tgctttgggctttgcagg

SEQ ID NO: 1057714 - DNA, 22 bp, Homo sapiens
tgctttgggctttgcaggctct

SEQ ID NO: 1057715 - DNA, 23 bp, Homo sapiens
tgctttgggctttgcaggctctg

SEQ ID NO: 1057716 - DNA, 19 bp, Homo sapiens
tgctttggggggtgtgctg

SEQ ID NO: 1057717 - DNA, 18 bp, Homo sapiens
tgctttggttaatacatc

SEQ ID NO: 1057718 - DNA, 16 bp, Homo sapiens
tgctttgtaaattgtg

SEQ ID NO: 1057719 - DNA, 22 bp, Homo sapiens
tgctttgtaaattgtgttgtct

SEQ ID NO: 1057720 - DNA, 17 bp, Homo sapiens
tgctttgtctggcctca

SEQ ID NO: 1057721 - DNA, 12 bp, Homo sapiens
tgctttgtgatt

SEQ ID NO: 1057722 - DNA, 20 bp, Homo sapiens
tgctttgtgcatatgttaaa

SEQ ID NO: 1057723 - DNA, 16 bp, Homo sapiens
tgcttttaactctaga

SEQ ID NO: 1057724 - DNA, 17 bp, Homo sapiens
tgcttttaactctagaa

SEQ ID NO: 1057725 - DNA, 18 bp, Homo sapiens
tgcttttatatggcccag

SEQ ID NO: 1057726 - DNA, 14 bp, Homo sapiens
tgcttttcaaatgt

SEQ ID NO: 1057727 - DNA, 23 bp, Homo sapiens
tgcttttcaaatgtttgaaaaca

SEQ ID NO: 1057728 - DNA, 17 bp, Homo sapiens
tgcttttcactttctgt

SEQ ID NO: 1057729 - DNA, 21 bp, Homo sapiens
tgcttttcactttctgtctag

SEQ ID NO: 1057730 - DNA, 23 bp, Homo sapiens
tgcttttcatcaccgtcccgcac

SEQ ID NO: 1057731 - DNA, 20 bp, Homo sapiens
tggactccggaggactgagc

SEQ ID NO: 1057732 - DNA, 22 bp, Homo sapiens
tggactccggaggactgagccc

SEQ ID NO: 1057733 - DNA, 23 bp, Homo sapiens
tggactccggaggactgagcccc

SEQ ID NO: 1057734 - DNA, 14 bp, Homo sapiens
tggactccggccct

SEQ ID NO: 1057735 - DNA, 17 bp, Homo sapiens
tggactccggccctcct

SEQ ID NO: 1057736 - DNA, 14 bp, Homo sapiens
tggactcctctgtc

SEQ ID NO: 1057737 - DNA, 18 bp, Homo sapiens
tggactcctgccaccagc

SEQ ID NO: 1057738 - DNA, 23 bp, Homo sapiens
tggactctaagctggagctcttg

SEQ ID NO: 1057739 - DNA, 23 bp, Homo sapiens
tggactctagtccttggctggac

SEQ ID NO: 1057740 - DNA, 20 bp, Homo sapiens
tggactctgcatcccagcac

SEQ ID NO: 1057741 - DNA, 13 bp, Homo sapiens
tggactctgcccc

SEQ ID NO: 1057742 - DNA, 19 bp, Homo sapiens
tggactctgccccaatcgg

SEQ ID NO: 1057743 - DNA, 15 bp, Homo sapiens
tggactgaagcctgc

SEQ ID NO: 1057744 - DNA, 19 bp, Homo sapiens
tggactgaagcctgcagga

SEQ ID NO: 1057745 - DNA, 14 bp, Homo sapiens
tggactgacagcat

SEQ ID NO: 1057746 - DNA, 21 bp, Homo sapiens
tggactgacagcatgtgccct

SEQ ID NO: 1057747 - DNA, 16 bp, Homo sapiens
tggactgaccctgcag

SEQ ID NO: 1057748 - DNA, 19 bp, Homo sapiens
tggactgagccaaggaggc

SEQ ID NO: 1057749 - DNA, 23 bp, Homo sapiens
tggactgagccaaggaggcctgg

SEQ ID NO: 1057750 - DNA, 17 bp, Homo sapiens
tggactgagtgggaagc

SEQ ID NO: 1057751 - DNA, 19 bp, Homo sapiens
tggactgcagaagcaaggg

SEQ ID NO: 1057752 - DNA, 13 bp, Homo sapiens
tggactgcatggg

SEQ ID NO: 1057753 - DNA, 19 bp, Homo sapiens
tggactgcatggggaggca

SEQ ID NO: 1057754 - DNA, 16 bp, Homo sapiens
tggactgcgctggacg

SEQ ID NO: 1057755 - DNA, 14 bp, Homo sapiens
tggactggaagggg

SEQ ID NO: 1057756 - DNA, 17 bp, Homo sapiens
tggactggaggtgggca

SEQ ID NO: 1057757 - DNA, 20 bp, Homo sapiens
tggactggctagagtcctca

SEQ ID NO: 1057758 - DNA, 18 bp, Homo sapiens
tggactggctgtgcccct

SEQ ID NO: 1057759 - DNA, 19 bp, Homo sapiens
tggactggctgtgcccctg

SEQ ID NO: 1057760 - DNA, 13 bp, Homo sapiens
tggactgggaggt

SEQ ID NO: 1057761 - DNA, 12 bp, Homo sapiens
tggactgtagaa

SEQ ID NO: 1057762 - DNA, 13 bp, Homo sapiens
tggactgtctttt

SEQ ID NO: 1057763 - DNA, 19 bp, Homo sapiens
tggactgtgaatttcaaaa

SEQ ID NO: 1057764 - DNA, 20 bp, Homo sapiens
tggactgtgaatttcaaaaa

SEQ ID NO: 1057765 - DNA, 17 bp, Homo sapiens
tggactgtgctggtgca

SEQ ID NO: 1057766 - DNA, 18 bp, Homo sapiens
tggactgttcacggcaga

SEQ ID NO: 1057767 - DNA, 18 bp, Homo sapiens
tggactgttccaggccct

SEQ ID NO: 1057768 - DNA, 12 bp, Homo sapiens
tggactgttttc

SEQ ID NO: 1057769 - DNA, 20 bp, Homo sapiens
tggactgttttctctcggct

SEQ ID NO: 1057770 - DNA, 23 bp, Homo sapiens
tggacttcacataagctcagaat

SEQ ID NO: 1057771 - DNA, 16 bp, Homo sapiens
tggacttgagaaagat

SEQ ID NO: 1057772 - DNA, 22 bp, Homo sapiens
tggacttgtatagtgagagagg

SEQ ID NO: 1057773 - DNA, 14 bp, Homo sapiens
tggacttgtatatt

SEQ ID NO: 1057774 - DNA, 17 bp, Homo sapiens
tggacttgtatatttgt

SEQ ID NO: 1057775 - DNA, 18 bp, Homo sapiens
tggacttgtatatttgta

SEQ ID NO: 1057776 - DNA, 21 bp, Homo sapiens
tggacttgtatatttgtacaa

SEQ ID NO: 1057777 - DNA, 16 bp, Homo sapiens
tggacttgttttaacg

SEQ ID NO: 1057778 - DNA, 16 bp, Homo sapiens
tggactttccaccccc

SEQ ID NO: 1057779 - DNA, 13 bp, Homo sapiens
tggactttcctgc

SEQ ID NO: 1057780 - DNA, 14 bp, Homo sapiens
tggactttcctgca

SEQ ID NO: 1057781 - DNA, 18 bp, Homo sapiens
tggactttcctgcaactc

SEQ ID NO: 1057782 - DNA, 19 bp, Homo sapiens
tggactttcctgcaactca

SEQ ID NO: 1057783 - DNA, 20 bp, Homo sapiens
tggacttttcgttaacattg

SEQ ID NO: 1057784 - DNA, 22 bp, Homo sapiens
tggagaaaaaaatcaaccctgc

SEQ ID NO: 1057785 - DNA, 13 bp, Homo sapiens
tggagaaaatggg

SEQ ID NO: 1057786 - DNA, 17 bp, Homo sapiens
tggagaaaatgggcggg

SEQ ID NO: 1057787 - DNA, 13 bp, Homo sapiens
tggagaaagaagt

SEQ ID NO: 1057788 - DNA, 17 bp, Homo sapiens
tggagaaagaagtggag

SEQ ID NO: 1057789 - DNA, 19 bp, Homo sapiens
tggagaaattatttaataa

SEQ ID NO: 1057790 - DNA, 20 bp, Homo sapiens
tggagaacgccagtctccca

SEQ ID NO: 1057791 - DNA, 11 bp, Homo sapiens
tggagaagaat

SEQ ID NO: 1057792 - DNA, 16 bp, Homo sapiens
tggagaagaatggctt

SEQ ID NO: 1057793 - DNA, 17 bp, Homo sapiens
tggagaagaatggcttt

SEQ ID NO: 1057794 - DNA, 14 bp, Homo sapiens
tggagaagatttat

SEQ ID NO: 1057795 - DNA, 11 bp, Homo sapiens
tggagaagcac

SEQ ID NO: 1057796 - DNA, 13 bp, Homo sapiens
tggagaagctgca

SEQ ID NO: 1057797 - DNA, 18 bp, Homo sapiens
tggagaagctgcaggctt

SEQ ID NO: 1057798 - DNA, 16 bp, Homo sapiens
tggagaagtctcagct

SEQ ID NO: 1057799 - DNA, 17 bp, Homo sapiens
tggagaagtctcagcta

SEQ ID NO: 1057800 - DNA, 21 bp, Homo sapiens
tggagaatactttgcttcata

SEQ ID NO: 1057801 - DNA, 22 bp, Homo sapiens
tggagaatgtatcagccagcct

SEQ ID NO: 1057802 - DNA, 17 bp, Homo sapiens
tggagacaaggtgctaa

SEQ ID NO: 1057803 - DNA, 18 bp, Homo sapiens
tggagaccctgccacagc

SEQ ID NO: 1057804 - DNA, 22 bp, Homo sapiens
tggagaccctgccacagccaga

SEQ ID NO: 1057805 - DNA, 23 bp, Homo sapiens
tggagaccctgccacagccagag

SEQ ID NO: 1057806 - DNA, 20 bp, Homo sapiens
tggagaccgcttcacccctg

SEQ ID NO: 1057807 - DNA, 22 bp, Homo sapiens
tggagaccgcttcacccctgca

SEQ ID NO: 1057808 - DNA, 22 bp, Homo sapiens
tggagacgtggaacctctgtct

SEQ ID NO: 1057809 - DNA, 23 bp, Homo sapiens
tggagacgtggaacctctgtctc

SEQ ID NO: 1057810 - DNA, 18 bp, Homo sapiens
tggagactcctgccctgt

SEQ ID NO: 1057811 - DNA, 17 bp, Homo sapiens
tggagactcctggtctg

SEQ ID NO: 1057812 - DNA, 19 bp, Homo sapiens
tggagactcctggtctgtg

SEQ ID NO: 1057813 - DNA, 20 bp, Homo sapiens
tggagactcctggtctgtga

SEQ ID NO: 1057814 - DNA, 14 bp, Homo sapiens
tggagactctgtgg

SEQ ID NO: 1057815 - DNA, 20 bp, Homo sapiens
tggagactgcttcccatcct

SEQ ID NO: 1057816 - DNA, 16 bp, Homo sapiens
tggagacttagggcac

SEQ ID NO: 1057817 - DNA, 17 bp, Homo sapiens
tggagactttctgttac

SEQ ID NO: 1057818 - DNA, 21 bp, Homo sapiens
tggagagagaggctgcctcag

SEQ ID NO: 1057819 - DNA, 21 bp, Homo sapiens
tggagagagattctgttgcat

SEQ ID NO: 1057820 - DNA, 12 bp, Homo sapiens
tggagagagggg

SEQ ID NO: 1057821 - DNA, 13 bp, Homo sapiens
tggagagagggga

SEQ ID NO: 1057822 - DNA, 16 bp, Homo sapiens
tggagagcaaaggccc

SEQ ID NO: 1057823 - DNA, 19 bp, Homo sapiens
tggagagcagcaggtgctg

SEQ ID NO: 1057824 - DNA, 21 bp, Homo sapiens
tggagaggaagccagtggagc

SEQ ID NO: 1057825 - DNA, 20 bp, Homo sapiens
tggagaggacggccctgcct

SEQ ID NO: 1057826 - DNA, 12 bp, Homo sapiens
tggagaggagag

SEQ ID NO: 1057827 - DNA, 22 bp, Homo sapiens
tggagaggagggatgctgcctg

SEQ ID NO: 1057828 - DNA, 16 bp, Homo sapiens
tggagaggccctctgg

SEQ ID NO: 1057829 - DNA, 13 bp, Homo sapiens
tggagaggcctgg

SEQ ID NO: 1057830 - DNA, 14 bp, Homo sapiens
tggagaggcctggg

SEQ ID NO: 1057831 - DNA, 16 bp, Homo sapiens
tggagagggggccgga

SEQ ID NO: 1057832 - DNA, 22 bp, Homo sapiens
tggagaggttataggtcactcc

SEQ ID NO: 1057833 - DNA, 15 bp, Homo sapiens
tggagagtaaaaact

SEQ ID NO: 1057834 - DNA, 16 bp, Homo sapiens
tggagagtcagatctt

SEQ ID NO: 1057835 - DNA, 18 bp, Homo sapiens
tggagagtgcggcgtggg

SEQ ID NO: 1057836 - DNA, 19 bp, Homo sapiens
tggagagtggggagaggca

SEQ ID NO: 1057837 - DNA, 16 bp, Homo sapiens
tggagatagctggggc

SEQ ID NO: 1057838 - DNA, 13 bp, Homo sapiens
tggagatagtgcc

SEQ ID NO: 1057839 - DNA, 21 bp, Homo sapiens
tggagatagtgccaggtggct

SEQ ID NO: 1057840 - DNA, 14 bp, Homo sapiens
tggagatctgaagg

SEQ ID NO: 1057841 - DNA, 16 bp, Homo sapiens
tggagatgaggccaga

SEQ ID NO: 1057842 - DNA, 24 bp, Homo sapiens
tggagatgaggccagaccatggac

SEQ ID NO: 1057843 - DNA, 21 bp, Homo sapiens
tggagatgcatcgggaaagaa

SEQ ID NO: 1057844 - DNA, 15 bp, Homo sapiens
tggagatggactcag

SEQ ID NO: 1057845 - DNA, 14 bp, Homo sapiens
tggagatggatcct

SEQ ID NO: 1057846 - DNA, 20 bp, Homo sapiens
tggagatggcaggagagctt

SEQ ID NO: 1057847 - DNA, 17 bp, Homo sapiens
tggagcaaaaggcagct

SEQ ID NO: 1057848 - DNA, 21 bp, Homo sapiens
tggagcaaaaggcagctcacc

SEQ ID NO: 1057849 - DNA, 23 bp, Homo sapiens
tggagcaaaaggcagctcacccc

SEQ ID NO: 1057850 - DNA, 19 bp, Homo sapiens
tggagcaaagaaggagctg

SEQ ID NO: 1057851 - DNA, 18 bp, Homo sapiens
tggagcaagaaggaagga

SEQ ID NO: 1057852 - DNA, 15 bp, Homo sapiens
tggagggtgaccaca

SEQ ID NO: 1057853 - DNA, 23 bp, Homo sapiens
tggaggtactgagacagggtgct

SEQ ID NO: 1057854 - DNA, 20 bp, Homo sapiens
tggaggtcggtaggttcagc

SEQ ID NO: 1057855 - DNA, 15 bp, Homo sapiens
tggaggtgagaaaag

SEQ ID NO: 1057856 - DNA, 23 bp, Homo sapiens
tggaggtgagatcacagcctcca

SEQ ID NO: 1057857 - DNA, 16 bp, Homo sapiens
tggaggtgctggtagc

SEQ ID NO: 1057858 - DNA, 20 bp, Homo sapiens
tggaggtgctggtagctgag

SEQ ID NO: 1057859 - DNA, 21 bp, Homo sapiens
tggaggtgggctgatggcctg

SEQ ID NO: 1057860 - DNA, 16 bp, Homo sapiens
tggaggttaaggcata

SEQ ID NO: 1057861 - DNA, 19 bp, Homo sapiens
tggaggttctcagagccaa

SEQ ID NO: 1057862 - DNA, 20 bp, Homo sapiens
tggaggttgcagtgagctga

SEQ ID NO: 1057863 - DNA, 22 bp, Homo sapiens
tggaggttgctgtacaggaaaa

SEQ ID NO: 1057864 - DNA, 15 bp, Homo sapiens
tggaggttgtgcatg

SEQ ID NO: 1057865 - DNA, 15 bp, Homo sapiens
tggagtaattgcaca

SEQ ID NO: 1057866 - DNA, 15 bp, Homo sapiens
tggagtacttagcta

SEQ ID NO: 1057867 - DNA, 22 bp, Homo sapiens
tggagtcatggtccggtgtcct

SEQ ID NO: 1057868 - DNA, 12 bp, Homo sapiens
tggagtcattca

SEQ ID NO: 1057869 - DNA, 14 bp, Homo sapiens
tggagtccagtgct

SEQ ID NO: 1057870 - DNA, 13 bp, Homo sapiens
tggagtcccaccc

SEQ ID NO: 1057871 - DNA, 13 bp, Homo sapiens
tggagtcctctcc

SEQ ID NO: 1057872 - DNA, 20 bp, Homo sapiens
tggagtctccagatgttaat

SEQ ID NO: 1057873 - DNA, 21 bp, Homo sapiens
tggagtctgagtctgagtcct

SEQ ID NO: 1057874 - DNA, 23 bp, Homo sapiens
tggagtctgtctctttcagtgct

SEQ ID NO: 1057875 - DNA, 22 bp, Homo sapiens
tggagtgagagcctttgccttt

SEQ ID NO: 1057876 - DNA, 19 bp, Homo sapiens
tggagtgaggcttccaggc

SEQ ID NO: 1057877 - DNA, 22 bp, Homo sapiens
tggagtgaggcttccaggctct

SEQ ID NO: 1057878 - DNA, 18 bp, Homo sapiens
tggagtgagtcacctgct

SEQ ID NO: 1057879 - DNA, 22 bp, Homo sapiens
tggagtgagtcacctgctccag

SEQ ID NO: 1057880 - DNA, 15 bp, Homo sapiens
tggagtgcagggagg

SEQ ID NO: 1057881 - DNA, 14 bp, Homo sapiens
tggagtgccctgca

SEQ ID NO: 1057882 - DNA, 17 bp, Homo sapiens
tggagtgccctgcaggc

SEQ ID NO: 1057883 - DNA, 12 bp, Homo sapiens
tggagtgcgctc

SEQ ID NO: 1057884 - DNA, 15 bp, Homo sapiens
tggagtgcgctcttg

SEQ ID NO: 1057885 - DNA, 16 bp, Homo sapiens
tggagtgctgcttgtg

SEQ ID NO: 1057886 - DNA, 22 bp, Homo sapiens
tggagtgctgcttgtgcctccc

SEQ ID NO: 1057887 - DNA, 22 bp, Homo sapiens
tggagtggccaaataggaggga

SEQ ID NO: 1057888 - DNA, 19 bp, Homo sapiens
tggagtgtatgactgcaca

SEQ ID NO: 1057889 - DNA, 18 bp, Homo sapiens
tggagtgtcggatcctgt

SEQ ID NO: 1057890 - DNA, 19 bp, Homo sapiens
tggagtgtcggatcctgtg

SEQ ID NO: 1057891 - DNA, 18 bp, Homo sapiens
tggagtgtgcagacagcc

SEQ ID NO: 1057892 - DNA, 22 bp, Homo sapiens
tggagtgtgtcagagcccaggg

SEQ ID NO: 1057893 - DNA, 19 bp, Homo sapiens
tggagtgttccccttccac

SEQ ID NO: 1057894 - DNA, 20 bp, Homo sapiens
tggagtgtttctaataaact

SEQ ID NO: 1057895 - DNA, 20 bp, Homo sapiens
tggagttacattaatgttaa

SEQ ID NO: 1057896 - DNA, 14 bp, Homo sapiens
tggagttcaccttg

SEQ ID NO: 1057897 - DNA, 13 bp, Homo sapiens
tggagttcagaga

SEQ ID NO: 1057898 - DNA, 14 bp, Homo sapiens
tggagttccggcct

SEQ ID NO: 1057899 - DNA, 23 bp, Homo sapiens
tggagttccggcctgggcaccag

SEQ ID NO: 1057900 - DNA, 20 bp, Homo sapiens
tggagttgactgactgagca

SEQ ID NO: 1057901 - DNA, 13 bp, Homo sapiens
tggagtttctcta

SEQ ID NO: 1057902 - DNA, 16 bp, Homo sapiens
tggagtttctctcttg

SEQ ID NO: 1057903 - DNA, 20 bp, Homo sapiens
tggagttttgtttcctctgt

SEQ ID NO: 1057904 - DNA, 17 bp, Homo sapiens
tggataaaactgtgtaa

SEQ ID NO: 1057905 - DNA, 16 bp, Homo sapiens
tggataaactgagcct

SEQ ID NO: 1057906 - DNA, 15 bp, Homo sapiens
tggataaattgttta

SEQ ID NO: 1057907 - DNA, 15 bp, Homo sapiens
tggataactagccag

SEQ ID NO: 1057908 - DNA, 17 bp, Homo sapiens
tggataactagccagac

SEQ ID NO: 1057909 - DNA, 19 bp, Homo sapiens
tggataagtttctattctg

SEQ ID NO: 1057910 - DNA, 18 bp, Homo sapiens
tggataatgctgttgcct

SEQ ID NO: 1057911 - DNA, 15 bp, Homo sapiens
tggatacagctgctt

SEQ ID NO: 1057912 - DNA, 13 bp, Homo sapiens
tggatacagtgcc

SEQ ID NO: 1057913 - DNA, 15 bp, Homo sapiens
tggatacagtgccca

SEQ ID NO: 1057914 - DNA, 14 bp, Homo sapiens
tggatacataaaga

SEQ ID NO: 1057915 - DNA, 16 bp, Homo sapiens
tggatacataaagact

SEQ ID NO: 1057916 - DNA, 17 bp, Homo sapiens
tggatacatctgctgtg

SEQ ID NO: 1057917 - DNA, 18 bp, Homo sapiens
tggatacatctgctgtgt

SEQ ID NO: 1057918 - DNA, 19 bp, Homo sapiens
tggatacatctgctgtgtg

SEQ ID NO: 1057919 - DNA, 20 bp, Homo sapiens
tggatacatctgctgtgtgg

SEQ ID NO: 1057920 - DNA, 18 bp, Homo sapiens
tggataccagctcagggg

SEQ ID NO: 1057921 - DNA, 15 bp, Homo sapiens
tggataccattatat

SEQ ID NO: 1057922 - DNA, 17 bp, Homo sapiens
tggatacgtgtcaatgt

SEQ ID NO: 1057923 - DNA, 14 bp, Homo sapiens
tggatactacatct

SEQ ID NO: 1057924 - DNA, 15 bp, Homo sapiens
tggatactacatctt

SEQ ID NO: 1057925 - DNA, 17 bp, Homo sapiens
tggatactgcccggggc

SEQ ID NO: 1057926 - DNA, 22 bp, Homo sapiens
tggatactgcccggggcagctg

SEQ ID NO: 1057927 - DNA, 14 bp, Homo sapiens
tggatactggacac

SEQ ID NO: 1057928 - DNA, 13 bp, Homo sapiens
tggatactgtaga

SEQ ID NO: 1057929 - DNA, 14 bp, Homo sapiens
tggatacttcctgg

SEQ ID NO: 1057930 - DNA, 22 bp, Homo sapiens
tggatacttggatttagtttca

SEQ ID NO: 1057931 - DNA, 18 bp, Homo sapiens
tggatagacttgggatgg

SEQ ID NO: 1057932 - DNA, 22 bp, Homo sapiens
tggatagacttgggatggggag

SEQ ID NO: 1057933 - DNA, 15 bp, Homo sapiens
tggatataaaatgtg

SEQ ID NO: 1057934 - DNA, 15 bp, Homo sapiens
tggatataatgtatt

SEQ ID NO: 1057935 - DNA, 17 bp, Homo sapiens
tggatatagaaaatctt

SEQ ID NO: 1057936 - DNA, 23 bp, Homo sapiens
tggatatagctaggtgacatata

SEQ ID NO: 1057937 - DNA, 18 bp, Homo sapiens
tggatatatgtttttgaa

SEQ ID NO: 1057938 - DNA, 21 bp, Homo sapiens
tggatatcagggtataaatta

SEQ ID NO: 1057939 - DNA, 16 bp, Homo sapiens
tggatatgtaaaacat

SEQ ID NO: 1057940 - DNA, 23 bp, Homo sapiens
tggatatgtccagtcatcctgcc

SEQ ID NO: 1057941 - DNA, 19 bp, Homo sapiens
tggatatgttgttaaacac

SEQ ID NO: 1057942 - DNA, 11 bp, Homo sapiens
tggatatttgt

SEQ ID NO: 1057943 - DNA, 13 bp, Homo sapiens
tggatatttgtat

SEQ ID NO: 1057944 - DNA, 22 bp, Homo sapiens
tggatattttcaaattgtatct

SEQ ID NO: 1057945 - DNA, 19 bp, Homo sapiens
tggatcaagcttgtgtact

SEQ ID NO: 1057946 - DNA, 14 bp, Homo sapiens
tggatcaagtatta

SEQ ID NO: 1057947 - DNA, 14 bp, Homo sapiens
tggatcacaaagtg

SEQ ID NO: 1057948 - DNA, 15 bp, Homo sapiens
tggatcacaaagtgg

SEQ ID NO: 1057949 - DNA, 16 bp, Homo sapiens
tggatcacaagatgga

SEQ ID NO: 1057950 - DNA, 14 bp, Homo sapiens
tggatcacagctgc

SEQ ID NO: 1057951 - DNA, 17 bp, Homo sapiens
tggatcaccattatatt

SEQ ID NO: 1057952 - DNA, 15 bp, Homo sapiens
tggatcactcaccat

SEQ ID NO: 1057953 - DNA, 14 bp, Homo sapiens
tggatccagcactg

SEQ ID NO: 1057954 - DNA, 22 bp, Homo sapiens
tggatcgagtgtagctgtgaaa

SEQ ID NO: 1057955 - DNA, 19 bp, Homo sapiens
tggatcgctaagctggctc

SEQ ID NO: 1057956 - DNA, 18 bp, Homo sapiens
tggatctcattggaccct

SEQ ID NO: 1057957 - DNA, 18 bp, Homo sapiens
tggatctcctgctgcctt

SEQ ID NO: 1057958 - DNA, 21 bp, Homo sapiens
tggatctgggaccctttcctt

SEQ ID NO: 1057959 - DNA, 19 bp, Homo sapiens
tggatcttcagaactgccc

SEQ ID NO: 1057960 - DNA, 20 bp, Homo sapiens
tggatcttcagaactgccct

SEQ ID NO: 1057961 - DNA, 21 bp, Homo sapiens
tggatcttcagaactgccctt

SEQ ID NO: 1057962 - DNA, 14 bp, Homo sapiens
tggatcttgaatgt

SEQ ID NO: 1057963 - DNA, 15 bp, Homo sapiens
tggatcttgcctaaa

SEQ ID NO: 1057964 - DNA, 15 bp, Homo sapiens
tggatgaaattttct

SEQ ID NO: 1057965 - DNA, 17 bp, Homo sapiens
tggatgaaattttctag

SEQ ID NO: 1057966 - DNA, 18 bp, Homo sapiens
tggatgaaattttctaga

SEQ ID NO: 1057967 - DNA, 18 bp, Homo sapiens
tggatgaggcacttctgt

SEQ ID NO: 1057968 - DNA, 20 bp, Homo sapiens
tggatgatactaataaacta

SEQ ID NO: 1057969 - DNA, 12 bp, Homo sapiens
tggatgatgttt

SEQ ID NO: 1057970 - DNA, 16 bp, Homo sapiens
tggatgcaattaaaac

SEQ ID NO: 1057971 - DNA, 14 bp, Homo sapiens
tggatgcccaggaa

SEQ ID NO: 1057972 - DNA, 17 bp, Homo sapiens
tggatgcccattatatt

SEQ ID NO: 1057973 - DNA, 16 bp, Homo sapiens
tggatgcctcagccca

SEQ ID NO: 1057974 - DNA, 12 bp, Homo sapiens
tggatgccttga

SEQ ID NO: 1057975 - DNA, 17 bp, Homo sapiens
tggatgctccagggcag

SEQ ID NO: 1057976 - DNA, 19 bp, Homo sapiens
tggatgctccagggcagcc

SEQ ID NO: 1057977 - DNA, 15 bp, Homo sapiens
tggatgctgagctgt

SEQ ID NO: 1057978 - DNA, 16 bp, Homo sapiens
tggatgctgagctgtg

SEQ ID NO: 1057979 - DNA, 20 bp, Homo sapiens
tggacagaggggactctggg

SEQ ID NO: 1057980 - DNA, 18 bp, Homo sapiens
tggacagatagacagtgc

SEQ ID NO: 1057981 - DNA, 20 bp, Homo sapiens
tggacagatggacgcaggcc

SEQ ID NO: 1057982 - DNA, 20 bp, Homo sapiens
tggacagatggcccaaggga

SEQ ID NO: 1057983 - DNA, 24 bp, Homo sapiens
tggacagatggcccaagggatggc

SEQ ID NO: 1057984 - DNA, 16 bp, Homo sapiens
tggacagatttcagta

SEQ ID NO: 1057985 - DNA, 14 bp, Homo sapiens
tggacagcagaagc

SEQ ID NO: 1057986 - DNA, 13 bp, Homo sapiens
tggacagccagtg

SEQ ID NO: 1057987 - DNA, 18 bp, Homo sapiens
tggacagccagtgacctt

SEQ ID NO: 1057988 - DNA, 14 bp, Homo sapiens
tggacagccccctt

SEQ ID NO: 1057989 - DNA, 19 bp, Homo sapiens
tggacagcgatgaggggac

SEQ ID NO: 1057990 - DNA, 12 bp, Homo sapiens
tggacagctgct

SEQ ID NO: 1057991 - DNA, 13 bp, Homo sapiens
tggacagctgctt

SEQ ID NO: 1057992 - DNA, 12 bp, Homo sapiens
tggacagcttgt

SEQ ID NO: 1057993 - DNA, 21 bp, Homo sapiens
tggacaggcagcctcctttgt

SEQ ID NO: 1057994 - DNA, 16 bp, Homo sapiens
tggacagggccagggt

SEQ ID NO: 1057995 - DNA, 22 bp, Homo sapiens
tggacagtacctgattgtattt

SEQ ID NO: 1057996 - DNA, 13 bp, Homo sapiens
tggacagtcctgg

SEQ ID NO: 1057997 - DNA, 15 bp, Homo sapiens
tggacagtcctggga

SEQ ID NO: 1057998 - DNA, 14 bp, Homo sapiens
tggacagtctccct

SEQ ID NO: 1057999 - DNA, 15 bp, Homo sapiens
tggacagtctccctg

SEQ ID NO: 1058000 - DNA, 20 bp, Homo sapiens
tggacagtctccctgatgga

SEQ ID NO: 1058001 - DNA, 17 bp, Homo sapiens
tggacatactgctggag

SEQ ID NO: 1058002 - DNA, 23 bp, Homo sapiens
tggacatagagagggagaagaag

SEQ ID NO: 1058003 - DNA, 16 bp, Homo sapiens
tggacatatgtatact

SEQ ID NO: 1058004 - DNA, 17 bp, Homo sapiens
tggacatatgtatactt

SEQ ID NO: 1058005 - DNA, 20 bp, Homo sapiens
tggacatcaccagtcctagc

SEQ ID NO: 1058006 - DNA, 18 bp, Homo sapiens
tggacatcctcttctgct

SEQ ID NO: 1058007 - DNA, 19 bp, Homo sapiens
tggacatcctcttctgctt

SEQ ID NO: 1058008 - DNA, 17 bp, Homo sapiens
tggacatctctctggct

SEQ ID NO: 1058009 - DNA, 21 bp, Homo sapiens
tggacatgaagattctttccc

SEQ ID NO: 1058010 - DNA, 16 bp, Homo sapiens
tggacatgagataatg

SEQ ID NO: 1058011 - DNA, 21 bp, Homo sapiens
tggacatgatttagggaagca

SEQ ID NO: 1058012 - DNA, 17 bp, Homo sapiens
tggacatggcccattgg

SEQ ID NO: 1058013 - DNA, 12 bp, Homo sapiens
tggacatggtca

SEQ ID NO: 1058014 - DNA, 19 bp, Homo sapiens
tggacatttagaagaaaga

SEQ ID NO: 1058015 - DNA, 13 bp, Homo sapiens
tggacattttctt

SEQ ID NO: 1058016 - DNA, 17 bp, Homo sapiens
tggacattttttcagtc

SEQ ID NO: 1058017 - DNA, 15 bp, Homo sapiens
tggaccaccagcccc

SEQ ID NO: 1058018 - DNA, 23 bp, Homo sapiens
tggaccaccgttcagtcattttg

SEQ ID NO: 1058019 - DNA, 20 bp, Homo sapiens
tggaccactgcatgagcttt

SEQ ID NO: 1058020 - DNA, 16 bp, Homo sapiens
tggaccacttggaaat

SEQ ID NO: 1058021 - DNA, 13 bp, Homo sapiens
tggaccagctggc

SEQ ID NO: 1058022 - DNA, 15 bp, Homo sapiens
tggaccaggcctgga

SEQ ID NO: 1058023 - DNA, 18 bp, Homo sapiens
tggaccaggcctggaggg

SEQ ID NO: 1058024 - DNA, 19 bp, Homo sapiens
tggaccagtggtttccagt

SEQ ID NO: 1058025 - DNA, 17 bp, Homo sapiens
tggaccagtttgcagag

SEQ ID NO: 1058026 - DNA, 18 bp, Homo sapiens
tggaccagtttgcagagt

SEQ ID NO: 1058027 - DNA, 13 bp, Homo sapiens
tggaccatctctg

SEQ ID NO: 1058028 - DNA, 22 bp, Homo sapiens
tggaccatgccagattctgcct

SEQ ID NO: 1058029 - DNA, 22 bp, Homo sapiens
tggaccatttgattgttttatt

SEQ ID NO: 1058030 - DNA, 13 bp, Homo sapiens
tggacccagggcc

SEQ ID NO: 1058031 - DNA, 13 bp, Homo sapiens
tggaccccactgg

SEQ ID NO: 1058032 - DNA, 15 bp, Homo sapiens
tggaccccagctggg

SEQ ID NO: 1058033 - DNA, 23 bp, Homo sapiens
tggaccccagctgggaggcaaga

SEQ ID NO: 1058034 - DNA, 23 bp, Homo sapiens
tggacccccagcccccagggccc

SEQ ID NO: 1058035 - DNA, 14 bp, Homo sapiens
tggaccccctgccc

SEQ ID NO: 1058036 - DNA, 20 bp, Homo sapiens
tggaccccctgcccgccaca

SEQ ID NO: 1058037 - DNA, 17 bp, Homo sapiens
tggaccgagatgtgagt

SEQ ID NO: 1058038 - DNA, 14 bp, Homo sapiens
tggaccgggtgggc

SEQ ID NO: 1058039 - DNA, 21 bp, Homo sapiens
tggaccgggtgggcctggcct

SEQ ID NO: 1058040 - DNA, 23 bp, Homo sapiens
tggaccgggtgggcctggcctga

SEQ ID NO: 1058041 - DNA, 18 bp, Homo sapiens
tggacctaaatggcctca

SEQ ID NO: 1058042 - DNA, 21 bp, Homo sapiens
tggacctaaatggcctcatgt

SEQ ID NO: 1058043 - DNA, 18 bp, Homo sapiens
tggacctatgcagggagg

SEQ ID NO: 1058044 - DNA, 19 bp, Homo sapiens
tggacctatgcagggaggc

SEQ ID NO: 1058045 - DNA, 20 bp, Homo sapiens
tggacctcaggagggcaggc

SEQ ID NO: 1058046 - DNA, 22 bp, Homo sapiens
tggacctcaggagggcaggctg

SEQ ID NO: 1058047 - DNA, 13 bp, Homo sapiens
tggacctccaggg

SEQ ID NO: 1058048 - DNA, 19 bp, Homo sapiens
tggacctccaggggctcct

SEQ ID NO: 1058049 - DNA, 20 bp, Homo sapiens
tggacctccaggggctcctg

SEQ ID NO: 1058050 - DNA, 22 bp, Homo sapiens
tggacctcgtcccatcttcact

SEQ ID NO: 1058051 - DNA, 21 bp, Homo sapiens
tggacctctatcatctgctaa

SEQ ID NO: 1058052 - DNA, 16 bp, Homo sapiens
tggacctctgctctga

SEQ ID NO: 1058053 - DNA, 17 bp, Homo sapiens
tggacctctgctctgag

SEQ ID NO: 1058054 - DNA, 17 bp, Homo sapiens
tggacctgcctcctgcc

SEQ ID NO: 1058055 - DNA, 18 bp, Homo sapiens
tggacctgcctcctgcct

SEQ ID NO: 1058056 - DNA, 20 bp, Homo sapiens
tggacctgcctcctgcctgc

SEQ ID NO: 1058057 - DNA, 23 bp, Homo sapiens
tggacctgggggtagccccgccc

SEQ ID NO: 1058058 - DNA, 16 bp, Homo sapiens
tggaccttaggccttc

SEQ ID NO: 1058059 - DNA, 17 bp, Homo sapiens
tggaccttaggccttcc

SEQ ID NO: 1058060 - DNA, 19 bp, Homo sapiens
tggaccttaggccttcctc

SEQ ID NO: 1058061 - DNA, 19 bp, Homo sapiens
tggaccttcctgccaccag

SEQ ID NO: 1058062 - DNA, 14 bp, Homo sapiens
tggacgaatatgaa

SEQ ID NO: 1058063 - DNA, 14 bp, Homo sapiens
tggacgcaggccct

SEQ ID NO: 1058064 - DNA, 15 bp, Homo sapiens
tggacgcaggccctg

SEQ ID NO: 1058065 - DNA, 13 bp, Homo sapiens
tggacgctgccct

SEQ ID NO: 1058066 - DNA, 16 bp, Homo sapiens
tggacgctgccctgca

SEQ ID NO: 1058067 - DNA, 23 bp, Homo sapiens
tggacggcaggctcactgccagg

SEQ ID NO: 1058068 - DNA, 16 bp, Homo sapiens
tggacggggactgggg

SEQ ID NO: 1058069 - DNA, 15 bp, Homo sapiens
tggacgtgcactgac

SEQ ID NO: 1058070 - DNA, 20 bp, Homo sapiens
tggacgtgcactgacagcct

SEQ ID NO: 1058071 - DNA, 23 bp, Homo sapiens
tggactaaaggcatccttgtctt

SEQ ID NO: 1058072 - DNA, 18 bp, Homo sapiens
tggactaaatatctgtca

SEQ ID NO: 1058073 - DNA, 16 bp, Homo sapiens
tggactaagatgaaat

SEQ ID NO: 1058074 - DNA, 22 bp, Homo sapiens
tggactaagatgaaatgcactg

SEQ ID NO: 1058075 - DNA, 17 bp, Homo sapiens
tggactatctgtctggt

SEQ ID NO: 1058076 - DNA, 20 bp, Homo sapiens
tggactatctgtctggtggc

SEQ ID NO: 1058077 - DNA, 19 bp, Homo sapiens
tggactcaatccctagggc

SEQ ID NO: 1058078 - DNA, 12 bp, Homo sapiens
tggactcagaaa

SEQ ID NO: 1058079 - DNA, 15 bp, Homo sapiens
tggactcagcagtga

SEQ ID NO: 1058080 - DNA, 16 bp, Homo sapiens
tggactcaggaacttt

SEQ ID NO: 1058081 - DNA, 20 bp, Homo sapiens
tggactcaggatccagtgac

SEQ ID NO: 1058082 - DNA, 18 bp, Homo sapiens
tggactcagggcagcgcc

SEQ ID NO: 1058083 - DNA, 14 bp, Homo sapiens
tggactccagcctg

SEQ ID NO: 1058084 - DNA, 15 bp, Homo sapiens
tggcacctcctgaga

SEQ ID NO: 1058085 - DNA, 23 bp, Homo sapiens
tggcacctctgcccttcccctcc

SEQ ID NO: 1058086 - DNA, 22 bp, Homo sapiens
tggcaccttcagactttgcttc

SEQ ID NO: 1058087 - DNA, 14 bp, Homo sapiens
tggcacgcacctgt

SEQ ID NO: 1058088 - DNA, 18 bp, Homo sapiens
tggcacgcatctgtagtt

SEQ ID NO: 1058089 - DNA, 20 bp, Homo sapiens
tggcacgccctactccactg

SEQ ID NO: 1058090 - DNA, 15 bp, Homo sapiens
tggcacggagagaag

SEQ ID NO: 1058091 - DNA, 14 bp, Homo sapiens
tggcacgtattgct

SEQ ID NO: 1058092 - DNA, 15 bp, Homo sapiens
tggcactagaatgca

SEQ ID NO: 1058093 - DNA, 16 bp, Homo sapiens
tggcactataatgtaa

SEQ ID NO: 1058094 - DNA, 22 bp, Homo sapiens
tggcactataatgtaagctcta

SEQ ID NO: 1058095 - DNA, 15 bp, Homo sapiens
tggcactcaactctg

SEQ ID NO: 1058096 - DNA, 21 bp, Homo sapiens
tggcactctctaacgtccact

SEQ ID NO: 1058097 - DNA, 23 bp, Homo sapiens
tggcactgaagtggccctccctc

SEQ ID NO: 1058098 - DNA, 14 bp, Homo sapiens
tggcactgagcccc

SEQ ID NO: 1058099 - DNA, 16 bp, Homo sapiens
tggcactgagcccccc

SEQ ID NO: 1058100 - DNA, 18 bp, Homo sapiens
tggcactgagccccccca

SEQ ID NO: 1058101 - DNA, 20 bp, Homo sapiens
tggcactgcgatcaggaaga

SEQ ID NO: 1058102 - DNA, 15 bp, Homo sapiens
tggcactggatgcag

SEQ ID NO: 1058103 - DNA, 18 bp, Homo sapiens
tggcactggatgcagaaa

SEQ ID NO: 1058104 - DNA, 19 bp, Homo sapiens
tggcacttaagtgcacttt

SEQ ID NO: 1058105 - DNA, 18 bp, Homo sapiens
tggcacttagcccaagag

SEQ ID NO: 1058106 - DNA, 23 bp, Homo sapiens
tggcacttagcccaagaggtctg

SEQ ID NO: 1058107 - DNA, 15 bp, Homo sapiens
tggcacttctgcctt

SEQ ID NO: 1058108 - DNA, 22 bp, Homo sapiens
tggcacttgccattccaaaata

SEQ ID NO: 1058109 - DNA, 14 bp, Homo sapiens
tggcacttgtattt

SEQ ID NO: 1058110 - DNA, 11 bp, Homo sapiens
tggcactttga

SEQ ID NO: 1058111 - DNA, 12 bp, Homo sapiens
tggcagaaaagt

SEQ ID NO: 1058112 - DNA, 15 bp, Homo sapiens
tggcagaagggaatt

SEQ ID NO: 1058113 - DNA, 23 bp, Homo sapiens
tggcagaagtgtcaccctgtggg

SEQ ID NO: 1058114 - DNA, 11 bp, Homo sapiens
tggcagactct

SEQ ID NO: 1058115 - DNA, 16 bp, Homo sapiens
tggcagagaaggcctc

SEQ ID NO: 1058116 - DNA, 15 bp, Homo sapiens
tggcagagcacagcc

SEQ ID NO: 1058117 - DNA, 16 bp, Homo sapiens
tggcagagccaggctg

SEQ ID NO: 1058118 - DNA, 19 bp, Homo sapiens
tggcagagcctcagctgta

SEQ ID NO: 1058119 - DNA, 16 bp, Homo sapiens
tggcagagcctctgag

SEQ ID NO: 1058120 - DNA, 17 bp, Homo sapiens
tggcagagttacagttc

SEQ ID NO: 1058121 - DNA, 17 bp, Homo sapiens
tggcagagtttgtgtgt

SEQ ID NO: 1058122 - DNA, 15 bp, Homo sapiens
tggcagatgtcttcc

SEQ ID NO: 1058123 - DNA, 18 bp, Homo sapiens
tggcagatgtcttccctg

SEQ ID NO: 1058124 - DNA, 19 bp, Homo sapiens
tggcagatgtcttccctgg

SEQ ID NO: 1058125 - DNA, 13 bp, Homo sapiens
tggcagattttac

SEQ ID NO: 1058126 - DNA, 16 bp, Homo sapiens
tggcagattttacaaa

SEQ ID NO: 1058127 - DNA, 13 bp, Homo sapiens
tggcagcacagcc

SEQ ID NO: 1058128 - DNA, 17 bp, Homo sapiens
tggcagcacggcccggc

SEQ ID NO: 1058129 - DNA, 21 bp, Homo sapiens
tggcagcacggcccggcccct

SEQ ID NO: 1058130 - DNA, 19 bp, Homo sapiens
tggcagcagcaggtgtggc

SEQ ID NO: 1058131 - DNA, 16 bp, Homo sapiens
tggcagccaaggaatg

SEQ ID NO: 1058132 - DNA, 21 bp, Homo sapiens
tggcagccagacttctggagg

SEQ ID NO: 1058133 - DNA, 21 bp, Homo sapiens
tggcagccatgcctcatgcca

SEQ ID NO: 1058134 - DNA, 16 bp, Homo sapiens
tggcagcccggctgct

SEQ ID NO: 1058135 - DNA, 19 bp, Homo sapiens
tggcagcccggctgctgct

SEQ ID NO: 1058136 - DNA, 20 bp, Homo sapiens
tggcagcccggctgctgctt

SEQ ID NO: 1058137 - DNA, 21 bp, Homo sapiens
tggcagcccggctgctgcttg

SEQ ID NO: 1058138 - DNA, 17 bp, Homo sapiens
tggcagccctgtaggga

SEQ ID NO: 1058139 - DNA, 18 bp, Homo sapiens
tggcagccgtcccaggcc

SEQ ID NO: 1058140 - DNA, 20 bp, Homo sapiens
tggcagcctcccatccaggg

SEQ ID NO: 1058141 - DNA, 17 bp, Homo sapiens
tggcagctagactggag

SEQ ID NO: 1058142 - DNA, 15 bp, Homo sapiens
tggcagctagtgcct

SEQ ID NO: 1058143 - DNA, 17 bp, Homo sapiens
tggcagctcctctcctt

SEQ ID NO: 1058144 - DNA, 14 bp, Homo sapiens
tggcagctctccag

SEQ ID NO: 1058145 - DNA, 15 bp, Homo sapiens
tggcagctctccagt

SEQ ID NO: 1058146 - DNA, 17 bp, Homo sapiens
tggcagctctccagtca

SEQ ID NO: 1058147 - DNA, 16 bp, Homo sapiens
tggcagctgagagccc

SEQ ID NO: 1058148 - DNA, 18 bp, Homo sapiens
tggcagctgagagccctg

SEQ ID NO: 1058149 - DNA, 11 bp, Homo sapiens
tggcagctgcc

SEQ ID NO: 1058150 - DNA, 16 bp, Homo sapiens
tggcagctgccacgcc

SEQ ID NO: 1058151 - DNA, 12 bp, Homo sapiens
tggcagctgctg

SEQ ID NO: 1058152 - DNA, 14 bp, Homo sapiens
tggcagctggacca

SEQ ID NO: 1058153 - DNA, 21 bp, Homo sapiens
tggcagctggaccatctctgt

SEQ ID NO: 1058154 - DNA, 16 bp, Homo sapiens
tggcagctgtttctca

SEQ ID NO: 1058155 - DNA, 19 bp, Homo sapiens
tggcagctgtttctcatga

SEQ ID NO: 1058156 - DNA, 20 bp, Homo sapiens
tggcagctgtttctcatgaa

SEQ ID NO: 1058157 - DNA, 23 bp, Homo sapiens
tggcagctgtttctcatgaagct

SEQ ID NO: 1058158 - DNA, 17 bp, Homo sapiens
tggcagctttttctgtg

SEQ ID NO: 1058159 - DNA, 15 bp, Homo sapiens
tggcaggaagatgta

SEQ ID NO: 1058160 - DNA, 23 bp, Homo sapiens
tggcaggaagatgtatgctttga

SEQ ID NO: 1058161 - DNA, 17 bp, Homo sapiens
tggcaggacacatcccg

SEQ ID NO: 1058162 - DNA, 16 bp, Homo sapiens
tggcaggaccaggact

SEQ ID NO: 1058163 - DNA, 15 bp, Homo sapiens
tggcaggacctgcct

SEQ ID NO: 1058164 - DNA, 17 bp, Homo sapiens
tggcaggactcctggca

SEQ ID NO: 1058165 - DNA, 23 bp, Homo sapiens
tggcaggactcctggcagggcca

SEQ ID NO: 1058166 - DNA, 16 bp, Homo sapiens
tggcaggatccaaggg

SEQ ID NO: 1058167 - DNA, 20 bp, Homo sapiens
tggcaggcacacagcagccc

SEQ ID NO: 1058168 - DNA, 22 bp, Homo sapiens
tggcaggcacacagcagccccc

SEQ ID NO: 1058169 - DNA, 13 bp, Homo sapiens
tggcaggcccact

SEQ ID NO: 1058170 - DNA, 22 bp, Homo sapiens
tggcaggcccactccccagccc

SEQ ID NO: 1058171 - DNA, 20 bp, Homo sapiens
tggcaggcctgacccacggg

SEQ ID NO: 1058172 - DNA, 22 bp, Homo sapiens
tggcaggcctgacccacggggc

SEQ ID NO: 1058173 - DNA, 18 bp, Homo sapiens
tggcaggctggccagtcc

SEQ ID NO: 1058174 - DNA, 11 bp, Homo sapiens
tggcagggcca

SEQ ID NO: 1058175 - DNA, 14 bp, Homo sapiens
tggcagggccacct

SEQ ID NO: 1058176 - DNA, 15 bp, Homo sapiens
tggcagggccagggc

SEQ ID NO: 1058177 - DNA, 21 bp, Homo sapiens
tggcagggccagggcaatgcc

SEQ ID NO: 1058178 - DNA, 24 bp, Homo sapiens
tggcaggggagacaggagcctagc

SEQ ID NO: 1058179 - DNA, 14 bp, Homo sapiens
tggcaggtcactgt

SEQ ID NO: 1058180 - DNA, 18 bp, Homo sapiens
tggcaggtcactgtcact

SEQ ID NO: 1058181 - DNA, 22 bp, Homo sapiens
tggcaggtgggggtgggctgct

SEQ ID NO: 1058182 - DNA, 23 bp, Homo sapiens
tggcaggtgtcatatgactgatt

SEQ ID NO: 1058183 - DNA, 13 bp, Homo sapiens
tggcagtgacttt

SEQ ID NO: 1058184 - DNA, 23 bp, Homo sapiens
tggcagtggactcagaaagccaa

SEQ ID NO: 1058185 - DNA, 20 bp, Homo sapiens
tggcatgatcatagctcact

SEQ ID NO: 1058186 - DNA, 22 bp, Homo sapiens
tggcatgattagattgcaaagc

SEQ ID NO: 1058187 - DNA, 13 bp, Homo sapiens
tggcatgatttat

SEQ ID NO: 1058188 - DNA, 19 bp, Homo sapiens
tggcatgatttatatatgg

SEQ ID NO: 1058189 - DNA, 16 bp, Homo sapiens
tggcatgcttaaattt

SEQ ID NO: 1058190 - DNA, 21 bp, Homo sapiens
tggcatggaaatttaaagcag

SEQ ID NO: 1058191 - DNA, 23 bp, Homo sapiens
tggcatggaaatttaaagcaggt

SEQ ID NO: 1058192 - DNA, 18 bp, Homo sapiens
tggcatgggacaggggga

SEQ ID NO: 1058193 - DNA, 13 bp, Homo sapiens
tggcatgtggaga

SEQ ID NO: 1058194 - DNA, 16 bp, Homo sapiens
tggcatgtggagacac

SEQ ID NO: 1058195 - DNA, 14 bp, Homo sapiens
tggcatgtggcctg

SEQ ID NO: 1058196 - DNA, 16 bp, Homo sapiens
tggcatgtggcctgtg

SEQ ID NO: 1058197 - DNA, 18 bp, Homo sapiens
tggcatgtggcctgtggc

SEQ ID NO: 1058198 - DNA, 20 bp, Homo sapiens
tggcatgtttcactcctgct

SEQ ID NO: 1058199 - DNA, 13 bp, Homo sapiens
tggcatgttttct

SEQ ID NO: 1058200 - DNA, 13 bp, Homo sapiens
tggcatgttttga

SEQ ID NO: 1058201 - DNA, 22 bp, Homo sapiens
tggcattaaaccacatcatgga

SEQ ID NO: 1058202 - DNA, 15 bp, Homo sapiens
tggcattaattatta

SEQ ID NO: 1058203 - DNA, 17 bp, Homo sapiens
tggcattaattattaat

SEQ ID NO: 1058204 - DNA, 17 bp, Homo sapiens
tggcattagaattattt

SEQ ID NO: 1058205 - DNA, 18 bp, Homo sapiens
tggcattatgtccactgt

SEQ ID NO: 1058206 - DNA, 12 bp, Homo sapiens
tggcattattag

SEQ ID NO: 1058207 - DNA, 15 bp, Homo sapiens
tggcattctacacct

SEQ ID NO: 1058208 - DNA, 16 bp, Homo sapiens
tggcattctacacctg

SEQ ID NO: 1058209 - DNA, 17 bp, Homo sapiens
tggcattcttgtacagt

SEQ ID NO: 1058210 - DNA, 18 bp, Homo sapiens
tggcattgcactgcttat

SEQ ID NO: 1058211 - DNA, 16 bp, Homo sapiens
tggcattgtccctgtg

SEQ ID NO: 1058212 - DNA, 20 bp, Homo sapiens
tggcattgtccctgtgccta

SEQ ID NO: 1058213 - DNA, 17 bp, Homo sapiens
tggcatttgcaataaaa

SEQ ID NO: 1058214 - DNA, 18 bp, Homo sapiens
tggcatttgctgatttct

SEQ ID NO: 1058215 - DNA, 21 bp, Homo sapiens
tggcatttgctggttataaca

SEQ ID NO: 1058216 - DNA, 17 bp, Homo sapiens
tggcatttggtctcagg

SEQ ID NO: 1058217 - DNA, 20 bp, Homo sapiens
tggcatttggtctcaggcag

SEQ ID NO: 1058218 - DNA, 21 bp, Homo sapiens
tggcatttggtctcaggcagc

SEQ ID NO: 1058219 - DNA, 18 bp, Homo sapiens
tggccaaaagcagtaaat

SEQ ID NO: 1058220 - DNA, 14 bp, Homo sapiens
tggccaaaatacca

SEQ ID NO: 1058221 - DNA, 19 bp, Homo sapiens
tggccaaacatcagacctg

SEQ ID NO: 1058222 - DNA, 16 bp, Homo sapiens
tggccaaataggaggg

SEQ ID NO: 1058223 - DNA, 16 bp, Homo sapiens
tggccaaattatttgt

SEQ ID NO: 1058224 - DNA, 19 bp, Homo sapiens
tggccaactcaactttcat

SEQ ID NO: 1058225 - DNA, 21 bp, Homo sapiens
tggccaactgcaaaaaaagcc

SEQ ID NO: 1058226 - DNA, 23 bp, Homo sapiens
tggccaactgcaaaaaaagcctc

SEQ ID NO: 1058227 - DNA, 14 bp, Homo sapiens
tggccaagagcatc

SEQ ID NO: 1058228 - DNA, 12 bp, Homo sapiens
tggccaagcctg

SEQ ID NO: 1058229 - DNA, 15 bp, Homo sapiens
tggccaaggagctgc

SEQ ID NO: 1058230 - DNA, 17 bp, Homo sapiens
tggccaaggagctgcta

SEQ ID NO: 1058231 - DNA, 18 bp, Homo sapiens
tggccaaggagctgctat

SEQ ID NO: 1058232 - DNA, 16 bp, Homo sapiens
tggccaaggtgtccag

SEQ ID NO: 1058233 - DNA, 17 bp, Homo sapiens
tggccacaactgctgtg

SEQ ID NO: 1058234 - DNA, 11 bp, Homo sapiens
tggccacagca

SEQ ID NO: 1058235 - DNA, 19 bp, Homo sapiens
tggccacagcgtgctggcg

SEQ ID NO: 1058236 - DNA, 19 bp, Homo sapiens
tggccacagtgtcactggt

SEQ ID NO: 1058237 - DNA, 14 bp, Homo sapiens
tggccacatcagcc

SEQ ID NO: 1058238 - DNA, 15 bp, Homo sapiens
tggccacatcagccc

SEQ ID NO: 1058239 - DNA, 12 bp, Homo sapiens
tggccaccaggc

SEQ ID NO: 1058240 - DNA, 13 bp, Homo sapiens
tggccaccaggct

SEQ ID NO: 1058241 - DNA, 20 bp, Homo sapiens
tggccaccaggctggcgcag

SEQ ID NO: 1058242 - DNA, 21 bp, Homo sapiens
tggccaccaggctggcgcagc

SEQ ID NO: 1058243 - DNA, 22 bp, Homo sapiens
tggccaccaggtgcctttcaaa

SEQ ID NO: 1058244 - DNA, 18 bp, Homo sapiens
tggccaccccgtgccacc

SEQ ID NO: 1058245 - DNA, 16 bp, Homo sapiens
tggccacccctcccca

SEQ ID NO: 1058246 - DNA, 19 bp, Homo sapiens
tggccacccctccccagta

SEQ ID NO: 1058247 - DNA, 16 bp, Homo sapiens
tggccaccctggcccg

SEQ ID NO: 1058248 - DNA, 17 bp, Homo sapiens
tggccaccgggggtggc

SEQ ID NO: 1058249 - DNA, 23 bp, Homo sapiens
tggccaccgggggtggctctgtc

SEQ ID NO: 1058250 - DNA, 23 bp, Homo sapiens
tggccacctgaggtgggcccagg

SEQ ID NO: 1058251 - DNA, 16 bp, Homo sapiens
tggccaccttttcagc

SEQ ID NO: 1058252 - DNA, 17 bp, Homo sapiens
tggccaccttttcagcg

SEQ ID NO: 1058253 - DNA, 14 bp, Homo sapiens
tggccactccgaga

SEQ ID NO: 1058254 - DNA, 20 bp, Homo sapiens
tggccactccgagaggtggg

SEQ ID NO: 1058255 - DNA, 19 bp, Homo sapiens
tggccactgaaaagctttc

SEQ ID NO: 1058256 - DNA, 22 bp, Homo sapiens
tggccactgggtctcactcctg

SEQ ID NO: 1058257 - DNA, 19 bp, Homo sapiens
tggccacttcattccagca

SEQ ID NO: 1058258 - DNA, 21 bp, Homo sapiens
tggccacttcattccagcagc

SEQ ID NO: 1058259 - DNA, 23 bp, Homo sapiens
tggccacttcattccagcagctg

SEQ ID NO: 1058260 - DNA, 23 bp, Homo sapiens
tggccagagagcctggtgctgct

SEQ ID NO: 1058261 - DNA, 14 bp, Homo sapiens
tggccagagcctct

SEQ ID NO: 1058262 - DNA, 22 bp, Homo sapiens
tggccagagcctctggcccctc

SEQ ID NO: 1058263 - DNA, 13 bp, Homo sapiens
tggccagagctgg

SEQ ID NO: 1058264 - DNA, 14 bp, Homo sapiens
tggccagagctggg

SEQ ID NO: 1058265 - DNA, 15 bp, Homo sapiens
tggccagagctggga

SEQ ID NO: 1058266 - DNA, 17 bp, Homo sapiens
tggccagagctgggagg

SEQ ID NO: 1058267 - DNA, 18 bp, Homo sapiens
tggccagagctgggaggc

SEQ ID NO: 1058268 - DNA, 23 bp, Homo sapiens
tggccagagctgggaggcatggc

SEQ ID NO: 1058269 - DNA, 16 bp, Homo sapiens
tggccagattgtgggg

SEQ ID NO: 1058270 - DNA, 12 bp, Homo sapiens
tggccagcaccc

SEQ ID NO: 1058271 - DNA, 13 bp, Homo sapiens
tggccagcaccct

SEQ ID NO: 1058272 - DNA, 18 bp, Homo sapiens
tggccagcaccctctcct

SEQ ID NO: 1058273 - DNA, 21 bp, Homo sapiens
tggccagccaacttttgcatg

SEQ ID NO: 1058274 - DNA, 20 bp, Homo sapiens
tggccagccaatttcccgga

SEQ ID NO: 1058275 - DNA, 23 bp, Homo sapiens
tggccagcccctggggcccagcc

SEQ ID NO: 1058276 - DNA, 11 bp, Homo sapiens
tggccagcccg

SEQ ID NO: 1058277 - DNA, 14 bp, Homo sapiens
tggccagcccggct

SEQ ID NO: 1058278 - DNA, 15 bp, Homo sapiens
tggccagcccggctg

SEQ ID NO: 1058279 - DNA, 19 bp, Homo sapiens
tggccagcccggctggttt

SEQ ID NO: 1058280 - DNA, 14 bp, Homo sapiens
tggccagcctggat

SEQ ID NO: 1058281 - DNA, 23 bp, Homo sapiens
tggccagcgccagggcccaggcc

SEQ ID NO: 1058282 - DNA, 23 bp, Homo sapiens
tggcgacactcagggcagctgcc

SEQ ID NO: 1058283 - DNA, 15 bp, Homo sapiens
tggcgaccaccaaag

SEQ ID NO: 1058284 - DNA, 17 bp, Homo sapiens
tggcgactctgcagagt

SEQ ID NO: 1058285 - DNA, 22 bp, Homo sapiens
tggcgagttctctttggaaata

SEQ ID NO: 1058286 - DNA, 13 bp, Homo sapiens
tggcgcagccaag

SEQ ID NO: 1058287 - DNA, 14 bp, Homo sapiens
tggcgcaggtgggc

SEQ ID NO: 1058288 - DNA, 22 bp, Homo sapiens
tggcgcccctgcctgtgcccgc

SEQ ID NO: 1058289 - DNA, 14 bp, Homo sapiens
tggcgccctgcctc

SEQ ID NO: 1058290 - DNA, 22 bp, Homo sapiens
tggcgccctgcctcctggagga

SEQ ID NO: 1058291 - DNA, 18 bp, Homo sapiens
tggcgccgtctccagggg

SEQ ID NO: 1058292 - DNA, 13 bp, Homo sapiens
tggcgcgggaggc

SEQ ID NO: 1058293 - DNA, 16 bp, Homo sapiens
tggcgcgggaggcacc

SEQ ID NO: 1058294 - DNA, 20 bp, Homo sapiens
tggcgcgggaggcaccagct

SEQ ID NO: 1058295 - DNA, 18 bp, Homo sapiens
tggcgctcagaccccacc

SEQ ID NO: 1058296 - DNA, 20 bp, Homo sapiens
tggcgctcagaccccaccct

SEQ ID NO: 1058297 - DNA, 15 bp, Homo sapiens
tggcgctctcagctt

SEQ ID NO: 1058298 - DNA, 12 bp, Homo sapiens
tggcgctgtgcg

SEQ ID NO: 1058299 - DNA, 17 bp, Homo sapiens
tggcgcttggatctggg

SEQ ID NO: 1058300 - DNA, 17 bp, Homo sapiens
tggcgctttctcctgtg

SEQ ID NO: 1058301 - DNA, 23 bp, Homo sapiens
tggcggccccaactcgggctccc

SEQ ID NO: 1058302 - DNA, 13 bp, Homo sapiens
tggcggcctgtgg

SEQ ID NO: 1058303 - DNA, 13 bp, Homo sapiens
tggcggccttccg

SEQ ID NO: 1058304 - DNA, 14 bp, Homo sapiens
tggcggtggctgcc

SEQ ID NO: 1058305 - DNA, 16 bp, Homo sapiens
tggcggtggctgcccc

SEQ ID NO: 1058306 - DNA, 15 bp, Homo sapiens
tggcgtaatgggcct

SEQ ID NO: 1058307 - DNA, 13 bp, Homo sapiens
tggcgtctccctc

SEQ ID NO: 1058308 - DNA, 15 bp, Homo sapiens
tggcgtctgctctgg

SEQ ID NO: 1058309 - DNA, 22 bp, Homo sapiens
tggcgtctgtcttcaagggctt

SEQ ID NO: 1058310 - DNA, 14 bp, Homo sapiens
tggcgtgaacccag

SEQ ID NO: 1058311 - DNA, 17 bp, Homo sapiens
tggcgtggcccgtggcc

SEQ ID NO: 1058312 - DNA, 14 bp, Homo sapiens
tggcgtggcctccc

SEQ ID NO: 1058313 - DNA, 17 bp, Homo sapiens
tggcgtgggagccagcc

SEQ ID NO: 1058314 - DNA, 18 bp, Homo sapiens
tggcgtgtccctctcgga

SEQ ID NO: 1058315 - DNA, 15 bp, Homo sapiens
tggcgttatggcagc

SEQ ID NO: 1058316 - DNA, 19 bp, Homo sapiens
tggcgttatggcagcccgg

SEQ ID NO: 1058317 - DNA, 22 bp, Homo sapiens
tggcgttcacctccctgctcag

SEQ ID NO: 1058318 - DNA, 19 bp, Homo sapiens
tggcgttctcaagaatcta

SEQ ID NO: 1058319 - DNA, 14 bp, Homo sapiens
tggcgttgttgcat

SEQ ID NO: 1058320 - DNA, 23 bp, Homo sapiens
tggcgtttttctcgtccccctcc

SEQ ID NO: 1058321 - DNA, 19 bp, Homo sapiens
tggctaacttttcattttt

SEQ ID NO: 1058322 - DNA, 14 bp, Homo sapiens
tggctaataaactg

SEQ ID NO: 1058323 - DNA, 17 bp, Homo sapiens
tggctaatgtactgcat

SEQ ID NO: 1058324 - DNA, 20 bp, Homo sapiens
tggctacatcccagcctgtg

SEQ ID NO: 1058325 - DNA, 19 bp, Homo sapiens
tggctacgcctcttctgtc

SEQ ID NO: 1058326 - DNA, 22 bp, Homo sapiens
tggctagaggttcaaagatatt

SEQ ID NO: 1058327 - DNA, 18 bp, Homo sapiens
tggctagagtcctcactc

SEQ ID NO: 1058328 - DNA, 21 bp, Homo sapiens
tggctagagtcctcactccca

SEQ ID NO: 1058329 - DNA, 17 bp, Homo sapiens
tggctagagtttccact

SEQ ID NO: 1058330 - DNA, 16 bp, Homo sapiens
tggctagcctttcttg

SEQ ID NO: 1058331 - DNA, 15 bp, Homo sapiens
tggctagtactgtat

SEQ ID NO: 1058332 - DNA, 18 bp, Homo sapiens
tggctagtcaagctcctc

SEQ ID NO: 1058333 - DNA, 22 bp, Homo sapiens
tggctagtcaagctcctcctcc

SEQ ID NO: 1058334 - DNA, 23 bp, Homo sapiens
tggctagtcaagctcctcctccc

SEQ ID NO: 1058335 - DNA, 16 bp, Homo sapiens
tggctagtcctttctg

SEQ ID NO: 1058336 - DNA, 19 bp, Homo sapiens
tggctagtggggtgaacag

SEQ ID NO: 1058337 - DNA, 23 bp, Homo sapiens
tggctataacagtgtctttctag

SEQ ID NO: 1058338 - DNA, 18 bp, Homo sapiens
tggctatagatgtctttt

SEQ ID NO: 1058339 - DNA, 20 bp, Homo sapiens
tggctatgaaaatgagccct

SEQ ID NO: 1058340 - DNA, 15 bp, Homo sapiens
tggctatgaacagaa

SEQ ID NO: 1058341 - DNA, 17 bp, Homo sapiens
tggctatgtttttaatg

SEQ ID NO: 1058342 - DNA, 22 bp, Homo sapiens
tggctcaagacaaggctggcaa

SEQ ID NO: 1058343 - DNA, 16 bp, Homo sapiens
tggctcaatcctctaa

SEQ ID NO: 1058344 - DNA, 14 bp, Homo sapiens
tggctcacagtaca

SEQ ID NO: 1058345 - DNA, 23 bp, Homo sapiens
tggctcacgccccgctgtgtcct

SEQ ID NO: 1058346 - DNA, 13 bp, Homo sapiens
tggctcactactg

SEQ ID NO: 1058347 - DNA, 14 bp, Homo sapiens
tggctcactggctg

SEQ ID NO: 1058348 - DNA, 20 bp, Homo sapiens
tggctcagagcttgaagatt

SEQ ID NO: 1058349 - DNA, 22 bp, Homo sapiens
tggctcagagggggactgctgc

SEQ ID NO: 1058350 - DNA, 13 bp, Homo sapiens
tggctcagccagc

SEQ ID NO: 1058351 - DNA, 24 bp, Homo sapiens
tggctcagcctgtctcgggctgac

SEQ ID NO: 1058352 - DNA, 16 bp, Homo sapiens
tggctcaggcaagccc

SEQ ID NO: 1058353 - DNA, 18 bp, Homo sapiens
tggctcaggcaagcccct

SEQ ID NO: 1058354 - DNA, 22 bp, Homo sapiens
tggctcaggcagacaagagctg

SEQ ID NO: 1058355 - DNA, 18 bp, Homo sapiens
tggctcaggggagcaagc

SEQ ID NO: 1058356 - DNA, 23 bp, Homo sapiens
tggctcatggcgtaatgggcctg

SEQ ID NO: 1058357 - DNA, 20 bp, Homo sapiens
tggctccagaaatgtctaaa

SEQ ID NO: 1058358 - DNA, 15 bp, Homo sapiens
tggctccagtctgct

SEQ ID NO: 1058359 - DNA, 19 bp, Homo sapiens
tggctccagtctgctgccc

SEQ ID NO: 1058360 - DNA, 20 bp, Homo sapiens
tggctcccagggtggaggaa

SEQ ID NO: 1058361 - DNA, 20 bp, Homo sapiens
tggctcccatgaccatactg

SEQ ID NO: 1058362 - DNA, 15 bp, Homo sapiens
tggctccccacctgg

SEQ ID NO: 1058363 - DNA, 18 bp, Homo sapiens
tggctccccacctggaca

SEQ ID NO: 1058364 - DNA, 20 bp, Homo sapiens
tggctccccctccccaggct

SEQ ID NO: 1058365 - DNA, 23 bp, Homo sapiens
tggctccccctccccaggctgga

SEQ ID NO: 1058366 - DNA, 15 bp, Homo sapiens
tggctccccctctgc

SEQ ID NO: 1058367 - DNA, 23 bp, Homo sapiens
tggctcccctctatttagcatga

SEQ ID NO: 1058368 - DNA, 19 bp, Homo sapiens
tggctccctcctccaggcc

SEQ ID NO: 1058369 - DNA, 17 bp, Homo sapiens
tggctccctgggcagtg

SEQ ID NO: 1058370 - DNA, 23 bp, Homo sapiens
tggctccgcaggggtttgggtgg

SEQ ID NO: 1058371 - DNA, 20 bp, Homo sapiens
tggctcctaccagcaaacag

SEQ ID NO: 1058372 - DNA, 16 bp, Homo sapiens
tggctcctatctgtgt

SEQ ID NO: 1058373 - DNA, 14 bp, Homo sapiens
tggctcctcccagc

SEQ ID NO: 1058374 - DNA, 16 bp, Homo sapiens
tggctcctcccggtgc

SEQ ID NO: 1058375 - DNA, 18 bp, Homo sapiens
tggctcctccgtctgacc

SEQ ID NO: 1058376 - DNA, 21 bp, Homo sapiens
tggctcctccgtctgaccctc

SEQ ID NO: 1058377 - DNA, 14 bp, Homo sapiens
tggctcctcctagg

SEQ ID NO: 1058378 - DNA, 15 bp, Homo sapiens
tggctcctcctagga

SEQ ID NO: 1058379 - DNA, 12 bp, Homo sapiens
tggctcctctca

SEQ ID NO: 1058380 - DNA, 20 bp, Homo sapiens
tggctcctgaggggcatctg

SEQ ID NO: 1058381 - DNA, 21 bp, Homo sapiens
tggctcctgaggggcatctgc

SEQ ID NO: 1058382 - DNA, 23 bp, Homo sapiens
tggctcctgaggggcatctgccc

SEQ ID NO: 1058383 - DNA, 17 bp, Homo sapiens
tggctccttcccatcgc

SEQ ID NO: 1058384 - DNA, 15 bp, Homo sapiens
tggctccttgccctc

SEQ ID NO: 1058385 - DNA, 19 bp, Homo sapiens
tggctcgcagggtgcagga

SEQ ID NO: 1058386 - DNA, 17 bp, Homo sapiens
tggctcggacccacccc

SEQ ID NO: 1058387 - DNA, 17 bp, Homo sapiens
tggctcgttctcttctc

SEQ ID NO: 1058388 - DNA, 13 bp, Homo sapiens
tggctctaccctg

SEQ ID NO: 1058389 - DNA, 20 bp, Homo sapiens
tggctctaccctgtctgtcc

SEQ ID NO: 1058390 - DNA, 22 bp, Homo sapiens
tggctctaccctgtctgtccct

SEQ ID NO: 1058391 - DNA, 16 bp, Homo sapiens
tggctctcagaaggta

SEQ ID NO: 1058392 - DNA, 21 bp, Homo sapiens
tggctctcagttaaaatgtga

SEQ ID NO: 1058393 - DNA, 20 bp, Homo sapiens
tggctctccaagtgccagag

SEQ ID NO: 1058394 - DNA, 23 bp, Homo sapiens
tggctctccaagtgccagaggtg

SEQ ID NO: 1058395 - DNA, 16 bp, Homo sapiens
tggctctcccaccccg

SEQ ID NO: 1058396 - DNA, 17 bp, Homo sapiens
tggctctcctggccctg

SEQ ID NO: 1058397 - DNA, 22 bp, Homo sapiens
tggctctctcttcctaccctcc

SEQ ID NO: 1058398 - DNA, 21 bp, Homo sapiens
tggctctctgacgtcaaccca

SEQ ID NO: 1058399 - DNA, 14 bp, Homo sapiens
tggctctgacaaga

SEQ ID NO: 1058400 - DNA, 14 bp, Homo sapiens
tggctctgcaatgg

SEQ ID NO: 1058401 - DNA, 11 bp, Homo sapiens
tggctctgccc

SEQ ID NO: 1058402 - DNA, 17 bp, Homo sapiens
tggctctgccccctccc

SEQ ID NO: 1058403 - DNA, 18 bp, Homo sapiens
tggctctgccccctcccc

SEQ ID NO: 1058404 - DNA, 14 bp, Homo sapiens
tggctctgccccgc

SEQ ID NO: 1058405 - DNA, 16 bp, Homo sapiens
tggctctgcccctcag

SEQ ID NO: 1058406 - DNA, 18 bp, Homo sapiens
tggctctgcccctcaggg

SEQ ID NO: 1058407 - DNA, 11 bp, Homo sapiens
tggctctggga

SEQ ID NO: 1058408 - DNA, 11 bp, Homo sapiens
tggctctgggc

SEQ ID NO: 1058409 - DNA, 17 bp, Homo sapiens
tggctctgggggaccca

SEQ ID NO: 1058410 - DNA, 12 bp, Homo sapiens
tggctctggggt

SEQ ID NO: 1058411 - DNA, 19 bp, Homo sapiens
tggctcttgatacccccct

SEQ ID NO: 1058412 - DNA, 18 bp, Homo sapiens
tggctcttggcttccaga

SEQ ID NO: 1058413 - DNA, 20 bp, Homo sapiens
tggctctttctatcctgctc

SEQ ID NO: 1058414 - DNA, 20 bp, Homo sapiens
tggctgaaattctcctggag

SEQ ID NO: 1058415 - DNA, 21 bp, Homo sapiens
tggctgaaattctcctggagg

SEQ ID NO: 1058416 - DNA, 15 bp, Homo sapiens
tggctgaaccctgtg

SEQ ID NO: 1058417 - DNA, 16 bp, Homo sapiens
tggctgaaccctgtgc

SEQ ID NO: 1058418 - DNA, 18 bp, Homo sapiens
tggctgaagctggagcag

SEQ ID NO: 1058419 - DNA, 18 bp, Homo sapiens
tggctgacatgaagctgt

SEQ ID NO: 1058420 - DNA, 19 bp, Homo sapiens
tggctgacccagtccctgg

SEQ ID NO: 1058421 - DNA, 21 bp, Homo sapiens
tggctgacccagtccctgggg

SEQ ID NO: 1058422 - DNA, 16 bp, Homo sapiens
tggctgacccctctgg

SEQ ID NO: 1058423 - DNA, 17 bp, Homo sapiens
tggctgacccctctggt

SEQ ID NO: 1058424 - DNA, 15 bp, Homo sapiens
tggctgacctgggcc

SEQ ID NO: 1058425 - DNA, 17 bp, Homo sapiens
tggctgagacactgaag

SEQ ID NO: 1058426 - DNA, 13 bp, Homo sapiens
tggctgagcccct

SEQ ID NO: 1058427 - DNA, 17 bp, Homo sapiens
tggctgagcccctgtct

SEQ ID NO: 1058428 - DNA, 19 bp, Homo sapiens
tggctgagcctcgtgtcca

SEQ ID NO: 1058429 - DNA, 19 bp, Homo sapiens
tggctgagcggatgcatct

SEQ ID NO: 1058430 - DNA, 20 bp, Homo sapiens
tggctgaggttcctctgcct

SEQ ID NO: 1058431 - DNA, 22 bp, Homo sapiens
tggctgaggttcctctgcctgc

SEQ ID NO: 1058432 - DNA, 14 bp, Homo sapiens
tggctgataatttt

SEQ ID NO: 1058433 - DNA, 16 bp, Homo sapiens
tggctgatctatgcct

SEQ ID NO: 1058434 - DNA, 22 bp, Homo sapiens
tggctgatgatccagaacagtg

SEQ ID NO: 1058435 - DNA, 20 bp, Homo sapiens
tggctgatttatttctacta

SEQ ID NO: 1058436 - DNA, 13 bp, Homo sapiens
tggctgcacaggc

SEQ ID NO: 1058437 - DNA, 15 bp, Homo sapiens
tggctgcacaggctg

SEQ ID NO: 1058438 - DNA, 20 bp, Homo sapiens
tggctgcatcccccccacct

SEQ ID NO: 1058439 - DNA, 22 bp, Homo sapiens
tggctgccaggcgttggtgcca

SEQ ID NO: 1058440 - DNA, 22 bp, Homo sapiens
tggctgcccatcatgtggcccc

SEQ ID NO: 1058441 - DNA, 17 bp, Homo sapiens
tggctgccccaacctgc

SEQ ID NO: 1058442 - DNA, 20 bp, Homo sapiens
tggctgccccaacctgctga

SEQ ID NO: 1058443 - DNA, 14 bp, Homo sapiens
tggctgccctggcc

SEQ ID NO: 1058444 - DNA, 16 bp, Homo sapiens
tggctgccctggccct

SEQ ID NO: 1058445 - DNA, 17 bp, Homo sapiens
tggctgccctggccctg

SEQ ID NO: 1058446 - DNA, 19 bp, Homo sapiens
tggctgcgctaacccccag

SEQ ID NO: 1058447 - DNA, 20 bp, Homo sapiens
tggctgcgtactccactggt

SEQ ID NO: 1058448 - DNA, 17 bp, Homo sapiens
tggctgctagattttaa

SEQ ID NO: 1058449 - DNA, 16 bp, Homo sapiens
tggctgctaggccaga

SEQ ID NO: 1058450 - DNA, 12 bp, Homo sapiens
tggctgctgccc

SEQ ID NO: 1058451 - DNA, 15 bp, Homo sapiens
tggctgctgcttctt

SEQ ID NO: 1058452 - DNA, 13 bp, Homo sapiens
tggctgctgggct

SEQ ID NO: 1058453 - DNA, 17 bp, Homo sapiens
tggctgcttcctgtgac

SEQ ID NO: 1058454 - DNA, 12 bp, Homo sapiens
tggctgcttctc

SEQ ID NO: 1058455 - DNA, 17 bp, Homo sapiens
tggctgcttgcagccag

SEQ ID NO: 1058456 - DNA, 20 bp, Homo sapiens
tggctgcttgcagccaggag

SEQ ID NO: 1058457 - DNA, 18 bp, Homo sapiens
tggctggaaagcagagcc

SEQ ID NO: 1058458 - DNA, 19 bp, Homo sapiens
tggctggaagatcctgcgg

SEQ ID NO: 1058459 - DNA, 13 bp, Homo sapiens
tggctggaagggg

SEQ ID NO: 1058460 - DNA, 11 bp, Homo sapiens
tggctggagcg

SEQ ID NO: 1058461 - DNA, 22 bp, Homo sapiens
tggctggcagctgagagccctg

SEQ ID NO: 1058462 - DNA, 17 bp, Homo sapiens
tggctggcccgtcatgt

SEQ ID NO: 1058463 - DNA, 11 bp, Homo sapiens
tggctggctct

SEQ ID NO: 1058464 - DNA, 20 bp, Homo sapiens
tggctggctctaccttcctg

SEQ ID NO: 1058465 - DNA, 13 bp, Homo sapiens
tggctggctgcag

SEQ ID NO: 1058466 - DNA, 23 bp, Homo sapiens
tggctggcttgtttgatttcaac

SEQ ID NO: 1058467 - DNA, 15 bp, Homo sapiens
tggctgggacgtggc

SEQ ID NO: 1058468 - DNA, 19 bp, Homo sapiens
tggctgggacgtggctcag

SEQ ID NO: 1058469 - DNA, 14 bp, Homo sapiens
tggctgggaggagg

SEQ ID NO: 1058470 - DNA, 20 bp, Homo sapiens
tggctgggagtccttacctc

SEQ ID NO: 1058471 - DNA, 12 bp, Homo sapiens
tggctgggccca

SEQ ID NO: 1058472 - DNA, 14 bp, Homo sapiens
tggctgggcccctg

SEQ ID NO: 1058473 - DNA, 15 bp, Homo sapiens
tggctgggcccctgg

SEQ ID NO: 1058474 - DNA, 16 bp, Homo sapiens
tggctgggcccctggg

SEQ ID NO: 1058475 - DNA, 22 bp, Homo sapiens
tggctgggcccctggggacaga

SEQ ID NO: 1058476 - DNA, 20 bp, Homo sapiens
tggctggggcagaggggcag

SEQ ID NO: 1058477 - DNA, 14 bp, Homo sapiens
tggctgggtcaggg

SEQ ID NO: 1058478 - DNA, 19 bp, Homo sapiens
tggctgggtcagggccaga

SEQ ID NO: 1058479 - DNA, 22 bp, Homo sapiens
tggctgggtcagggccagactg

SEQ ID NO: 1058480 - DNA, 23 bp, Homo sapiens
tggctgggtcagggccagactgg

SEQ ID NO: 1058481 - DNA, 19 bp, Homo sapiens
tggctgggtgccctctcag

SEQ ID NO: 1058482 - DNA, 23 bp, Homo sapiens
tggctggtagaaaaaggggcctg

SEQ ID NO: 1058483 - DNA, 17 bp, Homo sapiens
tggctggtagcagcagg

SEQ ID NO: 1058484 - DNA, 23 bp, Homo sapiens
tggctggtagcagcaggctcagg

SEQ ID NO: 1058485 - DNA, 15 bp, Homo sapiens
tggctggtccagggc

SEQ ID NO: 1058486 - DNA, 16 bp, Homo sapiens
tggctggtcttcactt

SEQ ID NO: 1058487 - DNA, 23 bp, Homo sapiens
tggctggtcttcactttcctcag

SEQ ID NO: 1058488 - DNA, 16 bp, Homo sapiens
tggctggtgagccggt

SEQ ID NO: 1058489 - DNA, 15 bp, Homo sapiens
tggctggtgtcccct

SEQ ID NO: 1058490 - DNA, 15 bp, Homo sapiens
tggctgtaacctgct

SEQ ID NO: 1058491 - DNA, 15 bp, Homo sapiens
tggctgtatttgctg

SEQ ID NO: 1058492 - DNA, 11 bp, Homo sapiens
tggctgtccct

SEQ ID NO: 1058493 - DNA, 16 bp, Homo sapiens
tggctgtccttcccct

SEQ ID NO: 1058494 - DNA, 19 bp, Homo sapiens
tggctgtccttccccttcc

SEQ ID NO: 1058495 - DNA, 22 bp, Homo sapiens
tggccttccccttttgcctggc

SEQ ID NO: 1058496 - DNA, 22 bp, Homo sapiens
tggccttctcctacttagggaa

SEQ ID NO: 1058497 - DNA, 23 bp, Homo sapiens
tggccttgcagcactcacacagg

SEQ ID NO: 1058498 - DNA, 13 bp, Homo sapiens
tggccttgcccgc

SEQ ID NO: 1058499 - DNA, 22 bp, Homo sapiens
tggccttgcccgccagcctcag

SEQ ID NO: 1058500 - DNA, 22 bp, Homo sapiens
tggccttgcccgtcgtgtgctg

SEQ ID NO: 1058501 - DNA, 14 bp, Homo sapiens
tggccttgggccgg

SEQ ID NO: 1058502 - DNA, 16 bp, Homo sapiens
tggccttgggccggtg

SEQ ID NO: 1058503 - DNA, 20 bp, Homo sapiens
tggccttgggccggtgctgg

SEQ ID NO: 1058504 - DNA, 17 bp, Homo sapiens
tggccttggtatgtgcc

SEQ ID NO: 1058505 - DNA, 19 bp, Homo sapiens
tggccttggtatgtgccag

SEQ ID NO: 1058506 - DNA, 20 bp, Homo sapiens
tggccttggtatgtgccagg

SEQ ID NO: 1058507 - DNA, 23 bp, Homo sapiens
tggccttggtatgtgccaggctt

SEQ ID NO: 1058508 - DNA, 23 bp, Homo sapiens
tggccttgtaagacccttattgc

SEQ ID NO: 1058509 - DNA, 23 bp, Homo sapiens
tggcctttcacttttagttggca

SEQ ID NO: 1058510 - DNA, 14 bp, Homo sapiens
tggcctttccttcc

SEQ ID NO: 1058511 - DNA, 16 bp, Homo sapiens
tggcctttccttccct

SEQ ID NO: 1058512 - DNA, 18 bp, Homo sapiens
tggcctttccttccctct

SEQ ID NO: 1058513 - DNA, 18 bp, Homo sapiens
tggcctttcttggggaga

SEQ ID NO: 1058514 - DNA, 21 bp, Homo sapiens
tggcctttgcttatgaatatt

SEQ ID NO: 1058515 - DNA, 18 bp, Homo sapiens
tggcctttggacccaggg

SEQ ID NO: 1058516 - DNA, 14 bp, Homo sapiens
tggcctttgtgctg

SEQ ID NO: 1058517 - DNA, 20 bp, Homo sapiens
tggccttttgctacgtgcct

SEQ ID NO: 1058518 - DNA, 16 bp, Homo sapiens
tggcctttttcattta

SEQ ID NO: 1058519 - DNA, 19 bp, Homo sapiens
tggcctttttcatttatct

SEQ ID NO: 1058520 - DNA, 20 bp, Homo sapiens
tggcctttttcatttatcta

SEQ ID NO: 1058521 - DNA, 19 bp, Homo sapiens
tggccttttttataactaa

SEQ ID NO: 1058522 - DNA, 19 bp, Homo sapiens
tggcgacactcagggcagc

SEQ ID NO: 1058523 - DNA, 17 bp, Homo sapiens
tggcttccctaaactgc

SEQ ID NO: 1058524 - DNA, 22 bp, Homo sapiens
tggcttcctccgtccacccagg

SEQ ID NO: 1058525 - DNA, 16 bp, Homo sapiens
tggcttcctttcttgg

SEQ ID NO: 1058526 - DNA, 16 bp, Homo sapiens
tggcttcggagggccg

SEQ ID NO: 1058527 - DNA, 22 bp, Homo sapiens
tggcttcggagggccgcagggc

SEQ ID NO: 1058528 - DNA, 22 bp, Homo sapiens
tggcttcgtcatttgcaagctg

SEQ ID NO: 1058529 - DNA, 15 bp, Homo sapiens
tggcttctcctgtga

SEQ ID NO: 1058530 - DNA, 13 bp, Homo sapiens
tggcttctctgtc

SEQ ID NO: 1058531 - DNA, 19 bp, Homo sapiens
tggcttctgggacctgtgt

SEQ ID NO: 1058532 - DNA, 14 bp, Homo sapiens
tggcttctgtgatg

SEQ ID NO: 1058533 - DNA, 21 bp, Homo sapiens
tggcttctgtgatgagctgat

SEQ ID NO: 1058534 - DNA, 15 bp, Homo sapiens
tggcttcttaaaaac

SEQ ID NO: 1058535 - DNA, 21 bp, Homo sapiens
tggcttcttaaaaactgtgta

SEQ ID NO: 1058536 - DNA, 15 bp, Homo sapiens
tggcttcttatcctt

SEQ ID NO: 1058537 - DNA, 13 bp, Homo sapiens
tggcttctttcca

SEQ ID NO: 1058538 - DNA, 16 bp, Homo sapiens
tggcttgaaggactgc

SEQ ID NO: 1058539 - DNA, 17 bp, Homo sapiens
tggcttgaaggactgca

SEQ ID NO: 1058540 - DNA, 18 bp, Homo sapiens
tggcttgacatgtgcaat

SEQ ID NO: 1058541 - DNA, 16 bp, Homo sapiens
tggcttgccccaggac

SEQ ID NO: 1058542 - DNA, 14 bp, Homo sapiens
tggcttgctccagg

SEQ ID NO: 1058543 - DNA, 16 bp, Homo sapiens
tggcttgctccagggt

SEQ ID NO: 1058544 - DNA, 18 bp, Homo sapiens
tggcttgctccagggtct

SEQ ID NO: 1058545 - DNA, 15 bp, Homo sapiens
tggcttggaggaaat

SEQ ID NO: 1058546 - DNA, 14 bp, Homo sapiens
tggcttggagtggc

SEQ ID NO: 1058547 - DNA, 17 bp, Homo sapiens
tggcttggcatctgtgt

SEQ ID NO: 1058548 - DNA, 14 bp, Homo sapiens
tggcttggccttgg

SEQ ID NO: 1058549 - DNA, 17 bp, Homo sapiens
tggcttgggcagggtct

SEQ ID NO: 1058550 - DNA, 17 bp, Homo sapiens
tggcttgtagaattttt

SEQ ID NO: 1058551 - DNA, 17 bp, Homo sapiens
tggctttaattgtataa

SEQ ID NO: 1058552 - DNA, 17 bp, Homo sapiens
tggctttcaaggctggg

SEQ ID NO: 1058553 - DNA, 19 bp, Homo sapiens
tggctttcaaggctggggc

SEQ ID NO: 1058554 - DNA, 14 bp, Homo sapiens
tggctttcatcctg

SEQ ID NO: 1058555 - DNA, 19 bp, Homo sapiens
tggctttcatcctgtgtcc

SEQ ID NO: 1058556 - DNA, 15 bp, Homo sapiens
tggctttccaggcac

SEQ ID NO: 1058557 - DNA, 13 bp, Homo sapiens
tggctttcccagg

SEQ ID NO: 1058558 - DNA, 14 bp, Homo sapiens
tggctttctccctg

SEQ ID NO: 1058559 - DNA, 13 bp, Homo sapiens
tggctttgcccac

SEQ ID NO: 1058560 - DNA, 18 bp, Homo sapiens
tggctttggcagtgtttt

SEQ ID NO: 1058561 - DNA, 17 bp, Homo sapiens
tggctttggcttcttgg

SEQ ID NO: 1058562 - DNA, 20 bp, Homo sapiens
tggctttgtgattcaatctg

SEQ ID NO: 1058563 - DNA, 17 bp, Homo sapiens
tggcttttattaatgca

SEQ ID NO: 1058564 - DNA, 22 bp, Homo sapiens
tggcttttattaatgcactttc

SEQ ID NO: 1058565 - DNA, 17 bp, Homo sapiens
tggcttttgcctgtaag

SEQ ID NO: 1058566 - DNA, 20 bp, Homo sapiens
tggcttttgcggttcaggaa

SEQ ID NO: 1058567 - DNA, 19 bp, Homo sapiens
tgggaaaaaaatgaatgag

SEQ ID NO: 1058568 - DNA, 22 bp, Homo sapiens
tgggaaaaaagttttgatgaaa

SEQ ID NO: 1058569 - DNA, 23 bp, Homo sapiens
tgggaaaaatgcccttaaatcat

SEQ ID NO: 1058570 - DNA, 10 bp, Homo sapiens
tgggaaacac

SEQ ID NO: 1058571 - DNA, 14 bp, Homo sapiens
tgggaaacctgcct

SEQ ID NO: 1058572 - DNA, 15 bp, Homo sapiens
tgggaaacctgcctt

SEQ ID NO: 1058573 - DNA, 18 bp, Homo sapiens
tgggaaacttggctcgaa

SEQ ID NO: 1058574 - DNA, 21 bp, Homo sapiens
tgggaaagaaggcaaagtccc

SEQ ID NO: 1058575 - DNA, 16 bp, Homo sapiens
tgggaaagatggataa

SEQ ID NO: 1058576 - DNA, 15 bp, Homo sapiens
tgggaaagccacctc

SEQ ID NO: 1058577 - DNA, 21 bp, Homo sapiens
tgggaaagccacctctccctc

SEQ ID NO: 1058578 - DNA, 19 bp, Homo sapiens
tgggaaaggacccacccat

SEQ ID NO: 1058579 - DNA, 22 bp, Homo sapiens
tgggaaatagggcaagaattct

SEQ ID NO: 1058580 - DNA, 19 bp, Homo sapiens
tgggaaatatttagcaaat

SEQ ID NO: 1058581 - DNA, 14 bp, Homo sapiens
tgggaaatgcagaa

SEQ ID NO: 1058582 - DNA, 15 bp, Homo sapiens
tgggaaattgaagtg

SEQ ID NO: 1058583 - DNA, 22 bp, Homo sapiens
tgggaaattgaagtgtcttctg

SEQ ID NO: 1058584 - DNA, 16 bp, Homo sapiens
tgggaaatttttaatg

SEQ ID NO: 1058585 - DNA, 19 bp, Homo sapiens
tgggaacaggccccacgcc

SEQ ID NO: 1058586 - DNA, 23 bp, Homo sapiens
tgggaacagtaaagaaagcagaa

SEQ ID NO: 1058587 - DNA, 21 bp, Homo sapiens
tgggaacatgacccagcctga

SEQ ID NO: 1058588 - DNA, 14 bp, Homo sapiens
tgggaaccccgcag

SEQ ID NO: 1058589 - DNA, 23 bp, Homo sapiens
tgggaacctagtactctctgctc

SEQ ID NO: 1058590 - DNA, 17 bp, Homo sapiens
tgggaacctcccagagg

SEQ ID NO: 1058591 - DNA, 22 bp, Homo sapiens
tgggaacctcccagaggtccag

SEQ ID NO: 1058592 - DNA, 15 bp, Homo sapiens
tgggaacgcagcctc

SEQ ID NO: 1058593 - DNA, 23 bp, Homo sapiens
tgggaacggctgatgtggactgt

SEQ ID NO: 1058594 - DNA, 18 bp, Homo sapiens
tgggaacgtgtgtccagg

SEQ ID NO: 1058595 - DNA, 21 bp, Homo sapiens
tgggaagactcaggagtctgc

SEQ ID NO: 1058596 - DNA, 22 bp, Homo sapiens
tgggaagataggctctgcacag

SEQ ID NO: 1058597 - DNA, 17 bp, Homo sapiens
tgggaagatggtttgaa

SEQ ID NO: 1058598 - DNA, 15 bp, Homo sapiens
tgggaagcagggaat

SEQ ID NO: 1058599 - DNA, 22 bp, Homo sapiens
tgggacccacgaaactgccctg

SEQ ID NO: 1058600 - DNA, 20 bp, Homo sapiens
tgggacccagctactctgtc

SEQ ID NO: 1058601 - DNA, 21 bp, Homo sapiens
tgggacccatagatcttctga

SEQ ID NO: 1058602 - DNA, 13 bp, Homo sapiens
tgggaccccctcg

SEQ ID NO: 1058603 - DNA, 23 bp, Homo sapiens
tgggaccctgtccggcccagtgc

SEQ ID NO: 1058604 - DNA, 13 bp, Homo sapiens
tgggacccttggc

SEQ ID NO: 1058605 - DNA, 14 bp, Homo sapiens
tgggaccctttcct

SEQ ID NO: 1058606 - DNA, 19 bp, Homo sapiens
tgggaccgtgcgagctgcc

SEQ ID NO: 1058607 - DNA, 16 bp, Homo sapiens
tgggacctaatgctgg

SEQ ID NO: 1058608 - DNA, 21 bp, Homo sapiens
tgggacctaatgctggcctga

SEQ ID NO: 1058609 - DNA, 15 bp, Homo sapiens
tgggacctcctccct

SEQ ID NO: 1058610 - DNA, 20 bp, Homo sapiens
tgggacctgccaggcagggg

SEQ ID NO: 1058611 - DNA, 21 bp, Homo sapiens
tgggacctgccctccctcagc

SEQ ID NO: 1058612 - DNA, 14 bp, Homo sapiens
tgggacggtgccca

SEQ ID NO: 1058613 - DNA, 15 bp, Homo sapiens
tgggacgtggctcag

SEQ ID NO: 1058614 - DNA, 16 bp, Homo sapiens
tgggacgtggctcagc

SEQ ID NO: 1058615 - DNA, 22 bp, Homo sapiens
tgggacgtgtacagcacagaat

SEQ ID NO: 1058616 - DNA, 22 bp, Homo sapiens
tgggactagaggctcagtggtg

SEQ ID NO: 1058617 - DNA, 20 bp, Homo sapiens
tgggactaggacctgagcct

SEQ ID NO: 1058618 - DNA, 15 bp, Homo sapiens
tgggactcaggatat

SEQ ID NO: 1058619 - DNA, 20 bp, Homo sapiens
tgggactcaggtctgtaact

SEQ ID NO: 1058620 - DNA, 23 bp, Homo sapiens
tgggactctcctcctcccctcct

SEQ ID NO: 1058621 - DNA, 16 bp, Homo sapiens
tgggactgagaaggct

SEQ ID NO: 1058622 - DNA, 18 bp, Homo sapiens
tgggactgctaaataaaa

SEQ ID NO: 1058623 - DNA, 22 bp, Homo sapiens
tgggactggacagctttgctcc

SEQ ID NO: 1058624 - DNA, 12 bp, Homo sapiens
tgggactggagt

SEQ ID NO: 1058625 - DNA, 13 bp, Homo sapiens
tgggactggagtc

SEQ ID NO: 1058626 - DNA, 18 bp, Homo sapiens
tgggactggtgggggttc

SEQ ID NO: 1058627 - DNA, 17 bp, Homo sapiens
tgggacttttctttctt

SEQ ID NO: 1058628 - DNA, 21 bp, Homo sapiens
tgggagaaaacgccagtgtgt

SEQ ID NO: 1058629 - DNA, 19 bp, Homo sapiens
tgggagaaattgacagatc

SEQ ID NO: 1058630 - DNA, 22 bp, Homo sapiens
tgggagaacctcaggcttcctt

SEQ ID NO: 1058631 - DNA, 18 bp, Homo sapiens
tgggagaatgtcagttca

SEQ ID NO: 1058632 - DNA, 21 bp, Homo sapiens
tgggagaattcttacatgttt

SEQ ID NO: 1058633 - DNA, 20 bp, Homo sapiens
tgggagacaactggacaaga

SEQ ID NO: 1058634 - DNA, 22 bp, Homo sapiens
tgggagacaagaaatccctgtt

SEQ ID NO: 1058635 - DNA, 13 bp, Homo sapiens
tgggagacagcag

SEQ ID NO: 1058636 - DNA, 19 bp, Homo sapiens
tgggagacatggaccagca

SEQ ID NO: 1058637 - DNA, 22 bp, Homo sapiens
tgggagacatggaccagcatct

SEQ ID NO: 1058638 - DNA, 15 bp, Homo sapiens
tgggagacatgtgac

SEQ ID NO: 1058639 - DNA, 16 bp, Homo sapiens
tgggagacatgtgaca

SEQ ID NO: 1058640 - DNA, 18 bp, Homo sapiens
tgggagacctgtaatcat

SEQ ID NO: 1058641 - DNA, 21 bp, Homo sapiens
tgggagacctgttggcctgtg

SEQ ID NO: 1058642 - DNA, 23 bp, Homo sapiens
tgggagacgaacggaagggttgg

SEQ ID NO: 1058643 - DNA, 18 bp, Homo sapiens
tgggagactctttgaaat

SEQ ID NO: 1058644 - DNA, 20 bp, Homo sapiens
tgggagactctttgaaatga

SEQ ID NO: 1058645 - DNA, 14 bp, Homo sapiens
tgggagagccagct

SEQ ID NO: 1058646 - DNA, 17 bp, Homo sapiens
tgggagagccagctttg

SEQ ID NO: 1058647 - DNA, 16 bp, Homo sapiens
tgggagagccatacat

SEQ ID NO: 1058648 - DNA, 14 bp, Homo sapiens
tgggagagcccagc

SEQ ID NO: 1058649 - DNA, 17 bp, Homo sapiens
tgggagaggctgggagg

SEQ ID NO: 1058650 - DNA, 22 bp, Homo sapiens
tgggagaggtgccagcaactga

SEQ ID NO: 1058651 - DNA, 22 bp, Homo sapiens
tgggagatggcagcagtgaagc

SEQ ID NO: 1058652 - DNA, 18 bp, Homo sapiens
tgggagatttttttgagt

SEQ ID NO: 1058653 - DNA, 21 bp, Homo sapiens
tgggagcaaaataaggaagag

SEQ ID NO: 1058654 - DNA, 23 bp, Homo sapiens
tgggagcactggagtgcagggag

SEQ ID NO: 1058655 - DNA, 21 bp, Homo sapiens
tgggagcagcggtttggggag

SEQ ID NO: 1058656 - DNA, 11 bp, Homo sapiens
tgggagcagct

SEQ ID NO: 1058657 - DNA, 13 bp, Homo sapiens
tgggagcagcttc

SEQ ID NO: 1058658 - DNA, 17 bp, Homo sapiens
tgggagccacttctccc

SEQ ID NO: 1058659 - DNA, 20 bp, Homo sapiens
tgggagccacttctccccag

SEQ ID NO: 1058660 - DNA, 16 bp, Homo sapiens
tgggagccagctgctt

SEQ ID NO: 1058661 - DNA, 17 bp, Homo sapiens
tgggagccagctgcttt

SEQ ID NO: 1058662 - DNA, 13 bp, Homo sapiens
tgggagccccagg

SEQ ID NO: 1058663 - DNA, 21 bp, Homo sapiens
tgggagccctgaccttggctg

SEQ ID NO: 1058664 - DNA, 13 bp, Homo sapiens
tgggagccgcctg

SEQ ID NO: 1058665 - DNA, 22 bp, Homo sapiens
tgggagccgggaccctcaggtg

SEQ ID NO: 1058666 - DNA, 14 bp, Homo sapiens
tgggagccgggtct

SEQ ID NO: 1058667 - DNA, 18 bp, Homo sapiens
tgggagccgggtctgcct

SEQ ID NO: 1058668 - DNA, 16 bp, Homo sapiens
tgggagcctaaggaag

SEQ ID NO: 1058669 - DNA, 12 bp, Homo sapiens
tgggagcctagc

SEQ ID NO: 1058670 - DNA, 16 bp, Homo sapiens
tgggagcctgaggcag

SEQ ID NO: 1058671 - DNA, 18 bp, Homo sapiens
tgggagcctgaggcagga

SEQ ID NO: 1058672 - DNA, 21 bp, Homo sapiens
tgggagcctggttcagacaca

SEQ ID NO: 1058673 - DNA, 14 bp, Homo sapiens
tgggctcccaccct

SEQ ID NO: 1058674 - DNA, 11 bp, Homo sapiens
tgggctccctg

SEQ ID NO: 1058675 - DNA, 17 bp, Homo sapiens
tgggctcccttgtgcgt

SEQ ID NO: 1058676 - DNA, 21 bp, Homo sapiens
tgggctccggaggactcacca

SEQ ID NO: 1058677 - DNA, 17 bp, Homo sapiens
tgggctcctggaaccaa

SEQ ID NO: 1058678 - DNA, 15 bp, Homo sapiens
tgggctcctggctgc

SEQ ID NO: 1058679 - DNA, 16 bp, Homo sapiens
tgggctcctggctgcc

SEQ ID NO: 1058680 - DNA, 21 bp, Homo sapiens
tgggctcctggctgccaggcg

SEQ ID NO: 1058681 - DNA, 21 bp, Homo sapiens
tgggctcgccgtgtctcagcc

SEQ ID NO: 1058682 - DNA, 14 bp, Homo sapiens
tgggctctacctct

SEQ ID NO: 1058683 - DNA, 20 bp, Homo sapiens
tgggctctacctctctttct

SEQ ID NO: 1058684 - DNA, 15 bp, Homo sapiens
tgggctctccacctc

SEQ ID NO: 1058685 - DNA, 21 bp, Homo sapiens
tgggctctccacctcagcctt

SEQ ID NO: 1058686 - DNA, 20 bp, Homo sapiens
tgggctctgcaattcccctc

SEQ ID NO: 1058687 - DNA, 12 bp, Homo sapiens
tgggctctgccc

SEQ ID NO: 1058688 - DNA, 18 bp, Homo sapiens
tgggctctgtgcagtcac

SEQ ID NO: 1058689 - DNA, 18 bp, Homo sapiens
tgggctgaatgtatgtaa

SEQ ID NO: 1058690 - DNA, 13 bp, Homo sapiens
tgggctgacacct

SEQ ID NO: 1058691 - DNA, 22 bp, Homo sapiens
tgggctgacacctaccatgctg

SEQ ID NO: 1058692 - DNA, 20 bp, Homo sapiens
tgggctgacccagcatctcc

SEQ ID NO: 1058693 - DNA, 18 bp, Homo sapiens
tgggctgacggtgcagtc

SEQ ID NO: 1058694 - DNA, 14 bp, Homo sapiens
tgggctgagactgg

SEQ ID NO: 1058695 - DNA, 15 bp, Homo sapiens
tgggctgagcccctg

SEQ ID NO: 1058696 - DNA, 14 bp, Homo sapiens
tgggctgagctagc

SEQ ID NO: 1058697 - DNA, 17 bp, Homo sapiens
tgggctgagctagcctc

SEQ ID NO: 1058698 - DNA, 18 bp, Homo sapiens
tgggctgagtgacacaag

SEQ ID NO: 1058699 - DNA, 14 bp, Homo sapiens
tgggctgagtgcag

SEQ ID NO: 1058700 - DNA, 15 bp, Homo sapiens
tgggctgagtgcagc

SEQ ID NO: 1058701 - DNA, 19 bp, Homo sapiens
tgggctgagtgcagccaaa

SEQ ID NO: 1058702 - DNA, 21 bp, Homo sapiens
tgggctgatggaagatggtcc

SEQ ID NO: 1058703 - DNA, 12 bp, Homo sapiens
tgggctgcagca

SEQ ID NO: 1058704 - DNA, 13 bp, Homo sapiens
tgggctgcagcag

SEQ ID NO: 1058705 - DNA, 12 bp, Homo sapiens
tgggctggactt

SEQ ID NO: 1058706 - DNA, 20 bp, Homo sapiens
tgggctggagtcctctccag

SEQ ID NO: 1058707 - DNA, 13 bp, Homo sapiens
tgggctggcccag

SEQ ID NO: 1058708 - DNA, 14 bp, Homo sapiens
tgggctgggccctc

SEQ ID NO: 1058709 - DNA, 21 bp, Homo sapiens
tgggctgggccctctcttctc

SEQ ID NO: 1058710 - DNA, 12 bp, Homo sapiens
tgggctgggctg

SEQ ID NO: 1058711 - DNA, 19 bp, Homo sapiens
tgggctgggctgggctgag

SEQ ID NO: 1058712 - DNA, 20 bp, Homo sapiens
tgggctggggactctggcac

SEQ ID NO: 1058713 - DNA, 21 bp, Homo sapiens
tgggctggggactctggcaca

SEQ ID NO: 1058714 - DNA, 18 bp, Homo sapiens
tgggctggggaggaggag

SEQ ID NO: 1058715 - DNA, 16 bp, Homo sapiens
tgggctggggcagggg

SEQ ID NO: 1058716 - DNA, 19 bp, Homo sapiens
tgggctggggcaggggcct

SEQ ID NO: 1058717 - DNA, 22 bp, Homo sapiens
tgggctggggcaggggcctggg

SEQ ID NO: 1058718 - DNA, 17 bp, Homo sapiens
tgggctggggccacctt

SEQ ID NO: 1058719 - DNA, 17 bp, Homo sapiens
tgggctggggcctcaga

SEQ ID NO: 1058720 - DNA, 13 bp, Homo sapiens
tgggctggggctg

SEQ ID NO: 1058721 - DNA, 18 bp, Homo sapiens
tgggctggggctgctccc

SEQ ID NO: 1058722 - DNA, 19 bp, Homo sapiens
tgggctggggctgctcccc

SEQ ID NO: 1058723 - DNA, 16 bp, Homo sapiens
tgggctgggggccagg

SEQ ID NO: 1058724 - DNA, 17 bp, Homo sapiens
tgggctgggtgctggga

SEQ ID NO: 1058725 - DNA, 19 bp, Homo sapiens
tgggctgggtgctgggaag

SEQ ID NO: 1058726 - DNA, 20 bp, Homo sapiens
tgggctggtatctcagaaag

SEQ ID NO: 1058727 - DNA, 23 bp, Homo sapiens
tgggctggtattctctctatgca

SEQ ID NO: 1058728 - DNA, 12 bp, Homo sapiens
tgggctgtccag

SEQ ID NO: 1058729 - DNA, 17 bp, Homo sapiens
tgggctgtccagcctta

SEQ ID NO: 1058730 - DNA, 15 bp, Homo sapiens
tgggctgtctctccc

SEQ ID NO: 1058731 - DNA, 22 bp, Homo sapiens
tgggctgtgagtgtaagtgtga

SEQ ID NO: 1058732 - DNA, 14 bp, Homo sapiens
tgggctgtggggcc

SEQ ID NO: 1058733 - DNA, 20 bp, Homo sapiens
tgggctgtgttgactgctgc

SEQ ID NO: 1058734 - DNA, 14 bp, Homo sapiens
tgggcttaaagcag

SEQ ID NO: 1058735 - DNA, 14 bp, Homo sapiens
tgggcttaagaaat

SEQ ID NO: 1058736 - DNA, 16 bp, Homo sapiens
tgggcttagtatttct

SEQ ID NO: 1058737 - DNA, 20 bp, Homo sapiens
tgggcttagtatttctcagg

SEQ ID NO: 1058738 - DNA, 23 bp, Homo sapiens
tgggcttagtatttctcaggaag

SEQ ID NO: 1058739 - DNA, 20 bp, Homo sapiens
tgggcttatatctggcctct

SEQ ID NO: 1058740 - DNA, 22 bp, Homo sapiens
tgggcttatatctggcctctgc

SEQ ID NO: 1058741 - DNA, 19 bp, Homo sapiens
tgggcttccatttgtgtgt

SEQ ID NO: 1058742 - DNA, 14 bp, Homo sapiens
tgggcttcctgccc

SEQ ID NO: 1058743 - DNA, 19 bp, Homo sapiens
tgggcttcctgcccttccc

SEQ ID NO: 1058744 - DNA, 20 bp, Homo sapiens
tgggcttcctgctgggactg

SEQ ID NO: 1058745 - DNA, 22 bp, Homo sapiens
tgggcttctgcgtccaccaggc

SEQ ID NO: 1058746 - DNA, 19 bp, Homo sapiens
tgggcttctgttctctgct

SEQ ID NO: 1058747 - DNA, 20 bp, Homo sapiens
tgggcttctgttctctgctg

SEQ ID NO: 1058748 - DNA, 13 bp, Homo sapiens
tgggcttcttcct

SEQ ID NO: 1058749 - DNA, 14 bp, Homo sapiens
tgggcttggaccac

SEQ ID NO: 1058750 - DNA, 14 bp, Homo sapiens
tgggcttggagatg

SEQ ID NO: 1058751 - DNA, 20 bp, Homo sapiens
tgggcttggagatggcagga

SEQ ID NO: 1058752 - DNA, 20 bp, Homo sapiens
tgggcttggcccgcggcctg

SEQ ID NO: 1058753 - DNA, 24 bp, Homo sapiens
tgggcttggcccgcggcctgcacc

SEQ ID NO: 1058754 - DNA, 14 bp, Homo sapiens
tgggcttggcctgc

SEQ ID NO: 1058755 - DNA, 18 bp, Homo sapiens
tgggcttggcctggagag

SEQ ID NO: 1058756 - DNA, 14 bp, Homo sapiens
tgggcttggccttg

SEQ ID NO: 1058757 - DNA, 15 bp, Homo sapiens
tgggcttggccttgt

SEQ ID NO: 1058758 - DNA, 16 bp, Homo sapiens
tgggcttggctcttgg

SEQ ID NO: 1058759 - DNA, 18 bp, Homo sapiens
tgggcttgtgctcgggat

SEQ ID NO: 1058760 - DNA, 19 bp, Homo sapiens
tgggctttcacgggcccca

SEQ ID NO: 1058761 - DNA, 11 bp, Homo sapiens
tgggctttctc

SEQ ID NO: 1058762 - DNA, 15 bp, Homo sapiens
tgggctttgcaggct

SEQ ID NO: 1058763 - DNA, 19 bp, Homo sapiens
tgggctttgcaggctctgg

SEQ ID NO: 1058764 - DNA, 20 bp, Homo sapiens
tgggctttgcaggctctggg

SEQ ID NO: 1058765 - DNA, 23 bp, Homo sapiens
tgggcttttggtttgggggcgcc

SEQ ID NO: 1058766 - DNA, 16 bp, Homo sapiens
tgggcttttgttctga

SEQ ID NO: 1058767 - DNA, 19 bp, Homo sapiens
tggggaaaaagaatgatgc

SEQ ID NO: 1058768 - DNA, 19 bp, Homo sapiens
tggggaaaatggccatgca

SEQ ID NO: 1058769 - DNA, 21 bp, Homo sapiens
tggggaaaatggccatgcagg

SEQ ID NO: 1058770 - DNA, 20 bp, Homo sapiens
tggggaaaccctggagccat

SEQ ID NO: 1058771 - DNA, 10 bp, Homo sapiens
tggggaaagc

SEQ ID NO: 1058772 - DNA, 23 bp, Homo sapiens
tggggaaaggggtcggctgacca

SEQ ID NO: 1058773 - DNA, 20 bp, Homo sapiens
tggggaagaggggctggggc

SEQ ID NO: 1058774 - DNA, 13 bp, Homo sapiens
tggggaaggcaga

SEQ ID NO: 1058775 - DNA, 13 bp, Homo sapiens
tggggaaggggag

SEQ ID NO: 1058776 - DNA, 16 bp, Homo sapiens
tggggaagggtgggga

SEQ ID NO: 1058777 - DNA, 20 bp, Homo sapiens
tggggaagggtggggagaaa

SEQ ID NO: 1058778 - DNA, 22 bp, Homo sapiens
tggggaagggtggggagaaata

SEQ ID NO: 1058779 - DNA, 21 bp, Homo sapiens
tggggaagggttttcttttct

SEQ ID NO: 1058780 - DNA, 23 bp, Homo sapiens
tggggaagtacgtcccagcggcc

SEQ ID NO: 1058781 - DNA, 15 bp, Homo sapiens
tggggaagtcagggg

SEQ ID NO: 1058782 - DNA, 17 bp, Homo sapiens
tggggaagtttatttga

SEQ ID NO: 1058783 - DNA, 19 bp, Homo sapiens
tggggaagtttatttgaga

SEQ ID NO: 1058784 - DNA, 20 bp, Homo sapiens
tggggaagtttatttgagaa

SEQ ID NO: 1058785 - DNA, 21 bp, Homo sapiens
tggggaagtttatttgagaaa

SEQ ID NO: 1058786 - DNA, 14 bp, Homo sapiens
tggggaatcatttt

SEQ ID NO: 1058787 - DNA, 16 bp, Homo sapiens
tggggacagagggtgt

SEQ ID NO: 1058788 - DNA, 11 bp, Homo sapiens
tggggacagat

SEQ ID NO: 1058789 - DNA, 13 bp, Homo sapiens
tggggacagggag

SEQ ID NO: 1058790 - DNA, 16 bp, Homo sapiens
tggggacagggagggg

SEQ ID NO: 1058791 - DNA, 18 bp, Homo sapiens
tggggacagttggcagag

SEQ ID NO: 1058792 - DNA, 21 bp, Homo sapiens
tggggacagttggcagagaag

SEQ ID NO: 1058793 - DNA, 23 bp, Homo sapiens
tggggacagttggcagagaaggc

SEQ ID NO: 1058794 - DNA, 14 bp, Homo sapiens
tggggacccaggct

SEQ ID NO: 1058795 - DNA, 22 bp, Homo sapiens
tggggacccaggctccgccctt

SEQ ID NO: 1058796 - DNA, 20 bp, Homo sapiens
tggggacctggggggaggga

SEQ ID NO: 1058797 - DNA, 18 bp, Homo sapiens
tggggacctggtaccctc

SEQ ID NO: 1058798 - DNA, 21 bp, Homo sapiens
tggggacgccaaggaggtggg

SEQ ID NO: 1058799 - DNA, 19 bp, Homo sapiens
tggggacgtgaacgtttta

SEQ ID NO: 1058800 - DNA, 14 bp, Homo sapiens
tggggactcctcaa

SEQ ID NO: 1058801 - DNA, 21 bp, Homo sapiens
tggggactcctcaaaccactt

SEQ ID NO: 1058802 - DNA, 20 bp, Homo sapiens
tggggagaaagaggggcctg

SEQ ID NO: 1058803 - DNA, 19 bp, Homo sapiens
tggggagaaagggagcgag

SEQ ID NO: 1058804 - DNA, 16 bp, Homo sapiens
tggggagacagttgag

SEQ ID NO: 1058805 - DNA, 17 bp, Homo sapiens
tggggagactgggctga

SEQ ID NO: 1058806 - DNA, 20 bp, Homo sapiens
tggggagacttggggccagc

SEQ ID NO: 1058807 - DNA, 15 bp, Homo sapiens
tggggagagatggca

SEQ ID NO: 1058808 - DNA, 12 bp, Homo sapiens
tggggagaggca

SEQ ID NO: 1058809 - DNA, 21 bp, Homo sapiens
tggggagagggatttccctgc

SEQ ID NO: 1058810 - DNA, 14 bp, Homo sapiens
tggggagatggggg

SEQ ID NO: 1058811 - DNA, 23 bp, Homo sapiens
tggggagatgggggcttcttcct

SEQ ID NO: 1058812 - DNA, 23 bp, Homo sapiens
tggggagcacttgcgtcctgcag

SEQ ID NO: 1058813 - DNA, 15 bp, Homo sapiens
tggggagcagagaca

SEQ ID NO: 1058814 - DNA, 20 bp, Homo sapiens
tggggagcaggaggccaata

SEQ ID NO: 1058815 - DNA, 22 bp, Homo sapiens
tggggagccaacagaagcttcc

SEQ ID NO: 1058816 - DNA, 21 bp, Homo sapiens
tggggagcccgtctcagtgtt

SEQ ID NO: 1058817 - DNA, 13 bp, Homo sapiens
tggggagctcctg

SEQ ID NO: 1058818 - DNA, 10 bp, Homo sapiens
tggggaggag

SEQ ID NO: 1058819 - DNA, 17 bp, Homo sapiens
tggggaggaggaagccg

SEQ ID NO: 1058820 - DNA, 21 bp, Homo sapiens
tggggaggcaggcattcctga

SEQ ID NO: 1058821 - DNA, 13 bp, Homo sapiens
tggggagggagaa

SEQ ID NO: 1058822 - DNA, 16 bp, Homo sapiens
tggggagggagcctcg

SEQ ID NO: 1058823 - DNA, 16 bp, Homo sapiens
tggggagggaggggaa

SEQ ID NO: 1058824 - DNA, 21 bp, Homo sapiens
tggggagggaggggaaatgta

SEQ ID NO: 1058825 - DNA, 21 bp, Homo sapiens
tggggagggatgaagggcgag

SEQ ID NO: 1058826 - DNA, 21 bp, Homo sapiens
tggggagggctgcagtcacat

SEQ ID NO: 1058827 - DNA, 15 bp, Homo sapiens
tggggaggggcgctg

SEQ ID NO: 1058828 - DNA, 20 bp, Homo sapiens
tggggaggggcgctggccca

SEQ ID NO: 1058829 - DNA, 22 bp, Homo sapiens
tggggaggggcgctggcccagc

SEQ ID NO: 1058830 - DNA, 16 bp, Homo sapiens
tggggagggggaagag

SEQ ID NO: 1058831 - DNA, 20 bp, Homo sapiens
tggggaggggggcgggtgac

SEQ ID NO: 1058832 - DNA, 17 bp, Homo sapiens
tggggagggtgacccac

SEQ ID NO: 1058833 - DNA, 21 bp, Homo sapiens
tggggagggtgacccacagct

SEQ ID NO: 1058834 - DNA, 17 bp, Homo sapiens
tggggaggtgctggggg

SEQ ID NO: 1058835 - DNA, 16 bp, Homo sapiens
tggggaggtgtcacat

SEQ ID NO: 1058836 - DNA, 21 bp, Homo sapiens
tggggagtcggttagtcattg

SEQ ID NO: 1058837 - DNA, 13 bp, Homo sapiens
tggggagtgggac

SEQ ID NO: 1058838 - DNA, 14 bp, Homo sapiens
tggggataaagaca

SEQ ID NO: 1058839 - DNA, 17 bp, Homo sapiens
tggggataaaggagaag

SEQ ID NO: 1058840 - DNA, 13 bp, Homo sapiens
tggggatagagga

SEQ ID NO: 1058841 - DNA, 17 bp, Homo sapiens
tggggatcaattttcat

SEQ ID NO: 1058842 - DNA, 22 bp, Homo sapiens
tggggatccccgcctggccagg

SEQ ID NO: 1058843 - DNA, 14 bp, Homo sapiens
tggggatcgatgtg

SEQ ID NO: 1058844 - DNA, 22 bp, Homo sapiens
tggggatcttcccacaggaggg

SEQ ID NO: 1058845 - DNA, 21 bp, Homo sapiens
tggggatgtaaccaagctgta

SEQ ID NO: 1058846 - DNA, 16 bp, Homo sapiens
tggggatgtgggaggg

SEQ ID NO: 1058847 - DNA, 20 bp, Homo sapiens
tggggattcaggggctttgg

SEQ ID NO: 1058848 - DNA, 21 bp, Homo sapiens
tggggattcaggggctttggg

SEQ ID NO: 1058849 - DNA, 18 bp, Homo sapiens
tggggcacagtccaggaa

SEQ ID NO: 1058850 - DNA, 16 bp, Homo sapiens
tggggcactgggcgtc

SEQ ID NO: 1058851 - DNA, 22 bp, Homo sapiens
tggggcaggagtgccaggacca

SEQ ID NO: 1058852 - DNA, 24 bp, Homo sapiens
tggggcaggagtgccaggaccagc

SEQ ID NO: 1058853 - DNA, 14 bp, Homo sapiens
tggggcaggctggg

SEQ ID NO: 1058854 - DNA, 15 bp, Homo sapiens
tggggcaggctgggc

SEQ ID NO: 1058855 - DNA, 16 bp, Homo sapiens
tggggcaggctgggcc

SEQ ID NO: 1058856 - DNA, 18 bp, Homo sapiens
tggggcaggctgggccat

SEQ ID NO: 1058857 - DNA, 15 bp, Homo sapiens
tggggcatgtgtgcc

SEQ ID NO: 1058858 - DNA, 17 bp, Homo sapiens
tggggccacacagaaac

SEQ ID NO: 1058859 - DNA, 11 bp, Homo sapiens
tggggccactt

SEQ ID NO: 1058860 - DNA, 20 bp, Homo sapiens
tggggccagaggctgggagt

SEQ ID NO: 1058861 - DNA, 21 bp, Homo sapiens
tggggccccatcttgatcttt

SEQ ID NO: 1058862 - DNA, 16 bp, Homo sapiens
tggggccccgctggga

SEQ ID NO: 1058863 - DNA, 12 bp, Homo sapiens
tggggccctcta

SEQ ID NO: 1058864 - DNA, 13 bp, Homo sapiens
tggggccctcttg

SEQ ID NO: 1058865 - DNA, 18 bp, Homo sapiens
tggtttccagtcatgagc

SEQ ID NO: 1058866 - DNA, 18 bp, Homo sapiens
tggtttcccaagagctac

SEQ ID NO: 1058867 - DNA, 17 bp, Homo sapiens
tggtttcccccttctac

SEQ ID NO: 1058868 - DNA, 15 bp, Homo sapiens
tggtttcggaaaaaa

SEQ ID NO: 1058869 - DNA, 22 bp, Homo sapiens
tggtttcggaaaaaaaaaaaga

SEQ ID NO: 1058870 - DNA, 19 bp, Homo sapiens
tgtaaatatataaatatat

SEQ ID NO: 1058871 - DNA, 13 bp, Homo sapiens
tgtaaatatatgt

SEQ ID NO: 1058872 - DNA, 11 bp, Homo sapiens
tgtaaatatcc

SEQ ID NO: 1058873 - DNA, 20 bp, Homo sapiens
tgtaaatatgtttgtgcctt

SEQ ID NO: 1058874 - DNA, 23 bp, Homo sapiens
tgtaaatattctacacatgtaaa

SEQ ID NO: 1058875 - DNA, 15 bp, Homo sapiens
tgtaaatattctata

SEQ ID NO: 1058876 - DNA, 14 bp, Homo sapiens
tgtaaatattcttg

SEQ ID NO: 1058877 - DNA, 15 bp, Homo sapiens
tgtaaatattcttgt

SEQ ID NO: 1058878 - DNA, 17 bp, Homo sapiens
tgtaaatattcttgtcc

SEQ ID NO: 1058879 - DNA, 22 bp, Homo sapiens
tgtaaatattcttgtccacatt

SEQ ID NO: 1058880 - DNA, 14 bp, Homo sapiens
tgtaaatattgtgt

SEQ ID NO: 1058881 - DNA, 18 bp, Homo sapiens
tgtaaatattttaaagaa

SEQ ID NO: 1058882 - DNA, 14 bp, Homo sapiens
tgtaaatattttga

SEQ ID NO: 1058883 - DNA, 19 bp, Homo sapiens
tgtaaatatttttccctcc

SEQ ID NO: 1058884 - DNA, 14 bp, Homo sapiens
tgtaatcatttgtt

SEQ ID NO: 1058885 - DNA, 19 bp, Homo sapiens
tgtaatcatttgtttacat

SEQ ID NO: 1058886 - DNA, 22 bp, Homo sapiens
tgtaatcccagcactttgggag

SEQ ID NO: 1058887 - DNA, 16 bp, Homo sapiens
tgtaatcccagctact

SEQ ID NO: 1058888 - DNA, 21 bp, Homo sapiens
tgtaatcccagctactcagga

SEQ ID NO: 1058889 - DNA, 21 bp, Homo sapiens
tgtaatctaagtatatgtgag

SEQ ID NO: 1058890 - DNA, 24 bp, Homo sapiens
tgtaatctaagtatatgtgagaaa

SEQ ID NO: 1058891 - DNA, 17 bp, Homo sapiens
tgtaatctctctgcagc

SEQ ID NO: 1058892 - DNA, 19 bp, Homo sapiens
tgtaatctctctgcagctg

SEQ ID NO: 1058893 - DNA, 22 bp, Homo sapiens
tgtaatctctctgcagctgccg

SEQ ID NO: 1058894 - DNA, 15 bp, Homo sapiens
tgtaatcttgaattg

SEQ ID NO: 1058895 - DNA, 14 bp, Homo sapiens
tgtaatcttgttga

SEQ ID NO: 1058896 - DNA, 17 bp, Homo sapiens
tgtaatctttttctcca

SEQ ID NO: 1058897 - DNA, 19 bp, Homo sapiens
tgtaatgcactgtttttaa

SEQ ID NO: 1058898 - DNA, 22 bp, Homo sapiens
tgtaatgcattaataaaaatca

SEQ ID NO: 1058899 - DNA, 14 bp, Homo sapiens
tgtaatgctgcact

SEQ ID NO: 1058900 - DNA, 19 bp, Homo sapiens
tgtaatgctgcacttcctg

SEQ ID NO: 1058901 - DNA, 17 bp, Homo sapiens
tgtaatggaactgaccc

SEQ ID NO: 1058902 - DNA, 17 bp, Homo sapiens
tgtaatggcagttatat

SEQ ID NO: 1058903 - DNA, 23 bp, Homo sapiens
tgtaatggcagttatattttgca

SEQ ID NO: 1058904 - DNA, 19 bp, Homo sapiens
tgtaatggtactgactttg

SEQ ID NO: 1058905 - DNA, 20 bp, Homo sapiens
tgtaatgtaggcacttttat

SEQ ID NO: 1058906 - DNA, 23 bp, Homo sapiens
tgtaatgtatcaaatacatttaa

SEQ ID NO: 1058907 - DNA, 13 bp, Homo sapiens
tgtaatgtcacca

SEQ ID NO: 1058908 - DNA, 16 bp, Homo sapiens
tgtaatgtcaccacct

SEQ ID NO: 1058909 - DNA, 20 bp, Homo sapiens
tgtaatgtcaccaccttccc

SEQ ID NO: 1058910 - DNA, 18 bp, Homo sapiens
tgtaatgtgtggtggcct

SEQ ID NO: 1058911 - DNA, 13 bp, Homo sapiens
tgtaatgttactg

SEQ ID NO: 1058912 - DNA, 16 bp, Homo sapiens
tgtaatgttactgatc

SEQ ID NO: 1058913 - DNA, 14 bp, Homo sapiens
tgtaatgttgcttt

SEQ ID NO: 1058914 - DNA, 13 bp, Homo sapiens
tgtaatgttttct

SEQ ID NO: 1058915 - DNA, 19 bp, Homo sapiens
tgtaattaaaagcaaatca

SEQ ID NO: 1058916 - DNA, 15 bp, Homo sapiens
tgtaattaaactagt

SEQ ID NO: 1058917 - DNA, 19 bp, Homo sapiens
tgtaattaaactagtttaa

SEQ ID NO: 1058918 - DNA, 14 bp, Homo sapiens
tgtaattaactgta

SEQ ID NO: 1058919 - DNA, 17 bp, Homo sapiens
tgtaattaagtactatg

SEQ ID NO: 1058920 - DNA, 21 bp, Homo sapiens
tgtaattaagtactatgtatc

SEQ ID NO: 1058921 - DNA, 14 bp, Homo sapiens
tgtaattaatattc

SEQ ID NO: 1058922 - DNA, 15 bp, Homo sapiens
tgtaattcaggactc

SEQ ID NO: 1058923 - DNA, 19 bp, Homo sapiens
tgtaattcaggtttttcct

SEQ ID NO: 1058924 - DNA, 15 bp, Homo sapiens
tgtaattcctacctc

SEQ ID NO: 1058925 - DNA, 15 bp, Homo sapiens
tgtaattctaaatga

SEQ ID NO: 1058926 - DNA, 19 bp, Homo sapiens
tgtaattcttatgactaaa

SEQ ID NO: 1058927 - DNA, 17 bp, Homo sapiens
tgtaattgaatattatt

SEQ ID NO: 1058928 - DNA, 23 bp, Homo sapiens
tgtaattggaatcttcacctcag

SEQ ID NO: 1058929 - DNA, 17 bp, Homo sapiens
tgtaattgtaattccaa

SEQ ID NO: 1058930 - DNA, 10 bp, Homo sapiens
tgtaattgtg

SEQ ID NO: 1058931 - DNA, 21 bp, Homo sapiens
tgtaattgtgtaaaaaatgga

SEQ ID NO: 1058932 - DNA, 16 bp, Homo sapiens
tgtaattgtgtggatt

SEQ ID NO: 1058933 - DNA, 20 bp, Homo sapiens
tgtaattgtgtggattcttt

SEQ ID NO: 1058934 - DNA, 21 bp, Homo sapiens
tgtaattgtgtggattcttta

SEQ ID NO: 1058935 - DNA, 15 bp, Homo sapiens
tgtaattgttccttt

SEQ ID NO: 1058936 - DNA, 19 bp, Homo sapiens
tgtaattgttgtttgtatg

SEQ ID NO: 1058937 - DNA, 15 bp, Homo sapiens
tgtaatttaaaactt

SEQ ID NO: 1058938 - DNA, 20 bp, Homo sapiens
tgtaatttaaacaggcccag

SEQ ID NO: 1058939 - DNA, 20 bp, Homo sapiens
tgtaatttagaaactgattt

SEQ ID NO: 1058940 - DNA, 14 bp, Homo sapiens
tgtaatttatgcaa

SEQ ID NO: 1058941 - DNA, 14 bp, Homo sapiens
tgtaatttcaaaat

SEQ ID NO: 1058942 - DNA, 16 bp, Homo sapiens
tgtaatttcgccttaa

SEQ ID NO: 1058943 - DNA, 22 bp, Homo sapiens
tgtaatttcgccttaaactctg

SEQ ID NO: 1058944 - DNA, 12 bp, Homo sapiens
tgtaatttgaat

SEQ ID NO: 1058945 - DNA, 14 bp, Homo sapiens
tgtaatttgaattg

SEQ ID NO: 1058946 - DNA, 17 bp, Homo sapiens
tgtaatttgtgatacaa

SEQ ID NO: 1058947 - DNA, 21 bp, Homo sapiens
tgtaatttgtgatacaatgct

SEQ ID NO: 1058948 - DNA, 23 bp, Homo sapiens
tgtaattttatttgttctttttc

SEQ ID NO: 1058949 - DNA, 18 bp, Homo sapiens
tgtacaaaactgtaaata

SEQ ID NO: 1058950 - DNA, 13 bp, Homo sapiens
tgtacaaaagcaa

SEQ ID NO: 1058951 - DNA, 21 bp, Homo sapiens
tgtacaaaatcgattggcttt

SEQ ID NO: 1058952 - DNA, 19 bp, Homo sapiens
tgtacaaagtagaagtctt

SEQ ID NO: 1058953 - DNA, 15 bp, Homo sapiens
tgtacaaatataaga

SEQ ID NO: 1058954 - DNA, 17 bp, Homo sapiens
tgtacaaatgtaagcaa

SEQ ID NO: 1058955 - DNA, 12 bp, Homo sapiens
tgtacaaccctg

SEQ ID NO: 1058956 - DNA, 13 bp, Homo sapiens
tgtacaaccctga

SEQ ID NO: 1058957 - DNA, 14 bp, Homo sapiens
tgtacaaccctgac

SEQ ID NO: 1058958 - DNA, 20 bp, Homo sapiens
tgtacaagagtccctttgaa

SEQ ID NO: 1058959 - DNA, 16 bp, Homo sapiens
tgtacaagatgaagga

SEQ ID NO: 1058960 - DNA, 17 bp, Homo sapiens
tgtacaagttttgtata

SEQ ID NO: 1058961 - DNA, 15 bp, Homo sapiens
tgtacaatacaatgt

SEQ ID NO: 1058962 - DNA, 19 bp, Homo sapiens
tgtacaatacaatgtacaa

SEQ ID NO: 1058963 - DNA, 18 bp, Homo sapiens
tgtacaatatgaaaagga

SEQ ID NO: 1058964 - DNA, 23 bp, Homo sapiens
tgtacaatcatgaacagctctga

SEQ ID NO: 1058965 - DNA, 14 bp, Homo sapiens
tgtacaatggttta

SEQ ID NO: 1058966 - DNA, 20 bp, Homo sapiens
tgtacaatggtttattccca

SEQ ID NO: 1058967 - DNA, 21 bp, Homo sapiens
tgtacaatggtttattcccaa

SEQ ID NO: 1058968 - DNA, 18 bp, Homo sapiens
tgtacaatgtacacactg

SEQ ID NO: 1058969 - DNA, 19 bp, Homo sapiens
tgtacaattactaaattgt

SEQ ID NO: 1058970 - DNA, 22 bp, Homo sapiens
tgtacaattactaaattgtata

SEQ ID NO: 1058971 - DNA, 14 bp, Homo sapiens
tgtacaattatgtc

SEQ ID NO: 1058972 - DNA, 14 bp, Homo sapiens
tgtacaattgatct

SEQ ID NO: 1058973 - DNA, 15 bp, Homo sapiens
tgtacaattgatctt

SEQ ID NO: 1058974 - DNA, 21 bp, Homo sapiens
tgtacaattttaaagttctta

SEQ ID NO: 1058975 - DNA, 22 bp, Homo sapiens
tgtacacactggtacttagagt

SEQ ID NO: 1058976 - DNA, 16 bp, Homo sapiens
tgtacacagtctgttt

SEQ ID NO: 1058977 - DNA, 21 bp, Homo sapiens
tgtacacctgcggggccaccc

SEQ ID NO: 1058978 - DNA, 14 bp, Homo sapiens
tgtacactgaatat

SEQ ID NO: 1058979 - DNA, 15 bp, Homo sapiens
tgtacagaaaacatg

SEQ ID NO: 1058980 - DNA, 15 bp, Homo sapiens
tgtacagaacacaaa

SEQ ID NO: 1058981 - DNA, 21 bp, Homo sapiens
tgtacagaacacaaatgtcta

SEQ ID NO: 1058982 - DNA, 17 bp, Homo sapiens
tgtacagaatcattgct

SEQ ID NO: 1058983 - DNA, 21 bp, Homo sapiens
tgtacagaattctgctacctc

SEQ ID NO: 1058984 - DNA, 14 bp, Homo sapiens
tgtacagacatatt

SEQ ID NO: 1058985 - DNA, 19 bp, Homo sapiens
tgtacagacatatttaact

SEQ ID NO: 1058986 - DNA, 22 bp, Homo sapiens
tgtacagacatatttaactggt

SEQ ID NO: 1058987 - DNA, 19 bp, Homo sapiens
tgtaaatcctagacttgaa

SEQ ID NO: 1058988 - DNA, 20 bp, Homo sapiens
tgtaaatcctttttctttat

SEQ ID NO: 1058989 - DNA, 19 bp, Homo sapiens
tgtaaatctaacattatta

SEQ ID NO: 1058990 - DNA, 15 bp, Homo sapiens
tgtaaatctgccaca

SEQ ID NO: 1058991 - DNA, 18 bp, Homo sapiens
tgtaaatgagtaaaacat

SEQ ID NO: 1058992 - DNA, 15 bp, Homo sapiens
tgtaaatggtgtaca

SEQ ID NO: 1058993 - DNA, 14 bp, Homo sapiens
tgtaaattaacttt

SEQ ID NO: 1058994 - DNA, 15 bp, Homo sapiens
tgtaaattaactttt

SEQ ID NO: 1058995 - DNA, 13 bp, Homo sapiens
tgtaaattatatt

SEQ ID NO: 1058996 - DNA, 22 bp, Homo sapiens
tgtaaattatatttgtgctata

SEQ ID NO: 1058997 - DNA, 16 bp, Homo sapiens
tgtaaattatttatgt

SEQ ID NO: 1058998 - DNA, 13 bp, Homo sapiens
tgtaaattatttg

SEQ ID NO: 1058999 - DNA, 15 bp, Homo sapiens
tgtaaattgaataag

SEQ ID NO: 1059000 - DNA, 16 bp, Homo sapiens
tgtaaattgaataagt

SEQ ID NO: 1059001 - DNA, 22 bp, Homo sapiens
tgtaaattgaatcagtataaac

SEQ ID NO: 1059002 - DNA, 18 bp, Homo sapiens
tgtaaattgcacagagca

SEQ ID NO: 1059003 - DNA, 15 bp, Homo sapiens
tgtaaatttataaat

SEQ ID NO: 1059004 - DNA, 20 bp, Homo sapiens
tgtaaattttgtatgaaaaa

SEQ ID NO: 1059005 - DNA, 14 bp, Homo sapiens
tgtaacaagccaga

SEQ ID NO: 1059006 - DNA, 16 bp, Homo sapiens
tgtaacaattgtgtag

SEQ ID NO: 1059007 - DNA, 21 bp, Homo sapiens
tgtaacaattgtgtagccttt

SEQ ID NO: 1059008 - DNA, 22 bp, Homo sapiens
tgtaacaattgtgtagcctttt

SEQ ID NO: 1059009 - DNA, 20 bp, Homo sapiens
tgtaacacagctgagagact

SEQ ID NO: 1059010 - DNA, 21 bp, Homo sapiens
tgtaacacagctgagagactt

SEQ ID NO: 1059011 - DNA, 16 bp, Homo sapiens
tgtaacactttacaat

SEQ ID NO: 1059012 - DNA, 20 bp, Homo sapiens
tgtaacactttacaatgttc

SEQ ID NO: 1059013 - DNA, 11 bp, Homo sapiens
tgtaacagctg

SEQ ID NO: 1059014 - DNA, 14 bp, Homo sapiens
tgtaacagctgagg

SEQ ID NO: 1059015 - DNA, 14 bp, Homo sapiens
tgtaacatagagta

SEQ ID NO: 1059016 - DNA, 15 bp, Homo sapiens
tgtaacattggtgaa

SEQ ID NO: 1059017 - DNA, 17 bp, Homo sapiens
tgtaacattgtaaagta

SEQ ID NO: 1059018 - DNA, 13 bp, Homo sapiens
tgtaaccaagctg

SEQ ID NO: 1059019 - DNA, 14 bp, Homo sapiens
tgtaaccaagctgt

SEQ ID NO: 1059020 - DNA, 17 bp, Homo sapiens
tgtaaccacaactttca

SEQ ID NO: 1059021 - DNA, 18 bp, Homo sapiens
tgtaaccacaactttcac

SEQ ID NO: 1059022 - DNA, 12 bp, Homo sapiens
tgtaacccacac

SEQ ID NO: 1059023 - DNA, 23 bp, Homo sapiens
tgtaacccttgaatttctagaca

SEQ ID NO: 1059024 - DNA, 20 bp, Homo sapiens
tgtaaccgtaacccaccccc

SEQ ID NO: 1059025 - DNA, 19 bp, Homo sapiens
tgtaacctcttcagaggcc

SEQ ID NO: 1059026 - DNA, 14 bp, Homo sapiens
tgtaaccttgggtg

SEQ ID NO: 1059027 - DNA, 19 bp, Homo sapiens
tgtaactacaaagctttgc

SEQ ID NO: 1059028 - DNA, 18 bp, Homo sapiens
tgtaactactttataact

SEQ ID NO: 1059029 - DNA, 13 bp, Homo sapiens
tgtaactcagaca

SEQ ID NO: 1059030 - DNA, 19 bp, Homo sapiens
tgtaactccagatagagaa

SEQ ID NO: 1059031 - DNA, 12 bp, Homo sapiens
tgtaactctaaa

SEQ ID NO: 1059032 - DNA, 16 bp, Homo sapiens
tgtaactctaaaagat

SEQ ID NO: 1059033 - DNA, 23 bp, Homo sapiens
tgtaactgcattgagaactgcat

SEQ ID NO: 1059034 - DNA, 16 bp, Homo sapiens
tgtaactgctgagcca

SEQ ID NO: 1059035 - DNA, 17 bp, Homo sapiens
tgtaactgctgagccac

SEQ ID NO: 1059036 - DNA, 21 bp, Homo sapiens
tgtaactggcagttttccatt

SEQ ID NO: 1059037 - DNA, 23 bp, Homo sapiens
tgtaactgtcagccgggccctga

SEQ ID NO: 1059038 - DNA, 15 bp, Homo sapiens
tgtaactgttacagt

SEQ ID NO: 1059039 - DNA, 16 bp, Homo sapiens
tgtaacttacacctgg

SEQ ID NO: 1059040 - DNA, 18 bp, Homo sapiens
tgtaacttatattgaaga

SEQ ID NO: 1059041 - DNA, 15 bp, Homo sapiens
tgtaacttccaaata

SEQ ID NO: 1059042 - DNA, 21 bp, Homo sapiens
tgtaacttccaaataaataat

SEQ ID NO: 1059043 - DNA, 12 bp, Homo sapiens
tgtaacttcctg

SEQ ID NO: 1059044 - DNA, 14 bp, Homo sapiens
tgtaacttcctgct

SEQ ID NO: 1059045 - DNA, 20 bp, Homo sapiens
tgtaacttgcttaaatttct

SEQ ID NO: 1059046 - DNA, 20 bp, Homo sapiens
tgtaacttttgtaagacaaa

SEQ ID NO: 1059047 - DNA, 22 bp, Homo sapiens
tgtaagaataggcattaacaca

SEQ ID NO: 1059048 - DNA, 18 bp, Homo sapiens
tgtaagaattcagaagac

SEQ ID NO: 1059049 - DNA, 16 bp, Homo sapiens
tgtaagacatttgtat

SEQ ID NO: 1059050 - DNA, 18 bp, Homo sapiens
tgtaagacgtatgtaaca

SEQ ID NO: 1059051 - DNA, 18 bp, Homo sapiens
tgtaagagcaccttcctc

SEQ ID NO: 1059052 - DNA, 18 bp, Homo sapiens
tgtaagagcttgctccag

SEQ ID NO: 1059053 - DNA, 20 bp, Homo sapiens
tgtaagatcgttctctgcct

SEQ ID NO: 1059054 - DNA, 11 bp, Homo sapiens
tgtaagatgtt

SEQ ID NO: 1059055 - DNA, 19 bp, Homo sapiens
tgtaagcaacttgcttcta

SEQ ID NO: 1059056 - DNA, 20 bp, Homo sapiens
tgtaagcaagtcacttaatc

SEQ ID NO: 1059057 - DNA, 19 bp, Homo sapiens
tgtaagcggtggtttgtaa

SEQ ID NO: 1059058 - DNA, 22 bp, Homo sapiens
tgtaagctctactgaggtgcta

SEQ ID NO: 1059059 - DNA, 17 bp, Homo sapiens
tgtaaggactgtaaaca

SEQ ID NO: 1059060 - DNA, 22 bp, Homo sapiens
tgtaaggcactgtcaggaatgg

SEQ ID NO: 1059061 - DNA, 14 bp, Homo sapiens
tgtaaggctgtgta

SEQ ID NO: 1059062 - DNA, 20 bp, Homo sapiens
tgtaaggctgtgtaagattt

SEQ ID NO: 1059063 - DNA, 21 bp, Homo sapiens
tgtaaggctgtgtaagatttg

SEQ ID NO: 1059064 - DNA, 13 bp, Homo sapiens
tgtaagggcagtg

SEQ ID NO: 1059065 - DNA, 14 bp, Homo sapiens
tgtaaggtctttgt

SEQ ID NO: 1059066 - DNA, 16 bp, Homo sapiens
tgtaaggttgtgcagg

SEQ ID NO: 1059067 - DNA, 15 bp, Homo sapiens
tgtaaggtttcaatg

SEQ ID NO: 1059068 - DNA, 16 bp, Homo sapiens
tgtaaggtttcaatgc

SEQ ID NO: 1059069 - DNA, 21 bp, Homo sapiens
tgtaagtaaattgcctgattt

SEQ ID NO: 1059070 - DNA, 16 bp, Homo sapiens
tgtaagtaacaatatg

SEQ ID NO: 1059071 - DNA, 21 bp, Homo sapiens
tgtaagtaacttcacattaaa

SEQ ID NO: 1059072 - DNA, 23 bp, Homo sapiens
tgtaagtaattgcatttctgctc

SEQ ID NO: 1059073 - DNA, 23 bp, Homo sapiens
tgtaagtcatctacttaataaat

SEQ ID NO: 1059074 - DNA, 15 bp, Homo sapiens
tgtaagtgtaaaaaa

SEQ ID NO: 1059075 - DNA, 15 bp, Homo sapiens
tgtaagtgtagctca

SEQ ID NO: 1059076 - DNA, 12 bp, Homo sapiens
tgtaagtgtgag

SEQ ID NO: 1059077 - DNA, 14 bp, Homo sapiens
tgtaagtgtgagta

SEQ ID NO: 1059078 - DNA, 21 bp, Homo sapiens
tgtaagtgtgagtaagagctg

SEQ ID NO: 1059079 - DNA, 13 bp, Homo sapiens
tgtaagtttgaat

SEQ ID NO: 1059080 - DNA, 15 bp, Homo sapiens
tgtaataaactttaa

SEQ ID NO: 1059081 - DNA, 17 bp, Homo sapiens
tgtaataaactttaata

SEQ ID NO: 1059082 - DNA, 13 bp, Homo sapiens
tgtaataaagtat

SEQ ID NO: 1059083 - DNA, 21 bp, Homo sapiens
tgtaataaatatgtttcacac

SEQ ID NO: 1059084 - DNA, 22 bp, Homo sapiens
tgtaataaatatgtttcacaca

SEQ ID NO: 1059085 - DNA, 19 bp, Homo sapiens
tgtaataactttcttacca

SEQ ID NO: 1059086 - DNA, 14 bp, Homo sapiens
tgtaataagaaagt

SEQ ID NO: 1059087 - DNA, 13 bp, Homo sapiens
tgtaataagcaat

SEQ ID NO: 1059088 - DNA, 19 bp, Homo sapiens
tgtaataagcacttgcctg

SEQ ID NO: 1059089 - DNA, 13 bp, Homo sapiens
tgtaatactggaa

SEQ ID NO: 1059090 - DNA, 17 bp, Homo sapiens
tgtaatacttaaataaa

SEQ ID NO: 1059091 - DNA, 18 bp, Homo sapiens
tgtaatacttaaataaac

SEQ ID NO: 1059092 - DNA, 22 bp, Homo sapiens
tgtaatacttaaataaacatga

SEQ ID NO: 1059093 - DNA, 13 bp, Homo sapiens
tgtaatagtccat

SEQ ID NO: 1059094 - DNA, 22 bp, Homo sapiens
tgtaatagttcagtagaattac

SEQ ID NO: 1059095 - DNA, 23 bp, Homo sapiens
tgtaatagttcagtagaattacc

SEQ ID NO: 1059096 - DNA, 22 bp, Homo sapiens
tgtatctgcaggcagacacgga

SEQ ID NO: 1059097 - DNA, 20 bp, Homo sapiens
tgtatctgtctttccactct

SEQ ID NO: 1059098 - DNA, 19 bp, Homo sapiens
tgtatctgtgcttctaata

SEQ ID NO: 1059099 - DNA, 12 bp, Homo sapiens
tgtatctgtgta

SEQ ID NO: 1059100 - DNA, 17 bp, Homo sapiens
tgtatcttgatgtttag

SEQ ID NO: 1059101 - DNA, 21 bp, Homo sapiens
tgtatcttggggcaagactgc

SEQ ID NO: 1059102 - DNA, 22 bp, Homo sapiens
tgtatcttgtctgagactgcat

SEQ ID NO: 1059103 - DNA, 15 bp, Homo sapiens
tgtatctttattaaa

SEQ ID NO: 1059104 - DNA, 19 bp, Homo sapiens
tgtatctttattaaaacaa

SEQ ID NO: 1059105 - DNA, 22 bp, Homo sapiens
tgtatctttgacaattctgggt

SEQ ID NO: 1059106 - DNA, 15 bp, Homo sapiens
tgtatgaaaatcctt

SEQ ID NO: 1059107 - DNA, 22 bp, Homo sapiens
tgtatgaaaatccttttaacca

SEQ ID NO: 1059108 - DNA, 18 bp, Homo sapiens
tgtatgaaatatatgtga

SEQ ID NO: 1059109 - DNA, 12 bp, Homo sapiens
tgtatgaatgta

SEQ ID NO: 1059110 - DNA, 14 bp, Homo sapiens
tgtatgactaaaga

SEQ ID NO: 1059111 - DNA, 15 bp, Homo sapiens
tgtatgactaaagag

SEQ ID NO: 1059112 - DNA, 15 bp, Homo sapiens
tgtatgacttctgct

SEQ ID NO: 1059113 - DNA, 18 bp, Homo sapiens
tgtatgagatggttaaaa

SEQ ID NO: 1059114 - DNA, 19 bp, Homo sapiens
tgtatgagatggttaaaaa

SEQ ID NO: 1059115 - DNA, 20 bp, Homo sapiens
tgtatgagatggttaaaaag

SEQ ID NO: 1059116 - DNA, 22 bp, Homo sapiens
tgtatgaggtcctcaggtcagc

SEQ ID NO: 1059117 - DNA, 19 bp, Homo sapiens
tgtatgagttgcatttgta

SEQ ID NO: 1059118 - DNA, 20 bp, Homo sapiens
tgtatgagttgcatttgtaa

SEQ ID NO: 1059119 - DNA, 22 bp, Homo sapiens
tgtatgcaaatgagttcaggac

SEQ ID NO: 1059120 - DNA, 18 bp, Homo sapiens
tgtatgcacgtgtgcaca

SEQ ID NO: 1059121 - DNA, 12 bp, Homo sapiens
tgtatgcagcta

SEQ ID NO: 1059122 - DNA, 17 bp, Homo sapiens
tgtatgcagctatctgg

SEQ ID NO: 1059123 - DNA, 13 bp, Homo sapiens
tgtatgcagggag

SEQ ID NO: 1059124 - DNA, 18 bp, Homo sapiens
tgtatgcagggagcactg

SEQ ID NO: 1059125 - DNA, 14 bp, Homo sapiens
tgtatgcatcagat

SEQ ID NO: 1059126 - DNA, 23 bp, Homo sapiens
tgtatgcatcagataacaactgt

SEQ ID NO: 1059127 - DNA, 16 bp, Homo sapiens
tgtatgccaagtgaga

SEQ ID NO: 1059128 - DNA, 14 bp, Homo sapiens
tgtatgccttctgt

SEQ ID NO: 1059129 - DNA, 12 bp, Homo sapiens
tgtatgccttta

SEQ ID NO: 1059130 - DNA, 13 bp, Homo sapiens
tgtatgctgaatt

SEQ ID NO: 1059131 - DNA, 23 bp, Homo sapiens
tgtatgctgatcatcgccagagg

SEQ ID NO: 1059132 - DNA, 20 bp, Homo sapiens
tgtatgctgatgatcaaaac

SEQ ID NO: 1059133 - DNA, 12 bp, Homo sapiens
tgtatgctgctt

SEQ ID NO: 1059134 - DNA, 16 bp, Homo sapiens
tgtatggaatacagtg

SEQ ID NO: 1059135 - DNA, 13 bp, Homo sapiens
tgtatggcccagg

SEQ ID NO: 1059136 - DNA, 20 bp, Homo sapiens
tgtatgggtagggtaaatca

SEQ ID NO: 1059137 - DNA, 12 bp, Homo sapiens
tgtatgtaaaaa

SEQ ID NO: 1059138 - DNA, 14 bp, Homo sapiens
tgtatgtaaatgtg

SEQ ID NO: 1059139 - DNA, 19 bp, Homo sapiens
tgtatgtaagtaattgcat

SEQ ID NO: 1059140 - DNA, 21 bp, Homo sapiens
tgtatgtacaatacaatgtac

SEQ ID NO: 1059141 - DNA, 20 bp, Homo sapiens
tgtatgtacttagctgtact

SEQ ID NO: 1059142 - DNA, 21 bp, Homo sapiens
tgtatgtacttagctgtacta

SEQ ID NO: 1059143 - DNA, 19 bp, Homo sapiens
tgtatgtcagtggtttcta

SEQ ID NO: 1059144 - DNA, 24 bp, Homo sapiens
tgtatgtcagtggtttctacttcc

SEQ ID NO: 1059145 - DNA, 22 bp, Homo sapiens
tgtatgtctgcaggtgtctgac

SEQ ID NO: 1059146 - DNA, 14 bp, Homo sapiens
tgtatgtgagagat

SEQ ID NO: 1059147 - DNA, 23 bp, Homo sapiens
tgtatgtgagctgtaaaaatgtt

SEQ ID NO: 1059148 - DNA, 13 bp, Homo sapiens
tgtatgtggaagt

SEQ ID NO: 1059149 - DNA, 14 bp, Homo sapiens
tgtatgtggaagta

SEQ ID NO: 1059150 - DNA, 23 bp, Homo sapiens
tgtatgtggaagtatacctggct

SEQ ID NO: 1059151 - DNA, 16 bp, Homo sapiens
tgtatgtggtgtgggg

SEQ ID NO: 1059152 - DNA, 20 bp, Homo sapiens
tgtatgtgtatgtgtgtgag

SEQ ID NO: 1059153 - DNA, 18 bp, Homo sapiens
tgtatgtgtgaaacaatg

SEQ ID NO: 1059154 - DNA, 17 bp, Homo sapiens
tgtatgtgtggctgtgg

SEQ ID NO: 1059155 - DNA, 13 bp, Homo sapiens
tgtatgtgtgtga

SEQ ID NO: 1059156 - DNA, 16 bp, Homo sapiens
tgtatgtgtgtgagtg

SEQ ID NO: 1059157 - DNA, 16 bp, Homo sapiens
tgtatgttatgaacat

SEQ ID NO: 1059158 - DNA, 11 bp, Homo sapiens
tgtatgtttac

SEQ ID NO: 1059159 - DNA, 22 bp, Homo sapiens
tgtatgtttcttctttctttta

SEQ ID NO: 1059160 - DNA, 12 bp, Homo sapiens
tgtatgtttgct

SEQ ID NO: 1059161 - DNA, 13 bp, Homo sapiens
tgtattaaatctt

SEQ ID NO: 1059162 - DNA, 16 bp, Homo sapiens
tgtattaaatcttaaa

SEQ ID NO: 1059163 - DNA, 24 bp, Homo sapiens
tgtattaaatcttaaacaatgtat

SEQ ID NO: 1059164 - DNA, 14 bp, Homo sapiens
tgtattaacaaaag

SEQ ID NO: 1059165 - DNA, 15 bp, Homo sapiens
tgtattaacaaaagt

SEQ ID NO: 1059166 - DNA, 17 bp, Homo sapiens
tgtattaagccaaacat

SEQ ID NO: 1059167 - DNA, 11 bp, Homo sapiens
tgtattaataa

SEQ ID NO: 1059168 - DNA, 13 bp, Homo sapiens
tgtattaataaag

SEQ ID NO: 1059169 - DNA, 17 bp, Homo sapiens
tgtattaataaagcatt

SEQ ID NO: 1059170 - DNA, 18 bp, Homo sapiens
tgtattaataaagcattc

SEQ ID NO: 1059171 - DNA, 14 bp, Homo sapiens
tgtattaatctgtt

SEQ ID NO: 1059172 - DNA, 18 bp, Homo sapiens
tgtattaatctgtttgtg

SEQ ID NO: 1059173 - DNA, 19 bp, Homo sapiens
tgtattaatttctgataaa

SEQ ID NO: 1059174 - DNA, 20 bp, Homo sapiens
tgtattacaacaatctggag

SEQ ID NO: 1059175 - DNA, 19 bp, Homo sapiens
tgtattacatctaatgctt

SEQ ID NO: 1059176 - DNA, 22 bp, Homo sapiens
tgtattacatgactgtttcttt

SEQ ID NO: 1059177 - DNA, 23 bp, Homo sapiens
tgtattacttaggttattttgct

SEQ ID NO: 1059178 - DNA, 15 bp, Homo sapiens
tgtattagctcactg

SEQ ID NO: 1059179 - DNA, 14 bp, Homo sapiens
tgtattaggaaaat

SEQ ID NO: 1059180 - DNA, 12 bp, Homo sapiens
tgtattagtatg

SEQ ID NO: 1059181 - DNA, 14 bp, Homo sapiens
tgtattataaaagc

SEQ ID NO: 1059182 - DNA, 23 bp, Homo sapiens
tgtattataataagcaaaaagat

SEQ ID NO: 1059183 - DNA, 14 bp, Homo sapiens
tgtattataattgt

SEQ ID NO: 1059184 - DNA, 20 bp, Homo sapiens
tgtattataattgttgatat

SEQ ID NO: 1059185 - DNA, 21 bp, Homo sapiens
tgtattatcacatcaagcatg

SEQ ID NO: 1059186 - DNA, 15 bp, Homo sapiens
tgtattatttataat

SEQ ID NO: 1059187 - DNA, 22 bp, Homo sapiens
tgtattcacgccattggttgga

SEQ ID NO: 1059188 - DNA, 14 bp, Homo sapiens
tgtattcagaggca

SEQ ID NO: 1059189 - DNA, 17 bp, Homo sapiens
tgtattcagaggcagtg

SEQ ID NO: 1059190 - DNA, 16 bp, Homo sapiens
tgtattcagataatta

SEQ ID NO: 1059191 - DNA, 20 bp, Homo sapiens
tgtattcatgaacttggctg

SEQ ID NO: 1059192 - DNA, 20 bp, Homo sapiens
tgtattcccttgtattttgt

SEQ ID NO: 1059193 - DNA, 19 bp, Homo sapiens
tgtattccttttagcagta

SEQ ID NO: 1059194 - DNA, 22 bp, Homo sapiens
tgtattctctcctgtacctctt

SEQ ID NO: 1059195 - DNA, 13 bp, Homo sapiens
tgtattctctgag

SEQ ID NO: 1059196 - DNA, 19 bp, Homo sapiens
tgtattctctgagctgtgc

SEQ ID NO: 1059197 - DNA, 13 bp, Homo sapiens
tgtattctctgta

SEQ ID NO: 1059198 - DNA, 22 bp, Homo sapiens
tgtattctctttaccttctaaa

SEQ ID NO: 1059199 - DNA, 23 bp, Homo sapiens
tgtattctctttaccttctaaaa

SEQ ID NO: 1059200 - DNA, 16 bp, Homo sapiens
tgtattctttctgcct

SEQ ID NO: 1059201 - DNA, 15 bp, Homo sapiens
tgtattgaaaacact

SEQ ID NO: 1059202 - DNA, 21 bp, Homo sapiens
tgtattgaaaacacttagtat

SEQ ID NO: 1059203 - DNA, 19 bp, Homo sapiens
tgtattgagggccagtgat

SEQ ID NO: 1059204 - DNA, 23 bp, Homo sapiens
tgtattgagggccagtgatgatg

SEQ ID NO: 1059205 - DNA, 17 bp, Homo sapiens
tgtattgatgcaatata

SEQ ID NO: 1059206 - DNA, 21 bp, Homo sapiens
tgtattgatgcaatataagca

SEQ ID NO: 1059207 - DNA, 16 bp, Homo sapiens
tgtattgctcctccca

SEQ ID NO: 1059208 - DNA, 13 bp, Homo sapiens
tgtattgcttatt

SEQ ID NO: 1059209 - DNA, 14 bp, Homo sapiens
tgtattgcttcctg

SEQ ID NO: 1059210 - DNA, 15 bp, Homo sapiens
tgtattgcttcctga

SEQ ID NO: 1059211 - DNA, 22 bp, Homo sapiens
tgtattgggccttttggatatg

SEQ ID NO: 1059212 - DNA, 19 bp, Homo sapiens
tgtattgtaaacatgtgtt

SEQ ID NO: 1059213 - DNA, 17 bp, Homo sapiens
tgtattgtaatctttca

SEQ ID NO: 1059214 - DNA, 13 bp, Homo sapiens
tgtattgttccca

SEQ ID NO: 1059215 - DNA, 15 bp, Homo sapiens
tgtattgttcccagt

SEQ ID NO: 1059216 - DNA, 23 bp, Homo sapiens
tgtattgttgaaaaagtttgttt

SEQ ID NO: 1059217 - DNA, 19 bp, Homo sapiens
tgtattgttttctgacagt

SEQ ID NO: 1059218 - DNA, 14 bp, Homo sapiens
tgtatttaaaaaca

SEQ ID NO: 1059219 - DNA, 17 bp, Homo sapiens
tgtatttaaaaacaaaa

SEQ ID NO: 1059220 - DNA, 22 bp, Homo sapiens
tgtatatttattcataatgaat

SEQ ID NO: 1059221 - DNA, 21 bp, Homo sapiens
tgtatatttgattcttaacta

SEQ ID NO: 1059222 - DNA, 12 bp, Homo sapiens
tgtatatttgct

SEQ ID NO: 1059223 - DNA, 15 bp, Homo sapiens
tgtatatttgctgca

SEQ ID NO: 1059224 - DNA, 14 bp, Homo sapiens
tgtatatttgcttc

SEQ ID NO: 1059225 - DNA, 15 bp, Homo sapiens
tgtatatttgtacaa

SEQ ID NO: 1059226 - DNA, 15 bp, Homo sapiens
tgtatatttgtatga

SEQ ID NO: 1059227 - DNA, 17 bp, Homo sapiens
tgtatatttgtatgata

SEQ ID NO: 1059228 - DNA, 22 bp, Homo sapiens
tgtatatttgtgatagcacttt

SEQ ID NO: 1059229 - DNA, 23 bp, Homo sapiens
tgtatatttgtgatagcactttc

SEQ ID NO: 1059230 - DNA, 22 bp, Homo sapiens
tgtatattttaagaaataacag

SEQ ID NO: 1059231 - DNA, 23 bp, Homo sapiens
tgtatattttaatagaattttta

SEQ ID NO: 1059232 - DNA, 17 bp, Homo sapiens
tgtatattttaatgaat

SEQ ID NO: 1059233 - DNA, 15 bp, Homo sapiens
tgtatattttatata

SEQ ID NO: 1059234 - DNA, 21 bp, Homo sapiens
tgtatcaaatacatttaaaac

SEQ ID NO: 1059235 - DNA, 17 bp, Homo sapiens
tgtatcagctctctgct

SEQ ID NO: 1059236 - DNA, 21 bp, Homo sapiens
tgtatcaggaaatatatatgt

SEQ ID NO: 1059237 - DNA, 13 bp, Homo sapiens
tgtatcagtgttt

SEQ ID NO: 1059238 - DNA, 18 bp, Homo sapiens
tgtatcagtgtttatgtg

SEQ ID NO: 1059239 - DNA, 13 bp, Homo sapiens
tgtatcataatta

SEQ ID NO: 1059240 - DNA, 15 bp, Homo sapiens
tgtatcatagaaatg

SEQ ID NO: 1059241 - DNA, 12 bp, Homo sapiens
tgtatcattaaa

SEQ ID NO: 1059242 - DNA, 13 bp, Homo sapiens
tgtatcattaaaa

SEQ ID NO: 1059243 - DNA, 18 bp, Homo sapiens
tgtatcatttttgtgcac

SEQ ID NO: 1059244 - DNA, 19 bp, Homo sapiens
tgtatcatttttgtgcaca

SEQ ID NO: 1059245 - DNA, 22 bp, Homo sapiens
tgtatcctccctggcagacaca

SEQ ID NO: 1059246 - DNA, 16 bp, Homo sapiens
tgtatcctggccctgg

SEQ ID NO: 1059247 - DNA, 19 bp, Homo sapiens
tgtatcctggccctggggg

SEQ ID NO: 1059248 - DNA, 12 bp, Homo sapiens
tgtatcctgggg

SEQ ID NO: 1059249 - DNA, 14 bp, Homo sapiens
tgtatcctggggct

SEQ ID NO: 1059250 - DNA, 15 bp, Homo sapiens
tgtatcctggggctc

SEQ ID NO: 1059251 - DNA, 18 bp, Homo sapiens
tgtatcctggggctccct

SEQ ID NO: 1059252 - DNA, 18 bp, Homo sapiens
tgtatcggagacagtgat

SEQ ID NO: 1059253 - DNA, 15 bp, Homo sapiens
tgtatctaagaataa

SEQ ID NO: 1059254 - DNA, 19 bp, Homo sapiens
tgtatctaggcatttcatt

SEQ ID NO: 1059255 - DNA, 19 bp, Homo sapiens
tgtatctctgaagcatgtt

SEQ ID NO: 1059256 - DNA, 21 bp, Homo sapiens
tgtatctctgaagcatgtttc

SEQ ID NO: 1059257 - DNA, 22 bp, Homo sapiens
tgtatctctgaagcatgtttca

SEQ ID NO: 1059258 - DNA, 19 bp, Homo sapiens
tgtatctgcaggcagacac

SEQ ID NO: 1059259 - DNA, 21 bp, Homo sapiens
tgtatctgcaggcagacacgg

SEQ ID NO: 1059260 - DNA, 13 bp, Homo sapiens
tgtatttaaatat

SEQ ID NO: 1059261 - DNA, 21 bp, Homo sapiens
tgtatttaacaaaaagtgctt

SEQ ID NO: 1059262 - DNA, 21 bp, Homo sapiens
tgtatttaacagaaattgtat

SEQ ID NO: 1059263 - DNA, 21 bp, Homo sapiens
tgtatttaagatgtacattta

SEQ ID NO: 1059264 - DNA, 23 bp, Homo sapiens
tgtatttaagatgtacatttaat

SEQ ID NO: 1059265 - DNA, 22 bp, Homo sapiens
tgtatttaaggaatcaaatctt

SEQ ID NO: 1059266 - DNA, 21 bp, Homo sapiens
tgtatttataaatatatttaa

SEQ ID NO: 1059267 - DNA, 21 bp, Homo sapiens
tgtatttataatttaaatgat

SEQ ID NO: 1059268 - DNA, 16 bp, Homo sapiens
tgtatttcagggacct

SEQ ID NO: 1059269 - DNA, 17 bp, Homo sapiens
tgtatttcagggacctc

SEQ ID NO: 1059270 - DNA, 15 bp, Homo sapiens
tgtatttcagtattt

SEQ ID NO: 1059271 - DNA, 12 bp, Homo sapiens
tgtatttcctga

SEQ ID NO: 1059272 - DNA, 15 bp, Homo sapiens
tgtatttctaagaaa

SEQ ID NO: 1059273 - DNA, 19 bp, Homo sapiens
tgtatttctaagaaataga

SEQ ID NO: 1059274 - DNA, 22 bp, Homo sapiens
tgtatttctctattttcataat

SEQ ID NO: 1059275 - DNA, 13 bp, Homo sapiens
tgtatttgagaag

SEQ ID NO: 1059276 - DNA, 14 bp, Homo sapiens
tgtatttgatttat

SEQ ID NO: 1059277 - DNA, 15 bp, Homo sapiens
tgtatttgctgttga

SEQ ID NO: 1059278 - DNA, 14 bp, Homo sapiens
tgtatttgcttttt

SEQ ID NO: 1059279 - DNA, 14 bp, Homo sapiens
tgtatttgtagtgt

SEQ ID NO: 1059280 - DNA, 16 bp, Homo sapiens
tgtatttgtattaata

SEQ ID NO: 1059281 - DNA, 20 bp, Homo sapiens
tgtattttaacactttgtat

SEQ ID NO: 1059282 - DNA, 14 bp, Homo sapiens
tgtattttaactca

SEQ ID NO: 1059283 - DNA, 19 bp, Homo sapiens
tgtattttatttagacaag

SEQ ID NO: 1059284 - DNA, 14 bp, Homo sapiens
tgtattttcaactt

SEQ ID NO: 1059285 - DNA, 14 bp, Homo sapiens
tgtattttcagagc

SEQ ID NO: 1059286 - DNA, 20 bp, Homo sapiens
tgtattttcgggattctttg

SEQ ID NO: 1059287 - DNA, 13 bp, Homo sapiens
tgtattttgaaaa

SEQ ID NO: 1059288 - DNA, 13 bp, Homo sapiens
tgtattttgaaat

SEQ ID NO: 1059289 - DNA, 14 bp, Homo sapiens
tgtattttgtccaa

SEQ ID NO: 1059290 - DNA, 19 bp, Homo sapiens
tgtattttgtccaagttca

SEQ ID NO: 1059291 - DNA, 16 bp, Homo sapiens
tgtattttgtgtgacc

SEQ ID NO: 1059292 - DNA, 16 bp, Homo sapiens
tgtattttgttaaagc

SEQ ID NO: 1059293 - DNA, 17 bp, Homo sapiens
tgtattttgttaaagct

SEQ ID NO: 1059294 - DNA, 18 bp, Homo sapiens
tgtattttgttaaagctg

SEQ ID NO: 1059295 - DNA, 13 bp, Homo sapiens
tgtatttttagta

SEQ ID NO: 1059296 - DNA, 23 bp, Homo sapiens
tgtatttttatataatatctaaa

SEQ ID NO: 1059297 - DNA, 14 bp, Homo sapiens
tgtatttttcttgc

SEQ ID NO: 1059298 - DNA, 18 bp, Homo sapiens
tgtatttttcttgctgtt

SEQ ID NO: 1059299 - DNA, 20 bp, Homo sapiens
tgtatttttcttgctgttca

SEQ ID NO: 1059300 - DNA, 21 bp, Homo sapiens
tgtatttttcttgctgttcag

SEQ ID NO: 1059301 - DNA, 14 bp, Homo sapiens
tgtatttttgtcaa

SEQ ID NO: 1059302 - DNA, 16 bp, Homo sapiens
tgtatttttgtcaatt

SEQ ID NO: 1059303 - DNA, 16 bp, Homo sapiens
tgtattttttaaagct

SEQ ID NO: 1059304 - DNA, 17 bp, Homo sapiens
tgtattttttaaagcta

SEQ ID NO: 1059305 - DNA, 17 bp, Homo sapiens
tgtattttttatttaca

SEQ ID NO: 1059306 - DNA, 19 bp, Homo sapiens
tgtattttttatttacatt

SEQ ID NO: 1059307 - DNA, 16 bp, Homo sapiens
tgtattttttccttaa

SEQ ID NO: 1059308 - DNA, 19 bp, Homo sapiens
tgtattttttccttaagag

SEQ ID NO: 1059309 - DNA, 14 bp, Homo sapiens
tgtatttttttact

SEQ ID NO: 1059310 - DNA, 12 bp, Homo sapiens
tgtcaaaaaggg

SEQ ID NO: 1059311 - DNA, 16 bp, Homo sapiens
tgtcaaaaatcaatat

SEQ ID NO: 1059312 - DNA, 23 bp, Homo sapiens
tgtcaaaaatgtcttgggtaggc

SEQ ID NO: 1059313 - DNA, 13 bp, Homo sapiens
tgtcaaaactggt

SEQ ID NO: 1059314 - DNA, 21 bp, Homo sapiens
tgtcaaacaaatagtctatca

SEQ ID NO: 1059315 - DNA, 13 bp, Homo sapiens
tgtcaaagaagct

SEQ ID NO: 1059316 - DNA, 12 bp, Homo sapiens
tgtcaaagaagg

SEQ ID NO: 1059317 - DNA, 14 bp, Homo sapiens
tgtcaaagaaggtt

SEQ ID NO: 1059318 - DNA, 17 bp, Homo sapiens
tgtcaaagagagggctt

SEQ ID NO: 1059319 - DNA, 12 bp, Homo sapiens
tgtcaaagcagg

SEQ ID NO: 1059320 - DNA, 12 bp, Homo sapiens
tgtcaaatgaac

SEQ ID NO: 1059321 - DNA, 21 bp, Homo sapiens
tgtcaaatgaacttttacaga

SEQ ID NO: 1059322 - DNA, 12 bp, Homo sapiens
tgtcaaatgttt

SEQ ID NO: 1059323 - DNA, 17 bp, Homo sapiens
tgtcaaatgtttcctta

SEQ ID NO: 1059324 - DNA, 22 bp, Homo sapiens
tgtcaacaaaccaagcatcagg

SEQ ID NO: 1059325 - DNA, 20 bp, Homo sapiens
tgtcaacactatataaataa

SEQ ID NO: 1059326 - DNA, 19 bp, Homo sapiens
tgtcaacatgcattgccat

SEQ ID NO: 1059327 - DNA, 15 bp, Homo sapiens
tgtcaacattgtgat

SEQ ID NO: 1059328 - DNA, 15 bp, Homo sapiens
tgtcaactaaatgag

SEQ ID NO: 1059329 - DNA, 17 bp, Homo sapiens
tgtcaactgagagtcat

SEQ ID NO: 1059330 - DNA, 20 bp, Homo sapiens
tgtcaacttcccatctggct

SEQ ID NO: 1059331 - DNA, 16 bp, Homo sapiens
tgtcaacttttgacta

SEQ ID NO: 1059332 - DNA, 14 bp, Homo sapiens
tgtcaagaaagagc

SEQ ID NO: 1059333 - DNA, 20 bp, Homo sapiens
tgtcaagagtagttatataa

SEQ ID NO: 1059334 - DNA, 22 bp, Homo sapiens
tgtcaagagtagttatataatt

SEQ ID NO: 1059335 - DNA, 17 bp, Homo sapiens
tgtcaagagtcgctgtg

SEQ ID NO: 1059336 - DNA, 19 bp, Homo sapiens
tgtcaagagtcgctgtgcc

SEQ ID NO: 1059337 - DNA, 22 bp, Homo sapiens
tgtcaagcaatggggaatacaa

SEQ ID NO: 1059338 - DNA, 13 bp, Homo sapiens
tgtcaagcatatt

SEQ ID NO: 1059339 - DNA, 16 bp, Homo sapiens
tgtccccgctggctca

SEQ ID NO: 1059340 - DNA, 17 bp, Homo sapiens
tgtccccgtgttgcatg

SEQ ID NO: 1059341 - DNA, 13 bp, Homo sapiens
tgtcccctatcct

SEQ ID NO: 1059342 - DNA, 17 bp, Homo sapiens
tgtcccctatcctcccc

SEQ ID NO: 1059343 - DNA, 15 bp, Homo sapiens
tgtcccctcactctg

SEQ ID NO: 1059344 - DNA, 18 bp, Homo sapiens
tgtcccctcactctgtca

SEQ ID NO: 1059345 - DNA, 23 bp, Homo sapiens
tgtcccctcactctgtcagccag

SEQ ID NO: 1059346 - DNA, 14 bp, Homo sapiens
tgtcccctgacctg

SEQ ID NO: 1059347 - DNA, 17 bp, Homo sapiens
tgtcccctgacctgtcc

SEQ ID NO: 1059348 - DNA, 19 bp, Homo sapiens
tgtcccctgtcccaccaac

SEQ ID NO: 1059349 - DNA, 20 bp, Homo sapiens
tgtcccctgtcccaccaact

SEQ ID NO: 1059350 - DNA, 11 bp, Homo sapiens
tgtccccttcc

SEQ ID NO: 1059351 - DNA, 16 bp, Homo sapiens
tgtccccttcccctgc

SEQ ID NO: 1059352 - DNA, 16 bp, Homo sapiens
tgtcccggtaccttcc

SEQ ID NO: 1059353 - DNA, 17 bp, Homo sapiens
tgtcccggttcaccttg

SEQ ID NO: 1059354 - DNA, 22 bp, Homo sapiens
tgtccctaagtaagtttcttcc

SEQ ID NO: 1059355 - DNA, 12 bp, Homo sapiens
tgtccctacacc

SEQ ID NO: 1059356 - DNA, 19 bp, Homo sapiens
tgtccctcaaatgacccaa

SEQ ID NO: 1059357 - DNA, 13 bp, Homo sapiens
tgtccctccaggg

SEQ ID NO: 1059358 - DNA, 12 bp, Homo sapiens
tgtccctccggg

SEQ ID NO: 1059359 - DNA, 22 bp, Homo sapiens
tgtccctctagtgccttcttta

SEQ ID NO: 1059360 - DNA, 15 bp, Homo sapiens
tgtccctctgcccca

SEQ ID NO: 1059361 - DNA, 14 bp, Homo sapiens
tgtccctcttcact

SEQ ID NO: 1059362 - DNA, 13 bp, Homo sapiens
tgtccctgtagct

SEQ ID NO: 1059363 - DNA, 17 bp, Homo sapiens
tgtccctgtagctcagt

SEQ ID NO: 1059364 - DNA, 18 bp, Homo sapiens
tgtccctgtagctcagtc

SEQ ID NO: 1059365 - DNA, 13 bp, Homo sapiens
tgtccctgtcacc

SEQ ID NO: 1059366 - DNA, 21 bp, Homo sapiens
tgtccctgtcaccaagctcac

SEQ ID NO: 1059367 - DNA, 12 bp, Homo sapiens
tgtccctgtcag

SEQ ID NO: 1059368 - DNA, 17 bp, Homo sapiens
tgtccctgtcaggacac

SEQ ID NO: 1059369 - DNA, 18 bp, Homo sapiens
tgtccctgtccttctaca

SEQ ID NO: 1059370 - DNA, 14 bp, Homo sapiens
tgtccctgtgccta

SEQ ID NO: 1059371 - DNA, 23 bp, Homo sapiens
tgtcccttccccttcaccgctcc

SEQ ID NO: 1059372 - DNA, 17 bp, Homo sapiens
tgtcccttcctttctcc

SEQ ID NO: 1059373 - DNA, 12 bp, Homo sapiens
tgtcccttgatg

SEQ ID NO: 1059374 - DNA, 18 bp, Homo sapiens
tgtcccttgatgcacaga

SEQ ID NO: 1059375 - DNA, 21 bp, Homo sapiens
tgtcccttgatgggtgctgcc

SEQ ID NO: 1059376 - DNA, 14 bp, Homo sapiens
tgtcccttgctgta

SEQ ID NO: 1059377 - DNA, 15 bp, Homo sapiens
tgtccctttcagaga

SEQ ID NO: 1059378 - DNA, 13 bp, Homo sapiens
tgtcccttttctt

SEQ ID NO: 1059379 - DNA, 15 bp, Homo sapiens
tgtcccttttctttg

SEQ ID NO: 1059380 - DNA, 14 bp, Homo sapiens
tgtcccttttgcta

SEQ ID NO: 1059381 - DNA, 22 bp, Homo sapiens
tgtccgagaactaaagccaagg

SEQ ID NO: 1059382 - DNA, 13 bp, Homo sapiens
tgtccgagctttg

SEQ ID NO: 1059383 - DNA, 14 bp, Homo sapiens
tgtccgagctttga

SEQ ID NO: 1059384 - DNA, 15 bp, Homo sapiens
tgtccgcctctgccc

SEQ ID NO: 1059385 - DNA, 15 bp, Homo sapiens
tgtccgctgggtggt

SEQ ID NO: 1059386 - DNA, 20 bp, Homo sapiens
tgtccgctgggtggtaccct

SEQ ID NO: 1059387 - DNA, 15 bp, Homo sapiens
tgtccggcccagtgc

SEQ ID NO: 1059388 - DNA, 16 bp, Homo sapiens
tgtccgtagtatcaga

SEQ ID NO: 1059389 - DNA, 13 bp, Homo sapiens
tgtccgtccaccc

SEQ ID NO: 1059390 - DNA, 17 bp, Homo sapiens
tgtccgtccacccttcc

SEQ ID NO: 1059391 - DNA, 18 bp, Homo sapiens
tgtccgtccacccttcca

SEQ ID NO: 1059392 - DNA, 19 bp, Homo sapiens
tgtccgtccacccttccat

SEQ ID NO: 1059393 - DNA, 22 bp, Homo sapiens
tgtccgtccacccttccatcag

SEQ ID NO: 1059394 - DNA, 14 bp, Homo sapiens
tgtccgtctgtctg

SEQ ID NO: 1059395 - DNA, 19 bp, Homo sapiens
tgtcctaaaaataggggcc

SEQ ID NO: 1059396 - DNA, 19 bp, Homo sapiens
tgtcctaaaaatggctaac

SEQ ID NO: 1059397 - DNA, 20 bp, Homo sapiens
tgtcctaagagatttatctt

SEQ ID NO: 1059398 - DNA, 15 bp, Homo sapiens
tgtcctaaggacaca

SEQ ID NO: 1059399 - DNA, 20 bp, Homo sapiens
tgtcctaatctgctgccaga

SEQ ID NO: 1059400 - DNA, 16 bp, Homo sapiens
tgtcctaattcttctg

SEQ ID NO: 1059401 - DNA, 20 bp, Homo sapiens
tgtcctaattcttctgtcct

SEQ ID NO: 1059402 - DNA, 22 bp, Homo sapiens
tgtcctacagtgactccctggg

SEQ ID NO: 1059403 - DNA, 16 bp, Homo sapiens
tgtcctacgtccaagg

SEQ ID NO: 1059404 - DNA, 21 bp, Homo sapiens
tgtcctacttctgactttact

SEQ ID NO: 1059405 - DNA, 22 bp, Homo sapiens
tgtcctacttctgactttactt

SEQ ID NO: 1059406 - DNA, 23 bp, Homo sapiens
tgtcctacttctgactttacttg

SEQ ID NO: 1059407 - DNA, 20 bp, Homo sapiens
tgtcctatctatcttccaaa

SEQ ID NO: 1059408 - DNA, 14 bp, Homo sapiens
tgtcctatgtcaat

SEQ ID NO: 1059409 - DNA, 15 bp, Homo sapiens
tgtcctcaccctgtg

SEQ ID NO: 1059410 - DNA, 19 bp, Homo sapiens
tgtcctcacgccccctgtg

SEQ ID NO: 1059411 - DNA, 23 bp, Homo sapiens
tgtcctcacgccccctgtgactt

SEQ ID NO: 1059412 - DNA, 20 bp, Homo sapiens
tgtcctcacggtgccttttt

SEQ ID NO: 1059413 - DNA, 13 bp, Homo sapiens
tgtcctcagagca

SEQ ID NO: 1059414 - DNA, 23 bp, Homo sapiens
tgtcctcagggagcagggaaggc

SEQ ID NO: 1059415 - DNA, 13 bp, Homo sapiens
tgtcctcatcctt

SEQ ID NO: 1059416 - DNA, 16 bp, Homo sapiens
tgtcctccagaagcct

SEQ ID NO: 1059417 - DNA, 19 bp, Homo sapiens
tgtcctccagaagcctctg

SEQ ID NO: 1059418 - DNA, 21 bp, Homo sapiens
tgtcctccagaagcctctggc

SEQ ID NO: 1059419 - DNA, 15 bp, Homo sapiens
tgtcctccaggagct

SEQ ID NO: 1059420 - DNA, 16 bp, Homo sapiens
tgtcctccaggagctt

SEQ ID NO: 1059421 - DNA, 21 bp, Homo sapiens
tgtcctccaggagcttcttgt

SEQ ID NO: 1059422 - DNA, 17 bp, Homo sapiens
tgtcctcccacagacct

SEQ ID NO: 1059423 - DNA, 18 bp, Homo sapiens
tgtcctcccacagacctg

SEQ ID NO: 1059424 - DNA, 14 bp, Homo sapiens
tgtcctcccaggct

SEQ ID NO: 1059425 - DNA, 19 bp, Homo sapiens
tgtcctcccatcccctgga

SEQ ID NO: 1059426 - DNA, 23 bp, Homo sapiens
tgtcctcccatcccctggactgg

SEQ ID NO: 1059427 - DNA, 14 bp, Homo sapiens
tgtcctccccttgg

SEQ ID NO: 1059428 - DNA, 23 bp, Homo sapiens
tgtcctcccgagctcctcttcca

SEQ ID NO: 1059429 - DNA, 21 bp, Homo sapiens
tgtcctcctcggatcaccgag

SEQ ID NO: 1059430 - DNA, 14 bp, Homo sapiens
tgtcctcctctgag

SEQ ID NO: 1059431 - DNA, 16 bp, Homo sapiens
tgtcctccttcctggg

SEQ ID NO: 1059432 - DNA, 17 bp, Homo sapiens
tgtcctccttttcactt

SEQ ID NO: 1059433 - DNA, 14 bp, Homo sapiens
tgtcctctccccct

SEQ ID NO: 1059434 - DNA, 17 bp, Homo sapiens
tgtcctctcccccttca

SEQ ID NO: 1059435 - DNA, 23 bp, Homo sapiens
tgtcctctcccccttcagctcct

SEQ ID NO: 1059436 - DNA, 15 bp, Homo sapiens
tgtcctctgcctggg

SEQ ID NO: 1059437 - DNA, 16 bp, Homo sapiens
tgtcctctgtgcccac

SEQ ID NO: 1059438 - DNA, 13 bp, Homo sapiens
tgtcctcttccct

SEQ ID NO: 1059439 - DNA, 17 bp, Homo sapiens
tgtcctctttactccct

SEQ ID NO: 1059440 - DNA, 22 bp, Homo sapiens
tgtcctctttactcccttcctg

SEQ ID NO: 1059441 - DNA, 23 bp, Homo sapiens
tgtcctctttactcccttcctgg

SEQ ID NO: 1059442 - DNA, 14 bp, Homo sapiens
tgtcctgaaacatg

SEQ ID NO: 1059443 - DNA, 19 bp, Homo sapiens
tgtcctgaaacatgaaccc

SEQ ID NO: 1059444 - DNA, 20 bp, Homo sapiens
tgtcctgaaccgactgaccc

SEQ ID NO: 1059445 - DNA, 12 bp, Homo sapiens
tgtcctgaagcc

SEQ ID NO: 1059446 - DNA, 16 bp, Homo sapiens
tgtcctgaagcccagc

SEQ ID NO: 1059447 - DNA, 20 bp, Homo sapiens
tgtcctgaccaccctcccct

SEQ ID NO: 1059448 - DNA, 19 bp, Homo sapiens
tgtcctgactttgccccct

SEQ ID NO: 1059449 - DNA, 18 bp, Homo sapiens
tgtcctgaggagccctga

SEQ ID NO: 1059450 - DNA, 13 bp, Homo sapiens
tgtcctgatttct

SEQ ID NO: 1059451 - DNA, 20 bp, Homo sapiens
tgtcctgatttctacaactg

SEQ ID NO: 1059452 - DNA, 14 bp, Homo sapiens
tgtcctgatttctt

SEQ ID NO: 1059453 - DNA, 18 bp, Homo sapiens
tgtcctgcagcaaacact

SEQ ID NO: 1059454 - DNA, 14 bp, Homo sapiens
tgtcctgccagctg

SEQ ID NO: 1059455 - DNA, 17 bp, Homo sapiens
tgtcctgccagctgcct

SEQ ID NO: 1059456 - DNA, 10 bp, Homo sapiens
tgtcctgcct

SEQ ID NO: 1059457 - DNA, 17 bp, Homo sapiens
tgtcctgcctattatct

SEQ ID NO: 1059458 - DNA, 24 bp, Homo sapiens
tgtcctgcctattatctgtcagct

SEQ ID NO: 1059459 - DNA, 12 bp, Homo sapiens
tgtcctgcctcc

SEQ ID NO: 1059460 - DNA, 13 bp, Homo sapiens
tgtcctgcctctt

SEQ ID NO: 1059461 - DNA, 15 bp, Homo sapiens
tgtcctgcctcttgt

SEQ ID NO: 1059462 - DNA, 15 bp, Homo sapiens
tgtcctgcctgtctg

SEQ ID NO: 1059463 - DNA, 19 bp, Homo sapiens
tgtcctgctctgtttggtg

SEQ ID NO: 1059464 - DNA, 15 bp, Homo sapiens
tgtcctggcccttca

SEQ ID NO: 1059465 - DNA, 18 bp, Homo sapiens
tgtcctgggcgccctgga

SEQ ID NO: 1059466 - DNA, 21 bp, Homo sapiens
tgtcctggttccttcctatgc

SEQ ID NO: 1059467 - DNA, 20 bp, Homo sapiens
tgtcctgtagaggttttgtt

SEQ ID NO: 1059468 - DNA, 14 bp, Homo sapiens
tgtcctgtcctgct

SEQ ID NO: 1059469 - DNA, 22 bp, Homo sapiens
tgtcctgtgaaatattcttagg

SEQ ID NO: 1059470 - DNA, 18 bp, Homo sapiens
tgtcctgtgatctgtgta

SEQ ID NO: 1059471 - DNA, 14 bp, Homo sapiens
tgtcctgtgctttc

SEQ ID NO: 1059472 - DNA, 18 bp, Homo sapiens
tgtcctgttaatttatag

SEQ ID NO: 1059473 - DNA, 15 bp, Homo sapiens
tgtcctgttgattaa

SEQ ID NO: 1059474 - DNA, 15 bp, Homo sapiens
tgtccttcagagctc

SEQ ID NO: 1059475 - DNA, 19 bp, Homo sapiens
tgtccttcagagctcttca

SEQ ID NO: 1059476 - DNA, 14 bp, Homo sapiens
tgtccttccccttc

SEQ ID NO: 1059477 - DNA, 11 bp, Homo sapiens
tgtccttccct

SEQ ID NO: 1059478 - DNA, 13 bp, Homo sapiens
tgtccttccctgc

SEQ ID NO: 1059479 - DNA, 22 bp, Homo sapiens
tgtccttccctgcatttctgag

SEQ ID NO: 1059480 - DNA, 22 bp, Homo sapiens
tgtccttcctccacaaggtccc

SEQ ID NO: 1059481 - DNA, 12 bp, Homo sapiens
tgtccttctaca

SEQ ID NO: 1059482 - DNA, 20 bp, Homo sapiens
tgtccttgaacccaacagtc

SEQ ID NO: 1059483 - DNA, 23 bp, Homo sapiens
tgtccttgaacccaacagtccct

SEQ ID NO: 1059484 - DNA, 21 bp, Homo sapiens
tgtccttgaactgaggccctg

SEQ ID NO: 1059485 - DNA, 15 bp, Homo sapiens
tgtccttgcacctgc

SEQ ID NO: 1059486 - DNA, 16 bp, Homo sapiens
tgtccttgcacctgca

SEQ ID NO: 1059487 - DNA, 18 bp, Homo sapiens
tgtccttgccccactcct

SEQ ID NO: 1059488 - DNA, 13 bp, Homo sapiens
tgtccttggactc

SEQ ID NO: 1059489 - DNA, 18 bp, Homo sapiens
tgtccttgttcatggaga

SEQ ID NO: 1059490 - DNA, 23 bp, Homo sapiens
tgtcctttcccttcagtaccctc

SEQ ID NO: 1059491 - DNA, 17 bp, Homo sapiens
tgtccttttaggaatat

SEQ ID NO: 1059492 - DNA, 15 bp, Homo sapiens
tgtccttttatttct

SEQ ID NO: 1059493 - DNA, 14 bp, Homo sapiens
tgtccttttctccc

SEQ ID NO: 1059494 - DNA, 15 bp, Homo sapiens
tgtccttttgcaaag

SEQ ID NO: 1059495 - DNA, 19 bp, Homo sapiens
tgtcgaattcctactgaca

SEQ ID NO: 1059496 - DNA, 13 bp, Homo sapiens
tgtcgagacactt

SEQ ID NO: 1059497 - DNA, 15 bp, Homo sapiens
tgtcgagacacttgc

SEQ ID NO: 1059498 - DNA, 21 bp, Homo sapiens
tgtcgagagctggccaaagag

SEQ ID NO: 1059499 - DNA, 22 bp, Homo sapiens
tgtcgattaaaatcactctcag

SEQ ID NO: 1059500 - DNA, 14 bp, Homo sapiens
tgtcgattagactg

SEQ ID NO: 1059501 - DNA, 20 bp, Homo sapiens
tgtcgattagactggacagc

SEQ ID NO: 1059502 - DNA, 23 bp, Homo sapiens
tgtcgattagactggacagcttg

SEQ ID NO: 1059503 - DNA, 13 bp, Homo sapiens
tgtcgcacaatgt

SEQ ID NO: 1059504 - DNA, 21 bp, Homo sapiens
tgtcgccccaggccctccctg

SEQ ID NO: 1059505 - DNA, 14 bp, Homo sapiens
tgtcgcgctcagca

SEQ ID NO: 1059506 - DNA, 22 bp, Homo sapiens
tgtcgctatgtgacttgcgctt

SEQ ID NO: 1059507 - DNA, 14 bp, Homo sapiens
tgtcgctcaggctg

SEQ ID NO: 1059508 - DNA, 16 bp, Homo sapiens
tgtcgctcaggctgga

SEQ ID NO: 1059509 - DNA, 17 bp, Homo sapiens
tgtcgctcaggctggag

SEQ ID NO: 1059510 - DNA, 15 bp, Homo sapiens
tgtcgctcatgtgtg

SEQ ID NO: 1059511 - DNA, 20 bp, Homo sapiens
tgtcggagaggctgtctggg

SEQ ID NO: 1059512 - DNA, 17 bp, Homo sapiens
tgtcggatcctgtgagt

SEQ ID NO: 1059513 - DNA, 18 bp, Homo sapiens
tgtcgggggcccaagtgg

SEQ ID NO: 1059514 - DNA, 22 bp, Homo sapiens
tgtcgggggctgtggatgggtg

SEQ ID NO: 1059515 - DNA, 16 bp, Homo sapiens
tgtcggggttggggtg

SEQ ID NO: 1059516 - DNA, 16 bp, Homo sapiens
tgtcggtggctgcctt

SEQ ID NO: 1059517 - DNA, 19 bp, Homo sapiens
tgtcggtggctgcctttga

SEQ ID NO: 1059518 - DNA, 17 bp, Homo sapiens
tgtcgtaatttgcactt

SEQ ID NO: 1059519 - DNA, 23 bp, Homo sapiens
tgtcgtagccaaggtgggctgag

SEQ ID NO: 1059520 - DNA, 16 bp, Homo sapiens
tgtcgtaggtaaacta

SEQ ID NO: 1059521 - DNA, 13 bp, Homo sapiens
tgtcgtctgactc

SEQ ID NO: 1059522 - DNA, 19 bp, Homo sapiens
tgtcgtctgactctgggtt

SEQ ID NO: 1059523 - DNA, 15 bp, Homo sapiens
tgtcgtgccagtcct

SEQ ID NO: 1059524 - DNA, 13 bp, Homo sapiens
tgtcgtgggatgg

SEQ ID NO: 1059525 - DNA, 12 bp, Homo sapiens
tgtcgtgttttc

SEQ ID NO: 1059526 - DNA, 20 bp, Homo sapiens
tgtcgtgttttcaaggaaga

SEQ ID NO: 1059527 - DNA, 17 bp, Homo sapiens
tgtcgttaaaaacagat

SEQ ID NO: 1059528 - DNA, 21 bp, Homo sapiens
tgtcgttaaaaagttgtttgt

SEQ ID NO: 1059529 - DNA, 22 bp, Homo sapiens
tgtctaaaatgcctcagtgtat

SEQ ID NO: 1059530 - DNA, 17 bp, Homo sapiens
tgtctaaacaatgctga

SEQ ID NO: 1059531 - DNA, 18 bp, Homo sapiens
tgtctaattaaaacactt

SEQ ID NO: 1059532 - DNA, 19 bp, Homo sapiens
tgtctaattgcatctcaaa

SEQ ID NO: 1059533 - DNA, 21 bp, Homo sapiens
tgtctaatttgcacctttgtc

SEQ ID NO: 1059534 - DNA, 13 bp, Homo sapiens
tgtctacagaaaa

SEQ ID NO: 1059535 - DNA, 19 bp, Homo sapiens
tgtctacagaaaatgctgg

SEQ ID NO: 1059536 - DNA, 17 bp, Homo sapiens
tgtctacagtagctgct

SEQ ID NO: 1059537 - DNA, 21 bp, Homo sapiens
tgtctacatgaaagtcctcag

SEQ ID NO: 1059538 - DNA, 22 bp, Homo sapiens
tgtctactcagcatttgattaa

SEQ ID NO: 1059539 - DNA, 19 bp, Homo sapiens
tgtctactcctagaagaac

SEQ ID NO: 1059540 - DNA, 14 bp, Homo sapiens
tgtctactggacaa

SEQ ID NO: 1059541 - DNA, 16 bp, Homo sapiens
tgtctactgtggtgat

SEQ ID NO: 1059542 - DNA, 19 bp, Homo sapiens
tgtctactttttaattttt

SEQ ID NO: 1059543 - DNA, 22 bp, Homo sapiens
tgtctactttttaatttttaag

SEQ ID NO: 1059544 - DNA, 14 bp, Homo sapiens
tgtctagagaggga

SEQ ID NO: 1059545 - DNA, 17 bp, Homo sapiens
tgtctaggaaggtgtga

SEQ ID NO: 1059546 - DNA, 17 bp, Homo sapiens
tgtctaggactgcagtg

SEQ ID NO: 1059547 - DNA, 18 bp, Homo sapiens
tgtctaggactgcagtgt

SEQ ID NO: 1059548 - DNA, 17 bp, Homo sapiens
tgtctaggcaggacctg

SEQ ID NO: 1059549 - DNA, 22 bp, Homo sapiens
tgtctagtgtttttttccctct

SEQ ID NO: 1059550 - DNA, 16 bp, Homo sapiens
tgtctataaaagaaac

SEQ ID NO: 1059551 - DNA, 18 bp, Homo sapiens
tgtctataatggaaacat

SEQ ID NO: 1059552 - DNA, 16 bp, Homo sapiens
tgtctatgaagttgct

SEQ ID NO: 1059553 - DNA, 18 bp, Homo sapiens
tgtctatgaagttgctgt

SEQ ID NO: 1059554 - DNA, 19 bp, Homo sapiens
tgtctatgtagctgaaaat

SEQ ID NO: 1059555 - DNA, 19 bp, Homo sapiens
tgtctattcaaaatatcaa

SEQ ID NO: 1059556 - DNA, 12 bp, Homo sapiens
tgtctattttaa

SEQ ID NO: 1059557 - DNA, 12 bp, Homo sapiens
tgtctcaaaaaa

SEQ ID NO: 1059558 - DNA, 16 bp, Homo sapiens
tgtctcacctggactt

SEQ ID NO: 1059559 - DNA, 17 bp, Homo sapiens
tgtctcactgaaacatt

SEQ ID NO: 1059560 - DNA, 14 bp, Homo sapiens
tgtctcactgttct

SEQ ID NO: 1059561 - DNA, 17 bp, Homo sapiens
tgtctcactgttctgca

SEQ ID NO: 1059562 - DNA, 17 bp, Homo sapiens
tgtctcagcctctgcca

SEQ ID NO: 1059563 - DNA, 11 bp, Homo sapiens
tgtctcatcca

SEQ ID NO: 1059564 - DNA, 16 bp, Homo sapiens
tgtctcatccatcatc

SEQ ID NO: 1059565 - DNA, 21 bp, Homo sapiens
tgtctcatccatcatcatgtg

SEQ ID NO: 1059566 - DNA, 13 bp, Homo sapiens
tgtctcatcccca

SEQ ID NO: 1059567 - DNA, 23 bp, Homo sapiens
tgtctcatccccaggggtcccag

SEQ ID NO: 1059568 - DNA, 14 bp, Homo sapiens
tgtctcatcctcct

SEQ ID NO: 1059569 - DNA, 19 bp, Homo sapiens
tgtctcatcctcctggaac

SEQ ID NO: 1059570 - DNA, 20 bp, Homo sapiens
tgtctccagacccccacccc

SEQ ID NO: 1059571 - DNA, 14 bp, Homo sapiens
tgtctccagctgcc

SEQ ID NO: 1059572 - DNA, 16 bp, Homo sapiens
tgtctccagctgcctg

SEQ ID NO: 1059573 - DNA, 17 bp, Homo sapiens
tgtctccagctgcctgg

SEQ ID NO: 1059574 - DNA, 18 bp, Homo sapiens
tgtctccagggcccccac

SEQ ID NO: 1059575 - DNA, 18 bp, Homo sapiens
tgtctccatgctggatac

SEQ ID NO: 1059576 - DNA, 15 bp, Homo sapiens
tgtctccatggccct

SEQ ID NO: 1059577 - DNA, 17 bp, Homo sapiens
tgtctccattgtgtgat

SEQ ID NO: 1059578 - DNA, 16 bp, Homo sapiens
tgtctcccaacatggg

SEQ ID NO: 1059579 - DNA, 16 bp, Homo sapiens
tgtctcccacacccac

SEQ ID NO: 1059580 - DNA, 18 bp, Homo sapiens
tgtctccctcccctctca

SEQ ID NO: 1059581 - DNA, 20 bp, Homo sapiens
tgtctccctcccctctcaga

SEQ ID NO: 1059582 - DNA, 11 bp, Homo sapiens
tgtctccctcg

SEQ ID NO: 1059583 - DNA, 21 bp, Homo sapiens
tgtctccctcgggggctcttc

SEQ ID NO: 1059584 - DNA, 22 bp, Homo sapiens
tgtctcctatatatttctatta

SEQ ID NO: 1059585 - DNA, 22 bp, Homo sapiens
tgtctcctttctgactgtccct

SEQ ID NO: 1059586 - DNA, 22 bp, Homo sapiens
tgtctcgggctgacccttttct

SEQ ID NO: 1059587 - DNA, 19 bp, Homo sapiens
tgtctcgtggtaggactgt

SEQ ID NO: 1059588 - DNA, 16 bp, Homo sapiens
tgtctcgtgtcagtaa

SEQ ID NO: 1059589 - DNA, 18 bp, Homo sapiens
tgtctcgtgtcagtaatt

SEQ ID NO: 1059590 - DNA, 20 bp, Homo sapiens
tgtctctaaccattcaaatg

SEQ ID NO: 1059591 - DNA, 18 bp, Homo sapiens
tgtctctagctgttctgg

SEQ ID NO: 1059592 - DNA, 13 bp, Homo sapiens
tgtctctcagaat

SEQ ID NO: 1059593 - DNA, 11 bp, Homo sapiens
tgtctctccca

SEQ ID NO: 1059594 - DNA, 22 bp, Homo sapiens
tgtctctcccaccccggcctcc

SEQ ID NO: 1059595 - DNA, 17 bp, Homo sapiens
tgtctctccccctctgt

SEQ ID NO: 1059596 - DNA, 20 bp, Homo sapiens
tgtctctccccctctgtctt

SEQ ID NO: 1059597 - DNA, 23 bp, Homo sapiens
tgtctctcctagcccctctctca

SEQ ID NO: 1059598 - DNA, 20 bp, Homo sapiens
tgtctctgatgcagcttata

SEQ ID NO: 1059599 - DNA, 11 bp, Homo sapiens
tgtctctgctc

SEQ ID NO: 1059600 - DNA, 22 bp, Homo sapiens
tgtctctgctcgccctcctttc

SEQ ID NO: 1059601 - DNA, 20 bp, Homo sapiens
tgtctctgctttccttttct

SEQ ID NO: 1059602 - DNA, 22 bp, Homo sapiens
tgtctctgctttccttttctct

SEQ ID NO: 1059603 - DNA, 15 bp, Homo sapiens
tgtctctggagtgat

SEQ ID NO: 1059604 - DNA, 18 bp, Homo sapiens
tgtctctggcgtgtgggt

SEQ ID NO: 1059605 - DNA, 13 bp, Homo sapiens
tgtctctgggcct

SEQ ID NO: 1059606 - DNA, 20 bp, Homo sapiens
tgtctctgggcctgtgtgtg

SEQ ID NO: 1059607 - DNA, 22 bp, Homo sapiens
tgtctctgtggaaaagccatct

SEQ ID NO: 1059608 - DNA, 12 bp, Homo sapiens
tgtctctgttca

SEQ ID NO: 1059609 - DNA, 18 bp, Homo sapiens
tgtctctgttcagatgtg

SEQ ID NO: 1059610 - DNA, 14 bp, Homo sapiens
tgtctctgtttcct

SEQ ID NO: 1059611 - DNA, 13 bp, Homo sapiens
tgtctcttagaaa

SEQ ID NO: 1059612 - DNA, 17 bp, Homo sapiens
tgtctcttagaaatact

SEQ ID NO: 1059613 - DNA, 23 bp, Homo sapiens
tgtctcttgagcatcaatcttgt

SEQ ID NO: 1059614 - DNA, 14 bp, Homo sapiens
tgtctcttgagttt

SEQ ID NO: 1059615 - DNA, 22 bp, Homo sapiens
tgtctcttggctttgtcacttt

SEQ ID NO: 1059616 - DNA, 14 bp, Homo sapiens
tgtctcttgtagaa

SEQ ID NO: 1059617 - DNA, 15 bp, Homo sapiens
tgtctcttgtagaag

SEQ ID NO: 1059618 - DNA, 23 bp, Homo sapiens
tgtctctttggcgacctcctttc

SEQ ID NO: 1059619 - DNA, 21 bp, Homo sapiens
tgtctcttttctcttttgctt

SEQ ID NO: 1059620 - DNA, 19 bp, Homo sapiens
tgtctgaaacatttcataa

SEQ ID NO: 1059621 - DNA, 13 bp, Homo sapiens
tgtctgaacaaag

SEQ ID NO: 1059622 - DNA, 17 bp, Homo sapiens
tgtctgaaggacacttc

SEQ ID NO: 1059623 - DNA, 19 bp, Homo sapiens
tgtctgaaggacacttcct

SEQ ID NO: 1059624 - DNA, 15 bp, Homo sapiens
tgtctgaagtacaaa

SEQ ID NO: 1059625 - DNA, 20 bp, Homo sapiens
tgtctgaagtacaaacatga

SEQ ID NO: 1059626 - DNA, 14 bp, Homo sapiens
tgtctgacacatta

SEQ ID NO: 1059627 - DNA, 18 bp, Homo sapiens
tgtctgaggagtaagtgt

SEQ ID NO: 1059628 - DNA, 22 bp, Homo sapiens
tgtctgaggagtaagtgtacaa

SEQ ID NO: 1059629 - DNA, 13 bp, Homo sapiens
tgtctgaggcctc

SEQ ID NO: 1059630 - DNA, 16 bp, Homo sapiens
tgtctgaggcctcatc

SEQ ID NO: 1059631 - DNA, 14 bp, Homo sapiens
tgtctgagtgaacc

SEQ ID NO: 1059632 - DNA, 21 bp, Homo sapiens
tgtctgatcgttcaaagcatg

SEQ ID NO: 1059633 - DNA, 19 bp, Homo sapiens
tgtctgattggctcaccca

SEQ ID NO: 1059634 - DNA, 15 bp, Homo sapiens
tgtctgcaggtttct

SEQ ID NO: 1059635 - DNA, 15 bp, Homo sapiens
tgtctgcattgttat

SEQ ID NO: 1059636 - DNA, 13 bp, Homo sapiens
tgtctgcatttcg

SEQ ID NO: 1059637 - DNA, 15 bp, Homo sapiens
tgtctgccaaacaca

SEQ ID NO: 1059638 - DNA, 15 bp, Homo sapiens
tgtctgccagccagc

SEQ ID NO: 1059639 - DNA, 15 bp, Homo sapiens
tgtctgccaggcact

SEQ ID NO: 1059640 - DNA, 16 bp, Homo sapiens
tgtctgccaggcactc

SEQ ID NO: 1059641 - DNA, 22 bp, Homo sapiens
tgtctgccaggcactctcatca

SEQ ID NO: 1059642 - DNA, 18 bp, Homo sapiens
tgtctgccatgttgcccc

SEQ ID NO: 1059643 - DNA, 15 bp, Homo sapiens
tgtctgcctgtattt

SEQ ID NO: 1059644 - DNA, 15 bp, Homo sapiens
tgtctgccttcacaa

SEQ ID NO: 1059645 - DNA, 15 bp, Homo sapiens
tgtctgcctttaaat

SEQ ID NO: 1059646 - DNA, 21 bp, Homo sapiens
tgtctgctaggcgctggggag

SEQ ID NO: 1059647 - DNA, 20 bp, Homo sapiens
tgtctgctttaaagggcctg

SEQ ID NO: 1059648 - DNA, 22 bp, Homo sapiens
tgtctgctttaaagggcctgcc

SEQ ID NO: 1059649 - DNA, 19 bp, Homo sapiens
tgtctgctttctccattgt

SEQ ID NO: 1059650 - DNA, 13 bp, Homo sapiens
tgtctgctttggt

SEQ ID NO: 1059651 - DNA, 17 bp, Homo sapiens
tgtctggaagacgtggc

SEQ ID NO: 1059652 - DNA, 21 bp, Homo sapiens
tgtctggatcagtaaaattat

SEQ ID NO: 1059653 - DNA, 18 bp, Homo sapiens
tgtctggcaaaagaaaaa

SEQ ID NO: 1059654 - DNA, 22 bp, Homo sapiens
tgtctggcccgcaatactgtag

SEQ ID NO: 1059655 - DNA, 20 bp, Homo sapiens
tgtctggcgttctcaagaat

SEQ ID NO: 1059656 - DNA, 18 bp, Homo sapiens
tgtctgggtttggcccaa

SEQ ID NO: 1059657 - DNA, 19 bp, Homo sapiens
tgtctgggtttggcccaag

SEQ ID NO: 1059658 - DNA, 21 bp, Homo sapiens
tgtctgggtttggcccaagac

SEQ ID NO: 1059659 - DNA, 16 bp, Homo sapiens
tgtctggtgaggtggc

SEQ ID NO: 1059660 - DNA, 22 bp, Homo sapiens
tgtctggtgaggtggcccaggc

SEQ ID NO: 1059661 - DNA, 14 bp, Homo sapiens
tgtctggtggcccc

SEQ ID NO: 1059662 - DNA, 21 bp, Homo sapiens
tgtctggtggtggcaccatct

SEQ ID NO: 1059663 - DNA, 14 bp, Homo sapiens
tgtctggttaaaaa

SEQ ID NO: 1059664 - DNA, 16 bp, Homo sapiens
tgtctggttaaaaaat

SEQ ID NO: 1059665 - DNA, 16 bp, Homo sapiens
tgtctgtaaaaaatgg

SEQ ID NO: 1059666 - DNA, 21 bp, Homo sapiens
tgtctgtaaaaaatggagctc

SEQ ID NO: 1059667 - DNA, 18 bp, Homo sapiens
tgtctgtaaatctaacat

SEQ ID NO: 1059668 - DNA, 12 bp, Homo sapiens
tgtctgtacata

SEQ ID NO: 1059669 - DNA, 15 bp, Homo sapiens
tgtctgtacatactg

SEQ ID NO: 1059670 - DNA, 19 bp, Homo sapiens
tgtctgtacatactggcct

SEQ ID NO: 1059671 - DNA, 21 bp, Homo sapiens
tgtctgtacatactggcctct

SEQ ID NO: 1059672 - DNA, 17 bp, Homo sapiens
tgtctgtagctcctcaa

SEQ ID NO: 1059673 - DNA, 23 bp, Homo sapiens
tgtctgtaggtgtctctgggcct

SEQ ID NO: 1059674 - DNA, 12 bp, Homo sapiens
tgtctgtcacag

SEQ ID NO: 1059675 - DNA, 16 bp, Homo sapiens
tgtctgtcacaggctg

SEQ ID NO: 1059676 - DNA, 18 bp, Homo sapiens
tgtctgtcacaggctggg

SEQ ID NO: 1059677 - DNA, 19 bp, Homo sapiens
tgtctgtcacaggctgggt

SEQ ID NO: 1059678 - DNA, 15 bp, Homo sapiens
tgtctgtcagctgtg

SEQ ID NO: 1059679 - DNA, 18 bp, Homo sapiens
tgtctgtccatctgtctg

SEQ ID NO: 1059680 - DNA, 14 bp, Homo sapiens
tgtctgtcctaccc

SEQ ID NO: 1059681 - DNA, 19 bp, Homo sapiens
tgtctgtcctacccgcccg

SEQ ID NO: 1059682 - DNA, 18 bp, Homo sapiens
tgtctgtcgcccttctcc

SEQ ID NO: 1059683 - DNA, 12 bp, Homo sapiens
tgtctgtctccc

SEQ ID NO: 1059684 - DNA, 19 bp, Homo sapiens
tgtctgtctctccatctgt

SEQ ID NO: 1059685 - DNA, 14 bp, Homo sapiens
tgtctgtctggcac

SEQ ID NO: 1059686 - DNA, 14 bp, Homo sapiens
tgtctgtcttctcc

SEQ ID NO: 1059687 - DNA, 19 bp, Homo sapiens
tgtctgtgaacagagagac

SEQ ID NO: 1059688 - DNA, 22 bp, Homo sapiens
tgtctgtgagtacctggtcata

SEQ ID NO: 1059689 - DNA, 16 bp, Homo sapiens
tgtctgtgccatggat

SEQ ID NO: 1059690 - DNA, 11 bp, Homo sapiens
tgtctgtgcta

SEQ ID NO: 1059691 - DNA, 13 bp, Homo sapiens
tgtctgtggggag

SEQ ID NO: 1059692 - DNA, 21 bp, Homo sapiens
tgtctgtgtgcaagtgtgtgc

SEQ ID NO: 1059693 - DNA, 20 bp, Homo sapiens
tgtctgtgttgcttcaaatt

SEQ ID NO: 1059694 - DNA, 14 bp, Homo sapiens
tgtctgtgtttaat

SEQ ID NO: 1059695 - DNA, 17 bp, Homo sapiens
tgtctgttacactggag

SEQ ID NO: 1059696 - DNA, 17 bp, Homo sapiens
tgtctgttatttcctaa

SEQ ID NO: 1059697 - DNA, 14 bp, Homo sapiens
tgtctgttcagcaa

SEQ ID NO: 1059698 - DNA, 15 bp, Homo sapiens
tgtctgttctacata

SEQ ID NO: 1059699 - DNA, 21 bp, Homo sapiens
tgtctgtttattaactactga

SEQ ID NO: 1059700 - DNA, 14 bp, Homo sapiens
tgtctgtttcagaa

SEQ ID NO: 1059701 - DNA, 16 bp, Homo sapiens
tgtctgtttgttctct

SEQ ID NO: 1059702 - DNA, 20 bp, Homo sapiens
tgtctgtttgtttcaagaac

SEQ ID NO: 1059703 - DNA, 22 bp, Homo sapiens
tgtctgtttgtttcaagaacct

SEQ ID NO: 1059704 - DNA, 17 bp, Homo sapiens
tgtcttaaaaatttata

SEQ ID NO: 1059705 - DNA, 13 bp, Homo sapiens
tgtcttaaaaggt

SEQ ID NO: 1059706 - DNA, 15 bp, Homo sapiens
tgtcttaaataaaac

SEQ ID NO: 1059707 - DNA, 23 bp, Homo sapiens
tgtcttagtgcaaaaaacatact

SEQ ID NO: 1059708 - DNA, 14 bp, Homo sapiens
tgtcttatggtctt

SEQ ID NO: 1059709 - DNA, 15 bp, Homo sapiens
tgtcttattgaaaaa

SEQ ID NO: 1059710 - DNA, 23 bp, Homo sapiens
tgtcttcagcagtcaatacaaat

SEQ ID NO: 1059711 - DNA, 17 bp, Homo sapiens
tgtcttcatttcattgt

SEQ ID NO: 1059712 - DNA, 19 bp, Homo sapiens
tgtcttcatttcattgtat

SEQ ID NO: 1059713 - DNA, 13 bp, Homo sapiens
tgtcttccaagga

SEQ ID NO: 1059714 - DNA, 18 bp, Homo sapiens
tgtgggttggccaggagg

SEQ ID NO: 1059715 - DNA, 21 bp, Homo sapiens
tgtgggtttgggtgcctcctg

SEQ ID NO: 1059716 - DNA, 18 bp, Homo sapiens
tgtggtacaaggtggaga

SEQ ID NO: 1059717 - DNA, 16 bp, Homo sapiens
tgtggtacaatctcaa

SEQ ID NO: 1059718 - DNA, 20 bp, Homo sapiens
tgtggtaggggcagggaggc

SEQ ID NO: 1059719 - DNA, 22 bp, Homo sapiens
tgtggtaggtgataaagaggca

SEQ ID NO: 1059720 - DNA, 15 bp, Homo sapiens
tgtggtctaaagtgt

SEQ ID NO: 1059721 - DNA, 11 bp, Homo sapiens
tgtggtctcag

SEQ ID NO: 1059722 - DNA, 12 bp, Homo sapiens
tgtggtgagggg

SEQ ID NO: 1059723 - DNA, 18 bp, Homo sapiens
tgtggtgaggggctttct

SEQ ID NO: 1059724 - DNA, 13 bp, Homo sapiens
tgtggtgatgaaa

SEQ ID NO: 1059725 - DNA, 16 bp, Homo sapiens
tgtggtgatgtgcctg

SEQ ID NO: 1059726 - DNA, 15 bp, Homo sapiens
tgtggtgcctgaggt

SEQ ID NO: 1059727 - DNA, 19 bp, Homo sapiens
tgtggtgcctgaggtctgt

SEQ ID NO: 1059728 - DNA, 23 bp, Homo sapiens
tgtggtggcacgcatctgtagtt

SEQ ID NO: 1059729 - DNA, 16 bp, Homo sapiens
tgtggtgttgggaagg

SEQ ID NO: 1059730 - DNA, 21 bp, Homo sapiens
tgtggtgtttcctgcaggcca

SEQ ID NO: 1059731 - DNA, 21 bp, Homo sapiens
tgtggttacagtgcagacagg

SEQ ID NO: 1059732 - DNA, 20 bp, Homo sapiens
tgtggttataacttaatgaa

SEQ ID NO: 1059733 - DNA, 23 bp, Homo sapiens
tgtggttataacttaatgaaaac

SEQ ID NO: 1059734 - DNA, 21 bp, Homo sapiens
tgtggttcagtgccttcctct

SEQ ID NO: 1059735 - DNA, 14 bp, Homo sapiens
tgtggttctatttt

SEQ ID NO: 1059736 - DNA, 20 bp, Homo sapiens
tgtggtttcagatgtgcaat

SEQ ID NO: 1059737 - DNA, 21 bp, Homo sapiens
tgtggtttcagatgtgcaata

SEQ ID NO: 1059738 - DNA, 22 bp, Homo sapiens
tgtggtttcatgttagttacct

SEQ ID NO: 1059739 - DNA, 16 bp, Homo sapiens
tgtggtttccctgccc

SEQ ID NO: 1059740 - DNA, 20 bp, Homo sapiens
tgtggtttccctgcccctgt

SEQ ID NO: 1059741 - DNA, 16 bp, Homo sapiens
tgtggttttcccctcc

SEQ ID NO: 1059742 - DNA, 21 bp, Homo sapiens
tgtggttttcccctccctggg

SEQ ID NO: 1059743 - DNA, 17 bp, Homo sapiens
tgtgtaaaaaatggaaa

SEQ ID NO: 1059744 - DNA, 20 bp, Homo sapiens
tgtgtaaaaaatggaaaaaa

SEQ ID NO: 1059745 - DNA, 18 bp, Homo sapiens
tgtgtaaagacttgagaa

SEQ ID NO: 1059746 - DNA, 21 bp, Homo sapiens
tgtgtaaagtgtaaatccttt

SEQ ID NO: 1059747 - DNA, 12 bp, Homo sapiens
tgtgtaaataat

SEQ ID NO: 1059748 - DNA, 20 bp, Homo sapiens
tgtgtaaataatttgcactg

SEQ ID NO: 1059749 - DNA, 14 bp, Homo sapiens
tgtgtaaatttgta

SEQ ID NO: 1059750 - DNA, 21 bp, Homo sapiens
tgtgtaacaattttaatgcta

SEQ ID NO: 1059751 - DNA, 16 bp, Homo sapiens
tgtgtaactttaaaca

SEQ ID NO: 1059752 - DNA, 16 bp, Homo sapiens
tgtgtaatagaaaact

SEQ ID NO: 1059753 - DNA, 18 bp, Homo sapiens
tgtgtaatagaaaactga

SEQ ID NO: 1059754 - DNA, 14 bp, Homo sapiens
tgtgtaatatgaaa

SEQ ID NO: 1059755 - DNA, 21 bp, Homo sapiens
tgtgtaatcatttcttgggcc

SEQ ID NO: 1059756 - DNA, 19 bp, Homo sapiens
tgtgtaatctaagtatatg

SEQ ID NO: 1059757 - DNA, 21 bp, Homo sapiens
tgtgtaattagtgccacttaa

SEQ ID NO: 1059758 - DNA, 17 bp, Homo sapiens
tgtgtacacctctggat

SEQ ID NO: 1059759 - DNA, 13 bp, Homo sapiens
tgtgtacagtgaa

SEQ ID NO: 1059760 - DNA, 21 bp, Homo sapiens
tgtgtacagtgaattgtcttt

SEQ ID NO: 1059761 - DNA, 22 bp, Homo sapiens
tgtgtacagtgaattgtctttt

SEQ ID NO: 1059762 - DNA, 18 bp, Homo sapiens
tgtgtacataactctgta

SEQ ID NO: 1059763 - DNA, 17 bp, Homo sapiens
tgtgtactgataaaata

SEQ ID NO: 1059764 - DNA, 16 bp, Homo sapiens
tgtgtagacaaatatt

SEQ ID NO: 1059765 - DNA, 16 bp, Homo sapiens
tgtgtagatttgaaaa

SEQ ID NO: 1059766 - DNA, 14 bp, Homo sapiens
tgtgtagccgccct

SEQ ID NO: 1059767 - DNA, 17 bp, Homo sapiens
tgtgtagccgccctgag

SEQ ID NO: 1059768 - DNA, 12 bp, Homo sapiens
tgtgtagccttt

SEQ ID NO: 1059769 - DNA, 13 bp, Homo sapiens
tgtgtagcctttt

SEQ ID NO: 1059770 - DNA, 14 bp, Homo sapiens
tgtgtagggaaagt

SEQ ID NO: 1059771 - DNA, 14 bp, Homo sapiens
tgtgtagggaccag

SEQ ID NO: 1059772 - DNA, 16 bp, Homo sapiens
tgtgtataaattgtct

SEQ ID NO: 1059773 - DNA, 21 bp, Homo sapiens
tgtgtatagatgcaagatatt

SEQ ID NO: 1059774 - DNA, 16 bp, Homo sapiens
tgtgtatatgtattta

SEQ ID NO: 1059775 - DNA, 20 bp, Homo sapiens
tgtgtatatttttgtatgtc

SEQ ID NO: 1059776 - DNA, 13 bp, Homo sapiens
tgtgtatgctgct

SEQ ID NO: 1059777 - DNA, 16 bp, Homo sapiens
tgtgtatgtacatata

SEQ ID NO: 1059778 - DNA, 22 bp, Homo sapiens
tgtgtatgtacttagctgtact

SEQ ID NO: 1059779 - DNA, 16 bp, Homo sapiens
tgtgtatgtatacaca

SEQ ID NO: 1059780 - DNA, 20 bp, Homo sapiens
tgtgtatgtgtatgtgtgtg

SEQ ID NO: 1059781 - DNA, 13 bp, Homo sapiens
tgtgtatgtgtgt

SEQ ID NO: 1059782 - DNA, 19 bp, Homo sapiens
tgtgtattaaaaaaaacaa

SEQ ID NO: 1059783 - DNA, 15 bp, Homo sapiens
tgtgtattaaatggt

SEQ ID NO: 1059784 - DNA, 23 bp, Homo sapiens
tgtgtattatgtgcctaattttc

SEQ ID NO: 1059785 - DNA, 16 bp, Homo sapiens
tgtgtattgatgcaat

SEQ ID NO: 1059786 - DNA, 17 bp, Homo sapiens
tgtgtattgatgcaata

SEQ ID NO: 1059787 - DNA, 18 bp, Homo sapiens
tgtgtattgatgcaatat

SEQ ID NO: 1059788 - DNA, 21 bp, Homo sapiens
tgtgtattgatgcaatataag

SEQ ID NO: 1059789 - DNA, 15 bp, Homo sapiens
tgtgtattgttccca

SEQ ID NO: 1059790 - DNA, 11 bp, Homo sapiens
tgtgtatttct

SEQ ID NO: 1059791 - DNA, 16 bp, Homo sapiens
tgtgtatttcttatac

SEQ ID NO: 1059792 - DNA, 11 bp, Homo sapiens
tgtgtatttgc

SEQ ID NO: 1059793 - DNA, 13 bp, Homo sapiens
tgtgtatttgcta

SEQ ID NO: 1059794 - DNA, 19 bp, Homo sapiens
tgtgtatttgtattaataa

SEQ ID NO: 1059795 - DNA, 16 bp, Homo sapiens
tgtgtattttcctgga

SEQ ID NO: 1059796 - DNA, 16 bp, Homo sapiens
tgtgtcaatgggcaat

SEQ ID NO: 1059797 - DNA, 17 bp, Homo sapiens
tgtgtcacttgtgcttt

SEQ ID NO: 1059798 - DNA, 15 bp, Homo sapiens
tgtgtcagaaacatg

SEQ ID NO: 1059799 - DNA, 11 bp, Homo sapiens
tgtgtcagagc

SEQ ID NO: 1059800 - DNA, 16 bp, Homo sapiens
tgtgtcagagcccagg

SEQ ID NO: 1059801 - DNA, 17 bp, Homo sapiens
tgtgtcagagcccaggg

SEQ ID NO: 1059802 - DNA, 19 bp, Homo sapiens
tgtgtcagagcccagggga

SEQ ID NO: 1059803 - DNA, 17 bp, Homo sapiens
tgtgtcagctgaggctg

SEQ ID NO: 1059804 - DNA, 20 bp, Homo sapiens
tgtgtcaggccctctgcctg

SEQ ID NO: 1059805 - DNA, 22 bp, Homo sapiens
tgtgtcaggccctctgcctgca

SEQ ID NO: 1059806 - DNA, 19 bp, Homo sapiens
tgtgtccaagtgtgtgtgc

SEQ ID NO: 1059807 - DNA, 16 bp, Homo sapiens
tgtgtccagcagctgc

SEQ ID NO: 1059808 - DNA, 22 bp, Homo sapiens
tgtgtccaggctctgggcacag

SEQ ID NO: 1059809 - DNA, 13 bp, Homo sapiens
tgtgtccatcctg

SEQ ID NO: 1059810 - DNA, 20 bp, Homo sapiens
tgtgtccatgcgctcagggc

SEQ ID NO: 1059811 - DNA, 14 bp, Homo sapiens
tgtgtccatgtgtg

SEQ ID NO: 1059812 - DNA, 16 bp, Homo sapiens
tgtgtccatgtgtgtg

SEQ ID NO: 1059813 - DNA, 17 bp, Homo sapiens
tgtgtccatgtgtgtgc

SEQ ID NO: 1059814 - DNA, 13 bp, Homo sapiens
tgtgtccattttg

SEQ ID NO: 1059815 - DNA, 17 bp, Homo sapiens
tgtgtcccagatgctgt

SEQ ID NO: 1059816 - DNA, 19 bp, Homo sapiens
tgtgtcccatgacccaccc

SEQ ID NO: 1059817 - DNA, 15 bp, Homo sapiens
tgtgtcccccccagg

SEQ ID NO: 1059818 - DNA, 22 bp, Homo sapiens
tgtgtcccccccaggccttgtc

SEQ ID NO: 1059819 - DNA, 22 bp, Homo sapiens
tgtgtcccctcactctgtcagc

SEQ ID NO: 1059820 - DNA, 20 bp, Homo sapiens
tgtgtcccctgacctgtcca

SEQ ID NO: 1059821 - DNA, 14 bp, Homo sapiens
tgtgtcctcaggga

SEQ ID NO: 1059822 - DNA, 17 bp, Homo sapiens
tgtgtcctccaggagct

SEQ ID NO: 1059823 - DNA, 21 bp, Homo sapiens
tgtgtcctccaggagcttctt

SEQ ID NO: 1059824 - DNA, 23 bp, Homo sapiens
tgtgtcctgtcctttcttgcaga

SEQ ID NO: 1059825 - DNA, 14 bp, Homo sapiens
tgtgtccttccctg

SEQ ID NO: 1059826 - DNA, 16 bp, Homo sapiens
tgtgtccttccctgca

SEQ ID NO: 1059827 - DNA, 19 bp, Homo sapiens
tgtgtccttgaactgaggc

SEQ ID NO: 1059828 - DNA, 13 bp, Homo sapiens
tgtgtctaaactg

SEQ ID NO: 1059829 - DNA, 20 bp, Homo sapiens
tgtgtctaggcaggacctgt

SEQ ID NO: 1059830 - DNA, 17 bp, Homo sapiens
tgtgtctcccagaacta

SEQ ID NO: 1059831 - DNA, 14 bp, Homo sapiens
tgtgtctcgtgtca

SEQ ID NO: 1059832 - DNA, 20 bp, Homo sapiens
tgtgtctcgtgtcagtaatt

SEQ ID NO: 1059833 - DNA, 13 bp, Homo sapiens
tgtgtctctgtct

SEQ ID NO: 1059834 - DNA, 17 bp, Homo sapiens
tgtgtctctgtctctcc

SEQ ID NO: 1059835 - DNA, 21 bp, Homo sapiens
tgttcagagtggctcactggc

SEQ ID NO: 1059836 - DNA, 13 bp, Homo sapiens
tgttcagcactgt

SEQ ID NO: 1059837 - DNA, 17 bp, Homo sapiens
tgttcagcactgtccct

SEQ ID NO: 1059838 - DNA, 18 bp, Homo sapiens
tgttcagcactgtccctt

SEQ ID NO: 1059839 - DNA, 18 bp, Homo sapiens
tgttcagctctttccaaa

SEQ ID NO: 1059840 - DNA, 20 bp, Homo sapiens
tgttcagctctttccaaatt

SEQ ID NO: 1059841 - DNA, 15 bp, Homo sapiens
tgttcagtgcttttt

SEQ ID NO: 1059842 - DNA, 14 bp, Homo sapiens
tgttcataataaaa

SEQ ID NO: 1059843 - DNA, 15 bp, Homo sapiens
tgttcatcatccaga

SEQ ID NO: 1059844 - DNA, 19 bp, Homo sapiens
tgttcattataatctcaaa

SEQ ID NO: 1059845 - DNA, 16 bp, Homo sapiens
tgttcattcaagctat

SEQ ID NO: 1059846 - DNA, 13 bp, Homo sapiens
tgttcattgtaat

SEQ ID NO: 1059847 - DNA, 18 bp, Homo sapiens
tgttcattgtaatgttac

SEQ ID NO: 1059848 - DNA, 20 bp, Homo sapiens
tgttcattgtaatgttactg

SEQ ID NO: 1059849 - DNA, 23 bp, Homo sapiens
tgttcattgtaatgttactgatc

SEQ ID NO: 1059850 - DNA, 10 bp, Homo sapiens
tgttcattta

SEQ ID NO: 1059851 - DNA, 20 bp, Homo sapiens
tgttcatttagataatttga

SEQ ID NO: 1059852 - DNA, 22 bp, Homo sapiens
tgttcatttagataatttgaaa

SEQ ID NO: 1059853 - DNA, 21 bp, Homo sapiens
tgttcatttggtgttcctgga

SEQ ID NO: 1059854 - DNA, 18 bp, Homo sapiens
tgttcattttagtgactg

SEQ ID NO: 1059855 - DNA, 22 bp, Homo sapiens
tgttcattttctctgtatgaat

SEQ ID NO: 1059856 - DNA, 12 bp, Homo sapiens
tgttcattttga

SEQ ID NO: 1059857 - DNA, 17 bp, Homo sapiens
tgttccaaattcagttt

SEQ ID NO: 1059858 - DNA, 20 bp, Homo sapiens
tgttccaaattcagtttcat

SEQ ID NO: 1059859 - DNA, 22 bp, Homo sapiens
tgttccaaattcagtttcataa

SEQ ID NO: 1059860 - DNA, 14 bp, Homo sapiens
tgttccaagacatt

SEQ ID NO: 1059861 - DNA, 15 bp, Homo sapiens
tgttccaatgaaaaa

SEQ ID NO: 1059862 - DNA, 18 bp, Homo sapiens
tgttccaatgtcaatgtg

SEQ ID NO: 1059863 - DNA, 17 bp, Homo sapiens
tgttccaatttcacgct

SEQ ID NO: 1059864 - DNA, 20 bp, Homo sapiens
tgttccacaagttaaataaa

SEQ ID NO: 1059865 - DNA, 21 bp, Homo sapiens
tgttccacacatttaaaacat

SEQ ID NO: 1059866 - DNA, 14 bp, Homo sapiens
tgttccaggctcac

SEQ ID NO: 1059867 - DNA, 14 bp, Homo sapiens
tgttccagtgttta

SEQ ID NO: 1059868 - DNA, 21 bp, Homo sapiens
tgttccattgaagccgactct

SEQ ID NO: 1059869 - DNA, 17 bp, Homo sapiens
tgttcccacctgctgga

SEQ ID NO: 1059870 - DNA, 17 bp, Homo sapiens
tgttcccagaggcaggc

SEQ ID NO: 1059871 - DNA, 15 bp, Homo sapiens
tgttcccagcagtgg

SEQ ID NO: 1059872 - DNA, 20 bp, Homo sapiens
tgttcccatgtagccccctg

SEQ ID NO: 1059873 - DNA, 22 bp, Homo sapiens
tgttccccactgacagcctccc

SEQ ID NO: 1059874 - DNA, 17 bp, Homo sapiens
tgttccccctgccgcag

SEQ ID NO: 1059875 - DNA, 18 bp, Homo sapiens
tgttcccctaagtggatt

SEQ ID NO: 1059876 - DNA, 21 bp, Homo sapiens
tgttcccctcactggatgaaa

SEQ ID NO: 1059877 - DNA, 13 bp, Homo sapiens
tgttcccctctcc

SEQ ID NO: 1059878 - DNA, 12 bp, Homo sapiens
tgttcccctctt

SEQ ID NO: 1059879 - DNA, 21 bp, Homo sapiens
tgttcccgagcgatagatggg

SEQ ID NO: 1059880 - DNA, 22 bp, Homo sapiens
tgttcccgatggtctctctccc

SEQ ID NO: 1059881 - DNA, 13 bp, Homo sapiens
tgttccctacccc

SEQ ID NO: 1059882 - DNA, 14 bp, Homo sapiens
tgttccctcctggt

SEQ ID NO: 1059883 - DNA, 16 bp, Homo sapiens
tgttccctctgctcct

SEQ ID NO: 1059884 - DNA, 18 bp, Homo sapiens
tgttccctctgctcctgg

SEQ ID NO: 1059885 - DNA, 14 bp, Homo sapiens
tgttccctgcaccc

SEQ ID NO: 1059886 - DNA, 13 bp, Homo sapiens
tgttccctggagt

SEQ ID NO: 1059887 - DNA, 18 bp, Homo sapiens
tgttccctgttctggtat

SEQ ID NO: 1059888 - DNA, 21 bp, Homo sapiens
tgttcccttcctcttcctgcc

SEQ ID NO: 1059889 - DNA, 15 bp, Homo sapiens
tgttcccttgaccat

SEQ ID NO: 1059890 - DNA, 16 bp, Homo sapiens
tgttccctttgcctta

SEQ ID NO: 1059891 - DNA, 22 bp, Homo sapiens
tgttccctttgccttaaacctg

SEQ ID NO: 1059892 - DNA, 22 bp, Homo sapiens
tgttccgaaaccaaagaagaaa

SEQ ID NO: 1059893 - DNA, 20 bp, Homo sapiens
tgttcctaacaaaatgagat

SEQ ID NO: 1059894 - DNA, 15 bp, Homo sapiens
tgttcctacagcccc

SEQ ID NO: 1059895 - DNA, 16 bp, Homo sapiens
tgttcctatggaaaca

SEQ ID NO: 1059896 - DNA, 15 bp, Homo sapiens
tgttcctcatgttgc

SEQ ID NO: 1059897 - DNA, 20 bp, Homo sapiens
tgttcctcatgttgctgaat

SEQ ID NO: 1059898 - DNA, 22 bp, Homo sapiens
tgttcctccattttcttatcca

SEQ ID NO: 1059899 - DNA, 23 bp, Homo sapiens
tgttcctcggtgggccagagctg

SEQ ID NO: 1059900 - DNA, 19 bp, Homo sapiens
tgttcctgaatacaagcct

SEQ ID NO: 1059901 - DNA, 15 bp, Homo sapiens
tgttcctgctccatg

SEQ ID NO: 1059902 - DNA, 10 bp, Homo sapiens
tgttcctgga

SEQ ID NO: 1059903 - DNA, 13 bp, Homo sapiens
tgttcctggaagc

SEQ ID NO: 1059904 - DNA, 23 bp, Homo sapiens
tgttcctggaggtcagcatttga

SEQ ID NO: 1059905 - DNA, 14 bp, Homo sapiens
tgttcctggcaata

SEQ ID NO: 1059906 - DNA, 21 bp, Homo sapiens
tgttcctggcaatagtgtgtt

SEQ ID NO: 1059907 - DNA, 15 bp, Homo sapiens
tgttcctggcagttt

SEQ ID NO: 1059908 - DNA, 22 bp, Homo sapiens
tgttcctggctgatgatccaga

SEQ ID NO: 1059909 - DNA, 12 bp, Homo sapiens
tgttcctgtgtt

SEQ ID NO: 1059910 - DNA, 19 bp, Homo sapiens
tgttccttaagtcagaaca

SEQ ID NO: 1059911 - DNA, 18 bp, Homo sapiens
tgttccttcacatcctgt

SEQ ID NO: 1059912 - DNA, 18 bp, Homo sapiens
tgttccttcctccactgc

SEQ ID NO: 1059913 - DNA, 17 bp, Homo sapiens
tgttccttggcagtgga

SEQ ID NO: 1059914 - DNA, 14 bp, Homo sapiens
tgttccttttgaaa

SEQ ID NO: 1059915 - DNA, 15 bp, Homo sapiens
tgttccttttgaaat

SEQ ID NO: 1059916 - DNA, 15 bp, Homo sapiens
tgttcgggggagcag

SEQ ID NO: 1059917 - DNA, 17 bp, Homo sapiens
tgttcgggggagcagag

SEQ ID NO: 1059918 - DNA, 21 bp, Homo sapiens
tgttcgtttccatcatgtctg

SEQ ID NO: 1059919 - DNA, 22 bp, Homo sapiens
tgttcgtttccatcatgtctgt

SEQ ID NO: 1059920 - DNA, 23 bp, Homo sapiens
tgttcgtttccatcatgtctgta

SEQ ID NO: 1059921 - DNA, 16 bp, Homo sapiens
tgttctaacctttaca

SEQ ID NO: 1059922 - DNA, 17 bp, Homo sapiens
tgttctaagtctttcca

SEQ ID NO: 1059923 - DNA, 15 bp, Homo sapiens
tgttctaatggatta

SEQ ID NO: 1059924 - DNA, 23 bp, Homo sapiens
tgttctaggtcagtctaacagtt

SEQ ID NO: 1059925 - DNA, 16 bp, Homo sapiens
tgttctagttttcagt

SEQ ID NO: 1059926 - DNA, 14 bp, Homo sapiens
tgttctatacgagt

SEQ ID NO: 1059927 - DNA, 24 bp, Homo sapiens
tgttctatttaacaactgggtcat

SEQ ID NO: 1059928 - DNA, 22 bp, Homo sapiens
tgttctcacactggtctgctgt

SEQ ID NO: 1059929 - DNA, 23 bp, Homo sapiens
tgttctcacactggtctgctgtc

SEQ ID NO: 1059930 - DNA, 15 bp, Homo sapiens
tgttctcatgaacta

SEQ ID NO: 1059931 - DNA, 16 bp, Homo sapiens
tgttctcatttgatca

SEQ ID NO: 1059932 - DNA, 17 bp, Homo sapiens
tgttctccctttctctc

SEQ ID NO: 1059933 - DNA, 22 bp, Homo sapiens
tgttctccctttctctctcctc

SEQ ID NO: 1059934 - DNA, 21 bp, Homo sapiens
tgttctccgggtgtggcctca

SEQ ID NO: 1059935 - DNA, 22 bp, Homo sapiens
tgttctccgggtgtggcctcag

SEQ ID NO: 1059936 - DNA, 17 bp, Homo sapiens
tgttctcgaactcctga

SEQ ID NO: 1059937 - DNA, 22 bp, Homo sapiens
tgttctcgaactcctgacctca

SEQ ID NO: 1059938 - DNA, 12 bp, Homo sapiens
tgttctctgctg

SEQ ID NO: 1059939 - DNA, 14 bp, Homo sapiens
tgttctctgctgag

SEQ ID NO: 1059940 - DNA, 15 bp, Homo sapiens
tgttctctgctgagg

SEQ ID NO: 1059941 - DNA, 22 bp, Homo sapiens
tgttctctgcttgacagactca

SEQ ID NO: 1059942 - DNA, 16 bp, Homo sapiens
tgttctctttaaaata

SEQ ID NO: 1059943 - DNA, 15 bp, Homo sapiens
tgttctgaaacctta

SEQ ID NO: 1059944 - DNA, 15 bp, Homo sapiens
tgttctgacattaac

SEQ ID NO: 1059945 - DNA, 12 bp, Homo sapiens
tgttctgagtaa

SEQ ID NO: 1059946 - DNA, 19 bp, Homo sapiens
tgttctgattagaaatgac

SEQ ID NO: 1059947 - DNA, 23 bp, Homo sapiens
tgttctgcaaaaatatttataaa

SEQ ID NO: 1059948 - DNA, 12 bp, Homo sapiens
tgttctgcaaag

SEQ ID NO: 1059949 - DNA, 22 bp, Homo sapiens
tgttctgcaagaattaaaactg

SEQ ID NO: 1059950 - DNA, 17 bp, Homo sapiens
tgttctgcacacagcac

SEQ ID NO: 1059951 - DNA, 15 bp, Homo sapiens
tgttctgcctctccc

SEQ ID NO: 1059952 - DNA, 12 bp, Homo sapiens
tgttctgctcct

SEQ ID NO: 1059953 - DNA, 13 bp, Homo sapiens
tgttctgctcctg

SEQ ID NO: 1059954 - DNA, 20 bp, Homo sapiens
tgttctgctcctgcttttct

SEQ ID NO: 1059955 - DNA, 15 bp, Homo sapiens
tgttggtccactgtg

SEQ ID NO: 1059956 - DNA, 14 bp, Homo sapiens
tgttggtgcacagc

SEQ ID NO: 1059957 - DNA, 22 bp, Homo sapiens
tgttggttagccgactgtcttg

SEQ ID NO: 1059958 - DNA, 23 bp, Homo sapiens
tgttttttgccacagcttttgca

SEQ ID NO: 1059959 - DNA, 14 bp, Homo sapiens
tgttttttggtctt

SEQ ID NO: 1059960 - DNA, 12 bp, Homo sapiens
tgtttttttcct

SEQ ID NO: 1059961 - DNA, 20 bp, Homo sapiens
tgtttttttcctcatgtaac

SEQ ID NO: 1059962 - DNA, 17 bp, Homo sapiens
tgtttttttctaaaaag

SEQ ID NO: 1059963 - DNA, 18 bp, Homo sapiens
tgtttttttgttattaaa

SEQ ID NO: 1059964 - DNA, 15 bp, Homo sapiens
tgtttttttgtttgt

SEQ ID NO: 1059965 - DNA, 15 bp, Homo sapiens
ttaaaatgtgatttt

SEQ ID NO: 1059966 - DNA, 22 bp, Homo sapiens
ttaaaatgtgatttttcttcag

SEQ ID NO: 1059967 - DNA, 20 bp, Homo sapiens
ttaaaattcaagaaaataaa

SEQ ID NO: 1059968 - DNA, 14 bp, Homo sapiens
ttaaaattcagttt

SEQ ID NO: 1059969 - DNA, 15 bp, Homo sapiens
ttaaaattcagtttt

SEQ ID NO: 1059970 - DNA, 21 bp, Homo sapiens
ttaaaattcagtttttgtatc

SEQ ID NO: 1059971 - DNA, 23 bp, Homo sapiens
ttaaaattcagtttttgtatctt

SEQ ID NO: 1059972 - DNA, 14 bp, Homo sapiens
ttaaaattctgaat

SEQ ID NO: 1059973 - DNA, 15 bp, Homo sapiens
ttaaaattgctatgt

SEQ ID NO: 1059974 - DNA, 22 bp, Homo sapiens
ttaaaatttggtgcttataaga

SEQ ID NO: 1059975 - DNA, 15 bp, Homo sapiens
ttaaaatttgtctta

SEQ ID NO: 1059976 - DNA, 12 bp, Homo sapiens
ttaaaatttgtt

SEQ ID NO: 1059977 - DNA, 19 bp, Homo sapiens
ttaaaattttaatttctac

SEQ ID NO: 1059978 - DNA, 22 bp, Homo sapiens
ttaaaatttttcttaagacaga

SEQ ID NO: 1059979 - DNA, 20 bp, Homo sapiens
ttaaacaaaatagaagctgt

SEQ ID NO: 1059980 - DNA, 14 bp, Homo sapiens
ttaaacaaaatgaa

SEQ ID NO: 1059981 - DNA, 15 bp, Homo sapiens
ttaaacaaaatttca

SEQ ID NO: 1059982 - DNA, 17 bp, Homo sapiens
ttaaacaaaatttcaca

SEQ ID NO: 1059983 - DNA, 14 bp, Homo sapiens
ttaaacaaagtgac

SEQ ID NO: 1059984 - DNA, 17 bp, Homo sapiens
ttaaacaaagtttcaga

SEQ ID NO: 1059985 - DNA, 12 bp, Homo sapiens
ttaaacaaataa

SEQ ID NO: 1059986 - DNA, 19 bp, Homo sapiens
ttaaacaatgtataaagat

SEQ ID NO: 1059987 - DNA, 20 bp, Homo sapiens
ttaaacaatgtataaagatt

SEQ ID NO: 1059988 - DNA, 18 bp, Homo sapiens
ttaaacaatttattttat

SEQ ID NO: 1059989 - DNA, 16 bp, Homo sapiens
ttaaacacgtgtctat

SEQ ID NO: 1059990 - DNA, 16 bp, Homo sapiens
ttaaacactgtaatct

SEQ ID NO: 1059991 - DNA, 22 bp, Homo sapiens
ttaaacagaagcagcaaatgaa

SEQ ID NO: 1059992 - DNA, 13 bp, Homo sapiens
ttaaacagaggat

SEQ ID NO: 1059993 - DNA, 12 bp, Homo sapiens
ttaaacagcagt

SEQ ID NO: 1059994 - DNA, 18 bp, Homo sapiens
ttaaacagggtctcactc

SEQ ID NO: 1059995 - DNA, 23 bp, Homo sapiens
ttaaacagggtctcactctgttg

SEQ ID NO: 1059996 - DNA, 23 bp, Homo sapiens
ttaaacagtagttgtattcttct

SEQ ID NO: 1059997 - DNA, 19 bp, Homo sapiens
ttaaacagtatttcattgc

SEQ ID NO: 1059998 - DNA, 22 bp, Homo sapiens
ttaaacatatccaagtttgaat

SEQ ID NO: 1059999 - DNA, 13 bp, Homo sapiens
ttaaacattgaag

SEQ ID NO: 1060000 - DNA, 20 bp, Homo sapiens
ttaaacccacaagctgcctc

SEQ ID NO: 1060001 - DNA, 23 bp, Homo sapiens
ttaaacccacaagctgcctctga

SEQ ID NO: 1060002 - DNA, 18 bp, Homo sapiens
ttaaacctgaagatgtct

SEQ ID NO: 1060003 - DNA, 23 bp, Homo sapiens
ttaaacctggaatctacaagcca

SEQ ID NO: 1060004 - DNA, 13 bp, Homo sapiens
ttaaaccttttat

SEQ ID NO: 1060005 - DNA, 14 bp, Homo sapiens
ttaaaccttttttg

SEQ ID NO: 1060006 - DNA, 22 bp, Homo sapiens
ttaaacggtgcccatcctgcca

SEQ ID NO: 1060007 - DNA, 16 bp, Homo sapiens
ttaaacgtatgcatgt

SEQ ID NO: 1060008 - DNA, 13 bp, Homo sapiens
ttaaacgtgtaaa

SEQ ID NO: 1060009 - DNA, 12 bp, Homo sapiens
ttaaactaaata

SEQ ID NO: 1060010 - DNA, 19 bp, Homo sapiens
ttaaactaatgaacaaata

SEQ ID NO: 1060011 - DNA, 16 bp, Homo sapiens
ttaaactagtttaagg

SEQ ID NO: 1060012 - DNA, 16 bp, Homo sapiens
ttaaactatcttgtgt

SEQ ID NO: 1060013 - DNA, 16 bp, Homo sapiens
ttaaactatgttccta

SEQ ID NO: 1060014 - DNA, 16 bp, Homo sapiens
ttaaactcagggacag

SEQ ID NO: 1060015 - DNA, 20 bp, Homo sapiens
ttaaactcagggacagagcc

SEQ ID NO: 1060016 - DNA, 16 bp, Homo sapiens
ttaaactctgccagaa

SEQ ID NO: 1060017 - DNA, 18 bp, Homo sapiens
ttaaactctgccagaaaa

SEQ ID NO: 1060018 - DNA, 19 bp, Homo sapiens
ttaaactctgccagaaaaa

SEQ ID NO: 1060019 - DNA, 16 bp, Homo sapiens
ttaaactctggacact

SEQ ID NO: 1060020 - DNA, 20 bp, Homo sapiens
ttaaactctggacactctat

SEQ ID NO: 1060021 - DNA, 18 bp, Homo sapiens
ttaaactgtacagtgtct

SEQ ID NO: 1060022 - DNA, 18 bp, Homo sapiens
ttaaactgttagcactgt

SEQ ID NO: 1060023 - DNA, 21 bp, Homo sapiens
ttaaactgttagcactgttga

SEQ ID NO: 1060024 - DNA, 16 bp, Homo sapiens
ttaaacttaatctaaa

SEQ ID NO: 1060025 - DNA, 11 bp, Homo sapiens
ttaaacttcca

SEQ ID NO: 1060026 - DNA, 17 bp, Homo sapiens
ttaaacttccaaagaaa

SEQ ID NO: 1060027 - DNA, 18 bp, Homo sapiens
ttaaacttccaaagaaag

SEQ ID NO: 1060028 - DNA, 20 bp, Homo sapiens
ttaaacttgaaatatataat

SEQ ID NO: 1060029 - DNA, 22 bp, Homo sapiens
ttaaacttgaaatatataatat

SEQ ID NO: 1060030 - DNA, 14 bp, Homo sapiens
ttaaactttttaaa

SEQ ID NO: 1060031 - DNA, 17 bp, Homo sapiens
ttaaactttttaaaata

SEQ ID NO: 1060032 - DNA, 22 bp, Homo sapiens
ttaaagaaaaaaattgaaatgt

SEQ ID NO: 1060033 - DNA, 17 bp, Homo sapiens
ttaaagaaaagatgaaa

SEQ ID NO: 1060034 - DNA, 16 bp, Homo sapiens
ttaaagaaaattgcat

SEQ ID NO: 1060035 - DNA, 16 bp, Homo sapiens
ttaaagaagagtgact

SEQ ID NO: 1060036 - DNA, 21 bp, Homo sapiens
ttaaagaataaagtccaaagt

SEQ ID NO: 1060037 - DNA, 21 bp, Homo sapiens
ttaaagacaaagacaaattct

SEQ ID NO: 1060038 - DNA, 10 bp, Homo sapiens
ttaaagacag

SEQ ID NO: 1060039 - DNA, 12 bp, Homo sapiens
ttaaagacagag

SEQ ID NO: 1060040 - DNA, 17 bp, Homo sapiens
ttaaagacccaacttgc

SEQ ID NO: 1060041 - DNA, 16 bp, Homo sapiens
ttaaagagatagcttc

SEQ ID NO: 1060042 - DNA, 22 bp, Homo sapiens
ttaaagagatttcccttcattt

SEQ ID NO: 1060043 - DNA, 16 bp, Homo sapiens
ttaaagagcatggaaa

SEQ ID NO: 1060044 - DNA, 18 bp, Homo sapiens
ttaaagatcatgacatat

SEQ ID NO: 1060045 - DNA, 11 bp, Homo sapiens
ttaaagatgcc

SEQ ID NO: 1060046 - DNA, 20 bp, Homo sapiens
ttaaagatgccatagcataa

SEQ ID NO: 1060047 - DNA, 23 bp, Homo sapiens
ttaaagatgccatagcataatat

SEQ ID NO: 1060048 - DNA, 13 bp, Homo sapiens
ttaaagatgttcc

SEQ ID NO: 1060049 - DNA, 11 bp, Homo sapiens
ttaaagcaaaa

SEQ ID NO: 1060050 - DNA, 20 bp, Homo sapiens
ttaaagcaggttcttgttgg

SEQ ID NO: 1060051 - DNA, 16 bp, Homo sapiens
ttaaagcatatgctat

SEQ ID NO: 1060052 - DNA, 16 bp, Homo sapiens
ttaaagccctgtgtta

SEQ ID NO: 1060053 - DNA, 11 bp, Homo sapiens
ttaaagcctgg

SEQ ID NO: 1060054 - DNA, 14 bp, Homo sapiens
ttaaagcctggctt

SEQ ID NO: 1060055 - DNA, 14 bp, Homo sapiens
ttaaagctaaactg

SEQ ID NO: 1060056 - DNA, 15 bp, Homo sapiens
ttaaagctaaactga

SEQ ID NO: 1060057 - DNA, 13 bp, Homo sapiens
ttaaagctaaatt

SEQ ID NO: 1060058 - DNA, 20 bp, Homo sapiens
ttaaagctcttcatttctgg

SEQ ID NO: 1060059 - DNA, 14 bp, Homo sapiens
ttaaagctgagaga

SEQ ID NO: 1060060 - DNA, 19 bp, Homo sapiens
ttaaagctgagagaccctg

SEQ ID NO: 1060061 - DNA, 17 bp, Homo sapiens
ttaaagctgcctgtagt

SEQ ID NO: 1060062 - DNA, 19 bp, Homo sapiens
ttaaagctggaacatttga

SEQ ID NO: 1060063 - DNA, 16 bp, Homo sapiens
ttaaagcttaaactga

SEQ ID NO: 1060064 - DNA, 17 bp, Homo sapiens
ttaaagcttatttttat

SEQ ID NO: 1060065 - DNA, 22 bp, Homo sapiens
ttaaagcttatttttatgtggt

SEQ ID NO: 1060066 - DNA, 20 bp, Homo sapiens
ttaaagcttgatttgatctt

SEQ ID NO: 1060067 - DNA, 15 bp, Homo sapiens
ttaaaggaaggaaaa

SEQ ID NO: 1060068 - DNA, 18 bp, Homo sapiens
ttaaaggcaccatctaat

SEQ ID NO: 1060069 - DNA, 15 bp, Homo sapiens
ttaaaggcagtccag

SEQ ID NO: 1060070 - DNA, 18 bp, Homo sapiens
ttaaaggcagtccagagc

SEQ ID NO: 1060071 - DNA, 20 bp, Homo sapiens
ttaaagggagatggtaagaa

SEQ ID NO: 1060072 - DNA, 21 bp, Homo sapiens
ttaaaggggcagaaaaactct

SEQ ID NO: 1060073 - DNA, 20 bp, Homo sapiens
ttaaagggtgcccatttgtg

SEQ ID NO: 1060074 - DNA, 20 bp, Homo sapiens
ttaaaggttggaatctttta

SEQ ID NO: 1060075 - DNA, 21 bp, Homo sapiens
ttaaaggtttttaaattgttt

SEQ ID NO: 1060076 - DNA, 16 bp, Homo sapiens
ttaaaggtttttgaaa

SEQ ID NO: 1060077 - DNA, 16 bp, Homo sapiens
ttacaagtataacagt

SEQ ID NO: 1060078 - DNA, 14 bp, Homo sapiens
ttacaagtggctcc

SEQ ID NO: 1060079 - DNA, 17 bp, Homo sapiens
ttacaagtggtgaccaa

SEQ ID NO: 1060080 - DNA, 16 bp, Homo sapiens
ttacaagtgtatatca

SEQ ID NO: 1060081 - DNA, 19 bp, Homo sapiens
ttacaagttatagtactag

SEQ ID NO: 1060082 - DNA, 16 bp, Homo sapiens
ttacaagtttgctaaa

SEQ ID NO: 1060083 - DNA, 22 bp, Homo sapiens
ttacaagtttgctaaaagaaga

SEQ ID NO: 1060084 - DNA, 21 bp, Homo sapiens
ttacaataaaactttgctgcc

SEQ ID NO: 1060085 - DNA, 14 bp, Homo sapiens
ttacaataaatatt

SEQ ID NO: 1060086 - DNA, 19 bp, Homo sapiens
ttacaataaatattctgca

SEQ ID NO: 1060087 - DNA, 22 bp, Homo sapiens
ttacaatgatgccgaacattag

SEQ ID NO: 1060088 - DNA, 19 bp, Homo sapiens
ttacaatgtatctttatta

SEQ ID NO: 1060089 - DNA, 13 bp, Homo sapiens
ttacaatgtatta

SEQ ID NO: 1060090 - DNA, 13 bp, Homo sapiens
ttacaattgaaat

SEQ ID NO: 1060091 - DNA, 17 bp, Homo sapiens
ttacaattgcactgctg

SEQ ID NO: 1060092 - DNA, 12 bp, Homo sapiens
ttacaatttaca

SEQ ID NO: 1060093 - DNA, 19 bp, Homo sapiens
ttacaatttacaaagtgtg

SEQ ID NO: 1060094 - DNA, 19 bp, Homo sapiens
ttacaatttatatgcttca

SEQ ID NO: 1060095 - DNA, 22 bp, Homo sapiens
ttacaatttgcacaatatttct

SEQ ID NO: 1060096 - DNA, 18 bp, Homo sapiens
ttacaattttatctgttt

SEQ ID NO: 1060097 - DNA, 15 bp, Homo sapiens
ttacacaagaatcta

SEQ ID NO: 1060098 - DNA, 17 bp, Homo sapiens
ttacacaattaattgtc

SEQ ID NO: 1060099 - DNA, 18 bp, Homo sapiens
ttacacactgtacacata

SEQ ID NO: 1060100 - DNA, 19 bp, Homo sapiens
ttacacagaaatgctgctg

SEQ ID NO: 1060101 - DNA, 23 bp, Homo sapiens
ttacacagagaaatacaaaataa

SEQ ID NO: 1060102 - DNA, 16 bp, Homo sapiens
ttacacattagatttt

SEQ ID NO: 1060103 - DNA, 23 bp, Homo sapiens
ttacacatttttcagatataaaa

SEQ ID NO: 1060104 - DNA, 21 bp, Homo sapiens
ttacaccaccggccccctccc

SEQ ID NO: 1060105 - DNA, 17 bp, Homo sapiens
ttacacgtatctcttgg

SEQ ID NO: 1060106 - DNA, 18 bp, Homo sapiens
ttacactaggaaacgtgt

SEQ ID NO: 1060107 - DNA, 13 bp, Homo sapiens
ttacactgggaga

SEQ ID NO: 1060108 - DNA, 13 bp, Homo sapiens
ttacactttatgc

SEQ ID NO: 1060109 - DNA, 16 bp, Homo sapiens
ttacactttttggaag

SEQ ID NO: 1060110 - DNA, 17 bp, Homo sapiens
ttacagaatgcattaaa

SEQ ID NO: 1060111 - DNA, 17 bp, Homo sapiens
ttacagagaatttctaa

SEQ ID NO: 1060112 - DNA, 18 bp, Homo sapiens
ttacagagaggagaaaca

SEQ ID NO: 1060113 - DNA, 22 bp, Homo sapiens
ttacagagaggatacatttaat

SEQ ID NO: 1060114 - DNA, 13 bp, Homo sapiens
ttaccttctaaaa

SEQ ID NO: 1060115 - DNA, 15 bp, Homo sapiens
ttaccttctgctgtt

SEQ ID NO: 1060116 - DNA, 19 bp, Homo sapiens
ttacctttatctttcacct

SEQ ID NO: 1060117 - DNA, 22 bp, Homo sapiens
ttaccttttcctattctgttgc

SEQ ID NO: 1060118 - DNA, 15 bp, Homo sapiens
ttaccttttctataa

SEQ ID NO: 1060119 - DNA, 15 bp, Homo sapiens
ttacctttttatttg

SEQ ID NO: 1060120 - DNA, 18 bp, Homo sapiens
ttacctttttatttgcat

SEQ ID NO: 1060121 - DNA, 20 bp, Homo sapiens
ttacctttttatttgcatgt

SEQ ID NO: 1060122 - DNA, 18 bp, Homo sapiens
ttacgatttcactaggac

SEQ ID NO: 1060123 - DNA, 15 bp, Homo sapiens
ttacgcaaggaagga

SEQ ID NO: 1060124 - DNA, 18 bp, Homo sapiens
ttacgcccaacccttccc

SEQ ID NO: 1060125 - DNA, 21 bp, Homo sapiens
ttacgtactgtaactgctcag

SEQ ID NO: 1060126 - DNA, 23 bp, Homo sapiens
ttacgtactgtaactgctcagag

SEQ ID NO: 1060127 - DNA, 21 bp, Homo sapiens
ttacgtgaagaaataaatgaa

SEQ ID NO: 1060128 - DNA, 22 bp, Homo sapiens
ttacgtgaagaaataaatgaaa

SEQ ID NO: 1060129 - DNA, 13 bp, Homo sapiens
ttacgtgcaaaca

SEQ ID NO: 1060130 - DNA, 17 bp, Homo sapiens
ttacgtgcaaacaacct

SEQ ID NO: 1060131 - DNA, 19 bp, Homo sapiens
ttacgtgcatttaaactct

SEQ ID NO: 1060132 - DNA, 22 bp, Homo sapiens
ttacgtgcatttaaactctgcc

SEQ ID NO: 1060133 - DNA, 15 bp, Homo sapiens
ttacgtgctctgtgg

SEQ ID NO: 1060134 - DNA, 16 bp, Homo sapiens
ttacgtgtatgtttct

SEQ ID NO: 1060135 - DNA, 17 bp, Homo sapiens
ttacgtgtatgtttctt

SEQ ID NO: 1060136 - DNA, 15 bp, Homo sapiens
ttacgttctttcact

SEQ ID NO: 1060137 - DNA, 13 bp, Homo sapiens
ttacgtttgtcct

SEQ ID NO: 1060138 - DNA, 17 bp, Homo sapiens
ttactaaaaagtataaa

SEQ ID NO: 1060139 - DNA, 11 bp, Homo sapiens
ttactaaagaa

SEQ ID NO: 1060140 - DNA, 22 bp, Homo sapiens
ttactaaagatatcagagctct

SEQ ID NO: 1060141 - DNA, 19 bp, Homo sapiens
ttactaaattgtatacatt

SEQ ID NO: 1060142 - DNA, 18 bp, Homo sapiens
ttactaactaaataccat

SEQ ID NO: 1060143 - DNA, 20 bp, Homo sapiens
ttactaagatgaaattgcca

SEQ ID NO: 1060144 - DNA, 21 bp, Homo sapiens
ttactaagcatagcaaacaga

SEQ ID NO: 1060145 - DNA, 21 bp, Homo sapiens
ttactaagccacaagaaattt

SEQ ID NO: 1060146 - DNA, 14 bp, Homo sapiens
ttactaagctttgc

SEQ ID NO: 1060147 - DNA, 20 bp, Homo sapiens
ttactaaggaagattactca

SEQ ID NO: 1060148 - DNA, 18 bp, Homo sapiens
ttactaagttttcaaatt

SEQ ID NO: 1060149 - DNA, 16 bp, Homo sapiens
ttactaatagacaatt

SEQ ID NO: 1060150 - DNA, 14 bp, Homo sapiens
ttactacaaaattt

SEQ ID NO: 1060151 - DNA, 15 bp, Homo sapiens
ttactacagttgttt

SEQ ID NO: 1060152 - DNA, 22 bp, Homo sapiens
ttactactgattttaaaatgaa

SEQ ID NO: 1060153 - DNA, 19 bp, Homo sapiens
ttactaggtaacttcatat

SEQ ID NO: 1060154 - DNA, 19 bp, Homo sapiens
ttactatagtggtgagatg

SEQ ID NO: 1060155 - DNA, 17 bp, Homo sapiens
ttactatctgttgaaaa

SEQ ID NO: 1060156 - DNA, 18 bp, Homo sapiens
ttactatctgttgaaaag

SEQ ID NO: 1060157 - DNA, 20 bp, Homo sapiens
ttactatctgttgaaaaggt

SEQ ID NO: 1060158 - DNA, 19 bp, Homo sapiens
ttactatggccctggccta

SEQ ID NO: 1060159 - DNA, 22 bp, Homo sapiens
ttactatgtgccagttcctgta

SEQ ID NO: 1060160 - DNA, 23 bp, Homo sapiens
ttactattaagcagtaaaaactg

SEQ ID NO: 1060161 - DNA, 15 bp, Homo sapiens
ttactattcttggtt

SEQ ID NO: 1060162 - DNA, 15 bp, Homo sapiens
ttactatttcttgtg

SEQ ID NO: 1060163 - DNA, 23 bp, Homo sapiens
ttactcagaattctctagtttga

SEQ ID NO: 1060164 - DNA, 14 bp, Homo sapiens
ttactcagccctgg

SEQ ID NO: 1060165 - DNA, 13 bp, Homo sapiens
ttactcagggctc

SEQ ID NO: 1060166 - DNA, 20 bp, Homo sapiens
ttactcagggctcctcccag

SEQ ID NO: 1060167 - DNA, 14 bp, Homo sapiens
ttactcaggggatg

SEQ ID NO: 1060168 - DNA, 21 bp, Homo sapiens
ttactcaggggatgtttacct

SEQ ID NO: 1060169 - DNA, 12 bp, Homo sapiens
ttactcaggttt

SEQ ID NO: 1060170 - DNA, 16 bp, Homo sapiens
ttactcagtaatttgt

SEQ ID NO: 1060171 - DNA, 21 bp, Homo sapiens
ttactcatttttttaatttat

SEQ ID NO: 1060172 - DNA, 18 bp, Homo sapiens
ttactccaaggtttataa

SEQ ID NO: 1060173 - DNA, 22 bp, Homo sapiens
ttactccaaggtttataaagca

SEQ ID NO: 1060174 - DNA, 22 bp, Homo sapiens
ttactccaggttattgcaataa

SEQ ID NO: 1060175 - DNA, 16 bp, Homo sapiens
ttactcccccaccact

SEQ ID NO: 1060176 - DNA, 22 bp, Homo sapiens
ttactcccctaagtctttactc

SEQ ID NO: 1060177 - DNA, 14 bp, Homo sapiens
ttactcccttcctg

SEQ ID NO: 1060178 - DNA, 17 bp, Homo sapiens
ttactcccttctgtagt

SEQ ID NO: 1060179 - DNA, 17 bp, Homo sapiens
ttactcctcctctttct

SEQ ID NO: 1060180 - DNA, 19 bp, Homo sapiens
ttactcctctgaccctcct

SEQ ID NO: 1060181 - DNA, 16 bp, Homo sapiens
ttactctgagcccagg

SEQ ID NO: 1060182 - DNA, 20 bp, Homo sapiens
ttactctgagcccaggccgt

SEQ ID NO: 1060183 - DNA, 22 bp, Homo sapiens
ttactctggtggattgttctag

SEQ ID NO: 1060184 - DNA, 13 bp, Homo sapiens
ttactctgtgtaa

SEQ ID NO: 1060185 - DNA, 18 bp, Homo sapiens
ttactctgtgtaaagact

SEQ ID NO: 1060186 - DNA, 16 bp, Homo sapiens
ttactcttatgatcaa

SEQ ID NO: 1060187 - DNA, 23 bp, Homo sapiens
ttactgaacaatcaaagcacttg

SEQ ID NO: 1060188 - DNA, 22 bp, Homo sapiens
ttactgacacttcctgtccttg

SEQ ID NO: 1060189 - DNA, 12 bp, Homo sapiens
ttactgaccagc

SEQ ID NO: 1060190 - DNA, 14 bp, Homo sapiens
ttactgagcttctc

SEQ ID NO: 1060191 - DNA, 18 bp, Homo sapiens
ttactgaggggattctct

SEQ ID NO: 1060192 - DNA, 14 bp, Homo sapiens
ttactgataatttt

SEQ ID NO: 1060193 - DNA, 21 bp, Homo sapiens
ttactgatactacaacttttg

SEQ ID NO: 1060194 - DNA, 14 bp, Homo sapiens
ttactgatatattt

SEQ ID NO: 1060195 - DNA, 18 bp, Homo sapiens
ttactgatcatgcattgt

SEQ ID NO: 1060196 - DNA, 19 bp, Homo sapiens
ttactgatcatgcattgtt

SEQ ID NO: 1060197 - DNA, 18 bp, Homo sapiens
ttactgatttagaagcaa

SEQ ID NO: 1060198 - DNA, 21 bp, Homo sapiens
ttactgccaaagggaaatatc

SEQ ID NO: 1060199 - DNA, 22 bp, Homo sapiens
ttactgcctataatcttataca

SEQ ID NO: 1060200 - DNA, 18 bp, Homo sapiens
ttactgccttcctcctta

SEQ ID NO: 1060201 - DNA, 13 bp, Homo sapiens
ttactgcgtagaa

SEQ ID NO: 1060202 - DNA, 22 bp, Homo sapiens
ttactgctaagtatttcccagc

SEQ ID NO: 1060203 - DNA, 23 bp, Homo sapiens
ttactgctaagtatttcccagca

SEQ ID NO: 1060204 - DNA, 14 bp, Homo sapiens
ttactgctctgaga

SEQ ID NO: 1060205 - DNA, 20 bp, Homo sapiens
ttactgctgattcttgtaaa

SEQ ID NO: 1060206 - DNA, 17 bp, Homo sapiens
ttactgctttaatcaga

SEQ ID NO: 1060207 - DNA, 14 bp, Homo sapiens
ttactgcttttcat

SEQ ID NO: 1060208 - DNA, 14 bp, Homo sapiens
ttactggtccaaaa

SEQ ID NO: 1060209 - DNA, 18 bp, Homo sapiens
ttactggtccaaaagatt

SEQ ID NO: 1060210 - DNA, 14 bp, Homo sapiens
ttactggttgcatg

SEQ ID NO: 1060211 - DNA, 18 bp, Homo sapiens
ttactggttgcatggaaa

SEQ ID NO: 1060212 - DNA, 19 bp, Homo sapiens
ttactggttgcatggaaat

SEQ ID NO: 1060213 - DNA, 15 bp, Homo sapiens
ttactggtttcccca

SEQ ID NO: 1060214 - DNA, 12 bp, Homo sapiens
ttactgtaatat

SEQ ID NO: 1060215 - DNA, 20 bp, Homo sapiens
ttactgtaatataaagtatt

SEQ ID NO: 1060216 - DNA, 12 bp, Homo sapiens
ttactgtacatg

SEQ ID NO: 1060217 - DNA, 13 bp, Homo sapiens
ttactgtacatga

SEQ ID NO: 1060218 - DNA, 21 bp, Homo sapiens
ttactgtagcctcagatgatt

SEQ ID NO: 1060219 - DNA, 21 bp, Homo sapiens
ttactgtatatgtattccctt

SEQ ID NO: 1060220 - DNA, 14 bp, Homo sapiens
ttactgtcaataaa

SEQ ID NO: 1060221 - DNA, 22 bp, Homo sapiens
ttactgtccaccagtttataca

SEQ ID NO: 1060222 - DNA, 19 bp, Homo sapiens
ttactgtccccttgatata

SEQ ID NO: 1060223 - DNA, 20 bp, Homo sapiens
ttactgtcctgttgattaat

SEQ ID NO: 1060224 - DNA, 22 bp, Homo sapiens
ttactgtctggttttaacaatt

SEQ ID NO: 1060225 - DNA, 13 bp, Homo sapiens
ttactgtgtaatt

SEQ ID NO: 1060226 - DNA, 16 bp, Homo sapiens
ttactgtgtaattagt

SEQ ID NO: 1060227 - DNA, 20 bp, Homo sapiens
ttactgtgtaattagtgcca

SEQ ID NO: 1060228 - DNA, 15 bp, Homo sapiens
ttactgttgcattta

SEQ ID NO: 1060229 - DNA, 19 bp, Homo sapiens
ttactgttgcatttacttt

SEQ ID NO: 1060230 - DNA, 20 bp, Homo sapiens
ttactgttttaattgtagtt

SEQ ID NO: 1060231 - DNA, 14 bp, Homo sapiens
ttactgttttatgt

SEQ ID NO: 1060232 - DNA, 23 bp, Homo sapiens
ttactgttttgaaatcaatgcaa

SEQ ID NO: 1060233 - DNA, 22 bp, Homo sapiens
ttacttaagacttaatgagact

SEQ ID NO: 1060234 - DNA, 19 bp, Homo sapiens
ttacttaattgccagcaaa

SEQ ID NO: 1060235 - DNA, 13 bp, Homo sapiens
ttacttacctaaa

SEQ ID NO: 1060236 - DNA, 23 bp, Homo sapiens
ttacttagaatgccataaaattg

SEQ ID NO: 1060237 - DNA, 18 bp, Homo sapiens
ttacttaggtgtggggga

SEQ ID NO: 1060238 - DNA, 20 bp, Homo sapiens
ttacttaggttattttgctt

SEQ ID NO: 1060239 - DNA, 13 bp, Homo sapiens
ttacttcagtata

SEQ ID NO: 1060240 - DNA, 19 bp, Homo sapiens
ttacttccagcaagcaaag

SEQ ID NO: 1060241 - DNA, 15 bp, Homo sapiens
ttacttccatgaatt

SEQ ID NO: 1060242 - DNA, 15 bp, Homo sapiens
ttacttcctatcaag

SEQ ID NO: 1060243 - DNA, 14 bp, Homo sapiens
ttacttcctggcct

SEQ ID NO: 1060244 - DNA, 24 bp, Homo sapiens
ttacttctctataaaaaatatgta

SEQ ID NO: 1060245 - DNA, 13 bp, Homo sapiens
ttacttcttctct

SEQ ID NO: 1060246 - DNA, 14 bp, Homo sapiens
ttacttgacctcct

SEQ ID NO: 1060247 - DNA, 19 bp, Homo sapiens
ttacttgcactgttactct

SEQ ID NO: 1060248 - DNA, 21 bp, Homo sapiens
ttacttgcactgttactctta

SEQ ID NO: 1060249 - DNA, 15 bp, Homo sapiens
ttacttgcttcagtg

SEQ ID NO: 1060250 - DNA, 16 bp, Homo sapiens
ttacttgctttcaatt

SEQ ID NO: 1060251 - DNA, 22 bp, Homo sapiens
ttacttgctttcaattgacaaa

SEQ ID NO: 1060252 - DNA, 14 bp, Homo sapiens
ttacttgggaaatt

SEQ ID NO: 1060253 - DNA, 20 bp, Homo sapiens
ttacttgggaaatttttaat

SEQ ID NO: 1060254 - DNA, 16 bp, Homo sapiens
ttacttgtctgaggcc

SEQ ID NO: 1060255 - DNA, 13 bp, Homo sapiens
ttacttgtggtgt

SEQ ID NO: 1060256 - DNA, 19 bp, Homo sapiens
ttacttgtgttacttgcca

SEQ ID NO: 1060257 - DNA, 18 bp, Homo sapiens
ttactttaaaataaaaaa

SEQ ID NO: 1060258 - DNA, 11 bp, Homo sapiens
ttactttccct

SEQ ID NO: 1060259 - DNA, 18 bp, Homo sapiens
ttactttctgttgccaca

SEQ ID NO: 1060260 - DNA, 14 bp, Homo sapiens
ttactttgccaact

SEQ ID NO: 1060261 - DNA, 20 bp, Homo sapiens
ttactttgcttgagaatcct

SEQ ID NO: 1060262 - DNA, 18 bp, Homo sapiens
ttactttggtttagtctt

SEQ ID NO: 1060263 - DNA, 16 bp, Homo sapiens
ttacttttaaactgtg

SEQ ID NO: 1060264 - DNA, 15 bp, Homo sapiens
ttacttttgtaaata

SEQ ID NO: 1060265 - DNA, 15 bp, Homo sapiens
ttactttttgctgtt

SEQ ID NO: 1060266 - DNA, 14 bp, Homo sapiens
ttactttttgtaga

SEQ ID NO: 1060267 - DNA, 17 bp, Homo sapiens
ttacttttttacactga

SEQ ID NO: 1060268 - DNA, 16 bp, Homo sapiens
ttacttttttatagct

SEQ ID NO: 1060269 - DNA, 21 bp, Homo sapiens
ttactttttttgtagatgaac

SEQ ID NO: 1060270 - DNA, 23 bp, Homo sapiens
ttagaaaaaaaactgaagatgaa

SEQ ID NO: 1060271 - DNA, 13 bp, Homo sapiens
ttagaaaaaaact

SEQ ID NO: 1060272 - DNA, 21 bp, Homo sapiens
ttagaaaacataatcttctgc

SEQ ID NO: 1060273 - DNA, 13 bp, Homo sapiens
ttagaaaagtgaa

SEQ ID NO: 1060274 - DNA, 19 bp, Homo sapiens
ttagaaaatgacttatttc

SEQ ID NO: 1060275 - DNA, 21 bp, Homo sapiens
ttagaaaatgacttatttctg

SEQ ID NO: 1060276 - DNA, 22 bp, Homo sapiens
ttagaaaatgacttatttctgc

SEQ ID NO: 1060277 - DNA, 15 bp, Homo sapiens
ttagaaacagaaata

SEQ ID NO: 1060278 - DNA, 18 bp, Homo sapiens
ttagaaaccttaatatgt

SEQ ID NO: 1060279 - DNA, 10 bp, Homo sapiens
ttagaaactg

SEQ ID NO: 1060280 - DNA, 16 bp, Homo sapiens
ttagaaactgatttct

SEQ ID NO: 1060281 - DNA, 22 bp, Homo sapiens
ttagaaagaagcccaatattat

SEQ ID NO: 1060282 - DNA, 20 bp, Homo sapiens
ttagaaaggacaacagttct

SEQ ID NO: 1060283 - DNA, 22 bp, Homo sapiens
ttagaaaggacaacagttctga

SEQ ID NO: 1060284 - DNA, 11 bp, Homo sapiens
ttagaaatatt

SEQ ID NO: 1060285 - DNA, 13 bp, Homo sapiens
ttagaaatattca

SEQ ID NO: 1060286 - DNA, 13 bp, Homo sapiens
ttagaaatcattt

SEQ ID NO: 1060287 - DNA, 19 bp, Homo sapiens
ttagaaattacctgtggat

SEQ ID NO: 1060288 - DNA, 14 bp, Homo sapiens
ttagaaattagaaa

SEQ ID NO: 1060289 - DNA, 22 bp, Homo sapiens
ttagaaatttggtttcaagtgt

SEQ ID NO: 1060290 - DNA, 20 bp, Homo sapiens
ttagaacactggtttaaagg

SEQ ID NO: 1060291 - DNA, 14 bp, Homo sapiens
ttagaacattcact

SEQ ID NO: 1060292 - DNA, 16 bp, Homo sapiens
ttagaacattcacttt

SEQ ID NO: 1060293 - DNA, 20 bp, Homo sapiens
ttagaaccagccgtatttta

SEQ ID NO: 1060294 - DNA, 13 bp, Homo sapiens
ttagaagagagcc

SEQ ID NO: 1060295 - DNA, 18 bp, Homo sapiens
ttagaagatagatgcact

SEQ ID NO: 1060296 - DNA, 13 bp, Homo sapiens
ttagaagcctgca

SEQ ID NO: 1060297 - DNA, 17 bp, Homo sapiens
ttagaagtagtatgtta

SEQ ID NO: 1060298 - DNA, 19 bp, Homo sapiens
ttagaataagaatttgcat

SEQ ID NO: 1060299 - DNA, 15 bp, Homo sapiens
ttagaataatattgt

SEQ ID NO: 1060300 - DNA, 17 bp, Homo sapiens
ttagaatagtgtcagtt

SEQ ID NO: 1060301 - DNA, 17 bp, Homo sapiens
ttagaatcttgttttgt

SEQ ID NO: 1060302 - DNA, 20 bp, Homo sapiens
ttagaatgaatttatcttta

SEQ ID NO: 1060303 - DNA, 22 bp, Homo sapiens
ttagaatgaatttatctttacc

SEQ ID NO: 1060304 - DNA, 12 bp, Homo sapiens
ttagaatgccat

SEQ ID NO: 1060305 - DNA, 12 bp, Homo sapiens
ttagaatgtgat

SEQ ID NO: 1060306 - DNA, 13 bp, Homo sapiens
ttagaattaaaaa

SEQ ID NO: 1060307 - DNA, 17 bp, Homo sapiens
ttagaattaccatttgt

SEQ ID NO: 1060308 - DNA, 21 bp, Homo sapiens
ttagaattgtgtgttaatgtc

SEQ ID NO: 1060309 - DNA, 19 bp, Homo sapiens
ttagacaccacctggagtg

SEQ ID NO: 1060310 - DNA, 13 bp, Homo sapiens
ttagacactttgg

SEQ ID NO: 1060311 - DNA, 19 bp, Homo sapiens
ttagaccagaggtctagat

SEQ ID NO: 1060312 - DNA, 13 bp, Homo sapiens
ttagacctcagcc

SEQ ID NO: 1060313 - DNA, 14 bp, Homo sapiens
ttagacctcagcct

SEQ ID NO: 1060314 - DNA, 16 bp, Homo sapiens
ttagacctcagcctgt

SEQ ID NO: 1060315 - DNA, 16 bp, Homo sapiens
ttagacctgtgttact

SEQ ID NO: 1060316 - DNA, 18 bp, Homo sapiens
ttagacgaagaagctggc

SEQ ID NO: 1060317 - DNA, 21 bp, Homo sapiens
ttagactcatggtgtgttaca

SEQ ID NO: 1060318 - DNA, 22 bp, Homo sapiens
ttagactcatggtgtgttacac

SEQ ID NO: 1060319 - DNA, 22 bp, Homo sapiens
ttagactggaacttgaactgat

SEQ ID NO: 1060320 - DNA, 18 bp, Homo sapiens
ttagactgtgattcagaa

SEQ ID NO: 1060321 - DNA, 22 bp, Homo sapiens
ttagactgtggccatatatgct

SEQ ID NO: 1060322 - DNA, 20 bp, Homo sapiens
ttagagaaaataaatttaac

SEQ ID NO: 1060323 - DNA, 12 bp, Homo sapiens
ttagagaataaa

SEQ ID NO: 1060324 - DNA, 16 bp, Homo sapiens
ttagagaatgagaaat

SEQ ID NO: 1060325 - DNA, 21 bp, Homo sapiens
ttagagagcatctgcaacaaa

SEQ ID NO: 1060326 - DNA, 19 bp, Homo sapiens
ttagagagggaccatgtgt

SEQ ID NO: 1060327 - DNA, 13 bp, Homo sapiens
ttagagcagcctc

SEQ ID NO: 1060328 - DNA, 17 bp, Homo sapiens
ttagagcagcctcgtgg

SEQ ID NO: 1060329 - DNA, 15 bp, Homo sapiens
ttagagccaagctgc

SEQ ID NO: 1060330 - DNA, 18 bp, Homo sapiens
ttagagccaagctgcaca

SEQ ID NO: 1060331 - DNA, 17 bp, Homo sapiens
ttagagccaagtgtctt

SEQ ID NO: 1060332 - DNA, 21 bp, Homo sapiens
ttagagccaagtgtcttttaa

SEQ ID NO: 1060333 - DNA, 20 bp, Homo sapiens
ttagagccattagagcacag

SEQ ID NO: 1060334 - DNA, 14 bp, Homo sapiens
ttagagccttttat

SEQ ID NO: 1060335 - DNA, 15 bp, Homo sapiens
ttagagcttccaaat

SEQ ID NO: 1060336 - DNA, 17 bp, Homo sapiens
ttagaggaaaaaaatga

SEQ ID NO: 1060337 - DNA, 16 bp, Homo sapiens
ttagaggaaaatgagt

SEQ ID NO: 1060338 - DNA, 22 bp, Homo sapiens
ttagaggaaataagaaaaatca

SEQ ID NO: 1060339 - DNA, 15 bp, Homo sapiens
ttagaggcattgtta

SEQ ID NO: 1060340 - DNA, 18 bp, Homo sapiens
ttagaggctttcaaatgt

SEQ ID NO: 1060341 - DNA, 19 bp, Homo sapiens
ttagagggtatttgtggaa

SEQ ID NO: 1060342 - DNA, 19 bp, Homo sapiens
ttagaggttttaaagtgat

SEQ ID NO: 1060343 - DNA, 20 bp, Homo sapiens
ttagaggttttaaagtgatt

SEQ ID NO: 1060344 - DNA, 21 bp, Homo sapiens
ttagaggttttaaagtgatta

SEQ ID NO: 1060345 - DNA, 17 bp, Homo sapiens
ttagagtatttcccttc

SEQ ID NO: 1060346 - DNA, 17 bp, Homo sapiens
ttagagtgcccagcaga

SEQ ID NO: 1060347 - DNA, 16 bp, Homo sapiens
ttagagtttctgtttg

SEQ ID NO: 1060348 - DNA, 18 bp, Homo sapiens
ttagagtttctgtttgat

SEQ ID NO: 1060349 - DNA, 17 bp, Homo sapiens
ttagataaagatttcta

SEQ ID NO: 1060350 - DNA, 16 bp, Homo sapiens
ttagataacttcttga

SEQ ID NO: 1060351 - DNA, 14 bp, Homo sapiens
ttagatataacact

SEQ ID NO: 1060352 - DNA, 17 bp, Homo sapiens
ttagatataacactatg

SEQ ID NO: 1060353 - DNA, 12 bp, Homo sapiens
ttagatattaaa

SEQ ID NO: 1060354 - DNA, 13 bp, Homo sapiens
ttagatattaaaa

SEQ ID NO: 1060355 - DNA, 14 bp, Homo sapiens
ttagatccattaat

SEQ ID NO: 1060356 - DNA, 20 bp, Homo sapiens
ttagatccattaatttaaat

SEQ ID NO: 1060357 - DNA, 23 bp, Homo sapiens
ttagatccattaatttaaatgat

SEQ ID NO: 1060358 - DNA, 16 bp, Homo sapiens
ttagatcccatgtcac

SEQ ID NO: 1060359 - DNA, 16 bp, Homo sapiens
ttagatctctcctgca

SEQ ID NO: 1060360 - DNA, 15 bp, Homo sapiens
ttagatgtatttttg

SEQ ID NO: 1060361 - DNA, 19 bp, Homo sapiens
ttagattaagaaatagaca

SEQ ID NO: 1060362 - DNA, 20 bp, Homo sapiens
ttagattcttaattcatgag

SEQ ID NO: 1060363 - DNA, 14 bp, Homo sapiens
ttacagagccttga

SEQ ID NO: 1060364 - DNA, 15 bp, Homo sapiens
ttacagcattgtctt

SEQ ID NO: 1060365 - DNA, 19 bp, Homo sapiens
ttacagcattgtctttgct

SEQ ID NO: 1060366 - DNA, 21 bp, Homo sapiens
ttacagcgagaggcagagaaa

SEQ ID NO: 1060367 - DNA, 15 bp, Homo sapiens
ttacaggaacttcat

SEQ ID NO: 1060368 - DNA, 14 bp, Homo sapiens
ttacaggaagcttt

SEQ ID NO: 1060369 - DNA, 23 bp, Homo sapiens
ttacaggcctacagaaattgaaa

SEQ ID NO: 1060370 - DNA, 17 bp, Homo sapiens
ttacagggtgactcaca

SEQ ID NO: 1060371 - DNA, 15 bp, Homo sapiens
ttacaggtttgaatt

SEQ ID NO: 1060372 - DNA, 21 bp, Homo sapiens
ttacagtacacatccccagaa

SEQ ID NO: 1060373 - DNA, 23 bp, Homo sapiens
ttacagtatgatgaaaataattt

SEQ ID NO: 1060374 - DNA, 18 bp, Homo sapiens
ttacagtatttttctgtg

SEQ ID NO: 1060375 - DNA, 19 bp, Homo sapiens
ttacagttagggttttgca

SEQ ID NO: 1060376 - DNA, 21 bp, Homo sapiens
ttacagttagggttttgcaat

SEQ ID NO: 1060377 - DNA, 15 bp, Homo sapiens
ttacagttctttcct

SEQ ID NO: 1060378 - DNA, 20 bp, Homo sapiens
ttacagtttaagattttaag

SEQ ID NO: 1060379 - DNA, 22 bp, Homo sapiens
ttacataaggatgactttttta

SEQ ID NO: 1060380 - DNA, 15 bp, Homo sapiens
ttacatagaacactt

SEQ ID NO: 1060381 - DNA, 20 bp, Homo sapiens
ttacatagatcagccattaa

SEQ ID NO: 1060382 - DNA, 21 bp, Homo sapiens
ttacatagatcagccattaaa

SEQ ID NO: 1060383 - DNA, 13 bp, Homo sapiens
ttacatagtctga

SEQ ID NO: 1060384 - DNA, 15 bp, Homo sapiens
ttacatattcctttg

SEQ ID NO: 1060385 - DNA, 12 bp, Homo sapiens
ttacatcttgta

SEQ ID NO: 1060386 - DNA, 13 bp, Homo sapiens
ttacatcttgtag

SEQ ID NO: 1060387 - DNA, 23 bp, Homo sapiens
ttacatcttgttggtacctttct

SEQ ID NO: 1060388 - DNA, 23 bp, Homo sapiens
ttacatggagaaaaccaaaatga

SEQ ID NO: 1060389 - DNA, 15 bp, Homo sapiens
ttacatggctgtggt

SEQ ID NO: 1060390 - DNA, 22 bp, Homo sapiens
ttacatggttaaggtaaagtaa

SEQ ID NO: 1060391 - DNA, 15 bp, Homo sapiens
ttacatgtaatttga

SEQ ID NO: 1060392 - DNA, 16 bp, Homo sapiens
ttacatgtttataaat

SEQ ID NO: 1060393 - DNA, 12 bp, Homo sapiens
ttacatgtttgc

SEQ ID NO: 1060394 - DNA, 12 bp, Homo sapiens
ttacatgttttc

SEQ ID NO: 1060395 - DNA, 14 bp, Homo sapiens
ttacatgttttttc

SEQ ID NO: 1060396 - DNA, 20 bp, Homo sapiens
ttacatgttttttcatttgt

SEQ ID NO: 1060397 - DNA, 20 bp, Homo sapiens
ttacattaatgcccagccag

SEQ ID NO: 1060398 - DNA, 15 bp, Homo sapiens
ttacattatgcaaat

SEQ ID NO: 1060399 - DNA, 19 bp, Homo sapiens
ttacattcctaactagaat

SEQ ID NO: 1060400 - DNA, 23 bp, Homo sapiens
ttacattgccgtggcatcttaaa

SEQ ID NO: 1060401 - DNA, 17 bp, Homo sapiens
ttacattgtcctgtagc

SEQ ID NO: 1060402 - DNA, 16 bp, Homo sapiens
ttacattgttcaatta

SEQ ID NO: 1060403 - DNA, 14 bp, Homo sapiens
ttacatttatacat

SEQ ID NO: 1060404 - DNA, 14 bp, Homo sapiens
ttacattttacaca

SEQ ID NO: 1060405 - DNA, 18 bp, Homo sapiens
ttacattttcgtcctgta

SEQ ID NO: 1060406 - DNA, 17 bp, Homo sapiens
ttacatttttaagtgct

SEQ ID NO: 1060407 - DNA, 20 bp, Homo sapiens
ttacatttttaagtgctgca

SEQ ID NO: 1060408 - DNA, 23 bp, Homo sapiens
ttacatttttaagtgctgcattt

SEQ ID NO: 1060409 - DNA, 21 bp, Homo sapiens
ttacatttttcacttttgcta

SEQ ID NO: 1060410 - DNA, 20 bp, Homo sapiens
ttaccaaagagatattgata

SEQ ID NO: 1060411 - DNA, 13 bp, Homo sapiens
ttaccaaattgct

SEQ ID NO: 1060412 - DNA, 13 bp, Homo sapiens
ttaccaacctgtt

SEQ ID NO: 1060413 - DNA, 11 bp, Homo sapiens
ttaccaacttc

SEQ ID NO: 1060414 - DNA, 13 bp, Homo sapiens
ttaccaacttcct

SEQ ID NO: 1060415 - DNA, 22 bp, Homo sapiens
ttaccaacttcctctgccatgt

SEQ ID NO: 1060416 - DNA, 16 bp, Homo sapiens
ttaccaagagtaactt

SEQ ID NO: 1060417 - DNA, 16 bp, Homo sapiens
ttaccaaggatgaatt

SEQ ID NO: 1060418 - DNA, 20 bp, Homo sapiens
ttaccaataaactgagcgac

SEQ ID NO: 1060419 - DNA, 14 bp, Homo sapiens
ttaccacagacata

SEQ ID NO: 1060420 - DNA, 18 bp, Homo sapiens
ttaccacagcaactgacc

SEQ ID NO: 1060421 - DNA, 17 bp, Homo sapiens
ttaccagacaaaaaaat

SEQ ID NO: 1060422 - DNA, 20 bp, Homo sapiens
ttaccagacaaaaaaattta

SEQ ID NO: 1060423 - DNA, 18 bp, Homo sapiens
ttaccagataatgctact

SEQ ID NO: 1060424 - DNA, 13 bp, Homo sapiens
ttaccagatgcta

SEQ ID NO: 1060425 - DNA, 14 bp, Homo sapiens
ttaccagatgctac

SEQ ID NO: 1060426 - DNA, 21 bp, Homo sapiens
ttaccaggcaccaaaagaagt

SEQ ID NO: 1060427 - DNA, 23 bp, Homo sapiens
ttaccaggcaccaaaagaagtaa

SEQ ID NO: 1060428 - DNA, 17 bp, Homo sapiens
ttaccaggtgagaagtg

SEQ ID NO: 1060429 - DNA, 17 bp, Homo sapiens
ttaccagtcctattttt

SEQ ID NO: 1060430 - DNA, 18 bp, Homo sapiens
ttaccagtcctatttttc

SEQ ID NO: 1060431 - DNA, 16 bp, Homo sapiens
ttaccagttaattact

SEQ ID NO: 1060432 - DNA, 12 bp, Homo sapiens
ttaccataaagc

SEQ ID NO: 1060433 - DNA, 16 bp, Homo sapiens
ttaccataaagccttt

SEQ ID NO: 1060434 - DNA, 19 bp, Homo sapiens
ttaccatactgtctctgga

SEQ ID NO: 1060435 - DNA, 14 bp, Homo sapiens
ttaccatgtaatgg

SEQ ID NO: 1060436 - DNA, 21 bp, Homo sapiens
ttaccattatttaatttgtat

SEQ ID NO: 1060437 - DNA, 20 bp, Homo sapiens
ttaccatttgtaataaagta

SEQ ID NO: 1060438 - DNA, 16 bp, Homo sapiens
ttaccattttaacgct

SEQ ID NO: 1060439 - DNA, 24 bp, Homo sapiens
ttacccaaaaactaaatctctaat

SEQ ID NO: 1060440 - DNA, 19 bp, Homo sapiens
ttaggaatctcttcactac

SEQ ID NO: 1060441 - DNA, 19 bp, Homo sapiens
ttaggagggagttatctaa

SEQ ID NO: 1060442 - DNA, 21 bp, Homo sapiens
ttaggagttcgagaccagcct

SEQ ID NO: 1060443 - DNA, 19 bp, Homo sapiens
ttaggatgcggctttctct

SEQ ID NO: 1060444 - DNA, 21 bp, Homo sapiens
ttaggatgcggctttctctgc

SEQ ID NO: 1060445 - DNA, 16 bp, Homo sapiens
ttaggatgtgtgcatg

SEQ ID NO: 1060446 - DNA, 12 bp, Homo sapiens
ttaggattcccc

SEQ ID NO: 1060447 - DNA, 19 bp, Homo sapiens
ttaggcaaagtacaaaatt

SEQ ID NO: 1060448 - DNA, 15 bp, Homo sapiens
ttaggcacatcaatt

SEQ ID NO: 1060449 - DNA, 13 bp, Homo sapiens
ttaggcagcctgc

SEQ ID NO: 1060450 - DNA, 19 bp, Homo sapiens
ttaggcattatttaatgtt

SEQ ID NO: 1060451 - DNA, 16 bp, Homo sapiens
ttaggcatttcctgct

SEQ ID NO: 1060452 - DNA, 17 bp, Homo sapiens
ttaggcatttcctgctg

SEQ ID NO: 1060453 - DNA, 18 bp, Homo sapiens
ttaggcatttcctgctga

SEQ ID NO: 1060454 - DNA, 22 bp, Homo sapiens
ttaggccaaaaaaatgtaagat

SEQ ID NO: 1060455 - DNA, 17 bp, Homo sapiens
ttaggccagcaacgctt

SEQ ID NO: 1060456 - DNA, 14 bp, Homo sapiens
ttaggcctacctga

SEQ ID NO: 1060457 - DNA, 16 bp, Homo sapiens
ttaggcctcatttctt

SEQ ID NO: 1060458 - DNA, 16 bp, Homo sapiens
ttaggcctctctgcct

SEQ ID NO: 1060459 - DNA, 14 bp, Homo sapiens
ttaggcctctgaga

SEQ ID NO: 1060460 - DNA, 18 bp, Homo sapiens
ttaggcttttaagaaaca

SEQ ID NO: 1060461 - DNA, 13 bp, Homo sapiens
ttagggaagaaaa

SEQ ID NO: 1060462 - DNA, 21 bp, Homo sapiens
ttagggacaggaccccagctc

SEQ ID NO: 1060463 - DNA, 13 bp, Homo sapiens
ttagggagaaaat

SEQ ID NO: 1060464 - DNA, 17 bp, Homo sapiens
ttagggagaaaattcaa

SEQ ID NO: 1060465 - DNA, 19 bp, Homo sapiens
ttagggagtggttcctgtg

SEQ ID NO: 1060466 - DNA, 14 bp, Homo sapiens
ttagggccctggag

SEQ ID NO: 1060467 - DNA, 11 bp, Homo sapiens
ttagggctgtt

SEQ ID NO: 1060468 - DNA, 14 bp, Homo sapiens
ttagggtataagtt

SEQ ID NO: 1060469 - DNA, 20 bp, Homo sapiens
ttagggtgaaacttaaaaaa

SEQ ID NO: 1060470 - DNA, 14 bp, Homo sapiens
ttaggtagaaaaac

SEQ ID NO: 1060471 - DNA, 14 bp, Homo sapiens
ttaggtccattttc

SEQ ID NO: 1060472 - DNA, 19 bp, Homo sapiens
ttaggtccctcactccaca

SEQ ID NO: 1060473 - DNA, 18 bp, Homo sapiens
ttaggtggccgctcctcc

SEQ ID NO: 1060474 - DNA, 19 bp, Homo sapiens
ttaggtggccgctcctccc

SEQ ID NO: 1060475 - DNA, 21 bp, Homo sapiens
ttaggtggccgctcctccctg

SEQ ID NO: 1060476 - DNA, 14 bp, Homo sapiens
ttaggtgtctgtcc

SEQ ID NO: 1060477 - DNA, 16 bp, Homo sapiens
ttaggtgtgactgaat

SEQ ID NO: 1060478 - DNA, 21 bp, Homo sapiens
ttaggtgtgactgaatttctt

SEQ ID NO: 1060479 - DNA, 22 bp, Homo sapiens
ttaggttatggtttaatgttac

SEQ ID NO: 1060480 - DNA, 18 bp, Homo sapiens
ttaggttattttgctttg

SEQ ID NO: 1060481 - DNA, 14 bp, Homo sapiens
ttaggttgaaacat

SEQ ID NO: 1060482 - DNA, 17 bp, Homo sapiens
ttagtaaaaaatcaatt

SEQ ID NO: 1060483 - DNA, 15 bp, Homo sapiens
ttagtaaatatgtga

SEQ ID NO: 1060484 - DNA, 16 bp, Homo sapiens
ttagtaaatatgtgaa

SEQ ID NO: 1060485 - DNA, 20 bp, Homo sapiens
ttagtaaatatgtgaagaaa

SEQ ID NO: 1060486 - DNA, 24 bp, Homo sapiens
ttagtaacatgaggggacattttg

SEQ ID NO: 1060487 - DNA, 14 bp, Homo sapiens
ttagtaatctgtat

SEQ ID NO: 1060488 - DNA, 17 bp, Homo sapiens
ttagtaatctgtataat

SEQ ID NO: 1060489 - DNA, 17 bp, Homo sapiens
ttagtaatttctttttt

SEQ ID NO: 1060490 - DNA, 23 bp, Homo sapiens
ttagtactttggatgcaattaaa

SEQ ID NO: 1060491 - DNA, 15 bp, Homo sapiens
ttagtagaaatgcca

SEQ ID NO: 1060492 - DNA, 17 bp, Homo sapiens
ttagtagtcaaaaacaa

SEQ ID NO: 1060493 - DNA, 21 bp, Homo sapiens
ttagtataatatttcttaatt

SEQ ID NO: 1060494 - DNA, 15 bp, Homo sapiens
ttagtatctaacatg

SEQ ID NO: 1060495 - DNA, 17 bp, Homo sapiens
ttagtatctaacatgta

SEQ ID NO: 1060496 - DNA, 18 bp, Homo sapiens
ttagtatctaacatgtat

SEQ ID NO: 1060497 - DNA, 12 bp, Homo sapiens
ttagtatgcagt

SEQ ID NO: 1060498 - DNA, 21 bp, Homo sapiens
ttataccagcttaatagctgt

SEQ ID NO: 1060499 - DNA, 22 bp, Homo sapiens
ttatacccccaggaaactagct

SEQ ID NO: 1060500 - DNA, 14 bp, Homo sapiens
ttatacgcttttct

SEQ ID NO: 1060501 - DNA, 17 bp, Homo sapiens
ttatactccatacataa

SEQ ID NO: 1060502 - DNA, 16 bp, Homo sapiens
ttatactctttctgta

SEQ ID NO: 1060503 - DNA, 21 bp, Homo sapiens
ttatactgacaataaaaatgt

SEQ ID NO: 1060504 - DNA, 18 bp, Homo sapiens
ttatactgggtttcaaga

SEQ ID NO: 1060505 - DNA, 20 bp, Homo sapiens
ttatactgggtttcaagaaa

SEQ ID NO: 1060506 - DNA, 15 bp, Homo sapiens
ttatactgtacaata

SEQ ID NO: 1060507 - DNA, 18 bp, Homo sapiens
ttatactgtatttctaag

SEQ ID NO: 1060508 - DNA, 23 bp, Homo sapiens
ttatacttgagaccaacttttca

SEQ ID NO: 1060509 - DNA, 13 bp, Homo sapiens
ttatactttattg

SEQ ID NO: 1060510 - DNA, 19 bp, Homo sapiens
ttatagaataaaagctata

SEQ ID NO: 1060511 - DNA, 23 bp, Homo sapiens
ttatagaataaaagctataaagt

SEQ ID NO: 1060512 - DNA, 15 bp, Homo sapiens
ttatagaatactttt

SEQ ID NO: 1060513 - DNA, 15 bp, Homo sapiens
ttatagaatatttat

SEQ ID NO: 1060514 - DNA, 23 bp, Homo sapiens
ttatagaatatttattacctctg

SEQ ID NO: 1060515 - DNA, 15 bp, Homo sapiens
ttatagacaaataat

SEQ ID NO: 1060516 - DNA, 21 bp, Homo sapiens
ttatagaggctagcttctgct

SEQ ID NO: 1060517 - DNA, 15 bp, Homo sapiens
ttatagatgtctagg

SEQ ID NO: 1060518 - DNA, 15 bp, Homo sapiens
ttatagattgtctta

SEQ ID NO: 1060519 - DNA, 18 bp, Homo sapiens
ttatagcaacaacaattg

SEQ ID NO: 1060520 - DNA, 20 bp, Homo sapiens
ttatagcaacaacaattggt

SEQ ID NO: 1060521 - DNA, 18 bp, Homo sapiens
ttatagcaactaatgttt

SEQ ID NO: 1060522 - DNA, 18 bp, Homo sapiens
ttatagcaagatattgat

SEQ ID NO: 1060523 - DNA, 17 bp, Homo sapiens
ttatagctattactgtc

SEQ ID NO: 1060524 - DNA, 18 bp, Homo sapiens
ttatagctctaataagtt

SEQ ID NO: 1060525 - DNA, 16 bp, Homo sapiens
ttatagcttaactaat

SEQ ID NO: 1060526 - DNA, 16 bp, Homo sapiens
ttataggcgttttttg

SEQ ID NO: 1060527 - DNA, 23 bp, Homo sapiens
ttataggtaacgtgattgattca

SEQ ID NO: 1060528 - DNA, 17 bp, Homo sapiens
ttataggtcactcctgg

SEQ ID NO: 1060529 - DNA, 15 bp, Homo sapiens
ttatagtaaccattt

SEQ ID NO: 1060530 - DNA, 22 bp, Homo sapiens
ttatagtaaccattttcctttg

SEQ ID NO: 1060531 - DNA, 14 bp, Homo sapiens
ttatagtagaacaa

SEQ ID NO: 1060532 - DNA, 18 bp, Homo sapiens
ttatagtatatctggaca

SEQ ID NO: 1060533 - DNA, 16 bp, Homo sapiens
ttatagtcaatggctt

SEQ ID NO: 1060534 - DNA, 21 bp, Homo sapiens
ttatagtgatgtaatcttgaa

SEQ ID NO: 1060535 - DNA, 17 bp, Homo sapiens
ttatagtgtttaactgg

SEQ ID NO: 1060536 - DNA, 15 bp, Homo sapiens
ttatagttactgtgt

SEQ ID NO: 1060537 - DNA, 18 bp, Homo sapiens
ttatataaagtattcttt

SEQ ID NO: 1060538 - DNA, 14 bp, Homo sapiens
ttatataaatatat

SEQ ID NO: 1060539 - DNA, 13 bp, Homo sapiens
ttatataactctt

SEQ ID NO: 1060540 - DNA, 20 bp, Homo sapiens
ttatataatatctaaagtta

SEQ ID NO: 1060541 - DNA, 17 bp, Homo sapiens
ttatatagcaaaatgat

SEQ ID NO: 1060542 - DNA, 19 bp, Homo sapiens
ttatatagcaaaatgattc

SEQ ID NO: 1060543 - DNA, 21 bp, Homo sapiens
ttatatagggatcaaccagct

SEQ ID NO: 1060544 - DNA, 18 bp, Homo sapiens
ttatataggttgtgcaaa

SEQ ID NO: 1060545 - DNA, 18 bp, Homo sapiens
ttatatataaggtaatgt

SEQ ID NO: 1060546 - DNA, 18 bp, Homo sapiens
ttatatatgaagttgtat

SEQ ID NO: 1060547 - DNA, 14 bp, Homo sapiens
ttatatatgtattt

SEQ ID NO: 1060548 - DNA, 19 bp, Homo sapiens
ttatatatttacagaagaa

SEQ ID NO: 1060549 - DNA, 13 bp, Homo sapiens
ttctcaagacctg

SEQ ID NO: 1060550 - DNA, 13 bp, Homo sapiens
ttctcaagacttt

SEQ ID NO: 1060551 - DNA, 17 bp, Homo sapiens
ttctcaagactttagct

SEQ ID NO: 1060552 - DNA, 15 bp, Homo sapiens
ttctcaagtgcctta

SEQ ID NO: 1060553 - DNA, 12 bp, Homo sapiens
ttctcaatgaaa

SEQ ID NO: 1060554 - DNA, 13 bp, Homo sapiens
ttctcaccaggaa

SEQ ID NO: 1060555 - DNA, 15 bp, Homo sapiens
ttctcactaaatctt

SEQ ID NO: 1060556 - DNA, 15 bp, Homo sapiens
ttctcactccaccac

SEQ ID NO: 1060557 - DNA, 16 bp, Homo sapiens
ttctcactcctacctg

SEQ ID NO: 1060558 - DNA, 18 bp, Homo sapiens
ttctcactgaactccacc

SEQ ID NO: 1060559 - DNA, 19 bp, Homo sapiens
ttctcactgaactccaccg

SEQ ID NO: 1060560 - DNA, 14 bp, Homo sapiens
ttctcactgccatg

SEQ ID NO: 1060561 - DNA, 19 bp, Homo sapiens
ttctcagaatctacccaaa

SEQ ID NO: 1060562 - DNA, 23 bp, Homo sapiens
ttctcagaatctacccaaaggat

SEQ ID NO: 1060563 - DNA, 19 bp, Homo sapiens
ttctcagaatctcaaataa

SEQ ID NO: 1060564 - DNA, 22 bp, Homo sapiens
ttctcagaatctcaaataacta

SEQ ID NO: 1060565 - DNA, 13 bp, Homo sapiens
ttctcagatattt

SEQ ID NO: 1060566 - DNA, 14 bp, Homo sapiens
ttctcagatcttga

SEQ ID NO: 1060567 - DNA, 14 bp, Homo sapiens
ttctcagatttctg

SEQ ID NO: 1060568 - DNA, 15 bp, Homo sapiens
ttctcagatttctga

SEQ ID NO: 1060569 - DNA, 16 bp, Homo sapiens
ttctcagatttctgag

SEQ ID NO: 1060570 - DNA, 22 bp, Homo sapiens
ttctcagggtcactgtccttga

SEQ ID NO: 1060571 - DNA, 16 bp, Homo sapiens
ttctcaggtaatcatt

SEQ ID NO: 1060572 - DNA, 20 bp, Homo sapiens
ttctcaggtaatcattttaa

SEQ ID NO: 1060573 - DNA, 16 bp, Homo sapiens
ttctcataattcctac

SEQ ID NO: 1060574 - DNA, 17 bp, Homo sapiens
ttctcataattcctaca

SEQ ID NO: 1060575 - DNA, 19 bp, Homo sapiens
ttctcataattcctacagc

SEQ ID NO: 1060576 - DNA, 20 bp, Homo sapiens
ttctcataattcctacagca

SEQ ID NO: 1060577 - DNA, 17 bp, Homo sapiens
ttctcatagcattaact

SEQ ID NO: 1060578 - DNA, 18 bp, Homo sapiens
ttctcatagcattaacta

SEQ ID NO: 1060579 - DNA, 21 bp, Homo sapiens
ttctcatagcattaactaatc

SEQ ID NO: 1060580 - DNA, 22 bp, Homo sapiens
ttctcatagcattaactaatct

SEQ ID NO: 1060581 - DNA, 20 bp, Homo sapiens
ttctcatcatattgtatgta

SEQ ID NO: 1060582 - DNA, 20 bp, Homo sapiens
ttctcatctgcacccttctt

SEQ ID NO: 1060583 - DNA, 17 bp, Homo sapiens
ttctcatgatttacaga

SEQ ID NO: 1060584 - DNA, 14 bp, Homo sapiens
ttctcatgtatctt

SEQ ID NO: 1060585 - DNA, 19 bp, Homo sapiens
ttctcatgttccttttgaa

SEQ ID NO: 1060586 - DNA, 14 bp, Homo sapiens
ttctcattgcctct

SEQ ID NO: 1060587 - DNA, 15 bp, Homo sapiens
ttctcatttctttct

SEQ ID NO: 1060588 - DNA, 19 bp, Homo sapiens
ttctcatttgtttttctca

SEQ ID NO: 1060589 - DNA, 22 bp, Homo sapiens
ttctcattttttaaaaaagctt

SEQ ID NO: 1060590 - DNA, 22 bp, Homo sapiens
ttctccacagcaaccccaggct

SEQ ID NO: 1060591 - DNA, 15 bp, Homo sapiens
ttctccaccagcccc

SEQ ID NO: 1060592 - DNA, 22 bp, Homo sapiens
ttctccacccaaaccccttccc

SEQ ID NO: 1060593 - DNA, 21 bp, Homo sapiens
ttctccacctcccacaaagga

SEQ ID NO: 1060594 - DNA, 21 bp, Homo sapiens
ttctccacgtctttcctgcta

SEQ ID NO: 1060595 - DNA, 15 bp, Homo sapiens
ttctccactttttct

SEQ ID NO: 1060596 - DNA, 11 bp, Homo sapiens
ttctccagacc

SEQ ID NO: 1060597 - DNA, 19 bp, Homo sapiens
ttctccagacccagaggcc

SEQ ID NO: 1060598 - DNA, 14 bp, Homo sapiens
ttctccagccagca

SEQ ID NO: 1060599 - DNA, 20 bp, Homo sapiens
ttctccaggtctcacgggca

SEQ ID NO: 1060600 - DNA, 13 bp, Homo sapiens
ttctccagtggtg

SEQ ID NO: 1060601 - DNA, 20 bp, Homo sapiens
ttctccatccacatgggagc

SEQ ID NO: 1060602 - DNA, 12 bp, Homo sapiens
ttctccatcccc

SEQ ID NO: 1060603 - DNA, 18 bp, Homo sapiens
ttctccatctggcagggt

SEQ ID NO: 1060604 - DNA, 17 bp, Homo sapiens
ttctccatttaagacac

SEQ ID NO: 1060605 - DNA, 18 bp, Homo sapiens
ttctccatttaagacaca

SEQ ID NO: 1060606 - DNA, 14 bp, Homo sapiens
ttctcccacccctt

SEQ ID NO: 1060607 - DNA, 22 bp, Homo sapiens
ttctcccaccccttggcccctc

SEQ ID NO: 1060608 - DNA, 17 bp, Homo sapiens
ttctcccagaatcccag

SEQ ID NO: 1060609 - DNA, 19 bp, Homo sapiens
ttctcccagcactgcctcc

SEQ ID NO: 1060610 - DNA, 10 bp, Homo sapiens
ttctcccagg

SEQ ID NO: 1060611 - DNA, 20 bp, Homo sapiens
ttctcccagggagtgagcag

SEQ ID NO: 1060612 - DNA, 22 bp, Homo sapiens
ttctccccatccccttcctaaa

SEQ ID NO: 1060613 - DNA, 14 bp, Homo sapiens
ttctcccccgccct

SEQ ID NO: 1060614 - DNA, 12 bp, Homo sapiens
ttctcccccttg

SEQ ID NO: 1060615 - DNA, 20 bp, Homo sapiens
ttctccccgaggctgcccca

SEQ ID NO: 1060616 - DNA, 22 bp, Homo sapiens
ttctccccgaggctgccccagg

SEQ ID NO: 1060617 - DNA, 22 bp, Homo sapiens
ttctccccgcagcccgcctgcc

SEQ ID NO: 1060618 - DNA, 20 bp, Homo sapiens
ttctcccctctcccagggat

SEQ ID NO: 1060619 - DNA, 23 bp, Homo sapiens
ttctcccctgcccttcctcctga

SEQ ID NO: 1060620 - DNA, 22 bp, Homo sapiens
ttctccccttcctggacacact

SEQ ID NO: 1060621 - DNA, 13 bp, Homo sapiens
ttctcccggccct

SEQ ID NO: 1060622 - DNA, 21 bp, Homo sapiens
ttctccctcacccccaggtgt

SEQ ID NO: 1060623 - DNA, 18 bp, Homo sapiens
ttctctcctgtacctctt

SEQ ID NO: 1060624 - DNA, 12 bp, Homo sapiens
ttctctcctgtg

SEQ ID NO: 1060625 - DNA, 20 bp, Homo sapiens
ttctctcctgtgtgcttgtc

SEQ ID NO: 1060626 - DNA, 11 bp, Homo sapiens
ttctctctcca

SEQ ID NO: 1060627 - DNA, 23 bp, Homo sapiens
ttctctctccagaaacagctgct

SEQ ID NO: 1060628 - DNA, 20 bp, Homo sapiens
ttctctctccatttggaatt

SEQ ID NO: 1060629 - DNA, 19 bp, Homo sapiens
ttctctctccctgtcacac

SEQ ID NO: 1060630 - DNA, 20 bp, Homo sapiens
ttctctctccctgtcacaca

SEQ ID NO: 1060631 - DNA, 14 bp, Homo sapiens
ttctctctggatgg

SEQ ID NO: 1060632 - DNA, 13 bp, Homo sapiens
ttctctcttcaat

SEQ ID NO: 1060633 - DNA, 16 bp, Homo sapiens
ttctctcttccctcag

SEQ ID NO: 1060634 - DNA, 15 bp, Homo sapiens
ttctctcttgttgtc

SEQ ID NO: 1060635 - DNA, 17 bp, Homo sapiens
ttctctctttatacagc

SEQ ID NO: 1060636 - DNA, 19 bp, Homo sapiens
ttctctcttttaaagtatt

SEQ ID NO: 1060637 - DNA, 16 bp, Homo sapiens
ttctctgaatcagaaa

SEQ ID NO: 1060638 - DNA, 12 bp, Homo sapiens
ttctctgacttc

SEQ ID NO: 1060639 - DNA, 16 bp, Homo sapiens
ttctctgaggacaaga

SEQ ID NO: 1060640 - DNA, 11 bp, Homo sapiens
ttctctgcaga

SEQ ID NO: 1060641 - DNA, 12 bp, Homo sapiens
ttctctgcagta

SEQ ID NO: 1060642 - DNA, 13 bp, Homo sapiens
ttctctgccagtg

SEQ ID NO: 1060643 - DNA, 15 bp, Homo sapiens
ttctctgctccacca

SEQ ID NO: 1060644 - DNA, 11 bp, Homo sapiens
ttctctgctga

SEQ ID NO: 1060645 - DNA, 16 bp, Homo sapiens
ttctctgctgagggcc

SEQ ID NO: 1060646 - DNA, 16 bp, Homo sapiens
ttctctggcaaacttt

SEQ ID NO: 1060647 - DNA, 16 bp, Homo sapiens
ttctctgggagaaaat

SEQ ID NO: 1060648 - DNA, 18 bp, Homo sapiens
ttctctggtggtcttcct

SEQ ID NO: 1060649 - DNA, 23 bp, Homo sapiens
ttctctgtaagtaattgccacag

SEQ ID NO: 1060650 - DNA, 19 bp, Homo sapiens
ttctctgtaagtgtagctc

SEQ ID NO: 1060651 - DNA, 21 bp, Homo sapiens
ttctctgtaagtgtagctcaa

SEQ ID NO: 1060652 - DNA, 16 bp, Homo sapiens
ttctctgtatgaatgt

SEQ ID NO: 1060653 - DNA, 13 bp, Homo sapiens
ttctctgtctctg

SEQ ID NO: 1060654 - DNA, 20 bp, Homo sapiens
ttctctgtgaacgatttaga

SEQ ID NO: 1060655 - DNA, 12 bp, Homo sapiens
ttctctgtgaag

SEQ ID NO: 1060656 - DNA, 15 bp, Homo sapiens
ttctctgtgctctga

SEQ ID NO: 1060657 - DNA, 24 bp, Homo sapiens
ttctctgtgtttgttcctacagcc

SEQ ID NO: 1060658 - DNA, 16 bp, Homo sapiens
ttctcttacctgttat

SEQ ID NO: 1060659 - DNA, 18 bp, Homo sapiens
ttctcttagcaactcaga

SEQ ID NO: 1060660 - DNA, 21 bp, Homo sapiens
ttctcttaggtggctctggga

SEQ ID NO: 1060661 - DNA, 15 bp, Homo sapiens
ttctcttcccaggcc

SEQ ID NO: 1060662 - DNA, 16 bp, Homo sapiens
ttctcttcccaggcct

SEQ ID NO: 1060663 - DNA, 12 bp, Homo sapiens
ttctcttcctgt

SEQ ID NO: 1060664 - DNA, 18 bp, Homo sapiens
ttctcttccttttatata

SEQ ID NO: 1060665 - DNA, 20 bp, Homo sapiens
ttctcttccttttatcagta

SEQ ID NO: 1060666 - DNA, 20 bp, Homo sapiens
ttctcttgacagtctgaagc

SEQ ID NO: 1060667 - DNA, 16 bp, Homo sapiens
ttctcttgagctggcc

SEQ ID NO: 1060668 - DNA, 21 bp, Homo sapiens
ttctcttggtgaaataataaa

SEQ ID NO: 1060669 - DNA, 18 bp, Homo sapiens
ttctcttgtgttcgtgtt

SEQ ID NO: 1060670 - DNA, 19 bp, Homo sapiens
ttctctttaaaatatttgt

SEQ ID NO: 1060671 - DNA, 15 bp, Homo sapiens
ttctctttaactgtg

SEQ ID NO: 1060672 - DNA, 18 bp, Homo sapiens
ttctctttaccttctaaa

SEQ ID NO: 1060673 - DNA, 13 bp, Homo sapiens
ttctctttcaaag

SEQ ID NO: 1060674 - DNA, 15 bp, Homo sapiens
ttctctttcccccac

SEQ ID NO: 1060675 - DNA, 22 bp, Homo sapiens
ttctctttccttggctcccatt

SEQ ID NO: 1060676 - DNA, 11 bp, Homo sapiens
ttctctttctc

SEQ ID NO: 1060677 - DNA, 19 bp, Homo sapiens
ttctctttgattatttgca

SEQ ID NO: 1060678 - DNA, 15 bp, Homo sapiens
ttctctttggaaata

SEQ ID NO: 1060679 - DNA, 23 bp, Homo sapiens
ttctctttggaaatagcatgaca

SEQ ID NO: 1060680 - DNA, 19 bp, Homo sapiens
ttctctttgtggtttcttg

SEQ ID NO: 1060681 - DNA, 22 bp, Homo sapiens
ttctctttgtttctgtttcttg

SEQ ID NO: 1060682 - DNA, 15 bp, Homo sapiens
ttctcttttcctttg

SEQ ID NO: 1060683 - DNA, 14 bp, Homo sapiens
ttctcttttgaaag

SEQ ID NO: 1060684 - DNA, 22 bp, Homo sapiens
ttctcttttgctttctgtttct

SEQ ID NO: 1060685 - DNA, 22 bp, Homo sapiens
ttctgaaaacacttgatgatgt

SEQ ID NO: 1060686 - DNA, 13 bp, Homo sapiens
ttctgaaacctta

SEQ ID NO: 1060687 - DNA, 12 bp, Homo sapiens
ttctgaaatgtt

SEQ ID NO: 1060688 - DNA, 16 bp, Homo sapiens
ttctgaactcaaactg

SEQ ID NO: 1060689 - DNA, 16 bp, Homo sapiens
ttctgaaggaagagaa

SEQ ID NO: 1060690 - DNA, 18 bp, Homo sapiens
ttctgaaggaagagaaga

SEQ ID NO: 1060691 - DNA, 19 bp, Homo sapiens
ttctgaagtgggaaaaaat

SEQ ID NO: 1060692 - DNA, 15 bp, Homo sapiens
ttctgaataacttga

SEQ ID NO: 1060693 - DNA, 17 bp, Homo sapiens
ttctgaataacttgaag

SEQ ID NO: 1060694 - DNA, 17 bp, Homo sapiens
ttctgaataatttctta

SEQ ID NO: 1060695 - DNA, 22 bp, Homo sapiens
ttctgaatattttatctttcct

SEQ ID NO: 1060696 - DNA, 15 bp, Homo sapiens
ttctgaatgcttcta

SEQ ID NO: 1060697 - DNA, 15 bp, Homo sapiens
ttctgacattaacag

SEQ ID NO: 1060698 - DNA, 23 bp, Homo sapiens
ttctgacattaacagttttccat

SEQ ID NO: 1060699 - DNA, 18 bp, Homo sapiens
ttctgacatttatatttg

SEQ ID NO: 1060700 - DNA, 22 bp, Homo sapiens
ttctgacatttatatttgtgta

SEQ ID NO: 1060701 - DNA, 14 bp, Homo sapiens
ttctgaccacactt

SEQ ID NO: 1060702 - DNA, 21 bp, Homo sapiens
ttctgacctgttgccagcaga

SEQ ID NO: 1060703 - DNA, 22 bp, Homo sapiens
ttctgacgtcagcgcaccaaaa

SEQ ID NO: 1060704 - DNA, 18 bp, Homo sapiens
ttctgactagtttaaaga

SEQ ID NO: 1060705 - DNA, 19 bp, Homo sapiens
ttctgactcggtttctcca

SEQ ID NO: 1060706 - DNA, 16 bp, Homo sapiens
ttctgactctgagcta

SEQ ID NO: 1060707 - DNA, 15 bp, Homo sapiens
ttctgactgtccagg

SEQ ID NO: 1060708 - DNA, 16 bp, Homo sapiens
ttctgacttctagctg

SEQ ID NO: 1060709 - DNA, 13 bp, Homo sapiens
ttctgactttact

SEQ ID NO: 1060710 - DNA, 15 bp, Homo sapiens
ttctgactttacttg

SEQ ID NO: 1060711 - DNA, 16 bp, Homo sapiens
ttctgacttttacaga

SEQ ID NO: 1060712 - DNA, 18 bp, Homo sapiens
ttctgagaaggtccttaa

SEQ ID NO: 1060713 - DNA, 21 bp, Homo sapiens
ttctgagattcaatattgaat

SEQ ID NO: 1060714 - DNA, 20 bp, Homo sapiens
ttctgagcccgggctgcctg

SEQ ID NO: 1060715 - DNA, 21 bp, Homo sapiens
ttctgagcccgggctgcctgg

SEQ ID NO: 1060716 - DNA, 23 bp, Homo sapiens
ttctgagctatttcatctatttt

SEQ ID NO: 1060717 - DNA, 12 bp, Homo sapiens
ttctgagctcca

SEQ ID NO: 1060718 - DNA, 14 bp, Homo sapiens
ttctgagctccacc

SEQ ID NO: 1060719 - DNA, 17 bp, Homo sapiens
ttctgagctccacctct

SEQ ID NO: 1060720 - DNA, 19 bp, Homo sapiens
ttctgaggagctgttactg

SEQ ID NO: 1060721 - DNA, 13 bp, Homo sapiens
ttctgagtaatta

SEQ ID NO: 1060722 - DNA, 14 bp, Homo sapiens
ttctgagtgttttt

SEQ ID NO: 1060723 - DNA, 16 bp, Homo sapiens
ttctgagtttcattct

SEQ ID NO: 1060724 - DNA, 16 bp, Homo sapiens
ttctgagttttgtgtt

SEQ ID NO: 1060725 - DNA, 22 bp, Homo sapiens
ttctgagttttgtgtttgttgt

SEQ ID NO: 1060726 - DNA, 23 bp, Homo sapiens
ttctgagttttgtgtttgttgta

SEQ ID NO: 1060727 - DNA, 14 bp, Homo sapiens
ttctgataggaggg

SEQ ID NO: 1060728 - DNA, 17 bp, Homo sapiens
ttctgataggagggggc

SEQ ID NO: 1060729 - DNA, 22 bp, Homo sapiens
ttctgatatgcagttttcctta

SEQ ID NO: 1060730 - DNA, 15 bp, Homo sapiens
ttctgatgacgcctg

SEQ ID NO: 1060731 - DNA, 18 bp, Homo sapiens
ttctgatgtattacatga

SEQ ID NO: 1060732 - DNA, 18 bp, Homo sapiens
ttctgattaatatattta

SEQ ID NO: 1060733 - DNA, 13 bp, Homo sapiens
ttctgatttcata

SEQ ID NO: 1060734 - DNA, 11 bp, Homo sapiens
ttctgatttct

SEQ ID NO: 1060735 - DNA, 17 bp, Homo sapiens
ttctgcaaatagaaaac

SEQ ID NO: 1060736 - DNA, 19 bp, Homo sapiens
ttctgcaaatagaaaacag

SEQ ID NO: 1060737 - DNA, 19 bp, Homo sapiens
ttctgcaactagccaaggc

SEQ ID NO: 1060738 - DNA, 22 bp, Homo sapiens
ttctgcaagaattaaaactgag

SEQ ID NO: 1060739 - DNA, 21 bp, Homo sapiens
ttctgcaagcacatctgcatt

SEQ ID NO: 1060740 - DNA, 12 bp, Homo sapiens
ttctgcaccctc

SEQ ID NO: 1060741 - DNA, 13 bp, Homo sapiens
ttctgcaccctcc

SEQ ID NO: 1060742 - DNA, 22 bp, Homo sapiens
ttctgcagcatgacctgtgacc

SEQ ID NO: 1060743 - DNA, 19 bp, Homo sapiens
ttctgcagcccttgggcag

SEQ ID NO: 1060744 - DNA, 23 bp, Homo sapiens
ttctgcaggttgaagccatgtct

SEQ ID NO: 1060745 - DNA, 20 bp, Homo sapiens
ttctttacaaaacaaactca

SEQ ID NO: 1060746 - DNA, 14 bp, Homo sapiens
ttctttacctgaga

SEQ ID NO: 1060747 - DNA, 21 bp, Homo sapiens
ttctttagagattataacaaa

SEQ ID NO: 1060748 - DNA, 18 bp, Homo sapiens
ttctttagaggctttcaa

SEQ ID NO: 1060749 - DNA, 21 bp, Homo sapiens
ttctttagcatttttatgcag

SEQ ID NO: 1060750 - DNA, 13 bp, Homo sapiens
ttctttataaaat

SEQ ID NO: 1060751 - DNA, 18 bp, Homo sapiens
ttctttattctgcggtga

SEQ ID NO: 1060752 - DNA, 14 bp, Homo sapiens
ttctttattgcact

SEQ ID NO: 1060753 - DNA, 18 bp, Homo sapiens
ttctttatttttgttaat

SEQ ID NO: 1060754 - DNA, 22 bp, Homo sapiens
ttctttcacttgatgtttgtta

SEQ ID NO: 1060755 - DNA, 21 bp, Homo sapiens
ttctttccaaagtacactgtt

SEQ ID NO: 1060756 - DNA, 22 bp, Homo sapiens
ttctttccagtatggaaggatt

SEQ ID NO: 1060757 - DNA, 12 bp, Homo sapiens
ttctttccctgg

SEQ ID NO: 1060758 - DNA, 13 bp, Homo sapiens
ttctttccctgga

SEQ ID NO: 1060759 - DNA, 13 bp, Homo sapiens
ttctttcctccca

SEQ ID NO: 1060760 - DNA, 21 bp, Homo sapiens
ttctttcctccccctgcaact

SEQ ID NO: 1060761 - DNA, 22 bp, Homo sapiens
ttctttcctcttccccttgccc

SEQ ID NO: 1060762 - DNA, 16 bp, Homo sapiens
ttctttctatttgact

SEQ ID NO: 1060763 - DNA, 15 bp, Homo sapiens
ttctttctcactaaa

SEQ ID NO: 1060764 - DNA, 12 bp, Homo sapiens
ttctttctggac

SEQ ID NO: 1060765 - DNA, 13 bp, Homo sapiens
ttctttctggact

SEQ ID NO: 1060766 - DNA, 17 bp, Homo sapiens
ttctttctggctatgca

SEQ ID NO: 1060767 - DNA, 20 bp, Homo sapiens
ttctttctggctatgcattt

SEQ ID NO: 1060768 - DNA, 22 bp, Homo sapiens
ttctttctggctatgcatttga

SEQ ID NO: 1060769 - DNA, 9 bp, Homo sapiens
ttctttctt

SEQ ID NO: 1060770 - DNA, 13 bp, Homo sapiens
ttctttcttcctc

SEQ ID NO: 1060771 - DNA, 14 bp, Homo sapiens
ttctttcttcctct

SEQ ID NO: 1060772 - DNA, 15 bp, Homo sapiens
ttctttcttcctctg

SEQ ID NO: 1060773 - DNA, 15 bp, Homo sapiens
ttctttgaaattgtt

SEQ ID NO: 1060774 - DNA, 17 bp, Homo sapiens
ttctttgagactgggtc

SEQ ID NO: 1060775 - DNA, 18 bp, Homo sapiens
ttctttgatctggacaga

SEQ ID NO: 1060776 - DNA, 17 bp, Homo sapiens
ttctttgatttgtacca

SEQ ID NO: 1060777 - DNA, 21 bp, Homo sapiens
ttctttgcaccaaagacatca

SEQ ID NO: 1060778 - DNA, 16 bp, Homo sapiens
ttctttggaaagtaca

SEQ ID NO: 1060779 - DNA, 22 bp, Homo sapiens
ttctttggaatgaaattcctcc

SEQ ID NO: 1060780 - DNA, 23 bp, Homo sapiens
ttctttggaatgaaattcctcct

SEQ ID NO: 1060781 - DNA, 16 bp, Homo sapiens
ttctttggagttaaaa

SEQ ID NO: 1060782 - DNA, 16 bp, Homo sapiens
ttctttggtaattttt

SEQ ID NO: 1060783 - DNA, 15 bp, Homo sapiens
ttctttggttgtgaa

SEQ ID NO: 1060784 - DNA, 10 bp, Homo sapiens
ttctttgtgt

SEQ ID NO: 1060785 - DNA, 19 bp, Homo sapiens
ttctttgtgtagctttgct

SEQ ID NO: 1060786 - DNA, 14 bp, Homo sapiens
ttcttttaaacata

SEQ ID NO: 1060787 - DNA, 18 bp, Homo sapiens
ttcttttaagtatacaac

SEQ ID NO: 1060788 - DNA, 14 bp, Homo sapiens
ttcttttcatcaaa

SEQ ID NO: 1060789 - DNA, 18 bp, Homo sapiens
ttcttttccaagctcctt

SEQ ID NO: 1060790 - DNA, 16 bp, Homo sapiens
ttcttttccattgtca

SEQ ID NO: 1060791 - DNA, 22 bp, Homo sapiens
ttcttttcccttaaatacagat

SEQ ID NO: 1060792 - DNA, 17 bp, Homo sapiens
ttcttttctatttttta

SEQ ID NO: 1060793 - DNA, 15 bp, Homo sapiens
ttcttttgaactgtt

SEQ ID NO: 1060794 - DNA, 22 bp, Homo sapiens
ttcttttgaactgttagatgct

SEQ ID NO: 1060795 - DNA, 23 bp, Homo sapiens
ttcttttgaactgttagatgctg

SEQ ID NO: 1060796 - DNA, 15 bp, Homo sapiens
ttcttttgaattgtt

SEQ ID NO: 1060797 - DNA, 17 bp, Homo sapiens
ttcttttgccaactgaa

SEQ ID NO: 1060798 - DNA, 21 bp, Homo sapiens
ttcttttgcccttcacagtgt

SEQ ID NO: 1060799 - DNA, 23 bp, Homo sapiens
ttcttttgcccttcacagtgttt

SEQ ID NO: 1060800 - DNA, 13 bp, Homo sapiens
ttcttttggtaaa

SEQ ID NO: 1060801 - DNA, 15 bp, Homo sapiens
ttcttttgtaaagag

SEQ ID NO: 1060802 - DNA, 16 bp, Homo sapiens
ttcttttgtaattgtg

SEQ ID NO: 1060803 - DNA, 14 bp, Homo sapiens
ttcttttgtctccc

SEQ ID NO: 1060804 - DNA, 18 bp, Homo sapiens
ttctttttaaagtttgtt

SEQ ID NO: 1060805 - DNA, 13 bp, Homo sapiens
ttctttttaaatt

SEQ ID NO: 1060806 - DNA, 20 bp, Homo sapiens
ttctttttacagcattgtct

SEQ ID NO: 1060807 - DNA, 12 bp, Homo sapiens
ttctttttcatc

SEQ ID NO: 1060808 - DNA, 14 bp, Homo sapiens
ttctttttctggac

SEQ ID NO: 1060809 - DNA, 17 bp, Homo sapiens
ttcttttttaaattaat

SEQ ID NO: 1060810 - DNA, 23 bp, Homo sapiens
ttcttttttatgcagaatttgat

SEQ ID NO: 1060811 - DNA, 16 bp, Homo sapiens
ttcttttttatgtgat

SEQ ID NO: 1060812 - DNA, 18 bp, Homo sapiens
ttctttttttccttttta

SEQ ID NO: 1060813 - DNA, 17 bp, Homo sapiens
ttctttttttctgtcag

SEQ ID NO: 1060814 - DNA, 23 bp, Homo sapiens
ttctttttttttttttttgaaag

SEQ ID NO: 1060815 - DNA, 20 bp, Homo sapiens
ttgaaaaaaacttcattctc

SEQ ID NO: 1060816 - DNA, 20 bp, Homo sapiens
ttgaaaaaatagagcctgag

SEQ ID NO: 1060817 - DNA, 12 bp, Homo sapiens
ttgaaaaacaaa

SEQ ID NO: 1060818 - DNA, 13 bp, Homo sapiens
ttgaaaaactttt

SEQ ID NO: 1060819 - DNA, 18 bp, Homo sapiens
ttgaaaaatattgctaaa

SEQ ID NO: 1060820 - DNA, 14 bp, Homo sapiens
ttgaaaacaattca

SEQ ID NO: 1060821 - DNA, 18 bp, Homo sapiens
ttgaaaacaattcagtgg

SEQ ID NO: 1060822 - DNA, 18 bp, Homo sapiens
ttgaaaacataatctgca

SEQ ID NO: 1060823 - DNA, 19 bp, Homo sapiens
ttgaaaactgtgcaacttt

SEQ ID NO: 1060824 - DNA, 13 bp, Homo sapiens
ttgaaaacttcaa

SEQ ID NO: 1060825 - DNA, 14 bp, Homo sapiens
ttgaaaacttcaaa

SEQ ID NO: 1060826 - DNA, 19 bp, Homo sapiens
ttgaaaagaccaagacttt

SEQ ID NO: 1060827 - DNA, 16 bp, Homo sapiens
ttgaaaagcacagagg

SEQ ID NO: 1060828 - DNA, 12 bp, Homo sapiens
ttgaaaagctga

SEQ ID NO: 1060829 - DNA, 16 bp, Homo sapiens
ttgaaaaggtgacctt

SEQ ID NO: 1060830 - DNA, 23 bp, Homo sapiens
ttgaaaaggtgtccttttccttt

SEQ ID NO: 1060831 - DNA, 12 bp, Homo sapiens
ttgaaaagtatt

SEQ ID NO: 1060832 - DNA, 23 bp, Homo sapiens
ttgaaaataaatcttagtgttca

SEQ ID NO: 1060833 - DNA, 15 bp, Homo sapiens
ttgaaaatcttgtgt

SEQ ID NO: 1060834 - DNA, 22 bp, Homo sapiens
ttgaaaatggtttcaagttatt

SEQ ID NO: 1060835 - DNA, 17 bp, Homo sapiens
ttgaaaatgtttatgcc

SEQ ID NO: 1060836 - DNA, 18 bp, Homo sapiens
ttgaaaatgttttggaac

SEQ ID NO: 1060837 - DNA, 14 bp, Homo sapiens
ttgaaaattttact

SEQ ID NO: 1060838 - DNA, 12 bp, Homo sapiens
ttgaaacaaagt

SEQ ID NO: 1060839 - DNA, 14 bp, Homo sapiens
ttgaaacagcctgg

SEQ ID NO: 1060840 - DNA, 19 bp, Homo sapiens
ttgaaaccaccttttatta

SEQ ID NO: 1060841 - DNA, 13 bp, Homo sapiens
ttgaaactaaaat

SEQ ID NO: 1060842 - DNA, 22 bp, Homo sapiens
ttgaaactgtaaatatgtttgt

SEQ ID NO: 1060843 - DNA, 18 bp, Homo sapiens
ttgaaagaagtattaaaa

SEQ ID NO: 1060844 - DNA, 21 bp, Homo sapiens
ttgaaagaccagatccttaga

SEQ ID NO: 1060845 - DNA, 17 bp, Homo sapiens
ttgaaagagaaccagtt

SEQ ID NO: 1060846 - DNA, 14 bp, Homo sapiens
ttgaaagagttaag

SEQ ID NO: 1060847 - DNA, 15 bp, Homo sapiens
ttgaattgtaactgt

SEQ ID NO: 1060848 - DNA, 23 bp, Homo sapiens
ttgaattgtgtattgatgcaata

SEQ ID NO: 1060849 - DNA, 13 bp, Homo sapiens
ttgaattgttaca

SEQ ID NO: 1060850 - DNA, 14 bp, Homo sapiens
ttgaattgttacat

SEQ ID NO: 1060851 - DNA, 17 bp, Homo sapiens
ttgaattgttatgaaaa

SEQ ID NO: 1060852 - DNA, 14 bp, Homo sapiens
ttgaatttaaataa

SEQ ID NO: 1060853 - DNA, 14 bp, Homo sapiens
ttgaattttctgtg

SEQ ID NO: 1060854 - DNA, 17 bp, Homo sapiens
ttgaatttttcctatgc

SEQ ID NO: 1060855 - DNA, 14 bp, Homo sapiens
ttgaatttttctct

SEQ ID NO: 1060856 - DNA, 16 bp, Homo sapiens
ttgaattttttgaaat

SEQ ID NO: 1060857 - DNA, 17 bp, Homo sapiens
ttgacaaaagtaaatgg

SEQ ID NO: 1060858 - DNA, 16 bp, Homo sapiens
ttgacaaaatttgttg

SEQ ID NO: 1060859 - DNA, 14 bp, Homo sapiens
ttgacaaagtgcct

SEQ ID NO: 1060860 - DNA, 16 bp, Homo sapiens
ttgacaaagtgcctca

SEQ ID NO: 1060861 - DNA, 16 bp, Homo sapiens
ttgacaaccatgagac

SEQ ID NO: 1060862 - DNA, 17 bp, Homo sapiens
ttgacaaggaaaatcta

SEQ ID NO: 1060863 - DNA, 22 bp, Homo sapiens
ttgacaagtcattttaacttta

SEQ ID NO: 1060864 - DNA, 19 bp, Homo sapiens
ttgacaattactcaggttt

SEQ ID NO: 1060865 - DNA, 19 bp, Homo sapiens
ttgacaattcctagataaa

SEQ ID NO: 1060866 - DNA, 16 bp, Homo sapiens
ttgacaattgggagct

SEQ ID NO: 1060867 - DNA, 17 bp, Homo sapiens
ttgacacaagtggacct

SEQ ID NO: 1060868 - DNA, 17 bp, Homo sapiens
ttgacacaccagttttg

SEQ ID NO: 1060869 - DNA, 16 bp, Homo sapiens
ttgacacagaaaatgt

SEQ ID NO: 1060870 - DNA, 18 bp, Homo sapiens
ttgacacatatgaacaca

SEQ ID NO: 1060871 - DNA, 16 bp, Homo sapiens
ttgacacctagattat

SEQ ID NO: 1060872 - DNA, 12 bp, Homo sapiens
ttgacactgaaa

SEQ ID NO: 1060873 - DNA, 15 bp, Homo sapiens
ttgacactgctctaa

SEQ ID NO: 1060874 - DNA, 13 bp, Homo sapiens
ttgacactggtat

SEQ ID NO: 1060875 - DNA, 12 bp, Homo sapiens
ttgacactgttt

SEQ ID NO: 1060876 - DNA, 13 bp, Homo sapiens
ttgacactgtttt

SEQ ID NO: 1060877 - DNA, 14 bp, Homo sapiens
ttgacactgttttc

SEQ ID NO: 1060878 - DNA, 18 bp, Homo sapiens
ttgacactgttttcctta

SEQ ID NO: 1060879 - DNA, 19 bp, Homo sapiens
ttgacactttttgtatttt

SEQ ID NO: 1060880 - DNA, 17 bp, Homo sapiens
ttgacagctttgctgct

SEQ ID NO: 1060881 - DNA, 19 bp, Homo sapiens
ttgacaggattattggaaa

SEQ ID NO: 1060882 - DNA, 15 bp, Homo sapiens
ttgacagttctgaag

SEQ ID NO: 1060883 - DNA, 18 bp, Homo sapiens
ttgacagttctgaagaat

SEQ ID NO: 1060884 - DNA, 19 bp, Homo sapiens
ttgacataaagttgataaa

SEQ ID NO: 1060885 - DNA, 20 bp, Homo sapiens
ttgacataacactataaagg

SEQ ID NO: 1060886 - DNA, 18 bp, Homo sapiens
ttgacatatttaatgttt

SEQ ID NO: 1060887 - DNA, 22 bp, Homo sapiens
ttgacatcagttcctttgtgtg

SEQ ID NO: 1060888 - DNA, 17 bp, Homo sapiens
ttgacatgaccctctgt

SEQ ID NO: 1060889 - DNA, 15 bp, Homo sapiens
ttgacatgggtattt

SEQ ID NO: 1060890 - DNA, 11 bp, Homo sapiens
ttgacatgtga

SEQ ID NO: 1060891 - DNA, 14 bp, Homo sapiens
ttgacatgtggaaa

SEQ ID NO: 1060892 - DNA, 22 bp, Homo sapiens
ttgacatgtggaaagtgaattt

SEQ ID NO: 1060893 - DNA, 13 bp, Homo sapiens
ttgacattctgaa

SEQ ID NO: 1060894 - DNA, 15 bp, Homo sapiens
ttgacattctgaatg

SEQ ID NO: 1060895 - DNA, 14 bp, Homo sapiens
ttgacattgcgttt

SEQ ID NO: 1060896 - DNA, 16 bp, Homo sapiens
ttgacatttagaactt

SEQ ID NO: 1060897 - DNA, 12 bp, Homo sapiens
ttgacattttct

SEQ ID NO: 1060898 - DNA, 15 bp, Homo sapiens
ttgaccaagaactgc

SEQ ID NO: 1060899 - DNA, 21 bp, Homo sapiens
ttgaccaagaactgcatggac

SEQ ID NO: 1060900 - DNA, 15 bp, Homo sapiens
ttgaccattggctgc

SEQ ID NO: 1060901 - DNA, 17 bp, Homo sapiens
ttgaccattttagtttt

SEQ ID NO: 1060902 - DNA, 21 bp, Homo sapiens
ttgaccattttgttaaaatct

SEQ ID NO: 1060903 - DNA, 17 bp, Homo sapiens
ttgaccccgatatattt

SEQ ID NO: 1060904 - DNA, 15 bp, Homo sapiens
ttgaccctgcaccct

SEQ ID NO: 1060905 - DNA, 17 bp, Homo sapiens
ttgaccctgcaccctcc

SEQ ID NO: 1060906 - DNA, 20 bp, Homo sapiens
ttgaccgtttttatattact

SEQ ID NO: 1060907 - DNA, 16 bp, Homo sapiens
ttgacctctgcagcaa

SEQ ID NO: 1060908 - DNA, 19 bp, Homo sapiens
ttgacctgaggctgtggtc

SEQ ID NO: 1060909 - DNA, 16 bp, Homo sapiens
ttgacctgctccgctg

SEQ ID NO: 1060910 - DNA, 15 bp, Homo sapiens
ttgacctgtcctctt

SEQ ID NO: 1060911 - DNA, 12 bp, Homo sapiens
ttgaccttcccc

SEQ ID NO: 1060912 - DNA, 23 bp, Homo sapiens
ttgaccttctccctcactcctgc

SEQ ID NO: 1060913 - DNA, 17 bp, Homo sapiens
ttgacctttgaggtcta

SEQ ID NO: 1060914 - DNA, 21 bp, Homo sapiens
ttgacctttgaggtctaaaca

SEQ ID NO: 1060915 - DNA, 21 bp, Homo sapiens
ttgaccttttatgtagtaatt

SEQ ID NO: 1060916 - DNA, 20 bp, Homo sapiens
ttgacggatgattggattat

SEQ ID NO: 1060917 - DNA, 13 bp, Homo sapiens
ttgactaaataaa

SEQ ID NO: 1060918 - DNA, 15 bp, Homo sapiens
ttgactaattttaca

SEQ ID NO: 1060919 - DNA, 19 bp, Homo sapiens
ttgactcacctgttacttg

SEQ ID NO: 1060920 - DNA, 17 bp, Homo sapiens
ttgactctaaatgcagt

SEQ ID NO: 1060921 - DNA, 22 bp, Homo sapiens
ttgactctcacactgaatcagc

SEQ ID NO: 1060922 - DNA, 15 bp, Homo sapiens
ttgactcttttgcca

SEQ ID NO: 1060923 - DNA, 22 bp, Homo sapiens
ttgactgactgagcaggctgtg

SEQ ID NO: 1060924 - DNA, 13 bp, Homo sapiens
ttgactgcagttg

SEQ ID NO: 1060925 - DNA, 22 bp, Homo sapiens
ttgactgggcaacactgcagga

SEQ ID NO: 1060926 - DNA, 20 bp, Homo sapiens
ttgactgtctagccactccc

SEQ ID NO: 1060927 - DNA, 17 bp, Homo sapiens
ttgacttaggtttttag

SEQ ID NO: 1060928 - DNA, 23 bp, Homo sapiens
ttgacttcagctgcctgaaacag

SEQ ID NO: 1060929 - DNA, 16 bp, Homo sapiens
ttgacttcttgcttca

SEQ ID NO: 1060930 - DNA, 16 bp, Homo sapiens
ttgacttgattagtgc

SEQ ID NO: 1060931 - DNA, 22 bp, Homo sapiens
ttgactttacgcccatctcagg

SEQ ID NO: 1060932 - DNA, 19 bp, Homo sapiens
ttgactttcaaaatatatt

SEQ ID NO: 1060933 - DNA, 21 bp, Homo sapiens
ttgactttcaggtactaaata

SEQ ID NO: 1060934 - DNA, 15 bp, Homo sapiens
ttgactttcttaaaa

SEQ ID NO: 1060935 - DNA, 13 bp, Homo sapiens
ttgactttgtaat

SEQ ID NO: 1060936 - DNA, 17 bp, Homo sapiens
ttgactttttgcattta

SEQ ID NO: 1060937 - DNA, 13 bp, Homo sapiens
ttgactttttgga

SEQ ID NO: 1060938 - DNA, 17 bp, Homo sapiens
ttgactttttttgtatg

SEQ ID NO: 1060939 - DNA, 17 bp, Homo sapiens
ttgagaaaataaagcta

SEQ ID NO: 1060940 - DNA, 14 bp, Homo sapiens
ttgagaaaatataa

SEQ ID NO: 1060941 - DNA, 17 bp, Homo sapiens
ttgagaaaatataataa

SEQ ID NO: 1060942 - DNA, 10 bp, Homo sapiens
ttgagaaacc

SEQ ID NO: 1060943 - DNA, 22 bp, Homo sapiens
ttgagaaaccttattgtacctc

SEQ ID NO: 1060944 - DNA, 23 bp, Homo sapiens
ttgagaaaccttattgtacctct

SEQ ID NO: 1060945 - DNA, 23 bp, Homo sapiens
ttgagaaccagtctcctcactct

SEQ ID NO: 1060946 - DNA, 17 bp, Homo sapiens
ttgagaagataatcatt

SEQ ID NO: 1060947 - DNA, 22 bp, Homo sapiens
ttgagaagataatcattgctta

SEQ ID NO: 1060948 - DNA, 19 bp, Homo sapiens
ttgagaagccttcagctcc

SEQ ID NO: 1060949 - DNA, 20 bp, Homo sapiens
ttgagaagtctaattcacag

SEQ ID NO: 1060950 - DNA, 22 bp, Homo sapiens
ttgagaatcccttaaaattacc

SEQ ID NO: 1060951 - DNA, 17 bp, Homo sapiens
ttgagaattttgtttca

SEQ ID NO: 1060952 - DNA, 23 bp, Homo sapiens
ttgagacaaatcctttctgcccc

SEQ ID NO: 1060953 - DNA, 16 bp, Homo sapiens
ttgagacaagccctgg

SEQ ID NO: 1060954 - DNA, 14 bp, Homo sapiens
ttgagacctcagcc

SEQ ID NO: 1060955 - DNA, 15 bp, Homo sapiens
ttgagacctcagcca

SEQ ID NO: 1060956 - DNA, 14 bp, Homo sapiens
ttgagactagtttt

SEQ ID NO: 1060957 - DNA, 13 bp, Homo sapiens
ttgagactcccca

SEQ ID NO: 1060958 - DNA, 23 bp, Homo sapiens
ttgagactgagtctctctctgtt

SEQ ID NO: 1060959 - DNA, 13 bp, Homo sapiens
ttgagagtgtgac

SEQ ID NO: 1060960 - DNA, 15 bp, Homo sapiens
ttgagagtgtgacca

SEQ ID NO: 1060961 - DNA, 18 bp, Homo sapiens
ttgagagttttgtcttga

SEQ ID NO: 1060962 - DNA, 16 bp, Homo sapiens
ttgagataaagtcaaa

SEQ ID NO: 1060963 - DNA, 21 bp, Homo sapiens
ttgagatactattttcatttt

SEQ ID NO: 1060964 - DNA, 17 bp, Homo sapiens
ttgagatagaagaactg

SEQ ID NO: 1060965 - DNA, 10 bp, Homo sapiens
ttgagatgcc

SEQ ID NO: 1060966 - DNA, 17 bp, Homo sapiens
ttgagatgtatgaaggc

SEQ ID NO: 1060967 - DNA, 12 bp, Homo sapiens
ttgagattagag

SEQ ID NO: 1060968 - DNA, 11 bp, Homo sapiens
ttgagatttct

SEQ ID NO: 1060969 - DNA, 21 bp, Homo sapiens
ttgagatttttaagaacttca

SEQ ID NO: 1060970 - DNA, 14 bp, Homo sapiens
ttgagcagaattca

SEQ ID NO: 1060971 - DNA, 14 bp, Homo sapiens
ttgagcatcaatct

SEQ ID NO: 1060972 - DNA, 19 bp, Homo sapiens
ttgagcatgcacagctgct

SEQ ID NO: 1060973 - DNA, 22 bp, Homo sapiens
ttgagcatgcacagctgcttgt

SEQ ID NO: 1060974 - DNA, 13 bp, Homo sapiens
ttgagccaggcct

SEQ ID NO: 1060975 - DNA, 17 bp, Homo sapiens
ttgagccaggcctgggt

SEQ ID NO: 1060976 - DNA, 18 bp, Homo sapiens
ttgagccagtaatcttta

SEQ ID NO: 1060977 - DNA, 19 bp, Homo sapiens
ttgagccatgctacagtta

SEQ ID NO: 1060978 - DNA, 11 bp, Homo sapiens
ttgagcccagg

SEQ ID NO: 1060979 - DNA, 13 bp, Homo sapiens
ttgagcccaggag

SEQ ID NO: 1060980 - DNA, 19 bp, Homo sapiens
ttgagcccattcttctggg

SEQ ID NO: 1060981 - DNA, 20 bp, Homo sapiens
ttgagccgggcccctgggct

SEQ ID NO: 1060982 - DNA, 11 bp, Homo sapiens
ttgagcctggg

SEQ ID NO: 1060983 - DNA, 18 bp, Homo sapiens
ttgagcctgtgaccttgg

SEQ ID NO: 1060984 - DNA, 15 bp, Homo sapiens
ttgagccttgaactt

SEQ ID NO: 1060985 - DNA, 15 bp, Homo sapiens
ttgagctctctgccc

SEQ ID NO: 1060986 - DNA, 18 bp, Homo sapiens
ttgagctctgtaacttac

SEQ ID NO: 1060987 - DNA, 19 bp, Homo sapiens
ttgagctctgtaacttaca

SEQ ID NO: 1060988 - DNA, 14 bp, Homo sapiens
ttgagctggtaaca

SEQ ID NO: 1060989 - DNA, 12 bp, Homo sapiens
ttgagctgtttt

SEQ ID NO: 1060990 - DNA, 16 bp, Homo sapiens
ttgagcttaatctttg

SEQ ID NO: 1060991 - DNA, 14 bp, Homo sapiens
ttgagctttccatg

SEQ ID NO: 1060992 - DNA, 21 bp, Homo sapiens
ttgagctttccatgttgctgc

SEQ ID NO: 1060993 - DNA, 20 bp, Homo sapiens
ttgaggaagtggctgtccct

SEQ ID NO: 1060994 - DNA, 17 bp, Homo sapiens
ttgaggagttgcctgac

SEQ ID NO: 1060995 - DNA, 21 bp, Homo sapiens
ttgaggataaaaaggaaggag

SEQ ID NO: 1060996 - DNA, 19 bp, Homo sapiens
ttgaggatgggatgtattt

SEQ ID NO: 1060997 - DNA, 18 bp, Homo sapiens
ttgaggattgtggaaaac

SEQ ID NO: 1060998 - DNA, 21 bp, Homo sapiens
ttgaggccaagaatattgcaa

SEQ ID NO: 1060999 - DNA, 22 bp, Homo sapiens
ttgaggcccccgtcagggagag

SEQ ID NO: 1061000 - DNA, 16 bp, Homo sapiens
ttgaggcctgacgtgg

SEQ ID NO: 1061001 - DNA, 17 bp, Homo sapiens
ttgaggctctgtcactg

SEQ ID NO: 1061002 - DNA, 21 bp, Homo sapiens
ttgaggctctgtcactgagca

SEQ ID NO: 1061003 - DNA, 18 bp, Homo sapiens
ttgaggctttaaaaagaa

SEQ ID NO: 1061004 - DNA, 12 bp, Homo sapiens
ttgagggagggc

SEQ ID NO: 1061005 - DNA, 19 bp, Homo sapiens
ttgagggcccagagcagga

SEQ ID NO: 1061006 - DNA, 15 bp, Homo sapiens
ttgaggggattaata

SEQ ID NO: 1061007 - DNA, 16 bp, Homo sapiens
ttgaggggattaatat

SEQ ID NO: 1061008 - DNA, 18 bp, Homo sapiens
ttgaggggccaggggcag

SEQ ID NO: 1061009 - DNA, 19 bp, Homo sapiens
ttgaggggccctggccagg

SEQ ID NO: 1061010 - DNA, 19 bp, Homo sapiens
ttgaggtctttctcctcag

SEQ ID NO: 1061011 - DNA, 20 bp, Homo sapiens
ttgaggtctttctcctcagg

SEQ ID NO: 1061012 - DNA, 22 bp, Homo sapiens
ttgaggtcttttgacatgtgga

SEQ ID NO: 1061013 - DNA, 22 bp, Homo sapiens
ttgaggtgggtgggcctgactg

SEQ ID NO: 1061014 - DNA, 18 bp, Homo sapiens
ttgagtacagtgaggagg

SEQ ID NO: 1061015 - DNA, 15 bp, Homo sapiens
ttgagtatcacttta

SEQ ID NO: 1061016 - DNA, 18 bp, Homo sapiens
ttgagtatcactttaact

SEQ ID NO: 1061017 - DNA, 17 bp, Homo sapiens
ttgagtcaaaagcctgg

SEQ ID NO: 1061018 - DNA, 12 bp, Homo sapiens
ttgagtcagaaa

SEQ ID NO: 1061019 - DNA, 22 bp, Homo sapiens
ttgagtcattatccttgctatg

SEQ ID NO: 1061020 - DNA, 20 bp, Homo sapiens
ttgagtcctaggacttaaaa

SEQ ID NO: 1061021 - DNA, 12 bp, Homo sapiens
ttgagtccttgt

SEQ ID NO: 1061022 - DNA, 22 bp, Homo sapiens
ttgagtctcaagggtggcaggt

SEQ ID NO: 1061023 - DNA, 20 bp, Homo sapiens
ttgagtcttaactgtatttc

SEQ ID NO: 1061024 - DNA, 21 bp, Homo sapiens
ttgagtgacagctttctggga

SEQ ID NO: 1061025 - DNA, 20 bp, Homo sapiens
ttgagtgactcgagggttgg

SEQ ID NO: 1061026 - DNA, 15 bp, Homo sapiens
ttgagtgagccggga

SEQ ID NO: 1061027 - DNA, 14 bp, Homo sapiens
ttgagtgctctgat

SEQ ID NO: 1061028 - DNA, 18 bp, Homo sapiens
ttgagtgctgggggaggc

SEQ ID NO: 1061029 - DNA, 23 bp, Homo sapiens
ttgagtgggccctgcccggggag

SEQ ID NO: 1061030 - DNA, 17 bp, Homo sapiens
ttgagtgtacagatttt

SEQ ID NO: 1061031 - DNA, 13 bp, Homo sapiens
ttgagtgtactgt

SEQ ID NO: 1061032 - DNA, 12 bp, Homo sapiens
ttgagtgtgtgt

SEQ ID NO: 1061033 - DNA, 13 bp, Homo sapiens
ttgagtgtttaaa

SEQ ID NO: 1061034 - DNA, 20 bp, Homo sapiens
ttgagttgattcagctctgc

SEQ ID NO: 1061035 - DNA, 15 bp, Homo sapiens
ttgagttgctctgtc

SEQ ID NO: 1061036 - DNA, 14 bp, Homo sapiens
ttgagttggctgtg

SEQ ID NO: 1061037 - DNA, 14 bp, Homo sapiens
ttgagttttcagtg

SEQ ID NO: 1061038 - DNA, 15 bp, Homo sapiens
ttgagtttttcctcc

SEQ ID NO: 1061039 - DNA, 23 bp, Homo sapiens
ttgagtttttcctcccagtgaga

SEQ ID NO: 1061040 - DNA, 16 bp, Homo sapiens
ttgataaaaacccaaa

SEQ ID NO: 1061041 - DNA, 22 bp, Homo sapiens
ttgataaaaacccaaaatacag

SEQ ID NO: 1061042 - DNA, 15 bp, Homo sapiens
ttgataaaaatactg

SEQ ID NO: 1061043 - DNA, 12 bp, Homo sapiens
ttgataaagtaa

SEQ ID NO: 1061044 - DNA, 13 bp, Homo sapiens
ttgataaatatat

SEQ ID NO: 1061045 - DNA, 22 bp, Homo sapiens
ttgataacaatgacactagaaa

SEQ ID NO: 1061046 - DNA, 21 bp, Homo sapiens
ttgataagctattgtctgtaa

SEQ ID NO: 1061047 - DNA, 22 bp, Homo sapiens
ttgataagctattgtctgtaat

SEQ ID NO: 1061048 - DNA, 17 bp, Homo sapiens
ttgataatatatattaa

SEQ ID NO: 1061049 - DNA, 21 bp, Homo sapiens
ttgataatatatattaagtgt

SEQ ID NO: 1061050 - DNA, 15 bp, Homo sapiens
ttgataatcttcagg

SEQ ID NO: 1061051 - DNA, 15 bp, Homo sapiens
ttgataatgctttca

SEQ ID NO: 1061052 - DNA, 14 bp, Homo sapiens
ttgataatttcagg

SEQ ID NO: 1061053 - DNA, 17 bp, Homo sapiens
ttgatacaaaccactgt

SEQ ID NO: 1061054 - DNA, 22 bp, Homo sapiens
ttgatacaaaccactgtgaaca

SEQ ID NO: 1061055 - DNA, 21 bp, Homo sapiens
ttgatacaaatgtttataact

SEQ ID NO: 1061056 - DNA, 17 bp, Homo sapiens
ttgatacattcaaattt

SEQ ID NO: 1061057 - DNA, 12 bp, Homo sapiens
ttgatagaacta

SEQ ID NO: 1061058 - DNA, 14 bp, Homo sapiens
ttgatagaagataa

SEQ ID NO: 1061059 - DNA, 14 bp, Homo sapiens
ttgatagctttatt

SEQ ID NO: 1061060 - DNA, 19 bp, Homo sapiens
ttgatagtcctgacctcat

SEQ ID NO: 1061061 - DNA, 13 bp, Homo sapiens
ttgatataatctt

SEQ ID NO: 1061062 - DNA, 14 bp, Homo sapiens
ttgatatacattgt

SEQ ID NO: 1061063 - DNA, 15 bp, Homo sapiens
ttgatatacattgtg

SEQ ID NO: 1061064 - DNA, 13 bp, Homo sapiens
ttgatataccaaa

SEQ ID NO: 1061065 - DNA, 20 bp, Homo sapiens
ttgatatacttttttcttat

SEQ ID NO: 1061066 - DNA, 21 bp, Homo sapiens
ttgatatacttttttcttatt

SEQ ID NO: 1061067 - DNA, 16 bp, Homo sapiens
ttgatatcgtgaaatc

SEQ ID NO: 1061068 - DNA, 14 bp, Homo sapiens
ttgatattgaagga

SEQ ID NO: 1061069 - DNA, 20 bp, Homo sapiens
ttgatattttccctttttaa

SEQ ID NO: 1061070 - DNA, 14 bp, Homo sapiens
ttgatatttttcca

SEQ ID NO: 1061071 - DNA, 20 bp, Homo sapiens
ttgatatttttccatttatt

SEQ ID NO: 1061072 - DNA, 14 bp, Homo sapiens
ttgatcacattgtt

SEQ ID NO: 1061073 - DNA, 14 bp, Homo sapiens
ttgatcagtataat

SEQ ID NO: 1061074 - DNA, 18 bp, Homo sapiens
ttgatcatccctttctcc

SEQ ID NO: 1061075 - DNA, 16 bp, Homo sapiens
ttgatcatgtactttt

SEQ ID NO: 1061076 - DNA, 18 bp, Homo sapiens
ttgatcattttcccccca

SEQ ID NO: 1061077 - DNA, 19 bp, Homo sapiens
ttgatcattttccccccac

SEQ ID NO: 1061078 - DNA, 22 bp, Homo sapiens
ttgatcattttccccccactct

SEQ ID NO: 1061079 - DNA, 22 bp, Homo sapiens
ttgatcatttttatatgaaata

SEQ ID NO: 1061080 - DNA, 22 bp, Homo sapiens
ttgatcccagaaagtatatact

SEQ ID NO: 1061081 - DNA, 23 bp, Homo sapiens
ttgatcccagaaagtatatactg

SEQ ID NO: 1061082 - DNA, 13 bp, Homo sapiens
ttgatccttggaa

SEQ ID NO: 1061083 - DNA, 14 bp, Homo sapiens
ttgatccttggaaa

SEQ ID NO: 1061084 - DNA, 16 bp, Homo sapiens
ttgatccttggaaacc

SEQ ID NO: 1061085 - DNA, 17 bp, Homo sapiens
ttgcaatctaatctgaa

SEQ ID NO: 1061086 - DNA, 19 bp, Homo sapiens
ttgcaattaaacttccaaa

SEQ ID NO: 1061087 - DNA, 15 bp, Homo sapiens
ttgcaattcatgtaa

SEQ ID NO: 1061088 - DNA, 17 bp, Homo sapiens
ttgcaattcatgtaaca

SEQ ID NO: 1061089 - DNA, 18 bp, Homo sapiens
ttgcaattcatgtaacag

SEQ ID NO: 1061090 - DNA, 16 bp, Homo sapiens
ttgcaattgctcttct

SEQ ID NO: 1061091 - DNA, 16 bp, Homo sapiens
ttgcacacccactgcc

SEQ ID NO: 1061092 - DNA, 13 bp, Homo sapiens
ttgcacacttccc

SEQ ID NO: 1061093 - DNA, 13 bp, Homo sapiens
ttgcacacttgtg

SEQ ID NO: 1061094 - DNA, 14 bp, Homo sapiens
ttgcacagaatttg

SEQ ID NO: 1061095 - DNA, 19 bp, Homo sapiens
ttgcacagccaaatttaaa

SEQ ID NO: 1061096 - DNA, 17 bp, Homo sapiens
ttgcacagtcaaaacga

SEQ ID NO: 1061097 - DNA, 21 bp, Homo sapiens
ttgcacagtcactgctcttca

SEQ ID NO: 1061098 - DNA, 19 bp, Homo sapiens
ttgcacatggattcagttt

SEQ ID NO: 1061099 - DNA, 16 bp, Homo sapiens
ttgcacatgtttcctc

SEQ ID NO: 1061100 - DNA, 14 bp, Homo sapiens
ttgcacattgttca

SEQ ID NO: 1061101 - DNA, 15 bp, Homo sapiens
ttgcaccactgcact

SEQ ID NO: 1061102 - DNA, 22 bp, Homo sapiens
ttgcacccctcactctggcctc

SEQ ID NO: 1061103 - DNA, 13 bp, Homo sapiens
ttgcacccctccc

SEQ ID NO: 1061104 - DNA, 14 bp, Homo sapiens
ttgcacccctccca

SEQ ID NO: 1061105 - DNA, 15 bp, Homo sapiens
ttgcacccctcccat

SEQ ID NO: 1061106 - DNA, 18 bp, Homo sapiens
ttgcacctgtccccaccc

SEQ ID NO: 1061107 - DNA, 15 bp, Homo sapiens
ttgcacctttctagt

SEQ ID NO: 1061108 - DNA, 17 bp, Homo sapiens
ttgcacgacgccctctc

SEQ ID NO: 1061109 - DNA, 15 bp, Homo sapiens
ttgcacgtggcctct

SEQ ID NO: 1061110 - DNA, 15 bp, Homo sapiens
ttgcactaaagtatg

SEQ ID NO: 1061111 - DNA, 16 bp, Homo sapiens
ttgcactaggaattct

SEQ ID NO: 1061112 - DNA, 21 bp, Homo sapiens
ttgcactaggaattctttgca

SEQ ID NO: 1061113 - DNA, 23 bp, Homo sapiens
ttgcactaggaattctttgcatt

SEQ ID NO: 1061114 - DNA, 15 bp, Homo sapiens
ttgcactcctcacac

SEQ ID NO: 1061115 - DNA, 16 bp, Homo sapiens
ttgcactgaatatata

SEQ ID NO: 1061116 - DNA, 12 bp, Homo sapiens
ttgcactgaggg

SEQ ID NO: 1061117 - DNA, 16 bp, Homo sapiens
ttgcactgagggccac

SEQ ID NO: 1061118 - DNA, 15 bp, Homo sapiens
ttgcactgccccctg

SEQ ID NO: 1061119 - DNA, 13 bp, Homo sapiens
ttgcactgctgtt

SEQ ID NO: 1061120 - DNA, 20 bp, Homo sapiens
ttgcacttgtgattatttat

SEQ ID NO: 1061121 - DNA, 17 bp, Homo sapiens
ttgcactttagacattt

SEQ ID NO: 1061122 - DNA, 20 bp, Homo sapiens
ttgcagaaaagcacctgccg

SEQ ID NO: 1061123 - DNA, 19 bp, Homo sapiens
ttgcagaaaattctgtgcc

SEQ ID NO: 1061124 - DNA, 13 bp, Homo sapiens
ttgcagaagaggg

SEQ ID NO: 1061125 - DNA, 18 bp, Homo sapiens
ttgcagaaggaaatgatg

SEQ ID NO: 1061126 - DNA, 14 bp, Homo sapiens
ttgcagatgtattg

SEQ ID NO: 1061127 - DNA, 15 bp, Homo sapiens
ttgcagatgtattga

SEQ ID NO: 1061128 - DNA, 14 bp, Homo sapiens
ttgcagattttctt

SEQ ID NO: 1061129 - DNA, 12 bp, Homo sapiens
ttgcagcagggc

SEQ ID NO: 1061130 - DNA, 13 bp, Homo sapiens
ttgcagcatgaga

SEQ ID NO: 1061131 - DNA, 17 bp, Homo sapiens
ttgcagccaggagaagg

SEQ ID NO: 1061132 - DNA, 21 bp, Homo sapiens
ttgcagcccttgtgatgtgat

SEQ ID NO: 1061133 - DNA, 22 bp, Homo sapiens
ttgcagcctgctctagtgggac

SEQ ID NO: 1061134 - DNA, 12 bp, Homo sapiens
ttgcagctgttt

SEQ ID NO: 1061135 - DNA, 18 bp, Homo sapiens
ttgcagctgttttgttga

SEQ ID NO: 1061136 - DNA, 21 bp, Homo sapiens
ttgcagctgttttgttgacat

SEQ ID NO: 1061137 - DNA, 19 bp, Homo sapiens
ttgcaggattcccttctgg

SEQ ID NO: 1061138 - DNA, 21 bp, Homo sapiens
ttgcaggcggccctcagtgca

SEQ ID NO: 1061139 - DNA, 13 bp, Homo sapiens
ttgcaggctctgg

SEQ ID NO: 1061140 - DNA, 18 bp, Homo sapiens
ttgcaggctctgggctca

SEQ ID NO: 1061141 - DNA, 20 bp, Homo sapiens
ttgcaggctctgggctcagg

SEQ ID NO: 1061142 - DNA, 16 bp, Homo sapiens
ttgcagggcacagatg

SEQ ID NO: 1061143 - DNA, 17 bp, Homo sapiens
ttgcagggcacagatga

SEQ ID NO: 1061144 - DNA, 16 bp, Homo sapiens
ttgcaggttcatggat

SEQ ID NO: 1061145 - DNA, 13 bp, Homo sapiens
ttgcagtaactgt

SEQ ID NO: 1061146 - DNA, 16 bp, Homo sapiens
ttgcagtatgatggca

SEQ ID NO: 1061147 - DNA, 14 bp, Homo sapiens
ttgcagtcatagaa

SEQ ID NO: 1061148 - DNA, 23 bp, Homo sapiens
ttgcagtcgtgtaattggcccaa

SEQ ID NO: 1061149 - DNA, 20 bp, Homo sapiens
ttgcagtgagcagggtgggg

SEQ ID NO: 1061150 - DNA, 17 bp, Homo sapiens
ttgcagtggcttttcat

SEQ ID NO: 1061151 - DNA, 16 bp, Homo sapiens
ttgcagttgtgatata

SEQ ID NO: 1061152 - DNA, 19 bp, Homo sapiens
ttgcagtttatcattcaag

SEQ ID NO: 1061153 - DNA, 21 bp, Homo sapiens
ttgcagtttcatgtatgtata

SEQ ID NO: 1061154 - DNA, 15 bp, Homo sapiens
ttgcagttttgtaag

SEQ ID NO: 1061155 - DNA, 19 bp, Homo sapiens
ttgcagttttgtaagccct

SEQ ID NO: 1061156 - DNA, 13 bp, Homo sapiens
ttgcataaattaa

SEQ ID NO: 1061157 - DNA, 22 bp, Homo sapiens
ttgcataagattaaaggaagga

SEQ ID NO: 1061158 - DNA, 15 bp, Homo sapiens
ttgcataataagcta

SEQ ID NO: 1061159 - DNA, 21 bp, Homo sapiens
ttgcataataagctaaagagg

SEQ ID NO: 1061160 - DNA, 16 bp, Homo sapiens
ttgcatactgagccaa

SEQ ID NO: 1061161 - DNA, 15 bp, Homo sapiens
ttgcatagctctcct

SEQ ID NO: 1061162 - DNA, 23 bp, Homo sapiens
ttgcatagtaccaatcattttaa

SEQ ID NO: 1061163 - DNA, 12 bp, Homo sapiens
ttgcatatagat

SEQ ID NO: 1061164 - DNA, 21 bp, Homo sapiens
ttgcatatagatttagttttg

SEQ ID NO: 1061165 - DNA, 18 bp, Homo sapiens
ttgcatccaactccagga

SEQ ID NO: 1061166 - DNA, 15 bp, Homo sapiens
ttgcatccattgttg

SEQ ID NO: 1061167 - DNA, 16 bp, Homo sapiens
ttgcatcctatttggt

SEQ ID NO: 1061168 - DNA, 20 bp, Homo sapiens
ttgcatctcccagataatgt

SEQ ID NO: 1061169 - DNA, 17 bp, Homo sapiens
ttgcatctgaccccggg

SEQ ID NO: 1061170 - DNA, 18 bp, Homo sapiens
ttgcatctgggtagctgt

SEQ ID NO: 1061171 - DNA, 13 bp, Homo sapiens
ttgcatctgtata

SEQ ID NO: 1061172 - DNA, 19 bp, Homo sapiens
ttgcatctgtataagtaag

SEQ ID NO: 1061173 - DNA, 11 bp, Homo sapiens
ttgcatgaaat

SEQ ID NO: 1061174 - DNA, 16 bp, Homo sapiens
ttgcatgaagagaagc

SEQ ID NO: 1061175 - DNA, 18 bp, Homo sapiens
ttgcatgaattactgtat

SEQ ID NO: 1061176 - DNA, 22 bp, Homo sapiens
ttgcatgaattactgtatataa

SEQ ID NO: 1061177 - DNA, 13 bp, Homo sapiens
ttgcatgatatct

SEQ ID NO: 1061178 - DNA, 18 bp, Homo sapiens
ttgcatgattcttctctt

SEQ ID NO: 1061179 - DNA, 21 bp, Homo sapiens
ttgcatggcagggcctcatct

SEQ ID NO: 1061180 - DNA, 17 bp, Homo sapiens
ttgcatgggctaatgaa

SEQ ID NO: 1061181 - DNA, 17 bp, Homo sapiens
ttgcatgtagtaacact

SEQ ID NO: 1061182 - DNA, 16 bp, Homo sapiens
ttgcatgtcgcacaat

SEQ ID NO: 1061183 - DNA, 19 bp, Homo sapiens
ttgcatgtcgcacaatgtt

SEQ ID NO: 1061184 - DNA, 15 bp, Homo sapiens
ttgcatgtggatcaa

SEQ ID NO: 1061185 - DNA, 13 bp, Homo sapiens
ttgcattaaattc

SEQ ID NO: 1061186 - DNA, 22 bp, Homo sapiens
ttgcattaaattcacaaacttt

SEQ ID NO: 1061187 - DNA, 13 bp, Homo sapiens
ttgcattccagaa

SEQ ID NO: 1061188 - DNA, 14 bp, Homo sapiens
ttgcattccagaat

SEQ ID NO: 1061189 - DNA, 17 bp, Homo sapiens
ttgcattccagaatctt

SEQ ID NO: 1061190 - DNA, 21 bp, Homo sapiens
ttgcattccagaatcttgact

SEQ ID NO: 1061191 - DNA, 18 bp, Homo sapiens
ttgcattccttacttgca

SEQ ID NO: 1061192 - DNA, 22 bp, Homo sapiens
ttgcattccttacttgcactgt

SEQ ID NO: 1061193 - DNA, 14 bp, Homo sapiens
ttgcattgaacaca

SEQ ID NO: 1061194 - DNA, 17 bp, Homo sapiens
ttgcattgaatatatta

SEQ ID NO: 1061195 - DNA, 15 bp, Homo sapiens
ttgcattgtctgtct

SEQ ID NO: 1061196 - DNA, 21 bp, Homo sapiens
ttgcatttaaaacagacactg

SEQ ID NO: 1061197 - DNA, 17 bp, Homo sapiens
ttgcatttaaacatgtt

SEQ ID NO: 1061198 - DNA, 19 bp, Homo sapiens
ttgcatttaaacatgttta

SEQ ID NO: 1061199 - DNA, 14 bp, Homo sapiens
ttgcatttactttt

SEQ ID NO: 1061200 - DNA, 15 bp, Homo sapiens
ttgcatttagaactt

SEQ ID NO: 1061201 - DNA, 17 bp, Homo sapiens
ttgcctctttctccagc

SEQ ID NO: 1061202 - DNA, 16 bp, Homo sapiens
ttgcctgaactccaga

SEQ ID NO: 1061203 - DNA, 22 bp, Homo sapiens
ttgcctgagaagaagtggctgc

SEQ ID NO: 1061204 - DNA, 23 bp, Homo sapiens
ttgcctgatttgttttcattata

SEQ ID NO: 1061205 - DNA, 20 bp, Homo sapiens
ttgcctgcagagagaagcct

SEQ ID NO: 1061206 - DNA, 22 bp, Homo sapiens
ttgcctgcagtttcttgtgtag

SEQ ID NO: 1061207 - DNA, 15 bp, Homo sapiens
ttgcctgccctcctg

SEQ ID NO: 1061208 - DNA, 13 bp, Homo sapiens
ttgcctgcctcct

SEQ ID NO: 1061209 - DNA, 14 bp, Homo sapiens
ttgcctgcctccta

SEQ ID NO: 1061210 - DNA, 14 bp, Homo sapiens
ttgcctggaataaa

SEQ ID NO: 1061211 - DNA, 17 bp, Homo sapiens
ttgcctggaataaaata

SEQ ID NO: 1061212 - DNA, 12 bp, Homo sapiens
ttgcctggctgt

SEQ ID NO: 1061213 - DNA, 16 bp, Homo sapiens
ttgcctggctgtggag

SEQ ID NO: 1061214 - DNA, 21 bp, Homo sapiens
ttgcctggctgtggaggcctg

SEQ ID NO: 1061215 - DNA, 12 bp, Homo sapiens
ttgcctggtaca

SEQ ID NO: 1061216 - DNA, 15 bp, Homo sapiens
ttgcctggtacagta

SEQ ID NO: 1061217 - DNA, 19 bp, Homo sapiens
ttgcctgtaacaagccaga

SEQ ID NO: 1061218 - DNA, 15 bp, Homo sapiens
ttgcctgtaagaaaa

SEQ ID NO: 1061219 - DNA, 12 bp, Homo sapiens
ttgctgaaactg

SEQ ID NO: 1061220 - DNA, 14 bp, Homo sapiens
ttgctgaaagatct

SEQ ID NO: 1061221 - DNA, 11 bp, Homo sapiens
ttgctgaaatt

SEQ ID NO: 1061222 - DNA, 14 bp, Homo sapiens
ttgctgaactcagc

SEQ ID NO: 1061223 - DNA, 14 bp, Homo sapiens
ttgctgaccccagg

SEQ ID NO: 1061224 - DNA, 15 bp, Homo sapiens
ttgctgaccccaggt

SEQ ID NO: 1061225 - DNA, 20 bp, Homo sapiens
ttgctgaccccaggtcagcc

SEQ ID NO: 1061226 - DNA, 20 bp, Homo sapiens
ttgctgactactactctgcc

SEQ ID NO: 1061227 - DNA, 11 bp, Homo sapiens
ttgctgagact

SEQ ID NO: 1061228 - DNA, 11 bp, Homo sapiens
ttgctgagagc

SEQ ID NO: 1061229 - DNA, 19 bp, Homo sapiens
ttgctgaggggcagggaga

SEQ ID NO: 1061230 - DNA, 16 bp, Homo sapiens
ttgctgagttgttcta

SEQ ID NO: 1061231 - DNA, 17 bp, Homo sapiens
ttgctgagttgttctaa

SEQ ID NO: 1061232 - DNA, 22 bp, Homo sapiens
ttgctgatggcttgacatgtgc

SEQ ID NO: 1061233 - DNA, 14 bp, Homo sapiens
ttgctgatttctag

SEQ ID NO: 1061234 - DNA, 14 bp, Homo sapiens
ttgctgcaaagaga

SEQ ID NO: 1061235 - DNA, 17 bp, Homo sapiens
ttgctgcaaagagaaac

SEQ ID NO: 1061236 - DNA, 18 bp, Homo sapiens
ttgctgcacagcaggacc

SEQ ID NO: 1061237 - DNA, 19 bp, Homo sapiens
ttgctgcacagcaggacct

SEQ ID NO: 1061238 - DNA, 17 bp, Homo sapiens
ttgctgcactcttgcac

SEQ ID NO: 1061239 - DNA, 12 bp, Homo sapiens
ttgctgcagaga

SEQ ID NO: 1061240 - DNA, 14 bp, Homo sapiens
ttgctgcaggccct

SEQ ID NO: 1061241 - DNA, 15 bp, Homo sapiens
ttgctgcattttaca

SEQ ID NO: 1061242 - DNA, 18 bp, Homo sapiens
ttgctgccaaaaccacat

SEQ ID NO: 1061243 - DNA, 21 bp, Homo sapiens
ttggaaattaggttgaaacat

SEQ ID NO: 1061244 - DNA, 14 bp, Homo sapiens
ttggaacatttctt

SEQ ID NO: 1061245 - DNA, 23 bp, Homo sapiens
ttggaacatttctttcttgctgg

SEQ ID NO: 1061246 - DNA, 13 bp, Homo sapiens
ttggaaccaaagt

SEQ ID NO: 1061247 - DNA, 14 bp, Homo sapiens
ttggaactctactc

SEQ ID NO: 1061248 - DNA, 16 bp, Homo sapiens
ttggaagaaaaaatct

SEQ ID NO: 1061249 - DNA, 20 bp, Homo sapiens
ttggaagaagttttttactt

SEQ ID NO: 1061250 - DNA, 22 bp, Homo sapiens
ttggaagaagttttttactttg

SEQ ID NO: 1061251 - DNA, 20 bp, Homo sapiens
ttggaagaccccacccaagc

SEQ ID NO: 1061252 - DNA, 21 bp, Homo sapiens
ttggaagagaggcacctgctg

SEQ ID NO: 1061253 - DNA, 23 bp, Homo sapiens
ttggaagagaggcacctgctgga

SEQ ID NO: 1061254 - DNA, 22 bp, Homo sapiens
ttggaagatggcataacctgtc

SEQ ID NO: 1061255 - DNA, 13 bp, Homo sapiens
ttggaaggagcag

SEQ ID NO: 1061256 - DNA, 22 bp, Homo sapiens
ttggaagtgcagtcagcagatg

SEQ ID NO: 1061257 - DNA, 19 bp, Homo sapiens
ttggaagtttgtgttctgt

SEQ ID NO: 1061258 - DNA, 16 bp, Homo sapiens
ttggaagttttcagga

SEQ ID NO: 1061259 - DNA, 13 bp, Homo sapiens
ttggaatactttt

SEQ ID NO: 1061260 - DNA, 15 bp, Homo sapiens
ttggaataggaataa

SEQ ID NO: 1061261 - DNA, 17 bp, Homo sapiens
ttggaatattaaaaaac

SEQ ID NO: 1061262 - DNA, 23 bp, Homo sapiens
ttggaatattaaaaaacttcatg

SEQ ID NO: 1061263 - DNA, 15 bp, Homo sapiens
ttggaatatttgaat

SEQ ID NO: 1061264 - DNA, 18 bp, Homo sapiens
ttggaatattttatcctg

SEQ ID NO: 1061265 - DNA, 22 bp, Homo sapiens
ttggaatctagccgatggaaaa

SEQ ID NO: 1061266 - DNA, 16 bp, Homo sapiens
ttggaatcttttataa

SEQ ID NO: 1061267 - DNA, 20 bp, Homo sapiens
ttggaatgaaattcctcctt

SEQ ID NO: 1061268 - DNA, 23 bp, Homo sapiens
ttggaatgactggggagggctgc

SEQ ID NO: 1061269 - DNA, 22 bp, Homo sapiens
ttggaatgcagaggtctccaaa

SEQ ID NO: 1061270 - DNA, 17 bp, Homo sapiens
ttggaatgttctcagat

SEQ ID NO: 1061271 - DNA, 20 bp, Homo sapiens
ttggaattaacctggtgctg

SEQ ID NO: 1061272 - DNA, 17 bp, Homo sapiens
ttggaattcgctttcta

SEQ ID NO: 1061273 - DNA, 18 bp, Homo sapiens
ttggaattctactggaaa

SEQ ID NO: 1061274 - DNA, 22 bp, Homo sapiens
ttggaatttgtaacctcagctc

SEQ ID NO: 1061275 - DNA, 19 bp, Homo sapiens
ttggacaaatcacatattt

SEQ ID NO: 1061276 - DNA, 22 bp, Homo sapiens
ttggacagacactgttgcaaag

SEQ ID NO: 1061277 - DNA, 13 bp, Homo sapiens
ttggacagccccc

SEQ ID NO: 1061278 - DNA, 20 bp, Homo sapiens
ttggacatggaaagaaaagt

SEQ ID NO: 1061279 - DNA, 17 bp, Homo sapiens
ttggaccacatctcttt

SEQ ID NO: 1061280 - DNA, 18 bp, Homo sapiens
ttggaccagtttgcagag

SEQ ID NO: 1061281 - DNA, 21 bp, Homo sapiens
ttggacccagggcctgacttg

SEQ ID NO: 1061282 - DNA, 16 bp, Homo sapiens
ttggaccccagctggg

SEQ ID NO: 1061283 - DNA, 15 bp, Homo sapiens
ttggacccgctctgg

SEQ ID NO: 1061284 - DNA, 17 bp, Homo sapiens
ttggacccgctctggac

SEQ ID NO: 1061285 - DNA, 18 bp, Homo sapiens
ttggaccctggtgacctc

SEQ ID NO: 1061286 - DNA, 16 bp, Homo sapiens
ttggacccttccatgg

SEQ ID NO: 1061287 - DNA, 17 bp, Homo sapiens
ttggacctaatccaagc

SEQ ID NO: 1061288 - DNA, 14 bp, Homo sapiens
ttggacctccaggg

SEQ ID NO: 1061289 - DNA, 22 bp, Homo sapiens
ttggacctccaggggctcctgg

SEQ ID NO: 1061290 - DNA, 13 bp, Homo sapiens
ttggacctctgct

SEQ ID NO: 1061291 - DNA, 17 bp, Homo sapiens
ttggacggctgggcaca

SEQ ID NO: 1061292 - DNA, 12 bp, Homo sapiens
ttggactatgga

SEQ ID NO: 1061293 - DNA, 13 bp, Homo sapiens
ttggactattata

SEQ ID NO: 1061294 - DNA, 14 bp, Homo sapiens
ttggactcctccca

SEQ ID NO: 1061295 - DNA, 16 bp, Homo sapiens
ttggactcttgctctt

SEQ ID NO: 1061296 - DNA, 14 bp, Homo sapiens
ttggactgacattt

SEQ ID NO: 1061297 - DNA, 15 bp, Homo sapiens
ttggactgacattta

SEQ ID NO: 1061298 - DNA, 15 bp, Homo sapiens
ttggactgttttcaa

SEQ ID NO: 1061299 - DNA, 22 bp, Homo sapiens
ttggacttttcgttaacattga

SEQ ID NO: 1061300 - DNA, 14 bp, Homo sapiens
ttggagaaattatt

SEQ ID NO: 1061301 - DNA, 22 bp, Homo sapiens
ttggagaaccagggctcttctc

SEQ ID NO: 1061302 - DNA, 19 bp, Homo sapiens
ttggagaacgccagtctcc

SEQ ID NO: 1061303 - DNA, 18 bp, Homo sapiens
ttggagaaggttatcaaa

SEQ ID NO: 1061304 - DNA, 16 bp, Homo sapiens
ttggagaatactttgc

SEQ ID NO: 1061305 - DNA, 22 bp, Homo sapiens
ttggagaccctgcaaacagaac

SEQ ID NO: 1061306 - DNA, 15 bp, Homo sapiens
ttggagactctgtgg

SEQ ID NO: 1061307 - DNA, 19 bp, Homo sapiens
ttggagagcaaaggcccat

SEQ ID NO: 1061308 - DNA, 15 bp, Homo sapiens
ttggagagcagcagg

SEQ ID NO: 1061309 - DNA, 15 bp, Homo sapiens
ttggagagcagctgg

SEQ ID NO: 1061310 - DNA, 12 bp, Homo sapiens
ttggagagccct

SEQ ID NO: 1061311 - DNA, 20 bp, Homo sapiens
ttggagagtaaaaactgaat

SEQ ID NO: 1061312 - DNA, 17 bp, Homo sapiens
ttggagatggcaggaga

SEQ ID NO: 1061313 - DNA, 23 bp, Homo sapiens
ttggagcacctgggccccactgg

SEQ ID NO: 1061314 - DNA, 11 bp, Homo sapiens
ttggagccact

SEQ ID NO: 1061315 - DNA, 21 bp, Homo sapiens
ttggagcctcccttctgcctt

SEQ ID NO: 1061316 - DNA, 22 bp, Homo sapiens
ttggcattggaattctactgga

SEQ ID NO: 1061317 - DNA, 11 bp, Homo sapiens
ttggcatttct

SEQ ID NO: 1061318 - DNA, 13 bp, Homo sapiens
ttggcatttctat

SEQ ID NO: 1061319 - DNA, 21 bp, Homo sapiens
ttggcatttgttatcctcttg

SEQ ID NO: 1061320 - DNA, 20 bp, Homo sapiens
ttggccaaacatcagacctg

SEQ ID NO: 1061321 - DNA, 14 bp, Homo sapiens
ttggccactccgag

SEQ ID NO: 1061322 - DNA, 12 bp, Homo sapiens
ttggccactggg

SEQ ID NO: 1061323 - DNA, 20 bp, Homo sapiens
ttggccactgggtctcactc

SEQ ID NO: 1061324 - DNA, 22 bp, Homo sapiens
ttggccagaaaccttcctgctg

SEQ ID NO: 1061325 - DNA, 21 bp, Homo sapiens
ttggccagattgtggggtgca

SEQ ID NO: 1061326 - DNA, 12 bp, Homo sapiens
ttggccaggctg

SEQ ID NO: 1061327 - DNA, 12 bp, Homo sapiens
ttggccagggag

SEQ ID NO: 1061328 - DNA, 13 bp, Homo sapiens
ttggccagggagg

SEQ ID NO: 1061329 - DNA, 20 bp, Homo sapiens
ttggccagtgagaagctgag

SEQ ID NO: 1061330 - DNA, 17 bp, Homo sapiens
ttggccatttgctagtt

SEQ ID NO: 1061331 - DNA, 19 bp, Homo sapiens
ttggcccaagtcattgttt

SEQ ID NO: 1061332 - DNA, 11 bp, Homo sapiens
ttggcccagcg

SEQ ID NO: 1061333 - DNA, 17 bp, Homo sapiens
ttggccccactttgaag

SEQ ID NO: 1061334 - DNA, 15 bp, Homo sapiens
ttggcccccgagctg

SEQ ID NO: 1061335 - DNA, 16 bp, Homo sapiens
ttggcccccgagctgg

SEQ ID NO: 1061336 - DNA, 12 bp, Homo sapiens
ttggcccctcac

SEQ ID NO: 1061337 - DNA, 10 bp, Homo sapiens
ttggccctgg

SEQ ID NO: 1061338 - DNA, 14 bp, Homo sapiens
ttggccctggagcc

SEQ ID NO: 1061339 - DNA, 14 bp, Homo sapiens
ttggcccttccagt

SEQ ID NO: 1061340 - DNA, 14 bp, Homo sapiens
ttggccctttcctt

SEQ ID NO: 1061341 - DNA, 16 bp, Homo sapiens
ttggccgagctcctgg

SEQ ID NO: 1061342 - DNA, 19 bp, Homo sapiens
ttggccgagctcctgggga

SEQ ID NO: 1061343 - DNA, 22 bp, Homo sapiens
ttggccgggtgcggtggctcac

SEQ ID NO: 1061344 - DNA, 12 bp, Homo sapiens
ttggcctcagaa

SEQ ID NO: 1061345 - DNA, 17 bp, Homo sapiens
ttggcctcccctgctga

SEQ ID NO: 1061346 - DNA, 13 bp, Homo sapiens
ttggcctccggcc

SEQ ID NO: 1061347 - DNA, 12 bp, Homo sapiens
ttggcctggagg

SEQ ID NO: 1061348 - DNA, 16 bp, Homo sapiens
ttggcctggaggtggg

SEQ ID NO: 1061349 - DNA, 21 bp, Homo sapiens
ttggcctgtttgatgtatgtg

SEQ ID NO: 1061350 - DNA, 14 bp, Homo sapiens
ttggccttaagaac

SEQ ID NO: 1061351 - DNA, 21 bp, Homo sapiens
ttggccttaagaactgtgtct

SEQ ID NO: 1061352 - DNA, 15 bp, Homo sapiens
ttggcctttccttgt

SEQ ID NO: 1061353 - DNA, 16 bp, Homo sapiens
ttggcgctctcagctt

SEQ ID NO: 1061354 - DNA, 17 bp, Homo sapiens
ttggcgctctcagcttt

SEQ ID NO: 1061355 - DNA, 14 bp, Homo sapiens
ttggcgggccaagg

SEQ ID NO: 1061356 - DNA, 19 bp, Homo sapiens
ttggcgtagcagagttaaa

SEQ ID NO: 1061357 - DNA, 21 bp, Homo sapiens
ttggctatgaaaatgagccct

SEQ ID NO: 1061358 - DNA, 23 bp, Homo sapiens
ttggctatgaaaatgagccctgg

SEQ ID NO: 1061359 - DNA, 16 bp, Homo sapiens
ttggctatttaaaact

SEQ ID NO: 1061360 - DNA, 17 bp, Homo sapiens
ttggctcaataaagatt

SEQ ID NO: 1061361 - DNA, 14 bp, Homo sapiens
ttggctcaatcctc

SEQ ID NO: 1061362 - DNA, 12 bp, Homo sapiens
ttggctcaccca

SEQ ID NO: 1061363 - DNA, 22 bp, Homo sapiens
ttggctcacccaagcaaggcca

SEQ ID NO: 1061364 - DNA, 15 bp, Homo sapiens
ttggctcaggcagac

SEQ ID NO: 1061365 - DNA, 20 bp, Homo sapiens
ttggctcaggcagacaagag

SEQ ID NO: 1061366 - DNA, 15 bp, Homo sapiens
ttggctcccgggggc

SEQ ID NO: 1061367 - DNA, 20 bp, Homo sapiens
ttggctcgaatctctgtgcc

SEQ ID NO: 1061368 - DNA, 21 bp, Homo sapiens
ttggctcgaatctctgtgcct

SEQ ID NO: 1061369 - DNA, 15 bp, Homo sapiens
ttggctctcccaccc

SEQ ID NO: 1061370 - DNA, 16 bp, Homo sapiens
ttggctctcccacccc

SEQ ID NO: 1061371 - DNA, 14 bp, Homo sapiens
ttggctctctgacg

SEQ ID NO: 1061372 - DNA, 18 bp, Homo sapiens
ttggctgacccctctggt

SEQ ID NO: 1061373 - DNA, 22 bp, Homo sapiens
ttggctgacccctctggtgtgt

SEQ ID NO: 1061374 - DNA, 17 bp, Homo sapiens
ttggctgagtactggaa

SEQ ID NO: 1061375 - DNA, 19 bp, Homo sapiens
ttggctgagtactggaata

SEQ ID NO: 1061376 - DNA, 16 bp, Homo sapiens
ttggctgcagccatcc

SEQ ID NO: 1061377 - DNA, 11 bp, Homo sapiens
ttggctgcagg

SEQ ID NO: 1061378 - DNA, 19 bp, Homo sapiens
ttggctgcgctaaccccca

SEQ ID NO: 1061379 - DNA, 20 bp, Homo sapiens
ttggctgcgctaacccccag

SEQ ID NO: 1061380 - DNA, 20 bp, Homo sapiens
ttggctgggctacaatttgt

SEQ ID NO: 1061381 - DNA, 16 bp, Homo sapiens
ttggctggtagcagca

SEQ ID NO: 1061382 - DNA, 19 bp, Homo sapiens
ttggctggtagcagcaggc

SEQ ID NO: 1061383 - DNA, 21 bp, Homo sapiens
ttggctgtccttccccttccc

SEQ ID NO: 1061384 - DNA, 18 bp, Homo sapiens
ttggctgtgacctcttca

SEQ ID NO: 1061385 - DNA, 21 bp, Homo sapiens
ttgtgatagcactttctacaa

SEQ ID NO: 1061386 - DNA, 23 bp, Homo sapiens
ttgtgatcagaccataatgttac

SEQ ID NO: 1061387 - DNA, 20 bp, Homo sapiens
ttgtgatgaatcaatgaaaa

SEQ ID NO: 1061388 - DNA, 16 bp, Homo sapiens
ttgtgatgatgctgtg

SEQ ID NO: 1061389 - DNA, 19 bp, Homo sapiens
ttgtgatgatgctgtgaca

SEQ ID NO: 1061390 - DNA, 18 bp, Homo sapiens
ttgtgatgtcccaacttg

SEQ ID NO: 1061391 - DNA, 22 bp, Homo sapiens
ttgtgatgtcccaacttgtaaa

SEQ ID NO: 1061392 - DNA, 17 bp, Homo sapiens
ttgtgatttttgtaatt

SEQ ID NO: 1061393 - DNA, 22 bp, Homo sapiens
ttgtgcaaaagcttcaaattaa

SEQ ID NO: 1061394 - DNA, 18 bp, Homo sapiens
ttgtgcaatgtaaatatt

SEQ ID NO: 1061395 - DNA, 23 bp, Homo sapiens
ttgtgcacttagtagtttttaca

SEQ ID NO: 1061396 - DNA, 17 bp, Homo sapiens
ttgtgcatgtatgtata

SEQ ID NO: 1061397 - DNA, 16 bp, Homo sapiens
ttgtgcatgtttactt

SEQ ID NO: 1061398 - DNA, 17 bp, Homo sapiens
ttgtgcattctttggta

SEQ ID NO: 1061399 - DNA, 22 bp, Homo sapiens
ttgtgcattctttggtaatttt

SEQ ID NO: 1061400 - DNA, 12 bp, Homo sapiens
ttgtgcatttgg

SEQ ID NO: 1061401 - DNA, 23 bp, Homo sapiens
ttgtgccaaacctactaggccat

SEQ ID NO: 1061402 - DNA, 13 bp, Homo sapiens
ttgtgccaagcct

SEQ ID NO: 1061403 - DNA, 20 bp, Homo sapiens
ttgtgccacacgcatgggca

SEQ ID NO: 1061404 - DNA, 13 bp, Homo sapiens
ttgtgccagagga

SEQ ID NO: 1061405 - DNA, 10 bp, Homo sapiens
ttgtgccagc

SEQ ID NO: 1061406 - DNA, 17 bp, Homo sapiens
ttgtgccccttcactca

SEQ ID NO: 1061407 - DNA, 11 bp, Homo sapiens
ttgtgcctccc

SEQ ID NO: 1061408 - DNA, 16 bp, Homo sapiens
ttgtgcctcccttccc

SEQ ID NO: 1061409 - DNA, 14 bp, Homo sapiens
ttgtgcctctgccc

SEQ ID NO: 1061410 - DNA, 16 bp, Homo sapiens
ttgtgccttttatagc

SEQ ID NO: 1061411 - DNA, 14 bp, Homo sapiens
ttgtgctacagatg

SEQ ID NO: 1061412 - DNA, 14 bp, Homo sapiens
ttgtgctagaatac

SEQ ID NO: 1061413 - DNA, 13 bp, Homo sapiens
ttgtgctataaag

SEQ ID NO: 1061414 - DNA, 14 bp, Homo sapiens
ttgtgctatagtat

SEQ ID NO: 1061415 - DNA, 19 bp, Homo sapiens
ttgtgctatagtatttgat

SEQ ID NO: 1061416 - DNA, 17 bp, Homo sapiens
ttgtgctcgggatcaaa

SEQ ID NO: 1061417 - DNA, 12 bp, Homo sapiens
ttgtgctgccat

SEQ ID NO: 1061418 - DNA, 14 bp, Homo sapiens
ttgtgctgccattt

SEQ ID NO: 1061419 - DNA, 21 bp, Homo sapiens
ttgtgctgggtcccagcctgg

SEQ ID NO: 1061420 - DNA, 22 bp, Homo sapiens
ttgtgctgtgggcagcaccctc

SEQ ID NO: 1061421 - DNA, 13 bp, Homo sapiens
ttgtgctttcctg

SEQ ID NO: 1061422 - DNA, 21 bp, Homo sapiens
ttgtgcttttctgttttcaag

SEQ ID NO: 1061423 - DNA, 13 bp, Homo sapiens
ttgtggaatgttg

SEQ ID NO: 1061424 - DNA, 21 bp, Homo sapiens
ttgtggaattgggagcttggg

SEQ ID NO: 1061425 - DNA, 15 bp, Homo sapiens
ttgtggagaaaaaga

SEQ ID NO: 1061426 - DNA, 14 bp, Homo sapiens
ttgtggagagaatg

SEQ ID NO: 1061427 - DNA, 16 bp, Homo sapiens
ttgtggatgtgttcat

SEQ ID NO: 1061428 - DNA, 18 bp, Homo sapiens
ttgtggcaagtgaatttg

SEQ ID NO: 1061429 - DNA, 19 bp, Homo sapiens
ttgtggccaaggagctgct

SEQ ID NO: 1061430 - DNA, 20 bp, Homo sapiens
ttgtggccaaggagctgcta

SEQ ID NO: 1061431 - DNA, 21 bp, Homo sapiens
ttgtggcccccgccccctccc

SEQ ID NO: 1061432 - DNA, 13 bp, Homo sapiens
ttgtggcctcaga

SEQ ID NO: 1061433 - DNA, 16 bp, Homo sapiens
ttgtggccttttttat

SEQ ID NO: 1061434 - DNA, 17 bp, Homo sapiens
ttgtggcgtctccctcg

SEQ ID NO: 1061435 - DNA, 17 bp, Homo sapiens
ttgtggctatcctgatt

SEQ ID NO: 1061436 - DNA, 19 bp, Homo sapiens
ttgtggctcctatctgtgt

SEQ ID NO: 1061437 - DNA, 16 bp, Homo sapiens
ttgtgggcaaaggcag

SEQ ID NO: 1061438 - DNA, 21 bp, Homo sapiens
ttgtgggcaaaggcagggcca

SEQ ID NO: 1061439 - DNA, 11 bp, Homo sapiens
ttgtgggctgg

SEQ ID NO: 1061440 - DNA, 22 bp, Homo sapiens
ttgtgggcttcctgctgggact

SEQ ID NO: 1061441 - DNA, 20 bp, Homo sapiens
ttgtggggacccaggctccg

SEQ ID NO: 1061442 - DNA, 13 bp, Homo sapiens
ttgtggggccagg

SEQ ID NO: 1061443 - DNA, 12 bp, Homo sapiens
ttgtggggtgca

SEQ ID NO: 1061444 - DNA, 13 bp, Homo sapiens
ttgtgggtgggag

SEQ ID NO: 1061445 - DNA, 17 bp, Homo sapiens
ttgtgggtttctctgtg

SEQ ID NO: 1061446 - DNA, 19 bp, Homo sapiens
ttgtggtgtcccctatcct

SEQ ID NO: 1061447 - DNA, 11 bp, Homo sapiens
ttgtggtgtga

SEQ ID NO: 1061448 - DNA, 13 bp, Homo sapiens
ttgtggttaatct

SEQ ID NO: 1061449 - DNA, 16 bp, Homo sapiens
ttgtggttctatttta

SEQ ID NO: 1061450 - DNA, 20 bp, Homo sapiens
ttgtggttctattttacttt

SEQ ID NO: 1061451 - DNA, 21 bp, Homo sapiens
ttgtgtaaaaaatggaaaaaa

SEQ ID NO: 1061452 - DNA, 13 bp, Homo sapiens
ttgtgtaaatttg

SEQ ID NO: 1061453 - DNA, 21 bp, Homo sapiens
ttgtgtaatagaaaactgaaa

SEQ ID NO: 1061454 - DNA, 15 bp, Homo sapiens
ttgtgtaatatgaaa

SEQ ID NO: 1061455 - DNA, 14 bp, Homo sapiens
ttgtgtaatctaag

SEQ ID NO: 1061456 - DNA, 15 bp, Homo sapiens
ttgtgtacagtgtgt

SEQ ID NO: 1061457 - DNA, 20 bp, Homo sapiens
ttgtgtactgataaaatact

SEQ ID NO: 1061458 - DNA, 14 bp, Homo sapiens
ttgtgtagcctttt

SEQ ID NO: 1061459 - DNA, 15 bp, Homo sapiens
ttgtgtagccttttt

SEQ ID NO: 1061460 - DNA, 16 bp, Homo sapiens
ttgtgtatatatctta

SEQ ID NO: 1061461 - DNA, 16 bp, Homo sapiens
ttgtgtatatattata

SEQ ID NO: 1061462 - DNA, 18 bp, Homo sapiens
ttgtgtatatttgcttca

SEQ ID NO: 1061463 - DNA, 13 bp, Homo sapiens
ttgtgtatgtact

SEQ ID NO: 1061464 - DNA, 14 bp, Homo sapiens
ttgtgtatgtactt

SEQ ID NO: 1061465 - DNA, 20 bp, Homo sapiens
ttgtgtatgtacttagctgt

SEQ ID NO: 1061466 - DNA, 11 bp, Homo sapiens
ttgtgtattga

SEQ ID NO: 1061467 - DNA, 18 bp, Homo sapiens
ttgtgtattgatgcaata

SEQ ID NO: 1061468 - DNA, 21 bp, Homo sapiens
ttgtgtcaatgggcaatgaca

SEQ ID NO: 1061469 - DNA, 21 bp, Homo sapiens
ttgtgtcccaaaatcccctca

SEQ ID NO: 1061470 - DNA, 16 bp, Homo sapiens
ttgtgtccctaatgtg

SEQ ID NO: 1061471 - DNA, 22 bp, Homo sapiens
ttgtgtctcatttagaaacaat

SEQ ID NO: 1061472 - DNA, 23 bp, Homo sapiens
ttgtgtctgtgccctccaaagag

SEQ ID NO: 1061473 - DNA, 14 bp, Homo sapiens
ttgtgtctgttgct

SEQ ID NO: 1061474 - DNA, 18 bp, Homo sapiens
ttgtgtcttttaaactgg

SEQ ID NO: 1061475 - DNA, 18 bp, Homo sapiens
ttgtgtgaaaaaagaaaa

SEQ ID NO: 1061476 - DNA, 19 bp, Homo sapiens
ttgtgtgaaaaaagaaaat

SEQ ID NO: 1061477 - DNA, 18 bp, Homo sapiens
ttgtgtgatccagccctg

SEQ ID NO: 1061478 - DNA, 20 bp, Homo sapiens
ttgtgtgatccagccctggt

SEQ ID NO: 1061479 - DNA, 20 bp, Homo sapiens
ttgtgtgatttcctaaacat

SEQ ID NO: 1061480 - DNA, 15 bp, Homo sapiens
ttgtgtgcttctgct

SEQ ID NO: 1061481 - DNA, 13 bp, Homo sapiens
ttgtgtggattct

SEQ ID NO: 1061482 - DNA, 18 bp, Homo sapiens
ttgtgtgtatatgtattt

SEQ ID NO: 1061483 - DNA, 19 bp, Homo sapiens
ttgtgtgtatatgtattta

SEQ ID NO: 1061484 - DNA, 15 bp, Homo sapiens
ttgttgttctgttaa

SEQ ID NO: 1061485 - DNA, 15 bp, Homo sapiens
ttgttgttgccaaag

SEQ ID NO: 1061486 - DNA, 15 bp, Homo sapiens
ttgttgtttcttgcc

SEQ ID NO: 1061487 - DNA, 14 bp, Homo sapiens
ttgttgtttgccat

SEQ ID NO: 1061488 - DNA, 23 bp, Homo sapiens
ttgttgtttgccatactttgtct

SEQ ID NO: 1061489 - DNA, 21 bp, Homo sapiens
ttgtttaaaaaccgaataaat

SEQ ID NO: 1061490 - DNA, 15 bp, Homo sapiens
ttgtttaaaaagtaa

SEQ ID NO: 1061491 - DNA, 18 bp, Homo sapiens
ttgtttaaaattcagttt

SEQ ID NO: 1061492 - DNA, 15 bp, Homo sapiens
ttgtttaaacaatct

SEQ ID NO: 1061493 - DNA, 16 bp, Homo sapiens
ttgtttaaagaataaa

SEQ ID NO: 1061494 - DNA, 13 bp, Homo sapiens
ttgtttagagaat

SEQ ID NO: 1061495 - DNA, 15 bp, Homo sapiens
ttgtttataataaaa

SEQ ID NO: 1061496 - DNA, 18 bp, Homo sapiens
ttgtttataataaaaata

SEQ ID NO: 1061497 - DNA, 13 bp, Homo sapiens
ttgtttatacaca

SEQ ID NO: 1061498 - DNA, 20 bp, Homo sapiens
ttgtttatacacaactttgc

SEQ ID NO: 1061499 - DNA, 13 bp, Homo sapiens
ttgtttatcaact

SEQ ID NO: 1061500 - DNA, 15 bp, Homo sapiens
ttgtttatgtaattt

SEQ ID NO: 1061501 - DNA, 23 bp, Homo sapiens
ttgtttcaatgaggtgtccaact

SEQ ID NO: 1061502 - DNA, 16 bp, Homo sapiens
ttgtttcaattgcatc

SEQ ID NO: 1061503 - DNA, 17 bp, Homo sapiens
ttgtttccttttttccc

SEQ ID NO: 1061504 - DNA, 13 bp, Homo sapiens
ttgtttctgtcaa

SEQ ID NO: 1061505 - DNA, 15 bp, Homo sapiens
ttgtttctgtgcccc

SEQ ID NO: 1061506 - DNA, 12 bp, Homo sapiens
ttgtttcttaaa

SEQ ID NO: 1061507 - DNA, 15 bp, Homo sapiens
ttgtttcttccaaag

SEQ ID NO: 1061508 - DNA, 16 bp, Homo sapiens
ttgtttcttcttttcc

SEQ ID NO: 1061509 - DNA, 19 bp, Homo sapiens
ttgtttctttctctgagga

SEQ ID NO: 1061510 - DNA, 13 bp, Homo sapiens
ttgtttgaaatgt

SEQ ID NO: 1061511 - DNA, 23 bp, Homo sapiens
ttgtttgatgcattaaaagaaaa

SEQ ID NO: 1061512 - DNA, 15 bp, Homo sapiens
ttgtttgccatactt

SEQ ID NO: 1061513 - DNA, 18 bp, Homo sapiens
ttgtttgcttccattatt

SEQ ID NO: 1061514 - DNA, 21 bp, Homo sapiens
ttgtttggactgttttcaata

SEQ ID NO: 1061515 - DNA, 14 bp, Homo sapiens
ttgtcttttgagct

SEQ ID NO: 1061516 - DNA, 16 bp, Homo sapiens
ttgtctttttcctact

SEQ ID NO: 1061517 - DNA, 21 bp, Homo sapiens
ttgtgaaataaaactggcttt

SEQ ID NO: 1061518 - DNA, 23 bp, Homo sapiens
ttgtgaaatgaaaacatgtaata

SEQ ID NO: 1061519 - DNA, 14 bp, Homo sapiens
ttgtgaaatgatgg

SEQ ID NO: 1061520 - DNA, 17 bp, Homo sapiens
ttgtgaaccaatgcaag

SEQ ID NO: 1061521 - DNA, 19 bp, Homo sapiens
ttgtgaagaattattcagt

SEQ ID NO: 1061522 - DNA, 14 bp, Homo sapiens
ttgtgaagctaatg

SEQ ID NO: 1061523 - DNA, 17 bp, Homo sapiens
ttgtgaatatttggaat

SEQ ID NO: 1061524 - DNA, 18 bp, Homo sapiens
ttgtgaatggtgtctttc

SEQ ID NO: 1061525 - DNA, 17 bp, Homo sapiens
ttgtgacaggaaagccc

SEQ ID NO: 1061526 - DNA, 22 bp, Homo sapiens
ttgtgacaggaaagccctcccc

SEQ ID NO: 1061527 - DNA, 15 bp, Homo sapiens
ttgtgacagtgcctc

SEQ ID NO: 1061528 - DNA, 16 bp, Homo sapiens
ttgtgacattccttct

SEQ ID NO: 1061529 - DNA, 19 bp, Homo sapiens
ttgtgactatatagagatg

SEQ ID NO: 1061530 - DNA, 17 bp, Homo sapiens
ttgtgactcagcagagg

SEQ ID NO: 1061531 - DNA, 16 bp, Homo sapiens
ttgtgacttcactgta

SEQ ID NO: 1061532 - DNA, 23 bp, Homo sapiens
ttgtgagataaaactctcctttt

SEQ ID NO: 1061533 - DNA, 17 bp, Homo sapiens
ttgtgagcctctttgta

SEQ ID NO: 1061534 - DNA, 14 bp, Homo sapiens
ttgtgagttttcta

SEQ ID NO: 1061535 - DNA, 19 bp, Homo sapiens
ttgtgatacaatgctgtgc

SEQ ID NO: 1061536 - DNA, 15 bp, Homo sapiens
ttgtgatagcacttt

SEQ ID NO: 1061537 - DNA, 17 bp, Homo sapiens
ttgtttggcaaggaaag

SEQ ID NO: 1061538 - DNA, 18 bp, Homo sapiens
ttgtttggcaaggaaagg

SEQ ID NO: 1061539 - DNA, 13 bp, Homo sapiens
ttgtttgtacagt

SEQ ID NO: 1061540 - DNA, 13 bp, Homo sapiens
ttgtttgtatgta

SEQ ID NO: 1061541 - DNA, 11 bp, Homo sapiens
ttgtttgtatt

SEQ ID NO: 1061542 - DNA, 12 bp, Homo sapiens
ttgtttgtctgt

SEQ ID NO: 1061543 - DNA, 12 bp, Homo sapiens
ttgtttgtttct

SEQ ID NO: 1061544 - DNA, 22 bp, Homo sapiens
ttgtttgtttcttcttttcctt

SEQ ID NO: 1061545 - DNA, 15 bp, Homo sapiens
ttgtttgtttttgct

SEQ ID NO: 1061546 - DNA, 18 bp, Homo sapiens
ttgttttaaaattaaagc

SEQ ID NO: 1061547 - DNA, 13 bp, Homo sapiens
ttgttttaatcta

SEQ ID NO: 1061548 - DNA, 12 bp, Homo sapiens
ttgttttacaat

SEQ ID NO: 1061549 - DNA, 19 bp, Homo sapiens
ttgttttatcatgacatgt

SEQ ID NO: 1061550 - DNA, 16 bp, Homo sapiens
ttgttttatcttttaa

SEQ ID NO: 1061551 - DNA, 14 bp, Homo sapiens
ttgttttcacttgt

SEQ ID NO: 1061552 - DNA, 16 bp, Homo sapiens
ttgttttcacttgtat

SEQ ID NO: 1061553 - DNA, 16 bp, Homo sapiens
ttgttttccaaagaaa

SEQ ID NO: 1061554 - DNA, 18 bp, Homo sapiens
ttgttttccactgtgcta

SEQ ID NO: 1061555 - DNA, 20 bp, Homo sapiens
ttgttttcggggagaaataa

SEQ ID NO: 1061556 - DNA, 16 bp, Homo sapiens
ttgttttctgactaat

SEQ ID NO: 1061557 - DNA, 15 bp, Homo sapiens
ttgttttgaaagttt

SEQ ID NO: 1061558 - DNA, 12 bp, Homo sapiens
ttgttttgcttt

SEQ ID NO: 1061559 - DNA, 13 bp, Homo sapiens
ttgttttgctttt

SEQ ID NO: 1061560 - DNA, 18 bp, Homo sapiens
ttgttttgggggtcaggc

SEQ ID NO: 1061561 - DNA, 19 bp, Homo sapiens
ttgtttttaaaaagcaaat

SEQ ID NO: 1061562 - DNA, 19 bp, Homo sapiens
ttgtttttcattcagtctt

SEQ ID NO: 1061563 - DNA, 23 bp, Homo sapiens
ttgtttttgaatttaaataaagt

SEQ ID NO: 1061564 - DNA, 14 bp, Homo sapiens
ttgtttttgcattt

SEQ ID NO: 1061565 - DNA, 18 bp, Homo sapiens
ttgtttttggaaagaaat

SEQ ID NO: 1061566 - DNA, 21 bp, Homo sapiens
ttgttttttaattctctgttc

SEQ ID NO: 1061567 - DNA, 16 bp, Homo sapiens
ttgttttttgtaacta

SEQ ID NO: 1061568 - DNA, 13 bp, Homo sapiens
ttgtttttttcct

SEQ ID NO: 1061569 - DNA, 23 bp, Homo sapiens
ttgtttttttcctcatgtaacat

SEQ ID NO: 1061570 - DNA, 18 bp, Homo sapiens
ttgttttttttttccact

SEQ ID NO: 1061571 - DNA, 14 bp, Homo sapiens
tttaaaaaaaaagt

SEQ ID NO: 1061572 - DNA, 17 bp, Homo sapiens
tttaaaaaaactgaagg

SEQ ID NO: 1061573 - DNA, 16 bp, Homo sapiens
tttaaaaaaattttta

SEQ ID NO: 1061574 - DNA, 19 bp, Homo sapiens
tttaaaaaacaaaaaaaga

SEQ ID NO: 1061575 - DNA, 15 bp, Homo sapiens
tttaaaaaactaaaa

SEQ ID NO: 1061576 - DNA, 20 bp, Homo sapiens
tttaaaaaactattttatgt

SEQ ID NO: 1061577 - DNA, 13 bp, Homo sapiens
tttaaaaaagctt

SEQ ID NO: 1061578 - DNA, 21 bp, Homo sapiens
tttaaaaaatattttaagaaa

SEQ ID NO: 1061579 - DNA, 12 bp, Homo sapiens
tttaaaaaatta

SEQ ID NO: 1061580 - DNA, 18 bp, Homo sapiens
tttaaaaacatagaaaaa

SEQ ID NO: 1061581 - DNA, 14 bp, Homo sapiens
tttaaaaactcttc

SEQ ID NO: 1061582 - DNA, 14 bp, Homo sapiens
tttaaaaagcaaat

SEQ ID NO: 1061583 - DNA, 15 bp, Homo sapiens
tttaaaaagcaaatc

SEQ ID NO: 1061584 - DNA, 17 bp, Homo sapiens
tttaaaaagcaaatctt

SEQ ID NO: 1061585 - DNA, 13 bp, Homo sapiens
tttaaaaaggaaa

SEQ ID NO: 1061586 - DNA, 23 bp, Homo sapiens
tttaaaaaggaaatttgtttgta

SEQ ID NO: 1061587 - DNA, 17 bp, Homo sapiens
tttaaaaagggaagaaa

SEQ ID NO: 1061588 - DNA, 19 bp, Homo sapiens
tttaaaaagggaagaaact

SEQ ID NO: 1061589 - DNA, 22 bp, Homo sapiens
tttaaaaagtaagttaataatg

SEQ ID NO: 1061590 - DNA, 21 bp, Homo sapiens
tttaaaaataagtcaacagta

SEQ ID NO: 1061591 - DNA, 19 bp, Homo sapiens
tttaaaaataccaatcaca

SEQ ID NO: 1061592 - DNA, 14 bp, Homo sapiens
tttaaaaatgtctt

SEQ ID NO: 1061593 - DNA, 18 bp, Homo sapiens
tttaaaaattgaaaaaag

SEQ ID NO: 1061594 - DNA, 16 bp, Homo sapiens
tttaaaaattgtttct

SEQ ID NO: 1061595 - DNA, 22 bp, Homo sapiens
tttaaaacgcgtctgcctgggc

SEQ ID NO: 1061596 - DNA, 20 bp, Homo sapiens
tttaaaactcagaatataac

SEQ ID NO: 1061597 - DNA, 13 bp, Homo sapiens
tttaaaactctgg

SEQ ID NO: 1061598 - DNA, 22 bp, Homo sapiens
tttaaaactgttggaatggatt

SEQ ID NO: 1061599 - DNA, 13 bp, Homo sapiens
tttaaaagaaaaa

SEQ ID NO: 1061600 - DNA, 12 bp, Homo sapiens
tttaaaagaaat

SEQ ID NO: 1061601 - DNA, 19 bp, Homo sapiens
tttaaaagacaagacttca

SEQ ID NO: 1061602 - DNA, 21 bp, Homo sapiens
tttaaaagagagagagagaaa

SEQ ID NO: 1061603 - DNA, 23 bp, Homo sapiens
tttaaaagagagagagagaaaaa

SEQ ID NO: 1061604 - DNA, 18 bp, Homo sapiens
tttaaaagcatgaaacat

SEQ ID NO: 1061605 - DNA, 13 bp, Homo sapiens
tttaaaagcctgc

SEQ ID NO: 1061606 - DNA, 17 bp, Homo sapiens
tttaaaaggaaagaaaa

SEQ ID NO: 1061607 - DNA, 17 bp, Homo sapiens
tttaaaaggatgtataa

SEQ ID NO: 1061608 - DNA, 20 bp, Homo sapiens
tttaaaaggtattttgaata

SEQ ID NO: 1061609 - DNA, 23 bp, Homo sapiens
tttaaaagtaaaatgtctttcca

SEQ ID NO: 1061610 - DNA, 21 bp, Homo sapiens
tttaaaagtaggaaatacaat

SEQ ID NO: 1061611 - DNA, 19 bp, Homo sapiens
tttaaaagtatctttaaca

SEQ ID NO: 1061612 - DNA, 18 bp, Homo sapiens
tttaaaagtcattattcc

SEQ ID NO: 1061613 - DNA, 23 bp, Homo sapiens
tttaaaagtgccattaacaaatg

SEQ ID NO: 1061614 - DNA, 22 bp, Homo sapiens
tttaaaagtgtattttattcag

SEQ ID NO: 1061615 - DNA, 15 bp, Homo sapiens
tttaacactttgtat

SEQ ID NO: 1061616 - DNA, 19 bp, Homo sapiens
tttaacactttttgtgaat

SEQ ID NO: 1061617 - DNA, 12 bp, Homo sapiens
tttaacagaaat

SEQ ID NO: 1061618 - DNA, 21 bp, Homo sapiens
tttaacagaaattgtatattg

SEQ ID NO: 1061619 - DNA, 23 bp, Homo sapiens
tttaacagggtctctagtgctgt

SEQ ID NO: 1061620 - DNA, 22 bp, Homo sapiens
tttaacagtatccccttctcat

SEQ ID NO: 1061621 - DNA, 15 bp, Homo sapiens
tttaacagtcattta

SEQ ID NO: 1061622 - DNA, 21 bp, Homo sapiens
tttaacatacaagaaaatgta

SEQ ID NO: 1061623 - DNA, 21 bp, Homo sapiens
tttaacatataatttctttaa

SEQ ID NO: 1061624 - DNA, 16 bp, Homo sapiens
tttaacatgtgttaaa

SEQ ID NO: 1061625 - DNA, 21 bp, Homo sapiens
tttaacatttgccttgcagaa

SEQ ID NO: 1061626 - DNA, 13 bp, Homo sapiens
tttaaccaaaggt

SEQ ID NO: 1061627 - DNA, 15 bp, Homo sapiens
tttaaccaaaggtga

SEQ ID NO: 1061628 - DNA, 17 bp, Homo sapiens
tttaaccataaatcaat

SEQ ID NO: 1061629 - DNA, 20 bp, Homo sapiens
tttaaccataaatcaattca

SEQ ID NO: 1061630 - DNA, 21 bp, Homo sapiens
tttaaccatccttaaattatt

SEQ ID NO: 1061631 - DNA, 18 bp, Homo sapiens
tttaaccctaatctttca

SEQ ID NO: 1061632 - DNA, 18 bp, Homo sapiens
tttaaccctctcttccct

SEQ ID NO: 1061633 - DNA, 23 bp, Homo sapiens
tttaacctagatgtttaacaaat

SEQ ID NO: 1061634 - DNA, 13 bp, Homo sapiens
tttaacctgtttt

SEQ ID NO: 1061635 - DNA, 16 bp, Homo sapiens
tttaacctttgataga

SEQ ID NO: 1061636 - DNA, 23 bp, Homo sapiens
tttaacgtggcttgtagaatttt

SEQ ID NO: 1061637 - DNA, 14 bp, Homo sapiens
tttaactaaatttt

SEQ ID NO: 1061638 - DNA, 17 bp, Homo sapiens
tttaactaaattttaaa

SEQ ID NO: 1061639 - DNA, 17 bp, Homo sapiens
tttaactacatctgcct

SEQ ID NO: 1061640 - DNA, 22 bp, Homo sapiens
tttaactcatacctttaaagga

SEQ ID NO: 1061641 - DNA, 20 bp, Homo sapiens
tttaactcccattaccatgt

SEQ ID NO: 1061642 - DNA, 22 bp, Homo sapiens
tttaactctgcggatagcattt

SEQ ID NO: 1061643 - DNA, 19 bp, Homo sapiens
tttaactctggattttgaa

SEQ ID NO: 1061644 - DNA, 19 bp, Homo sapiens
tttaactgaaaatgtaaat

SEQ ID NO: 1061645 - DNA, 19 bp, Homo sapiens
tttaactgacaagccatct

SEQ ID NO: 1061646 - DNA, 21 bp, Homo sapiens
tttaactgccaatccttaaat

SEQ ID NO: 1061647 - DNA, 14 bp, Homo sapiens
tttaactgccttgt

SEQ ID NO: 1061648 - DNA, 18 bp, Homo sapiens
tttaactggcatggatta

SEQ ID NO: 1061649 - DNA, 19 bp, Homo sapiens
tttaactggcttcatttta

SEQ ID NO: 1061650 - DNA, 15 bp, Homo sapiens
tttaactgtggatat

SEQ ID NO: 1061651 - DNA, 17 bp, Homo sapiens
tttaactgtggatattg

SEQ ID NO: 1061652 - DNA, 18 bp, Homo sapiens
tttaactgtggatattgt

SEQ ID NO: 1061653 - DNA, 14 bp, Homo sapiens
tttaacttaaatag

SEQ ID NO: 1061654 - DNA, 16 bp, Homo sapiens
tttaacttaactgaaa

SEQ ID NO: 1061655 - DNA, 16 bp, Homo sapiens
tttaactttaaaactg

SEQ ID NO: 1061656 - DNA, 18 bp, Homo sapiens
tttaactttaagtttcag

SEQ ID NO: 1061657 - DNA, 12 bp, Homo sapiens
tttaacttttga

SEQ ID NO: 1061658 - DNA, 16 bp, Homo sapiens
tttaacttttggaatc

SEQ ID NO: 1061659 - DNA, 17 bp, Homo sapiens
tttaagaaaaacaagtt

SEQ ID NO: 1061660 - DNA, 18 bp, Homo sapiens
tttaagaaaaaggatgca

SEQ ID NO: 1061661 - DNA, 22 bp, Homo sapiens
tttaagaaaaaggatgcacaga

SEQ ID NO: 1061662 - DNA, 22 bp, Homo sapiens
tttaagaaaaatgaaaactttt

SEQ ID NO: 1061663 - DNA, 12 bp, Homo sapiens
tttaagaaaata

SEQ ID NO: 1061664 - DNA, 14 bp, Homo sapiens
tttaagaaatagaa

SEQ ID NO: 1061665 - DNA, 23 bp, Homo sapiens
tttaagaaccttattttgataaa

SEQ ID NO: 1061666 - DNA, 19 bp, Homo sapiens
tttaagaacttcattttta

SEQ ID NO: 1061667 - DNA, 22 bp, Homo sapiens
tttaagacagtcccatcaaaac

SEQ ID NO: 1061668 - DNA, 16 bp, Homo sapiens
tttaagaccagcctgg

SEQ ID NO: 1061669 - DNA, 17 bp, Homo sapiens
tttaagacgtgtttgtg

SEQ ID NO: 1061670 - DNA, 11 bp, Homo sapiens
tttaagactga

SEQ ID NO: 1061671 - DNA, 21 bp, Homo sapiens
tttaagactgataattttaca

SEQ ID NO: 1061672 - DNA, 12 bp, Homo sapiens
tttaagagacag

SEQ ID NO: 1061673 - DNA, 15 bp, Homo sapiens
tttaagataaattat

SEQ ID NO: 1061674 - DNA, 22 bp, Homo sapiens
tttaagatatccatctttttct

SEQ ID NO: 1061675 - DNA, 13 bp, Homo sapiens
tttaagatcttgg

SEQ ID NO: 1061676 - DNA, 17 bp, Homo sapiens
tttaagatgtacattta

SEQ ID NO: 1061677 - DNA, 19 bp, Homo sapiens
tttaagatgtacatttaat

SEQ ID NO: 1061678 - DNA, 14 bp, Homo sapiens
tttaagcatttgta

SEQ ID NO: 1061679 - DNA, 17 bp, Homo sapiens
tttaagcatttgtatat

SEQ ID NO: 1061680 - DNA, 18 bp, Homo sapiens
tttaagcatttgtatatt

SEQ ID NO: 1061681 - DNA, 20 bp, Homo sapiens
tttaagccaaaacaatgttt

SEQ ID NO: 1061682 - DNA, 21 bp, Homo sapiens
tttaagccatctcagattctg

SEQ ID NO: 1061683 - DNA, 16 bp, Homo sapiens
tttaagccttcatttg

SEQ ID NO: 1061684 - DNA, 15 bp, Homo sapiens
tttaagccttttgtg

SEQ ID NO: 1061685 - DNA, 14 bp, Homo sapiens
tttaagctcaaaat

SEQ ID NO: 1061686 - DNA, 15 bp, Homo sapiens
tttaagctccagctt

SEQ ID NO: 1061687 - DNA, 17 bp, Homo sapiens
tttaagctccagcttta

SEQ ID NO: 1061688 - DNA, 19 bp, Homo sapiens
tttaagctccatgtgcata

SEQ ID NO: 1061689 - DNA, 22 bp, Homo sapiens
tttaagctccatgtgcatataa

SEQ ID NO: 1061690 - DNA, 21 bp, Homo sapiens
tttaagctgttactgtcttca

SEQ ID NO: 1061691 - DNA, 18 bp, Homo sapiens
tttaagctgtttccatag

SEQ ID NO: 1061692 - DNA, 12 bp, Homo sapiens
tttaaggaatat

SEQ ID NO: 1061693 - DNA, 19 bp, Homo sapiens
tttaaggataaatcataaa

SEQ ID NO: 1061694 - DNA, 19 bp, Homo sapiens
tttaaggatgcttgtacat

SEQ ID NO: 1061695 - DNA, 12 bp, Homo sapiens
tttaaggcaaaa

SEQ ID NO: 1061696 - DNA, 17 bp, Homo sapiens
tttaagggtttgtggaa

SEQ ID NO: 1061697 - DNA, 18 bp, Homo sapiens
tttaagtaattgcctaca

SEQ ID NO: 1061698 - DNA, 21 bp, Homo sapiens
tttaagtatatagtatattta

SEQ ID NO: 1061699 - DNA, 17 bp, Homo sapiens
tttaagtatcttgtgct

SEQ ID NO: 1061700 - DNA, 14 bp, Homo sapiens
tttaagtatttata

SEQ ID NO: 1061701 - DNA, 21 bp, Homo sapiens
tttaagtctcctttactgaat

SEQ ID NO: 1061702 - DNA, 19 bp, Homo sapiens
tttaagtgaaagtgaggaa

SEQ ID NO: 1061703 - DNA, 17 bp, Homo sapiens
tttaagtgcaacatttc

SEQ ID NO: 1061704 - DNA, 19 bp, Homo sapiens
tttaagtgcaacatttctg

SEQ ID NO: 1061705 - DNA, 20 bp, Homo sapiens
tttaagtgcaacatttctgt

SEQ ID NO: 1061706 - DNA, 15 bp, Homo sapiens
tttaagtgcaattaa

SEQ ID NO: 1061707 - DNA, 17 bp, Homo sapiens
tttaagtgctgcattta

SEQ ID NO: 1061708 - DNA, 19 bp, Homo sapiens
tttaagtgctgcatttaaa

SEQ ID NO: 1061709 - DNA, 18 bp, Homo sapiens
tttaagttacacattttt

SEQ ID NO: 1061710 - DNA, 16 bp, Homo sapiens
tttaagttattaagag

SEQ ID NO: 1061711 - DNA, 16 bp, Homo sapiens
tttaagttgtattaaa

SEQ ID NO: 1061712 - DNA, 21 bp, Homo sapiens
tttaagttgtcaaagaagctt

SEQ ID NO: 1061713 - DNA, 21 bp, Homo sapiens
tttaagttgtctgtctgaatg

SEQ ID NO: 1061714 - DNA, 19 bp, Homo sapiens
tttaagttttgattaatgt

SEQ ID NO: 1061715 - DNA, 14 bp, Homo sapiens
tttaataaacagta

SEQ ID NO: 1061716 - DNA, 21 bp, Homo sapiens
tttaataaactactctttgat

SEQ ID NO: 1061717 - DNA, 15 bp, Homo sapiens
tttaataaagaaata

SEQ ID NO: 1061718 - DNA, 18 bp, Homo sapiens
tttaataaagaaatattt

SEQ ID NO: 1061719 - DNA, 17 bp, Homo sapiens
tttaataaagatgagtt

SEQ ID NO: 1061720 - DNA, 21 bp, Homo sapiens
tttaataaatgacaaatgtat

SEQ ID NO: 1061721 - DNA, 14 bp, Homo sapiens
tttaataaatttat

SEQ ID NO: 1061722 - DNA, 20 bp, Homo sapiens
tttaataacaaggagatttc

SEQ ID NO: 1061723 - DNA, 13 bp, Homo sapiens
tttaataagaaca

SEQ ID NO: 1061724 - DNA, 15 bp, Homo sapiens
tttaatacaggaaat

SEQ ID NO: 1061725 - DNA, 14 bp, Homo sapiens
tttaatacagggta

SEQ ID NO: 1061726 - DNA, 17 bp, Homo sapiens
tttaatacagtttattt

SEQ ID NO: 1061727 - DNA, 22 bp, Homo sapiens
tttaatagaaataaattcctaa

SEQ ID NO: 1061728 - DNA, 23 bp, Homo sapiens
tttaatagaaataaattcctaaa

SEQ ID NO: 1061729 - DNA, 18 bp, Homo sapiens
tttaatagcaaagaattg

SEQ ID NO: 1061730 - DNA, 12 bp, Homo sapiens
tttaatataaac

SEQ ID NO: 1061731 - DNA, 21 bp, Homo sapiens
tttaatatagtgaaatggcca

SEQ ID NO: 1061732 - DNA, 17 bp, Homo sapiens
tttaatatctggcactg

SEQ ID NO: 1061733 - DNA, 19 bp, Homo sapiens
tttaatatctggcactgtt

SEQ ID NO: 1061734 - DNA, 14 bp, Homo sapiens
tttaatatgagctt

SEQ ID NO: 1061735 - DNA, 17 bp, Homo sapiens
tttaatatgagcttcaa

SEQ ID NO: 1061736 - DNA, 21 bp, Homo sapiens
tttaatatgagcttcaatata

SEQ ID NO: 1061737 - DNA, 12 bp, Homo sapiens
tttaatatgcaa

SEQ ID NO: 1061738 - DNA, 18 bp, Homo sapiens
tttaatatttaaacagca

SEQ ID NO: 1061739 - DNA, 20 bp, Homo sapiens
tttaatattttgtattttca

SEQ ID NO: 1061740 - DNA, 19 bp, Homo sapiens
tttaatcaagttgtaactt

SEQ ID NO: 1061741 - DNA, 19 bp, Homo sapiens
tttaatcagttgtttaata

SEQ ID NO: 1061742 - DNA, 15 bp, Homo sapiens
tttaatcatgaatat

SEQ ID NO: 1061743 - DNA, 14 bp, Homo sapiens
tttaatccagaatt

SEQ ID NO: 1061744 - DNA, 23 bp, Homo sapiens
tttaatccttctagtttcccaca

SEQ ID NO: 1061745 - DNA, 14 bp, Homo sapiens
tttaatctcctgtt

SEQ ID NO: 1061746 - DNA, 13 bp, Homo sapiens
tttaatcttatct

SEQ ID NO: 1061747 - DNA, 20 bp, Homo sapiens
tttaatgaatttaaggcaaa

SEQ ID NO: 1061748 - DNA, 13 bp, Homo sapiens
tttaatgagaaaa

SEQ ID NO: 1061749 - DNA, 19 bp, Homo sapiens
tttaatgcattaaacctgt

SEQ ID NO: 1061750 - DNA, 21 bp, Homo sapiens
tttaatgcattaaacctgtct

SEQ ID NO: 1061751 - DNA, 15 bp, Homo sapiens
tttaatgctatttga

SEQ ID NO: 1061752 - DNA, 13 bp, Homo sapiens
tttaatgctgtct

SEQ ID NO: 1061753 - DNA, 16 bp, Homo sapiens
tttaatgctgtctttg

SEQ ID NO: 1061754 - DNA, 17 bp, Homo sapiens
tttaatggatatttctc

SEQ ID NO: 1061755 - DNA, 18 bp, Homo sapiens
tttaatggatatttctca

SEQ ID NO: 1061756 - DNA, 20 bp, Homo sapiens
tttaatggccggctggaaat

SEQ ID NO: 1061757 - DNA, 21 bp, Homo sapiens
tttaatgggggtagcagctgg

SEQ ID NO: 1061758 - DNA, 18 bp, Homo sapiens
tttaatggggtctgtaaa

SEQ ID NO: 1061759 - DNA, 21 bp, Homo sapiens
tttaatggtatgtacaagttg

SEQ ID NO: 1061760 - DNA, 12 bp, Homo sapiens
tttaatgtaaag

SEQ ID NO: 1061761 - DNA, 20 bp, Homo sapiens
tttaatgtatagtaaatcac

SEQ ID NO: 1061762 - DNA, 22 bp, Homo sapiens
tttaatgtatatttgctgcaaa

SEQ ID NO: 1061763 - DNA, 22 bp, Homo sapiens
tttaatgttcattttctctgta

SEQ ID NO: 1061764 - DNA, 15 bp, Homo sapiens
tttaatgttctgtga

SEQ ID NO: 1061765 - DNA, 21 bp, Homo sapiens
tttaatgtttattatttacat

SEQ ID NO: 1061766 - DNA, 16 bp, Homo sapiens
tttaatgtttgattta

SEQ ID NO: 1061767 - DNA, 16 bp, Homo sapiens
tttaattaaaaacttt

SEQ ID NO: 1061768 - DNA, 23 bp, Homo sapiens
tttaattaaaaactttaaagata

SEQ ID NO: 1061769 - DNA, 13 bp, Homo sapiens
tttaattaaagca

SEQ ID NO: 1061770 - DNA, 15 bp, Homo sapiens
tttaattaaatctca

SEQ ID NO: 1061771 - DNA, 14 bp, Homo sapiens
tttaattaattggg

SEQ ID NO: 1061772 - DNA, 16 bp, Homo sapiens
tttaattactgctata

SEQ ID NO: 1061773 - DNA, 21 bp, Homo sapiens
tttaattaggggttgctaaga

SEQ ID NO: 1061774 - DNA, 13 bp, Homo sapiens
tttaattatgaaa

SEQ ID NO: 1061775 - DNA, 14 bp, Homo sapiens
tttaattgaagaac

SEQ ID NO: 1061776 - DNA, 14 bp, Homo sapiens
tttaattgattatt

SEQ ID NO: 1061777 - DNA, 21 bp, Homo sapiens
tttaattgtaaagtaaaagct

SEQ ID NO: 1061778 - DNA, 13 bp, Homo sapiens
tttaattgtagtt

SEQ ID NO: 1061779 - DNA, 15 bp, Homo sapiens
tttaattgtttaaaa

SEQ ID NO: 1061780 - DNA, 19 bp, Homo sapiens
tttaatttatttattaaga

SEQ ID NO: 1061781 - DNA, 14 bp, Homo sapiens
tttaatttatttca

SEQ ID NO: 1061782 - DNA, 23 bp, Homo sapiens
tttaatttctaagaagttacttt

SEQ ID NO: 1061783 - DNA, 18 bp, Homo sapiens
tttaatttgatgaaagct

SEQ ID NO: 1061784 - DNA, 19 bp, Homo sapiens
tttaatttgatgaaagctg

SEQ ID NO: 1061785 - DNA, 21 bp, Homo sapiens
tttaatttgatgaaagctgat

SEQ ID NO: 1061786 - DNA, 12 bp, Homo sapiens
tttaatttgctt

SEQ ID NO: 1061787 - DNA, 16 bp, Homo sapiens
tttaattttcttgttt

SEQ ID NO: 1061788 - DNA, 14 bp, Homo sapiens
tttaattttgatat

SEQ ID NO: 1061789 - DNA, 19 bp, Homo sapiens
tttaattttgatatacatt

SEQ ID NO: 1061790 - DNA, 18 bp, Homo sapiens
tttacaaaacaaactcat

SEQ ID NO: 1061791 - DNA, 23 bp, Homo sapiens
tttacaaaactgccaaaaatata

SEQ ID NO: 1061792 - DNA, 11 bp, Homo sapiens
tttacaaaaga

SEQ ID NO: 1061793 - DNA, 13 bp, Homo sapiens
tttacaaaagatg

SEQ ID NO: 1061794 - DNA, 19 bp, Homo sapiens
tttacaaaccattacctgt

SEQ ID NO: 1061795 - DNA, 13 bp, Homo sapiens
tttacaaactgaa

SEQ ID NO: 1061796 - DNA, 15 bp, Homo sapiens
tttacaaactgaaga

SEQ ID NO: 1061797 - DNA, 12 bp, Homo sapiens
tttacaactaaa

SEQ ID NO: 1061798 - DNA, 19 bp, Homo sapiens
tttacaagaagtttattct

SEQ ID NO: 1061799 - DNA, 21 bp, Homo sapiens
tttacaagcccccccttccac

SEQ ID NO: 1061800 - DNA, 16 bp, Homo sapiens
tttacaataaataatc

SEQ ID NO: 1061801 - DNA, 16 bp, Homo sapiens
tttacaatctgtatct

SEQ ID NO: 1061802 - DNA, 13 bp, Homo sapiens
tttacaatgtatt

SEQ ID NO: 1061803 - DNA, 14 bp, Homo sapiens
tttacaatgtatta

SEQ ID NO: 1061804 - DNA, 15 bp, Homo sapiens
tttacaattgaaatg

SEQ ID NO: 1061805 - DNA, 16 bp, Homo sapiens
tttacaattgaaatga

SEQ ID NO: 1061806 - DNA, 19 bp, Homo sapiens
tttacaatttacaaagtgt

SEQ ID NO: 1061807 - DNA, 22 bp, Homo sapiens
tttacacacgtcgttctaatta

SEQ ID NO: 1061808 - DNA, 23 bp, Homo sapiens
tttacacactgtacacataagcc

SEQ ID NO: 1061809 - DNA, 15 bp, Homo sapiens
tttacacagagaaat

SEQ ID NO: 1061810 - DNA, 21 bp, Homo sapiens
tttacacattcggctccctgg

SEQ ID NO: 1061811 - DNA, 23 bp, Homo sapiens
tttacaccaatttggtaaaaatg

SEQ ID NO: 1061812 - DNA, 14 bp, Homo sapiens
tttacactcaggct

SEQ ID NO: 1061813 - DNA, 18 bp, Homo sapiens
tttacactggtctaatgt

SEQ ID NO: 1061814 - DNA, 21 bp, Homo sapiens
tttacagagaggatacattta

SEQ ID NO: 1061815 - DNA, 22 bp, Homo sapiens
tttacagatccagaatttatta

SEQ ID NO: 1061816 - DNA, 22 bp, Homo sapiens
tttacagccagtgggagatgtt

SEQ ID NO: 1061817 - DNA, 14 bp, Homo sapiens
tttacaggaaaaaa

SEQ ID NO: 1061818 - DNA, 23 bp, Homo sapiens
tttacaggaaaaaaaattctgtt

SEQ ID NO: 1061819 - DNA, 14 bp, Homo sapiens
tttacaggaacttc

SEQ ID NO: 1061820 - DNA, 14 bp, Homo sapiens
tttacaggagggcc

SEQ ID NO: 1061821 - DNA, 22 bp, Homo sapiens
tttacagtatctacttgcatgt

SEQ ID NO: 1061822 - DNA, 19 bp, Homo sapiens
tttacagtctctttcttcc

SEQ ID NO: 1061823 - DNA, 21 bp, Homo sapiens
tttacagtctctttcttcctt

SEQ ID NO: 1061824 - DNA, 17 bp, Homo sapiens
tttacagtgaagaaagc

SEQ ID NO: 1061825 - DNA, 14 bp, Homo sapiens
tttacagtttgtgt

SEQ ID NO: 1061826 - DNA, 19 bp, Homo sapiens
tttacatagtgcaaaactg

SEQ ID NO: 1061827 - DNA, 16 bp, Homo sapiens
tttacatgaggactct

SEQ ID NO: 1061828 - DNA, 20 bp, Homo sapiens
tttacatgtcatttgactgt

SEQ ID NO: 1061829 - DNA, 14 bp, Homo sapiens
tttacattctgtgt

SEQ ID NO: 1061830 - DNA, 11 bp, Homo sapiens
tttattcacat

SEQ ID NO: 1061831 - DNA, 21 bp, Homo sapiens
tttattcagcttcatttgtgt

SEQ ID NO: 1061832 - DNA, 12 bp, Homo sapiens
tttattcataat

SEQ ID NO: 1061833 - DNA, 21 bp, Homo sapiens
tttattcataatgaattataa

SEQ ID NO: 1061834 - DNA, 18 bp, Homo sapiens
tttattccagaatgctgt

SEQ ID NO: 1061835 - DNA, 14 bp, Homo sapiens
tttattcccaagta

SEQ ID NO: 1061836 - DNA, 22 bp, Homo sapiens
tttattcccaagtatgccttaa

SEQ ID NO: 1061837 - DNA, 21 bp, Homo sapiens
tttattccctgcccaaaccct

SEQ ID NO: 1061838 - DNA, 22 bp, Homo sapiens
tttattccctgcccaaaccctt

SEQ ID NO: 1061839 - DNA, 14 bp, Homo sapiens
tttattccttccat

SEQ ID NO: 1061840 - DNA, 15 bp, Homo sapiens
tttattccttctgta

SEQ ID NO: 1061841 - DNA, 14 bp, Homo sapiens
tttattccttgtga

SEQ ID NO: 1061842 - DNA, 15 bp, Homo sapiens
tttattctagttaag

SEQ ID NO: 1061843 - DNA, 21 bp, Homo sapiens
tttattctcaggtaatcattt

SEQ ID NO: 1061844 - DNA, 14 bp, Homo sapiens
tttattctgttata

SEQ ID NO: 1061845 - DNA, 12 bp, Homo sapiens
tttattcttcca

SEQ ID NO: 1061846 - DNA, 14 bp, Homo sapiens
tttattcttccaga

SEQ ID NO: 1061847 - DNA, 17 bp, Homo sapiens
tttattgaaatgtataa

SEQ ID NO: 1061848 - DNA, 18 bp, Homo sapiens
tttattgaattagaaaat

SEQ ID NO: 1061849 - DNA, 13 bp, Homo sapiens
tttattgacacag

SEQ ID NO: 1061850 - DNA, 16 bp, Homo sapiens
tttattgagaaagagc

SEQ ID NO: 1061851 - DNA, 14 bp, Homo sapiens
tttattgagaattt

SEQ ID NO: 1061852 - DNA, 19 bp, Homo sapiens
tttattgattaaaaatgtg

SEQ ID NO: 1061853 - DNA, 13 bp, Homo sapiens
tttattgcaaagt

SEQ ID NO: 1061854 - DNA, 12 bp, Homo sapiens
tttattgcacta

SEQ ID NO: 1061855 - DNA, 19 bp, Homo sapiens
tttattgcactaggaattc

SEQ ID NO: 1061856 - DNA, 14 bp, Homo sapiens
tttattgcagaatg

SEQ ID NO: 1061857 - DNA, 17 bp, Homo sapiens
tttattgcatatagatt

SEQ ID NO: 1061858 - DNA, 24 bp, Homo sapiens
tttattgcatctgggtagctgtaa

SEQ ID NO: 1061859 - DNA, 12 bp, Homo sapiens
tttattgcattg

SEQ ID NO: 1061860 - DNA, 23 bp, Homo sapiens
tttattgccttttaatttttaat

SEQ ID NO: 1061861 - DNA, 19 bp, Homo sapiens
tttattgctgtgtaacact

SEQ ID NO: 1061862 - DNA, 20 bp, Homo sapiens
tttattggcagccaaggaat

SEQ ID NO: 1061863 - DNA, 16 bp, Homo sapiens
tttattggctgagata

SEQ ID NO: 1061864 - DNA, 20 bp, Homo sapiens
tttattggtaaattctggta

SEQ ID NO: 1061865 - DNA, 15 bp, Homo sapiens
tttattggttttgca

SEQ ID NO: 1061866 - DNA, 23 bp, Homo sapiens
tttattggttttgcagaagaagg

SEQ ID NO: 1061867 - DNA, 12 bp, Homo sapiens
tttattgtacag

SEQ ID NO: 1061868 - DNA, 13 bp, Homo sapiens
tttattgtataaa

SEQ ID NO: 1061869 - DNA, 14 bp, Homo sapiens
tttattgtctgtaa

SEQ ID NO: 1061870 - DNA, 14 bp, Homo sapiens
tttattgtgctggg

SEQ ID NO: 1061871 - DNA, 19 bp, Homo sapiens
tttattgttaaattacatt

SEQ ID NO: 1061872 - DNA, 17 bp, Homo sapiens
tttattgtttgatgttt

SEQ ID NO: 1061873 - DNA, 14 bp, Homo sapiens
tttatttaaaactc

SEQ ID NO: 1061874 - DNA, 19 bp, Homo sapiens
tttatttaaaactctggtg

SEQ ID NO: 1061875 - DNA, 16 bp, Homo sapiens
tttatttactgctagt

SEQ ID NO: 1061876 - DNA, 14 bp, Homo sapiens
tttatttaggaaac

SEQ ID NO: 1061877 - DNA, 15 bp, Homo sapiens
tttatttattactgt

SEQ ID NO: 1061878 - DNA, 14 bp, Homo sapiens
tttatttatttaca

SEQ ID NO: 1061879 - DNA, 13 bp, Homo sapiens
tttatttatttat

SEQ ID NO: 1061880 - DNA, 17 bp, Homo sapiens
tttatttcattggttaa

SEQ ID NO: 1061881 - DNA, 20 bp, Homo sapiens
tttatttccactaaaaatat

SEQ ID NO: 1061882 - DNA, 13 bp, Homo sapiens
tttatttcctccc

SEQ ID NO: 1061883 - DNA, 11 bp, Homo sapiens
tttatttcctg

SEQ ID NO: 1061884 - DNA, 21 bp, Homo sapiens
tttatttcctgctacttaaat

SEQ ID NO: 1061885 - DNA, 16 bp, Homo sapiens
tttatttctaagtatt

SEQ ID NO: 1061886 - DNA, 20 bp, Homo sapiens
tttatttctaagtatttaaa

SEQ ID NO: 1061887 - DNA, 21 bp, Homo sapiens
tttatttctactgtcaaatga

SEQ ID NO: 1061888 - DNA, 13 bp, Homo sapiens
tttatttctctct

SEQ ID NO: 1061889 - DNA, 17 bp, Homo sapiens
tttatttgagaaaatat

SEQ ID NO: 1061890 - DNA, 17 bp, Homo sapiens
tttatttgagaattttg

SEQ ID NO: 1061891 - DNA, 14 bp, Homo sapiens
tttatttgcttctt

SEQ ID NO: 1061892 - DNA, 17 bp, Homo sapiens
tttatttgtaaaccatt

SEQ ID NO: 1061893 - DNA, 20 bp, Homo sapiens
tttattttaaaatttcatag

SEQ ID NO: 1061894 - DNA, 14 bp, Homo sapiens
tttattttaatgta

SEQ ID NO: 1061895 - DNA, 10 bp, Homo sapiens
tttattttac

SEQ ID NO: 1061896 - DNA, 13 bp, Homo sapiens
tttattttacatt

SEQ ID NO: 1061897 - DNA, 17 bp, Homo sapiens
tttattttactattgga

SEQ ID NO: 1061898 - DNA, 17 bp, Homo sapiens
tttattttgctccctct

SEQ ID NO: 1061899 - DNA, 18 bp, Homo sapiens
tttattttgctgagttgt

SEQ ID NO: 1061900 - DNA, 21 bp, Homo sapiens
tttattttggcttcatttcaa

SEQ ID NO: 1061901 - DNA, 21 bp, Homo sapiens
tttattttgtatgaaatatat

SEQ ID NO: 1061902 - DNA, 15 bp, Homo sapiens
tttatttttcatatt

SEQ ID NO: 1061903 - DNA, 17 bp, Homo sapiens
tttatttttcatttagt

SEQ ID NO: 1061904 - DNA, 18 bp, Homo sapiens
tttatttttctctttctc

SEQ ID NO: 1061905 - DNA, 15 bp, Homo sapiens
tttatttttctgtta

SEQ ID NO: 1061906 - DNA, 13 bp, Homo sapiens
tttatttttgaac

SEQ ID NO: 1061907 - DNA, 23 bp, Homo sapiens
tttatttttgaacccctgtgtcc

SEQ ID NO: 1061908 - DNA, 23 bp, Homo sapiens
tttatttttgggtttggccaggg

SEQ ID NO: 1061909 - DNA, 15 bp, Homo sapiens
tttatttttgtgtag

SEQ ID NO: 1061910 - DNA, 14 bp, Homo sapiens
tttattttttaagt

SEQ ID NO: 1061911 - DNA, 21 bp, Homo sapiens
tttattttttaccataatctt

SEQ ID NO: 1061912 - DNA, 18 bp, Homo sapiens
tttattttttctacacag

SEQ ID NO: 1061913 - DNA, 16 bp, Homo sapiens
tttattttttgtgagt

SEQ ID NO: 1061914 - DNA, 15 bp, Homo sapiens
tttatttttttaagt

SEQ ID NO: 1061915 - DNA, 17 bp, Homo sapiens
tttcaaaaatataactt

SEQ ID NO: 1061916 - DNA, 18 bp, Homo sapiens
tttcaaaaatataactta

SEQ ID NO: 1061917 - DNA, 23 bp, Homo sapiens
tttcaaaacacatctttcctgtc

SEQ ID NO: 1061918 - DNA, 20 bp, Homo sapiens
tttcaaaactcatttcctat

SEQ ID NO: 1061919 - DNA, 13 bp, Homo sapiens
tttcaaaatacat

SEQ ID NO: 1061920 - DNA, 11 bp, Homo sapiens
tttcaaaatag

SEQ ID NO: 1061921 - DNA, 19 bp, Homo sapiens
tttcaaaatcagtttttca

SEQ ID NO: 1061922 - DNA, 12 bp, Homo sapiens
tttcaaaatgct

SEQ ID NO: 1061923 - DNA, 13 bp, Homo sapiens
tttcaaaatgctt

SEQ ID NO: 1061924 - DNA, 15 bp, Homo sapiens
tttcaaaatgctttt

SEQ ID NO: 1061925 - DNA, 15 bp, Homo sapiens
tttcaaaattaatag

SEQ ID NO: 1061926 - DNA, 15 bp, Homo sapiens
tttcaaaccagcttc

SEQ ID NO: 1061927 - DNA, 16 bp, Homo sapiens
tttcaaacttactatt

SEQ ID NO: 1061928 - DNA, 19 bp, Homo sapiens
tttcaaacttactattttg

SEQ ID NO: 1061929 - DNA, 22 bp, Homo sapiens
tttcaaactttattgacaagtg

SEQ ID NO: 1061930 - DNA, 12 bp, Homo sapiens
tttcaaagcaat

SEQ ID NO: 1061931 - DNA, 14 bp, Homo sapiens
tttcaaagcaattg

SEQ ID NO: 1061932 - DNA, 14 bp, Homo sapiens
tttcaaagccctgc

SEQ ID NO: 1061933 - DNA, 20 bp, Homo sapiens
tttcaaagccctgcctctgt

SEQ ID NO: 1061934 - DNA, 20 bp, Homo sapiens
tttcaaatagggtctaactc

SEQ ID NO: 1061935 - DNA, 13 bp, Homo sapiens
tttcaaatatcac

SEQ ID NO: 1061936 - DNA, 21 bp, Homo sapiens
tttcaaatgcagaatacttga

SEQ ID NO: 1061937 - DNA, 14 bp, Homo sapiens
tttcaaattgtatc

SEQ ID NO: 1061938 - DNA, 14 bp, Homo sapiens
tttcaaatttagaa

SEQ ID NO: 1061939 - DNA, 18 bp, Homo sapiens
tttcaaatttagaaacta

SEQ ID NO: 1061940 - DNA, 18 bp, Homo sapiens
tttcaacatgagtgtatt

SEQ ID NO: 1061941 - DNA, 21 bp, Homo sapiens
tttcaacatgtacaggaagtt

SEQ ID NO: 1061942 - DNA, 15 bp, Homo sapiens
tttcaacgcagccct

SEQ ID NO: 1061943 - DNA, 16 bp, Homo sapiens
tttcaacgcagccctg

SEQ ID NO: 1061944 - DNA, 23 bp, Homo sapiens
tttcaactcaggaactatggcaa

SEQ ID NO: 1061945 - DNA, 16 bp, Homo sapiens
tttcaactgccaaaat

SEQ ID NO: 1061946 - DNA, 15 bp, Homo sapiens
tttcaagaaaatctt

SEQ ID NO: 1061947 - DNA, 17 bp, Homo sapiens
tttcaagaacctggaaa

SEQ ID NO: 1061948 - DNA, 18 bp, Homo sapiens
tttcaagacccctgtctt

SEQ ID NO: 1061949 - DNA, 16 bp, Homo sapiens
tttcaagattctaaag

SEQ ID NO: 1061950 - DNA, 17 bp, Homo sapiens
tttcaaggaagaaaacg

SEQ ID NO: 1061951 - DNA, 15 bp, Homo sapiens
tttcaaggaatggaa

SEQ ID NO: 1061952 - DNA, 23 bp, Homo sapiens
tttcaaggaatggaatcttctcc

SEQ ID NO: 1061953 - DNA, 21 bp, Homo sapiens
tttcaaggcatttattgccat

SEQ ID NO: 1061954 - DNA, 16 bp, Homo sapiens
tttcaaggccttcagt

SEQ ID NO: 1061955 - DNA, 16 bp, Homo sapiens
tttcaaggctggggca

SEQ ID NO: 1061956 - DNA, 15 bp, Homo sapiens
tttcaagggttgctt

SEQ ID NO: 1061957 - DNA, 18 bp, Homo sapiens
tttcaagtcaaattaata

SEQ ID NO: 1061958 - DNA, 23 bp, Homo sapiens
tttcaagtcaaattaataatctt

SEQ ID NO: 1061959 - DNA, 18 bp, Homo sapiens
tttcaagtgtacatgtgt

SEQ ID NO: 1061960 - DNA, 20 bp, Homo sapiens
tttcaagtttacacttcata

SEQ ID NO: 1061961 - DNA, 18 bp, Homo sapiens
tttcaagttttaaagttc

SEQ ID NO: 1061962 - DNA, 18 bp, Homo sapiens
tttcaataaatgtatcat

SEQ ID NO: 1061963 - DNA, 17 bp, Homo sapiens
tttcaatacccttttaa

SEQ ID NO: 1061964 - DNA, 20 bp, Homo sapiens
tttcaatagcgtgtgtagat

SEQ ID NO: 1061965 - DNA, 13 bp, Homo sapiens
tttcaatatattg

SEQ ID NO: 1061966 - DNA, 17 bp, Homo sapiens
tttcaatatattgaact

SEQ ID NO: 1061967 - DNA, 19 bp, Homo sapiens
tttcaatatattgaacttt

SEQ ID NO: 1061968 - DNA, 13 bp, Homo sapiens
tttcaatcaactt

SEQ ID NO: 1061969 - DNA, 14 bp, Homo sapiens
tttcaatcattgaa

SEQ ID NO: 1061970 - DNA, 14 bp, Homo sapiens
tttcaatgacattt

SEQ ID NO: 1061971 - DNA, 23 bp, Homo sapiens
tttcaatgcatacaataaaagag

SEQ ID NO: 1061972 - DNA, 20 bp, Homo sapiens
tttcaatgtaattaaactgt

SEQ ID NO: 1061973 - DNA, 13 bp, Homo sapiens
tttcaatgtgaaa

SEQ ID NO: 1061974 - DNA, 22 bp, Homo sapiens
tttcaatgtgattctaatgtct

SEQ ID NO: 1061975 - DNA, 21 bp, Homo sapiens
tttcaatgtgttggaaactgt

SEQ ID NO: 1061976 - DNA, 22 bp, Homo sapiens
tttcaattccacctgcaatcaa

SEQ ID NO: 1061977 - DNA, 14 bp, Homo sapiens
tttcaattctcaaa

SEQ ID NO: 1061978 - DNA, 15 bp, Homo sapiens
tttcaattctcaaaa

SEQ ID NO: 1061979 - DNA, 20 bp, Homo sapiens
tttcaattctgtaattacat

SEQ ID NO: 1061980 - DNA, 14 bp, Homo sapiens
tttcaattgacaaa

SEQ ID NO: 1061981 - DNA, 17 bp, Homo sapiens
tttcaattgtattttat

SEQ ID NO: 1061982 - DNA, 21 bp, Homo sapiens
tttcaattgtattttatatga

SEQ ID NO: 1061983 - DNA, 23 bp, Homo sapiens
tttcacaacagcctgacaacatt

SEQ ID NO: 1061984 - DNA, 22 bp, Homo sapiens
tttcacaaccttctgtggctca

SEQ ID NO: 1061985 - DNA, 12 bp, Homo sapiens
tttcacaagcaa

SEQ ID NO: 1061986 - DNA, 18 bp, Homo sapiens
tttcacacatctgggtgc

SEQ ID NO: 1061987 - DNA, 19 bp, Homo sapiens
tttcacactggtaaatgtt

SEQ ID NO: 1061988 - DNA, 17 bp, Homo sapiens
tttcacactgtcttccc

SEQ ID NO: 1061989 - DNA, 19 bp, Homo sapiens
tttcacactgtcttcccga

SEQ ID NO: 1061990 - DNA, 17 bp, Homo sapiens
tttcacagctatgaaga

SEQ ID NO: 1061991 - DNA, 19 bp, Homo sapiens
tttcacagtgtgtttgtga

SEQ ID NO: 1061992 - DNA, 20 bp, Homo sapiens
tttcaccaaaatttctacac

SEQ ID NO: 1061993 - DNA, 15 bp, Homo sapiens
tttcaccaggttaaa

SEQ ID NO: 1061994 - DNA, 23 bp, Homo sapiens
tttcaccatgttggccaggctgt

SEQ ID NO: 1061995 - DNA, 22 bp, Homo sapiens
tttcaccatgttggtcaggctg

SEQ ID NO: 1061996 - DNA, 22 bp, Homo sapiens
tttcacccttaacccaaggagc

SEQ ID NO: 1061997 - DNA, 16 bp, Homo sapiens
tttcacctagattttt

SEQ ID NO: 1061998 - DNA, 14 bp, Homo sapiens
tttcacctgtaaac

SEQ ID NO: 1061999 - DNA, 18 bp, Homo sapiens
tttcacctgtaaacctga

SEQ ID NO: 1062000 - DNA, 16 bp, Homo sapiens
tttcaccttttcagga

SEQ ID NO: 1062001 - DNA, 15 bp, Homo sapiens
tttcacgattcattt

SEQ ID NO: 1062002 - DNA, 14 bp, Homo sapiens
tttcacggaagttt

SEQ ID NO: 1062003 - DNA, 18 bp, Homo sapiens
tttcacggaagttttcaa

SEQ ID NO: 1062004 - DNA, 23 bp, Homo sapiens
tttcacggaagttttcaatgatg

SEQ ID NO: 1062005 - DNA, 18 bp, Homo sapiens
tttcacgggaactctcca

SEQ ID NO: 1062006 - DNA, 15 bp, Homo sapiens
tttcacgggagattt

SEQ ID NO: 1062007 - DNA, 20 bp, Homo sapiens
tttcacgtaaatattcatat

SEQ ID NO: 1062008 - DNA, 16 bp, Homo sapiens
tttcacgtcttggtgc

SEQ ID NO: 1062009 - DNA, 20 bp, Homo sapiens
tttcacgtcttggtgccttt

SEQ ID NO: 1062010 - DNA, 23 bp, Homo sapiens
tttcacgtcttggtgccttttgt

SEQ ID NO: 1062011 - DNA, 22 bp, Homo sapiens
tttcactaaatgtaaaatttgg

SEQ ID NO: 1062012 - DNA, 16 bp, Homo sapiens
tttcactataatgtga

SEQ ID NO: 1062013 - DNA, 19 bp, Homo sapiens
tttcactatttttatttat

SEQ ID NO: 1062014 - DNA, 14 bp, Homo sapiens
tttcactccctctt

SEQ ID NO: 1062015 - DNA, 17 bp, Homo sapiens
tttcactccctcttggt

SEQ ID NO: 1062016 - DNA, 16 bp, Homo sapiens
tttcactcctgcttct

SEQ ID NO: 1062017 - DNA, 23 bp, Homo sapiens
tttcactctaagtcatgtatgtt

SEQ ID NO: 1062018 - DNA, 12 bp, Homo sapiens
tttcactgctgc

SEQ ID NO: 1062019 - DNA, 20 bp, Homo sapiens
tttcactgctggctgcctta

SEQ ID NO: 1062020 - DNA, 24 bp, Homo sapiens
tttcactgctggctgccttagaac

SEQ ID NO: 1062021 - DNA, 18 bp, Homo sapiens
tttcactggagttacatt

SEQ ID NO: 1062022 - DNA, 18 bp, Homo sapiens
tttcacttgaaagatttt

SEQ ID NO: 1062023 - DNA, 11 bp, Homo sapiens
tttcacttgta

SEQ ID NO: 1062024 - DNA, 16 bp, Homo sapiens
tttcacttgtattgac

SEQ ID NO: 1062025 - DNA, 18 bp, Homo sapiens
tttcacttgtattgactt

SEQ ID NO: 1062026 - DNA, 15 bp, Homo sapiens
tttcactttattgct

SEQ ID NO: 1062027 - DNA, 18 bp, Homo sapiens
tttcactttctgtctagg

SEQ ID NO: 1062028 - DNA, 15 bp, Homo sapiens
tttcactttgaaaag

SEQ ID NO: 1062029 - DNA, 16 bp, Homo sapiens
tttcacttttgttctg

SEQ ID NO: 1062030 - DNA, 22 bp, Homo sapiens
tttcacttttgttgcccaggct

SEQ ID NO: 1062031 - DNA, 13 bp, Homo sapiens
tttcagaaatgtg

SEQ ID NO: 1062032 - DNA, 15 bp, Homo sapiens
tttcagaagcaagcc

SEQ ID NO: 1062033 - DNA, 23 bp, Homo sapiens
tttcagaagtcagcctacataac

SEQ ID NO: 1062034 - DNA, 22 bp, Homo sapiens
tttcagaagtgagctttgctgc

SEQ ID NO: 1062035 - DNA, 20 bp, Homo sapiens
tttcagaagttagtttgtat

SEQ ID NO: 1062036 - DNA, 15 bp, Homo sapiens
tttcagaatcatctt

SEQ ID NO: 1062037 - DNA, 11 bp, Homo sapiens
tttcagacagg

SEQ ID NO: 1062038 - DNA, 12 bp, Homo sapiens
tttcagaccccc

SEQ ID NO: 1062039 - DNA, 20 bp, Homo sapiens
tttcagagggtaagtaaaca

SEQ ID NO: 1062040 - DNA, 16 bp, Homo sapiens
tttcagatatcaaaat

SEQ ID NO: 1062041 - DNA, 17 bp, Homo sapiens
tttcagatgatttgaaa

SEQ ID NO: 1062042 - DNA, 12 bp, Homo sapiens
tttcagatgctt

SEQ ID NO: 1062043 - DNA, 15 bp, Homo sapiens
tttcagatgtaatgt

SEQ ID NO: 1062044 - DNA, 19 bp, Homo sapiens
tttcagatgtcttctgcct

SEQ ID NO: 1062045 - DNA, 16 bp, Homo sapiens
tttcagatgtgcaata

SEQ ID NO: 1062046 - DNA, 17 bp, Homo sapiens
tttcagatgtgcaataa

SEQ ID NO: 1062047 - DNA, 20 bp, Homo sapiens
tttcagattcccagagcaaa

SEQ ID NO: 1062048 - DNA, 21 bp, Homo sapiens
tttcagattgtggaatgttgg

SEQ ID NO: 1062049 - DNA, 21 bp, Homo sapiens
tttcagattttttaaaatttt

SEQ ID NO: 1062050 - DNA, 18 bp, Homo sapiens
tttcagcacccccaccca

SEQ ID NO: 1062051 - DNA, 21 bp, Homo sapiens
tttcagcacccccacccacct

SEQ ID NO: 1062052 - DNA, 15 bp, Homo sapiens
tttcagcactgatgg

SEQ ID NO: 1062053 - DNA, 18 bp, Homo sapiens
tttcagcattaagctgtt

SEQ ID NO: 1062054 - DNA, 17 bp, Homo sapiens
tttcagccaaagtccta

SEQ ID NO: 1062055 - DNA, 20 bp, Homo sapiens
tttcagccatgataagaaca

SEQ ID NO: 1062056 - DNA, 11 bp, Homo sapiens
tttcagcctcc

SEQ ID NO: 1062057 - DNA, 22 bp, Homo sapiens
tttcagcgatgtatgcagctat

SEQ ID NO: 1062058 - DNA, 17 bp, Homo sapiens
tttcagctcttaaaaag

SEQ ID NO: 1062059 - DNA, 23 bp, Homo sapiens
tttcaggaaaatgtattgattca

SEQ ID NO: 1062060 - DNA, 12 bp, Homo sapiens
tttcaggaggaa

SEQ ID NO: 1062061 - DNA, 13 bp, Homo sapiens
tttcaggatactc

SEQ ID NO: 1062062 - DNA, 19 bp, Homo sapiens
tttcaggccagtgtggtgt

SEQ ID NO: 1062063 - DNA, 21 bp, Homo sapiens
tttcaggctacctttttctgg

SEQ ID NO: 1062064 - DNA, 21 bp, Homo sapiens
tttcaggggtcgtcaccacct

SEQ ID NO: 1062065 - DNA, 22 bp, Homo sapiens
tttcagggttttctgagggaaa

SEQ ID NO: 1062066 - DNA, 16 bp, Homo sapiens
tttctgttccaaattc

SEQ ID NO: 1062067 - DNA, 17 bp, Homo sapiens
tttctgttcttacaaat

SEQ ID NO: 1062068 - DNA, 23 bp, Homo sapiens
tttctgttcttacaaatgtgaaa

SEQ ID NO: 1062069 - DNA, 22 bp, Homo sapiens
tttctgttgaattatgttttga

SEQ ID NO: 1062070 - DNA, 18 bp, Homo sapiens
tttctgttgtcattgctg

SEQ ID NO: 1062071 - DNA, 23 bp, Homo sapiens
tttctgttgtcattgctgttgtc

SEQ ID NO: 1062072 - DNA, 18 bp, Homo sapiens
tttcttaaaccttcagtt

SEQ ID NO: 1062073 - DNA, 15 bp, Homo sapiens
tttcttaaagctttt

SEQ ID NO: 1062074 - DNA, 19 bp, Homo sapiens
tttcttaaataagaaactt

SEQ ID NO: 1062075 - DNA, 22 bp, Homo sapiens
tttcttaaataatgcttcagat

SEQ ID NO: 1062076 - DNA, 20 bp, Homo sapiens
tttcttaaatatgtatatga

SEQ ID NO: 1062077 - DNA, 22 bp, Homo sapiens
tttcttaaatggaattattttg

SEQ ID NO: 1062078 - DNA, 14 bp, Homo sapiens
tttcttaaccatct

SEQ ID NO: 1062079 - DNA, 17 bp, Homo sapiens
tttcttaacttcttgct

SEQ ID NO: 1062080 - DNA, 21 bp, Homo sapiens
tttcttaacttcttgcttctt

SEQ ID NO: 1062081 - DNA, 12 bp, Homo sapiens
tttcttaaggtt

SEQ ID NO: 1062082 - DNA, 12 bp, Homo sapiens
tttcttaatttg

SEQ ID NO: 1062083 - DNA, 14 bp, Homo sapiens
tttcttaccagtct

SEQ ID NO: 1062084 - DNA, 17 bp, Homo sapiens
tttcttaccagtctcct

SEQ ID NO: 1062085 - DNA, 15 bp, Homo sapiens
tttcttactcctcct

SEQ ID NO: 1062086 - DNA, 19 bp, Homo sapiens
tttcttaggagcaagaaga

SEQ ID NO: 1062087 - DNA, 23 bp, Homo sapiens
tttcttaggagcaagaagaaaat

SEQ ID NO: 1062088 - DNA, 18 bp, Homo sapiens
tttcttagtcgaatgtta

SEQ ID NO: 1062089 - DNA, 21 bp, Homo sapiens
tttcttagtgttgtggacact

SEQ ID NO: 1062090 - DNA, 13 bp, Homo sapiens
tttcttatgtgac

SEQ ID NO: 1062091 - DNA, 14 bp, Homo sapiens
tttcttatgtgaca

SEQ ID NO: 1062092 - DNA, 15 bp, Homo sapiens
tttcttatgtgacat

SEQ ID NO: 1062093 - DNA, 16 bp, Homo sapiens
tttcttatgtgacatt

SEQ ID NO: 1062094 - DNA, 16 bp, Homo sapiens
tttcttcaatggttct

SEQ ID NO: 1062095 - DNA, 18 bp, Homo sapiens
tttcttcaccaaatcttg

SEQ ID NO: 1062096 - DNA, 21 bp, Homo sapiens
tttcttcactgttgaaaatta

SEQ ID NO: 1062097 - DNA, 20 bp, Homo sapiens
tttcttcacttacaagaaag

SEQ ID NO: 1062098 - DNA, 18 bp, Homo sapiens
tttcttcatttctctgca

SEQ ID NO: 1062099 - DNA, 14 bp, Homo sapiens
tttcttccattcct

SEQ ID NO: 1062100 - DNA, 21 bp, Homo sapiens
tttcttcccgtgtgtatttct

SEQ ID NO: 1062101 - DNA, 23 bp, Homo sapiens
tttcttcccgtgtgtatttctaa

SEQ ID NO: 1062102 - DNA, 23 bp, Homo sapiens
tttcttcctaccaagtcaaactt

SEQ ID NO: 1062103 - DNA, 11 bp, Homo sapiens
tttcttcctct

SEQ ID NO: 1062104 - DNA, 13 bp, Homo sapiens
tttcttcctctgc

SEQ ID NO: 1062105 - DNA, 16 bp, Homo sapiens
tttcttcctctgctga

SEQ ID NO: 1062106 - DNA, 11 bp, Homo sapiens
tttcttccttt

SEQ ID NO: 1062107 - DNA, 13 bp, Homo sapiens
tttcttctattaa

SEQ ID NO: 1062108 - DNA, 16 bp, Homo sapiens
tttcttctctttcata

SEQ ID NO: 1062109 - DNA, 11 bp, Homo sapiens
tttcttctgcc

SEQ ID NO: 1062110 - DNA, 14 bp, Homo sapiens
tttcttctgtgtta

SEQ ID NO: 1062111 - DNA, 12 bp, Homo sapiens
tttcttcttccc

SEQ ID NO: 1062112 - DNA, 12 bp, Homo sapiens
tttcttcttcct

SEQ ID NO: 1062113 - DNA, 13 bp, Homo sapiens
tttcttcttcctg

SEQ ID NO: 1062114 - DNA, 16 bp, Homo sapiens
tttcttctttccctgg

SEQ ID NO: 1062115 - DNA, 15 bp, Homo sapiens
tttcttctttccttt

SEQ ID NO: 1062116 - DNA, 14 bp, Homo sapiens
tttcttctttctag

SEQ ID NO: 1062117 - DNA, 14 bp, Homo sapiens
tttcttcttttcct

SEQ ID NO: 1062118 - DNA, 21 bp, Homo sapiens
tttcttgaaaagccttggaga

SEQ ID NO: 1062119 - DNA, 19 bp, Homo sapiens
tttcttgctctctctccct

SEQ ID NO: 1062120 - DNA, 21 bp, Homo sapiens
tttcttgctggttgtcatttt

SEQ ID NO: 1062121 - DNA, 23 bp, Homo sapiens
tttcttggttcataaatgaattt

SEQ ID NO: 1062122 - DNA, 14 bp, Homo sapiens
tttcttgtatctgg

SEQ ID NO: 1062123 - DNA, 17 bp, Homo sapiens
tttcttgtgtagatttg

SEQ ID NO: 1062124 - DNA, 20 bp, Homo sapiens
tttcttgtgtagatttgaaa

SEQ ID NO: 1062125 - DNA, 22 bp, Homo sapiens
tttcttgtttaacatatatatt

SEQ ID NO: 1062126 - DNA, 13 bp, Homo sapiens
tttctttaaagat

SEQ ID NO: 1062127 - DNA, 19 bp, Homo sapiens
tttctttaggacataaaga

SEQ ID NO: 1062128 - DNA, 11 bp, Homo sapiens
tttctttatat

SEQ ID NO: 1062129 - DNA, 18 bp, Homo sapiens
tttctttatcattgctaa

SEQ ID NO: 1062130 - DNA, 13 bp, Homo sapiens
tttctttccagag

SEQ ID NO: 1062131 - DNA, 19 bp, Homo sapiens
tttctttccatttacagtc

SEQ ID NO: 1062132 - DNA, 16 bp, Homo sapiens
tttctttccgacacat

SEQ ID NO: 1062133 - DNA, 10 bp, Homo sapiens
tttctttctt

SEQ ID NO: 1062134 - DNA, 21 bp, Homo sapiens
tttctttgaaaaaaaataaat

SEQ ID NO: 1062135 - DNA, 16 bp, Homo sapiens
tttctttgaatgcttt

SEQ ID NO: 1062136 - DNA, 16 bp, Homo sapiens
tttctttgttatcaaa

SEQ ID NO: 1062137 - DNA, 21 bp, Homo sapiens
tttcttttcccccattaatca

SEQ ID NO: 1062138 - DNA, 15 bp, Homo sapiens
tttcttttgtattaa

SEQ ID NO: 1062139 - DNA, 15 bp, Homo sapiens
tttctttttaaagtt

SEQ ID NO: 1062140 - DNA, 14 bp, Homo sapiens
tttctttttcttct

SEQ ID NO: 1062141 - DNA, 15 bp, Homo sapiens
tttcttttttaaagt

SEQ ID NO: 1062142 - DNA, 17 bp, Homo sapiens
tttctttttttttaagt

SEQ ID NO: 1062143 - DNA, 16 bp, Homo sapiens
tttgaaaaaaacttca

SEQ ID NO: 1062144 - DNA, 14 bp, Homo sapiens
tttgaaaaaaagca

SEQ ID NO: 1062145 - DNA, 14 bp, Homo sapiens
tttgaaaacaattc

SEQ ID NO: 1062146 - DNA, 15 bp, Homo sapiens
tttgaaaacatataa

SEQ ID NO: 1062147 - DNA, 15 bp, Homo sapiens
tttgaaaatgtcctt

SEQ ID NO: 1062148 - DNA, 22 bp, Homo sapiens
tttgaaaattacatgttttttc

SEQ ID NO: 1062149 - DNA, 20 bp, Homo sapiens
tttgaaaattgtataccaat

SEQ ID NO: 1062150 - DNA, 15 bp, Homo sapiens
tttgaaacaaagaag

SEQ ID NO: 1062151 - DNA, 23 bp, Homo sapiens
tttgaaactgtaaatatgtttgt

SEQ ID NO: 1062152 - DNA, 14 bp, Homo sapiens
tttgaaagaaaaat

SEQ ID NO: 1062153 - DNA, 21 bp, Homo sapiens
tttgaaaggagatgtcttgga

SEQ ID NO: 1062154 - DNA, 20 bp, Homo sapiens
tttgaaagtttaacaaatga

SEQ ID NO: 1062155 - DNA, 13 bp, Homo sapiens
tttgaaataaaaa

SEQ ID NO: 1062156 - DNA, 14 bp, Homo sapiens
tttgaaataataaa

SEQ ID NO: 1062157 - DNA, 14 bp, Homo sapiens
tttgaaatagaaaa

SEQ ID NO: 1062158 - DNA, 16 bp, Homo sapiens
tttgaaatatggtctt

SEQ ID NO: 1062159 - DNA, 14 bp, Homo sapiens
tttgaaatgggcat

SEQ ID NO: 1062160 - DNA, 22 bp, Homo sapiens
tttgaaatgtcgatcaagagaa

SEQ ID NO: 1062161 - DNA, 17 bp, Homo sapiens
tttgaaattgtagtgca

SEQ ID NO: 1062162 - DNA, 23 bp, Homo sapiens
tttgaacactggctaaagataat

SEQ ID NO: 1062163 - DNA, 23 bp, Homo sapiens
tttgaaccattccctagtcattt

SEQ ID NO: 1062164 - DNA, 23 bp, Homo sapiens
tttgaacctttttttttgaaaca

SEQ ID NO: 1062165 - DNA, 15 bp, Homo sapiens
tttgaactgataaag

SEQ ID NO: 1062166 - DNA, 17 bp, Homo sapiens
tttgaactggcaattgt

SEQ ID NO: 1062167 - DNA, 19 bp, Homo sapiens
tttgaactggcaattgtct

SEQ ID NO: 1062168 - DNA, 19 bp, Homo sapiens
tttgaactgttagatgctg

SEQ ID NO: 1062169 - DNA, 21 bp, Homo sapiens
tttgaactgttagatgctgaa

SEQ ID NO: 1062170 - DNA, 13 bp, Homo sapiens
tttgaacttgtca

SEQ ID NO: 1062171 - DNA, 21 bp, Homo sapiens
tttgaagacacagcctccccc

SEQ ID NO: 1062172 - DNA, 20 bp, Homo sapiens
tttgaagacgtggactcctc

SEQ ID NO: 1062173 - DNA, 17 bp, Homo sapiens
tttgaagacttcaaaat

SEQ ID NO: 1062174 - DNA, 23 bp, Homo sapiens
tttgaagacttcaaaatattgag

SEQ ID NO: 1062175 - DNA, 17 bp, Homo sapiens
tttgaagataataatct

SEQ ID NO: 1062176 - DNA, 20 bp, Homo sapiens
tttgaagcagtcttgctctg

SEQ ID NO: 1062177 - DNA, 18 bp, Homo sapiens
tttgaagcagttgtgtca

SEQ ID NO: 1062178 - DNA, 20 bp, Homo sapiens
tttgaagcatagctacaatt

SEQ ID NO: 1062179 - DNA, 21 bp, Homo sapiens
tttgaagcatagctacaattt

SEQ ID NO: 1062180 - DNA, 22 bp, Homo sapiens
tttgaaggaaatgagtggccag

SEQ ID NO: 1062181 - DNA, 17 bp, Homo sapiens
tttgaagggcaagaaat

SEQ ID NO: 1062182 - DNA, 23 bp, Homo sapiens
tttgaagtagtttgtataacttc

SEQ ID NO: 1062183 - DNA, 22 bp, Homo sapiens
tttgaagtcataccaatgaaaa

SEQ ID NO: 1062184 - DNA, 19 bp, Homo sapiens
tttgaagtcttccctcaga

SEQ ID NO: 1062185 - DNA, 15 bp, Homo sapiens
tttgaagtgctgttt

SEQ ID NO: 1062186 - DNA, 16 bp, Homo sapiens
tttgaagtgctgttta

SEQ ID NO: 1062187 - DNA, 11 bp, Homo sapiens
tttgaagtgta

SEQ ID NO: 1062188 - DNA, 23 bp, Homo sapiens
tttgaagttagctttaacttaaa

SEQ ID NO: 1062189 - DNA, 19 bp, Homo sapiens
tttgaataaaaagtgaact

SEQ ID NO: 1062190 - DNA, 21 bp, Homo sapiens
tttgaataaaaagtgaacttt

SEQ ID NO: 1062191 - DNA, 22 bp, Homo sapiens
tttgaataaaaagtgaactttt

SEQ ID NO: 1062192 - DNA, 13 bp, Homo sapiens
tttgaataaatgt

SEQ ID NO: 1062193 - DNA, 16 bp, Homo sapiens
tttgaataccattaaa

SEQ ID NO: 1062194 - DNA, 18 bp, Homo sapiens
tttgaatcacatgaatta

SEQ ID NO: 1062195 - DNA, 17 bp, Homo sapiens
tttgaatccatgcttgg

SEQ ID NO: 1062196 - DNA, 12 bp, Homo sapiens
tttgaatgaaaa

SEQ ID NO: 1062197 - DNA, 23 bp, Homo sapiens
tttgaatgaaaaatttaagcatt

SEQ ID NO: 1062198 - DNA, 13 bp, Homo sapiens
tttgaatgaaaac

SEQ ID NO: 1062199 - DNA, 13 bp, Homo sapiens
tttgaatgttaat

SEQ ID NO: 1062200 - DNA, 20 bp, Homo sapiens
tttgaatgttatttgttatt

SEQ ID NO: 1062201 - DNA, 18 bp, Homo sapiens
tttgaattatttctttat

SEQ ID NO: 1062202 - DNA, 20 bp, Homo sapiens
tttgaattcctcctctattt

SEQ ID NO: 1062203 - DNA, 20 bp, Homo sapiens
tttgaattcttgatctctaa

SEQ ID NO: 1062204 - DNA, 16 bp, Homo sapiens
tttgaattttctgtgt

SEQ ID NO: 1062205 - DNA, 17 bp, Homo sapiens
tttgaattttgttttta

SEQ ID NO: 1062206 - DNA, 18 bp, Homo sapiens
tttgacaaaagtaaatgg

SEQ ID NO: 1062207 - DNA, 14 bp, Homo sapiens
tttgacaaagtgcc

SEQ ID NO: 1062208 - DNA, 18 bp, Homo sapiens
agggtccctctgtgtatt

SEQ ID NO: 1062209 - DNA, 12 bp, Homo sapiens
agggtccctggg

SEQ ID NO: 1062210 - DNA, 16 bp, Homo sapiens
agggtccgcaccagct

SEQ ID NO: 1062211 - DNA, 22 bp, Homo sapiens
agggtccgcaccagctgctctg

SEQ ID NO: 1062212 - DNA, 15 bp, Homo sapiens
agggtcctcttttcc

SEQ ID NO: 1062213 - DNA, 20 bp, Homo sapiens
agggtcctgccggtgggacc

SEQ ID NO: 1062214 - DNA, 17 bp, Homo sapiens
agggtcctggctcctga

SEQ ID NO: 1062215 - DNA, 19 bp, Homo sapiens
agggtcctggctcctgagg

SEQ ID NO: 1062216 - DNA, 20 bp, Homo sapiens
agggtcctggctcctgaggg

SEQ ID NO: 1062217 - DNA, 18 bp, Homo sapiens
agggtcctttagtacctg

SEQ ID NO: 1062218 - DNA, 17 bp, Homo sapiens
agggtccttttgacact

SEQ ID NO: 1062219 - DNA, 22 bp, Homo sapiens
agggtccttttgacactgctct

SEQ ID NO: 1062220 - DNA, 17 bp, Homo sapiens
agggtcggaacccaagc

SEQ ID NO: 1062221 - DNA, 16 bp, Homo sapiens
agggtctagggagaga

SEQ ID NO: 1062222 - DNA, 19 bp, Homo sapiens
agggtctagggagagaccc

SEQ ID NO: 1062223 - DNA, 17 bp, Homo sapiens
agggtctcccctcctgc

SEQ ID NO: 1062224 - DNA, 12 bp, Homo sapiens
agggtctctccc

SEQ ID NO: 1062225 - DNA, 19 bp, Homo sapiens
agggtctgcagcctgctgg

SEQ ID NO: 1062226 - DNA, 13 bp, Homo sapiens
agggtctgctctt

SEQ ID NO: 1062227 - DNA, 14 bp, Homo sapiens
agggtctgctcttt

SEQ ID NO: 1062228 - DNA, 23 bp, Homo sapiens
agggtctgctctttctctgccag

SEQ ID NO: 1062229 - DNA, 21 bp, Homo sapiens
agggtctggcagagcctctga

SEQ ID NO: 1062230 - DNA, 18 bp, Homo sapiens
agggtctgggctgggcac

SEQ ID NO: 1062231 - DNA, 17 bp, Homo sapiens
agggtctgggggcagct

SEQ ID NO: 1062232 - DNA, 18 bp, Homo sapiens
agggtctgggggcagctg

SEQ ID NO: 1062233 - DNA, 18 bp, Homo sapiens
agggtctgtgtgaatgtg

SEQ ID NO: 1062234 - DNA, 23 bp, Homo sapiens
agggtcttacctctctgggacct

SEQ ID NO: 1062235 - DNA, 13 bp, Homo sapiens
agggtcttcttgg

SEQ ID NO: 1062236 - DNA, 16 bp, Homo sapiens
agggtcttcttggcag

SEQ ID NO: 1062237 - DNA, 21 bp, Homo sapiens
agggtcttgactctaaatgca

SEQ ID NO: 1062238 - DNA, 14 bp, Homo sapiens
agggtcttgagggg

SEQ ID NO: 1062239 - DNA, 20 bp, Homo sapiens
agggtcttgaggggaagctg

SEQ ID NO: 1062240 - DNA, 19 bp, Homo sapiens
agggtcttggctgcctgtg

SEQ ID NO: 1062241 - DNA, 15 bp, Homo sapiens
agggtcttgggaaat

SEQ ID NO: 1062242 - DNA, 17 bp, Homo sapiens
agggtcttgggctactg

SEQ ID NO: 1062243 - DNA, 21 bp, Homo sapiens
agggtcttttaccctgtgtca

SEQ ID NO: 1062244 - DNA, 18 bp, Homo sapiens
agggtcttttcatctggg

SEQ ID NO: 1062245 - DNA, 17 bp, Homo sapiens
agggtgacagcttcctt

SEQ ID NO: 1062246 - DNA, 20 bp, Homo sapiens
agggtgacatggggaaggca

SEQ ID NO: 1062247 - DNA, 18 bp, Homo sapiens
agggtgacccacagctct

SEQ ID NO: 1062248 - DNA, 19 bp, Homo sapiens
agggtgacccacagctctg

SEQ ID NO: 1062249 - DNA, 20 bp, Homo sapiens
agggtgacccacagctctgg

SEQ ID NO: 1062250 - DNA, 14 bp, Homo sapiens
agggtgacgcccag

SEQ ID NO: 1062251 - DNA, 15 bp, Homo sapiens
agggtgacgcccagc

SEQ ID NO: 1062252 - DNA, 21 bp, Homo sapiens
agggtgacgcctgagacagca

SEQ ID NO: 1062253 - DNA, 14 bp, Homo sapiens
agggtgagagctgc

SEQ ID NO: 1062254 - DNA, 23 bp, Homo sapiens
agggtgattttatgatcagtgtt

SEQ ID NO: 1062255 - DNA, 13 bp, Homo sapiens
agggtgcatagct

SEQ ID NO: 1062256 - DNA, 20 bp, Homo sapiens
agggtgccccgcctgagtca

SEQ ID NO: 1062257 - DNA, 21 bp, Homo sapiens
agggtgccccgcctgagtcag

SEQ ID NO: 1062258 - DNA, 21 bp, Homo sapiens
agggtgctctgaatctgtaca

SEQ ID NO: 1062259 - DNA, 19 bp, Homo sapiens
agggtgctctgaggtcaat

SEQ ID NO: 1062260 - DNA, 21 bp, Homo sapiens
agggtgctgatgggaaggagg

SEQ ID NO: 1062261 - DNA, 20 bp, Homo sapiens
agggtgctgtcccctcccct

SEQ ID NO: 1062262 - DNA, 12 bp, Homo sapiens
agggtggagact

SEQ ID NO: 1062263 - DNA, 22 bp, Homo sapiens
agggtggaggaaggtgctgagc

SEQ ID NO: 1062264 - DNA, 16 bp, Homo sapiens
agggtggcagaagtgt

SEQ ID NO: 1062265 - DNA, 11 bp, Homo sapiens
agggtggcagc

SEQ ID NO: 1062266 - DNA, 23 bp, Homo sapiens
agagggtatttgtggaaactgtc

SEQ ID NO: 1062267 - DNA, 16 bp, Homo sapiens
agagggtatttttgta

SEQ ID NO: 1062268 - DNA, 19 bp, Homo sapiens
agagggtcccagggctgca

SEQ ID NO: 1062269 - DNA, 15 bp, Homo sapiens
agagggtgtcatcta

SEQ ID NO: 1062270 - DNA, 17 bp, Homo sapiens
agagggttgctgccttt

SEQ ID NO: 1062271 - DNA, 23 bp, Homo sapiens
agagggttttaggtagaaaaaca

SEQ ID NO: 1062272 - DNA, 19 bp, Homo sapiens
agaggtaaaagtgtgagca

SEQ ID NO: 1062273 - DNA, 23 bp, Homo sapiens
agaggtaaaagtgtgagcagtga

SEQ ID NO: 1062274 - DNA, 15 bp, Homo sapiens
agaggtagtgtgaat

SEQ ID NO: 1062275 - DNA, 21 bp, Homo sapiens
agaggtatcttactttcctct

SEQ ID NO: 1062276 - DNA, 19 bp, Homo sapiens
agaggtatgtcagaaaaaa

SEQ ID NO: 1062277 - DNA, 15 bp, Homo sapiens
agaggtatttaactg

SEQ ID NO: 1062278 - DNA, 20 bp, Homo sapiens
agaggtcaggacggctcctc

SEQ ID NO: 1062279 - DNA, 16 bp, Homo sapiens
agaggtccagcccatc

SEQ ID NO: 1062280 - DNA, 17 bp, Homo sapiens
agaggtccagcccatct

SEQ ID NO: 1062281 - DNA, 18 bp, Homo sapiens
agaggtccagcccatctc

SEQ ID NO: 1062282 - DNA, 21 bp, Homo sapiens
agaggtcccagccccaggcct

SEQ ID NO: 1062283 - DNA, 23 bp, Homo sapiens
agaggtcccagccccaggcctgg

SEQ ID NO: 1062284 - DNA, 18 bp, Homo sapiens
agaggtcctctggagccc

SEQ ID NO: 1062285 - DNA, 15 bp, Homo sapiens
agaggtctgagccct

SEQ ID NO: 1062286 - DNA, 16 bp, Homo sapiens
agaggtctgagccctg

SEQ ID NO: 1062287 - DNA, 16 bp, Homo sapiens
agaggtgagaaattta

SEQ ID NO: 1062288 - DNA, 20 bp, Homo sapiens
agaggtgattctcagggctg

SEQ ID NO: 1062289 - DNA, 12 bp, Homo sapiens
agaggtgccagc

SEQ ID NO: 1062290 - DNA, 20 bp, Homo sapiens
agaggtgcttctgcctgtgc

SEQ ID NO: 1062291 - DNA, 23 bp, Homo sapiens
agaggtggctgcgcccccagctt

SEQ ID NO: 1062292 - DNA, 17 bp, Homo sapiens
agaggtgggagactcgc

SEQ ID NO: 1062293 - DNA, 15 bp, Homo sapiens
agaggtgggcagctg

SEQ ID NO: 1062294 - DNA, 20 bp, Homo sapiens
agaggtgggcagctgggccc

SEQ ID NO: 1062295 - DNA, 14 bp, Homo sapiens
agaggtgggcaggt

SEQ ID NO: 1062296 - DNA, 13 bp, Homo sapiens
agaggtgggccag

SEQ ID NO: 1062297 - DNA, 16 bp, Homo sapiens
agaggtggggagcaga

SEQ ID NO: 1062298 - DNA, 20 bp, Homo sapiens
agaggtgggtggtgggcttc

SEQ ID NO: 1062299 - DNA, 17 bp, Homo sapiens
agaggttatctgcctgg

SEQ ID NO: 1062300 - DNA, 17 bp, Homo sapiens
agaggttttatttacat

SEQ ID NO: 1062301 - DNA, 20 bp, Homo sapiens
agaggtttttcttgggaaag

SEQ ID NO: 1062302 - DNA, 14 bp, Homo sapiens
agagtaagcagtgt

SEQ ID NO: 1062303 - DNA, 19 bp, Homo sapiens
agagtaagcagtgttactt

SEQ ID NO: 1062304 - DNA, 14 bp, Homo sapiens
agagtaatgggttt

SEQ ID NO: 1062305 - DNA, 17 bp, Homo sapiens
agagtaatgggtttcat

SEQ ID NO: 1062306 - DNA, 18 bp, Homo sapiens
agagtacagactgcagac

SEQ ID NO: 1062307 - DNA, 16 bp, Homo sapiens
agagtacagtgagcca

SEQ ID NO: 1062308 - DNA, 17 bp, Homo sapiens
agagtacgtgaaatgct

SEQ ID NO: 1062309 - DNA, 20 bp, Homo sapiens
agagtactcacttttcactt

SEQ ID NO: 1062310 - DNA, 18 bp, Homo sapiens
agagtagagctcaaaact

SEQ ID NO: 1062311 - DNA, 23 bp, Homo sapiens
agagtagccagggtgtggccctg

SEQ ID NO: 1062312 - DNA, 19 bp, Homo sapiens
agagtagccgagagcctgc

SEQ ID NO: 1062313 - DNA, 22 bp, Homo sapiens
agagtagccgagagcctgctcc

SEQ ID NO: 1062314 - DNA, 17 bp, Homo sapiens
agagtagggtagaagga

SEQ ID NO: 1062315 - DNA, 15 bp, Homo sapiens
agagtagttagagaa

SEQ ID NO: 1062316 - DNA, 13 bp, Homo sapiens
agagtatatgcac

SEQ ID NO: 1062317 - DNA, 21 bp, Homo sapiens
agagtatccttccttcagggt

SEQ ID NO: 1062318 - DNA, 22 bp, Homo sapiens
agagtatgagtcttctgtaatt

SEQ ID NO: 1062319 - DNA, 15 bp, Homo sapiens
agagtatttcccttc

SEQ ID NO: 1062320 - DNA, 15 bp, Homo sapiens
agagtatttttaaca

SEQ ID NO: 1062321 - DNA, 16 bp, Homo sapiens
agagtatttttaacac

SEQ ID NO: 1062322 - DNA, 21 bp, Homo sapiens
agagtcaactacacaaagcag

SEQ ID NO: 1062323 - DNA, 22 bp, Homo sapiens
agagtcaactacacaaagcagg

SEQ ID NO: 1062324 - DNA, 23 bp, Homo sapiens
agagtcaatgtcattacatagaa

SEQ ID NO: 1062325 - DNA, 16 bp, Homo sapiens
agagtcaccttttctg

SEQ ID NO: 1062326 - DNA, 14 bp, Homo sapiens
agagtcactcacac

SEQ ID NO: 1062327 - DNA, 14 bp, Homo sapiens
agagtcagatcttt

SEQ ID NO: 1062328 - DNA, 13 bp, Homo sapiens
agagtcagccctt

SEQ ID NO: 1062329 - DNA, 15 bp, Homo sapiens
agagtcagctctctg

SEQ ID NO: 1062330 - DNA, 17 bp, Homo sapiens
agagtcagctctctgcc

SEQ ID NO: 1062331 - DNA, 16 bp, Homo sapiens
agagtcatatacatta

SEQ ID NO: 1062332 - DNA, 21 bp, Homo sapiens
agagtcatatacattagtttt

SEQ ID NO: 1062333 - DNA, 15 bp, Homo sapiens
agggtggcagcaaca

SEQ ID NO: 1062334 - DNA, 14 bp, Homo sapiens
agggtggcaggtga

SEQ ID NO: 1062335 - DNA, 11 bp, Homo sapiens
agggtggctgc

SEQ ID NO: 1062336 - DNA, 14 bp, Homo sapiens
agggtggctgccag

SEQ ID NO: 1062337 - DNA, 16 bp, Homo sapiens
agggtggctgccagcc

SEQ ID NO: 1062338 - DNA, 18 bp, Homo sapiens
agggtggctgccagccca

SEQ ID NO: 1062339 - DNA, 20 bp, Homo sapiens
agggtggctgccagcccact

SEQ ID NO: 1062340 - DNA, 18 bp, Homo sapiens
agggtggctttaattgta

SEQ ID NO: 1062341 - DNA, 22 bp, Homo sapiens
agggtggctttaattgtataag

SEQ ID NO: 1062342 - DNA, 17 bp, Homo sapiens
agggtgggaagaaagaa

SEQ ID NO: 1062343 - DNA, 18 bp, Homo sapiens
agggtgggaagaaagaat

SEQ ID NO: 1062344 - DNA, 12 bp, Homo sapiens
agggtgggaagg

SEQ ID NO: 1062345 - DNA, 17 bp, Homo sapiens
agggtgggagagcccag

SEQ ID NO: 1062346 - DNA, 18 bp, Homo sapiens
agggtgggagagcccagc

SEQ ID NO: 1062347 - DNA, 14 bp, Homo sapiens
agggtgggagccta

SEQ ID NO: 1062348 - DNA, 18 bp, Homo sapiens
agggtgggatggaggaga

SEQ ID NO: 1062349 - DNA, 17 bp, Homo sapiens
agggtgggccactctcc

SEQ ID NO: 1062350 - DNA, 22 bp, Homo sapiens
agggtgggccactctcccctcc

SEQ ID NO: 1062351 - DNA, 15 bp, Homo sapiens
agggtgggctgggga

SEQ ID NO: 1062352 - DNA, 19 bp, Homo sapiens
agggtgggcttcctgccct

SEQ ID NO: 1062353 - DNA, 18 bp, Homo sapiens
agggtgggggagggaggt

SEQ ID NO: 1062354 - DNA, 17 bp, Homo sapiens
agggtgggggccacctg

SEQ ID NO: 1062355 - DNA, 17 bp, Homo sapiens
agggtggggtctgggag

SEQ ID NO: 1062356 - DNA, 20 bp, Homo sapiens
agggtggggtctgggagggg

SEQ ID NO: 1062357 - DNA, 16 bp, Homo sapiens
agggtgggtgctcaga

SEQ ID NO: 1062358 - DNA, 17 bp, Homo sapiens
agggtgggtgctcagaa

SEQ ID NO: 1062359 - DNA, 18 bp, Homo sapiens
agggtgggtgctcagaat

SEQ ID NO: 1062360 - DNA, 20 bp, Homo sapiens
agggtgggtgctcagaataa

SEQ ID NO: 1062361 - DNA, 17 bp, Homo sapiens
agggtggtctgagcacc

SEQ ID NO: 1062362 - DNA, 12 bp, Homo sapiens
agggtggtggta

SEQ ID NO: 1062363 - DNA, 18 bp, Homo sapiens
agggtgtaggggccacct

SEQ ID NO: 1062364 - DNA, 15 bp, Homo sapiens
agggtgtatagtgtt

SEQ ID NO: 1062365 - DNA, 16 bp, Homo sapiens
agggtgtatagtgttc

SEQ ID NO: 1062366 - DNA, 19 bp, Homo sapiens
agggtgtatagtgttcaca

SEQ ID NO: 1062367 - DNA, 20 bp, Homo sapiens
agggtgtatagtgttcacaa

SEQ ID NO: 1062368 - DNA, 19 bp, Homo sapiens
agggtgtggctcctaccag

SEQ ID NO: 1062369 - DNA, 17 bp, Homo sapiens
agggttaagaaaagaga

SEQ ID NO: 1062370 - DNA, 16 bp, Homo sapiens
agggttaaggcctgaa

SEQ ID NO: 1062371 - DNA, 20 bp, Homo sapiens
agggttaggaatctcttcac

SEQ ID NO: 1062372 - DNA, 13 bp, Homo sapiens
agggttagggagg

SEQ ID NO: 1062373 - DNA, 16 bp, Homo sapiens
agggttcagagactca

SEQ ID NO: 1062374 - DNA, 18 bp, Homo sapiens
agggttcccccagccctg

SEQ ID NO: 1062375 - DNA, 14 bp, Homo sapiens
agggttctgccctg

SEQ ID NO: 1062376 - DNA, 15 bp, Homo sapiens
agggttctgccctgc

SEQ ID NO: 1062377 - DNA, 21 bp, Homo sapiens
agggttctgccctgcctgagg

SEQ ID NO: 1062378 - DNA, 22 bp, Homo sapiens
agggttctgccctgcctgagga

SEQ ID NO: 1062379 - DNA, 19 bp, Homo sapiens
agggttctgctcggcttct

SEQ ID NO: 1062380 - DNA, 21 bp, Homo sapiens
agggttgaaaatgtgtttgct

SEQ ID NO: 1062381 - DNA, 23 bp, Homo sapiens
agggttgggttcatctgagcaag

SEQ ID NO: 1062382 - DNA, 22 bp, Homo sapiens
agggttggtgggctggcccagc

SEQ ID NO: 1062383 - DNA, 23 bp, Homo sapiens
agggttggtgggctggcccagcc

SEQ ID NO: 1062384 - DNA, 23 bp, Homo sapiens
aggtgagaagcagaggaaggaga

SEQ ID NO: 1062385 - DNA, 22 bp, Homo sapiens
aggtgagacttcccagaccccg

SEQ ID NO: 1062386 - DNA, 22 bp, Homo sapiens
aggtgagatcacagcctccagg

SEQ ID NO: 1062387 - DNA, 13 bp, Homo sapiens
aggtgaggcagaa

SEQ ID NO: 1062388 - DNA, 21 bp, Homo sapiens
aggtgaggcatggcaattctg

SEQ ID NO: 1062389 - DNA, 22 bp, Homo sapiens
aggtgaggcgttctcctgcttg

SEQ ID NO: 1062390 - DNA, 14 bp, Homo sapiens
aggtgaggggcagg

SEQ ID NO: 1062391 - DNA, 20 bp, Homo sapiens
aggtgaggggcaggacctga

SEQ ID NO: 1062392 - DNA, 18 bp, Homo sapiens
aggtgagtgtgagggcag

SEQ ID NO: 1062393 - DNA, 19 bp, Homo sapiens
aggtgagtgtgagggcagc

SEQ ID NO: 1062394 - DNA, 16 bp, Homo sapiens
aggtgataaagaggca

SEQ ID NO: 1062395 - DNA, 15 bp, Homo sapiens
aggtgataagggaaa

SEQ ID NO: 1062396 - DNA, 16 bp, Homo sapiens
aggtgatagcattgct

SEQ ID NO: 1062397 - DNA, 18 bp, Homo sapiens
aggtgatatatttaaaaa

SEQ ID NO: 1062398 - DNA, 22 bp, Homo sapiens
aggtgatatttttatgtgcagc

SEQ ID NO: 1062399 - DNA, 21 bp, Homo sapiens
aggtgatctgtttgaggagag

SEQ ID NO: 1062400 - DNA, 19 bp, Homo sapiens
aggtgatggaggtatttga

SEQ ID NO: 1062401 - DNA, 23 bp, Homo sapiens
aggtgatgggcagatcttttctt

SEQ ID NO: 1062402 - DNA, 17 bp, Homo sapiens
aggtgattctcagggct

SEQ ID NO: 1062403 - DNA, 22 bp, Homo sapiens
aggtgattctcagggctggagc

SEQ ID NO: 1062404 - DNA, 22 bp, Homo sapiens
aggtgcaacaaggtcctctgtc

SEQ ID NO: 1062405 - DNA, 14 bp, Homo sapiens
aggtgcacattttc

SEQ ID NO: 1062406 - DNA, 17 bp, Homo sapiens
aggtgcagatgggctgt

SEQ ID NO: 1062407 - DNA, 17 bp, Homo sapiens
aggtgcagccccagggc

SEQ ID NO: 1062408 - DNA, 18 bp, Homo sapiens
aggtgcagccccagggcc

SEQ ID NO: 1062409 - DNA, 17 bp, Homo sapiens
aggtgcagctcctcagc

SEQ ID NO: 1062410 - DNA, 12 bp, Homo sapiens
aggtgcaggtgc

SEQ ID NO: 1062411 - DNA, 16 bp, Homo sapiens
aggtgcagtggctcac

SEQ ID NO: 1062412 - DNA, 17 bp, Homo sapiens
aggtgcatctgcaggca

SEQ ID NO: 1062413 - DNA, 23 bp, Homo sapiens
aggtgcatctggggaactagagg

SEQ ID NO: 1062414 - DNA, 15 bp, Homo sapiens
aggtgccactccctg

SEQ ID NO: 1062415 - DNA, 16 bp, Homo sapiens
aggtgccactccctga

SEQ ID NO: 1062416 - DNA, 18 bp, Homo sapiens
aggtgccactccctgagc

SEQ ID NO: 1062417 - DNA, 13 bp, Homo sapiens
aggtgccaggctg

SEQ ID NO: 1062418 - DNA, 14 bp, Homo sapiens
aggtgccattttaa

SEQ ID NO: 1062419 - DNA, 17 bp, Homo sapiens
aggtgccccaaaatgca

SEQ ID NO: 1062420 - DNA, 15 bp, Homo sapiens
aggtgcctccaggtg

SEQ ID NO: 1062421 - DNA, 17 bp, Homo sapiens
aggtgcctgctcaggtg

SEQ ID NO: 1062422 - DNA, 18 bp, Homo sapiens
aggtgcctgctcaggtgc

SEQ ID NO: 1062423 - DNA, 20 bp, Homo sapiens
aggtgcctgctcaggtgcta

SEQ ID NO: 1062424 - DNA, 13 bp, Homo sapiens
aggtgcctggcca

SEQ ID NO: 1062425 - DNA, 11 bp, Homo sapiens
aggtgcctgtg

SEQ ID NO: 1062426 - DNA, 19 bp, Homo sapiens
aggtgcctgtgaggcaggg

SEQ ID NO: 1062427 - DNA, 21 bp, Homo sapiens
aggtgcctgtgaggcaggggc

SEQ ID NO: 1062428 - DNA, 22 bp, Homo sapiens
aggtgcctgtgaggcaggggcg

SEQ ID NO: 1062429 - DNA, 22 bp, Homo sapiens
aggtgccttacatcttttctaa

SEQ ID NO: 1062430 - DNA, 21 bp, Homo sapiens
aggtgcgaatgacagtagcat

SEQ ID NO: 1062431 - DNA, 22 bp, Homo sapiens
aggtgcgcgccaccgtgcctgg

SEQ ID NO: 1062432 - DNA, 20 bp, Homo sapiens
aggtgcgtgtgtctctgtct

SEQ ID NO: 1062433 - DNA, 22 bp, Homo sapiens
aggtgcgtgttcagcagaacct

SEQ ID NO: 1062434 - DNA, 23 bp, Homo sapiens
aggtgctaaatggtcgcccagga

SEQ ID NO: 1062435 - DNA, 18 bp, Homo sapiens
aggtgctaacatagattt

SEQ ID NO: 1062436 - DNA, 20 bp, Homo sapiens
aggtgctaatttgttttgga

SEQ ID NO: 1062437 - DNA, 20 bp, Homo sapiens
aggtgctatataattgtgaa

SEQ ID NO: 1062438 - DNA, 20 bp, Homo sapiens
aggtgctcttgaacctgtgc

SEQ ID NO: 1062439 - DNA, 22 bp, Homo sapiens
aggtgctgaatgaagctgccat

SEQ ID NO: 1062440 - DNA, 18 bp, Homo sapiens
aggtgctgagcttagcct

SEQ ID NO: 1062441 - DNA, 17 bp, Homo sapiens
aggtgctgggctggact

SEQ ID NO: 1062442 - DNA, 14 bp, Homo sapiens
aggtgctgggggag

SEQ ID NO: 1062443 - DNA, 17 bp, Homo sapiens
aggtgctggtagctgag

SEQ ID NO: 1062444 - DNA, 17 bp, Homo sapiens
aggtgctggtgggtctg

SEQ ID NO: 1062445 - DNA, 23 bp, Homo sapiens
aggtgcttattctcaaagcagga

SEQ ID NO: 1062446 - DNA, 18 bp, Homo sapiens
aggtgcttttccctatcc

SEQ ID NO: 1062447 - DNA, 19 bp, Homo sapiens
aggtgcttttccctatcca

SEQ ID NO: 1062448 - DNA, 16 bp, Homo sapiens
aggtggaagaagggag

SEQ ID NO: 1062449 - DNA, 18 bp, Homo sapiens
aggtggaagaagggagaa

SEQ ID NO: 1062450 - DNA, 11 bp, Homo sapiens
aggtggaagcc

SEQ ID NO: 1062451 - DNA, 19 bp, Homo sapiens
aggtggaagccctccttcc

SEQ ID NO: 1062452 - DNA, 16 bp, Homo sapiens
aggtggaaggcagaca

SEQ ID NO: 1062453 - DNA, 20 bp, Homo sapiens
aggtggaagttgcagtgagt

SEQ ID NO: 1062454 - DNA, 15 bp, Homo sapiens
aggtggactctggga

SEQ ID NO: 1062455 - DNA, 16 bp, Homo sapiens
aggtggactctgggat

SEQ ID NO: 1062456 - DNA, 18 bp, Homo sapiens
aggtggagagcactagaa

SEQ ID NO: 1062457 - DNA, 15 bp, Homo sapiens
aggtggagggaagga

SEQ ID NO: 1062458 - DNA, 19 bp, Homo sapiens
aggtggagggaaggataaa

SEQ ID NO: 1062459 - DNA, 14 bp, Homo sapiens
aggtggagggaggg

SEQ ID NO: 1062460 - DNA, 17 bp, Homo sapiens
aggtggagtttctctgt

SEQ ID NO: 1062461 - DNA, 16 bp, Homo sapiens
aggtggatcacagagg

SEQ ID NO: 1062462 - DNA, 17 bp, Homo sapiens
aggtggatcacctgagg

SEQ ID NO: 1062463 - DNA, 20 bp, Homo sapiens
aggtggatgttatgaacagc

SEQ ID NO: 1062464 - DNA, 20 bp, Homo sapiens
aggtggcaatgcttaaacta

SEQ ID NO: 1062465 - DNA, 22 bp, Homo sapiens
aggtggcaatgcttaaactaaa

SEQ ID NO: 1062466 - DNA, 14 bp, Homo sapiens
aggtggcagagtga

SEQ ID NO: 1062467 - DNA, 23 bp, Homo sapiens
aggtggccaccgggggtggctct

SEQ ID NO: 1062468 - DNA, 17 bp, Homo sapiens
aggtggccactccagac

SEQ ID NO: 1062469 - DNA, 12 bp, Homo sapiens
aggtggcccagg

SEQ ID NO: 1062470 - DNA, 14 bp, Homo sapiens
aggtggcccaggcc

SEQ ID NO: 1062471 - DNA, 16 bp, Homo sapiens
aggtggcccaggcccc

SEQ ID NO: 1062472 - DNA, 21 bp, Homo sapiens
aggtggcccttgtttacagtg

SEQ ID NO: 1062473 - DNA, 17 bp, Homo sapiens
aggtggccgcccctgag

SEQ ID NO: 1062474 - DNA, 19 bp, Homo sapiens
aggtggccgcccctgaggc

SEQ ID NO: 1062475 - DNA, 12 bp, Homo sapiens
aggtgggcatgc

SEQ ID NO: 1062476 - DNA, 18 bp, Homo sapiens
aggtgggcatgccaccct

SEQ ID NO: 1062477 - DNA, 22 bp, Homo sapiens
aggtgggcatgccaccctcaca

SEQ ID NO: 1062478 - DNA, 15 bp, Homo sapiens
aggtgggccagcccc

SEQ ID NO: 1062479 - DNA, 12 bp, Homo sapiens
aggtgggcccag

SEQ ID NO: 1062480 - DNA, 23 bp, Homo sapiens
aggtgggcccaggaccagctggg

SEQ ID NO: 1062481 - DNA, 16 bp, Homo sapiens
aggtgggcctggcggc

SEQ ID NO: 1062482 - DNA, 19 bp, Homo sapiens
aggtgggcctggcggcctg

SEQ ID NO: 1062483 - DNA, 20 bp, Homo sapiens
aggtgggcctggcggcctgt

SEQ ID NO: 1062484 - DNA, 13 bp, Homo sapiens
aggtgggcctggg

SEQ ID NO: 1062485 - DNA, 16 bp, Homo sapiens
aggtgggctgcctgct

SEQ ID NO: 1062486 - DNA, 13 bp, Homo sapiens
aggtgggctgggc

SEQ ID NO: 1062487 - DNA, 22 bp, Homo sapiens
aggtgggctgggccctctcttc

SEQ ID NO: 1062488 - DNA, 14 bp, Homo sapiens
aggtgggctggggc

SEQ ID NO: 1062489 - DNA, 22 bp, Homo sapiens
aggtggggaaggagggacttgg

SEQ ID NO: 1062490 - DNA, 21 bp, Homo sapiens
aggtggggagactgggctgag

SEQ ID NO: 1062491 - DNA, 18 bp, Homo sapiens
aggtggggccctgcccct

SEQ ID NO: 1062492 - DNA, 19 bp, Homo sapiens
aggtggggccctgccccta

SEQ ID NO: 1062493 - DNA, 16 bp, Homo sapiens
aggtggggcctcagcc

SEQ ID NO: 1062494 - DNA, 21 bp, Homo sapiens
aggtggggcctcagcctgggg

SEQ ID NO: 1062495 - DNA, 17 bp, Homo sapiens
aggtgggggtgggctgc

SEQ ID NO: 1062496 - DNA, 18 bp, Homo sapiens
aggtgggtaggagccctt

SEQ ID NO: 1062497 - DNA, 14 bp, Homo sapiens
aggtgggtccagga

SEQ ID NO: 1062498 - DNA, 22 bp, Homo sapiens
aggtgggtccaggaaggcagct

SEQ ID NO: 1062499 - DNA, 23 bp, Homo sapiens
aggtgggtccaggaaggcagctg

SEQ ID NO: 1062500 - DNA, 14 bp, Homo sapiens
aggtgggtgggcct

SEQ ID NO: 1062501 - DNA, 18 bp, Homo sapiens
aggtgggtgggcctgact

SEQ ID NO: 1062502 - DNA, 21 bp, Homo sapiens
aggtgggtggtgggcttctgc

SEQ ID NO: 1062503 - DNA, 19 bp, Homo sapiens
aggtgggttttcttcccat

SEQ ID NO: 1062504 - DNA, 14 bp, Homo sapiens
aggtggtctgaatg

SEQ ID NO: 1062505 - DNA, 20 bp, Homo sapiens
aggtggtctgaatgttctga

SEQ ID NO: 1062506 - DNA, 15 bp, Homo sapiens
aggtggtgccttctc

SEQ ID NO: 1062507 - DNA, 15 bp, Homo sapiens
aggtgtagctgagct

SEQ ID NO: 1062508 - DNA, 14 bp, Homo sapiens
aggtgtataaatgt

SEQ ID NO: 1062509 - DNA, 20 bp, Homo sapiens
aggtgtataaatgtacattt

SEQ ID NO: 1062510 - DNA, 19 bp, Homo sapiens
aggtgtcaccctgcagagc

SEQ ID NO: 1062511 - DNA, 14 bp, Homo sapiens
aggtgtcaggcccg

SEQ ID NO: 1062512 - DNA, 23 bp, Homo sapiens
aggtgtcaggcccgtcggagctg

SEQ ID NO: 1062513 - DNA, 15 bp, Homo sapiens
aggtgtccccaacgt

SEQ ID NO: 1062514 - DNA, 20 bp, Homo sapiens
aggtgtccccaacgtcccct

SEQ ID NO: 1062515 - DNA, 15 bp, Homo sapiens
aggtgtctctgggcc

SEQ ID NO: 1062516 - DNA, 18 bp, Homo sapiens
aggtgtctctgggcctgt

SEQ ID NO: 1062517 - DNA, 19 bp, Homo sapiens
aggtgtctctgggcctgtg

SEQ ID NO: 1062518 - DNA, 21 bp, Homo sapiens
aggtgtctctgggcctgtgtg

SEQ ID NO: 1062519 - DNA, 16 bp, Homo sapiens
aggtgtctgcacccag

SEQ ID NO: 1062520 - DNA, 15 bp, Homo sapiens
aggtgtctgccttca

SEQ ID NO: 1062521 - DNA, 18 bp, Homo sapiens
aggtgtgactgaatttct

SEQ ID NO: 1062522 - DNA, 22 bp, Homo sapiens
aggtgtgagccactgcgcccag

SEQ ID NO: 1062523 - DNA, 17 bp, Homo sapiens
aggtgtgaggaggaggc

SEQ ID NO: 1062524 - DNA, 17 bp, Homo sapiens
aggtgtgagtctggctg

SEQ ID NO: 1062525 - DNA, 22 bp, Homo sapiens
aggtgtgatttcctaatatgat

SEQ ID NO: 1062526 - DNA, 15 bp, Homo sapiens
aggtgtgcctggaag

SEQ ID NO: 1062527 - DNA, 19 bp, Homo sapiens
aggtgtgcttcctgctgta

SEQ ID NO: 1062528 - DNA, 18 bp, Homo sapiens
aggtgtgggatggagagt

SEQ ID NO: 1062529 - DNA, 19 bp, Homo sapiens
aggtgtgggatggagagtg

SEQ ID NO: 1062530 - DNA, 22 bp, Homo sapiens
aggtgtggggacacagcagtga

SEQ ID NO: 1062531 - DNA, 23 bp, Homo sapiens
aggtgtggggacacagcagtgag

SEQ ID NO: 1062532 - DNA, 17 bp, Homo sapiens
aggtgtgggggctgcag

SEQ ID NO: 1062533 - DNA, 12 bp, Homo sapiens
aggtgtggtggc

SEQ ID NO: 1062534 - DNA, 18 bp, Homo sapiens
aggtgtgtccttgaactg

SEQ ID NO: 1062535 - DNA, 23 bp, Homo sapiens
aggtgtgtccttgaactgaggcc

SEQ ID NO: 1062536 - DNA, 16 bp, Homo sapiens
aggtgtgtggtgcacg

SEQ ID NO: 1062537 - DNA, 20 bp, Homo sapiens
aggtgtgtgtgaactgggca

SEQ ID NO: 1062538 - DNA, 21 bp, Homo sapiens
aggtgtgtgtgaactgggcac

SEQ ID NO: 1062539 - DNA, 20 bp, Homo sapiens
aggtgttacagaggaccctt

SEQ ID NO: 1062540 - DNA, 12 bp, Homo sapiens
aggtgttgccaa

SEQ ID NO: 1062541 - DNA, 21 bp, Homo sapiens
aggtgttgccaaatatgtcct

SEQ ID NO: 1062542 - DNA, 15 bp, Homo sapiens
aggtgttgtcccttc

SEQ ID NO: 1062543 - DNA, 16 bp, Homo sapiens
aggtgttgtcccttct

SEQ ID NO: 1062544 - DNA, 13 bp, Homo sapiens
aggtgtttaaaga

SEQ ID NO: 1062545 - DNA, 17 bp, Homo sapiens
aggtgtttattaaaatt

SEQ ID NO: 1062546 - DNA, 21 bp, Homo sapiens
aggtgtttattaaaattctga

SEQ ID NO: 1062547 - DNA, 22 bp, Homo sapiens
aggtgtttccatttctcaatca

SEQ ID NO: 1062548 - DNA, 23 bp, Homo sapiens
aggtgtttcttgtgtttgagaac

SEQ ID NO: 1062549 - DNA, 17 bp, Homo sapiens
aggtgtttgactttcaa

SEQ ID NO: 1062550 - DNA, 23 bp, Homo sapiens
aggtgttttttatgaagtgcgtg

SEQ ID NO: 1062551 - DNA, 18 bp, Homo sapiens
aggttaaaaaaaaaagtc

SEQ ID NO: 1062552 - DNA, 15 bp, Homo sapiens
aggttaaagaagctg

SEQ ID NO: 1062553 - DNA, 13 bp, Homo sapiens
aggttaaagctaa

SEQ ID NO: 1062554 - DNA, 13 bp, Homo sapiens
aggttaatattta

SEQ ID NO: 1062555 - DNA, 16 bp, Homo sapiens
aggttaatatttaaga

SEQ ID NO: 1062556 - DNA, 14 bp, Homo sapiens
aggttaatgttcat

SEQ ID NO: 1062557 - DNA, 20 bp, Homo sapiens
aggttaattctctagggcta

SEQ ID NO: 1062558 - DNA, 15 bp, Homo sapiens
aggttacgaagacaa

SEQ ID NO: 1062559 - DNA, 20 bp, Homo sapiens
aggttactcagcagcagaga

SEQ ID NO: 1062560 - DNA, 14 bp, Homo sapiens
aggttactgagtga

SEQ ID NO: 1062561 - DNA, 19 bp, Homo sapiens
aggttatacaataacccag

SEQ ID NO: 1062562 - DNA, 19 bp, Homo sapiens
aggttataggtcactcctg

SEQ ID NO: 1062563 - DNA, 13 bp, Homo sapiens
aggttatctgcct

SEQ ID NO: 1062564 - DNA, 15 bp, Homo sapiens
aggttatctgcctgg

SEQ ID NO: 1062565 - DNA, 22 bp, Homo sapiens
aggttatctttttaaaaactct

SEQ ID NO: 1062566 - DNA, 19 bp, Homo sapiens
aggttatggtttaatgtta

SEQ ID NO: 1062567 - DNA, 21 bp, Homo sapiens
aggttattcacaacctcacca

SEQ ID NO: 1062568 - DNA, 14 bp, Homo sapiens
aggttattttgctt

SEQ ID NO: 1062569 - DNA, 19 bp, Homo sapiens
aggttattttgctttggtt

SEQ ID NO: 1062570 - DNA, 17 bp, Homo sapiens
aggttcaagtgattctc

SEQ ID NO: 1062571 - DNA, 24 bp, Homo sapiens
aggttcactgagctccccagatct

SEQ ID NO: 1062572 - DNA, 13 bp, Homo sapiens
aggttcagccaag

SEQ ID NO: 1062573 - DNA, 13 bp, Homo sapiens
agtaacaaaaata

SEQ ID NO: 1062574 - DNA, 20 bp, Homo sapiens
agtaacaatatgtaatcaaa

SEQ ID NO: 1062575 - DNA, 21 bp, Homo sapiens
agtaacactgtgatttatctt

SEQ ID NO: 1062576 - DNA, 11 bp, Homo sapiens
agtaacacttt

SEQ ID NO: 1062577 - DNA, 12 bp, Homo sapiens
agtaacacttta

SEQ ID NO: 1062578 - DNA, 21 bp, Homo sapiens
agtaacactttaaaaccagtt

SEQ ID NO: 1062579 - DNA, 12 bp, Homo sapiens
agtaacagggca

SEQ ID NO: 1062580 - DNA, 19 bp, Homo sapiens
agtaacataactgcttctt

SEQ ID NO: 1062581 - DNA, 17 bp, Homo sapiens
agtaacatgaggggaca

SEQ ID NO: 1062582 - DNA, 15 bp, Homo sapiens
agtaacatttgctgt

SEQ ID NO: 1062583 - DNA, 18 bp, Homo sapiens
agtaaccaaaacagcata

SEQ ID NO: 1062584 - DNA, 16 bp, Homo sapiens
agtaaccattttcctt

SEQ ID NO: 1062585 - DNA, 18 bp, Homo sapiens
agtaaccattttcctttg

SEQ ID NO: 1062586 - DNA, 23 bp, Homo sapiens
agtaaccttttgcacctgctctc

SEQ ID NO: 1062587 - DNA, 16 bp, Homo sapiens
agtaacgcgtcttcct

SEQ ID NO: 1062588 - DNA, 13 bp, Homo sapiens
agtaactactttt

SEQ ID NO: 1062589 - DNA, 22 bp, Homo sapiens
agtaactcataatctataaaca

SEQ ID NO: 1062590 - DNA, 20 bp, Homo sapiens
agtaactcttacctaaactg

SEQ ID NO: 1062591 - DNA, 13 bp, Homo sapiens
agtaactgtgact

SEQ ID NO: 1062592 - DNA, 11 bp, Homo sapiens
agtaactgttt

SEQ ID NO: 1062593 - DNA, 23 bp, Homo sapiens
agtaactgttttttaagtctctc

SEQ ID NO: 1062594 - DNA, 16 bp, Homo sapiens
agtaacttaatactct

SEQ ID NO: 1062595 - DNA, 17 bp, Homo sapiens
agtaacttacttaggtg

SEQ ID NO: 1062596 - DNA, 19 bp, Homo sapiens
agtaacttcttatggaatt

SEQ ID NO: 1062597 - DNA, 15 bp, Homo sapiens
agtaacttggctttc

SEQ ID NO: 1062598 - DNA, 17 bp, Homo sapiens
agtaactttatgtgtaa

SEQ ID NO: 1062599 - DNA, 20 bp, Homo sapiens
agtaactttatgtgtaaata

SEQ ID NO: 1062600 - DNA, 13 bp, Homo sapiens
agtaacttttaaa

SEQ ID NO: 1062601 - DNA, 15 bp, Homo sapiens
agtaacttttttgtg

SEQ ID NO: 1062602 - DNA, 13 bp, Homo sapiens
agtaagaaaatat

SEQ ID NO: 1062603 - DNA, 14 bp, Homo sapiens
agtaagaaaatatt

SEQ ID NO: 1062604 - DNA, 21 bp, Homo sapiens
agtaagaaagtgaagcaaatc

SEQ ID NO: 1062605 - DNA, 15 bp, Homo sapiens
agtaagaatggccaa

SEQ ID NO: 1062606 - DNA, 18 bp, Homo sapiens
agtaagatctctttctaa

SEQ ID NO: 1062607 - DNA, 12 bp, Homo sapiens
agtaagcagtgt

SEQ ID NO: 1062608 - DNA, 12 bp, Homo sapiens
agtaagcctcat

SEQ ID NO: 1062609 - DNA, 17 bp, Homo sapiens
agtaagcctcatcatca

SEQ ID NO: 1062610 - DNA, 21 bp, Homo sapiens
agtaagcctcatcatcagagc

SEQ ID NO: 1062611 - DNA, 19 bp, Homo sapiens
agtaaggtgcttggagttt

SEQ ID NO: 1062612 - DNA, 22 bp, Homo sapiens
agtaagtcttttttttttccaa

SEQ ID NO: 1062613 - DNA, 12 bp, Homo sapiens
agtaagtgtaca

SEQ ID NO: 1062614 - DNA, 15 bp, Homo sapiens
agtaagttaataatg

SEQ ID NO: 1062615 - DNA, 15 bp, Homo sapiens
agtaagttaatgtat

SEQ ID NO: 1062616 - DNA, 23 bp, Homo sapiens
agtaagtttatccaaatcttgaa

SEQ ID NO: 1062617 - DNA, 16 bp, Homo sapiens
agtaataaactgtgtt

SEQ ID NO: 1062618 - DNA, 16 bp, Homo sapiens
agtaataccaaagact

SEQ ID NO: 1062619 - DNA, 18 bp, Homo sapiens
agtaatagtccaatattt

SEQ ID NO: 1062620 - DNA, 18 bp, Homo sapiens
agtaatatgcacacattt

SEQ ID NO: 1062621 - DNA, 19 bp, Homo sapiens
agtaatatgcacacatttt

SEQ ID NO: 1062622 - DNA, 20 bp, Homo sapiens
agtaatatgcacacattttt

SEQ ID NO: 1062623 - DNA, 22 bp, Homo sapiens
agtaatatgcctgctatttgaa

SEQ ID NO: 1062624 - DNA, 13 bp, Homo sapiens
agtaatattatta

SEQ ID NO: 1062625 - DNA, 14 bp, Homo sapiens
agtaatattattac

SEQ ID NO: 1062626 - DNA, 18 bp, Homo sapiens
agtaatcaataaagaaaa

SEQ ID NO: 1062627 - DNA, 22 bp, Homo sapiens
agtaatcaatacagacaaggtt

SEQ ID NO: 1062628 - DNA, 14 bp, Homo sapiens
agtaatcaggcagc

SEQ ID NO: 1062629 - DNA, 16 bp, Homo sapiens
agtaatcccatttccc

SEQ ID NO: 1062630 - DNA, 19 bp, Homo sapiens
agtaatcccgccacctatc

SEQ ID NO: 1062631 - DNA, 17 bp, Homo sapiens
agtaatcgcttaaagat

SEQ ID NO: 1062632 - DNA, 22 bp, Homo sapiens
agtaatctatgtgtttctgtaa

SEQ ID NO: 1062633 - DNA, 24 bp, Homo sapiens
agtaatctatgtgtttctgtaaca

SEQ ID NO: 1062634 - DNA, 13 bp, Homo sapiens
agtaatctgcatt

SEQ ID NO: 1062635 - DNA, 13 bp, Homo sapiens
agtaatctgtata

SEQ ID NO: 1062636 - DNA, 22 bp, Homo sapiens
agtaatctgtataatactttgt

SEQ ID NO: 1062637 - DNA, 19 bp, Homo sapiens
agtaatctgtgtacaaaga

SEQ ID NO: 1062638 - DNA, 18 bp, Homo sapiens
agtaatctttttacagtt

SEQ ID NO: 1062639 - DNA, 21 bp, Homo sapiens
agtaatctttttacagttgca

SEQ ID NO: 1062640 - DNA, 13 bp, Homo sapiens
agtaatgaagaat

SEQ ID NO: 1062641 - DNA, 19 bp, Homo sapiens
agtaatgaagaatcacgat

SEQ ID NO: 1062642 - DNA, 12 bp, Homo sapiens
agtaatgaattt

SEQ ID NO: 1062643 - DNA, 19 bp, Homo sapiens
agtaatgacttagaaactg

SEQ ID NO: 1062644 - DNA, 17 bp, Homo sapiens
agtaatgatactgtgtg

SEQ ID NO: 1062645 - DNA, 15 bp, Homo sapiens
agtaatggtgtagaa

SEQ ID NO: 1062646 - DNA, 16 bp, Homo sapiens
agtaatggtgtagaac

SEQ ID NO: 1062647 - DNA, 23 bp, Homo sapiens
agtaatgtcataaagtgagaaaa

SEQ ID NO: 1062648 - DNA, 13 bp, Homo sapiens
agtaattaataaa

SEQ ID NO: 1062649 - DNA, 19 bp, Homo sapiens
agtaattaataaagaaaaa

SEQ ID NO: 1062650 - DNA, 20 bp, Homo sapiens
agtaattaataaagaaaaag

SEQ ID NO: 1062651 - DNA, 22 bp, Homo sapiens
agtaattcatacaaagtactgt

SEQ ID NO: 1062652 - DNA, 18 bp, Homo sapiens
agtaattgacatgtgcca

SEQ ID NO: 1062653 - DNA, 20 bp, Homo sapiens
agtaattgacatgtgccagg

SEQ ID NO: 1062654 - DNA, 15 bp, Homo sapiens
agtaattgcacattt

SEQ ID NO: 1062655 - DNA, 13 bp, Homo sapiens
agtaattgtgaca

SEQ ID NO: 1062656 - DNA, 17 bp, Homo sapiens
agtaatttagaaatcat

SEQ ID NO: 1062657 - DNA, 23 bp, Homo sapiens
agtaatttagaaatcattttgca

SEQ ID NO: 1062658 - DNA, 13 bp, Homo sapiens
agtaatttattgt

SEQ ID NO: 1062659 - DNA, 23 bp, Homo sapiens
agtaatttattgtttttccttgt

SEQ ID NO: 1062660 - DNA, 14 bp, Homo sapiens
agtaatttcagtgt

SEQ ID NO: 1062661 - DNA, 12 bp, Homo sapiens
agtaatttccta

SEQ ID NO: 1062662 - DNA, 14 bp, Homo sapiens
agtaatttcttttt

SEQ ID NO: 1062663 - DNA, 23 bp, Homo sapiens
agtaattttcatattaaacaaaa

SEQ ID NO: 1062664 - DNA, 20 bp, Homo sapiens
agtaattttgtcacattatt

SEQ ID NO: 1062665 - DNA, 21 bp, Homo sapiens
agtaattttgtcacattattt

SEQ ID NO: 1062666 - DNA, 11 bp, Homo sapiens
agtacaaaatt

SEQ ID NO: 1062667 - DNA, 15 bp, Homo sapiens
agtacaaacatgaaa

SEQ ID NO: 1062668 - DNA, 22 bp, Homo sapiens
agtacaaggacagacagcaggc

SEQ ID NO: 1062669 - DNA, 14 bp, Homo sapiens
agtacaatgaactg

SEQ ID NO: 1062670 - DNA, 17 bp, Homo sapiens
agtacaatgaactgctt

SEQ ID NO: 1062671 - DNA, 21 bp, Homo sapiens
agtacaatgaactgcttttcc

SEQ ID NO: 1062672 - DNA, 17 bp, Homo sapiens
agtacactctgctgttt

SEQ ID NO: 1062673 - DNA, 19 bp, Homo sapiens
agtacacttggtgtactgg

SEQ ID NO: 1062674 - DNA, 14 bp, Homo sapiens
agtacagaaggcaa

SEQ ID NO: 1062675 - DNA, 21 bp, Homo sapiens
agtacagcggctcccctctgc

SEQ ID NO: 1062676 - DNA, 23 bp, Homo sapiens
agtacagcggctcccctctgctt

SEQ ID NO: 1062677 - DNA, 21 bp, Homo sapiens
agtacagtattcttttaaaat

SEQ ID NO: 1062678 - DNA, 13 bp, Homo sapiens
agtacagtgtgtg

SEQ ID NO: 1062679 - DNA, 21 bp, Homo sapiens
agtacataattgattaaaatc

SEQ ID NO: 1062680 - DNA, 23 bp, Homo sapiens
agtacataattgattaaaatctc

SEQ ID NO: 1062681 - DNA, 19 bp, Homo sapiens
agtacattgttacctctat

SEQ ID NO: 1062682 - DNA, 13 bp, Homo sapiens
agtacatttaaat

SEQ ID NO: 1062683 - DNA, 12 bp, Homo sapiens
agtacatttaat

SEQ ID NO: 1062684 - DNA, 16 bp, Homo sapiens
agtaccaatgctgttg

SEQ ID NO: 1062685 - DNA, 17 bp, Homo sapiens
agtaccaatgctgttgt

SEQ ID NO: 1062686 - DNA, 17 bp, Homo sapiens
agtaccacactgagttc

SEQ ID NO: 1062687 - DNA, 15 bp, Homo sapiens
agtaccactcttggt

SEQ ID NO: 1062688 - DNA, 12 bp, Homo sapiens
agtaccatttaa

SEQ ID NO: 1062689 - DNA, 19 bp, Homo sapiens
agtatataataactttatt

SEQ ID NO: 1062690 - DNA, 21 bp, Homo sapiens
agtatatagtatatttatact

SEQ ID NO: 1062691 - DNA, 20 bp, Homo sapiens
agtatatcccaagtgcactt

SEQ ID NO: 1062692 - DNA, 13 bp, Homo sapiens
agtatatctggac

SEQ ID NO: 1062693 - DNA, 15 bp, Homo sapiens
agtatatctggacaa

SEQ ID NO: 1062694 - DNA, 21 bp, Homo sapiens
agtatattgataaccttgaaa

SEQ ID NO: 1062695 - DNA, 11 bp, Homo sapiens
agtatatttat

SEQ ID NO: 1062696 - DNA, 14 bp, Homo sapiens
agtatatttatact

SEQ ID NO: 1062697 - DNA, 20 bp, Homo sapiens
agtatattttatttcaatgt

SEQ ID NO: 1062698 - DNA, 17 bp, Homo sapiens
agtatcaaagaaaaaca

SEQ ID NO: 1062699 - DNA, 16 bp, Homo sapiens
agtatcaagtatagaa

SEQ ID NO: 1062700 - DNA, 17 bp, Homo sapiens
agtatcaagtatagaaa

SEQ ID NO: 1062701 - DNA, 15 bp, Homo sapiens
agtatcagaatactt

SEQ ID NO: 1062702 - DNA, 18 bp, Homo sapiens
agtatcagaatacttgca

SEQ ID NO: 1062703 - DNA, 18 bp, Homo sapiens
agtatcagagatgtccat

SEQ ID NO: 1062704 - DNA, 16 bp, Homo sapiens
agtatcaggggaaaaa

SEQ ID NO: 1062705 - DNA, 15 bp, Homo sapiens
agtatcaggtctccc

SEQ ID NO: 1062706 - DNA, 20 bp, Homo sapiens
agtatcatcagatagcatct

SEQ ID NO: 1062707 - DNA, 14 bp, Homo sapiens
agtatcattttagg

SEQ ID NO: 1062708 - DNA, 21 bp, Homo sapiens
agtatccatgctcttgacctt

SEQ ID NO: 1062709 - DNA, 12 bp, Homo sapiens
agtatcccacat

SEQ ID NO: 1062710 - DNA, 16 bp, Homo sapiens
agtatctaacatgtat

SEQ ID NO: 1062711 - DNA, 18 bp, Homo sapiens
agtatctatatatgtgta

SEQ ID NO: 1062712 - DNA, 22 bp, Homo sapiens
agtatctatatatgtgtatgta

SEQ ID NO: 1062713 - DNA, 15 bp, Homo sapiens
agtatctcagggcct

SEQ ID NO: 1062714 - DNA, 15 bp, Homo sapiens
agtatctgtaaccct

SEQ ID NO: 1062715 - DNA, 18 bp, Homo sapiens
agtatctgtaacccttga

SEQ ID NO: 1062716 - DNA, 12 bp, Homo sapiens
agtatctgtata

SEQ ID NO: 1062717 - DNA, 20 bp, Homo sapiens
agtatctgtatataagttgc

SEQ ID NO: 1062718 - DNA, 21 bp, Homo sapiens
agtatctgtatataagttgct

SEQ ID NO: 1062719 - DNA, 15 bp, Homo sapiens
agtatctgtatctct

SEQ ID NO: 1062720 - DNA, 17 bp, Homo sapiens
agtatctgttgcttgtc

SEQ ID NO: 1062721 - DNA, 15 bp, Homo sapiens
agtatcttctatttt

SEQ ID NO: 1062722 - DNA, 17 bp, Homo sapiens
agtatcttgtgcttctt

SEQ ID NO: 1062723 - DNA, 15 bp, Homo sapiens
agtatcttgtttggc

SEQ ID NO: 1062724 - DNA, 24 bp, Homo sapiens
agtatctttaacaattgtcttaaa

SEQ ID NO: 1062725 - DNA, 17 bp, Homo sapiens
agtatcttttttcaaaa

SEQ ID NO: 1062726 - DNA, 19 bp, Homo sapiens
agtatgaaaatggaaattt

SEQ ID NO: 1062727 - DNA, 15 bp, Homo sapiens
agtatgaacttgaga

SEQ ID NO: 1062728 - DNA, 16 bp, Homo sapiens
agtatgaacttgagat

SEQ ID NO: 1062729 - DNA, 20 bp, Homo sapiens
agtatgaacttgagatctgt

SEQ ID NO: 1062730 - DNA, 22 bp, Homo sapiens
agtatgaacttgagatctgtat

SEQ ID NO: 1062731 - DNA, 16 bp, Homo sapiens
agtatgaatctatgcc

SEQ ID NO: 1062732 - DNA, 23 bp, Homo sapiens
agtatgaatttgagcaggtctca

SEQ ID NO: 1062733 - DNA, 23 bp, Homo sapiens
agtatgagaaaaatattcaagta

SEQ ID NO: 1062734 - DNA, 21 bp, Homo sapiens
agtatgaggcatttgtttgaa

SEQ ID NO: 1062735 - DNA, 15 bp, Homo sapiens
agtatgatgaaaata

SEQ ID NO: 1062736 - DNA, 18 bp, Homo sapiens
agtatgcaaaataaagaa

SEQ ID NO: 1062737 - DNA, 19 bp, Homo sapiens
agtatgcattattaaattg

SEQ ID NO: 1062738 - DNA, 18 bp, Homo sapiens
agtatgccttaagcagaa

SEQ ID NO: 1062739 - DNA, 20 bp, Homo sapiens
agtatgccttaagcagaaca

SEQ ID NO: 1062740 - DNA, 16 bp, Homo sapiens
agtatgctggcttgta

SEQ ID NO: 1062741 - DNA, 20 bp, Homo sapiens
agtatgctttccctgaggaa

SEQ ID NO: 1062742 - DNA, 19 bp, Homo sapiens
agtatggaatattcatttt

SEQ ID NO: 1062743 - DNA, 23 bp, Homo sapiens
agtatggtaggggagggcaggct

SEQ ID NO: 1062744 - DNA, 18 bp, Homo sapiens
agtatggttcaagattgt

SEQ ID NO: 1062745 - DNA, 22 bp, Homo sapiens
agtatggttcaagattgttgat

SEQ ID NO: 1062746 - DNA, 21 bp, Homo sapiens
agtatgtaaagtatgtaaaca

SEQ ID NO: 1062747 - DNA, 15 bp, Homo sapiens
agtatgtatattaaa

SEQ ID NO: 1062748 - DNA, 22 bp, Homo sapiens
agtatgtgacttttctgattaa

SEQ ID NO: 1062749 - DNA, 13 bp, Homo sapiens
agtatgtgatgga

SEQ ID NO: 1062750 - DNA, 15 bp, Homo sapiens
agtatgtgatggact

SEQ ID NO: 1062751 - DNA, 15 bp, Homo sapiens
agtatgttaatatgt

SEQ ID NO: 1062752 - DNA, 20 bp, Homo sapiens
agtatgttattcctggttaa

SEQ ID NO: 1062753 - DNA, 21 bp, Homo sapiens
agtatgttctaacctttacat

SEQ ID NO: 1062754 - DNA, 21 bp, Homo sapiens
agtatgtttttacattatgca

SEQ ID NO: 1062755 - DNA, 13 bp, Homo sapiens
agtattaaggttt

SEQ ID NO: 1062756 - DNA, 17 bp, Homo sapiens
agtattacaaccatata

SEQ ID NO: 1062757 - DNA, 17 bp, Homo sapiens
agtattactgctgctgt

SEQ ID NO: 1062758 - DNA, 14 bp, Homo sapiens
agtattactttctg

SEQ ID NO: 1062759 - DNA, 15 bp, Homo sapiens
agtattatacctttt

SEQ ID NO: 1062760 - DNA, 19 bp, Homo sapiens
agtattatctaaatgaatg

SEQ ID NO: 1062761 - DNA, 23 bp, Homo sapiens
agtattatttctccatcccctcc

SEQ ID NO: 1062762 - DNA, 18 bp, Homo sapiens
agtattcagaaattaaaa

SEQ ID NO: 1062763 - DNA, 14 bp, Homo sapiens
agtattcaggcact

SEQ ID NO: 1062764 - DNA, 14 bp, Homo sapiens
agtattcattctgc

SEQ ID NO: 1062765 - DNA, 22 bp, Homo sapiens
agtattccaccttaaattaaac

SEQ ID NO: 1062766 - DNA, 22 bp, Homo sapiens
agtattccattgtgtgagtgta

SEQ ID NO: 1062767 - DNA, 20 bp, Homo sapiens
agtattcctagcaaatttct

SEQ ID NO: 1062768 - DNA, 23 bp, Homo sapiens
agtattctaaagttttgcaacaa

SEQ ID NO: 1062769 - DNA, 22 bp, Homo sapiens
agtattctcagagcatgtgtca

SEQ ID NO: 1062770 - DNA, 11 bp, Homo sapiens
agtattctcat

SEQ ID NO: 1062771 - DNA, 15 bp, Homo sapiens
agtattctccatcct

SEQ ID NO: 1062772 - DNA, 16 bp, Homo sapiens
agtattctccatcctc

SEQ ID NO: 1062773 - DNA, 12 bp, Homo sapiens
agtattctgaca

SEQ ID NO: 1062774 - DNA, 21 bp, Homo sapiens
agtattctgacatgtaagaaa

SEQ ID NO: 1062775 - DNA, 15 bp, Homo sapiens
agtattgaaaacttc

SEQ ID NO: 1062776 - DNA, 20 bp, Homo sapiens
agtattgaaaacttcaaagc

SEQ ID NO: 1062777 - DNA, 21 bp, Homo sapiens
agtattgaaaacttcaaagct

SEQ ID NO: 1062778 - DNA, 22 bp, Homo sapiens
agtattgcatctgtataagtaa

SEQ ID NO: 1062779 - DNA, 21 bp, Homo sapiens
agtattgccacctctggccaa

SEQ ID NO: 1062780 - DNA, 17 bp, Homo sapiens
agtattgcgaatgtgca

SEQ ID NO: 1062781 - DNA, 13 bp, Homo sapiens
agtattggagcac

SEQ ID NO: 1062782 - DNA, 13 bp, Homo sapiens
agtattgtaaatt

SEQ ID NO: 1062783 - DNA, 15 bp, Homo sapiens
agtattgtaaattat

SEQ ID NO: 1062784 - DNA, 22 bp, Homo sapiens
agtattgtaaattatatttgtg

SEQ ID NO: 1062785 - DNA, 19 bp, Homo sapiens
agtattgttctatttttgt

SEQ ID NO: 1062786 - DNA, 13 bp, Homo sapiens
agtattgttgtcc

SEQ ID NO: 1062787 - DNA, 15 bp, Homo sapiens
agtattgttgtcctt

SEQ ID NO: 1062788 - DNA, 16 bp, Homo sapiens
agtattgttgtccttt

SEQ ID NO: 1062789 - DNA, 15 bp, Homo sapiens
agtattgtttcctga

SEQ ID NO: 1062790 - DNA, 22 bp, Homo sapiens
agtatttaactacatctgcctc

SEQ ID NO: 1062791 - DNA, 19 bp, Homo sapiens
agtatttagaagccaacta

SEQ ID NO: 1062792 - DNA, 19 bp, Homo sapiens
agtatttaggatgactgct

SEQ ID NO: 1062793 - DNA, 16 bp, Homo sapiens
agtatttataaaaata

SEQ ID NO: 1062794 - DNA, 22 bp, Homo sapiens
agtatttataaaaatataaatt

SEQ ID NO: 1062795 - DNA, 21 bp, Homo sapiens
agtcagtaggtccaagggcca

SEQ ID NO: 1062796 - DNA, 14 bp, Homo sapiens
agtcagtgatgagg

SEQ ID NO: 1062797 - DNA, 20 bp, Homo sapiens
agtcagtgcccaactgttat

SEQ ID NO: 1062798 - DNA, 15 bp, Homo sapiens
agtcagtgctctcag

SEQ ID NO: 1062799 - DNA, 23 bp, Homo sapiens
agtcagtgctctcagctggcagt

SEQ ID NO: 1062800 - DNA, 14 bp, Homo sapiens
agtcagtggagggc

SEQ ID NO: 1062801 - DNA, 18 bp, Homo sapiens
agtcagtggctttgcata

SEQ ID NO: 1062802 - DNA, 17 bp, Homo sapiens
agtcagtgtttctttta

SEQ ID NO: 1062803 - DNA, 15 bp, Homo sapiens
agtcagttcccggag

SEQ ID NO: 1062804 - DNA, 20 bp, Homo sapiens
agtcagttcccggagcacag

SEQ ID NO: 1062805 - DNA, 21 bp, Homo sapiens
agtcagttgctcaaaaagaaa

SEQ ID NO: 1062806 - DNA, 23 bp, Homo sapiens
agtcataccaatgaaaaaatgta

SEQ ID NO: 1062807 - DNA, 16 bp, Homo sapiens
agtcataggttaatat

SEQ ID NO: 1062808 - DNA, 22 bp, Homo sapiens
agtcataggttaatatttaaga

SEQ ID NO: 1062809 - DNA, 14 bp, Homo sapiens
agtcatcatcaggg

SEQ ID NO: 1062810 - DNA, 22 bp, Homo sapiens
agtcatcatcagggcctggggc

SEQ ID NO: 1062811 - DNA, 13 bp, Homo sapiens
agtcatcattact

SEQ ID NO: 1062812 - DNA, 23 bp, Homo sapiens
agtcatccaacaagaagaaatat

SEQ ID NO: 1062813 - DNA, 15 bp, Homo sapiens
agtcatcccctctca

SEQ ID NO: 1062814 - DNA, 14 bp, Homo sapiens
agtcatcctcctgg

SEQ ID NO: 1062815 - DNA, 11 bp, Homo sapiens
agtcatcctgc

SEQ ID NO: 1062816 - DNA, 15 bp, Homo sapiens
agtcatcctgccctg

SEQ ID NO: 1062817 - DNA, 16 bp, Homo sapiens
agtcatcctgccctgc

SEQ ID NO: 1062818 - DNA, 20 bp, Homo sapiens
agtcatcctgccctgcagca

SEQ ID NO: 1062819 - DNA, 21 bp, Homo sapiens
agtcatcctgccctgcagcac

SEQ ID NO: 1062820 - DNA, 22 bp, Homo sapiens
agtcatctatagttgatatgtt

SEQ ID NO: 1062821 - DNA, 19 bp, Homo sapiens
agtcatctccatcagctgt

SEQ ID NO: 1062822 - DNA, 15 bp, Homo sapiens
agtcatctgtaagag

SEQ ID NO: 1062823 - DNA, 22 bp, Homo sapiens
agtcatcttgtgagtggataat

SEQ ID NO: 1062824 - DNA, 13 bp, Homo sapiens
agtcatgaagccc

SEQ ID NO: 1062825 - DNA, 23 bp, Homo sapiens
agtcatggaatcttgctgcaggc

SEQ ID NO: 1062826 - DNA, 22 bp, Homo sapiens
agtcatggagaatctgctgcat

SEQ ID NO: 1062827 - DNA, 19 bp, Homo sapiens
agtcatggataactacatt

SEQ ID NO: 1062828 - DNA, 20 bp, Homo sapiens
agtcatgggaacgcagcctc

SEQ ID NO: 1062829 - DNA, 19 bp, Homo sapiens
agtcatggtactaccccag

SEQ ID NO: 1062830 - DNA, 12 bp, Homo sapiens
agtcatgtatgt

SEQ ID NO: 1062831 - DNA, 15 bp, Homo sapiens
agtcatgtgagcctc

SEQ ID NO: 1062832 - DNA, 23 bp, Homo sapiens
agtcattaaattactatagcaaa

SEQ ID NO: 1062833 - DNA, 18 bp, Homo sapiens
agtcattcatatttgtct

SEQ ID NO: 1062834 - DNA, 16 bp, Homo sapiens
agtcattctaggatgt

SEQ ID NO: 1062835 - DNA, 18 bp, Homo sapiens
agtcattctaggatgtgg

SEQ ID NO: 1062836 - DNA, 18 bp, Homo sapiens
agtcattgtcgctcagca

SEQ ID NO: 1062837 - DNA, 20 bp, Homo sapiens
agtcatttccaaacttgaaa

SEQ ID NO: 1062838 - DNA, 22 bp, Homo sapiens
agtcatttgctgagcatgtact

SEQ ID NO: 1062839 - DNA, 21 bp, Homo sapiens
agtcattttaactttatcaca

SEQ ID NO: 1062840 - DNA, 21 bp, Homo sapiens
agtcattttcatgtgtgtgag

SEQ ID NO: 1062841 - DNA, 11 bp, Homo sapiens
agtccaaagtc

SEQ ID NO: 1062842 - DNA, 16 bp, Homo sapiens
agtccaacctgcctgt

SEQ ID NO: 1062843 - DNA, 18 bp, Homo sapiens
agtccaacctgcctgtgc

SEQ ID NO: 1062844 - DNA, 16 bp, Homo sapiens
agtccaaggccagtcc

SEQ ID NO: 1062845 - DNA, 16 bp, Homo sapiens
agtccaatttttactc

SEQ ID NO: 1062846 - DNA, 17 bp, Homo sapiens
agtccacaggggccacc

SEQ ID NO: 1062847 - DNA, 21 bp, Homo sapiens
agtccactgttgagccccagt

SEQ ID NO: 1062848 - DNA, 12 bp, Homo sapiens
agtccagctccc

SEQ ID NO: 1062849 - DNA, 19 bp, Homo sapiens
agtccagctccccccaaga

SEQ ID NO: 1062850 - DNA, 13 bp, Homo sapiens
agtccagctctac

SEQ ID NO: 1062851 - DNA, 19 bp, Homo sapiens
agtccaggaggccctggtc

SEQ ID NO: 1062852 - DNA, 14 bp, Homo sapiens
agtccaggcacagg

SEQ ID NO: 1062853 - DNA, 19 bp, Homo sapiens
agtccaggcacaggatgct

SEQ ID NO: 1062854 - DNA, 13 bp, Homo sapiens
agtccaggcccca

SEQ ID NO: 1062855 - DNA, 18 bp, Homo sapiens
agtccaggccccaaaacc

SEQ ID NO: 1062856 - DNA, 16 bp, Homo sapiens
agtccaggcctctctc

SEQ ID NO: 1062857 - DNA, 17 bp, Homo sapiens
agtccaggcctctctct

SEQ ID NO: 1062858 - DNA, 22 bp, Homo sapiens
agtccaggcctctctctgctcc

SEQ ID NO: 1062859 - DNA, 18 bp, Homo sapiens
agtccagggtttctctgc

SEQ ID NO: 1062860 - DNA, 15 bp, Homo sapiens
agtccagtgctctgc

SEQ ID NO: 1062861 - DNA, 13 bp, Homo sapiens
agtccatgaaaat

SEQ ID NO: 1062862 - DNA, 16 bp, Homo sapiens
agtccatgaaaatacc

SEQ ID NO: 1062863 - DNA, 22 bp, Homo sapiens
agtccattaactgctttccacc

SEQ ID NO: 1062864 - DNA, 14 bp, Homo sapiens
agtccattctccca

SEQ ID NO: 1062865 - DNA, 17 bp, Homo sapiens
agtccattctcccaggt

SEQ ID NO: 1062866 - DNA, 18 bp, Homo sapiens
agtccatttcccacatct

SEQ ID NO: 1062867 - DNA, 19 bp, Homo sapiens
agtccatttcctaatgtat

SEQ ID NO: 1062868 - DNA, 16 bp, Homo sapiens
agtcccaagctaggct

SEQ ID NO: 1062869 - DNA, 18 bp, Homo sapiens
agtcccacactgtgcaga

SEQ ID NO: 1062870 - DNA, 17 bp, Homo sapiens
agtcccacactgtggcc

SEQ ID NO: 1062871 - DNA, 18 bp, Homo sapiens
agtcccacactgtggcca

SEQ ID NO: 1062872 - DNA, 22 bp, Homo sapiens
agtcccacactgtggccaggcc

SEQ ID NO: 1062873 - DNA, 12 bp, Homo sapiens
agtcccacccgg

SEQ ID NO: 1062874 - DNA, 18 bp, Homo sapiens
agtcccacccggacaggt

SEQ ID NO: 1062875 - DNA, 17 bp, Homo sapiens
agtcccagacaaggaga

SEQ ID NO: 1062876 - DNA, 20 bp, Homo sapiens
agtcccagagcacctcacct

SEQ ID NO: 1062877 - DNA, 17 bp, Homo sapiens
agtcccagctactcgat

SEQ ID NO: 1062878 - DNA, 21 bp, Homo sapiens
agtcccagctacttgggagcc

SEQ ID NO: 1062879 - DNA, 23 bp, Homo sapiens
agtcccagctacttgggagcctg

SEQ ID NO: 1062880 - DNA, 20 bp, Homo sapiens
agtcccagctacttgggagg

SEQ ID NO: 1062881 - DNA, 20 bp, Homo sapiens
agtcccattgtcagaaatat

SEQ ID NO: 1062882 - DNA, 18 bp, Homo sapiens
agtcccatttttctcttg

SEQ ID NO: 1062883 - DNA, 13 bp, Homo sapiens
agtccccacccct

SEQ ID NO: 1062884 - DNA, 18 bp, Homo sapiens
agtccccacccctgcccc

SEQ ID NO: 1062885 - DNA, 10 bp, Homo sapiens
agtccccagc

SEQ ID NO: 1062886 - DNA, 16 bp, Homo sapiens
agtccccagccctggg

SEQ ID NO: 1062887 - DNA, 18 bp, Homo sapiens
agtccccagcccttctgc

SEQ ID NO: 1062888 - DNA, 20 bp, Homo sapiens
agtccccagcccttctgcct

SEQ ID NO: 1062889 - DNA, 19 bp, Homo sapiens
agtcccccaccacactgaa

SEQ ID NO: 1062890 - DNA, 16 bp, Homo sapiens
agtcccccacccacct

SEQ ID NO: 1062891 - DNA, 18 bp, Homo sapiens
agtcccccacccacctcc

SEQ ID NO: 1062892 - DNA, 20 bp, Homo sapiens
agtcccccacccacctcctg

SEQ ID NO: 1062893 - DNA, 19 bp, Homo sapiens
agtccccgaggagctgggc

SEQ ID NO: 1062894 - DNA, 19 bp, Homo sapiens
agtccccgagggcgaaggc

SEQ ID NO: 1062895 - DNA, 15 bp, Homo sapiens
agtccccgtgccccg

SEQ ID NO: 1062896 - DNA, 18 bp, Homo sapiens
agtccccgtgccccgcct

SEQ ID NO: 1062897 - DNA, 16 bp, Homo sapiens
agtcccctcacctcct

SEQ ID NO: 1062898 - DNA, 18 bp, Homo sapiens
agtcccctcccatctggg

SEQ ID NO: 1062899 - DNA, 21 bp, Homo sapiens
agtcccctcccatctgggagt

SEQ ID NO: 1062900 - DNA, 18 bp, Homo sapiens
agtcccctccccggccct

SEQ ID NO: 1062901 - DNA, 23 bp, Homo sapiens
agtcccctgttgattatcttcag

SEQ ID NO: 1062902 - DNA, 15 bp, Homo sapiens
agtcccgtcaggacg

SEQ ID NO: 1062903 - DNA, 20 bp, Homo sapiens
agtccctatgtatttgcagt

SEQ ID NO: 1062904 - DNA, 19 bp, Homo sapiens
agtccctccctgcctgagg

SEQ ID NO: 1062905 - DNA, 21 bp, Homo sapiens
agtccctgactctctgtgacc

SEQ ID NO: 1062906 - DNA, 20 bp, Homo sapiens
agtccctgggggaagccctg

SEQ ID NO: 1062907 - DNA, 21 bp, Homo sapiens
agtccctgggggaagccctgg

SEQ ID NO: 1062908 - DNA, 23 bp, Homo sapiens
agtccctgtcatttgaacctgga

SEQ ID NO: 1062909 - DNA, 21 bp, Homo sapiens
agtccctgtgaagactgggtg

SEQ ID NO: 1062910 - DNA, 17 bp, Homo sapiens
agtcccttcccctccct

SEQ ID NO: 1062911 - DNA, 20 bp, Homo sapiens
agtcccttcccctccctggc

SEQ ID NO: 1062912 - DNA, 21 bp, Homo sapiens
agtcccttcccctccctggct

SEQ ID NO: 1062913 - DNA, 12 bp, Homo sapiens
agtcccttccta

SEQ ID NO: 1062914 - DNA, 19 bp, Homo sapiens
agtcccttcctattctcct

SEQ ID NO: 1062915 - DNA, 23 bp, Homo sapiens
agtcccttcctattctcctgcca

SEQ ID NO: 1062916 - DNA, 15 bp, Homo sapiens
agtcccttgttttgt

SEQ ID NO: 1062917 - DNA, 14 bp, Homo sapiens
agtccggaggcagc

SEQ ID NO: 1062918 - DNA, 15 bp, Homo sapiens
agtccggaggcagca

SEQ ID NO: 1062919 - DNA, 22 bp, Homo sapiens
agtccggaggcagcagacacgc

SEQ ID NO: 1062920 - DNA, 15 bp, Homo sapiens
agtccggatttctaa

SEQ ID NO: 1062921 - DNA, 22 bp, Homo sapiens
agtccggatttctaacagtcct

SEQ ID NO: 1062922 - DNA, 15 bp, Homo sapiens
agtccgtcaaaacag

SEQ ID NO: 1062923 - DNA, 20 bp, Homo sapiens
agtcctacaagctaaaatta

SEQ ID NO: 1062924 - DNA, 22 bp, Homo sapiens
agtcctactttacatatgcttt

SEQ ID NO: 1062925 - DNA, 19 bp, Homo sapiens
agtcctagaatgtttcatt

SEQ ID NO: 1062926 - DNA, 17 bp, Homo sapiens
agtcctagccactcagg

SEQ ID NO: 1062927 - DNA, 15 bp, Homo sapiens
agtcctagctgacgc

SEQ ID NO: 1062928 - DNA, 16 bp, Homo sapiens
agtcctaggacttaaa

SEQ ID NO: 1062929 - DNA, 16 bp, Homo sapiens
agtcctagttttccta

SEQ ID NO: 1062930 - DNA, 13 bp, Homo sapiens
agtcctatctcat

SEQ ID NO: 1062931 - DNA, 16 bp, Homo sapiens
agtcctatggaaaaaa

SEQ ID NO: 1062932 - DNA, 19 bp, Homo sapiens
agtcctattcaaattccta

SEQ ID NO: 1062933 - DNA, 16 bp, Homo sapiens
agtcctattctattgc

SEQ ID NO: 1062934 - DNA, 11 bp, Homo sapiens
agtcctcaggt

SEQ ID NO: 1062935 - DNA, 22 bp, Homo sapiens
agtcctcaggtacagcgggctg

SEQ ID NO: 1062936 - DNA, 18 bp, Homo sapiens
agtcctcataaaaagcaa

SEQ ID NO: 1062937 - DNA, 16 bp, Homo sapiens
agtcctccactcgacc

SEQ ID NO: 1062938 - DNA, 15 bp, Homo sapiens
agtcctcctgggagc

SEQ ID NO: 1062939 - DNA, 17 bp, Homo sapiens
agtcctctgctccagca

SEQ ID NO: 1062940 - DNA, 19 bp, Homo sapiens
agtcctgaagaggcgggcc

SEQ ID NO: 1062941 - DNA, 21 bp, Homo sapiens
agtcctgaagaggcgggccag

SEQ ID NO: 1062942 - DNA, 23 bp, Homo sapiens
agtcctgaagaggcgggccagcc

SEQ ID NO: 1062943 - DNA, 20 bp, Homo sapiens
agtcctgatcagagccgtgg

SEQ ID NO: 1062944 - DNA, 18 bp, Homo sapiens
agtcctgcagaggattta

SEQ ID NO: 1062945 - DNA, 16 bp, Homo sapiens
agtcctgcctcagcct

SEQ ID NO: 1062946 - DNA, 20 bp, Homo sapiens
agtcctgcctggccaggcag

SEQ ID NO: 1062947 - DNA, 23 bp, Homo sapiens
agtctccccactccaccctgtta

SEQ ID NO: 1062948 - DNA, 14 bp, Homo sapiens
agtctccctccctt

SEQ ID NO: 1062949 - DNA, 18 bp, Homo sapiens
agtctccctcccttgggg

SEQ ID NO: 1062950 - DNA, 12 bp, Homo sapiens
agtctccctccg

SEQ ID NO: 1062951 - DNA, 16 bp, Homo sapiens
agtctccctccgactc

SEQ ID NO: 1062952 - DNA, 20 bp, Homo sapiens
agtctccctccgactccaga

SEQ ID NO: 1062953 - DNA, 20 bp, Homo sapiens
agtctcctcactctgtccct

SEQ ID NO: 1062954 - DNA, 12 bp, Homo sapiens
agtctcctgggt

SEQ ID NO: 1062955 - DNA, 14 bp, Homo sapiens
agtctccttcccct

SEQ ID NO: 1062956 - DNA, 14 bp, Homo sapiens
agtctcgaatgtaa

SEQ ID NO: 1062957 - DNA, 17 bp, Homo sapiens
agtctcgaatgtaattg

SEQ ID NO: 1062958 - DNA, 17 bp, Homo sapiens
agtctctctgtgaatac

SEQ ID NO: 1062959 - DNA, 18 bp, Homo sapiens
agtctctctgtgaataca

SEQ ID NO: 1062960 - DNA, 22 bp, Homo sapiens
agtctctctgtgaatacaatta

SEQ ID NO: 1062961 - DNA, 23 bp, Homo sapiens
agtctctcttaaagttggaattt

SEQ ID NO: 1062962 - DNA, 15 bp, Homo sapiens
agtctctcttctctc

SEQ ID NO: 1062963 - DNA, 13 bp, Homo sapiens
agtctctgagcag

SEQ ID NO: 1062964 - DNA, 23 bp, Homo sapiens
agtctctgaggggctaccaggaa

SEQ ID NO: 1062965 - DNA, 18 bp, Homo sapiens
agtctctgatacacagta

SEQ ID NO: 1062966 - DNA, 14 bp, Homo sapiens
agtctctgccaccc

SEQ ID NO: 1062967 - DNA, 18 bp, Homo sapiens
agtctctgccacccactc

SEQ ID NO: 1062968 - DNA, 16 bp, Homo sapiens
agtctctgctggccca

SEQ ID NO: 1062969 - DNA, 17 bp, Homo sapiens
agtctctgctggcccag

SEQ ID NO: 1062970 - DNA, 12 bp, Homo sapiens
agtctcttcaga

SEQ ID NO: 1062971 - DNA, 14 bp, Homo sapiens
agtctcttctccac

SEQ ID NO: 1062972 - DNA, 16 bp, Homo sapiens
agtctcttctccactg

SEQ ID NO: 1062973 - DNA, 17 bp, Homo sapiens
agtctcttgtattaaac

SEQ ID NO: 1062974 - DNA, 15 bp, Homo sapiens
agtctctttaatctt

SEQ ID NO: 1062975 - DNA, 17 bp, Homo sapiens
agtctctttaatcttca

SEQ ID NO: 1062976 - DNA, 18 bp, Homo sapiens
agtctctttcttcctttc

SEQ ID NO: 1062977 - DNA, 19 bp, Homo sapiens
agtctctttcttcctttct

SEQ ID NO: 1062978 - DNA, 20 bp, Homo sapiens
agtctctttcttcctttcta

SEQ ID NO: 1062979 - DNA, 18 bp, Homo sapiens
agtctcttttttattctg

SEQ ID NO: 1062980 - DNA, 18 bp, Homo sapiens
agtctgaacagctgtaat

SEQ ID NO: 1062981 - DNA, 19 bp, Homo sapiens
agtctgaacccttgtgctt

SEQ ID NO: 1062982 - DNA, 16 bp, Homo sapiens
agtctgaatgctgcca

SEQ ID NO: 1062983 - DNA, 14 bp, Homo sapiens
agtctgaggactgt

SEQ ID NO: 1062984 - DNA, 17 bp, Homo sapiens
agtctgaggactgtcct

SEQ ID NO: 1062985 - DNA, 19 bp, Homo sapiens
agtctgagtcctgtctctg

SEQ ID NO: 1062986 - DNA, 14 bp, Homo sapiens
agtctgagtctgag

SEQ ID NO: 1062987 - DNA, 15 bp, Homo sapiens
agtctgagtctgagt

SEQ ID NO: 1062988 - DNA, 17 bp, Homo sapiens
agtctgagtctgagtcc

SEQ ID NO: 1062989 - DNA, 15 bp, Homo sapiens
agtctgattatacca

SEQ ID NO: 1062990 - DNA, 11 bp, Homo sapiens
agtctgattta

SEQ ID NO: 1062991 - DNA, 13 bp, Homo sapiens
agtctgcaaaatg

SEQ ID NO: 1062992 - DNA, 23 bp, Homo sapiens
agtctgcacatgcagctgcaccc

SEQ ID NO: 1062993 - DNA, 23 bp, Homo sapiens
agtctgcccacgcagaggacgca

SEQ ID NO: 1062994 - DNA, 14 bp, Homo sapiens
agtctgccgcccac

SEQ ID NO: 1062995 - DNA, 23 bp, Homo sapiens
agtctgcgtctctgctttaaagt

SEQ ID NO: 1062996 - DNA, 13 bp, Homo sapiens
agtctgctgccct

SEQ ID NO: 1062997 - DNA, 17 bp, Homo sapiens
agtctgcttagaaataa

SEQ ID NO: 1062998 - DNA, 13 bp, Homo sapiens
agtctggaaagtg

SEQ ID NO: 1062999 - DNA, 15 bp, Homo sapiens
agtctggagagctgt

SEQ ID NO: 1063000 - DNA, 15 bp, Homo sapiens
agtctggccaacatc

SEQ ID NO: 1063001 - DNA, 16 bp, Homo sapiens
agtctggccactgtca

SEQ ID NO: 1063002 - DNA, 19 bp, Homo sapiens
agtctggctttgctctatt

SEQ ID NO: 1063003 - DNA, 14 bp, Homo sapiens
agtctgggacacaa

SEQ ID NO: 1063004 - DNA, 23 bp, Homo sapiens
agtctgggcctctgactctgagt

SEQ ID NO: 1063005 - DNA, 17 bp, Homo sapiens
agtctgggtccaggcct

SEQ ID NO: 1063006 - DNA, 15 bp, Homo sapiens
agtctggtgaagctc

SEQ ID NO: 1063007 - DNA, 17 bp, Homo sapiens
agtctggtggaggagct

SEQ ID NO: 1063008 - DNA, 23 bp, Homo sapiens
agtctgtaactctttctgaggag

SEQ ID NO: 1063009 - DNA, 17 bp, Homo sapiens
agtctgtaggagcaagg

SEQ ID NO: 1063010 - DNA, 17 bp, Homo sapiens
agtctgtcagggccttg

SEQ ID NO: 1063011 - DNA, 16 bp, Homo sapiens
agtctgtctactgtgg

SEQ ID NO: 1063012 - DNA, 19 bp, Homo sapiens
agtctgtctcttggctttg

SEQ ID NO: 1063013 - DNA, 22 bp, Homo sapiens
agtctgtcttgagatctgattt

SEQ ID NO: 1063014 - DNA, 16 bp, Homo sapiens
agtctgtctttcctga

SEQ ID NO: 1063015 - DNA, 23 bp, Homo sapiens
agtctgtctttctatagaaatat

SEQ ID NO: 1063016 - DNA, 14 bp, Homo sapiens
agtctgtggaactt

SEQ ID NO: 1063017 - DNA, 20 bp, Homo sapiens
agtctgtgtaactttaaaca

SEQ ID NO: 1063018 - DNA, 19 bp, Homo sapiens
agtctgtgtgatgaacttt

SEQ ID NO: 1063019 - DNA, 21 bp, Homo sapiens
agtctgtgtgatgaactttct

SEQ ID NO: 1063020 - DNA, 15 bp, Homo sapiens
agtcttaactgtatt

SEQ ID NO: 1063021 - DNA, 17 bp, Homo sapiens
agtcttaactgtatttc

SEQ ID NO: 1063022 - DNA, 15 bp, Homo sapiens
agtcttacaatcaaa

SEQ ID NO: 1063023 - DNA, 21 bp, Homo sapiens
agtcttacaatcaaatctcct

SEQ ID NO: 1063024 - DNA, 16 bp, Homo sapiens
agtcttactctgtctc

SEQ ID NO: 1063025 - DNA, 17 bp, Homo sapiens
agtcttactctgtctcc

SEQ ID NO: 1063026 - DNA, 24 bp, Homo sapiens
agtcttagacttgaaatactactt

SEQ ID NO: 1063027 - DNA, 15 bp, Homo sapiens
agtcttatgtaaagt

SEQ ID NO: 1063028 - DNA, 22 bp, Homo sapiens
agtcttatttccaagtaagagt

SEQ ID NO: 1063029 - DNA, 19 bp, Homo sapiens
agtcttcactctctgaaga

SEQ ID NO: 1063030 - DNA, 14 bp, Homo sapiens
agtcttcagaccca

SEQ ID NO: 1063031 - DNA, 16 bp, Homo sapiens
agtcttcagacccaga

SEQ ID NO: 1063032 - DNA, 13 bp, Homo sapiens
agtcttccaaggc

SEQ ID NO: 1063033 - DNA, 21 bp, Homo sapiens
agtcttccacaaagaaaattc

SEQ ID NO: 1063034 - DNA, 15 bp, Homo sapiens
agtcttccatttgca

SEQ ID NO: 1063035 - DNA, 12 bp, Homo sapiens
agtcttcctgac

SEQ ID NO: 1063036 - DNA, 14 bp, Homo sapiens
agtcttccttgtct

SEQ ID NO: 1063037 - DNA, 17 bp, Homo sapiens
agtcttccttgtggaat

SEQ ID NO: 1063038 - DNA, 13 bp, Homo sapiens
agtcttctcatag

SEQ ID NO: 1063039 - DNA, 20 bp, Homo sapiens
agtcttctgtaattcattga

SEQ ID NO: 1063040 - DNA, 14 bp, Homo sapiens
agtcttgcagctga

SEQ ID NO: 1063041 - DNA, 15 bp, Homo sapiens
agtcttgctctgtca

SEQ ID NO: 1063042 - DNA, 17 bp, Homo sapiens
agtcttgctctgtcacc

SEQ ID NO: 1063043 - DNA, 16 bp, Homo sapiens
agtcttgctctgtctc

SEQ ID NO: 1063044 - DNA, 18 bp, Homo sapiens
agtctttagctattactg

SEQ ID NO: 1063045 - DNA, 13 bp, Homo sapiens
agtctttcagatg

SEQ ID NO: 1063046 - DNA, 22 bp, Homo sapiens
agtctttcattcggtgtgaact

SEQ ID NO: 1063047 - DNA, 9 bp, Homo sapiens
agtctttgc

SEQ ID NO: 1063048 - DNA, 19 bp, Homo sapiens
agtctttgctcagtgtcca

SEQ ID NO: 1063049 - DNA, 21 bp, Homo sapiens
agtctttgtgtgttatattcc

SEQ ID NO: 1063050 - DNA, 23 bp, Homo sapiens
agtctttgtgtgttatattccaa

SEQ ID NO: 1063051 - DNA, 16 bp, Homo sapiens
agtcttttctgttatt

SEQ ID NO: 1063052 - DNA, 18 bp, Homo sapiens
agtcttttctgttattgt

SEQ ID NO: 1063053 - DNA, 21 bp, Homo sapiens
agtcttttgcatgtcgcacaa

SEQ ID NO: 1063054 - DNA, 22 bp, Homo sapiens
agtcttttgcatgtcgcacaat

SEQ ID NO: 1063055 - DNA, 13 bp, Homo sapiens
agtcttttgcttt

SEQ ID NO: 1063056 - DNA, 19 bp, Homo sapiens
agtcttttgcttttggcaa

SEQ ID NO: 1063057 - DNA, 15 bp, Homo sapiens
agtctttttcatttt

SEQ ID NO: 1063058 - DNA, 21 bp, Homo sapiens
agtctttttcattttgcagaa

SEQ ID NO: 1063059 - DNA, 21 bp, Homo sapiens
agtctttttctttttttggta

SEQ ID NO: 1063060 - DNA, 22 bp, Homo sapiens
agtctttttctttttttggtaa

SEQ ID NO: 1063061 - DNA, 14 bp, Homo sapiens
agtctttttttcct

SEQ ID NO: 1063062 - DNA, 17 bp, Homo sapiens
agtcttttttttttcca

SEQ ID NO: 1063063 - DNA, 13 bp, Homo sapiens
agtgagcctcctg

SEQ ID NO: 1063064 - DNA, 14 bp, Homo sapiens
agtgagcctgggcc

SEQ ID NO: 1063065 - DNA, 22 bp, Homo sapiens
agtgagcggtgctgtcctcagg

SEQ ID NO: 1063066 - DNA, 14 bp, Homo sapiens
agtgagctgagaca

SEQ ID NO: 1063067 - DNA, 16 bp, Homo sapiens
agtgaggaaccctgat

SEQ ID NO: 1063068 - DNA, 21 bp, Homo sapiens
agtgaggaatagttgagcccc

SEQ ID NO: 1063069 - DNA, 19 bp, Homo sapiens
agtgaggactcggccactg

SEQ ID NO: 1063070 - DNA, 19 bp, Homo sapiens
agtgaggatgctgcagtga

SEQ ID NO: 1063071 - DNA, 15 bp, Homo sapiens
agtgaggcaggagaa

SEQ ID NO: 1063072 - DNA, 18 bp, Homo sapiens
agtgaggcttccaggctc

SEQ ID NO: 1063073 - DNA, 14 bp, Homo sapiens
agtgagggctgggc

SEQ ID NO: 1063074 - DNA, 14 bp, Homo sapiens
agtgaggggctgtg

SEQ ID NO: 1063075 - DNA, 21 bp, Homo sapiens
agtgaggggttacctccctcg

SEQ ID NO: 1063076 - DNA, 16 bp, Homo sapiens
agtgaggtgtgtcaca

SEQ ID NO: 1063077 - DNA, 15 bp, Homo sapiens
agtgagtcacctgct

SEQ ID NO: 1063078 - DNA, 17 bp, Homo sapiens
agtgagtcacctgctcc

SEQ ID NO: 1063079 - DNA, 22 bp, Homo sapiens
agtgagtcacctgctccagaag

SEQ ID NO: 1063080 - DNA, 17 bp, Homo sapiens
agtgagtctggtggagg

SEQ ID NO: 1063081 - DNA, 14 bp, Homo sapiens
agtgagtctgtcag

SEQ ID NO: 1063082 - DNA, 16 bp, Homo sapiens
agtgagtgccatgctt

SEQ ID NO: 1063083 - DNA, 16 bp, Homo sapiens
agtgagtgtaaataat

SEQ ID NO: 1063084 - DNA, 15 bp, Homo sapiens
agtgagtgtatgtgt

SEQ ID NO: 1063085 - DNA, 19 bp, Homo sapiens
agtgagtgtatgtgtgtgt

SEQ ID NO: 1063086 - DNA, 19 bp, Homo sapiens
agtgagtgtggctcccctc

SEQ ID NO: 1063087 - DNA, 23 bp, Homo sapiens
agtgagtgtgtgtgcttgaatgt

SEQ ID NO: 1063088 - DNA, 20 bp, Homo sapiens
agtgagttttactcttaaat

SEQ ID NO: 1063089 - DNA, 15 bp, Homo sapiens
agtgagttttttagt

SEQ ID NO: 1063090 - DNA, 19 bp, Homo sapiens
agtgagttttttagtgcgt

SEQ ID NO: 1063091 - DNA, 20 bp, Homo sapiens
agtgataatattgtttccct

SEQ ID NO: 1063092 - DNA, 22 bp, Homo sapiens
agtgataatattgtttccctcg

SEQ ID NO: 1063093 - DNA, 19 bp, Homo sapiens
agtgataattttatttata

SEQ ID NO: 1063094 - DNA, 23 bp, Homo sapiens
agtgataattttatttataaact

SEQ ID NO: 1063095 - DNA, 21 bp, Homo sapiens
agtgatagtcttttgcttttg

SEQ ID NO: 1063096 - DNA, 14 bp, Homo sapiens
agtgatataaatca

SEQ ID NO: 1063097 - DNA, 16 bp, Homo sapiens
agtgatatatttctat

SEQ ID NO: 1063098 - DNA, 17 bp, Homo sapiens
agtgatcaataaaatgt

SEQ ID NO: 1063099 - DNA, 16 bp, Homo sapiens
agtgatcacctcttgg

SEQ ID NO: 1063100 - DNA, 14 bp, Homo sapiens
agtgatcatttaaa

SEQ ID NO: 1063101 - DNA, 19 bp, Homo sapiens
agtgatccttccacctcag

SEQ ID NO: 1063102 - DNA, 16 bp, Homo sapiens
agtgatctatgtttgt

SEQ ID NO: 1063103 - DNA, 16 bp, Homo sapiens
agtgatctcagggcag

SEQ ID NO: 1063104 - DNA, 19 bp, Homo sapiens
agtgatcttaggtttgttt

SEQ ID NO: 1063105 - DNA, 23 bp, Homo sapiens
agtgatcttaggtttgttttttc

SEQ ID NO: 1063106 - DNA, 13 bp, Homo sapiens
agtgatgaatgta

SEQ ID NO: 1063107 - DNA, 19 bp, Homo sapiens
agtgatgagacagtgaagt

SEQ ID NO: 1063108 - DNA, 12 bp, Homo sapiens
agtgatgatgtt

SEQ ID NO: 1063109 - DNA, 13 bp, Homo sapiens
agtgatgatgttt

SEQ ID NO: 1063110 - DNA, 12 bp, Homo sapiens
agtgatgatttg

SEQ ID NO: 1063111 - DNA, 22 bp, Homo sapiens
agtgatgcttttagttttaaaa

SEQ ID NO: 1063112 - DNA, 13 bp, Homo sapiens
agtgatggtcaga

SEQ ID NO: 1063113 - DNA, 19 bp, Homo sapiens
agtgatggtgtccttccct

SEQ ID NO: 1063114 - DNA, 20 bp, Homo sapiens
agtgatggtgtccttccctg

SEQ ID NO: 1063115 - DNA, 16 bp, Homo sapiens
agtgatgtaccatgaa

SEQ ID NO: 1063116 - DNA, 19 bp, Homo sapiens
agtgatgtattttcatagt

SEQ ID NO: 1063117 - DNA, 15 bp, Homo sapiens
agtgatgtcatttga

SEQ ID NO: 1063118 - DNA, 13 bp, Homo sapiens
agtgatgtgctga

SEQ ID NO: 1063119 - DNA, 22 bp, Homo sapiens
agtgattctcctgcctcagcct

SEQ ID NO: 1063120 - DNA, 16 bp, Homo sapiens
agtgattgaaccagct

SEQ ID NO: 1063121 - DNA, 13 bp, Homo sapiens
agtgattgcagct

SEQ ID NO: 1063122 - DNA, 23 bp, Homo sapiens
agtgattttatttttgcaaaata

SEQ ID NO: 1063123 - DNA, 20 bp, Homo sapiens
agtgcaacagcactggctct

SEQ ID NO: 1063124 - DNA, 22 bp, Homo sapiens
agtgcaacatttctgtatactg

SEQ ID NO: 1063125 - DNA, 18 bp, Homo sapiens
agtgcaagcagatgacaa

SEQ ID NO: 1063126 - DNA, 17 bp, Homo sapiens
agtgcaagcccctgctc

SEQ ID NO: 1063127 - DNA, 14 bp, Homo sapiens
agtgcaagctgaag

SEQ ID NO: 1063128 - DNA, 14 bp, Homo sapiens
agtgcaaggaccta

SEQ ID NO: 1063129 - DNA, 23 bp, Homo sapiens
agtgcaatggtgcaatcacagct

SEQ ID NO: 1063130 - DNA, 22 bp, Homo sapiens
agtgcaattaacatatgtcacg

SEQ ID NO: 1063131 - DNA, 18 bp, Homo sapiens
agtgcaattccaagaaaa

SEQ ID NO: 1063132 - DNA, 11 bp, Homo sapiens
agtgcacacct

SEQ ID NO: 1063133 - DNA, 18 bp, Homo sapiens
agtgcaccaaagagaatg

SEQ ID NO: 1063134 - DNA, 17 bp, Homo sapiens
agtgcacctgcctcagc

SEQ ID NO: 1063135 - DNA, 21 bp, Homo sapiens
agtgcacctgcctcagctacc

SEQ ID NO: 1063136 - DNA, 18 bp, Homo sapiens
agtgcacttttttatgaa

SEQ ID NO: 1063137 - DNA, 12 bp, Homo sapiens
agtgcagacagg

SEQ ID NO: 1063138 - DNA, 13 bp, Homo sapiens
agtgcagacaggc

SEQ ID NO: 1063139 - DNA, 16 bp, Homo sapiens
agtgcagacaggccat

SEQ ID NO: 1063140 - DNA, 17 bp, Homo sapiens
agtgcagagccttctca

SEQ ID NO: 1063141 - DNA, 18 bp, Homo sapiens
agtgcagagccttctcag

SEQ ID NO: 1063142 - DNA, 13 bp, Homo sapiens
agtgcagaggctc

SEQ ID NO: 1063143 - DNA, 22 bp, Homo sapiens
agtgcagccaagtagcctctcc

SEQ ID NO: 1063144 - DNA, 18 bp, Homo sapiens
agtgcagcccttcctcct

SEQ ID NO: 1063145 - DNA, 21 bp, Homo sapiens
agtgcagcccttcctcctgaa

SEQ ID NO: 1063146 - DNA, 15 bp, Homo sapiens
agtgcagctgatttt

SEQ ID NO: 1063147 - DNA, 20 bp, Homo sapiens
agtgcagctgattttaacaa

SEQ ID NO: 1063148 - DNA, 20 bp, Homo sapiens
agtgcagggattacaggcgt

SEQ ID NO: 1063149 - DNA, 17 bp, Homo sapiens
agtgcaggtttctattg

SEQ ID NO: 1063150 - DNA, 22 bp, Homo sapiens
agtgcagtcagcagatgctgtt

SEQ ID NO: 1063151 - DNA, 10 bp, Homo sapiens
agtgcagtga

SEQ ID NO: 1063152 - DNA, 21 bp, Homo sapiens
agtgcagtggcacaatcttgg

SEQ ID NO: 1063153 - DNA, 21 bp, Homo sapiens
agtgcatagttgtagacaaag

SEQ ID NO: 1063154 - DNA, 16 bp, Homo sapiens
agtgcatatttatcca

SEQ ID NO: 1063155 - DNA, 12 bp, Homo sapiens
agtgcatcatta

SEQ ID NO: 1063156 - DNA, 14 bp, Homo sapiens
agtgcatccaaagg

SEQ ID NO: 1063157 - DNA, 14 bp, Homo sapiens
agtgcatctcagcc

SEQ ID NO: 1063158 - DNA, 16 bp, Homo sapiens
agtgcatctcagccca

SEQ ID NO: 1063159 - DNA, 13 bp, Homo sapiens
agtgcatgcatgt

SEQ ID NO: 1063160 - DNA, 16 bp, Homo sapiens
agtgcatgctctctgc

SEQ ID NO: 1063161 - DNA, 22 bp, Homo sapiens
agtgcatgctctctgcagccag

SEQ ID NO: 1063162 - DNA, 23 bp, Homo sapiens
agtgcatttacaaggttaaagat

SEQ ID NO: 1063163 - DNA, 21 bp, Homo sapiens
agtgcatttgtgctagaaatt

SEQ ID NO: 1063164 - DNA, 15 bp, Homo sapiens
agtgcattttcccag

SEQ ID NO: 1063165 - DNA, 17 bp, Homo sapiens
agtgcattttcccagat

SEQ ID NO: 1063166 - DNA, 20 bp, Homo sapiens
agtgcattttgtttctgtat

SEQ ID NO: 1063167 - DNA, 22 bp, Homo sapiens
agtgcattttgtttctgtatat

SEQ ID NO: 1063168 - DNA, 13 bp, Homo sapiens
agtgcatttttaa

SEQ ID NO: 1063169 - DNA, 22 bp, Homo sapiens
agtgcatttttaaacttgaaat

SEQ ID NO: 1063170 - DNA, 23 bp, Homo sapiens
agtgcatttttaaacttgaaata

SEQ ID NO: 1063171 - DNA, 16 bp, Homo sapiens
agtgccaactcctcac

SEQ ID NO: 1063172 - DNA, 16 bp, Homo sapiens
agtgccacagcctgct

SEQ ID NO: 1063173 - DNA, 22 bp, Homo sapiens
agtgccacagcctgctggcagg

SEQ ID NO: 1063174 - DNA, 19 bp, Homo sapiens
agtgccacctatgcctgtg

SEQ ID NO: 1063175 - DNA, 21 bp, Homo sapiens
agtgccacctatgcctgtggt

SEQ ID NO: 1063176 - DNA, 23 bp, Homo sapiens
agtgccacctatgcctgtggtga

SEQ ID NO: 1063177 - DNA, 19 bp, Homo sapiens
agtgccactcattcctgta

SEQ ID NO: 1063178 - DNA, 20 bp, Homo sapiens
agtgccactgcccgagctgg

SEQ ID NO: 1063179 - DNA, 22 bp, Homo sapiens
agtgccactgcccgagctggtg

SEQ ID NO: 1063180 - DNA, 14 bp, Homo sapiens
agtgccacttaatg

SEQ ID NO: 1063181 - DNA, 23 bp, Homo sapiens
agtgtgtattaaaaaaaacaaaa

SEQ ID NO: 1063182 - DNA, 15 bp, Homo sapiens
agtgtgtattgttcc

SEQ ID NO: 1063183 - DNA, 16 bp, Homo sapiens
agtgtgtattgttccc

SEQ ID NO: 1063184 - DNA, 15 bp, Homo sapiens
agtgtgtcagagccc

SEQ ID NO: 1063185 - DNA, 20 bp, Homo sapiens
agtgtgtcagagcccagggg

SEQ ID NO: 1063186 - DNA, 21 bp, Homo sapiens
agtgtgtcagagcccagggga

SEQ ID NO: 1063187 - DNA, 13 bp, Homo sapiens
agtgtgtctgctg

SEQ ID NO: 1063188 - DNA, 20 bp, Homo sapiens
agtgtgtcttcctagaattc

SEQ ID NO: 1063189 - DNA, 14 bp, Homo sapiens
agtgtgtgcatgtg

SEQ ID NO: 1063190 - DNA, 12 bp, Homo sapiens
agtgtgtgtgca

SEQ ID NO: 1063191 - DNA, 16 bp, Homo sapiens
agtgtgtgtgcatgga

SEQ ID NO: 1063192 - DNA, 18 bp, Homo sapiens
agtgtgtgtgcatgtgtg

SEQ ID NO: 1063193 - DNA, 16 bp, Homo sapiens
agtgtgtgtgtgtcca

SEQ ID NO: 1063194 - DNA, 17 bp, Homo sapiens
agtgtgtgtgttctgta

SEQ ID NO: 1063195 - DNA, 18 bp, Homo sapiens
agtgtgtgtttaacattc

SEQ ID NO: 1063196 - DNA, 13 bp, Homo sapiens
agtgtgttctgat

SEQ ID NO: 1063197 - DNA, 17 bp, Homo sapiens
agtgtgttctgattaga

SEQ ID NO: 1063198 - DNA, 20 bp, Homo sapiens
agtgtgttctgattagaaat

SEQ ID NO: 1063199 - DNA, 15 bp, Homo sapiens
agtgtgtttagaagg

SEQ ID NO: 1063200 - DNA, 15 bp, Homo sapiens
agtgttaaatgtgat

SEQ ID NO: 1063201 - DNA, 20 bp, Homo sapiens
agtgttaaggcaacattcct

SEQ ID NO: 1063202 - DNA, 13 bp, Homo sapiens
agtgttagagaaa

SEQ ID NO: 1063203 - DNA, 14 bp, Homo sapiens
agtgttagagaaat

SEQ ID NO: 1063204 - DNA, 15 bp, Homo sapiens
agtgttagggaaggg

SEQ ID NO: 1063205 - DNA, 23 bp, Homo sapiens
agtgttagtgctggtcagagaga

SEQ ID NO: 1063206 - DNA, 13 bp, Homo sapiens
agtgttatgtatt

SEQ ID NO: 1063207 - DNA, 15 bp, Homo sapiens
agtgttattgcatgc

SEQ ID NO: 1063208 - DNA, 20 bp, Homo sapiens
agtgttatttttcaaggaag

SEQ ID NO: 1063209 - DNA, 17 bp, Homo sapiens
agtgttcaaaatactac

SEQ ID NO: 1063210 - DNA, 17 bp, Homo sapiens
agtgttcaagaaataaa

SEQ ID NO: 1063211 - DNA, 13 bp, Homo sapiens
agtgttcacaaac

SEQ ID NO: 1063212 - DNA, 16 bp, Homo sapiens
agtgttcctatttggg

SEQ ID NO: 1063213 - DNA, 20 bp, Homo sapiens
agtgttcctttttaaatgtg

SEQ ID NO: 1063214 - DNA, 18 bp, Homo sapiens
agtgttctgccagatctt

SEQ ID NO: 1063215 - DNA, 22 bp, Homo sapiens
agtgttctgtgggcttggcctt

SEQ ID NO: 1063216 - DNA, 22 bp, Homo sapiens
agtgttctgtttgttattgttt

SEQ ID NO: 1063217 - DNA, 17 bp, Homo sapiens
agtgttgaaaatgtatt

SEQ ID NO: 1063218 - DNA, 18 bp, Homo sapiens
agtgttgcatatgagcct

SEQ ID NO: 1063219 - DNA, 17 bp, Homo sapiens
agtgttgcctcctccca

SEQ ID NO: 1063220 - DNA, 14 bp, Homo sapiens
agtgttggctgtgt

SEQ ID NO: 1063221 - DNA, 16 bp, Homo sapiens
agtgttggctgtgtga

SEQ ID NO: 1063222 - DNA, 16 bp, Homo sapiens
agtgttggggttgaca

SEQ ID NO: 1063223 - DNA, 17 bp, Homo sapiens
agtgttggtctttctaa

SEQ ID NO: 1063224 - DNA, 17 bp, Homo sapiens
agtgttgtgttcctggc

SEQ ID NO: 1063225 - DNA, 14 bp, Homo sapiens
agtgttgtttgtaa

SEQ ID NO: 1063226 - DNA, 18 bp, Homo sapiens
agtgttgtttgtaaataa

SEQ ID NO: 1063227 - DNA, 20 bp, Homo sapiens
agtgttgtttgtaaataaga

SEQ ID NO: 1063228 - DNA, 21 bp, Homo sapiens
agtgttgtttgtaaataagag

SEQ ID NO: 1063229 - DNA, 22 bp, Homo sapiens
agtgttgtttgtaaataagaga

SEQ ID NO: 1063230 - DNA, 15 bp, Homo sapiens
agtgtttaaaacttc

SEQ ID NO: 1063231 - DNA, 22 bp, Homo sapiens
agtgtttaaaaggctaagaata

SEQ ID NO: 1063232 - DNA, 21 bp, Homo sapiens
agtgtttacttcctgcagtga

SEQ ID NO: 1063233 - DNA, 18 bp, Homo sapiens
agtgtttatcctttcata

SEQ ID NO: 1063234 - DNA, 17 bp, Homo sapiens
agtgtttatttttcata

SEQ ID NO: 1063235 - DNA, 22 bp, Homo sapiens
agtgtttatttttcatattgtg

SEQ ID NO: 1063236 - DNA, 11 bp, Homo sapiens
agtgtttcaat

SEQ ID NO: 1063237 - DNA, 19 bp, Homo sapiens
agtgtttcaattctgtaat

SEQ ID NO: 1063238 - DNA, 20 bp, Homo sapiens
agtgtttcagattttttaaa

SEQ ID NO: 1063239 - DNA, 16 bp, Homo sapiens
agtgtttcccataatt

SEQ ID NO: 1063240 - DNA, 19 bp, Homo sapiens
agtgtttcgacagctgatt

SEQ ID NO: 1063241 - DNA, 12 bp, Homo sapiens
agtgtttctgtt

SEQ ID NO: 1063242 - DNA, 13 bp, Homo sapiens
agtgtttctgtta

SEQ ID NO: 1063243 - DNA, 14 bp, Homo sapiens
agtgtttctgttat

SEQ ID NO: 1063244 - DNA, 21 bp, Homo sapiens
agtgtttctgttattaacaaa

SEQ ID NO: 1063245 - DNA, 23 bp, Homo sapiens
agtgtttcttctggcttagtctg

SEQ ID NO: 1063246 - DNA, 12 bp, Homo sapiens
agtgtttggggg

SEQ ID NO: 1063247 - DNA, 18 bp, Homo sapiens
agtgtttggtgtattatc

SEQ ID NO: 1063248 - DNA, 14 bp, Homo sapiens
agtgttttctctga

SEQ ID NO: 1063249 - DNA, 11 bp, Homo sapiens
agtgttttctt

SEQ ID NO: 1063250 - DNA, 17 bp, Homo sapiens
agtgttttctttgagga

SEQ ID NO: 1063251 - DNA, 19 bp, Homo sapiens
agtgttttggactccatct

SEQ ID NO: 1063252 - DNA, 20 bp, Homo sapiens
agtgttttggactccatctc

SEQ ID NO: 1063253 - DNA, 22 bp, Homo sapiens
agtgttttggactccatctctc

SEQ ID NO: 1063254 - DNA, 17 bp, Homo sapiens
agtgttttggagaaaaa

SEQ ID NO: 1063255 - DNA, 16 bp, Homo sapiens
agtgtttttacctctg

SEQ ID NO: 1063256 - DNA, 19 bp, Homo sapiens
agtgtttttttatttctac

SEQ ID NO: 1063257 - DNA, 17 bp, Homo sapiens
agtgtttttttccctct

SEQ ID NO: 1063258 - DNA, 17 bp, Homo sapiens
agttaaaacaaaggaac

SEQ ID NO: 1063259 - DNA, 13 bp, Homo sapiens
agttaaaagcatt

SEQ ID NO: 1063260 - DNA, 16 bp, Homo sapiens
agttaaaagcatttta

SEQ ID NO: 1063261 - DNA, 17 bp, Homo sapiens
agttaaaatcacatttt

SEQ ID NO: 1063262 - DNA, 12 bp, Homo sapiens
agttaaaattga

SEQ ID NO: 1063263 - DNA, 22 bp, Homo sapiens
agttaaaattgttatcaaaata

SEQ ID NO: 1063264 - DNA, 12 bp, Homo sapiens
agttaaacacac

SEQ ID NO: 1063265 - DNA, 11 bp, Homo sapiens
agttaaagcca

SEQ ID NO: 1063266 - DNA, 21 bp, Homo sapiens
agttaaatagagtatatgcac

SEQ ID NO: 1063267 - DNA, 12 bp, Homo sapiens
agttaaatctca

SEQ ID NO: 1063268 - DNA, 14 bp, Homo sapiens
agttaaatctcaaa

SEQ ID NO: 1063269 - DNA, 12 bp, Homo sapiens
agttaaatcttc

SEQ ID NO: 1063270 - DNA, 14 bp, Homo sapiens
agttaacaaggaat

SEQ ID NO: 1063271 - DNA, 16 bp, Homo sapiens
agttaacaaggaatgc

SEQ ID NO: 1063272 - DNA, 17 bp, Homo sapiens
agttaacaaggaatgcc

SEQ ID NO: 1063273 - DNA, 23 bp, Homo sapiens
agttaacaaggaatgcctgtgcc

SEQ ID NO: 1063274 - DNA, 22 bp, Homo sapiens
agttaacacactaccgaatgtg

SEQ ID NO: 1063275 - DNA, 13 bp, Homo sapiens
agttaacaggata

SEQ ID NO: 1063276 - DNA, 15 bp, Homo sapiens
agttaacaggatatt

SEQ ID NO: 1063277 - DNA, 20 bp, Homo sapiens
agttaactattgcatttata

SEQ ID NO: 1063278 - DNA, 16 bp, Homo sapiens
agttaactcttcaaat

SEQ ID NO: 1063279 - DNA, 20 bp, Homo sapiens
agttaagacatgatttcctt

SEQ ID NO: 1063280 - DNA, 15 bp, Homo sapiens
agttaataacagctc

SEQ ID NO: 1063281 - DNA, 17 bp, Homo sapiens
agttaataacagctcct

SEQ ID NO: 1063282 - DNA, 14 bp, Homo sapiens
agttaatattttgt

SEQ ID NO: 1063283 - DNA, 21 bp, Homo sapiens
agttaattggatgttcactgc

SEQ ID NO: 1063284 - DNA, 14 bp, Homo sapiens
agttaatttaaagt

SEQ ID NO: 1063285 - DNA, 13 bp, Homo sapiens
agttacacatttt

SEQ ID NO: 1063286 - DNA, 19 bp, Homo sapiens
agttacacatttttcagat

SEQ ID NO: 1063287 - DNA, 22 bp, Homo sapiens
agttgaatgttgcaatgtgaaa

SEQ ID NO: 1063288 - DNA, 22 bp, Homo sapiens
agttgacaaaaagctcttacac

SEQ ID NO: 1063289 - DNA, 19 bp, Homo sapiens
agttgacaacctagaatgt

SEQ ID NO: 1063290 - DNA, 20 bp, Homo sapiens
agttgacaacctagaatgtc

SEQ ID NO: 1063291 - DNA, 19 bp, Homo sapiens
agttgacatccaaatctag

SEQ ID NO: 1063292 - DNA, 16 bp, Homo sapiens
agttgaccgttttcat

SEQ ID NO: 1063293 - DNA, 23 bp, Homo sapiens
agttgaccgttttcatcctggcc

SEQ ID NO: 1063294 - DNA, 16 bp, Homo sapiens
agttgactcacaggcc

SEQ ID NO: 1063295 - DNA, 22 bp, Homo sapiens
agttgactgactgagcaggctg

SEQ ID NO: 1063296 - DNA, 16 bp, Homo sapiens
agttgaggacttcttg

SEQ ID NO: 1063297 - DNA, 15 bp, Homo sapiens
agttgaggtctgcgt

SEQ ID NO: 1063298 - DNA, 19 bp, Homo sapiens
agttgaggtctttctcctc

SEQ ID NO: 1063299 - DNA, 21 bp, Homo sapiens
agttgagtacagtgaggaggg

SEQ ID NO: 1063300 - DNA, 17 bp, Homo sapiens
agttgataaagattttt

SEQ ID NO: 1063301 - DNA, 19 bp, Homo sapiens
agttgataacccctcttag

SEQ ID NO: 1063302 - DNA, 17 bp, Homo sapiens
agttgatattcaaggct

SEQ ID NO: 1063303 - DNA, 15 bp, Homo sapiens
agttgatgaaatgga

SEQ ID NO: 1063304 - DNA, 16 bp, Homo sapiens
agttgattatttcaac

SEQ ID NO: 1063305 - DNA, 14 bp, Homo sapiens
agttgattcagctc

SEQ ID NO: 1063306 - DNA, 18 bp, Homo sapiens
agttgattcagctctgca

SEQ ID NO: 1063307 - DNA, 18 bp, Homo sapiens
agttgatttagtgttttt

SEQ ID NO: 1063308 - DNA, 23 bp, Homo sapiens
agttgattttacaattgaaatga

SEQ ID NO: 1063309 - DNA, 20 bp, Homo sapiens
agttgcaattgaattaaatt

SEQ ID NO: 1063310 - DNA, 15 bp, Homo sapiens
agttgcactcaggtg

SEQ ID NO: 1063311 - DNA, 18 bp, Homo sapiens
agttgcagactcagtttg

SEQ ID NO: 1063312 - DNA, 22 bp, Homo sapiens
agttgcagactcagtttgtcag

SEQ ID NO: 1063313 - DNA, 15 bp, Homo sapiens
agttgcagatgtatt

SEQ ID NO: 1063314 - DNA, 17 bp, Homo sapiens
agttgcagatgtattga

SEQ ID NO: 1063315 - DNA, 16 bp, Homo sapiens
agttgcagattcattt

SEQ ID NO: 1063316 - DNA, 17 bp, Homo sapiens
agttgcagctgttttgt

SEQ ID NO: 1063317 - DNA, 14 bp, Homo sapiens
agttgcagtgagca

SEQ ID NO: 1063318 - DNA, 15 bp, Homo sapiens
agttgcagtgagcag

SEQ ID NO: 1063319 - DNA, 10 bp, Homo sapiens
agttgcagtt

SEQ ID NO: 1063320 - DNA, 16 bp, Homo sapiens
agttgccaagacaaat

SEQ ID NO: 1063321 - DNA, 22 bp, Homo sapiens
agttgcccgaaactaagccagg

SEQ ID NO: 1063322 - DNA, 18 bp, Homo sapiens
agttgccctagcccagac

SEQ ID NO: 1063323 - DNA, 20 bp, Homo sapiens
agttgcgacggagagaaaaa

SEQ ID NO: 1063324 - DNA, 14 bp, Homo sapiens
agttgctcacatgt

SEQ ID NO: 1063325 - DNA, 17 bp, Homo sapiens
agttgctcacatgtctt

SEQ ID NO: 1063326 - DNA, 17 bp, Homo sapiens
agttgctgcaaacctga

SEQ ID NO: 1063327 - DNA, 21 bp, Homo sapiens
agttgctgggattacaggtgt

SEQ ID NO: 1063328 - DNA, 18 bp, Homo sapiens
agttgctgtaaaatttgt

SEQ ID NO: 1063329 - DNA, 14 bp, Homo sapiens
agttgctgtttact

SEQ ID NO: 1063330 - DNA, 14 bp, Homo sapiens
agttgctgtttatt

SEQ ID NO: 1063331 - DNA, 21 bp, Homo sapiens
agttggaaaacttgtgccctt

SEQ ID NO: 1063332 - DNA, 17 bp, Homo sapiens
agttggactctcaggga

SEQ ID NO: 1063333 - DNA, 22 bp, Homo sapiens
agttggattaaattctgggtga

SEQ ID NO: 1063334 - DNA, 16 bp, Homo sapiens
agttggccaggctctt

SEQ ID NO: 1063335 - DNA, 12 bp, Homo sapiens
agttggcttcta

SEQ ID NO: 1063336 - DNA, 16 bp, Homo sapiens
agttggctttgcccac

SEQ ID NO: 1063337 - DNA, 23 bp, Homo sapiens
agttgggaacttcagatggacct

SEQ ID NO: 1063338 - DNA, 22 bp, Homo sapiens
agttgggatgccaatttcctct

SEQ ID NO: 1063339 - DNA, 23 bp, Homo sapiens
agttgggatgccaatttcctctc

SEQ ID NO: 1063340 - DNA, 16 bp, Homo sapiens
agttgggcagccagga

SEQ ID NO: 1063341 - DNA, 20 bp, Homo sapiens
agttgggctcgcactgccca

SEQ ID NO: 1063342 - DNA, 17 bp, Homo sapiens
agttggggccctcttgc

SEQ ID NO: 1063343 - DNA, 20 bp, Homo sapiens
agttggggctgccatagggt

SEQ ID NO: 1063344 - DNA, 15 bp, Homo sapiens
agttggtaacttttg

SEQ ID NO: 1063345 - DNA, 13 bp, Homo sapiens
agttggtgacaga

SEQ ID NO: 1063346 - DNA, 17 bp, Homo sapiens
agttggtgactgggaaa

SEQ ID NO: 1063347 - DNA, 15 bp, Homo sapiens
agttggttggataag

SEQ ID NO: 1063348 - DNA, 16 bp, Homo sapiens
agttggtttggatttt

SEQ ID NO: 1063349 - DNA, 17 bp, Homo sapiens
agttggtttgtatgaga

SEQ ID NO: 1063350 - DNA, 18 bp, Homo sapiens
agttgtaaagtatgtatt

SEQ ID NO: 1063351 - DNA, 18 bp, Homo sapiens
agttgtaaatatataaat

SEQ ID NO: 1063352 - DNA, 22 bp, Homo sapiens
agttgtaaatatataaatatat

SEQ ID NO: 1063353 - DNA, 16 bp, Homo sapiens
agttgtaacttatatt

SEQ ID NO: 1063354 - DNA, 11 bp, Homo sapiens
agttgtaccaa

SEQ ID NO: 1063355 - DNA, 15 bp, Homo sapiens
agttgtaccaaaaca

SEQ ID NO: 1063356 - DNA, 14 bp, Homo sapiens
agttgtacttctgc

SEQ ID NO: 1063357 - DNA, 23 bp, Homo sapiens
agttgtagacaaagtacattctg

SEQ ID NO: 1063358 - DNA, 13 bp, Homo sapiens
agttgtagtgtta

SEQ ID NO: 1063359 - DNA, 15 bp, Homo sapiens
agttgtatctctttt

SEQ ID NO: 1063360 - DNA, 15 bp, Homo sapiens
agttgtatgtttgct

SEQ ID NO: 1063361 - DNA, 16 bp, Homo sapiens
agttgtatgtttgctg

SEQ ID NO: 1063362 - DNA, 20 bp, Homo sapiens
agttgtatttaacagaaatt

SEQ ID NO: 1063363 - DNA, 22 bp, Homo sapiens
agttgtatttaacagaaattgt

SEQ ID NO: 1063364 - DNA, 23 bp, Homo sapiens
agttgtatttaacagaaattgta

SEQ ID NO: 1063365 - DNA, 16 bp, Homo sapiens
agttgtcaaagaagct

SEQ ID NO: 1063366 - DNA, 19 bp, Homo sapiens
agttgtcaagtctctgctg

SEQ ID NO: 1063367 - DNA, 20 bp, Homo sapiens
agttgtcctatggacaactt

SEQ ID NO: 1063368 - DNA, 17 bp, Homo sapiens
agttgtcctgatttctt

SEQ ID NO: 1063369 - DNA, 18 bp, Homo sapiens
agttgtcgtttttagctt

SEQ ID NO: 1063370 - DNA, 13 bp, Homo sapiens
agttgtctaaaca

SEQ ID NO: 1063371 - DNA, 18 bp, Homo sapiens
agttgtctattctgagcc

SEQ ID NO: 1063372 - DNA, 19 bp, Homo sapiens
agttgtctattctgagcct

SEQ ID NO: 1063373 - DNA, 21 bp, Homo sapiens
agttgtctattctgagccttg

SEQ ID NO: 1063374 - DNA, 13 bp, Homo sapiens
agttgtctccttc

SEQ ID NO: 1063375 - DNA, 17 bp, Homo sapiens
agttgtctctgatgcag

SEQ ID NO: 1063376 - DNA, 12 bp, Homo sapiens
agttgtcttaaa

SEQ ID NO: 1063377 - DNA, 13 bp, Homo sapiens
agttgtcttatgt

SEQ ID NO: 1063378 - DNA, 22 bp, Homo sapiens
agttgtcttatgtgaaaaatta

SEQ ID NO: 1063379 - DNA, 19 bp, Homo sapiens
agttgtgagccctctaggg

SEQ ID NO: 1063380 - DNA, 21 bp, Homo sapiens
agttgtgagccctctagggca

SEQ ID NO: 1063381 - DNA, 18 bp, Homo sapiens
agttgtgatataaaggac

SEQ ID NO: 1063382 - DNA, 19 bp, Homo sapiens
agttgtgcatgtatgtata

SEQ ID NO: 1063383 - DNA, 18 bp, Homo sapiens
agttgtgccttttatagc

SEQ ID NO: 1063384 - DNA, 23 bp, Homo sapiens
agttgtgccttttatagctatta

SEQ ID NO: 1063385 - DNA, 20 bp, Homo sapiens
agttgtggaaagataataaa

SEQ ID NO: 1063386 - DNA, 21 bp, Homo sapiens
agttgtggaaagcctctgctg

SEQ ID NO: 1063387 - DNA, 13 bp, Homo sapiens
agttgtggatatc

SEQ ID NO: 1063388 - DNA, 21 bp, Homo sapiens
agttgtgtctggcagtttata

SEQ ID NO: 1063389 - DNA, 18 bp, Homo sapiens
agttgtgtgtatgtgtgt

SEQ ID NO: 1063390 - DNA, 21 bp, Homo sapiens
agttgtgttttttaagatggc

SEQ ID NO: 1063391 - DNA, 19 bp, Homo sapiens
agttgttacatttttaagt

SEQ ID NO: 1063392 - DNA, 23 bp, Homo sapiens
agttgttactaactaaactctct

SEQ ID NO: 1063393 - DNA, 15 bp, Homo sapiens
agttgttagattaag

SEQ ID NO: 1063394 - DNA, 20 bp, Homo sapiens
agttgttagattaagaaata

SEQ ID NO: 1063395 - DNA, 22 bp, Homo sapiens
agttgttatgccatgatttttg

SEQ ID NO: 1063396 - DNA, 15 bp, Homo sapiens
agttgttggcctccg

SEQ ID NO: 1063397 - DNA, 22 bp, Homo sapiens
agttgttgtttgccaagctaat

SEQ ID NO: 1063398 - DNA, 14 bp, Homo sapiens
agttgtttatgtat

SEQ ID NO: 1063399 - DNA, 15 bp, Homo sapiens
agttgtttcattgac

SEQ ID NO: 1063400 - DNA, 13 bp, Homo sapiens
agttgtttgatgc

SEQ ID NO: 1063401 - DNA, 16 bp, Homo sapiens
agttgtttgtttttgc

SEQ ID NO: 1063402 - DNA, 18 bp, Homo sapiens
agttgtttgtttttgctt

SEQ ID NO: 1063403 - DNA, 18 bp, Homo sapiens
agttgttttatcttttaa

SEQ ID NO: 1063404 - DNA, 22 bp, Homo sapiens
agtttgctaaaagaagagaggg

SEQ ID NO: 1063405 - DNA, 16 bp, Homo sapiens
agtttgctaatgtttc

SEQ ID NO: 1063406 - DNA, 14 bp, Homo sapiens
agtttgcttagaaa

SEQ ID NO: 1063407 - DNA, 17 bp, Homo sapiens
agtttggaaataaaaat

SEQ ID NO: 1063408 - DNA, 19 bp, Homo sapiens
agtttggaaataaaaatgt

SEQ ID NO: 1063409 - DNA, 20 bp, Homo sapiens
agtttggaaataaaaatgtt

SEQ ID NO: 1063410 - DNA, 22 bp, Homo sapiens
agtttggagcactagtttgatt

SEQ ID NO: 1063411 - DNA, 16 bp, Homo sapiens
agtttggatatgtaaa

SEQ ID NO: 1063412 - DNA, 21 bp, Homo sapiens
agtttggatatttttgtactt

SEQ ID NO: 1063413 - DNA, 22 bp, Homo sapiens
agtttggatatttttgtacttg

SEQ ID NO: 1063414 - DNA, 16 bp, Homo sapiens
agtttggcaatagttt

SEQ ID NO: 1063415 - DNA, 17 bp, Homo sapiens
agtttggcaatagtttg

SEQ ID NO: 1063416 - DNA, 13 bp, Homo sapiens
agtttggccctgg

SEQ ID NO: 1063417 - DNA, 20 bp, Homo sapiens
agtttggccctggagccagg

SEQ ID NO: 1063418 - DNA, 15 bp, Homo sapiens
agtttgggcatattt

SEQ ID NO: 1063419 - DNA, 18 bp, Homo sapiens
agtttgggtaaaatactt

SEQ ID NO: 1063420 - DNA, 15 bp, Homo sapiens
agtttggtctggact

SEQ ID NO: 1063421 - DNA, 15 bp, Homo sapiens
agtttgtacatgcat

SEQ ID NO: 1063422 - DNA, 18 bp, Homo sapiens
agtttgtagaactttatt

SEQ ID NO: 1063423 - DNA, 16 bp, Homo sapiens
agtttgtagccaggta

SEQ ID NO: 1063424 - DNA, 14 bp, Homo sapiens
agtttgtataactt

SEQ ID NO: 1063425 - DNA, 22 bp, Homo sapiens
agtttgtatgccaagtgagaag

SEQ ID NO: 1063426 - DNA, 14 bp, Homo sapiens
agtttgtattttgc

SEQ ID NO: 1063427 - DNA, 18 bp, Homo sapiens
agtttgtattttgcatac

SEQ ID NO: 1063428 - DNA, 19 bp, Homo sapiens
agtttgtcgctcatgtgtg

SEQ ID NO: 1063429 - DNA, 21 bp, Homo sapiens
agtttgtctattttaaaataa

SEQ ID NO: 1063430 - DNA, 16 bp, Homo sapiens
agtttgtgtgtcttaa

SEQ ID NO: 1063431 - DNA, 14 bp, Homo sapiens
agtttgtgtgttgt

SEQ ID NO: 1063432 - DNA, 16 bp, Homo sapiens
agtttgtgtgttgtct

SEQ ID NO: 1063433 - DNA, 21 bp, Homo sapiens
agtttgtgtgttgtctcttga

SEQ ID NO: 1063434 - DNA, 20 bp, Homo sapiens
agtttgtgtgttgtcttgaa

SEQ ID NO: 1063435 - DNA, 21 bp, Homo sapiens
agtttgtgtgttgtgtccatt

SEQ ID NO: 1063436 - DNA, 22 bp, Homo sapiens
agtttgtgttagaaaagtttcg

SEQ ID NO: 1063437 - DNA, 14 bp, Homo sapiens
agtttgtgttttaa

SEQ ID NO: 1063438 - DNA, 17 bp, Homo sapiens
agtttgtgttttaaaaa

SEQ ID NO: 1063439 - DNA, 12 bp, Homo sapiens
ataaaattgtga

SEQ ID NO: 1063440 - DNA, 13 bp, Homo sapiens
ataaaattgtgat

SEQ ID NO: 1063441 - DNA, 14 bp, Homo sapiens
ataaaattgtgatg

SEQ ID NO: 1063442 - DNA, 21 bp, Homo sapiens
ataaaatttccttcaggtttt

SEQ ID NO: 1063443 - DNA, 16 bp, Homo sapiens
ataaaatttgttgcat

SEQ ID NO: 1063444 - DNA, 13 bp, Homo sapiens
ataaaattttaaa

SEQ ID NO: 1063445 - DNA, 15 bp, Homo sapiens
ataaacaaagttact

SEQ ID NO: 1063446 - DNA, 16 bp, Homo sapiens
ataaacaacagctgaa

SEQ ID NO: 1063447 - DNA, 22 bp, Homo sapiens
ataaacaagaccacgtttctaa

SEQ ID NO: 1063448 - DNA, 13 bp, Homo sapiens
ataaacaagcatt

SEQ ID NO: 1063449 - DNA, 24 bp, Homo sapiens
ataaacacatagattcacctgtaa

SEQ ID NO: 1063450 - DNA, 22 bp, Homo sapiens
ataaacacattgaatgcgcttt

SEQ ID NO: 1063451 - DNA, 21 bp, Homo sapiens
ataaacactccacagtgttta

SEQ ID NO: 1063452 - DNA, 14 bp, Homo sapiens
ataaacagacaata

SEQ ID NO: 1063453 - DNA, 19 bp, Homo sapiens
ataaacagacaatatgtga

SEQ ID NO: 1063454 - DNA, 20 bp, Homo sapiens
ataaacagactgttaattat

SEQ ID NO: 1063455 - DNA, 15 bp, Homo sapiens
ataaacagtgagcat

SEQ ID NO: 1063456 - DNA, 20 bp, Homo sapiens
ataaacagtgagcatatctg

SEQ ID NO: 1063457 - DNA, 14 bp, Homo sapiens
ataaacagttgtta

SEQ ID NO: 1063458 - DNA, 17 bp, Homo sapiens
ataaacagttgttactt

SEQ ID NO: 1063459 - DNA, 21 bp, Homo sapiens
ataaacatatttttatacttt

SEQ ID NO: 1063460 - DNA, 16 bp, Homo sapiens
ataaacatcacacaca

SEQ ID NO: 1063461 - DNA, 17 bp, Homo sapiens
ataaacatcacatgaga

SEQ ID NO: 1063462 - DNA, 21 bp, Homo sapiens
ataaacatccttcaagaactc

SEQ ID NO: 1063463 - DNA, 12 bp, Homo sapiens
ataaacatgaaa

SEQ ID NO: 1063464 - DNA, 14 bp, Homo sapiens
ataaacatgtcaca

SEQ ID NO: 1063465 - DNA, 20 bp, Homo sapiens
ataaacatgtcacaatacag

SEQ ID NO: 1063466 - DNA, 17 bp, Homo sapiens
ataaacattaaacactg

SEQ ID NO: 1063467 - DNA, 14 bp, Homo sapiens
ataaacattaattt

SEQ ID NO: 1063468 - DNA, 22 bp, Homo sapiens
ataaacattaattttgtgcatt

SEQ ID NO: 1063469 - DNA, 20 bp, Homo sapiens
ataaaccaaacccagccact

SEQ ID NO: 1063470 - DNA, 13 bp, Homo sapiens
ataaaccattcca

SEQ ID NO: 1063471 - DNA, 20 bp, Homo sapiens
ataaaccatttttgttactc

SEQ ID NO: 1063472 - DNA, 21 bp, Homo sapiens
ataaacccagttgccatctgc

SEQ ID NO: 1063473 - DNA, 20 bp, Homo sapiens
ataaacctaaaaaagatata

SEQ ID NO: 1063474 - DNA, 18 bp, Homo sapiens
ataaaccttaatatttct

SEQ ID NO: 1063475 - DNA, 11 bp, Homo sapiens
ataaaccttga

SEQ ID NO: 1063476 - DNA, 19 bp, Homo sapiens
ataaacgtggattttaaaa

SEQ ID NO: 1063477 - DNA, 17 bp, Homo sapiens
ataaactaataattgca

SEQ ID NO: 1063478 - DNA, 20 bp, Homo sapiens
ataaactaattttgtacgta

SEQ ID NO: 1063479 - DNA, 21 bp, Homo sapiens
ataaactcctactaaatccct

SEQ ID NO: 1063480 - DNA, 15 bp, Homo sapiens
ataaactctaaacat

SEQ ID NO: 1063481 - DNA, 17 bp, Homo sapiens
ataaactgaaaaatgtc

SEQ ID NO: 1063482 - DNA, 19 bp, Homo sapiens
ataaactgaatattttgga

SEQ ID NO: 1063483 - DNA, 21 bp, Homo sapiens
ataaactgaatattttggaaa

SEQ ID NO: 1063484 - DNA, 16 bp, Homo sapiens
ataaactgctgtcaat

SEQ ID NO: 1063485 - DNA, 18 bp, Homo sapiens
ataaactgtcaaattttc

SEQ ID NO: 1063486 - DNA, 13 bp, Homo sapiens
ataaactgtcact

SEQ ID NO: 1063487 - DNA, 16 bp, Homo sapiens
ataaacttaagggcaa

SEQ ID NO: 1063488 - DNA, 13 bp, Homo sapiens
ataaacttcagag

SEQ ID NO: 1063489 - DNA, 20 bp, Homo sapiens
ataaactttaatataaagta

SEQ ID NO: 1063490 - DNA, 22 bp, Homo sapiens
ataaactttaatataaagtagt

SEQ ID NO: 1063491 - DNA, 15 bp, Homo sapiens
ataaactttaccttt

SEQ ID NO: 1063492 - DNA, 23 bp, Homo sapiens
ataaagaagcaataaagaagagt

SEQ ID NO: 1063493 - DNA, 23 bp, Homo sapiens
ataaagaaggatgatgtcttttt

SEQ ID NO: 1063494 - DNA, 14 bp, Homo sapiens
ataaagtaaagcta

SEQ ID NO: 1063495 - DNA, 16 bp, Homo sapiens
ataaagtaaatacatg

SEQ ID NO: 1063496 - DNA, 15 bp, Homo sapiens
ataaagtaatgatga

SEQ ID NO: 1063497 - DNA, 14 bp, Homo sapiens
ataaagtaattcat

SEQ ID NO: 1063498 - DNA, 17 bp, Homo sapiens
ataaagtaattcataca

SEQ ID NO: 1063499 - DNA, 14 bp, Homo sapiens
ataaagtacaaatg

SEQ ID NO: 1063500 - DNA, 17 bp, Homo sapiens
ataaagtataatgttta

SEQ ID NO: 1063501 - DNA, 20 bp, Homo sapiens
ataaagtattcaacaatttc

SEQ ID NO: 1063502 - DNA, 16 bp, Homo sapiens
ataaagtattccacct

SEQ ID NO: 1063503 - DNA, 14 bp, Homo sapiens
ataaagtctgagaa

SEQ ID NO: 1063504 - DNA, 18 bp, Homo sapiens
ataaagtctgagaaatag

SEQ ID NO: 1063505 - DNA, 14 bp, Homo sapiens
ataaagtgccttct

SEQ ID NO: 1063506 - DNA, 17 bp, Homo sapiens
ataaagtgccttctggg

SEQ ID NO: 1063507 - DNA, 19 bp, Homo sapiens
ataaagtgtaacaattgtg

SEQ ID NO: 1063508 - DNA, 21 bp, Homo sapiens
ataaagttcctgtcattcctc

SEQ ID NO: 1063509 - DNA, 13 bp, Homo sapiens
ataaagttcctta

SEQ ID NO: 1063510 - DNA, 21 bp, Homo sapiens
ataaagttctgagtgttttta

SEQ ID NO: 1063511 - DNA, 20 bp, Homo sapiens
ataaagttctgcaaaataca

SEQ ID NO: 1063512 - DNA, 15 bp, Homo sapiens
ataaagttctgtact

SEQ ID NO: 1063513 - DNA, 16 bp, Homo sapiens
ataaagttgataaaga

SEQ ID NO: 1063514 - DNA, 20 bp, Homo sapiens
ataaagttgataaagatttt

SEQ ID NO: 1063515 - DNA, 16 bp, Homo sapiens
ataaagttggtgacag

SEQ ID NO: 1063516 - DNA, 14 bp, Homo sapiens
ataaagttgtaaat

SEQ ID NO: 1063517 - DNA, 19 bp, Homo sapiens
ataaagtttttttccttaa

SEQ ID NO: 1063518 - DNA, 15 bp, Homo sapiens
ataaataaaaatgga

SEQ ID NO: 1063519 - DNA, 16 bp, Homo sapiens
ataaataaaactgaat

SEQ ID NO: 1063520 - DNA, 19 bp, Homo sapiens
ataaataaaattcatttct

SEQ ID NO: 1063521 - DNA, 13 bp, Homo sapiens
ataaataaatatt

SEQ ID NO: 1063522 - DNA, 13 bp, Homo sapiens
ataaataataaag

SEQ ID NO: 1063523 - DNA, 15 bp, Homo sapiens
ataaataatctgtac

SEQ ID NO: 1063524 - DNA, 13 bp, Homo sapiens
ataaataatttta

SEQ ID NO: 1063525 - DNA, 20 bp, Homo sapiens
ataaatacagcatacttcaa

SEQ ID NO: 1063526 - DNA, 22 bp, Homo sapiens
ataaatacatacggtcaggttt

SEQ ID NO: 1063527 - DNA, 21 bp, Homo sapiens
ataaatacgtattacaaacaa

SEQ ID NO: 1063528 - DNA, 19 bp, Homo sapiens
ataaatactgtcaaacaat

SEQ ID NO: 1063529 - DNA, 15 bp, Homo sapiens
ataaatagaactatc

SEQ ID NO: 1063530 - DNA, 15 bp, Homo sapiens
ataaatagctatatc

SEQ ID NO: 1063531 - DNA, 23 bp, Homo sapiens
ataaatatatatatatataaaat

SEQ ID NO: 1063532 - DNA, 19 bp, Homo sapiens
ataaatatatatttttcaa

SEQ ID NO: 1063533 - DNA, 13 bp, Homo sapiens
ataaatatatcta

SEQ ID NO: 1063534 - DNA, 21 bp, Homo sapiens
ataaatatatctaccccagac

SEQ ID NO: 1063535 - DNA, 21 bp, Homo sapiens
ataaatatcagtattctgaca

SEQ ID NO: 1063536 - DNA, 22 bp, Homo sapiens
ataaatatggttaatttcatgt

SEQ ID NO: 1063537 - DNA, 11 bp, Homo sapiens
ataaatatgta

SEQ ID NO: 1063538 - DNA, 14 bp, Homo sapiens
ataaatatttatgt

SEQ ID NO: 1063539 - DNA, 20 bp, Homo sapiens
ataaatcaattcatgtttaa

SEQ ID NO: 1063540 - DNA, 20 bp, Homo sapiens
ataaatcagagagcaaggca

SEQ ID NO: 1063541 - DNA, 15 bp, Homo sapiens
ataaatcagtatttt

SEQ ID NO: 1063542 - DNA, 20 bp, Homo sapiens
ataaatcattcttactaaaa

SEQ ID NO: 1063543 - DNA, 17 bp, Homo sapiens
ataaatctctccagcta

SEQ ID NO: 1063544 - DNA, 14 bp, Homo sapiens
ataaatctcttctt

SEQ ID NO: 1063545 - DNA, 17 bp, Homo sapiens
ataaatcttcttattaa

SEQ ID NO: 1063546 - DNA, 15 bp, Homo sapiens
ataaatctttggaaa

SEQ ID NO: 1063547 - DNA, 18 bp, Homo sapiens
ataaatctttttactttg

SEQ ID NO: 1063548 - DNA, 20 bp, Homo sapiens
ataaatgacaaagtgttgaa

SEQ ID NO: 1063549 - DNA, 19 bp, Homo sapiens
ataaatgattatattcaca

SEQ ID NO: 1063550 - DNA, 23 bp, Homo sapiens
ataaatgctattttttattttac

SEQ ID NO: 1063551 - DNA, 16 bp, Homo sapiens
ataaatggccagtgct

SEQ ID NO: 1063552 - DNA, 18 bp, Homo sapiens
ataaatggccagtgctgc

SEQ ID NO: 1063553 - DNA, 21 bp, Homo sapiens
ataaatggccagtgctgcttc

SEQ ID NO: 1063554 - DNA, 16 bp, Homo sapiens
ataaatggctggtttt

SEQ ID NO: 1063555 - DNA, 23 bp, Homo sapiens
ataaatgggtgtatataatttta

SEQ ID NO: 1063556 - DNA, 13 bp, Homo sapiens
ataaatgtacatt

SEQ ID NO: 1063557 - DNA, 15 bp, Homo sapiens
ataaatgtacattaa

SEQ ID NO: 1063558 - DNA, 15 bp, Homo sapiens
ataaatgtacatttc

SEQ ID NO: 1063559 - DNA, 13 bp, Homo sapiens
ataaatgtatcat

SEQ ID NO: 1063560 - DNA, 14 bp, Homo sapiens
ataaatgtgtgtat

SEQ ID NO: 1063561 - DNA, 14 bp, Homo sapiens
ataaatgtgttggg

SEQ ID NO: 1063562 - DNA, 13 bp, Homo sapiens
ataaatgtttcaa

SEQ ID NO: 1063563 - DNA, 14 bp, Homo sapiens
ataaatgtttggaa

SEQ ID NO: 1063564 - DNA, 16 bp, Homo sapiens
ataaatgtttggaaag

SEQ ID NO: 1063565 - DNA, 21 bp, Homo sapiens
ataaatgtttggaaaggttct

SEQ ID NO: 1063566 - DNA, 14 bp, Homo sapiens
ataaatgtttgtct

SEQ ID NO: 1063567 - DNA, 19 bp, Homo sapiens
ataaattaaataaactgtt

SEQ ID NO: 1063568 - DNA, 20 bp, Homo sapiens
ataaattaaataaactgttt

SEQ ID NO: 1063569 - DNA, 23 bp, Homo sapiens
ataaattaaataaactgttttca

SEQ ID NO: 1063570 - DNA, 19 bp, Homo sapiens
ataaattaaatatatgtat

SEQ ID NO: 1063571 - DNA, 13 bp, Homo sapiens
ataaattaataaa

SEQ ID NO: 1063572 - DNA, 17 bp, Homo sapiens
ataaattaataaattta

SEQ ID NO: 1063573 - DNA, 14 bp, Homo sapiens
ataaattacacaat

SEQ ID NO: 1063574 - DNA, 20 bp, Homo sapiens
ataaattacacaataaagca

SEQ ID NO: 1063575 - DNA, 17 bp, Homo sapiens
ataaattatggcatttc

SEQ ID NO: 1063576 - DNA, 21 bp, Homo sapiens
ataaattattcagaactattt

SEQ ID NO: 1063577 - DNA, 17 bp, Homo sapiens
ataaattatttgattat

SEQ ID NO: 1063578 - DNA, 19 bp, Homo sapiens
ataaattcatcagaatcct

SEQ ID NO: 1063579 - DNA, 21 bp, Homo sapiens
ataaattccagaggactctgc

SEQ ID NO: 1063580 - DNA, 18 bp, Homo sapiens
ataaattcctaaactccc

SEQ ID NO: 1063581 - DNA, 20 bp, Homo sapiens
ataaattcctctttgctttg

SEQ ID NO: 1063582 - DNA, 22 bp, Homo sapiens
ataaattctacctccttgtgtt

SEQ ID NO: 1063583 - DNA, 16 bp, Homo sapiens
ataaattctataggaa

SEQ ID NO: 1063584 - DNA, 19 bp, Homo sapiens
ataaattctgacttatgaa

SEQ ID NO: 1063585 - DNA, 14 bp, Homo sapiens
ataaattgatttgt

SEQ ID NO: 1063586 - DNA, 19 bp, Homo sapiens
ataaattgatttttataaa

SEQ ID NO: 1063587 - DNA, 13 bp, Homo sapiens
ataaattgctcct

SEQ ID NO: 1063588 - DNA, 17 bp, Homo sapiens
ataaattgcttactgat

SEQ ID NO: 1063589 - DNA, 22 bp, Homo sapiens
ataaattgtagggctttagctt

SEQ ID NO: 1063590 - DNA, 13 bp, Homo sapiens
ataaattgtcttt

SEQ ID NO: 1063591 - DNA, 17 bp, Homo sapiens
ataaattgtctttaaaa

SEQ ID NO: 1063592 - DNA, 18 bp, Homo sapiens
ataaatttaagaaaacaa

SEQ ID NO: 1063593 - DNA, 19 bp, Homo sapiens
ataaatttaagaaaacaag

SEQ ID NO: 1063594 - DNA, 16 bp, Homo sapiens
ataaatttaagcaaac

SEQ ID NO: 1063595 - DNA, 15 bp, Homo sapiens
ataaatttatttact

SEQ ID NO: 1063596 - DNA, 20 bp, Homo sapiens
ataaatttcccagttaaaga

SEQ ID NO: 1063597 - DNA, 21 bp, Homo sapiens
ataaatttcccagttaaagat

SEQ ID NO: 1063598 - DNA, 17 bp, Homo sapiens
ataaatttcgcttctta

SEQ ID NO: 1063599 - DNA, 12 bp, Homo sapiens
ataaatttgact

SEQ ID NO: 1063600 - DNA, 18 bp, Homo sapiens
ataaatttgacttttctg

SEQ ID NO: 1063601 - DNA, 20 bp, Homo sapiens
ataaatttggttctaataga

SEQ ID NO: 1063602 - DNA, 20 bp, Homo sapiens
atactgctactgtaatttta

SEQ ID NO: 1063603 - DNA, 22 bp, Homo sapiens
atactgctctgaatattttgta

SEQ ID NO: 1063604 - DNA, 22 bp, Homo sapiens
atactgcttgaccgtactctca

SEQ ID NO: 1063605 - DNA, 16 bp, Homo sapiens
atactggaagttttgc

SEQ ID NO: 1063606 - DNA, 17 bp, Homo sapiens
atactggaagttttgca

SEQ ID NO: 1063607 - DNA, 20 bp, Homo sapiens
atactggaagttttgcattt

SEQ ID NO: 1063608 - DNA, 14 bp, Homo sapiens
atactggactcagg

SEQ ID NO: 1063609 - DNA, 16 bp, Homo sapiens
atactggactcaggaa

SEQ ID NO: 1063610 - DNA, 15 bp, Homo sapiens
atactggaggaacac

SEQ ID NO: 1063611 - DNA, 13 bp, Homo sapiens
atactggcacaga

SEQ ID NO: 1063612 - DNA, 15 bp, Homo sapiens
atactgggagagaag

SEQ ID NO: 1063613 - DNA, 20 bp, Homo sapiens
atactgggtttcaagaaaat

SEQ ID NO: 1063614 - DNA, 14 bp, Homo sapiens
atactgtaaaagtt

SEQ ID NO: 1063615 - DNA, 12 bp, Homo sapiens
atactgtaacac

SEQ ID NO: 1063616 - DNA, 11 bp, Homo sapiens
atactgtacat

SEQ ID NO: 1063617 - DNA, 12 bp, Homo sapiens
atactgtacatg

SEQ ID NO: 1063618 - DNA, 14 bp, Homo sapiens
atactgtacatgct

SEQ ID NO: 1063619 - DNA, 19 bp, Homo sapiens
atactgtacatgctatgct

SEQ ID NO: 1063620 - DNA, 15 bp, Homo sapiens
atactgtagaacctg

SEQ ID NO: 1063621 - DNA, 23 bp, Homo sapiens
atagatatataagaaaaaattct

SEQ ID NO: 1063622 - DNA, 17 bp, Homo sapiens
atagatcaataaatgtc

SEQ ID NO: 1063623 - DNA, 15 bp, Homo sapiens
atagatcagccatta

SEQ ID NO: 1063624 - DNA, 15 bp, Homo sapiens
atagatcagtatttc

SEQ ID NO: 1063625 - DNA, 21 bp, Homo sapiens
atagatctgatggtgagctgg

SEQ ID NO: 1063626 - DNA, 16 bp, Homo sapiens
atagatgcaagatatt

SEQ ID NO: 1063627 - DNA, 22 bp, Homo sapiens
atagatgtccctttcttggcca

SEQ ID NO: 1063628 - DNA, 23 bp, Homo sapiens
atagatgtccctttcttggccag

SEQ ID NO: 1063629 - DNA, 14 bp, Homo sapiens
atagatgtcttcat

SEQ ID NO: 1063630 - DNA, 16 bp, Homo sapiens
atagatgtcttcatca

SEQ ID NO: 1063631 - DNA, 12 bp, Homo sapiens
atagatgtttga

SEQ ID NO: 1063632 - DNA, 21 bp, Homo sapiens
atagattatttcatatactat

SEQ ID NO: 1063633 - DNA, 15 bp, Homo sapiens
atagattcacctgta

SEQ ID NO: 1063634 - DNA, 18 bp, Homo sapiens
atagattcacctgtaaaa

SEQ ID NO: 1063635 - DNA, 14 bp, Homo sapiens
atagattgcaaata

SEQ ID NO: 1063636 - DNA, 21 bp, Homo sapiens
atagattgcaaatattggtta

SEQ ID NO: 1063637 - DNA, 14 bp, Homo sapiens
atagattgtccttt

SEQ ID NO: 1063638 - DNA, 16 bp, Homo sapiens
atagattgtcttaatg

SEQ ID NO: 1063639 - DNA, 16 bp, Homo sapiens
atagatttattttaca

SEQ ID NO: 1063640 - DNA, 17 bp, Homo sapiens
atagatttattttacat

SEQ ID NO: 1063641 - DNA, 20 bp, Homo sapiens
atagatttattttacattta

SEQ ID NO: 1063642 - DNA, 20 bp, Homo sapiens
atagatttatttttcagttc

SEQ ID NO: 1063643 - DNA, 23 bp, Homo sapiens
atagatttatttttcagttccaa

SEQ ID NO: 1063644 - DNA, 19 bp, Homo sapiens
atagatttgaaaaactttt

SEQ ID NO: 1063645 - DNA, 13 bp, Homo sapiens
atagatttggaat

SEQ ID NO: 1063646 - DNA, 15 bp, Homo sapiens
atagattttctctgg

SEQ ID NO: 1063647 - DNA, 17 bp, Homo sapiens
atagcaaaagaagaagt

SEQ ID NO: 1063648 - DNA, 20 bp, Homo sapiens
atagcaaaattcctgtgttc

SEQ ID NO: 1063649 - DNA, 16 bp, Homo sapiens
atagcaaacttggaat

SEQ ID NO: 1063650 - DNA, 13 bp, Homo sapiens
atagcaaagaatt

SEQ ID NO: 1063651 - DNA, 14 bp, Homo sapiens
atagcaaagaattg

SEQ ID NO: 1063652 - DNA, 15 bp, Homo sapiens
atagcaaagaattga

SEQ ID NO: 1063653 - DNA, 19 bp, Homo sapiens
atagcaaatgaaggatgaa

SEQ ID NO: 1063654 - DNA, 17 bp, Homo sapiens
atagcaacaacaattgg

SEQ ID NO: 1063655 - DNA, 18 bp, Homo sapiens
atagcaacaacaattggt

SEQ ID NO: 1063656 - DNA, 15 bp, Homo sapiens
atagcaacagagcac

SEQ ID NO: 1063657 - DNA, 15 bp, Homo sapiens
atagcaacaggaaaa

SEQ ID NO: 1063658 - DNA, 22 bp, Homo sapiens
atagcaacttttgtgtaatgaa

SEQ ID NO: 1063659 - DNA, 19 bp, Homo sapiens
atagcaagacacatcccta

SEQ ID NO: 1063660 - DNA, 18 bp, Homo sapiens
atagcaagagtgtgaaat

SEQ ID NO: 1063661 - DNA, 22 bp, Homo sapiens
atagcaagtgaatttttctcta

SEQ ID NO: 1063662 - DNA, 14 bp, Homo sapiens
atagcacaggctaa

SEQ ID NO: 1063663 - DNA, 14 bp, Homo sapiens
atagcagattttaa

SEQ ID NO: 1063664 - DNA, 17 bp, Homo sapiens
atagcagctttgtctct

SEQ ID NO: 1063665 - DNA, 22 bp, Homo sapiens
atagcagtatatgttaatttgt

SEQ ID NO: 1063666 - DNA, 18 bp, Homo sapiens
atagcatagattgtcaaa

SEQ ID NO: 1063667 - DNA, 23 bp, Homo sapiens
atagcatccactggaaaaggtga

SEQ ID NO: 1063668 - DNA, 13 bp, Homo sapiens
atagcatgaaata

SEQ ID NO: 1063669 - DNA, 23 bp, Homo sapiens
atagcatgcttcctttctctcct

SEQ ID NO: 1063670 - DNA, 20 bp, Homo sapiens
atagcatggggcccctggcc

SEQ ID NO: 1063671 - DNA, 13 bp, Homo sapiens
atagcatgtaatg

SEQ ID NO: 1063672 - DNA, 13 bp, Homo sapiens
atagcattaacta

SEQ ID NO: 1063673 - DNA, 21 bp, Homo sapiens
atagcattaactaatctattg

SEQ ID NO: 1063674 - DNA, 18 bp, Homo sapiens
atagcattgataatcttc

SEQ ID NO: 1063675 - DNA, 18 bp, Homo sapiens
atagcatttttgatttat

SEQ ID NO: 1063676 - DNA, 12 bp, Homo sapiens
atagccaaaaat

SEQ ID NO: 1063677 - DNA, 15 bp, Homo sapiens
atagccaaaaatagc

SEQ ID NO: 1063678 - DNA, 21 bp, Homo sapiens
atagccacatttggaatactt

SEQ ID NO: 1063679 - DNA, 20 bp, Homo sapiens
atagccactaaccttgcctg

SEQ ID NO: 1063680 - DNA, 21 bp, Homo sapiens
atagccactaaccttgcctgg

SEQ ID NO: 1063681 - DNA, 15 bp, Homo sapiens
atagccagagaggag

SEQ ID NO: 1063682 - DNA, 20 bp, Homo sapiens
atagccagcattcagcacac

SEQ ID NO: 1063683 - DNA, 21 bp, Homo sapiens
atagccagcattcagcacaca

SEQ ID NO: 1063684 - DNA, 23 bp, Homo sapiens
atagccagcattcagcacacaca

SEQ ID NO: 1063685 - DNA, 13 bp, Homo sapiens
atagcccacttac

SEQ ID NO: 1063686 - DNA, 13 bp, Homo sapiens
atagcccagaaca

SEQ ID NO: 1063687 - DNA, 15 bp, Homo sapiens
atagccccagactgg

SEQ ID NO: 1063688 - DNA, 24 bp, Homo sapiens
atagccccagactgggcccaggca

SEQ ID NO: 1063689 - DNA, 19 bp, Homo sapiens
atagccctccccctcaacc

SEQ ID NO: 1063690 - DNA, 19 bp, Homo sapiens
atagccctgcaaaaattca

SEQ ID NO: 1063691 - DNA, 14 bp, Homo sapiens
atagccctgtcctg

SEQ ID NO: 1063692 - DNA, 15 bp, Homo sapiens
atagccctgtcctgg

SEQ ID NO: 1063693 - DNA, 16 bp, Homo sapiens
atagccctgtcctggt

SEQ ID NO: 1063694 - DNA, 18 bp, Homo sapiens
atagccgattctctgccc

SEQ ID NO: 1063695 - DNA, 20 bp, Homo sapiens
atagccgattctctgcccgg

SEQ ID NO: 1063696 - DNA, 13 bp, Homo sapiens
atagcctacattt

SEQ ID NO: 1063697 - DNA, 17 bp, Homo sapiens
atagcctgaggtgggag

SEQ ID NO: 1063698 - DNA, 20 bp, Homo sapiens
atagcctgcctgatccctga

SEQ ID NO: 1063699 - DNA, 21 bp, Homo sapiens
atagcgctgtttttgttgtgt

SEQ ID NO: 1063700 - DNA, 13 bp, Homo sapiens
atagcgttcttgt

SEQ ID NO: 1063701 - DNA, 15 bp, Homo sapiens
atagcgttcttgtaa

SEQ ID NO: 1063702 - DNA, 18 bp, Homo sapiens
atagcgttcttgtaattt

SEQ ID NO: 1063703 - DNA, 23 bp, Homo sapiens
atagctaacattttaaataaaag

SEQ ID NO: 1063704 - DNA, 15 bp, Homo sapiens
atagctaactgtaaa

SEQ ID NO: 1063705 - DNA, 14 bp, Homo sapiens
atagctaagtacac

SEQ ID NO: 1063706 - DNA, 23 bp, Homo sapiens
atagctacaatttgtttttgcat

SEQ ID NO: 1063707 - DNA, 20 bp, Homo sapiens
atagctatatccatgtactg

SEQ ID NO: 1063708 - DNA, 22 bp, Homo sapiens
atagctatatccatgtactgta

SEQ ID NO: 1063709 - DNA, 21 bp, Homo sapiens
atagctattttccttgctttt

SEQ ID NO: 1063710 - DNA, 16 bp, Homo sapiens
atagctcactgcagcc

SEQ ID NO: 1063711 - DNA, 13 bp, Homo sapiens
atagctcagttta

SEQ ID NO: 1063712 - DNA, 21 bp, Homo sapiens
atagctgaaaactaatgtact

SEQ ID NO: 1063713 - DNA, 23 bp, Homo sapiens
atagctgcttggattctctgaga

SEQ ID NO: 1063714 - DNA, 17 bp, Homo sapiens
atagctggaaaaaacaa

SEQ ID NO: 1063715 - DNA, 18 bp, Homo sapiens
atagctggaaaaaacaaa

SEQ ID NO: 1063716 - DNA, 21 bp, Homo sapiens
atagctggaaaaaacaaaata

SEQ ID NO: 1063717 - DNA, 20 bp, Homo sapiens
atagctgtgtgaacgtgtat

SEQ ID NO: 1063718 - DNA, 20 bp, Homo sapiens
atagctgttttgtgtatatt

SEQ ID NO: 1063719 - DNA, 19 bp, Homo sapiens
atagcttaactaatttgaa

SEQ ID NO: 1063720 - DNA, 21 bp, Homo sapiens
atagcttattatagaattgca

SEQ ID NO: 1063721 - DNA, 21 bp, Homo sapiens
atagcttcaccccaatcccag

SEQ ID NO: 1063722 - DNA, 22 bp, Homo sapiens
atagcttcaccccaatcccagc

SEQ ID NO: 1063723 - DNA, 20 bp, Homo sapiens
atagcttgtatagtgtaaaa

SEQ ID NO: 1063724 - DNA, 22 bp, Homo sapiens
atagcttgtttctgtcaagcat

SEQ ID NO: 1063725 - DNA, 17 bp, Homo sapiens
atagctttaaaagggaa

SEQ ID NO: 1063726 - DNA, 19 bp, Homo sapiens
atagctttattttttaagt

SEQ ID NO: 1063727 - DNA, 21 bp, Homo sapiens
atagctttattttttaagtat

SEQ ID NO: 1063728 - DNA, 22 bp, Homo sapiens
atagctttattttttaagtatt

SEQ ID NO: 1063729 - DNA, 18 bp, Homo sapiens
atagcttttattgtataa

SEQ ID NO: 1063730 - DNA, 22 bp, Homo sapiens
ataggaaaacattgcaataaat

SEQ ID NO: 1063731 - DNA, 19 bp, Homo sapiens
ataggaaagcatatgcagc

SEQ ID NO: 1063732 - DNA, 16 bp, Homo sapiens
ataggaacatatgaaa

SEQ ID NO: 1063733 - DNA, 21 bp, Homo sapiens
ataggaacatatgaaaataca

SEQ ID NO: 1063734 - DNA, 15 bp, Homo sapiens
ataggaagacataaa

SEQ ID NO: 1063735 - DNA, 20 bp, Homo sapiens
ataggaagacataaaacttt

SEQ ID NO: 1063736 - DNA, 13 bp, Homo sapiens
ataggaaggaaac

SEQ ID NO: 1063737 - DNA, 14 bp, Homo sapiens
ataggaaggaaact

SEQ ID NO: 1063738 - DNA, 20 bp, Homo sapiens
ataggaatgtccaccatgaa

SEQ ID NO: 1063739 - DNA, 21 bp, Homo sapiens
ataggaatgtccaccatgaac

SEQ ID NO: 1063740 - DNA, 18 bp, Homo sapiens
ataggacatactgcatgt

SEQ ID NO: 1063741 - DNA, 19 bp, Homo sapiens
ataggacatactgcatgta

SEQ ID NO: 1063742 - DNA, 16 bp, Homo sapiens
ataggaccttgggcca

SEQ ID NO: 1063743 - DNA, 20 bp, Homo sapiens
ataggacctttccaccacag

SEQ ID NO: 1063744 - DNA, 22 bp, Homo sapiens
atactgtatttttactattgaa

SEQ ID NO: 1063745 - DNA, 15 bp, Homo sapiens
atactgtctgggatt

SEQ ID NO: 1063746 - DNA, 23 bp, Homo sapiens
atactgtctgggattaagggcaa

SEQ ID NO: 1063747 - DNA, 15 bp, Homo sapiens
atactgtctttgtgc

SEQ ID NO: 1063748 - DNA, 14 bp, Homo sapiens
atactgtgcagaat

SEQ ID NO: 1063749 - DNA, 16 bp, Homo sapiens
atactgtgcagaataa

SEQ ID NO: 1063750 - DNA, 21 bp, Homo sapiens
atactgtgcagaataatggaa

SEQ ID NO: 1063751 - DNA, 20 bp, Homo sapiens
atactgtgtgggatacttag

SEQ ID NO: 1063752 - DNA, 13 bp, Homo sapiens
atactgtgtgtga

SEQ ID NO: 1063753 - DNA, 21 bp, Homo sapiens
atactgtgtgttttcccaaag

SEQ ID NO: 1063754 - DNA, 17 bp, Homo sapiens
atactgttgatacaaac

SEQ ID NO: 1063755 - DNA, 19 bp, Homo sapiens
atactgttgatacaaacca

SEQ ID NO: 1063756 - DNA, 17 bp, Homo sapiens
atactgtttcttgcact

SEQ ID NO: 1063757 - DNA, 22 bp, Homo sapiens
atactgtttcttgcactgaata

SEQ ID NO: 1063758 - DNA, 16 bp, Homo sapiens
atacttaaaaatttat

SEQ ID NO: 1063759 - DNA, 17 bp, Homo sapiens
atacttaaaatgacaaa

SEQ ID NO: 1063760 - DNA, 21 bp, Homo sapiens
atacttaaaatgacaaagcca

SEQ ID NO: 1063761 - DNA, 14 bp, Homo sapiens
atacttaaataaac

SEQ ID NO: 1063762 - DNA, 13 bp, Homo sapiens
atacttaacattt

SEQ ID NO: 1063763 - DNA, 14 bp, Homo sapiens
atacttaagcaaaa

SEQ ID NO: 1063764 - DNA, 15 bp, Homo sapiens
atacttaatctaaga

SEQ ID NO: 1063765 - DNA, 15 bp, Homo sapiens
atacttacatttcca

SEQ ID NO: 1063766 - DNA, 20 bp, Homo sapiens
atacttacatttccatttat

SEQ ID NO: 1063767 - DNA, 23 bp, Homo sapiens
atacttacatttccatttattgt

SEQ ID NO: 1063768 - DNA, 21 bp, Homo sapiens
atacttacctagtgaaacttt

SEQ ID NO: 1063769 - DNA, 21 bp, Homo sapiens
atacttagtggtatgtctctt

SEQ ID NO: 1063770 - DNA, 17 bp, Homo sapiens
atacttatgttgtattg

SEQ ID NO: 1063771 - DNA, 19 bp, Homo sapiens
atacttcaaaaataatgtg

SEQ ID NO: 1063772 - DNA, 16 bp, Homo sapiens
atacttcactacttta

SEQ ID NO: 1063773 - DNA, 18 bp, Homo sapiens
atacttcaggtgcttttg

SEQ ID NO: 1063774 - DNA, 21 bp, Homo sapiens
atacttcatgaaatcctgggt

SEQ ID NO: 1063775 - DNA, 17 bp, Homo sapiens
atacttcatttaaaaaa

SEQ ID NO: 1063776 - DNA, 20 bp, Homo sapiens
atacttcatttaaaaaaatc

SEQ ID NO: 1063777 - DNA, 12 bp, Homo sapiens
atacttgcaact

SEQ ID NO: 1063778 - DNA, 19 bp, Homo sapiens
atacttgcaactaaggaca

SEQ ID NO: 1063779 - DNA, 22 bp, Homo sapiens
atacttggatttagtttcagta

SEQ ID NO: 1063780 - DNA, 19 bp, Homo sapiens
atacttggctgcttcctgt

SEQ ID NO: 1063781 - DNA, 17 bp, Homo sapiens
atacttgttccagatgg

SEQ ID NO: 1063782 - DNA, 23 bp, Homo sapiens
atactttaaaggaaaaaatgttg

SEQ ID NO: 1063783 - DNA, 12 bp, Homo sapiens
atactttacatg

SEQ ID NO: 1063784 - DNA, 13 bp, Homo sapiens
atactttattgaa

SEQ ID NO: 1063785 - DNA, 16 bp, Homo sapiens
atactttattgaaagg

SEQ ID NO: 1063786 - DNA, 23 bp, Homo sapiens
atactttgaaaggagatgtcttg

SEQ ID NO: 1063787 - DNA, 18 bp, Homo sapiens
atactttgacaaggaaaa

SEQ ID NO: 1063788 - DNA, 23 bp, Homo sapiens
atactttgacaaggaaaatctat

SEQ ID NO: 1063789 - DNA, 22 bp, Homo sapiens
atactttgcagcacagctgaga

SEQ ID NO: 1063790 - DNA, 16 bp, Homo sapiens
atacttttactctgcc

SEQ ID NO: 1063791 - DNA, 17 bp, Homo sapiens
atacttttactctgcct

SEQ ID NO: 1063792 - DNA, 20 bp, Homo sapiens
atacttttactctgcctaca

SEQ ID NO: 1063793 - DNA, 11 bp, Homo sapiens
atacttttctt

SEQ ID NO: 1063794 - DNA, 15 bp, Homo sapiens
atactttttaaaaaa

SEQ ID NO: 1063795 - DNA, 17 bp, Homo sapiens
atactttttctaatgag

SEQ ID NO: 1063796 - DNA, 12 bp, Homo sapiens
atagaaaaatgt

SEQ ID NO: 1063797 - DNA, 15 bp, Homo sapiens
atagaaaaatgtata

SEQ ID NO: 1063798 - DNA, 23 bp, Homo sapiens
atagaaaacaggaaaaaaacttt

SEQ ID NO: 1063799 - DNA, 13 bp, Homo sapiens
atagaaaagttat

SEQ ID NO: 1063800 - DNA, 17 bp, Homo sapiens
atagaaaatcttagtat

SEQ ID NO: 1063801 - DNA, 19 bp, Homo sapiens
atagaaaattatttgtatg

SEQ ID NO: 1063802 - DNA, 21 bp, Homo sapiens
atagaaactcaccatgtaaaa

SEQ ID NO: 1063803 - DNA, 14 bp, Homo sapiens
atagaaagaaacta

SEQ ID NO: 1063804 - DNA, 16 bp, Homo sapiens
atagaaagtgccagaa

SEQ ID NO: 1063805 - DNA, 23 bp, Homo sapiens
atagaaagttgcaaggcaaatgt

SEQ ID NO: 1063806 - DNA, 22 bp, Homo sapiens
atagaaataaaggatgtgattg

SEQ ID NO: 1063807 - DNA, 16 bp, Homo sapiens
atagaaatagaacact

SEQ ID NO: 1063808 - DNA, 21 bp, Homo sapiens
atagaaatatagggttttttt

SEQ ID NO: 1063809 - DNA, 22 bp, Homo sapiens
atagaaatgctggtttttcagt

SEQ ID NO: 1063810 - DNA, 12 bp, Homo sapiens
atagaaatggaa

SEQ ID NO: 1063811 - DNA, 14 bp, Homo sapiens
atagaacaaggctg

SEQ ID NO: 1063812 - DNA, 16 bp, Homo sapiens
atagaacactgcctct

SEQ ID NO: 1063813 - DNA, 14 bp, Homo sapiens
atagaagattgttg

SEQ ID NO: 1063814 - DNA, 16 bp, Homo sapiens
atagaagccacatcgt

SEQ ID NO: 1063815 - DNA, 13 bp, Homo sapiens
atagaagctgtag

SEQ ID NO: 1063816 - DNA, 16 bp, Homo sapiens
atagaaggaagtgtgt

SEQ ID NO: 1063817 - DNA, 16 bp, Homo sapiens
atagaaggaatttgta

SEQ ID NO: 1063818 - DNA, 18 bp, Homo sapiens
atagaaggaatttgtact

SEQ ID NO: 1063819 - DNA, 19 bp, Homo sapiens
atagaaggatgtacatttc

SEQ ID NO: 1063820 - DNA, 15 bp, Homo sapiens
atagaaggctgtctt

SEQ ID NO: 1063821 - DNA, 13 bp, Homo sapiens
atagaaggtgatg

SEQ ID NO: 1063822 - DNA, 16 bp, Homo sapiens
atagaagttttaaatt

SEQ ID NO: 1063823 - DNA, 20 bp, Homo sapiens
atagaataattcttttctga

SEQ ID NO: 1063824 - DNA, 22 bp, Homo sapiens
atagaatacttttttctagttt

SEQ ID NO: 1063825 - DNA, 22 bp, Homo sapiens
atagaataggcactttaaaaca

SEQ ID NO: 1063826 - DNA, 18 bp, Homo sapiens
atagaatgatagaacttt

SEQ ID NO: 1063827 - DNA, 18 bp, Homo sapiens
atagaatgatgttttaaa

SEQ ID NO: 1063828 - DNA, 19 bp, Homo sapiens
atagaatgatgttttaaaa

SEQ ID NO: 1063829 - DNA, 22 bp, Homo sapiens
atagaattgacattgaaatcta

SEQ ID NO: 1063830 - DNA, 17 bp, Homo sapiens
atagacaacgatgaatt

SEQ ID NO: 1063831 - DNA, 22 bp, Homo sapiens
atagacaatttattatggcaca

SEQ ID NO: 1063832 - DNA, 20 bp, Homo sapiens
atagacaatttgcacatctt

SEQ ID NO: 1063833 - DNA, 14 bp, Homo sapiens
atagacacatcaaa

SEQ ID NO: 1063834 - DNA, 18 bp, Homo sapiens
atagacatttcaaaatta

SEQ ID NO: 1063835 - DNA, 20 bp, Homo sapiens
atagacatttcaaaattaat

SEQ ID NO: 1063836 - DNA, 13 bp, Homo sapiens
atagaccaaagca

SEQ ID NO: 1063837 - DNA, 18 bp, Homo sapiens
atagacctctagtagctg

SEQ ID NO: 1063838 - DNA, 16 bp, Homo sapiens
atagactaacttcagt

SEQ ID NO: 1063839 - DNA, 16 bp, Homo sapiens
atagactcctttgcta

SEQ ID NO: 1063840 - DNA, 15 bp, Homo sapiens
atagacttctcttac

SEQ ID NO: 1063841 - DNA, 16 bp, Homo sapiens
atagacttctcttaca

SEQ ID NO: 1063842 - DNA, 23 bp, Homo sapiens
ataggacctttccaccacagcca

SEQ ID NO: 1063843 - DNA, 17 bp, Homo sapiens
ataggactaccgcaggc

SEQ ID NO: 1063844 - DNA, 20 bp, Homo sapiens
ataggactaccgcaggcccg

SEQ ID NO: 1063845 - DNA, 23 bp, Homo sapiens
ataggaggagctctcaattttat

SEQ ID NO: 1063846 - DNA, 23 bp, Homo sapiens
ataggaggggtctggacatgtgg

SEQ ID NO: 1063847 - DNA, 17 bp, Homo sapiens
ataggagttctctgatg

SEQ ID NO: 1063848 - DNA, 23 bp, Homo sapiens
ataggagttctctgatgcagaaa

SEQ ID NO: 1063849 - DNA, 15 bp, Homo sapiens
ataggataaagttgg

SEQ ID NO: 1063850 - DNA, 15 bp, Homo sapiens
ataggatagacactg

SEQ ID NO: 1063851 - DNA, 15 bp, Homo sapiens
ataggatcctggagg

SEQ ID NO: 1063852 - DNA, 19 bp, Homo sapiens
ataggattaaacacacaca

SEQ ID NO: 1063853 - DNA, 22 bp, Homo sapiens
ataggatttatttaaaatagca

SEQ ID NO: 1063854 - DNA, 14 bp, Homo sapiens
ataggcagaatgga

SEQ ID NO: 1063855 - DNA, 14 bp, Homo sapiens
ataggcagggggcc

SEQ ID NO: 1063856 - DNA, 16 bp, Homo sapiens
ataggcagggggccct

SEQ ID NO: 1063857 - DNA, 22 bp, Homo sapiens
ataggccaaactggcaaacttc

SEQ ID NO: 1063858 - DNA, 20 bp, Homo sapiens
ataggccagggcatgtgtat

SEQ ID NO: 1063859 - DNA, 13 bp, Homo sapiens
ataggccatctgt

SEQ ID NO: 1063860 - DNA, 17 bp, Homo sapiens
ataggccatctgtaaat

SEQ ID NO: 1063861 - DNA, 23 bp, Homo sapiens
ataggcccaaccaccagatgaga

SEQ ID NO: 1063862 - DNA, 19 bp, Homo sapiens
ataggcggtcatgtgtgca

SEQ ID NO: 1063863 - DNA, 21 bp, Homo sapiens
ataggctattttctaaagact

SEQ ID NO: 1063864 - DNA, 16 bp, Homo sapiens
ataggctggagaagct

SEQ ID NO: 1063865 - DNA, 18 bp, Homo sapiens
ataggctggagaagctca

SEQ ID NO: 1063866 - DNA, 17 bp, Homo sapiens
ataggctggtggccttg

SEQ ID NO: 1063867 - DNA, 18 bp, Homo sapiens
ataggcttctattaccta

SEQ ID NO: 1063868 - DNA, 15 bp, Homo sapiens
atagggatggcagtg

SEQ ID NO: 1063869 - DNA, 14 bp, Homo sapiens
atagggctgagctc

SEQ ID NO: 1063870 - DNA, 17 bp, Homo sapiens
ataggggatatttaagg

SEQ ID NO: 1063871 - DNA, 13 bp, Homo sapiens
ataggggggaggg

SEQ ID NO: 1063872 - DNA, 13 bp, Homo sapiens
ataggggtcctgg

SEQ ID NO: 1063873 - DNA, 21 bp, Homo sapiens
atagggtagaatgattaatca

SEQ ID NO: 1063874 - DNA, 21 bp, Homo sapiens
atagggtctcttcaggttctt

SEQ ID NO: 1063875 - DNA, 22 bp, Homo sapiens
atagggtctgcagcctgctggg

SEQ ID NO: 1063876 - DNA, 22 bp, Homo sapiens
atagggttttttttaatgtgaa

SEQ ID NO: 1063877 - DNA, 19 bp, Homo sapiens
ataggtagggggctttcac

SEQ ID NO: 1063878 - DNA, 22 bp, Homo sapiens
ataggtagtttggatatttttg

SEQ ID NO: 1063879 - DNA, 17 bp, Homo sapiens
ataggtcactggctctc

SEQ ID NO: 1063880 - DNA, 23 bp, Homo sapiens
ataggtcagtgaggcccagggag

SEQ ID NO: 1063881 - DNA, 22 bp, Homo sapiens
ataggtctaaataggatcctgg

SEQ ID NO: 1063882 - DNA, 15 bp, Homo sapiens
ataggtctcttctcc

SEQ ID NO: 1063883 - DNA, 16 bp, Homo sapiens
ataggtctctttgctt

SEQ ID NO: 1063884 - DNA, 22 bp, Homo sapiens
ataggtctctttgctttctggt

SEQ ID NO: 1063885 - DNA, 14 bp, Homo sapiens
ataggtctgaaatt

SEQ ID NO: 1063886 - DNA, 17 bp, Homo sapiens
ataggtctgtatggctg

SEQ ID NO: 1063887 - DNA, 17 bp, Homo sapiens
ataggtctttctctcag

SEQ ID NO: 1063888 - DNA, 18 bp, Homo sapiens
ataggtgagaaaaaaaca

SEQ ID NO: 1063889 - DNA, 16 bp, Homo sapiens
ataggtgatgggcaga

SEQ ID NO: 1063890 - DNA, 22 bp, Homo sapiens
ataggttcttcttgttctgaga

SEQ ID NO: 1063891 - DNA, 22 bp, Homo sapiens
ataggtttatattattgattca

SEQ ID NO: 1063892 - DNA, 14 bp, Homo sapiens
ataggtttctctcc

SEQ ID NO: 1063893 - DNA, 17 bp, Homo sapiens
atagtaaaacacttatt

SEQ ID NO: 1063894 - DNA, 18 bp, Homo sapiens
atagtaaaagataacaag

SEQ ID NO: 1063895 - DNA, 16 bp, Homo sapiens
atagtaaccattttcc

SEQ ID NO: 1063896 - DNA, 22 bp, Homo sapiens
atagtaactactttttatactc

SEQ ID NO: 1063897 - DNA, 20 bp, Homo sapiens
atagtagatttttaacaaaa

SEQ ID NO: 1063898 - DNA, 22 bp, Homo sapiens
atagtaggcactaaatacatgt

SEQ ID NO: 1063899 - DNA, 13 bp, Homo sapiens
atagtagtatgat

SEQ ID NO: 1063900 - DNA, 17 bp, Homo sapiens
atagtagttacttgtga

SEQ ID NO: 1063901 - DNA, 16 bp, Homo sapiens
atagtatatttatact

SEQ ID NO: 1063902 - DNA, 17 bp, Homo sapiens
atagtatatttatactc

SEQ ID NO: 1063903 - DNA, 23 bp, Homo sapiens
atagtatccatattttattactg

SEQ ID NO: 1063904 - DNA, 15 bp, Homo sapiens
atagtatctgtatat

SEQ ID NO: 1063905 - DNA, 22 bp, Homo sapiens
atagtatgggaaaaaaactgaa

SEQ ID NO: 1063906 - DNA, 16 bp, Homo sapiens
atagtatgtgactttt

SEQ ID NO: 1063907 - DNA, 17 bp, Homo sapiens
atagtatgttaatatgt

SEQ ID NO: 1063908 - DNA, 12 bp, Homo sapiens
atagtattccat

SEQ ID NO: 1063909 - DNA, 22 bp, Homo sapiens
atagtattccattgtgtgagtg

SEQ ID NO: 1063910 - DNA, 20 bp, Homo sapiens
atagtattgctgaactctta

SEQ ID NO: 1063911 - DNA, 21 bp, Homo sapiens
atagtattggaaaataaaaat

SEQ ID NO: 1063912 - DNA, 13 bp, Homo sapiens
atagtattggagc

SEQ ID NO: 1063913 - DNA, 22 bp, Homo sapiens
atagtatttgattcaaaatatt

SEQ ID NO: 1063914 - DNA, 19 bp, Homo sapiens
atagtcaatggcttgttca

SEQ ID NO: 1063915 - DNA, 14 bp, Homo sapiens
atagtcagctgcct

SEQ ID NO: 1063916 - DNA, 16 bp, Homo sapiens
atagtcattccaaata

SEQ ID NO: 1063917 - DNA, 13 bp, Homo sapiens
atagtccaatatt

SEQ ID NO: 1063918 - DNA, 16 bp, Homo sapiens
atagtccttcctggca

SEQ ID NO: 1063919 - DNA, 17 bp, Homo sapiens
atagtccttcctggcat

SEQ ID NO: 1063920 - DNA, 18 bp, Homo sapiens
atatataacagatacatt

SEQ ID NO: 1063921 - DNA, 13 bp, Homo sapiens
atatataaccagt

SEQ ID NO: 1063922 - DNA, 15 bp, Homo sapiens
atatataagtgtaca

SEQ ID NO: 1063923 - DNA, 17 bp, Homo sapiens
atatataatgttgccag

SEQ ID NO: 1063924 - DNA, 22 bp, Homo sapiens
atatataatttgagtgtatata

SEQ ID NO: 1063925 - DNA, 15 bp, Homo sapiens
atatatacacataca

SEQ ID NO: 1063926 - DNA, 15 bp, Homo sapiens
atatatacatgtttt

SEQ ID NO: 1063927 - DNA, 13 bp, Homo sapiens
atatatacatttt

SEQ ID NO: 1063928 - DNA, 13 bp, Homo sapiens
atatatatatagt

SEQ ID NO: 1063929 - DNA, 15 bp, Homo sapiens
atatatatatatatt

SEQ ID NO: 1063930 - DNA, 15 bp, Homo sapiens
atatatatatgtaca

SEQ ID NO: 1063931 - DNA, 14 bp, Homo sapiens
atatatatatgtat

SEQ ID NO: 1063932 - DNA, 14 bp, Homo sapiens
atatatatatttgt

SEQ ID NO: 1063933 - DNA, 16 bp, Homo sapiens
atatatatgtacagtt

SEQ ID NO: 1063934 - DNA, 16 bp, Homo sapiens
atatatatgtatatgt

SEQ ID NO: 1063935 - DNA, 22 bp, Homo sapiens
atatatatgtatatgtatatat

SEQ ID NO: 1063936 - DNA, 14 bp, Homo sapiens
atatatatgtcaat

SEQ ID NO: 1063937 - DNA, 21 bp, Homo sapiens
atatatattcatcagaatgtt

SEQ ID NO: 1063938 - DNA, 14 bp, Homo sapiens
atatatatttgtaa

SEQ ID NO: 1063939 - DNA, 17 bp, Homo sapiens
atatatatttttaaaat

SEQ ID NO: 1063940 - DNA, 17 bp, Homo sapiens
atatatatttttcaaat

SEQ ID NO: 1063941 - DNA, 19 bp, Homo sapiens
atatatcaagaagtcttga

SEQ ID NO: 1063942 - DNA, 20 bp, Homo sapiens
atatatcatattggtattca

SEQ ID NO: 1063943 - DNA, 15 bp, Homo sapiens
atatatctacacata

SEQ ID NO: 1063944 - DNA, 16 bp, Homo sapiens
atatatctagaactat

SEQ ID NO: 1063945 - DNA, 20 bp, Homo sapiens
atatatctatctatttgagg

SEQ ID NO: 1063946 - DNA, 16 bp, Homo sapiens
atatatctctatttga

SEQ ID NO: 1063947 - DNA, 17 bp, Homo sapiens
atatatctgcttcagtg

SEQ ID NO: 1063948 - DNA, 23 bp, Homo sapiens
atatatcttaagcaggtttgttt

SEQ ID NO: 1063949 - DNA, 23 bp, Homo sapiens
atatatgatgtggacatatgtat

SEQ ID NO: 1063950 - DNA, 19 bp, Homo sapiens
atatatgcactatgtatat

SEQ ID NO: 1063951 - DNA, 22 bp, Homo sapiens
atatatgctgtatttctttgta

SEQ ID NO: 1063952 - DNA, 14 bp, Homo sapiens
atatatgcttacat

SEQ ID NO: 1063953 - DNA, 16 bp, Homo sapiens
atatatggacctagct

SEQ ID NO: 1063954 - DNA, 13 bp, Homo sapiens
atatatggatcag

SEQ ID NO: 1063955 - DNA, 13 bp, Homo sapiens
atatatggcagag

SEQ ID NO: 1063956 - DNA, 19 bp, Homo sapiens
atatatggcagagttgtaa

SEQ ID NO: 1063957 - DNA, 21 bp, Homo sapiens
atatatggggatggtagtttt

SEQ ID NO: 1063958 - DNA, 22 bp, Homo sapiens
atatatggggatggtagttttt

SEQ ID NO: 1063959 - DNA, 19 bp, Homo sapiens
atatatgtatatatatgca

SEQ ID NO: 1063960 - DNA, 20 bp, Homo sapiens
atatatgtatatgtatatat

SEQ ID NO: 1063961 - DNA, 12 bp, Homo sapiens
atatatgtatgt

SEQ ID NO: 1063962 - DNA, 12 bp, Homo sapiens
atatatgtattt

SEQ ID NO: 1063963 - DNA, 17 bp, Homo sapiens
atatatgtcaatattta

SEQ ID NO: 1063964 - DNA, 20 bp, Homo sapiens
atatatgtgtatacatacat

SEQ ID NO: 1063965 - DNA, 23 bp, Homo sapiens
atatatgtgtgtttaaataaagt

SEQ ID NO: 1063966 - DNA, 15 bp, Homo sapiens
atatatgtgtttttc

SEQ ID NO: 1063967 - DNA, 13 bp, Homo sapiens
atatatgttctgc

SEQ ID NO: 1063968 - DNA, 17 bp, Homo sapiens
atatattaaaaatataa

SEQ ID NO: 1063969 - DNA, 16 bp, Homo sapiens
atatattaaaattcca

SEQ ID NO: 1063970 - DNA, 22 bp, Homo sapiens
atatattaatcagcattagaga

SEQ ID NO: 1063971 - DNA, 18 bp, Homo sapiens
atatattactgatttaga

SEQ ID NO: 1063972 - DNA, 14 bp, Homo sapiens
atatattcttataa

SEQ ID NO: 1063973 - DNA, 20 bp, Homo sapiens
atatattgaaagttgctttt

SEQ ID NO: 1063974 - DNA, 21 bp, Homo sapiens
atatattgaaagttgctttta

SEQ ID NO: 1063975 - DNA, 13 bp, Homo sapiens
atatattgaatta

SEQ ID NO: 1063976 - DNA, 16 bp, Homo sapiens
atatattgtacaaatg

SEQ ID NO: 1063977 - DNA, 16 bp, Homo sapiens
atatatttaaaaataa

SEQ ID NO: 1063978 - DNA, 20 bp, Homo sapiens
atatatttaagcaacatctt

SEQ ID NO: 1063979 - DNA, 18 bp, Homo sapiens
atatatttaatatattga

SEQ ID NO: 1063980 - DNA, 19 bp, Homo sapiens
atattgtgattctgccttt

SEQ ID NO: 1063981 - DNA, 12 bp, Homo sapiens
atattgtgccaa

SEQ ID NO: 1063982 - DNA, 21 bp, Homo sapiens
atattgtgccaatatgtattg

SEQ ID NO: 1063983 - DNA, 20 bp, Homo sapiens
atattgtgttgactttataa

SEQ ID NO: 1063984 - DNA, 13 bp, Homo sapiens
atattgtgtttgt

SEQ ID NO: 1063985 - DNA, 17 bp, Homo sapiens
atattgtgtttgtgtat

SEQ ID NO: 1063986 - DNA, 16 bp, Homo sapiens
atattgttataaataa

SEQ ID NO: 1063987 - DNA, 21 bp, Homo sapiens
atattgttgacaactgtgact

SEQ ID NO: 1063988 - DNA, 12 bp, Homo sapiens
atattgtttaaa

SEQ ID NO: 1063989 - DNA, 13 bp, Homo sapiens
atattgtttaaaa

SEQ ID NO: 1063990 - DNA, 16 bp, Homo sapiens
atattgtttaaaattc

SEQ ID NO: 1063991 - DNA, 15 bp, Homo sapiens
atattgtttgctgtt

SEQ ID NO: 1063992 - DNA, 16 bp, Homo sapiens
atattgtttgctgttg

SEQ ID NO: 1063993 - DNA, 13 bp, Homo sapiens
atattgttttcag

SEQ ID NO: 1063994 - DNA, 20 bp, Homo sapiens
atattgttttctcctttctg

SEQ ID NO: 1063995 - DNA, 18 bp, Homo sapiens
atattgttttctgtaaat

SEQ ID NO: 1063996 - DNA, 23 bp, Homo sapiens
atattgttttctgtaaataacct

SEQ ID NO: 1063997 - DNA, 22 bp, Homo sapiens
atatttaaaaaattaaaaatga

SEQ ID NO: 1063998 - DNA, 14 bp, Homo sapiens
atatttaaaaataa

SEQ ID NO: 1063999 - DNA, 14 bp, Homo sapiens
atatttaaaaatgt

SEQ ID NO: 1064000 - DNA, 15 bp, Homo sapiens
atatttaaaaatgtc

SEQ ID NO: 1064001 - DNA, 17 bp, Homo sapiens
atatttaaaaatgtctt

SEQ ID NO: 1064002 - DNA, 18 bp, Homo sapiens
atatttaaaaatgtcttg

SEQ ID NO: 1064003 - DNA, 16 bp, Homo sapiens
atatttaaaaattgtt

SEQ ID NO: 1064004 - DNA, 12 bp, Homo sapiens
atatttaaacag

SEQ ID NO: 1064005 - DNA, 14 bp, Homo sapiens
atatttaaacagca

SEQ ID NO: 1064006 - DNA, 21 bp, Homo sapiens
atatttaaacctttttcttga

SEQ ID NO: 1064007 - DNA, 12 bp, Homo sapiens
atatttaaactc

SEQ ID NO: 1064008 - DNA, 13 bp, Homo sapiens
atatttaactggt

SEQ ID NO: 1064009 - DNA, 16 bp, Homo sapiens
atatttaagaaaatac

SEQ ID NO: 1064010 - DNA, 18 bp, Homo sapiens
atatttaagaaaatacaa

SEQ ID NO: 1064011 - DNA, 20 bp, Homo sapiens
atatttaagaaaatacaata

SEQ ID NO: 1064012 - DNA, 15 bp, Homo sapiens
atcaagagaaacttc

SEQ ID NO: 1064013 - DNA, 12 bp, Homo sapiens
atcaagagaatc

SEQ ID NO: 1064014 - DNA, 13 bp, Homo sapiens
atcaagagactga

SEQ ID NO: 1064015 - DNA, 20 bp, Homo sapiens
atcaagagtccggatttcta

SEQ ID NO: 1064016 - DNA, 18 bp, Homo sapiens
atcaagagttttggagat

SEQ ID NO: 1064017 - DNA, 18 bp, Homo sapiens
atcaagatgtcagactgg

SEQ ID NO: 1064018 - DNA, 19 bp, Homo sapiens
atcaagcacactgtatgtt

SEQ ID NO: 1064019 - DNA, 13 bp, Homo sapiens
atcaagcccttta

SEQ ID NO: 1064020 - DNA, 22 bp, Homo sapiens
atcaagcctttatggctgctgg

SEQ ID NO: 1064021 - DNA, 11 bp, Homo sapiens
atcaagctgtg

SEQ ID NO: 1064022 - DNA, 19 bp, Homo sapiens
atcaagcttgtgtacttga

SEQ ID NO: 1064023 - DNA, 13 bp, Homo sapiens
atcaagcttttct

SEQ ID NO: 1064024 - DNA, 15 bp, Homo sapiens
atcaagcttttctgt

SEQ ID NO: 1064025 - DNA, 16 bp, Homo sapiens
atcaagcttttctgta

SEQ ID NO: 1064026 - DNA, 14 bp, Homo sapiens
atcaaggtccagtg

SEQ ID NO: 1064027 - DNA, 16 bp, Homo sapiens
atcaaggtccagtgga

SEQ ID NO: 1064028 - DNA, 17 bp, Homo sapiens
atcaaggtccagtggaa

SEQ ID NO: 1064029 - DNA, 14 bp, Homo sapiens
atcaaggtgaaata

SEQ ID NO: 1064030 - DNA, 19 bp, Homo sapiens
atcaaggttataatttttt

SEQ ID NO: 1064031 - DNA, 17 bp, Homo sapiens
atcaagtaatacaaact

SEQ ID NO: 1064032 - DNA, 13 bp, Homo sapiens
atcaagtaatgaa

SEQ ID NO: 1064033 - DNA, 15 bp, Homo sapiens
atcaagtacctatat

SEQ ID NO: 1064034 - DNA, 19 bp, Homo sapiens
atcaagtatagaaaatctt

SEQ ID NO: 1064035 - DNA, 12 bp, Homo sapiens
atcaagtattac

SEQ ID NO: 1064036 - DNA, 20 bp, Homo sapiens
atcaagtattactaaattga

SEQ ID NO: 1064037 - DNA, 13 bp, Homo sapiens
atcaagtattata

SEQ ID NO: 1064038 - DNA, 16 bp, Homo sapiens
atcaagtatttgggaa

SEQ ID NO: 1064039 - DNA, 20 bp, Homo sapiens
atcaagtatttgggaagtga

SEQ ID NO: 1064040 - DNA, 20 bp, Homo sapiens
atcaagttgtaacttatatt

SEQ ID NO: 1064041 - DNA, 21 bp, Homo sapiens
atcaagtttgaccagtgcagt

SEQ ID NO: 1064042 - DNA, 16 bp, Homo sapiens
atcaataaaatgtgat

SEQ ID NO: 1064043 - DNA, 18 bp, Homo sapiens
atcaataatatattttct

SEQ ID NO: 1064044 - DNA, 20 bp, Homo sapiens
atcaataatatattttctgt

SEQ ID NO: 1064045 - DNA, 17 bp, Homo sapiens
atcaatacactagttgt

SEQ ID NO: 1064046 - DNA, 18 bp, Homo sapiens
atcaatacagcttcatta

SEQ ID NO: 1064047 - DNA, 14 bp, Homo sapiens
atcaatagttgaat

SEQ ID NO: 1064048 - DNA, 21 bp, Homo sapiens
atcaatatcccaacattctgc

SEQ ID NO: 1064049 - DNA, 15 bp, Homo sapiens
atcaatatctaatat

SEQ ID NO: 1064050 - DNA, 18 bp, Homo sapiens
atcaatatctaatatata

SEQ ID NO: 1064051 - DNA, 13 bp, Homo sapiens
atcaatcaatggt

SEQ ID NO: 1064052 - DNA, 22 bp, Homo sapiens
atcaatcatctgtgtgaaaatg

SEQ ID NO: 1064053 - DNA, 14 bp, Homo sapiens
atcaatcttgttac

SEQ ID NO: 1064054 - DNA, 15 bp, Homo sapiens
atcaatcttgttact

SEQ ID NO: 1064055 - DNA, 22 bp, Homo sapiens
atcaatgcaagagtgattgcag

SEQ ID NO: 1064056 - DNA, 17 bp, Homo sapiens
atcaatgtgtctttcta

SEQ ID NO: 1064057 - DNA, 22 bp, Homo sapiens
atcaatgtgtctttctaagaaa

SEQ ID NO: 1064058 - DNA, 13 bp, Homo sapiens
atcaatgttcatt

SEQ ID NO: 1064059 - DNA, 15 bp, Homo sapiens
atcaatgttcattgt

SEQ ID NO: 1064060 - DNA, 16 bp, Homo sapiens
atcaatgttcattgta

SEQ ID NO: 1064061 - DNA, 21 bp, Homo sapiens
atcaattaacatcgtgggtca

SEQ ID NO: 1064062 - DNA, 17 bp, Homo sapiens
atcaattattacattta

SEQ ID NO: 1064063 - DNA, 16 bp, Homo sapiens
atcaattcatgtttaa

SEQ ID NO: 1064064 - DNA, 18 bp, Homo sapiens
atcaattcttgagaccca

SEQ ID NO: 1064065 - DNA, 19 bp, Homo sapiens
atcaattggcagtgacttt

SEQ ID NO: 1064066 - DNA, 12 bp, Homo sapiens
atcacaaaagaa

SEQ ID NO: 1064067 - DNA, 14 bp, Homo sapiens
atcacaaatggaat

SEQ ID NO: 1064068 - DNA, 16 bp, Homo sapiens
atcacaacaagaaatt

SEQ ID NO: 1064069 - DNA, 17 bp, Homo sapiens
atcacaacactggctga

SEQ ID NO: 1064070 - DNA, 17 bp, Homo sapiens
atcacaaggtcaggagt

SEQ ID NO: 1064071 - DNA, 11 bp, Homo sapiens
atcacacacac

SEQ ID NO: 1064072 - DNA, 13 bp, Homo sapiens
atcacacagtgtt

SEQ ID NO: 1064073 - DNA, 15 bp, Homo sapiens
atcacacagtgttag

SEQ ID NO: 1064074 - DNA, 13 bp, Homo sapiens
atcacacctctgg

SEQ ID NO: 1064075 - DNA, 14 bp, Homo sapiens
atcacacctctggg

SEQ ID NO: 1064076 - DNA, 16 bp, Homo sapiens
atcacacctctgggct

SEQ ID NO: 1064077 - DNA, 21 bp, Homo sapiens
atcacacttatattttatgaa

SEQ ID NO: 1064078 - DNA, 14 bp, Homo sapiens
atcacacttctgtg

SEQ ID NO: 1064079 - DNA, 16 bp, Homo sapiens
atcacagaaaatttaa

SEQ ID NO: 1064080 - DNA, 14 bp, Homo sapiens
atcacagaggcttc

SEQ ID NO: 1064081 - DNA, 15 bp, Homo sapiens
atcacagaggcttct

SEQ ID NO: 1064082 - DNA, 15 bp, Homo sapiens
atcacagcccagccc

SEQ ID NO: 1064083 - DNA, 16 bp, Homo sapiens
atcacagcccagcccg

SEQ ID NO: 1064084 - DNA, 13 bp, Homo sapiens
atcacagcctcca

SEQ ID NO: 1064085 - DNA, 13 bp, Homo sapiens
atcacagcctctg

SEQ ID NO: 1064086 - DNA, 18 bp, Homo sapiens
atcacagcgtttcaggaa

SEQ ID NO: 1064087 - DNA, 21 bp, Homo sapiens
atcacagctcactgcagcctc

SEQ ID NO: 1064088 - DNA, 16 bp, Homo sapiens
atcacagctgctttct

SEQ ID NO: 1064089 - DNA, 18 bp, Homo sapiens
atcacaggggcggggcag

SEQ ID NO: 1064090 - DNA, 23 bp, Homo sapiens
atcacagggttgggcccagatct

SEQ ID NO: 1064091 - DNA, 17 bp, Homo sapiens
atcacagtctcagttct

SEQ ID NO: 1064092 - DNA, 23 bp, Homo sapiens
atcacagtgttatgtagtattgt

SEQ ID NO: 1064093 - DNA, 20 bp, Homo sapiens
atcacagtgtttttattgct

SEQ ID NO: 1064094 - DNA, 20 bp, Homo sapiens
atcacataattccagtcaca

SEQ ID NO: 1064095 - DNA, 22 bp, Homo sapiens
atcacatgaattattacagtgt

SEQ ID NO: 1064096 - DNA, 13 bp, Homo sapiens
atcacatgtgaaa

SEQ ID NO: 1064097 - DNA, 14 bp, Homo sapiens
atcacatgtgaaaa

SEQ ID NO: 1064098 - DNA, 15 bp, Homo sapiens
atcacatgtgctgca

SEQ ID NO: 1064099 - DNA, 21 bp, Homo sapiens
atcacattaatctcaaagaga

SEQ ID NO: 1064100 - DNA, 19 bp, Homo sapiens
atcacattaggggaaccat

SEQ ID NO: 1064101 - DNA, 16 bp, Homo sapiens
atcacattatttgcat

SEQ ID NO: 1064102 - DNA, 14 bp, Homo sapiens
atcacatttctatg

SEQ ID NO: 1064103 - DNA, 21 bp, Homo sapiens
atcacatttttttatgctctt

SEQ ID NO: 1064104 - DNA, 21 bp, Homo sapiens
atcaccaccgcctctggccgc

SEQ ID NO: 1064105 - DNA, 22 bp, Homo sapiens
atcaccagtcctagctcttaca

SEQ ID NO: 1064106 - DNA, 17 bp, Homo sapiens
atcaccagtctgtaaaa

SEQ ID NO: 1064107 - DNA, 16 bp, Homo sapiens
atcaccatagttttgt

SEQ ID NO: 1064108 - DNA, 21 bp, Homo sapiens
atcaccatgggaggtggggcc

SEQ ID NO: 1064109 - DNA, 14 bp, Homo sapiens
atcacccactccta

SEQ ID NO: 1064110 - DNA, 20 bp, Homo sapiens
atcaccgacgcgtctcctgt

SEQ ID NO: 1064111 - DNA, 18 bp, Homo sapiens
atcaccgctgggtggttt

SEQ ID NO: 1064112 - DNA, 17 bp, Homo sapiens
atcaccgtcccgcacag

SEQ ID NO: 1064113 - DNA, 19 bp, Homo sapiens
atcaccgtgggctccctga

SEQ ID NO: 1064114 - DNA, 16 bp, Homo sapiens
atcacctaagcacttc

SEQ ID NO: 1064115 - DNA, 22 bp, Homo sapiens
atcacctaagcacttctagaat

SEQ ID NO: 1064116 - DNA, 14 bp, Homo sapiens
atcacctatttcca

SEQ ID NO: 1064117 - DNA, 15 bp, Homo sapiens
atcacctctcttcag

SEQ ID NO: 1064118 - DNA, 14 bp, Homo sapiens
atcacctctttgcc

SEQ ID NO: 1064119 - DNA, 15 bp, Homo sapiens
atcacctgaaacact

SEQ ID NO: 1064120 - DNA, 17 bp, Homo sapiens
atcacctgaaacactgg

SEQ ID NO: 1064121 - DNA, 20 bp, Homo sapiens
atcacctgaaacactggacc

SEQ ID NO: 1064122 - DNA, 17 bp, Homo sapiens
atcaccttcctgaattc

SEQ ID NO: 1064123 - DNA, 15 bp, Homo sapiens
atcatgaagccttgc

SEQ ID NO: 1064124 - DNA, 18 bp, Homo sapiens
atcatgaatgcttttagt

SEQ ID NO: 1064125 - DNA, 15 bp, Homo sapiens
atcatgaattttaaa

SEQ ID NO: 1064126 - DNA, 18 bp, Homo sapiens
atcatgaattttaaagta

SEQ ID NO: 1064127 - DNA, 13 bp, Homo sapiens
atcatgagcctgc

SEQ ID NO: 1064128 - DNA, 16 bp, Homo sapiens
atcatgagcctgctgg

SEQ ID NO: 1064129 - DNA, 23 bp, Homo sapiens
atcatgagtgaataaatgtcttg

SEQ ID NO: 1064130 - DNA, 14 bp, Homo sapiens
atcatgatagactt

SEQ ID NO: 1064131 - DNA, 12 bp, Homo sapiens
atcatgcaaaat

SEQ ID NO: 1064132 - DNA, 19 bp, Homo sapiens
atcatgcaaatgctgtatt

SEQ ID NO: 1064133 - DNA, 22 bp, Homo sapiens
atcatgcatcttactgaaggta

SEQ ID NO: 1064134 - DNA, 21 bp, Homo sapiens
atcatgcatgtcctgtaaagg

SEQ ID NO: 1064135 - DNA, 22 bp, Homo sapiens
atcatgcattgttgaggtggtc

SEQ ID NO: 1064136 - DNA, 15 bp, Homo sapiens
atcatgctcatgtat

SEQ ID NO: 1064137 - DNA, 14 bp, Homo sapiens
atcatgctgttgca

SEQ ID NO: 1064138 - DNA, 17 bp, Homo sapiens
atcatggaaatgtattt

SEQ ID NO: 1064139 - DNA, 19 bp, Homo sapiens
atcatggaggtttgaagat

SEQ ID NO: 1064140 - DNA, 21 bp, Homo sapiens
atcatggtaatgacagatgca

SEQ ID NO: 1064141 - DNA, 13 bp, Homo sapiens
atcatgtactttg

SEQ ID NO: 1064142 - DNA, 17 bp, Homo sapiens
atcatgtactttttagt

SEQ ID NO: 1064143 - DNA, 16 bp, Homo sapiens
atcatgtcagtctgct

SEQ ID NO: 1064144 - DNA, 17 bp, Homo sapiens
atcatgtcgtaggtaaa

SEQ ID NO: 1064145 - DNA, 17 bp, Homo sapiens
atcatgtctattgtcca

SEQ ID NO: 1064146 - DNA, 16 bp, Homo sapiens
atcatgtctgtatact

SEQ ID NO: 1064147 - DNA, 21 bp, Homo sapiens
atcatgtgaacccgggacgca

SEQ ID NO: 1064148 - DNA, 18 bp, Homo sapiens
atcatgtgctcagaagag

SEQ ID NO: 1064149 - DNA, 20 bp, Homo sapiens
atcatgttaaattagaatga

SEQ ID NO: 1064150 - DNA, 16 bp, Homo sapiens
atcatgttgatcatgt

SEQ ID NO: 1064151 - DNA, 12 bp, Homo sapiens
atcatgtttgct

SEQ ID NO: 1064152 - DNA, 13 bp, Homo sapiens
atcatgtttgctc

SEQ ID NO: 1064153 - DNA, 23 bp, Homo sapiens
atcatgttttgatgagaaaaaac

SEQ ID NO: 1064154 - DNA, 14 bp, Homo sapiens
atcattaaaatata

SEQ ID NO: 1064155 - DNA, 15 bp, Homo sapiens
atcattaagacaact

SEQ ID NO: 1064156 - DNA, 22 bp, Homo sapiens
atcattacccttccctgcacta

SEQ ID NO: 1064157 - DNA, 12 bp, Homo sapiens
atcattactgtt

SEQ ID NO: 1064158 - DNA, 12 bp, Homo sapiens
atcattcaagtg

SEQ ID NO: 1064159 - DNA, 18 bp, Homo sapiens
atcattccaattctaaat

SEQ ID NO: 1064160 - DNA, 22 bp, Homo sapiens
atcattccaattctaaatccga

SEQ ID NO: 1064161 - DNA, 16 bp, Homo sapiens
atcattccttctggcc

SEQ ID NO: 1064162 - DNA, 18 bp, Homo sapiens
atcattctacagaataat

SEQ ID NO: 1064163 - DNA, 14 bp, Homo sapiens
atcattctctgtct

SEQ ID NO: 1064164 - DNA, 16 bp, Homo sapiens
atcattctctgtctca

SEQ ID NO: 1064165 - DNA, 12 bp, Homo sapiens
atcattctgtgt

SEQ ID NO: 1064166 - DNA, 14 bp, Homo sapiens
atcattcttactaa

SEQ ID NO: 1064167 - DNA, 19 bp, Homo sapiens
atcattgaagtatattctt

SEQ ID NO: 1064168 - DNA, 22 bp, Homo sapiens
atcattgcactctagcctgggc

SEQ ID NO: 1064169 - DNA, 16 bp, Homo sapiens
atcattgctcccctga

SEQ ID NO: 1064170 - DNA, 23 bp, Homo sapiens
atcattgctcccctgatagaaga

SEQ ID NO: 1064171 - DNA, 14 bp, Homo sapiens
atcattgcttatgt

SEQ ID NO: 1064172 - DNA, 20 bp, Homo sapiens
atcattggaacaactgatac

SEQ ID NO: 1064173 - DNA, 13 bp, Homo sapiens
atcattgtagaaa

SEQ ID NO: 1064174 - DNA, 18 bp, Homo sapiens
atcattgtatatatgtgt

SEQ ID NO: 1064175 - DNA, 16 bp, Homo sapiens
atcattgttataaaga

SEQ ID NO: 1064176 - DNA, 15 bp, Homo sapiens
atcatttattcattg

SEQ ID NO: 1064177 - DNA, 14 bp, Homo sapiens
atcatttatttcat

SEQ ID NO: 1064178 - DNA, 15 bp, Homo sapiens
atcatttcactgtct

SEQ ID NO: 1064179 - DNA, 12 bp, Homo sapiens
atcatttcagcc

SEQ ID NO: 1064180 - DNA, 15 bp, Homo sapiens
atcatttcagccaaa

SEQ ID NO: 1064181 - DNA, 19 bp, Homo sapiens
atcatttcctgggagaaag

SEQ ID NO: 1064182 - DNA, 14 bp, Homo sapiens
atcatttctgccat

SEQ ID NO: 1064183 - DNA, 15 bp, Homo sapiens
atcatttctttagag

SEQ ID NO: 1064184 - DNA, 17 bp, Homo sapiens
atcatttgaacaactag

SEQ ID NO: 1064185 - DNA, 14 bp, Homo sapiens
atcatttgtgaaga

SEQ ID NO: 1064186 - DNA, 16 bp, Homo sapiens
atcatttgtgaagaat

SEQ ID NO: 1064187 - DNA, 19 bp, Homo sapiens
atcatttgttcaaagctgt

SEQ ID NO: 1064188 - DNA, 15 bp, Homo sapiens
atcatttgtttaaaa

SEQ ID NO: 1064189 - DNA, 18 bp, Homo sapiens
atcatttgtttaaaaagg

SEQ ID NO: 1064190 - DNA, 17 bp, Homo sapiens
atcattttaaaaacttt

SEQ ID NO: 1064191 - DNA, 17 bp, Homo sapiens
atcattttaaattccac

SEQ ID NO: 1064192 - DNA, 12 bp, Homo sapiens
atcattttaaga

SEQ ID NO: 1064193 - DNA, 22 bp, Homo sapiens
atcattttaagaagacatgaca

SEQ ID NO: 1064194 - DNA, 17 bp, Homo sapiens
atcattttatatgtcaa

SEQ ID NO: 1064195 - DNA, 11 bp, Homo sapiens
atcattttcat

SEQ ID NO: 1064196 - DNA, 13 bp, Homo sapiens
atcattttccccc

SEQ ID NO: 1064197 - DNA, 15 bp, Homo sapiens
atcattttcccccca

SEQ ID NO: 1064198 - DNA, 22 bp, Homo sapiens
atcattttcttatcttctgcaa

SEQ ID NO: 1064199 - DNA, 13 bp, Homo sapiens
atcatttttcact

SEQ ID NO: 1064200 - DNA, 18 bp, Homo sapiens
atcatttttgtataaaaa

SEQ ID NO: 1064201 - DNA, 20 bp, Homo sapiens
atccaaaaaaagggaaggat

SEQ ID NO: 1064202 - DNA, 18 bp, Homo sapiens
atccaaaaagctctgaaa

SEQ ID NO: 1064203 - DNA, 13 bp, Homo sapiens
atccaaaagacaa

SEQ ID NO: 1064204 - DNA, 19 bp, Homo sapiens
atccaaaatgtgtatttct

SEQ ID NO: 1064205 - DNA, 22 bp, Homo sapiens
atccaaagaacttgatttgcat

SEQ ID NO: 1064206 - DNA, 14 bp, Homo sapiens
atccaaagactgta

SEQ ID NO: 1064207 - DNA, 12 bp, Homo sapiens
atccaaatctag

SEQ ID NO: 1064208 - DNA, 16 bp, Homo sapiens
atccaaatctgtcctc

SEQ ID NO: 1064209 - DNA, 22 bp, Homo sapiens
atccaaatctgtcctctgtagt

SEQ ID NO: 1064210 - DNA, 22 bp, Homo sapiens
atccaaatttttttttaaagca

SEQ ID NO: 1064211 - DNA, 14 bp, Homo sapiens
atccaacaagaaga

SEQ ID NO: 1064212 - DNA, 18 bp, Homo sapiens
atccaaccccccacctgc

SEQ ID NO: 1064213 - DNA, 20 bp, Homo sapiens
atccaaccccccacctgcca

SEQ ID NO: 1064214 - DNA, 14 bp, Homo sapiens
atccaactccagga

SEQ ID NO: 1064215 - DNA, 22 bp, Homo sapiens
atccaagacagaataatgaatg

SEQ ID NO: 1064216 - DNA, 19 bp, Homo sapiens
atccaagatattttaaaat

SEQ ID NO: 1064217 - DNA, 15 bp, Homo sapiens
atccaagcctccaca

SEQ ID NO: 1064218 - DNA, 16 bp, Homo sapiens
atccaagcctccacag

SEQ ID NO: 1064219 - DNA, 17 bp, Homo sapiens
atccaagcctccacagc

SEQ ID NO: 1064220 - DNA, 18 bp, Homo sapiens
atccaagcctccacagcg

SEQ ID NO: 1064221 - DNA, 21 bp, Homo sapiens
atccaagcctccacagcgagg

SEQ ID NO: 1064222 - DNA, 18 bp, Homo sapiens
atccaagctccctgcccc

SEQ ID NO: 1064223 - DNA, 20 bp, Homo sapiens
atccaaggaaacatgcagct

SEQ ID NO: 1064224 - DNA, 18 bp, Homo sapiens
atccaaggaaacatttta

SEQ ID NO: 1064225 - DNA, 13 bp, Homo sapiens
atccaaggagaaa

SEQ ID NO: 1064226 - DNA, 19 bp, Homo sapiens
atccaaggagaaacagaga

SEQ ID NO: 1064227 - DNA, 15 bp, Homo sapiens
atccaaggccgcggc

SEQ ID NO: 1064228 - DNA, 21 bp, Homo sapiens
atccaaggccgcggcccagac

SEQ ID NO: 1064229 - DNA, 14 bp, Homo sapiens
atccaagtaccaat

SEQ ID NO: 1064230 - DNA, 20 bp, Homo sapiens
atccaagtaccaatgctgtt

SEQ ID NO: 1064231 - DNA, 23 bp, Homo sapiens
atccaagtaccaatgctgttgta

SEQ ID NO: 1064232 - DNA, 12 bp, Homo sapiens
atccaagtgaac

SEQ ID NO: 1064233 - DNA, 15 bp, Homo sapiens
atccaataatcagaa

SEQ ID NO: 1064234 - DNA, 21 bp, Homo sapiens
atccaatatcatgtcttgtgc

SEQ ID NO: 1064235 - DNA, 15 bp, Homo sapiens
atccaatatgactca

SEQ ID NO: 1064236 - DNA, 19 bp, Homo sapiens
atccaatatgactcagaga

SEQ ID NO: 1064237 - DNA, 12 bp, Homo sapiens
atccaatattgt

SEQ ID NO: 1064238 - DNA, 19 bp, Homo sapiens
atccaatattttctttaat

SEQ ID NO: 1064239 - DNA, 24 bp, Homo sapiens
atccaatattttctttaatgcttt

SEQ ID NO: 1064240 - DNA, 17 bp, Homo sapiens
atccaatcctcactggg

SEQ ID NO: 1064241 - DNA, 14 bp, Homo sapiens
atccaccacctccc

SEQ ID NO: 1064242 - DNA, 20 bp, Homo sapiens
atccacccaaccctatctcc

SEQ ID NO: 1064243 - DNA, 20 bp, Homo sapiens
atccacccacctcggcctcc

SEQ ID NO: 1064244 - DNA, 18 bp, Homo sapiens
atccacccagcaggcaga

SEQ ID NO: 1064245 - DNA, 13 bp, Homo sapiens
atccacccagccc

SEQ ID NO: 1064246 - DNA, 15 bp, Homo sapiens
atccacccagcccat

SEQ ID NO: 1064247 - DNA, 16 bp, Homo sapiens
atccacccagtgctgc

SEQ ID NO: 1064248 - DNA, 19 bp, Homo sapiens
atccacccagtgctgccat

SEQ ID NO: 1064249 - DNA, 22 bp, Homo sapiens
atccacccccaggtgcagcccc

SEQ ID NO: 1064250 - DNA, 19 bp, Homo sapiens
atccacccgctgcccctcc

SEQ ID NO: 1064251 - DNA, 22 bp, Homo sapiens
atccacccgctgcccctccccg

SEQ ID NO: 1064252 - DNA, 21 bp, Homo sapiens
atccacccgggggagcccagt

SEQ ID NO: 1064253 - DNA, 18 bp, Homo sapiens
atccaccctcaaatgtca

SEQ ID NO: 1064254 - DNA, 22 bp, Homo sapiens
atccaccctcatttttccttta

SEQ ID NO: 1064255 - DNA, 17 bp, Homo sapiens
atccaccgccagcttcc

SEQ ID NO: 1064256 - DNA, 19 bp, Homo sapiens
atccacctcatcactggac

SEQ ID NO: 1064257 - DNA, 16 bp, Homo sapiens
atccacctccctacca

SEQ ID NO: 1064258 - DNA, 21 bp, Homo sapiens
atccacctgtctcagcctccc

SEQ ID NO: 1064259 - DNA, 14 bp, Homo sapiens
atccacgtggcctc

SEQ ID NO: 1064260 - DNA, 21 bp, Homo sapiens
atccactagtgcaaatcatag

SEQ ID NO: 1064261 - DNA, 19 bp, Homo sapiens
atccactctaccctcccac

SEQ ID NO: 1064262 - DNA, 18 bp, Homo sapiens
atccactctgcaggaaat

SEQ ID NO: 1064263 - DNA, 23 bp, Homo sapiens
atccacttcttggttcctgggat

SEQ ID NO: 1064264 - DNA, 14 bp, Homo sapiens
atccagaaagaaaa

SEQ ID NO: 1064265 - DNA, 15 bp, Homo sapiens
atccagaaagaaaaa

SEQ ID NO: 1064266 - DNA, 13 bp, Homo sapiens
atccagaagtttt

SEQ ID NO: 1064267 - DNA, 22 bp, Homo sapiens
atccagaagttttaacttccag

SEQ ID NO: 1064268 - DNA, 22 bp, Homo sapiens
atccagacagtcgctcagtctg

SEQ ID NO: 1064269 - DNA, 20 bp, Homo sapiens
atccagactgtaagatgttg

SEQ ID NO: 1064270 - DNA, 17 bp, Homo sapiens
atccagagattcatttt

SEQ ID NO: 1064271 - DNA, 11 bp, Homo sapiens
atccagagcag

SEQ ID NO: 1064272 - DNA, 22 bp, Homo sapiens
atccagaggaacaagcatgtct

SEQ ID NO: 1064273 - DNA, 14 bp, Homo sapiens
atccagatgtggct

SEQ ID NO: 1064274 - DNA, 23 bp, Homo sapiens
atccagatgtggctactgacata

SEQ ID NO: 1064275 - DNA, 12 bp, Homo sapiens
atccagccacgg

SEQ ID NO: 1064276 - DNA, 21 bp, Homo sapiens
atccagccacggagggaggca

SEQ ID NO: 1064277 - DNA, 11 bp, Homo sapiens
atccagccctg

SEQ ID NO: 1064278 - DNA, 21 bp, Homo sapiens
atccagcctggggctgaggct

SEQ ID NO: 1064279 - DNA, 20 bp, Homo sapiens
atccagcctgtgtgttctgt

SEQ ID NO: 1064280 - DNA, 15 bp, Homo sapiens
atccagctaccacca

SEQ ID NO: 1064281 - DNA, 18 bp, Homo sapiens
atccagctagtgccaaat

SEQ ID NO: 1064282 - DNA, 15 bp, Homo sapiens
atccagctccctaga

SEQ ID NO: 1064283 - DNA, 17 bp, Homo sapiens
atccagctccctagact

SEQ ID NO: 1064284 - DNA, 13 bp, Homo sapiens
atccagctcctct

SEQ ID NO: 1064285 - DNA, 17 bp, Homo sapiens
atccagctcctctaggg

SEQ ID NO: 1064286 - DNA, 15 bp, Homo sapiens
atccagctgcccctc

SEQ ID NO: 1064287 - DNA, 20 bp, Homo sapiens
atccaggagataattgtttc

SEQ ID NO: 1064288 - DNA, 17 bp, Homo sapiens
atccaggcacagctgag

SEQ ID NO: 1064289 - DNA, 18 bp, Homo sapiens
atccagggatggagatgg

SEQ ID NO: 1064290 - DNA, 13 bp, Homo sapiens
atccagggtctgg

SEQ ID NO: 1064291 - DNA, 16 bp, Homo sapiens
atccagggtctggcag

SEQ ID NO: 1064292 - DNA, 17 bp, Homo sapiens
atccagggtctggcaga

SEQ ID NO: 1064293 - DNA, 22 bp, Homo sapiens
atccagggtctggcagagcctc

SEQ ID NO: 1064294 - DNA, 23 bp, Homo sapiens
atccagggtctggcagagcctct

SEQ ID NO: 1064295 - DNA, 14 bp, Homo sapiens
atccaggtaatcca

SEQ ID NO: 1064296 - DNA, 16 bp, Homo sapiens
atccagtaggatccag

SEQ ID NO: 1064297 - DNA, 18 bp, Homo sapiens
atccagtctatcattgtt

SEQ ID NO: 1064298 - DNA, 21 bp, Homo sapiens
atccagtgacatgattctgaa

SEQ ID NO: 1064299 - DNA, 19 bp, Homo sapiens
atccagtgacttgttctga

SEQ ID NO: 1064300 - DNA, 20 bp, Homo sapiens
atccagtgacttgttctgag

SEQ ID NO: 1064301 - DNA, 16 bp, Homo sapiens
atccagtgatccttac

SEQ ID NO: 1064302 - DNA, 13 bp, Homo sapiens
atccagtgtataa

SEQ ID NO: 1064303 - DNA, 13 bp, Homo sapiens
atccagttcctgc

SEQ ID NO: 1064304 - DNA, 21 bp, Homo sapiens
atccagttcctgctctctgct

SEQ ID NO: 1064305 - DNA, 14 bp, Homo sapiens
atccagtttctttc

SEQ ID NO: 1064306 - DNA, 16 bp, Homo sapiens
atccagtttctttccc

SEQ ID NO: 1064307 - DNA, 20 bp, Homo sapiens
atccagtttgtgtttttcta

SEQ ID NO: 1064308 - DNA, 20 bp, Homo sapiens
atccagtttgttctccgggt

SEQ ID NO: 1064309 - DNA, 13 bp, Homo sapiens
atccataaagaag

SEQ ID NO: 1064310 - DNA, 17 bp, Homo sapiens
atccataaatgtgttcc

SEQ ID NO: 1064311 - DNA, 23 bp, Homo sapiens
atccataggactaccgcaggccc

SEQ ID NO: 1064312 - DNA, 22 bp, Homo sapiens
atccataggtttctctccctcc

SEQ ID NO: 1064313 - DNA, 22 bp, Homo sapiens
atccatcaactaaaacattata

SEQ ID NO: 1064314 - DNA, 20 bp, Homo sapiens
atccatcaatacctgtacta

SEQ ID NO: 1064315 - DNA, 14 bp, Homo sapiens
atccatccatctcc

SEQ ID NO: 1064316 - DNA, 21 bp, Homo sapiens
atccatcctgcaaaggccctt

SEQ ID NO: 1064317 - DNA, 14 bp, Homo sapiens
atccatcttgagcc

SEQ ID NO: 1064318 - DNA, 13 bp, Homo sapiens
atccatgccctcc

SEQ ID NO: 1064319 - DNA, 14 bp, Homo sapiens
atccatgccctccc

SEQ ID NO: 1064320 - DNA, 14 bp, Homo sapiens
atccatgtactgta

SEQ ID NO: 1064321 - DNA, 20 bp, Homo sapiens
atccatgtactgtagttttt

SEQ ID NO: 1064322 - DNA, 22 bp, Homo sapiens
atccatgtgattaatgttttca

SEQ ID NO: 1064323 - DNA, 18 bp, Homo sapiens
atccatgttagtttttac

SEQ ID NO: 1064324 - DNA, 15 bp, Homo sapiens
atccattaatttaaa

SEQ ID NO: 1064325 - DNA, 17 bp, Homo sapiens
atccattacgtgcattt

SEQ ID NO: 1064326 - DNA, 18 bp, Homo sapiens
atccattacgtgcattta

SEQ ID NO: 1064327 - DNA, 20 bp, Homo sapiens
atccattacgtgcatttaaa

SEQ ID NO: 1064328 - DNA, 15 bp, Homo sapiens
atccattaggccagc

SEQ ID NO: 1064329 - DNA, 19 bp, Homo sapiens
atccattaggccagcaacg

SEQ ID NO: 1064330 - DNA, 16 bp, Homo sapiens
atccattcacaagcct

SEQ ID NO: 1064331 - DNA, 19 bp, Homo sapiens
atccattcacaagcctcct

SEQ ID NO: 1064332 - DNA, 22 bp, Homo sapiens
atccatttagcactatttaaaa

SEQ ID NO: 1064333 - DNA, 20 bp, Homo sapiens
atccatttcatctatttctg

SEQ ID NO: 1064334 - DNA, 21 bp, Homo sapiens
atccatttcatctatttctga

SEQ ID NO: 1064335 - DNA, 13 bp, Homo sapiens
atccatttcccct

SEQ ID NO: 1064336 - DNA, 18 bp, Homo sapiens
atccatttcccctccttc

SEQ ID NO: 1064337 - DNA, 14 bp, Homo sapiens
atccatttctttta

SEQ ID NO: 1064338 - DNA, 18 bp, Homo sapiens
atccatttgaacacatta

SEQ ID NO: 1064339 - DNA, 22 bp, Homo sapiens
atccatttgttttcacactgat

SEQ ID NO: 1064340 - DNA, 19 bp, Homo sapiens
atccattttacacagcacc

SEQ ID NO: 1064341 - DNA, 16 bp, Homo sapiens
atcccaaaccattact

SEQ ID NO: 1064342 - DNA, 21 bp, Homo sapiens
atcccaaaccattactgaggg

SEQ ID NO: 1064343 - DNA, 16 bp, Homo sapiens
atcccaaacttcggaa

SEQ ID NO: 1064344 - DNA, 19 bp, Homo sapiens
atcccaacctctttttcct

SEQ ID NO: 1064345 - DNA, 18 bp, Homo sapiens
atctagttttttttgtaa

SEQ ID NO: 1064346 - DNA, 15 bp, Homo sapiens
atctataaactataa

SEQ ID NO: 1064347 - DNA, 13 bp, Homo sapiens
atctataaagaag

SEQ ID NO: 1064348 - DNA, 16 bp, Homo sapiens
atctataaagaagaac

SEQ ID NO: 1064349 - DNA, 23 bp, Homo sapiens
atctataagtagtaaatcagaaa

SEQ ID NO: 1064350 - DNA, 23 bp, Homo sapiens
atctataatttacctaagattac

SEQ ID NO: 1064351 - DNA, 21 bp, Homo sapiens
atctatagttcactgacacag

SEQ ID NO: 1064352 - DNA, 17 bp, Homo sapiens
atctatataaaataact

SEQ ID NO: 1064353 - DNA, 14 bp, Homo sapiens
atctatatatgtat

SEQ ID NO: 1064354 - DNA, 16 bp, Homo sapiens
atctatatatgtatct

SEQ ID NO: 1064355 - DNA, 16 bp, Homo sapiens
atctatatatgtgtat

SEQ ID NO: 1064356 - DNA, 12 bp, Homo sapiens
atctatattaga

SEQ ID NO: 1064357 - DNA, 15 bp, Homo sapiens
atctatatttaacaa

SEQ ID NO: 1064358 - DNA, 18 bp, Homo sapiens
atctatatttgtcttccg

SEQ ID NO: 1064359 - DNA, 19 bp, Homo sapiens
atctatatttttgtactga

SEQ ID NO: 1064360 - DNA, 17 bp, Homo sapiens
atctatcgagtttgcaa

SEQ ID NO: 1064361 - DNA, 14 bp, Homo sapiens
atctatctatttga

SEQ ID NO: 1064362 - DNA, 15 bp, Homo sapiens
atctatctatttgag

SEQ ID NO: 1064363 - DNA, 16 bp, Homo sapiens
atctatctggtgattt

SEQ ID NO: 1064364 - DNA, 19 bp, Homo sapiens
atctatctggtgatttcta

SEQ ID NO: 1064365 - DNA, 23 bp, Homo sapiens
atctatctggtgatttctagctc

SEQ ID NO: 1064366 - DNA, 21 bp, Homo sapiens
atctatgcaaagcactctctg

SEQ ID NO: 1064367 - DNA, 22 bp, Homo sapiens
atctatgcaaagcactctctgc

SEQ ID NO: 1064368 - DNA, 23 bp, Homo sapiens
atctatgcagcatggggttttta

SEQ ID NO: 1064369 - DNA, 16 bp, Homo sapiens
atctatgcctttcaac

SEQ ID NO: 1064370 - DNA, 17 bp, Homo sapiens
atctatggaaatgtgag

SEQ ID NO: 1064371 - DNA, 18 bp, Homo sapiens
atctatggaaatgtgaga

SEQ ID NO: 1064372 - DNA, 20 bp, Homo sapiens
atctatggccctgcaaaaat

SEQ ID NO: 1064373 - DNA, 17 bp, Homo sapiens
atctatggtcgggagac

SEQ ID NO: 1064374 - DNA, 17 bp, Homo sapiens
atctatgtgtttctgta

SEQ ID NO: 1064375 - DNA, 18 bp, Homo sapiens
atctatgtgtttctgtaa

SEQ ID NO: 1064376 - DNA, 20 bp, Homo sapiens
atctatgtgtttctgtaaca

SEQ ID NO: 1064377 - DNA, 21 bp, Homo sapiens
atctatgtttgtgtgatttcc

SEQ ID NO: 1064378 - DNA, 15 bp, Homo sapiens
atctattaaagtgac

SEQ ID NO: 1064379 - DNA, 22 bp, Homo sapiens
atctattcctgtaaataagagt

SEQ ID NO: 1064380 - DNA, 19 bp, Homo sapiens
atctattgcagagactcat

SEQ ID NO: 1064381 - DNA, 23 bp, Homo sapiens
atctattgcagagactcatttca

SEQ ID NO: 1064382 - DNA, 20 bp, Homo sapiens
atctattggctgatctatgc

SEQ ID NO: 1064383 - DNA, 17 bp, Homo sapiens
atctattgggttcatta

SEQ ID NO: 1064384 - DNA, 19 bp, Homo sapiens
atctattgggttcattatt

SEQ ID NO: 1064385 - DNA, 22 bp, Homo sapiens
atctattgggttcattattgga

SEQ ID NO: 1064386 - DNA, 14 bp, Homo sapiens
atctatttctgaga

SEQ ID NO: 1064387 - DNA, 15 bp, Homo sapiens
atctatttctgagaa

SEQ ID NO: 1064388 - DNA, 16 bp, Homo sapiens
atctatttgagattga

SEQ ID NO: 1064389 - DNA, 13 bp, Homo sapiens
atctatttgtaca

SEQ ID NO: 1064390 - DNA, 14 bp, Homo sapiens
atctatttgtacaa

SEQ ID NO: 1064391 - DNA, 16 bp, Homo sapiens
atctatttgtacaatt

SEQ ID NO: 1064392 - DNA, 14 bp, Homo sapiens
atctcaaaaaataa

SEQ ID NO: 1064393 - DNA, 17 bp, Homo sapiens
atctcaaaggagaaaaa

SEQ ID NO: 1064394 - DNA, 14 bp, Homo sapiens
atctcaaataacta

SEQ ID NO: 1064395 - DNA, 23 bp, Homo sapiens
atctcaaataggctattaaaaaa

SEQ ID NO: 1064396 - DNA, 22 bp, Homo sapiens
atctcctcctatttatgaaaac

SEQ ID NO: 1064397 - DNA, 16 bp, Homo sapiens
atctcctctgctcatt

SEQ ID NO: 1064398 - DNA, 15 bp, Homo sapiens
atctcctgacagaag

SEQ ID NO: 1064399 - DNA, 17 bp, Homo sapiens
atctcctgacagaaggt

SEQ ID NO: 1064400 - DNA, 13 bp, Homo sapiens
atctcctgaccct

SEQ ID NO: 1064401 - DNA, 22 bp, Homo sapiens
atctcctgaccctcccactccc

SEQ ID NO: 1064402 - DNA, 12 bp, Homo sapiens
atctcctgctct

SEQ ID NO: 1064403 - DNA, 17 bp, Homo sapiens
atctcctgctgcctttt

SEQ ID NO: 1064404 - DNA, 13 bp, Homo sapiens
atctcctggtgtt

SEQ ID NO: 1064405 - DNA, 13 bp, Homo sapiens
atctcctgtattc

SEQ ID NO: 1064406 - DNA, 19 bp, Homo sapiens
atctcctgtgcatgggtga

SEQ ID NO: 1064407 - DNA, 16 bp, Homo sapiens
atctccttacctctgg

SEQ ID NO: 1064408 - DNA, 18 bp, Homo sapiens
atctccttacctctggaa

SEQ ID NO: 1064409 - DNA, 22 bp, Homo sapiens
atctccttttgcgcttatttgg

SEQ ID NO: 1064410 - DNA, 17 bp, Homo sapiens
atctcgagccccctgga

SEQ ID NO: 1064411 - DNA, 22 bp, Homo sapiens
atctcgattaataacctgccag

SEQ ID NO: 1064412 - DNA, 19 bp, Homo sapiens
atctcggctcactgcaacc

SEQ ID NO: 1064413 - DNA, 14 bp, Homo sapiens
atctcgtgggagag

SEQ ID NO: 1064414 - DNA, 15 bp, Homo sapiens
atctcgtgggagagc

SEQ ID NO: 1064415 - DNA, 22 bp, Homo sapiens
atctcgtttttcttcttaagac

SEQ ID NO: 1064416 - DNA, 23 bp, Homo sapiens
atctcgtttttcttcttaagact

SEQ ID NO: 1064417 - DNA, 21 bp, Homo sapiens
atctctaatgagctagtgtct

SEQ ID NO: 1064418 - DNA, 20 bp, Homo sapiens
atctctacaaaaataaagaa

SEQ ID NO: 1064419 - DNA, 21 bp, Homo sapiens
atctctagtgtagctgccaca

SEQ ID NO: 1064420 - DNA, 17 bp, Homo sapiens
atctctataacagatcc

SEQ ID NO: 1064421 - DNA, 22 bp, Homo sapiens
atctctcaggagcacaggcagc

SEQ ID NO: 1064422 - DNA, 20 bp, Homo sapiens
atctctccacggtagcactt

SEQ ID NO: 1064423 - DNA, 22 bp, Homo sapiens
atctctccagctaattcaggtc

SEQ ID NO: 1064424 - DNA, 16 bp, Homo sapiens
atctctcccacttcct

SEQ ID NO: 1064425 - DNA, 14 bp, Homo sapiens
atctctccctcccc

SEQ ID NO: 1064426 - DNA, 23 bp, Homo sapiens
atctctccctcccctgccatttt

SEQ ID NO: 1064427 - DNA, 19 bp, Homo sapiens
atctctcggttccacgtcc

SEQ ID NO: 1064428 - DNA, 16 bp, Homo sapiens
atctctctacctccac

SEQ ID NO: 1064429 - DNA, 14 bp, Homo sapiens
atctctctgcagct

SEQ ID NO: 1064430 - DNA, 16 bp, Homo sapiens
atctctctgcagctgc

SEQ ID NO: 1064431 - DNA, 19 bp, Homo sapiens
atctctctgcagctgccgg

SEQ ID NO: 1064432 - DNA, 12 bp, Homo sapiens
atctctctggct

SEQ ID NO: 1064433 - DNA, 15 bp, Homo sapiens
atctctgaaaattct

SEQ ID NO: 1064434 - DNA, 17 bp, Homo sapiens
atctctgaagcatgttt

SEQ ID NO: 1064435 - DNA, 18 bp, Homo sapiens
atctctgacctctgctga

SEQ ID NO: 1064436 - DNA, 22 bp, Homo sapiens
atctctgacctctgctgagtgc

SEQ ID NO: 1064437 - DNA, 23 bp, Homo sapiens
atctctgattccctgatttaata

SEQ ID NO: 1064438 - DNA, 20 bp, Homo sapiens
atctctgcaccctggggcct

SEQ ID NO: 1064439 - DNA, 17 bp, Homo sapiens
atctctgccgtctctcc

SEQ ID NO: 1064440 - DNA, 19 bp, Homo sapiens
atctctgccgtctctcctg

SEQ ID NO: 1064441 - DNA, 21 bp, Homo sapiens
atctctgcctctcccaggctg

SEQ ID NO: 1064442 - DNA, 17 bp, Homo sapiens
atctctggaaaaataag

SEQ ID NO: 1064443 - DNA, 19 bp, Homo sapiens
atctctggaaggggcagcc

SEQ ID NO: 1064444 - DNA, 20 bp, Homo sapiens
atctctggcaccacactagg

SEQ ID NO: 1064445 - DNA, 19 bp, Homo sapiens
atctctggttttcttgcca

SEQ ID NO: 1064446 - DNA, 18 bp, Homo sapiens
atctctgtactttgcttg

SEQ ID NO: 1064447 - DNA, 17 bp, Homo sapiens
atctctgtcccattccc

SEQ ID NO: 1064448 - DNA, 22 bp, Homo sapiens
atctctgtcccattccctggga

SEQ ID NO: 1064449 - DNA, 15 bp, Homo sapiens
atctctgtctggggc

SEQ ID NO: 1064450 - DNA, 18 bp, Homo sapiens
atctctgtgccttcgtct

SEQ ID NO: 1064451 - DNA, 21 bp, Homo sapiens
atctcttaagacagcatgtgt

SEQ ID NO: 1064452 - DNA, 22 bp, Homo sapiens
atctcttaagacagcatgtgtt

SEQ ID NO: 1064453 - DNA, 18 bp, Homo sapiens
atctcttaatattgagaa

SEQ ID NO: 1064454 - DNA, 19 bp, Homo sapiens
atctgtataagtaagaaaa

SEQ ID NO: 1064455 - DNA, 18 bp, Homo sapiens
atctgtataccctctgtt

SEQ ID NO: 1064456 - DNA, 20 bp, Homo sapiens
atctgtatatgttgtaataa

SEQ ID NO: 1064457 - DNA, 20 bp, Homo sapiens
atctgtatctagaaagagat

SEQ ID NO: 1064458 - DNA, 14 bp, Homo sapiens
atctgtatctctct

SEQ ID NO: 1064459 - DNA, 23 bp, Homo sapiens
atctgtatctttgacaattctgg

SEQ ID NO: 1064460 - DNA, 18 bp, Homo sapiens
atctgtcaaaacactgtg

SEQ ID NO: 1064461 - DNA, 19 bp, Homo sapiens
atctgtcaaaacactgtgg

SEQ ID NO: 1064462 - DNA, 22 bp, Homo sapiens
atctgtcacaataaatggccag

SEQ ID NO: 1064463 - DNA, 21 bp, Homo sapiens
atctgtcatatagtaaacact

SEQ ID NO: 1064464 - DNA, 16 bp, Homo sapiens
atctgtcatctctctg

SEQ ID NO: 1064465 - DNA, 21 bp, Homo sapiens
atctgtccacatccccagagc

SEQ ID NO: 1064466 - DNA, 23 bp, Homo sapiens
atctgtccacatccccagagccc

SEQ ID NO: 1064467 - DNA, 17 bp, Homo sapiens
atctgtccgtccagagc

SEQ ID NO: 1064468 - DNA, 18 bp, Homo sapiens
atctgtccgtccagagcc

SEQ ID NO: 1064469 - DNA, 19 bp, Homo sapiens
atctgtccgtccagagccg

SEQ ID NO: 1064470 - DNA, 20 bp, Homo sapiens
atctgtcctcaccctgtggg

SEQ ID NO: 1064471 - DNA, 16 bp, Homo sapiens
atctgtcctctgtagt

SEQ ID NO: 1064472 - DNA, 13 bp, Homo sapiens
atctgtctccaag

SEQ ID NO: 1064473 - DNA, 16 bp, Homo sapiens
atctgtctggtggccc

SEQ ID NO: 1064474 - DNA, 13 bp, Homo sapiens
atctgtctgtcct

SEQ ID NO: 1064475 - DNA, 14 bp, Homo sapiens
atctgtctgtccta

SEQ ID NO: 1064476 - DNA, 13 bp, Homo sapiens
atctgtctgtctg

SEQ ID NO: 1064477 - DNA, 15 bp, Homo sapiens
atctgtctgtggcaa

SEQ ID NO: 1064478 - DNA, 13 bp, Homo sapiens
atctgtctttcca

SEQ ID NO: 1064479 - DNA, 21 bp, Homo sapiens
atctgtgaaaggtaggaaact

SEQ ID NO: 1064480 - DNA, 11 bp, Homo sapiens
atctgtgaata

SEQ ID NO: 1064481 - DNA, 17 bp, Homo sapiens
atctgtgaattgagctg

SEQ ID NO: 1064482 - DNA, 14 bp, Homo sapiens
atctgtgatgggag

SEQ ID NO: 1064483 - DNA, 13 bp, Homo sapiens
atctgtgatttct

SEQ ID NO: 1064484 - DNA, 22 bp, Homo sapiens
atctgtgcaaatccttgatact

SEQ ID NO: 1064485 - DNA, 15 bp, Homo sapiens
atctgtgccccatgc

SEQ ID NO: 1064486 - DNA, 23 bp, Homo sapiens
atctgtgccccatgcctgtccag

SEQ ID NO: 1064487 - DNA, 21 bp, Homo sapiens
atctgtgcctgcactgagagg

SEQ ID NO: 1064488 - DNA, 18 bp, Homo sapiens
atctgtgcgtgaaacaca

SEQ ID NO: 1064489 - DNA, 15 bp, Homo sapiens
atctgtgctctttca

SEQ ID NO: 1064490 - DNA, 16 bp, Homo sapiens
atctgtgctggccatg

SEQ ID NO: 1064491 - DNA, 19 bp, Homo sapiens
atctgtgcttctaatatta

SEQ ID NO: 1064492 - DNA, 17 bp, Homo sapiens
atctgtggagctgccac

SEQ ID NO: 1064493 - DNA, 16 bp, Homo sapiens
atctgtggagttcctg

SEQ ID NO: 1064494 - DNA, 19 bp, Homo sapiens
atctgtgggcatggtcaaa

SEQ ID NO: 1064495 - DNA, 15 bp, Homo sapiens
atctgtgtacaaaga

SEQ ID NO: 1064496 - DNA, 18 bp, Homo sapiens
atctgtgtacaaagaaat

SEQ ID NO: 1064497 - DNA, 16 bp, Homo sapiens
atctgtgtacaatttt

SEQ ID NO: 1064498 - DNA, 20 bp, Homo sapiens
atctgtgtgaaactttcatt

SEQ ID NO: 1064499 - DNA, 18 bp, Homo sapiens
atctgtgtgcatatttgt

SEQ ID NO: 1064500 - DNA, 21 bp, Homo sapiens
atctgtgtgcgtggtgtggcc

SEQ ID NO: 1064501 - DNA, 17 bp, Homo sapiens
atctgttagcagagtct

SEQ ID NO: 1064502 - DNA, 21 bp, Homo sapiens
atctgttagcagagtctgtct

SEQ ID NO: 1064503 - DNA, 15 bp, Homo sapiens
atctgttagggcctt

SEQ ID NO: 1064504 - DNA, 18 bp, Homo sapiens
atctgttaggttggggat

SEQ ID NO: 1064505 - DNA, 14 bp, Homo sapiens
atctgttgttctgt

SEQ ID NO: 1064506 - DNA, 22 bp, Homo sapiens
atctgtttcaggtttccattct

SEQ ID NO: 1064507 - DNA, 12 bp, Homo sapiens
atctgtttgtat

SEQ ID NO: 1064508 - DNA, 13 bp, Homo sapiens
atctgtttgtata

SEQ ID NO: 1064509 - DNA, 18 bp, Homo sapiens
atctgtttgtatatttgc

SEQ ID NO: 1064510 - DNA, 22 bp, Homo sapiens
atctgtttgtatatttgcaaac

SEQ ID NO: 1064511 - DNA, 15 bp, Homo sapiens
atctgtttgtttttt

SEQ ID NO: 1064512 - DNA, 21 bp, Homo sapiens
atctgttttataccttgctta

SEQ ID NO: 1064513 - DNA, 17 bp, Homo sapiens
atctgttttgtatatga

SEQ ID NO: 1064514 - DNA, 22 bp, Homo sapiens
atctgttttgtatatgatctaa

SEQ ID NO: 1064515 - DNA, 22 bp, Homo sapiens
atctgttttgtggtttggaata

SEQ ID NO: 1064516 - DNA, 15 bp, Homo sapiens
atcttaaacaatgta

SEQ ID NO: 1064517 - DNA, 17 bp, Homo sapiens
atcttaaacaatgtata

SEQ ID NO: 1064518 - DNA, 19 bp, Homo sapiens
atcttaaaccttaagatac

SEQ ID NO: 1064519 - DNA, 10 bp, Homo sapiens
atcttaaact

SEQ ID NO: 1064520 - DNA, 11 bp, Homo sapiens
atcttaaacta

SEQ ID NO: 1064521 - DNA, 19 bp, Homo sapiens
atcttaaagaaacagcttt

SEQ ID NO: 1064522 - DNA, 22 bp, Homo sapiens
atcttaaagaaacagctttcaa

SEQ ID NO: 1064523 - DNA, 18 bp, Homo sapiens
atcttaaatctaaacaaa

SEQ ID NO: 1064524 - DNA, 20 bp, Homo sapiens
atcttaaattcatttctaga

SEQ ID NO: 1064525 - DNA, 21 bp, Homo sapiens
atcttaaattcatttctagac

SEQ ID NO: 1064526 - DNA, 18 bp, Homo sapiens
atcttaagcaggtttgtt

SEQ ID NO: 1064527 - DNA, 12 bp, Homo sapiens
atcttaaggtct

SEQ ID NO: 1064528 - DNA, 18 bp, Homo sapiens
atcttaatcattatcctt

SEQ ID NO: 1064529 - DNA, 18 bp, Homo sapiens
atcttaattctttgttct

SEQ ID NO: 1064530 - DNA, 22 bp, Homo sapiens
atcttcctttcttgtctttcct

SEQ ID NO: 1064531 - DNA, 15 bp, Homo sapiens
atcttcgttagtaat

SEQ ID NO: 1064532 - DNA, 23 bp, Homo sapiens
atcttctatttttatcatgaatt

SEQ ID NO: 1064533 - DNA, 14 bp, Homo sapiens
atcttctcatcttt

SEQ ID NO: 1064534 - DNA, 14 bp, Homo sapiens
atcttctctggcga

SEQ ID NO: 1064535 - DNA, 21 bp, Homo sapiens
atcttctgccttagtctcagt

SEQ ID NO: 1064536 - DNA, 16 bp, Homo sapiens
atcttctgccttctca

SEQ ID NO: 1064537 - DNA, 12 bp, Homo sapiens
atcttctggaat

SEQ ID NO: 1064538 - DNA, 13 bp, Homo sapiens
atcttctggaata

SEQ ID NO: 1064539 - DNA, 15 bp, Homo sapiens
atcttctggaatatt

SEQ ID NO: 1064540 - DNA, 20 bp, Homo sapiens
atcttctggagaaaaaggtg

SEQ ID NO: 1064541 - DNA, 20 bp, Homo sapiens
atcttctggagtctccagtg

SEQ ID NO: 1064542 - DNA, 15 bp, Homo sapiens
atcttctgtgaaata

SEQ ID NO: 1064543 - DNA, 14 bp, Homo sapiens
atcttcttcaccat

SEQ ID NO: 1064544 - DNA, 17 bp, Homo sapiens
atcttcttgcatctaat

SEQ ID NO: 1064545 - DNA, 21 bp, Homo sapiens
atcttctttattattcctagt

SEQ ID NO: 1064546 - DNA, 15 bp, Homo sapiens
atcttctttcctcaa

SEQ ID NO: 1064547 - DNA, 21 bp, Homo sapiens
atcttgaaattaagaaggcaa

SEQ ID NO: 1064548 - DNA, 22 bp, Homo sapiens
atcttgaaattaagaaggcaaa

SEQ ID NO: 1064549 - DNA, 16 bp, Homo sapiens
atcttgaagtcagcca

SEQ ID NO: 1064550 - DNA, 22 bp, Homo sapiens
atcttgaagtcagccacactgg

SEQ ID NO: 1064551 - DNA, 12 bp, Homo sapiens
atcttgaatgtg

SEQ ID NO: 1064552 - DNA, 21 bp, Homo sapiens
atcttgaatgtggtctcagga

SEQ ID NO: 1064553 - DNA, 14 bp, Homo sapiens
atcttgaatgtttg

SEQ ID NO: 1064554 - DNA, 15 bp, Homo sapiens
atcttgaatttctgc

SEQ ID NO: 1064555 - DNA, 17 bp, Homo sapiens
atcttgactacagtcag

SEQ ID NO: 1064556 - DNA, 13 bp, Homo sapiens
atcttgatacatt

SEQ ID NO: 1064557 - DNA, 20 bp, Homo sapiens
atcttgatacattcaaattt

SEQ ID NO: 1064558 - DNA, 12 bp, Homo sapiens
atcttgatcttt

SEQ ID NO: 1064559 - DNA, 18 bp, Homo sapiens
atcttgatctttgagccc

SEQ ID NO: 1064560 - DNA, 19 bp, Homo sapiens
atcttgatctttgagccca

SEQ ID NO: 1064561 - DNA, 17 bp, Homo sapiens
atcttgatggtgtttct

SEQ ID NO: 1064562 - DNA, 15 bp, Homo sapiens
atcttgatgtttaga

SEQ ID NO: 1064563 - DNA, 16 bp, Homo sapiens
atcttgatgtttagaa

SEQ ID NO: 1064564 - DNA, 15 bp, Homo sapiens
atcttgcagttttgt

SEQ ID NO: 1064565 - DNA, 12 bp, Homo sapiens
atcttgccagcc

SEQ ID NO: 1064566 - DNA, 16 bp, Homo sapiens
atcttgcctacttttc

SEQ ID NO: 1064567 - DNA, 18 bp, Homo sapiens
atcttgcctacttttctt

SEQ ID NO: 1064568 - DNA, 14 bp, Homo sapiens
atcttgctaccagt

SEQ ID NO: 1064569 - DNA, 16 bp, Homo sapiens
atcttgctaccagtat

SEQ ID NO: 1064570 - DNA, 21 bp, Homo sapiens
atcttgctgcaggccctccct

SEQ ID NO: 1064571 - DNA, 23 bp, Homo sapiens
atcttgctgcaggccctccctct

SEQ ID NO: 1064572 - DNA, 15 bp, Homo sapiens
atcttgcttccctaa

SEQ ID NO: 1064573 - DNA, 23 bp, Homo sapiens
atcttgcttccctaatctatggt

SEQ ID NO: 1064574 - DNA, 12 bp, Homo sapiens
atcttgctttct

SEQ ID NO: 1064575 - DNA, 19 bp, Homo sapiens
atcttgctttctttagaat

SEQ ID NO: 1064576 - DNA, 21 bp, Homo sapiens
atcttggactgacatttagcg

SEQ ID NO: 1064577 - DNA, 21 bp, Homo sapiens
atcttggagctttttcaaaag

SEQ ID NO: 1064578 - DNA, 20 bp, Homo sapiens
atcttggcctaaacctcagt

SEQ ID NO: 1064579 - DNA, 21 bp, Homo sapiens
atcttggctatgtaattcttg

SEQ ID NO: 1064580 - DNA, 17 bp, Homo sapiens
atcttggctgggtgcgg

SEQ ID NO: 1064581 - DNA, 13 bp, Homo sapiens
atcttggcttctt

SEQ ID NO: 1064582 - DNA, 19 bp, Homo sapiens
atcttggcttcttaaaaac

SEQ ID NO: 1064583 - DNA, 21 bp, Homo sapiens
atcttggcttcttaaaaactg

SEQ ID NO: 1064584 - DNA, 22 bp, Homo sapiens
atcttggcttcttaaaaactgt

SEQ ID NO: 1064585 - DNA, 17 bp, Homo sapiens
atcttggggacatctct

SEQ ID NO: 1064586 - DNA, 22 bp, Homo sapiens
atcttggggacatctctttgaa

SEQ ID NO: 1064587 - DNA, 12 bp, Homo sapiens
atcttgggtgta

SEQ ID NO: 1064588 - DNA, 21 bp, Homo sapiens
atcttggtagttctgtgcctc

SEQ ID NO: 1064589 - DNA, 22 bp, Homo sapiens
atcttggtagttctgtgcctcc

SEQ ID NO: 1064590 - DNA, 21 bp, Homo sapiens
atcttggttgatgccaaaaaa

SEQ ID NO: 1064591 - DNA, 15 bp, Homo sapiens
atcttgtaggtcatt

SEQ ID NO: 1064592 - DNA, 16 bp, Homo sapiens
atcttgtccctaagta

SEQ ID NO: 1064593 - DNA, 14 bp, Homo sapiens
atcttgtgcttctt

SEQ ID NO: 1064594 - DNA, 14 bp, Homo sapiens
atcttgtggggcca

SEQ ID NO: 1064595 - DNA, 16 bp, Homo sapiens
atcttgttaatgtcat

SEQ ID NO: 1064596 - DNA, 18 bp, Homo sapiens
atcttgttaatgtcattg

SEQ ID NO: 1064597 - DNA, 21 bp, Homo sapiens
atcttgttactgctgattctt

SEQ ID NO: 1064598 - DNA, 18 bp, Homo sapiens
atcttgttagagagcttt

SEQ ID NO: 1064599 - DNA, 15 bp, Homo sapiens
atcttgttcaggaaa

SEQ ID NO: 1064600 - DNA, 17 bp, Homo sapiens
atcttgttcaggaaaag

SEQ ID NO: 1064601 - DNA, 21 bp, Homo sapiens
atcttgtttacaataaagaat

SEQ ID NO: 1064602 - DNA, 17 bp, Homo sapiens
atcttgttttgaaaata

SEQ ID NO: 1064603 - DNA, 15 bp, Homo sapiens
atcttgtttttccac

SEQ ID NO: 1064604 - DNA, 19 bp, Homo sapiens
atctttaacaattgtctta

SEQ ID NO: 1064605 - DNA, 14 bp, Homo sapiens
atctttaatttata

SEQ ID NO: 1064606 - DNA, 15 bp, Homo sapiens
atctttaccaaaaac

SEQ ID NO: 1064607 - DNA, 16 bp, Homo sapiens
atctttaccaaaaacc

SEQ ID NO: 1064608 - DNA, 17 bp, Homo sapiens
atctttacctgtataca

SEQ ID NO: 1064609 - DNA, 19 bp, Homo sapiens
atctttacgtactgtaact

SEQ ID NO: 1064610 - DNA, 20 bp, Homo sapiens
atctttacgtactgtaactg

SEQ ID NO: 1064611 - DNA, 15 bp, Homo sapiens
atctttataaatgta

SEQ ID NO: 1064612 - DNA, 16 bp, Homo sapiens
atctttatacagattt

SEQ ID NO: 1064613 - DNA, 22 bp, Homo sapiens
atctttatactgggtttcaaga

SEQ ID NO: 1064614 - DNA, 13 bp, Homo sapiens
atctttattaaaa

SEQ ID NO: 1064615 - DNA, 21 bp, Homo sapiens
atctttattaaaacaaaaggg

SEQ ID NO: 1064616 - DNA, 19 bp, Homo sapiens
atctttattgaacttgaaa

SEQ ID NO: 1064617 - DNA, 17 bp, Homo sapiens
atctttcaaaccagctt

SEQ ID NO: 1064618 - DNA, 17 bp, Homo sapiens
atctttcacttgaaaga

SEQ ID NO: 1064619 - DNA, 21 bp, Homo sapiens
atctttcacttgaaagatttt

SEQ ID NO: 1064620 - DNA, 12 bp, Homo sapiens
atctttcaggaa

SEQ ID NO: 1064621 - DNA, 14 bp, Homo sapiens
atctttcatacata

SEQ ID NO: 1064622 - DNA, 15 bp, Homo sapiens
atctttcatacatat

SEQ ID NO: 1064623 - DNA, 22 bp, Homo sapiens
atctttcatacatatatatatt

SEQ ID NO: 1064624 - DNA, 18 bp, Homo sapiens
atctttccctaaagaaga

SEQ ID NO: 1064625 - DNA, 16 bp, Homo sapiens
atctttcctcaagtat

SEQ ID NO: 1064626 - DNA, 23 bp, Homo sapiens
atctttctatataaaatgtattc

SEQ ID NO: 1064627 - DNA, 19 bp, Homo sapiens
atctttctccctcaactga

SEQ ID NO: 1064628 - DNA, 13 bp, Homo sapiens
atctttctcctgg

SEQ ID NO: 1064629 - DNA, 14 bp, Homo sapiens
atctttctcctggt

SEQ ID NO: 1064630 - DNA, 17 bp, Homo sapiens
atctttctttacctgag

SEQ ID NO: 1064631 - DNA, 18 bp, Homo sapiens
atctttctttacctgaga

SEQ ID NO: 1064632 - DNA, 13 bp, Homo sapiens
atctttctttcca

SEQ ID NO: 1064633 - DNA, 14 bp, Homo sapiens
atctttctttcttc

SEQ ID NO: 1064634 - DNA, 15 bp, Homo sapiens
atctttgaatatgta

SEQ ID NO: 1064635 - DNA, 13 bp, Homo sapiens
atctttgagccca

SEQ ID NO: 1064636 - DNA, 14 bp, Homo sapiens
atctttgagcccat

SEQ ID NO: 1064637 - DNA, 23 bp, Homo sapiens
atctttgagcccattcttctggg

SEQ ID NO: 1064638 - DNA, 20 bp, Homo sapiens
atctttgccttgggctgctc

SEQ ID NO: 1064639 - DNA, 20 bp, Homo sapiens
atctttgcgaaaagataaac

SEQ ID NO: 1064640 - DNA, 15 bp, Homo sapiens
atctttgtaccaaaa

SEQ ID NO: 1064641 - DNA, 17 bp, Homo sapiens
atctttgtaccaaaatt

SEQ ID NO: 1064642 - DNA, 19 bp, Homo sapiens
atctttgtaccaaaatttt

SEQ ID NO: 1064643 - DNA, 18 bp, Homo sapiens
atctttgtttaaatgcca

SEQ ID NO: 1064644 - DNA, 21 bp, Homo sapiens
atctttgtttaaatgccaaaa

SEQ ID NO: 1064645 - DNA, 14 bp, Homo sapiens
atcttttaaaatca

SEQ ID NO: 1064646 - DNA, 16 bp, Homo sapiens
atgaacagctctgaga

SEQ ID NO: 1064647 - DNA, 22 bp, Homo sapiens
atgaacagctctgagatcctgg

SEQ ID NO: 1064648 - DNA, 12 bp, Homo sapiens
atgaacagctgt

SEQ ID NO: 1064649 - DNA, 13 bp, Homo sapiens
atgaacagctgtg

SEQ ID NO: 1064650 - DNA, 17 bp, Homo sapiens
atgaacagctgtgtctg

SEQ ID NO: 1064651 - DNA, 16 bp, Homo sapiens
atgaacagggcccagg

SEQ ID NO: 1064652 - DNA, 14 bp, Homo sapiens
atgaacatcccttt

SEQ ID NO: 1064653 - DNA, 17 bp, Homo sapiens
atgaacatctcttgaaa

SEQ ID NO: 1064654 - DNA, 18 bp, Homo sapiens
atgaacatctcttgaaac

SEQ ID NO: 1064655 - DNA, 19 bp, Homo sapiens
atgaacatgcagttcatta

SEQ ID NO: 1064656 - DNA, 12 bp, Homo sapiens
atgaacattgta

SEQ ID NO: 1064657 - DNA, 14 bp, Homo sapiens
atgaacattgtact

SEQ ID NO: 1064658 - DNA, 15 bp, Homo sapiens
atgaacattgtactg

SEQ ID NO: 1064659 - DNA, 18 bp, Homo sapiens
atgaacccaaaaagagac

SEQ ID NO: 1064660 - DNA, 20 bp, Homo sapiens
atgaacccatagggagctga

SEQ ID NO: 1064661 - DNA, 15 bp, Homo sapiens
atgaaccctcctcct

SEQ ID NO: 1064662 - DNA, 22 bp, Homo sapiens
atgaaccctcctcctttttaag

SEQ ID NO: 1064663 - DNA, 20 bp, Homo sapiens
atgaacctattttcatttgt

SEQ ID NO: 1064664 - DNA, 20 bp, Homo sapiens
atgaactaccatctgatgtt

SEQ ID NO: 1064665 - DNA, 14 bp, Homo sapiens
atgaactcaacttt

SEQ ID NO: 1064666 - DNA, 22 bp, Homo sapiens
atgaactcagctattaagaaaa

SEQ ID NO: 1064667 - DNA, 16 bp, Homo sapiens
atgaactcttaatcaa

SEQ ID NO: 1064668 - DNA, 20 bp, Homo sapiens
atgaactcttagaaatgaag

SEQ ID NO: 1064669 - DNA, 15 bp, Homo sapiens
atgaactctttcaaa

SEQ ID NO: 1064670 - DNA, 20 bp, Homo sapiens
atgaactgaagtttcacatg

SEQ ID NO: 1064671 - DNA, 16 bp, Homo sapiens
atgaactgcttttcct

SEQ ID NO: 1064672 - DNA, 18 bp, Homo sapiens
atgaactgcttttcctca

SEQ ID NO: 1064673 - DNA, 23 bp, Homo sapiens
atgaactgcttttcctcaagcaa

SEQ ID NO: 1064674 - DNA, 13 bp, Homo sapiens
atgaactgtggaa

SEQ ID NO: 1064675 - DNA, 23 bp, Homo sapiens
atgaacttgagctctgtaactta

SEQ ID NO: 1064676 - DNA, 14 bp, Homo sapiens
atgaagaaaaagta

SEQ ID NO: 1064677 - DNA, 19 bp, Homo sapiens
atgaagaaaatcacttagg

SEQ ID NO: 1064678 - DNA, 15 bp, Homo sapiens
atgaagaaagcccct

SEQ ID NO: 1064679 - DNA, 14 bp, Homo sapiens
atgaagaaagggag

SEQ ID NO: 1064680 - DNA, 19 bp, Homo sapiens
atgaagaaagggaggccca

SEQ ID NO: 1064681 - DNA, 23 bp, Homo sapiens
atgaagaaagggaggcccagccg

SEQ ID NO: 1064682 - DNA, 15 bp, Homo sapiens
atgaagaactgagga

SEQ ID NO: 1064683 - DNA, 18 bp, Homo sapiens
atgaagaatagaaacaag

SEQ ID NO: 1064684 - DNA, 12 bp, Homo sapiens
atgaagaatgca

SEQ ID NO: 1064685 - DNA, 17 bp, Homo sapiens
atgaagaattatgtaat

SEQ ID NO: 1064686 - DNA, 15 bp, Homo sapiens
atgaagagaagcaat

SEQ ID NO: 1064687 - DNA, 18 bp, Homo sapiens
atgaagagcttgctttga

SEQ ID NO: 1064688 - DNA, 18 bp, Homo sapiens
atgaagagtgagagggca

SEQ ID NO: 1064689 - DNA, 17 bp, Homo sapiens
atgaagatgttaaaatc

SEQ ID NO: 1064690 - DNA, 13 bp, Homo sapiens
atgaagcaaggaa

SEQ ID NO: 1064691 - DNA, 15 bp, Homo sapiens
atgaagcaaggaaga

SEQ ID NO: 1064692 - DNA, 16 bp, Homo sapiens
atgaagcaaggaagat

SEQ ID NO: 1064693 - DNA, 15 bp, Homo sapiens
atgaagcagatttat

SEQ ID NO: 1064694 - DNA, 13 bp, Homo sapiens
atgaagcaggagg

SEQ ID NO: 1064695 - DNA, 15 bp, Homo sapiens
atgaagcaggaggcc

SEQ ID NO: 1064696 - DNA, 20 bp, Homo sapiens
atgaagcataatttgtttaa

SEQ ID NO: 1064697 - DNA, 12 bp, Homo sapiens
atgaagccagct

SEQ ID NO: 1064698 - DNA, 15 bp, Homo sapiens
atgaagcccaagtga

SEQ ID NO: 1064699 - DNA, 17 bp, Homo sapiens
atgaagccttgctgaac

SEQ ID NO: 1064700 - DNA, 11 bp, Homo sapiens
atgaagccttt

SEQ ID NO: 1064701 - DNA, 12 bp, Homo sapiens
atgaagctgcca

SEQ ID NO: 1064702 - DNA, 21 bp, Homo sapiens
atgaagctgccatccttgctg

SEQ ID NO: 1064703 - DNA, 22 bp, Homo sapiens
atgaagctgccatccttgctgc

SEQ ID NO: 1064704 - DNA, 21 bp, Homo sapiens
atgaaggagaggcaacatcca

SEQ ID NO: 1064705 - DNA, 21 bp, Homo sapiens
atgaaggcaaaaactgtactg

SEQ ID NO: 1064706 - DNA, 17 bp, Homo sapiens
atgaaggcttttggtct

SEQ ID NO: 1064707 - DNA, 17 bp, Homo sapiens
atgaagggaaaggatat

SEQ ID NO: 1064708 - DNA, 17 bp, Homo sapiens
atgaagggagggtccct

SEQ ID NO: 1064709 - DNA, 22 bp, Homo sapiens
atgaaggttaggatttaacagt

SEQ ID NO: 1064710 - DNA, 12 bp, Homo sapiens
atgaagtaaatt

SEQ ID NO: 1064711 - DNA, 16 bp, Homo sapiens
atgaagtgcgtgaatg

SEQ ID NO: 1064712 - DNA, 14 bp, Homo sapiens
atgaagttgctgtt

SEQ ID NO: 1064713 - DNA, 13 bp, Homo sapiens
atgaagtttaaat

SEQ ID NO: 1064714 - DNA, 16 bp, Homo sapiens
atgaagttttacattg

SEQ ID NO: 1064715 - DNA, 17 bp, Homo sapiens
atgaataaaaggctgga

SEQ ID NO: 1064716 - DNA, 21 bp, Homo sapiens
atgaataaactgaatattttg

SEQ ID NO: 1064717 - DNA, 16 bp, Homo sapiens
atgaataacatttaaa

SEQ ID NO: 1064718 - DNA, 13 bp, Homo sapiens
atgaataatggaa

SEQ ID NO: 1064719 - DNA, 20 bp, Homo sapiens
atgaataatggaaaatgcca

SEQ ID NO: 1064720 - DNA, 16 bp, Homo sapiens
atgaataatttattat

SEQ ID NO: 1064721 - DNA, 22 bp, Homo sapiens
atgaataatttcccaattagga

SEQ ID NO: 1064722 - DNA, 17 bp, Homo sapiens
atgaatagcttgtttct

SEQ ID NO: 1064723 - DNA, 21 bp, Homo sapiens
atgaatatcaggctattattt

SEQ ID NO: 1064724 - DNA, 17 bp, Homo sapiens
atgaatatctattaata

SEQ ID NO: 1064725 - DNA, 14 bp, Homo sapiens
atgaatatgatgac

SEQ ID NO: 1064726 - DNA, 12 bp, Homo sapiens
atgaatatttat

SEQ ID NO: 1064727 - DNA, 16 bp, Homo sapiens
atgaatcaatgaaaaa

SEQ ID NO: 1064728 - DNA, 17 bp, Homo sapiens
atgaatcaatgaaaaat

SEQ ID NO: 1064729 - DNA, 19 bp, Homo sapiens
atgaatcaatgaaaaatgt

SEQ ID NO: 1064730 - DNA, 21 bp, Homo sapiens
atgaatcagttttggaatcta

SEQ ID NO: 1064731 - DNA, 16 bp, Homo sapiens
atgaatccaactgctt

SEQ ID NO: 1064732 - DNA, 15 bp, Homo sapiens
atgaatccccgaccc

SEQ ID NO: 1064733 - DNA, 21 bp, Homo sapiens
atgaatcgggctaaggtccct

SEQ ID NO: 1064734 - DNA, 14 bp, Homo sapiens
atgaatctatgcca

SEQ ID NO: 1064735 - DNA, 20 bp, Homo sapiens
atgaatctggtgttggggaa

SEQ ID NO: 1064736 - DNA, 14 bp, Homo sapiens
atgaatctgtgctg

SEQ ID NO: 1064737 - DNA, 22 bp, Homo sapiens
atgaatctgtgctggccatgga

SEQ ID NO: 1064738 - DNA, 12 bp, Homo sapiens
atgaatctttca

SEQ ID NO: 1064739 - DNA, 13 bp, Homo sapiens
atgaatctttcat

SEQ ID NO: 1064740 - DNA, 16 bp, Homo sapiens
atgaatgaaaatacat

SEQ ID NO: 1064741 - DNA, 15 bp, Homo sapiens
atgaatgaatggctt

SEQ ID NO: 1064742 - DNA, 16 bp, Homo sapiens
atgaatgagccaaaat

SEQ ID NO: 1064743 - DNA, 13 bp, Homo sapiens
atgaatgatatct

SEQ ID NO: 1064744 - DNA, 20 bp, Homo sapiens
atgaatgcaaaattgttttc

SEQ ID NO: 1064745 - DNA, 21 bp, Homo sapiens
atgaatgcaaaattgttttca

SEQ ID NO: 1064746 - DNA, 18 bp, Homo sapiens
atgaatgcagattacact

SEQ ID NO: 1064747 - DNA, 20 bp, Homo sapiens
atgaatgcccccagctggcc

SEQ ID NO: 1064748 - DNA, 12 bp, Homo sapiens
atgaatggtctg

SEQ ID NO: 1064749 - DNA, 15 bp, Homo sapiens
atgaatgtaaggatg

SEQ ID NO: 1064750 - DNA, 19 bp, Homo sapiens
atgaatgtactatgtctga

SEQ ID NO: 1064751 - DNA, 16 bp, Homo sapiens
atgaatgtatcaggaa

SEQ ID NO: 1064752 - DNA, 17 bp, Homo sapiens
atgaatgtatgtgcact

SEQ ID NO: 1064753 - DNA, 19 bp, Homo sapiens
atgaatgtcacttctggat

SEQ ID NO: 1064754 - DNA, 13 bp, Homo sapiens
atgaattaaattt

SEQ ID NO: 1064755 - DNA, 18 bp, Homo sapiens
atgaattactgtatataa

SEQ ID NO: 1064756 - DNA, 19 bp, Homo sapiens
atgaattataactagacat

SEQ ID NO: 1064757 - DNA, 17 bp, Homo sapiens
atgaattcaagaaagga

SEQ ID NO: 1064758 - DNA, 19 bp, Homo sapiens
atgaattcaagaaaggaaa

SEQ ID NO: 1064759 - DNA, 17 bp, Homo sapiens
atgaattcttatgctta

SEQ ID NO: 1064760 - DNA, 13 bp, Homo sapiens
atgaattgcattt

SEQ ID NO: 1064761 - DNA, 11 bp, Homo sapiens
atgaatttaaa

SEQ ID NO: 1064762 - DNA, 23 bp, Homo sapiens
atgaatttaaatataattctgta

SEQ ID NO: 1064763 - DNA, 22 bp, Homo sapiens
atgaatttattgcacattgttc

SEQ ID NO: 1064764 - DNA, 15 bp, Homo sapiens
atgaatttggagact

SEQ ID NO: 1064765 - DNA, 20 bp, Homo sapiens
atgaatttggagactctgtg

SEQ ID NO: 1064766 - DNA, 13 bp, Homo sapiens
atgaatttgtcca

SEQ ID NO: 1064767 - DNA, 17 bp, Homo sapiens
atgaattttaaaatctg

SEQ ID NO: 1064768 - DNA, 14 bp, Homo sapiens
atgacaaaaataac

SEQ ID NO: 1064769 - DNA, 17 bp, Homo sapiens
atgacaaaaataacact

SEQ ID NO: 1064770 - DNA, 18 bp, Homo sapiens
atgacaaatgtattaatg

SEQ ID NO: 1064771 - DNA, 19 bp, Homo sapiens
atgacaacagaagcttcag

SEQ ID NO: 1064772 - DNA, 21 bp, Homo sapiens
atgctcagggtcactgaacca

SEQ ID NO: 1064773 - DNA, 21 bp, Homo sapiens
atgctcataaagatgttaaat

SEQ ID NO: 1064774 - DNA, 12 bp, Homo sapiens
atgctcatgtat

SEQ ID NO: 1064775 - DNA, 23 bp, Homo sapiens
atgctcatgtccctgtccccagg

SEQ ID NO: 1064776 - DNA, 22 bp, Homo sapiens
atgctccagattagagcctgta

SEQ ID NO: 1064777 - DNA, 21 bp, Homo sapiens
atgctccagccaacccctgtg

SEQ ID NO: 1064778 - DNA, 12 bp, Homo sapiens
atgctcccagct

SEQ ID NO: 1064779 - DNA, 18 bp, Homo sapiens
atgctcccagctgtgctg

SEQ ID NO: 1064780 - DNA, 13 bp, Homo sapiens
atgctccccacag

SEQ ID NO: 1064781 - DNA, 14 bp, Homo sapiens
atgctccccacagc

SEQ ID NO: 1064782 - DNA, 23 bp, Homo sapiens
atgctccccacagcgtccctggc

SEQ ID NO: 1064783 - DNA, 15 bp, Homo sapiens
atgctcccccatcct

SEQ ID NO: 1064784 - DNA, 22 bp, Homo sapiens
atgctcccccatcctccccttc

SEQ ID NO: 1064785 - DNA, 19 bp, Homo sapiens
atgctccctcccctgccct

SEQ ID NO: 1064786 - DNA, 20 bp, Homo sapiens
atgctcctcacctgtctagg

SEQ ID NO: 1064787 - DNA, 18 bp, Homo sapiens
atgctccttgagaggaga

SEQ ID NO: 1064788 - DNA, 23 bp, Homo sapiens
atgctccttgagaggagaaatgc

SEQ ID NO: 1064789 - DNA, 17 bp, Homo sapiens
atgctcgtgtgatttcc

SEQ ID NO: 1064790 - DNA, 22 bp, Homo sapiens
atgctctaatgagcatttcctt

SEQ ID NO: 1064791 - DNA, 21 bp, Homo sapiens
atgctctctgcagccagccca

SEQ ID NO: 1064792 - DNA, 22 bp, Homo sapiens
atgctctctgcagccagcccag

SEQ ID NO: 1064793 - DNA, 18 bp, Homo sapiens
atgctctgcatgttacat

SEQ ID NO: 1064794 - DNA, 14 bp, Homo sapiens
atgctctgctttta

SEQ ID NO: 1064795 - DNA, 20 bp, Homo sapiens
atgctctggcttgccccagg

SEQ ID NO: 1064796 - DNA, 13 bp, Homo sapiens
atgctctgtgcca

SEQ ID NO: 1064797 - DNA, 14 bp, Homo sapiens
atgctctgtgccag

SEQ ID NO: 1064798 - DNA, 23 bp, Homo sapiens
atgctctgtgcgagggttactat

SEQ ID NO: 1064799 - DNA, 15 bp, Homo sapiens
atgctcttctgtgga

SEQ ID NO: 1064800 - DNA, 17 bp, Homo sapiens
atgctcttgaaatattc

SEQ ID NO: 1064801 - DNA, 21 bp, Homo sapiens
atgctcttgaaatattcagaa

SEQ ID NO: 1064802 - DNA, 17 bp, Homo sapiens
atgctgaaaaatatagc

SEQ ID NO: 1064803 - DNA, 22 bp, Homo sapiens
atgctgaatatctgttcacttt

SEQ ID NO: 1064804 - DNA, 17 bp, Homo sapiens
atgctgaatgccccctg

SEQ ID NO: 1064805 - DNA, 20 bp, Homo sapiens
atgctgacattcacctgccc

SEQ ID NO: 1064806 - DNA, 22 bp, Homo sapiens
atgctgacattcacctgcccca

SEQ ID NO: 1064807 - DNA, 13 bp, Homo sapiens
atgctgacccagg

SEQ ID NO: 1064808 - DNA, 14 bp, Homo sapiens
atgctgacccagga

SEQ ID NO: 1064809 - DNA, 20 bp, Homo sapiens
atgctgactgtactcctccc

SEQ ID NO: 1064810 - DNA, 21 bp, Homo sapiens
atgctgactgtactcctccca

SEQ ID NO: 1064811 - DNA, 15 bp, Homo sapiens
atgctgagctgtgat

SEQ ID NO: 1064812 - DNA, 16 bp, Homo sapiens
atgctgagctgtgatg

SEQ ID NO: 1064813 - DNA, 20 bp, Homo sapiens
atgctgaggatataagcttt

SEQ ID NO: 1064814 - DNA, 15 bp, Homo sapiens
atgctgaggcctcga

SEQ ID NO: 1064815 - DNA, 15 bp, Homo sapiens
atgctgaggcctggg

SEQ ID NO: 1064816 - DNA, 17 bp, Homo sapiens
atgctgaggcctgggcc

SEQ ID NO: 1064817 - DNA, 13 bp, Homo sapiens
atgctgagggtgt

SEQ ID NO: 1064818 - DNA, 20 bp, Homo sapiens
atgctgagggtgtttcttcc

SEQ ID NO: 1064819 - DNA, 15 bp, Homo sapiens
atgctgaggttttga

SEQ ID NO: 1064820 - DNA, 22 bp, Homo sapiens
atgctgagtatgttaagctctt

SEQ ID NO: 1064821 - DNA, 15 bp, Homo sapiens
atgctgatcttttaa

SEQ ID NO: 1064822 - DNA, 15 bp, Homo sapiens
atgctgatgatcaaa

SEQ ID NO: 1064823 - DNA, 15 bp, Homo sapiens
atgctgcaacaaaat

SEQ ID NO: 1064824 - DNA, 20 bp, Homo sapiens
atgctgcaacaaaatgtaga

SEQ ID NO: 1064825 - DNA, 19 bp, Homo sapiens
atgctgcaggacttgagaa

SEQ ID NO: 1064826 - DNA, 13 bp, Homo sapiens
atgctgccagtgt

SEQ ID NO: 1064827 - DNA, 21 bp, Homo sapiens
atgctgccccgttccctgtca

SEQ ID NO: 1064828 - DNA, 12 bp, Homo sapiens
atgctgcctcca

SEQ ID NO: 1064829 - DNA, 17 bp, Homo sapiens
atgctgcctgcctgtct

SEQ ID NO: 1064830 - DNA, 23 bp, Homo sapiens
atgctgcctgggagccagggtga

SEQ ID NO: 1064831 - DNA, 23 bp, Homo sapiens
atgctgcctttattatatttgaa

SEQ ID NO: 1064832 - DNA, 14 bp, Homo sapiens
atgctgctcatcca

SEQ ID NO: 1064833 - DNA, 15 bp, Homo sapiens
atgctgctgaagaga

SEQ ID NO: 1064834 - DNA, 14 bp, Homo sapiens
atgctgctggccaa

SEQ ID NO: 1064835 - DNA, 12 bp, Homo sapiens
atgctgctgtga

SEQ ID NO: 1064836 - DNA, 14 bp, Homo sapiens
atgctgctgtgaat

SEQ ID NO: 1064837 - DNA, 19 bp, Homo sapiens
atgctgctgtgaatttttt

SEQ ID NO: 1064838 - DNA, 20 bp, Homo sapiens
atgctgctttcccctgtggg

SEQ ID NO: 1064839 - DNA, 23 bp, Homo sapiens
atgctgctttcccctgtggggat

SEQ ID NO: 1064840 - DNA, 12 bp, Homo sapiens
atgctgctttgc

SEQ ID NO: 1064841 - DNA, 15 bp, Homo sapiens
atgctgctttgtcca

SEQ ID NO: 1064842 - DNA, 21 bp, Homo sapiens
atgctggacggcattcctgct

SEQ ID NO: 1064843 - DNA, 20 bp, Homo sapiens
atgctggactggaggcccct

SEQ ID NO: 1064844 - DNA, 13 bp, Homo sapiens
atgctggagaggt

SEQ ID NO: 1064845 - DNA, 15 bp, Homo sapiens
atgctggagaggtta

SEQ ID NO: 1064846 - DNA, 17 bp, Homo sapiens
atgctggccagcaccct

SEQ ID NO: 1064847 - DNA, 18 bp, Homo sapiens
atgctggccagcaccctc

SEQ ID NO: 1064848 - DNA, 22 bp, Homo sapiens
atgctggccagcaccctctcct

SEQ ID NO: 1064849 - DNA, 21 bp, Homo sapiens
atgctggctatagatgtcttt

SEQ ID NO: 1064850 - DNA, 22 bp, Homo sapiens
atgctggctgagctgaacacat

SEQ ID NO: 1064851 - DNA, 16 bp, Homo sapiens
atgctggcttgtacat

SEQ ID NO: 1064852 - DNA, 16 bp, Homo sapiens
atgctgggacccttag

SEQ ID NO: 1064853 - DNA, 21 bp, Homo sapiens
atgctgggcccccagcctggc

SEQ ID NO: 1064854 - DNA, 12 bp, Homo sapiens
atgctgggccct

SEQ ID NO: 1064855 - DNA, 15 bp, Homo sapiens
atgctgggccctctt

SEQ ID NO: 1064856 - DNA, 13 bp, Homo sapiens
atgctgggctggg

SEQ ID NO: 1064857 - DNA, 17 bp, Homo sapiens
atgctgggctgggccct

SEQ ID NO: 1064858 - DNA, 20 bp, Homo sapiens
atgctgggtatgctctgtga

SEQ ID NO: 1064859 - DNA, 22 bp, Homo sapiens
atgctgggtatgctctgtgaca

SEQ ID NO: 1064860 - DNA, 16 bp, Homo sapiens
atgctggtggctggtg

SEQ ID NO: 1064861 - DNA, 16 bp, Homo sapiens
atgctggttacctgtt

SEQ ID NO: 1064862 - DNA, 21 bp, Homo sapiens
atgctggttacctgttccatt

SEQ ID NO: 1064863 - DNA, 13 bp, Homo sapiens
atgctggtttttc

SEQ ID NO: 1064864 - DNA, 12 bp, Homo sapiens
atgctgtacatc

SEQ ID NO: 1064865 - DNA, 20 bp, Homo sapiens
atgctgtacgtactgcattt

SEQ ID NO: 1064866 - DNA, 15 bp, Homo sapiens
atgctgtatctgtgc

SEQ ID NO: 1064867 - DNA, 18 bp, Homo sapiens
atgctgtatttctttgta

SEQ ID NO: 1064868 - DNA, 21 bp, Homo sapiens
atgctgtatttctttgtagaa

SEQ ID NO: 1064869 - DNA, 13 bp, Homo sapiens
atgctgtatttta

SEQ ID NO: 1064870 - DNA, 22 bp, Homo sapiens
atgctgtcactggcagagcaca

SEQ ID NO: 1064871 - DNA, 21 bp, Homo sapiens
atgctgttgcatttagaactt

SEQ ID NO: 1064872 - DNA, 15 bp, Homo sapiens
atgctgttgtaaaca

SEQ ID NO: 1064873 - DNA, 22 bp, Homo sapiens
atgctgttgtaaacaacgtgta

SEQ ID NO: 1064874 - DNA, 22 bp, Homo sapiens
atgctgtttgtagtgaaataat

SEQ ID NO: 1064875 - DNA, 13 bp, Homo sapiens
atgcttaaaatat

SEQ ID NO: 1064876 - DNA, 22 bp, Homo sapiens
atgcttaaaatatgtatgtcta

SEQ ID NO: 1064877 - DNA, 13 bp, Homo sapiens
atgcttaaatttt

SEQ ID NO: 1064878 - DNA, 19 bp, Homo sapiens
atgcttaataaaagaacat

SEQ ID NO: 1064879 - DNA, 14 bp, Homo sapiens
atgcttaataaaca

SEQ ID NO: 1064880 - DNA, 16 bp, Homo sapiens
atgcttactaaatctt

SEQ ID NO: 1064881 - DNA, 22 bp, Homo sapiens
atgcttactgatatattttaca

SEQ ID NO: 1064882 - DNA, 13 bp, Homo sapiens
atgcttagagcat

SEQ ID NO: 1064883 - DNA, 23 bp, Homo sapiens
atgcttagcttatctttctttcc

SEQ ID NO: 1064884 - DNA, 23 bp, Homo sapiens
atgcttagtcactgcctgcagag

SEQ ID NO: 1064885 - DNA, 22 bp, Homo sapiens
atgcttagtgaagcataaagtt

SEQ ID NO: 1064886 - DNA, 17 bp, Homo sapiens
atgcttatgcttgtgta

SEQ ID NO: 1064887 - DNA, 22 bp, Homo sapiens
atgcttatgcttgtgtatatgt

SEQ ID NO: 1064888 - DNA, 19 bp, Homo sapiens
atgcttcaagtgttgctct

SEQ ID NO: 1064889 - DNA, 22 bp, Homo sapiens
atgcttcatcattccctctcat

SEQ ID NO: 1064890 - DNA, 12 bp, Homo sapiens
atgcttcatgtg

SEQ ID NO: 1064891 - DNA, 14 bp, Homo sapiens
atgcttcctttctc

SEQ ID NO: 1064892 - DNA, 16 bp, Homo sapiens
atgcttcctttctctc

SEQ ID NO: 1064893 - DNA, 22 bp, Homo sapiens
atgcttcctttctctcctggct

SEQ ID NO: 1064894 - DNA, 22 bp, Homo sapiens
atgcttctaagtaaatacaatt

SEQ ID NO: 1064895 - DNA, 23 bp, Homo sapiens
atgcttctataattttgccttta

SEQ ID NO: 1064896 - DNA, 18 bp, Homo sapiens
atggataacctatatgat

SEQ ID NO: 1064897 - DNA, 16 bp, Homo sapiens
atggatacttcctggg

SEQ ID NO: 1064898 - DNA, 21 bp, Homo sapiens
atggatatttgtactgtttaa

SEQ ID NO: 1064899 - DNA, 15 bp, Homo sapiens
atggatcacaagatg

SEQ ID NO: 1064900 - DNA, 18 bp, Homo sapiens
atggatccttccatcttg

SEQ ID NO: 1064901 - DNA, 19 bp, Homo sapiens
atggatctgatctgtacca

SEQ ID NO: 1064902 - DNA, 21 bp, Homo sapiens
atggatgaatctcccactcca

SEQ ID NO: 1064903 - DNA, 16 bp, Homo sapiens
atggatggcagactct

SEQ ID NO: 1064904 - DNA, 14 bp, Homo sapiens
atggatggcttcta

SEQ ID NO: 1064905 - DNA, 12 bp, Homo sapiens
atggatgttact

SEQ ID NO: 1064906 - DNA, 12 bp, Homo sapiens
atggattaaaga

SEQ ID NO: 1064907 - DNA, 21 bp, Homo sapiens
atggattcccccccctttcct

SEQ ID NO: 1064908 - DNA, 16 bp, Homo sapiens
atggattctatttatt

SEQ ID NO: 1064909 - DNA, 16 bp, Homo sapiens
atggattctcagatat

SEQ ID NO: 1064910 - DNA, 18 bp, Homo sapiens
atggatttccagccaaag

SEQ ID NO: 1064911 - DNA, 23 bp, Homo sapiens
atggatttcgtttttcttggggt

SEQ ID NO: 1064912 - DNA, 18 bp, Homo sapiens
atggattttctattgtta

SEQ ID NO: 1064913 - DNA, 20 bp, Homo sapiens
atggattttctattgttact

SEQ ID NO: 1064914 - DNA, 21 bp, Homo sapiens
atggattttctattgttactc

SEQ ID NO: 1064915 - DNA, 15 bp, Homo sapiens
atggattttgggagt

SEQ ID NO: 1064916 - DNA, 21 bp, Homo sapiens
atggattttgggagtgactca

SEQ ID NO: 1064917 - DNA, 13 bp, Homo sapiens
atggatttttaaa

SEQ ID NO: 1064918 - DNA, 22 bp, Homo sapiens
atggatttttaaattatactgt

SEQ ID NO: 1064919 - DNA, 16 bp, Homo sapiens
atggcaaatcaggggc

SEQ ID NO: 1064920 - DNA, 21 bp, Homo sapiens
atggcaaatcaggggccagag

SEQ ID NO: 1064921 - DNA, 16 bp, Homo sapiens
atggcaaatgggcagc

SEQ ID NO: 1064922 - DNA, 23 bp, Homo sapiens
atggcaagaaagctggtaaacta

SEQ ID NO: 1064923 - DNA, 23 bp, Homo sapiens
atggcaagggggtgtcatctgag

SEQ ID NO: 1064924 - DNA, 18 bp, Homo sapiens
atggcaagtctagagtct

SEQ ID NO: 1064925 - DNA, 14 bp, Homo sapiens
atggcaataggaca

SEQ ID NO: 1064926 - DNA, 23 bp, Homo sapiens
atggcaattctttgacctcaacc

SEQ ID NO: 1064927 - DNA, 16 bp, Homo sapiens
atggcaattgcactca

SEQ ID NO: 1064928 - DNA, 15 bp, Homo sapiens
atggcaattttgtaa

SEQ ID NO: 1064929 - DNA, 16 bp, Homo sapiens
atggcaattttgtaac

SEQ ID NO: 1064930 - DNA, 14 bp, Homo sapiens
atggcacaatgaat

SEQ ID NO: 1064931 - DNA, 17 bp, Homo sapiens
atggcacatcagcacga

SEQ ID NO: 1064932 - DNA, 14 bp, Homo sapiens
atggcaccagcccc

SEQ ID NO: 1064933 - DNA, 22 bp, Homo sapiens
atggcaccagccccctggatgg

SEQ ID NO: 1064934 - DNA, 20 bp, Homo sapiens
atggcacctcaggctgaggg

SEQ ID NO: 1064935 - DNA, 21 bp, Homo sapiens
atggcaccttcagactttgct

SEQ ID NO: 1064936 - DNA, 15 bp, Homo sapiens
atggcactaaaccac

SEQ ID NO: 1064937 - DNA, 23 bp, Homo sapiens
atggcactaaaccacttctctgc

SEQ ID NO: 1064938 - DNA, 20 bp, Homo sapiens
atggcacttagctatcagaa

SEQ ID NO: 1064939 - DNA, 13 bp, Homo sapiens
atggcagaaggca

SEQ ID NO: 1064940 - DNA, 22 bp, Homo sapiens
atggcagagccaggctgttgga

SEQ ID NO: 1064941 - DNA, 15 bp, Homo sapiens
atggcagagttgtaa

SEQ ID NO: 1064942 - DNA, 20 bp, Homo sapiens
atggcagagttgtaaatata

SEQ ID NO: 1064943 - DNA, 23 bp, Homo sapiens
atggcagagtttgtgtgttgtct

SEQ ID NO: 1064944 - DNA, 15 bp, Homo sapiens
atggcagcagtgaag

SEQ ID NO: 1064945 - DNA, 16 bp, Homo sapiens
atggcagcattcccac

SEQ ID NO: 1064946 - DNA, 14 bp, Homo sapiens
atggcagcccggct

SEQ ID NO: 1064947 - DNA, 20 bp, Homo sapiens
atggcagcccggctgctgct

SEQ ID NO: 1064948 - DNA, 19 bp, Homo sapiens
atggcagctagactggagt

SEQ ID NO: 1064949 - DNA, 15 bp, Homo sapiens
atggcagctagtgcc

SEQ ID NO: 1064950 - DNA, 21 bp, Homo sapiens
atggcagctgtttctcatgaa

SEQ ID NO: 1064951 - DNA, 21 bp, Homo sapiens
atggcaggagaatcagcctgg

SEQ ID NO: 1064952 - DNA, 15 bp, Homo sapiens
atggcaggagagctt

SEQ ID NO: 1064953 - DNA, 17 bp, Homo sapiens
atggcaggcctgaccca

SEQ ID NO: 1064954 - DNA, 12 bp, Homo sapiens
atggcagggcct

SEQ ID NO: 1064955 - DNA, 19 bp, Homo sapiens
atggcagggcctcatctca

SEQ ID NO: 1064956 - DNA, 16 bp, Homo sapiens
atggcaggtgtcatat

SEQ ID NO: 1064957 - DNA, 18 bp, Homo sapiens
atggcagtgttcctattt

SEQ ID NO: 1064958 - DNA, 15 bp, Homo sapiens
atggcagttatattt

SEQ ID NO: 1064959 - DNA, 24 bp, Homo sapiens
atggcatatttatattgtatattc

SEQ ID NO: 1064960 - DNA, 16 bp, Homo sapiens
atggcatcctgtgaag

SEQ ID NO: 1064961 - DNA, 15 bp, Homo sapiens
atggcatcttcaata

SEQ ID NO: 1064962 - DNA, 15 bp, Homo sapiens
atggcatgatttata

SEQ ID NO: 1064963 - DNA, 17 bp, Homo sapiens
atggcatgcgccaccat

SEQ ID NO: 1064964 - DNA, 21 bp, Homo sapiens
atggcatgcgccaccatgccc

SEQ ID NO: 1064965 - DNA, 13 bp, Homo sapiens
atggcatttctct

SEQ ID NO: 1064966 - DNA, 17 bp, Homo sapiens
atggcatttctctttaa

SEQ ID NO: 1064967 - DNA, 19 bp, Homo sapiens
atggcatttggtctcaggc

SEQ ID NO: 1064968 - DNA, 23 bp, Homo sapiens
atggcatttggtctcaggcagca

SEQ ID NO: 1064969 - DNA, 14 bp, Homo sapiens
atggccaaaatacc

SEQ ID NO: 1064970 - DNA, 13 bp, Homo sapiens
atggccaagagca

SEQ ID NO: 1064971 - DNA, 15 bp, Homo sapiens
atggccaagagcatc

SEQ ID NO: 1064972 - DNA, 18 bp, Homo sapiens
atggccaccccgtgccac

SEQ ID NO: 1064973 - DNA, 21 bp, Homo sapiens
atgtttattgttttttaaaga

SEQ ID NO: 1064974 - DNA, 15 bp, Homo sapiens
atgtttatttagctc

SEQ ID NO: 1064975 - DNA, 19 bp, Homo sapiens
atgtttatttagctctgaa

SEQ ID NO: 1064976 - DNA, 13 bp, Homo sapiens
atgtttatttata

SEQ ID NO: 1064977 - DNA, 16 bp, Homo sapiens
atgtttcaactgtgct

SEQ ID NO: 1064978 - DNA, 16 bp, Homo sapiens
atgtttcacacaaaca

SEQ ID NO: 1064979 - DNA, 21 bp, Homo sapiens
atgtttcattatgcactttta

SEQ ID NO: 1064980 - DNA, 13 bp, Homo sapiens
atgtttccaacct

SEQ ID NO: 1064981 - DNA, 12 bp, Homo sapiens
atgtttccactg

SEQ ID NO: 1064982 - DNA, 24 bp, Homo sapiens
atgtttccagcagaagacaaaaag

SEQ ID NO: 1064983 - DNA, 21 bp, Homo sapiens
atgtttccccatctctgtctg

SEQ ID NO: 1064984 - DNA, 14 bp, Homo sapiens
atgtttcctctagt

SEQ ID NO: 1064985 - DNA, 12 bp, Homo sapiens
atgtttccttaa

SEQ ID NO: 1064986 - DNA, 13 bp, Homo sapiens
atgtttccttaaa

SEQ ID NO: 1064987 - DNA, 12 bp, Homo sapiens
atgtttccttgt

SEQ ID NO: 1064988 - DNA, 22 bp, Homo sapiens
atgtttcgctgatatatgtgtt

SEQ ID NO: 1064989 - DNA, 22 bp, Homo sapiens
atgtttctgcagtagtctctgt

SEQ ID NO: 1064990 - DNA, 22 bp, Homo sapiens
atgtttcttctaggttctaaaa

SEQ ID NO: 1064991 - DNA, 20 bp, Homo sapiens
atgtttcttttcccttaaat

SEQ ID NO: 1064992 - DNA, 20 bp, Homo sapiens
atgtttcttttgtatgtaaa

SEQ ID NO: 1064993 - DNA, 17 bp, Homo sapiens
atgtttgaaaacaaaaa

SEQ ID NO: 1064994 - DNA, 21 bp, Homo sapiens
atgtttgcacctttctagttg

SEQ ID NO: 1064995 - DNA, 13 bp, Homo sapiens
atgtttgcccaaa

SEQ ID NO: 1064996 - DNA, 16 bp, Homo sapiens
atgtttgctattgaca

SEQ ID NO: 1064997 - DNA, 12 bp, Homo sapiens
atgtttgctgat

SEQ ID NO: 1064998 - DNA, 22 bp, Homo sapiens
atgtttgctgattatttatgac

SEQ ID NO: 1064999 - DNA, 18 bp, Homo sapiens
atgtttgcttcataaatg

SEQ ID NO: 1065000 - DNA, 18 bp, Homo sapiens
atgtttggaaaggttcta

SEQ ID NO: 1065001 - DNA, 18 bp, Homo sapiens
atgtttgggcagaaggga

SEQ ID NO: 1065002 - DNA, 23 bp, Homo sapiens
atgtttggggatcgatgtgctca

SEQ ID NO: 1065003 - DNA, 23 bp, Homo sapiens
atgtttgtcctgaacacttttgt

SEQ ID NO: 1065004 - DNA, 24 bp, Homo sapiens
atgtttgtgagaagcttctaatta

SEQ ID NO: 1065005 - DNA, 17 bp, Homo sapiens
atgtttgtggcctcaga

SEQ ID NO: 1065006 - DNA, 15 bp, Homo sapiens
atgtttgtgtgattt

SEQ ID NO: 1065007 - DNA, 18 bp, Homo sapiens
atgtttgtgtgatttcct

SEQ ID NO: 1065008 - DNA, 22 bp, Homo sapiens
atgtttgttatttacactggtc

SEQ ID NO: 1065009 - DNA, 15 bp, Homo sapiens
atgtttgtttcagtg

SEQ ID NO: 1065010 - DNA, 18 bp, Homo sapiens
atgtttgtttcagtgcca

SEQ ID NO: 1065011 - DNA, 17 bp, Homo sapiens
atgttttaaaaaaattt

SEQ ID NO: 1065012 - DNA, 20 bp, Homo sapiens
atgttttaccgtaataatta

SEQ ID NO: 1065013 - DNA, 17 bp, Homo sapiens
atgttttacgcaaggaa

SEQ ID NO: 1065014 - DNA, 21 bp, Homo sapiens
atgttttacgcaaggaaggac

SEQ ID NO: 1065015 - DNA, 16 bp, Homo sapiens
atgttttacgtgcaaa

SEQ ID NO: 1065016 - DNA, 18 bp, Homo sapiens
atgttttacgtgcaaaca

SEQ ID NO: 1065017 - DNA, 20 bp, Homo sapiens
atgttttacgtgcaaacaac

SEQ ID NO: 1065018 - DNA, 12 bp, Homo sapiens
atgttttagcat

SEQ ID NO: 1065019 - DNA, 14 bp, Homo sapiens
atgttttatatcaa

SEQ ID NO: 1065020 - DNA, 15 bp, Homo sapiens
atgttttatttcatt

SEQ ID NO: 1065021 - DNA, 23 bp, Homo sapiens
atgttttatttcattggttaatt

SEQ ID NO: 1065022 - DNA, 19 bp, Homo sapiens
atgttttcattatgttcat

SEQ ID NO: 1065023 - DNA, 18 bp, Homo sapiens
atgttttctgctgtttaa

SEQ ID NO: 1065024 - DNA, 17 bp, Homo sapiens
atgttttctttgcaaag

SEQ ID NO: 1065025 - DNA, 18 bp, Homo sapiens
atgttttctttgctttaa

SEQ ID NO: 1065026 - DNA, 16 bp, Homo sapiens
atgttttgaaatgata

SEQ ID NO: 1065027 - DNA, 16 bp, Homo sapiens
atgttttgaatgtgga

SEQ ID NO: 1065028 - DNA, 23 bp, Homo sapiens
atgttttgatatttatttcctgc

SEQ ID NO: 1065029 - DNA, 16 bp, Homo sapiens
atgttttgtaaacatt

SEQ ID NO: 1065030 - DNA, 19 bp, Homo sapiens
atgttttgtaaacatttat

SEQ ID NO: 1065031 - DNA, 17 bp, Homo sapiens
atgttttgtgactatat

SEQ ID NO: 1065032 - DNA, 19 bp, Homo sapiens
atgttttgtgactatatag

SEQ ID NO: 1065033 - DNA, 14 bp, Homo sapiens
atgttttgttcaaa

SEQ ID NO: 1065034 - DNA, 11 bp, Homo sapiens
atgtttttaaa

SEQ ID NO: 1065035 - DNA, 22 bp, Homo sapiens
atgtttttaaaagtttcaatgt

SEQ ID NO: 1065036 - DNA, 23 bp, Homo sapiens
atgtttttaaaagtttcaatgtg

SEQ ID NO: 1065037 - DNA, 15 bp, Homo sapiens
atgtttttacattat

SEQ ID NO: 1065038 - DNA, 19 bp, Homo sapiens
atgtttttccctccccaga

SEQ ID NO: 1065039 - DNA, 20 bp, Homo sapiens
atgtttttccctccccagaa

SEQ ID NO: 1065040 - DNA, 14 bp, Homo sapiens
atgtttttcctttc

SEQ ID NO: 1065041 - DNA, 22 bp, Homo sapiens
atgtttttctgccagggagctt

SEQ ID NO: 1065042 - DNA, 23 bp, Homo sapiens
atgtttttctttatttttgttaa

SEQ ID NO: 1065043 - DNA, 12 bp, Homo sapiens
atgtttttgaag

SEQ ID NO: 1065044 - DNA, 18 bp, Homo sapiens
atgtttttggttattggt

SEQ ID NO: 1065045 - DNA, 19 bp, Homo sapiens
atgtttttgttcaaagcca

SEQ ID NO: 1065046 - DNA, 15 bp, Homo sapiens
atgttttttcatgtg

SEQ ID NO: 1065047 - DNA, 20 bp, Homo sapiens
atgttttttccttttcacat

SEQ ID NO: 1065048 - DNA, 12 bp, Homo sapiens
atgttttttgcc

SEQ ID NO: 1065049 - DNA, 18 bp, Homo sapiens
atgttttttggaaattca

SEQ ID NO: 1065050 - DNA, 16 bp, Homo sapiens
attatttcttctctta

SEQ ID NO: 1065051 - DNA, 19 bp, Homo sapiens
attatttgattatttaaga

SEQ ID NO: 1065052 - DNA, 21 bp, Homo sapiens
attatttgattatttaagact

SEQ ID NO: 1065053 - DNA, 22 bp, Homo sapiens
attatttgattatttaagacta

SEQ ID NO: 1065054 - DNA, 20 bp, Homo sapiens
attatttgcatgttatgttt

SEQ ID NO: 1065055 - DNA, 21 bp, Homo sapiens
attatttgcatgttatgttta

SEQ ID NO: 1065056 - DNA, 16 bp, Homo sapiens
attatttgctatggca

SEQ ID NO: 1065057 - DNA, 14 bp, Homo sapiens
attatttgcttttc

SEQ ID NO: 1065058 - DNA, 20 bp, Homo sapiens
attatttgcttttcatgtag

SEQ ID NO: 1065059 - DNA, 22 bp, Homo sapiens
attatttgcttttcatgtagaa

SEQ ID NO: 1065060 - DNA, 22 bp, Homo sapiens
attatttggagcctgccaagag

SEQ ID NO: 1065061 - DNA, 21 bp, Homo sapiens
attatttgggagggaaaaggg

SEQ ID NO: 1065062 - DNA, 15 bp, Homo sapiens
attatttgtaagata

SEQ ID NO: 1065063 - DNA, 12 bp, Homo sapiens
attatttgtgca

SEQ ID NO: 1065064 - DNA, 14 bp, Homo sapiens
attatttgtgcatt

SEQ ID NO: 1065065 - DNA, 21 bp, Homo sapiens
attatttgtgcattttattga

SEQ ID NO: 1065066 - DNA, 18 bp, Homo sapiens
attatttgtgtaatagaa

SEQ ID NO: 1065067 - DNA, 13 bp, Homo sapiens
attattttaaaaa

SEQ ID NO: 1065068 - DNA, 18 bp, Homo sapiens
attattttaaaatattta

SEQ ID NO: 1065069 - DNA, 19 bp, Homo sapiens
attattttaattttttctc

SEQ ID NO: 1065070 - DNA, 21 bp, Homo sapiens
attattttaattttttctctt

SEQ ID NO: 1065071 - DNA, 18 bp, Homo sapiens
attattttagcttcagtt

SEQ ID NO: 1065072 - DNA, 21 bp, Homo sapiens
attattttagcttcagttgtt

SEQ ID NO: 1065073 - DNA, 21 bp, Homo sapiens
attattttatatcatacagtt

SEQ ID NO: 1065074 - DNA, 14 bp, Homo sapiens
attattttctgtca

SEQ ID NO: 1065075 - DNA, 15 bp, Homo sapiens
attattttctgtcag

SEQ ID NO: 1065076 - DNA, 14 bp, Homo sapiens
attattttgtggtt

SEQ ID NO: 1065077 - DNA, 12 bp, Homo sapiens
attatttttacc

SEQ ID NO: 1065078 - DNA, 19 bp, Homo sapiens
attatttttccactttgtt

SEQ ID NO: 1065079 - DNA, 11 bp, Homo sapiens
attatttttgt

SEQ ID NO: 1065080 - DNA, 20 bp, Homo sapiens
attatttttgtgtttctaaa

SEQ ID NO: 1065081 - DNA, 20 bp, Homo sapiens
attatttttgttagcaaaga

SEQ ID NO: 1065082 - DNA, 13 bp, Homo sapiens
attattttttaat

SEQ ID NO: 1065083 - DNA, 20 bp, Homo sapiens
attattttttaataaactgc

SEQ ID NO: 1065084 - DNA, 16 bp, Homo sapiens
attattttttatactg

SEQ ID NO: 1065085 - DNA, 17 bp, Homo sapiens
attattttttatttctg

SEQ ID NO: 1065086 - DNA, 14 bp, Homo sapiens
attattttttctat

SEQ ID NO: 1065087 - DNA, 22 bp, Homo sapiens
attcaaaaagacagcagacaaa

SEQ ID NO: 1065088 - DNA, 11 bp, Homo sapiens
attcaaaacat

SEQ ID NO: 1065089 - DNA, 14 bp, Homo sapiens
attcaaaagtattg

SEQ ID NO: 1065090 - DNA, 22 bp, Homo sapiens
attcaaaatatttaaaaatgtc

SEQ ID NO: 1065091 - DNA, 14 bp, Homo sapiens
attcaaaatgctct

SEQ ID NO: 1065092 - DNA, 16 bp, Homo sapiens
attcaaaatgctctaa

SEQ ID NO: 1065093 - DNA, 13 bp, Homo sapiens
attcaaacatatt

SEQ ID NO: 1065094 - DNA, 15 bp, Homo sapiens
attcaaaccaaagct

SEQ ID NO: 1065095 - DNA, 22 bp, Homo sapiens
attcaaaccaatttcttccttc

SEQ ID NO: 1065096 - DNA, 22 bp, Homo sapiens
attcaaactggggcctccagaa

SEQ ID NO: 1065097 - DNA, 13 bp, Homo sapiens
attcaaagaagta

SEQ ID NO: 1065098 - DNA, 12 bp, Homo sapiens
attcaaagcatg

SEQ ID NO: 1065099 - DNA, 17 bp, Homo sapiens
attcaaagctctattaa

SEQ ID NO: 1065100 - DNA, 21 bp, Homo sapiens
attcaaagtgttgtgttcctg

SEQ ID NO: 1065101 - DNA, 14 bp, Homo sapiens
attcaaatgtttta

SEQ ID NO: 1065102 - DNA, 15 bp, Homo sapiens
attcaaattgctgct

SEQ ID NO: 1065103 - DNA, 18 bp, Homo sapiens
attcaaattgctgcttgg

SEQ ID NO: 1065104 - DNA, 17 bp, Homo sapiens
attcaaatttgtacagg

SEQ ID NO: 1065105 - DNA, 13 bp, Homo sapiens
attcaacaaacat

SEQ ID NO: 1065106 - DNA, 20 bp, Homo sapiens
attcaacatcaaaacttaag

SEQ ID NO: 1065107 - DNA, 16 bp, Homo sapiens
attcaaccactgtaaa

SEQ ID NO: 1065108 - DNA, 13 bp, Homo sapiens
attcaagcaaaca

SEQ ID NO: 1065109 - DNA, 22 bp, Homo sapiens
attcaagcaaacatcaaataaa

SEQ ID NO: 1065110 - DNA, 15 bp, Homo sapiens
attcaagcctctaaa

SEQ ID NO: 1065111 - DNA, 16 bp, Homo sapiens
attcaagcctgtgaat

SEQ ID NO: 1065112 - DNA, 21 bp, Homo sapiens
attcaagctatttaatatctg

SEQ ID NO: 1065113 - DNA, 15 bp, Homo sapiens
attcaagctgagaaa

SEQ ID NO: 1065114 - DNA, 17 bp, Homo sapiens
attcaagctgagaaaag

SEQ ID NO: 1065115 - DNA, 18 bp, Homo sapiens
attcaagctgagaaaagt

SEQ ID NO: 1065116 - DNA, 19 bp, Homo sapiens
attcaaggagaatatgata

SEQ ID NO: 1065117 - DNA, 13 bp, Homo sapiens
attcaagtaacac

SEQ ID NO: 1065118 - DNA, 18 bp, Homo sapiens
attcaagtaacactttaa

SEQ ID NO: 1065119 - DNA, 21 bp, Homo sapiens
attcaagtgataggataaagt

SEQ ID NO: 1065120 - DNA, 22 bp, Homo sapiens
attcaagtgcttaaaaatactt

SEQ ID NO: 1065121 - DNA, 21 bp, Homo sapiens
attcaagtgtaaaatattttg

SEQ ID NO: 1065122 - DNA, 16 bp, Homo sapiens
attcaagtgtacagtg

SEQ ID NO: 1065123 - DNA, 22 bp, Homo sapiens
attcaataaaaaaaagaaatga

SEQ ID NO: 1065124 - DNA, 13 bp, Homo sapiens
attcaataccgct

SEQ ID NO: 1065125 - DNA, 21 bp, Homo sapiens
attcaatattgaatttttcct

SEQ ID NO: 1065126 - DNA, 15 bp, Homo sapiens
attcaatattgacat

SEQ ID NO: 1065127 - DNA, 16 bp, Homo sapiens
attcaatattgacatt

SEQ ID NO: 1065128 - DNA, 19 bp, Homo sapiens
attcaatattgacatttgt

SEQ ID NO: 1065129 - DNA, 13 bp, Homo sapiens
attccacagctgc

SEQ ID NO: 1065130 - DNA, 22 bp, Homo sapiens
attccacaggacacgaaggctg

SEQ ID NO: 1065131 - DNA, 23 bp, Homo sapiens
attccacaggtcatcagatgcct

SEQ ID NO: 1065132 - DNA, 16 bp, Homo sapiens
attccacctgcaatca

SEQ ID NO: 1065133 - DNA, 14 bp, Homo sapiens
attccaccttaaat

SEQ ID NO: 1065134 - DNA, 17 bp, Homo sapiens
attccaccttaaattaa

SEQ ID NO: 1065135 - DNA, 20 bp, Homo sapiens
attccaccttaaattaaaca

SEQ ID NO: 1065136 - DNA, 17 bp, Homo sapiens
attccactacacctggc

SEQ ID NO: 1065137 - DNA, 14 bp, Homo sapiens
attccactgaaaat

SEQ ID NO: 1065138 - DNA, 16 bp, Homo sapiens
attccagaacaaattg

SEQ ID NO: 1065139 - DNA, 19 bp, Homo sapiens
attccagaagaagagaagc

SEQ ID NO: 1065140 - DNA, 23 bp, Homo sapiens
attccagaagaagagaagctgct

SEQ ID NO: 1065141 - DNA, 22 bp, Homo sapiens
attccagaatcttgactttctg

SEQ ID NO: 1065142 - DNA, 23 bp, Homo sapiens
attccagactgcttccaattttc

SEQ ID NO: 1065143 - DNA, 18 bp, Homo sapiens
attccagagacatcagca

SEQ ID NO: 1065144 - DNA, 22 bp, Homo sapiens
attccagaggactctgcttaaa

SEQ ID NO: 1065145 - DNA, 11 bp, Homo sapiens
attccagcaat

SEQ ID NO: 1065146 - DNA, 17 bp, Homo sapiens
attccagcaataagaaa

SEQ ID NO: 1065147 - DNA, 15 bp, Homo sapiens
attccagccaggccc

SEQ ID NO: 1065148 - DNA, 17 bp, Homo sapiens
attccagccaggcccag

SEQ ID NO: 1065149 - DNA, 18 bp, Homo sapiens
attccagccaggcccagg

SEQ ID NO: 1065150 - DNA, 21 bp, Homo sapiens
attccagccaggcccaggcca

SEQ ID NO: 1065151 - DNA, 22 bp, Homo sapiens
attccagccaggcccaggccag

SEQ ID NO: 1065152 - DNA, 23 bp, Homo sapiens
attccagccaggcccaggccagc

SEQ ID NO: 1065153 - DNA, 14 bp, Homo sapiens
attccagcccctct

SEQ ID NO: 1065154 - DNA, 17 bp, Homo sapiens
attccagctctgccccc

SEQ ID NO: 1065155 - DNA, 18 bp, Homo sapiens
attccagctctgcccccg

SEQ ID NO: 1065156 - DNA, 15 bp, Homo sapiens
attccaggaattcct

SEQ ID NO: 1065157 - DNA, 11 bp, Homo sapiens
attccagggct

SEQ ID NO: 1065158 - DNA, 15 bp, Homo sapiens
attccagtacagtat

SEQ ID NO: 1065159 - DNA, 17 bp, Homo sapiens
attccagtacagtattc

SEQ ID NO: 1065160 - DNA, 16 bp, Homo sapiens
attccatacttctctc

SEQ ID NO: 1065161 - DNA, 17 bp, Homo sapiens
attccatacttctctca

SEQ ID NO: 1065162 - DNA, 16 bp, Homo sapiens
attccatagtggacca

SEQ ID NO: 1065163 - DNA, 22 bp, Homo sapiens
attccatagtggaccacttgga

SEQ ID NO: 1065164 - DNA, 13 bp, Homo sapiens
attccatatttat

SEQ ID NO: 1065165 - DNA, 14 bp, Homo sapiens
attccatccatata

SEQ ID NO: 1065166 - DNA, 18 bp, Homo sapiens
attccatccatatacttt

SEQ ID NO: 1065167 - DNA, 13 bp, Homo sapiens
attccatcttgta

SEQ ID NO: 1065168 - DNA, 15 bp, Homo sapiens
attccatgaatgtat

SEQ ID NO: 1065169 - DNA, 23 bp, Homo sapiens
attccatgaatgtatcaggaaat

SEQ ID NO: 1065170 - DNA, 23 bp, Homo sapiens
attccatgaccagaaacagggac

SEQ ID NO: 1065171 - DNA, 16 bp, Homo sapiens
attccatgagctgctc

SEQ ID NO: 1065172 - DNA, 14 bp, Homo sapiens
attcccaccaaggt

SEQ ID NO: 1065173 - DNA, 18 bp, Homo sapiens
attcccactcaccagccc

SEQ ID NO: 1065174 - DNA, 23 bp, Homo sapiens
attcccactcaccagccctagct

SEQ ID NO: 1065175 - DNA, 14 bp, Homo sapiens
attcccactgccag

SEQ ID NO: 1065176 - DNA, 17 bp, Homo sapiens
attcccagactctgcct

SEQ ID NO: 1065177 - DNA, 19 bp, Homo sapiens
attcccagagacaggaaaa

SEQ ID NO: 1065178 - DNA, 17 bp, Homo sapiens
attcccagagcaaaata

SEQ ID NO: 1065179 - DNA, 15 bp, Homo sapiens
attcccagagtcaga

SEQ ID NO: 1065180 - DNA, 12 bp, Homo sapiens
attcccagccca

SEQ ID NO: 1065181 - DNA, 16 bp, Homo sapiens
attcccatggtggcct

SEQ ID NO: 1065182 - DNA, 18 bp, Homo sapiens
attcccatggtggcctca

SEQ ID NO: 1065183 - DNA, 15 bp, Homo sapiens
attccccatttcctg

SEQ ID NO: 1065184 - DNA, 21 bp, Homo sapiens
attcccccatgtggctgaaga

SEQ ID NO: 1065185 - DNA, 17 bp, Homo sapiens
attcccccccctttcct

SEQ ID NO: 1065186 - DNA, 20 bp, Homo sapiens
attcccccccctttcctaaa

SEQ ID NO: 1065187 - DNA, 17 bp, Homo sapiens
attccccctgccctgtg

SEQ ID NO: 1065188 - DNA, 15 bp, Homo sapiens
attcccctcccacct

SEQ ID NO: 1065189 - DNA, 14 bp, Homo sapiens
attcccctgtgtca

SEQ ID NO: 1065190 - DNA, 17 bp, Homo sapiens
attccctacagcctagg

SEQ ID NO: 1065191 - DNA, 17 bp, Homo sapiens
attccctagaaacttcc

SEQ ID NO: 1065192 - DNA, 13 bp, Homo sapiens
attccctcatcct

SEQ ID NO: 1065193 - DNA, 17 bp, Homo sapiens
attccctcatttaaacc

SEQ ID NO: 1065194 - DNA, 14 bp, Homo sapiens
attccctcctgcta

SEQ ID NO: 1065195 - DNA, 21 bp, Homo sapiens
attccctcctgctactctgtt

SEQ ID NO: 1065196 - DNA, 16 bp, Homo sapiens
attccctctcatctca

SEQ ID NO: 1065197 - DNA, 13 bp, Homo sapiens
attccctctcctg

SEQ ID NO: 1065198 - DNA, 20 bp, Homo sapiens
attccctgagtcaccaggaa

SEQ ID NO: 1065199 - DNA, 13 bp, Homo sapiens
attccctgcccaa

SEQ ID NO: 1065200 - DNA, 20 bp, Homo sapiens
attccctgcccaaaccctta

SEQ ID NO: 1065201 - DNA, 22 bp, Homo sapiens
attcccttaactctaaccctgt

SEQ ID NO: 1065202 - DNA, 17 bp, Homo sapiens
attcccttatcttttac

SEQ ID NO: 1065203 - DNA, 19 bp, Homo sapiens
attcccttatcttttactt

SEQ ID NO: 1065204 - DNA, 12 bp, Homo sapiens
attcccttcagg

SEQ ID NO: 1065205 - DNA, 16 bp, Homo sapiens
attcccttcctgttcc

SEQ ID NO: 1065206 - DNA, 19 bp, Homo sapiens
attcccttcctgttccctc

SEQ ID NO: 1065207 - DNA, 22 bp, Homo sapiens
attcccttcctgttccctcctg

SEQ ID NO: 1065208 - DNA, 23 bp, Homo sapiens
attcccttcctgttccctcctgg

SEQ ID NO: 1065209 - DNA, 18 bp, Homo sapiens
attccctttgacttcagc

SEQ ID NO: 1065210 - DNA, 16 bp, Homo sapiens
attccgagcattccag

SEQ ID NO: 1065211 - DNA, 17 bp, Homo sapiens
attccgagcattccagt

SEQ ID NO: 1065212 - DNA, 19 bp, Homo sapiens
attccgattagacctttat

SEQ ID NO: 1065213 - DNA, 19 bp, Homo sapiens
attcctaaaattatggaaa

SEQ ID NO: 1065214 - DNA, 19 bp, Homo sapiens
attcctaaatattttcaag

SEQ ID NO: 1065215 - DNA, 20 bp, Homo sapiens
attcctaacacagcatgtgt

SEQ ID NO: 1065216 - DNA, 21 bp, Homo sapiens
attcctaactagaattagtat

SEQ ID NO: 1065217 - DNA, 20 bp, Homo sapiens
attcctactgacaacattat

SEQ ID NO: 1065218 - DNA, 16 bp, Homo sapiens
attcctagaattaaac

SEQ ID NO: 1065219 - DNA, 22 bp, Homo sapiens
attctgtgtgttttcataataa

SEQ ID NO: 1065220 - DNA, 18 bp, Homo sapiens
attctgttccctgggctg

SEQ ID NO: 1065221 - DNA, 14 bp, Homo sapiens
attctgttgcttta

SEQ ID NO: 1065222 - DNA, 16 bp, Homo sapiens
attctgttgttccatt

SEQ ID NO: 1065223 - DNA, 17 bp, Homo sapiens
attctgttttcccccag

SEQ ID NO: 1065224 - DNA, 12 bp, Homo sapiens
attctgttttct

SEQ ID NO: 1065225 - DNA, 20 bp, Homo sapiens
attcttaaaatatatttcag

SEQ ID NO: 1065226 - DNA, 23 bp, Homo sapiens
attcttaaaatatatttcagata

SEQ ID NO: 1065227 - DNA, 20 bp, Homo sapiens
attcttaaaattcaagaaaa

SEQ ID NO: 1065228 - DNA, 16 bp, Homo sapiens
attcttaacaaactct

SEQ ID NO: 1065229 - DNA, 17 bp, Homo sapiens
attcttaacaaactctt

SEQ ID NO: 1065230 - DNA, 13 bp, Homo sapiens
attcttaagcact

SEQ ID NO: 1065231 - DNA, 17 bp, Homo sapiens
attcttaagcactttga

SEQ ID NO: 1065232 - DNA, 17 bp, Homo sapiens
attcttaattctctgca

SEQ ID NO: 1065233 - DNA, 20 bp, Homo sapiens
attcttacatatgatccagt

SEQ ID NO: 1065234 - DNA, 17 bp, Homo sapiens
attcttacatgttttct

SEQ ID NO: 1065235 - DNA, 22 bp, Homo sapiens
attcttatgtagcaggaaataa

SEQ ID NO: 1065236 - DNA, 17 bp, Homo sapiens
attcttcacctttgtaa

SEQ ID NO: 1065237 - DNA, 19 bp, Homo sapiens
attcttccacctcagcctc

SEQ ID NO: 1065238 - DNA, 15 bp, Homo sapiens
attcttccagaatgc

SEQ ID NO: 1065239 - DNA, 20 bp, Homo sapiens
attcttccatcatcactgta

SEQ ID NO: 1065240 - DNA, 17 bp, Homo sapiens
attcttcctagttttct

SEQ ID NO: 1065241 - DNA, 19 bp, Homo sapiens
attcttcctagttttctcc

SEQ ID NO: 1065242 - DNA, 16 bp, Homo sapiens
attcttcctctccttc

SEQ ID NO: 1065243 - DNA, 19 bp, Homo sapiens
attcttcctctccttccca

SEQ ID NO: 1065244 - DNA, 21 bp, Homo sapiens
attcttcctctccttcccaca

SEQ ID NO: 1065245 - DNA, 15 bp, Homo sapiens
attcttctaaagcac

SEQ ID NO: 1065246 - DNA, 19 bp, Homo sapiens
attcttctcataaatcttt

SEQ ID NO: 1065247 - DNA, 15 bp, Homo sapiens
attcttctctgttgt

SEQ ID NO: 1065248 - DNA, 15 bp, Homo sapiens
attcttctcttcctt

SEQ ID NO: 1065249 - DNA, 12 bp, Homo sapiens
attcttctcttg

SEQ ID NO: 1065250 - DNA, 17 bp, Homo sapiens
attcttctgagcactgt

SEQ ID NO: 1065251 - DNA, 18 bp, Homo sapiens
attcttctgtatttctag

SEQ ID NO: 1065252 - DNA, 22 bp, Homo sapiens
attcttctgtcaagcttactac

SEQ ID NO: 1065253 - DNA, 13 bp, Homo sapiens
attcttctgtcct

SEQ ID NO: 1065254 - DNA, 14 bp, Homo sapiens
attcttctgttctc

SEQ ID NO: 1065255 - DNA, 12 bp, Homo sapiens
attcttcttgct

SEQ ID NO: 1065256 - DNA, 14 bp, Homo sapiens
attcttctttcttt

SEQ ID NO: 1065257 - DNA, 15 bp, Homo sapiens
attcttcttttggca

SEQ ID NO: 1065258 - DNA, 22 bp, Homo sapiens
attcttgattttcaagctttca

SEQ ID NO: 1065259 - DNA, 19 bp, Homo sapiens
attcttgctgggcatactt

SEQ ID NO: 1065260 - DNA, 20 bp, Homo sapiens
attcttgctgggcatacttt

SEQ ID NO: 1065261 - DNA, 20 bp, Homo sapiens
attcttgctttagaaaacat

SEQ ID NO: 1065262 - DNA, 20 bp, Homo sapiens
attcttggaccatgccagat

SEQ ID NO: 1065263 - DNA, 21 bp, Homo sapiens
attcttggaccatgccagatt

SEQ ID NO: 1065264 - DNA, 18 bp, Homo sapiens
attcttgtgcttttcctg

SEQ ID NO: 1065265 - DNA, 18 bp, Homo sapiens
attcttgtgggagacagc

SEQ ID NO: 1065266 - DNA, 20 bp, Homo sapiens
attcttgtgggagacagcag

SEQ ID NO: 1065267 - DNA, 13 bp, Homo sapiens
attcttgtttgaa

SEQ ID NO: 1065268 - DNA, 21 bp, Homo sapiens
attcttgtttgaattcctcct

SEQ ID NO: 1065269 - DNA, 20 bp, Homo sapiens
attctttaaacaaatatgaa

SEQ ID NO: 1065270 - DNA, 16 bp, Homo sapiens
attctttataaaatgt

SEQ ID NO: 1065271 - DNA, 15 bp, Homo sapiens
attctttattctgcg

SEQ ID NO: 1065272 - DNA, 17 bp, Homo sapiens
attctttcacttgatgt

SEQ ID NO: 1065273 - DNA, 22 bp, Homo sapiens
attctttcacttgatgtttgtt

SEQ ID NO: 1065274 - DNA, 17 bp, Homo sapiens
attctttccattatgat

SEQ ID NO: 1065275 - DNA, 16 bp, Homo sapiens
attctttccatttgca

SEQ ID NO: 1065276 - DNA, 20 bp, Homo sapiens
attctttccatttgcatttg

SEQ ID NO: 1065277 - DNA, 13 bp, Homo sapiens
attctttccccag

SEQ ID NO: 1065278 - DNA, 21 bp, Homo sapiens
attctttccttctctgaaagt

SEQ ID NO: 1065279 - DNA, 16 bp, Homo sapiens
attctttctgttgaaa

SEQ ID NO: 1065280 - DNA, 20 bp, Homo sapiens
attctttctgttgaaaagca

SEQ ID NO: 1065281 - DNA, 14 bp, Homo sapiens
attctttgaaaaca

SEQ ID NO: 1065282 - DNA, 22 bp, Homo sapiens
attctttgaaaacagatgacca

SEQ ID NO: 1065283 - DNA, 19 bp, Homo sapiens
attctttgaacatgaacta

SEQ ID NO: 1065284 - DNA, 17 bp, Homo sapiens
attctttggtaattttt

SEQ ID NO: 1065285 - DNA, 14 bp, Homo sapiens
attctttgttctgt

SEQ ID NO: 1065286 - DNA, 22 bp, Homo sapiens
attcttttaaaaaattcttgta

SEQ ID NO: 1065287 - DNA, 20 bp, Homo sapiens
attcttttaaaattcaaaag

SEQ ID NO: 1065288 - DNA, 13 bp, Homo sapiens
attcttttaaata

SEQ ID NO: 1065289 - DNA, 19 bp, Homo sapiens
attcttttaaatatttgtg

SEQ ID NO: 1065290 - DNA, 14 bp, Homo sapiens
attcttttaaatta

SEQ ID NO: 1065291 - DNA, 17 bp, Homo sapiens
attcttttataaatatt

SEQ ID NO: 1065292 - DNA, 17 bp, Homo sapiens
attcttttcatcaaaaa

SEQ ID NO: 1065293 - DNA, 19 bp, Homo sapiens
attcttttccaagctcctt

SEQ ID NO: 1065294 - DNA, 15 bp, Homo sapiens
attcttttgaattgt

SEQ ID NO: 1065295 - DNA, 15 bp, Homo sapiens
attcttttgtttcca

SEQ ID NO: 1065296 - DNA, 20 bp, Homo sapiens
attctttttttctgtcagta

SEQ ID NO: 1065297 - DNA, 12 bp, Homo sapiens
attgaaaaaagt

SEQ ID NO: 1065298 - DNA, 17 bp, Homo sapiens
attgaaaaaagtggaaa

SEQ ID NO: 1065299 - DNA, 14 bp, Homo sapiens
attgaaaaaataga

SEQ ID NO: 1065300 - DNA, 20 bp, Homo sapiens
attgaaaagaagtagtgtct

SEQ ID NO: 1065301 - DNA, 21 bp, Homo sapiens
attgaaaatagtaaatgcttt

SEQ ID NO: 1065302 - DNA, 19 bp, Homo sapiens
attgaaagaacttaagtct

SEQ ID NO: 1065303 - DNA, 13 bp, Homo sapiens
attgaaagccaac

SEQ ID NO: 1065304 - DNA, 18 bp, Homo sapiens
attgaaaggcattctctg

SEQ ID NO: 1065305 - DNA, 14 bp, Homo sapiens
attgaaagtattca

SEQ ID NO: 1065306 - DNA, 16 bp, Homo sapiens
attgaaagtattcaga

SEQ ID NO: 1065307 - DNA, 22 bp, Homo sapiens
attgaaagtattcagaaattaa

SEQ ID NO: 1065308 - DNA, 14 bp, Homo sapiens
attgaaagttgctt

SEQ ID NO: 1065309 - DNA, 15 bp, Homo sapiens
attgaaagttgcttt

SEQ ID NO: 1065310 - DNA, 19 bp, Homo sapiens
attgaaagttgcttttatt

SEQ ID NO: 1065311 - DNA, 17 bp, Homo sapiens
attgaaataaggaggga

SEQ ID NO: 1065312 - DNA, 14 bp, Homo sapiens
attgaaatactttt

SEQ ID NO: 1065313 - DNA, 16 bp, Homo sapiens
attgaaatgactaaaa

SEQ ID NO: 1065314 - DNA, 17 bp, Homo sapiens
attgaaatttactgtga

SEQ ID NO: 1065315 - DNA, 14 bp, Homo sapiens
attgaacacaaact

SEQ ID NO: 1065316 - DNA, 15 bp, Homo sapiens
attgaacacaaactg

SEQ ID NO: 1065317 - DNA, 17 bp, Homo sapiens
attgaacacaaactgta

SEQ ID NO: 1065318 - DNA, 20 bp, Homo sapiens
attgaacgactgtatattgc

SEQ ID NO: 1065319 - DNA, 23 bp, Homo sapiens
attgaacgactgtatattgctaa

SEQ ID NO: 1065320 - DNA, 22 bp, Homo sapiens
attgaactgtattctagtggct

SEQ ID NO: 1065321 - DNA, 14 bp, Homo sapiens
attgaacttaaatg

SEQ ID NO: 1065322 - DNA, 22 bp, Homo sapiens
attgaacttactgtagcctcag

SEQ ID NO: 1065323 - DNA, 16 bp, Homo sapiens
attgaacttgaaatct

SEQ ID NO: 1065324 - DNA, 18 bp, Homo sapiens
attgaacttttgtactga

SEQ ID NO: 1065325 - DNA, 15 bp, Homo sapiens
attgaagaactgcac

SEQ ID NO: 1065326 - DNA, 18 bp, Homo sapiens
attgaagaactgcacttt

SEQ ID NO: 1065327 - DNA, 17 bp, Homo sapiens
attgaagaatctgcccc

SEQ ID NO: 1065328 - DNA, 19 bp, Homo sapiens
attgaagacaatttgatac

SEQ ID NO: 1065329 - DNA, 20 bp, Homo sapiens
attgaagcaactacaacttc

SEQ ID NO: 1065330 - DNA, 22 bp, Homo sapiens
attgaagcaactacaacttctc

SEQ ID NO: 1065331 - DNA, 15 bp, Homo sapiens
attgaagccctccaa

SEQ ID NO: 1065332 - DNA, 22 bp, Homo sapiens
attgaagccgactctggccctg

SEQ ID NO: 1065333 - DNA, 12 bp, Homo sapiens
attgaaggaatt

SEQ ID NO: 1065334 - DNA, 16 bp, Homo sapiens
attgaagtaaactttt

SEQ ID NO: 1065335 - DNA, 18 bp, Homo sapiens
attgaagttgtttatcaa

SEQ ID NO: 1065336 - DNA, 16 bp, Homo sapiens
attgaagtttcaagtt

SEQ ID NO: 1065337 - DNA, 20 bp, Homo sapiens
attgaagtttcaagttttaa

SEQ ID NO: 1065338 - DNA, 19 bp, Homo sapiens
attgaataaagttgaagct

SEQ ID NO: 1065339 - DNA, 22 bp, Homo sapiens
attgaataagtggcatactttt

SEQ ID NO: 1065340 - DNA, 22 bp, Homo sapiens
attgaatatatcagaatctgtg

SEQ ID NO: 1065341 - DNA, 20 bp, Homo sapiens
attgaatcagtataaacaaa

SEQ ID NO: 1065342 - DNA, 10 bp, Homo sapiens
attgaatcta

SEQ ID NO: 1065343 - DNA, 17 bp, Homo sapiens
attctatttttgtcctt

SEQ ID NO: 1065344 - DNA, 19 bp, Homo sapiens
attctatttttgtccttgc

SEQ ID NO: 1065345 - DNA, 19 bp, Homo sapiens
attctcaaagatgcatttt

SEQ ID NO: 1065346 - DNA, 17 bp, Homo sapiens
attctcaaaggagcgag

SEQ ID NO: 1065347 - DNA, 12 bp, Homo sapiens
attctcacaata

SEQ ID NO: 1065348 - DNA, 13 bp, Homo sapiens
attctcaccagga

SEQ ID NO: 1065349 - DNA, 16 bp, Homo sapiens
attctcaccaggaagg

SEQ ID NO: 1065350 - DNA, 14 bp, Homo sapiens
attctcactccacc

SEQ ID NO: 1065351 - DNA, 15 bp, Homo sapiens
attctcactccacca

SEQ ID NO: 1065352 - DNA, 18 bp, Homo sapiens
attctcagaatctcaaat

SEQ ID NO: 1065353 - DNA, 20 bp, Homo sapiens
attctcagaatctcaaataa

SEQ ID NO: 1065354 - DNA, 17 bp, Homo sapiens
attctcagagcatgtgt

SEQ ID NO: 1065355 - DNA, 16 bp, Homo sapiens
attctcataattccta

SEQ ID NO: 1065356 - DNA, 22 bp, Homo sapiens
attctcataattcctacagcac

SEQ ID NO: 1065357 - DNA, 15 bp, Homo sapiens
attctcatctgcacc

SEQ ID NO: 1065358 - DNA, 14 bp, Homo sapiens
attgaatctgattg

SEQ ID NO: 1065359 - DNA, 23 bp, Homo sapiens
attgaatctgattggacattttc

SEQ ID NO: 1065360 - DNA, 21 bp, Homo sapiens
attgaatggctatgtttttaa

SEQ ID NO: 1065361 - DNA, 22 bp, Homo sapiens
attgaatggctatgtttttaat

SEQ ID NO: 1065362 - DNA, 14 bp, Homo sapiens
attgaattagaaaa

SEQ ID NO: 1065363 - DNA, 16 bp, Homo sapiens
attgaattagaaaatt

SEQ ID NO: 1065364 - DNA, 13 bp, Homo sapiens
attgaattatctt

SEQ ID NO: 1065365 - DNA, 21 bp, Homo sapiens
attgaattatcttggttgaaa

SEQ ID NO: 1065366 - DNA, 12 bp, Homo sapiens
attgaattcatt

SEQ ID NO: 1065367 - DNA, 13 bp, Homo sapiens
attgaattcatta

SEQ ID NO: 1065368 - DNA, 16 bp, Homo sapiens
attgaattcattataa

SEQ ID NO: 1065369 - DNA, 23 bp, Homo sapiens
attgaattcttggttgaggaaac

SEQ ID NO: 1065370 - DNA, 22 bp, Homo sapiens
attgaatttgcacggtttgtga

SEQ ID NO: 1065371 - DNA, 15 bp, Homo sapiens
attgaatttgttaga

SEQ ID NO: 1065372 - DNA, 23 bp, Homo sapiens
attgaatttttcctatgctattg

SEQ ID NO: 1065373 - DNA, 12 bp, Homo sapiens
attgacaaaaaa

SEQ ID NO: 1065374 - DNA, 15 bp, Homo sapiens
attgacaagaactga

SEQ ID NO: 1065375 - DNA, 17 bp, Homo sapiens
attgacaataaaatatt

SEQ ID NO: 1065376 - DNA, 18 bp, Homo sapiens
attgacaataaaatatta

SEQ ID NO: 1065377 - DNA, 18 bp, Homo sapiens
attgacacagtaccattt

SEQ ID NO: 1065378 - DNA, 15 bp, Homo sapiens
attgacactgaactt

SEQ ID NO: 1065379 - DNA, 16 bp, Homo sapiens
attgacactgaactta

SEQ ID NO: 1065380 - DNA, 17 bp, Homo sapiens
attgacatgatatacaa

SEQ ID NO: 1065381 - DNA, 17 bp, Homo sapiens
attgacatttgtagttg

SEQ ID NO: 1065382 - DNA, 18 bp, Homo sapiens
attgaccaagaactgcat

SEQ ID NO: 1065383 - DNA, 23 bp, Homo sapiens
attgaccgcgactaatttcaaaa

SEQ ID NO: 1065384 - DNA, 20 bp, Homo sapiens
attgacctagttcagataca

SEQ ID NO: 1065385 - DNA, 13 bp, Homo sapiens
attgacctcagct

SEQ ID NO: 1065386 - DNA, 17 bp, Homo sapiens
attgacctgaggagaca

SEQ ID NO: 1065387 - DNA, 20 bp, Homo sapiens
attgacctttaggtattaca

SEQ ID NO: 1065388 - DNA, 21 bp, Homo sapiens
attgacgacaagtgctgaaca

SEQ ID NO: 1065389 - DNA, 14 bp, Homo sapiens
attgactaaataaa

SEQ ID NO: 1065390 - DNA, 18 bp, Homo sapiens
attgactatcaaactgaa

SEQ ID NO: 1065391 - DNA, 22 bp, Homo sapiens
attgactcaaatctccagtatt

SEQ ID NO: 1065392 - DNA, 13 bp, Homo sapiens
attgactctcaca

SEQ ID NO: 1065393 - DNA, 13 bp, Homo sapiens
attgactgcagtt

SEQ ID NO: 1065394 - DNA, 23 bp, Homo sapiens
attgactgggcaacactgcagga

SEQ ID NO: 1065395 - DNA, 21 bp, Homo sapiens
attgactggtttacaggccct

SEQ ID NO: 1065396 - DNA, 20 bp, Homo sapiens
attgacttagatattaaaat

SEQ ID NO: 1065397 - DNA, 13 bp, Homo sapiens
attgactttatgt

SEQ ID NO: 1065398 - DNA, 17 bp, Homo sapiens
attgactttcttaaaaa

SEQ ID NO: 1065399 - DNA, 17 bp, Homo sapiens
attgagactttcttcta

SEQ ID NO: 1065400 - DNA, 22 bp, Homo sapiens
attgagagaatggaaaacagac

SEQ ID NO: 1065401 - DNA, 14 bp, Homo sapiens
attgagagttttgt

SEQ ID NO: 1065402 - DNA, 19 bp, Homo sapiens
attgagattagagggaggt

SEQ ID NO: 1065403 - DNA, 22 bp, Homo sapiens
attgagccttgcatgtacttga

SEQ ID NO: 1065404 - DNA, 23 bp, Homo sapiens
attgagccttgcatgtacttgaa

SEQ ID NO: 1065405 - DNA, 22 bp, Homo sapiens
attgaggagagggactgaatag

SEQ ID NO: 1065406 - DNA, 14 bp, Homo sapiens
attgaggagctgca

SEQ ID NO: 1065407 - DNA, 16 bp, Homo sapiens
attgaggagctgcact

SEQ ID NO: 1065408 - DNA, 20 bp, Homo sapiens
attgaggataaaaaggaagg

SEQ ID NO: 1065409 - DNA, 17 bp, Homo sapiens
attgaggccaagaatat

SEQ ID NO: 1065410 - DNA, 20 bp, Homo sapiens
attgagggccagtgatgatg

SEQ ID NO: 1065411 - DNA, 22 bp, Homo sapiens
attgagggccagtgatgatgtt

SEQ ID NO: 1065412 - DNA, 20 bp, Homo sapiens
attgagggtcattctttatt

SEQ ID NO: 1065413 - DNA, 19 bp, Homo sapiens
attgaggttgtgggccttc

SEQ ID NO: 1065414 - DNA, 19 bp, Homo sapiens
attgagtaatggtgtagaa

SEQ ID NO: 1065415 - DNA, 15 bp, Homo sapiens
attgagtcaaatggt

SEQ ID NO: 1065416 - DNA, 18 bp, Homo sapiens
attgagtcttaactgtat

SEQ ID NO: 1065417 - DNA, 19 bp, Homo sapiens
attgagtcttaactgtatt

SEQ ID NO: 1065418 - DNA, 20 bp, Homo sapiens
attgagtcttaactgtattt

SEQ ID NO: 1065419 - DNA, 17 bp, Homo sapiens
attgagttccagttgaa

SEQ ID NO: 1065420 - DNA, 20 bp, Homo sapiens
attgagttcttcctgtaatc

SEQ ID NO: 1065421 - DNA, 22 bp, Homo sapiens
attgagttcttcctgtaatctt

SEQ ID NO: 1065422 - DNA, 13 bp, Homo sapiens
attgagttggaat

SEQ ID NO: 1065423 - DNA, 15 bp, Homo sapiens
attgagttttcagtg

SEQ ID NO: 1065424 - DNA, 17 bp, Homo sapiens
attgataatcttcaggt

SEQ ID NO: 1065425 - DNA, 21 bp, Homo sapiens
attgatacttcaggtgctttt

SEQ ID NO: 1065426 - DNA, 13 bp, Homo sapiens
attgatagaacta

SEQ ID NO: 1065427 - DNA, 17 bp, Homo sapiens
attgatagaagaatatc

SEQ ID NO: 1065428 - DNA, 18 bp, Homo sapiens
attgatagagtgttatca

SEQ ID NO: 1065429 - DNA, 20 bp, Homo sapiens
attgatatctccatgatgat

SEQ ID NO: 1065430 - DNA, 20 bp, Homo sapiens
attgatattcaataaagcag

SEQ ID NO: 1065431 - DNA, 21 bp, Homo sapiens
attgatcaaatatagaaagtt

SEQ ID NO: 1065432 - DNA, 17 bp, Homo sapiens
attgatcacacagtgtt

SEQ ID NO: 1065433 - DNA, 20 bp, Homo sapiens
attgatcattttccccccac

SEQ ID NO: 1065434 - DNA, 22 bp, Homo sapiens
attgatcccttctcctgccctt

SEQ ID NO: 1065435 - DNA, 21 bp, Homo sapiens
attgatcctttgatcccagaa

SEQ ID NO: 1065436 - DNA, 13 bp, Homo sapiens
attgatctttttt

SEQ ID NO: 1065437 - DNA, 15 bp, Homo sapiens
attgatcttttttaa

SEQ ID NO: 1065438 - DNA, 16 bp, Homo sapiens
attgatcttttttaat

SEQ ID NO: 1065439 - DNA, 18 bp, Homo sapiens
attgatgaagatgtttat

SEQ ID NO: 1065440 - DNA, 13 bp, Homo sapiens
attgatgcaatat

SEQ ID NO: 1065441 - DNA, 12 bp, Homo sapiens
attgatgtacag

SEQ ID NO: 1065442 - DNA, 13 bp, Homo sapiens
attgatgtacaga

SEQ ID NO: 1065443 - DNA, 22 bp, Homo sapiens
attgatgtacagtctgtcatga

SEQ ID NO: 1065444 - DNA, 14 bp, Homo sapiens
attgatgtatatgt

SEQ ID NO: 1065445 - DNA, 19 bp, Homo sapiens
attgatgttttacgtgcaa

SEQ ID NO: 1065446 - DNA, 23 bp, Homo sapiens
attgatgttttacgtgcaaacaa

SEQ ID NO: 1065447 - DNA, 16 bp, Homo sapiens
attgattcagtatctt

SEQ ID NO: 1065448 - DNA, 23 bp, Homo sapiens
attgattctgaaatttttttcct

SEQ ID NO: 1065449 - DNA, 16 bp, Homo sapiens
attgattgtattgttg

SEQ ID NO: 1065450 - DNA, 13 bp, Homo sapiens
attgatttaaaag

SEQ ID NO: 1065451 - DNA, 15 bp, Homo sapiens
attgatttaaaattg

SEQ ID NO: 1065452 - DNA, 21 bp, Homo sapiens
attgatttaaaattgttctac

SEQ ID NO: 1065453 - DNA, 16 bp, Homo sapiens
attgatttcaagacct

SEQ ID NO: 1065454 - DNA, 16 bp, Homo sapiens
attgatttttctcttc

SEQ ID NO: 1065455 - DNA, 18 bp, Homo sapiens
attgatttttctcttcat

SEQ ID NO: 1065456 - DNA, 16 bp, Homo sapiens
attgcaaaatacatga

SEQ ID NO: 1065457 - DNA, 17 bp, Homo sapiens
attgcaaaatacatgaa

SEQ ID NO: 1065458 - DNA, 19 bp, Homo sapiens
attgcaaaatacatgaagc

SEQ ID NO: 1065459 - DNA, 10 bp, Homo sapiens
attgcaaagt

SEQ ID NO: 1065460 - DNA, 12 bp, Homo sapiens
attgcaaatctt

SEQ ID NO: 1065461 - DNA, 20 bp, Homo sapiens
attgcaactcttttaagtgc

SEQ ID NO: 1065462 - DNA, 23 bp, Homo sapiens
attgcaagaagctttatttctag

SEQ ID NO: 1065463 - DNA, 13 bp, Homo sapiens
attgcaattaaac

SEQ ID NO: 1065464 - DNA, 15 bp, Homo sapiens
attgcacagaatttg

SEQ ID NO: 1065465 - DNA, 23 bp, Homo sapiens
attgcacagagcacacttattta

SEQ ID NO: 1065466 - DNA, 14 bp, Homo sapiens
attgcacattgttc

SEQ ID NO: 1065467 - DNA, 19 bp, Homo sapiens
attgcacctatctcagcca

SEQ ID NO: 1065468 - DNA, 19 bp, Homo sapiens
attgcacgtggcctcttga

SEQ ID NO: 1065469 - DNA, 23 bp, Homo sapiens
attgcacgtggcctcttgagcag

SEQ ID NO: 1065470 - DNA, 11 bp, Homo sapiens
attgcactagg

SEQ ID NO: 1065471 - DNA, 14 bp, Homo sapiens
attgcactaggaat

SEQ ID NO: 1065472 - DNA, 22 bp, Homo sapiens
attgcactaggaattctttgca

SEQ ID NO: 1065473 - DNA, 17 bp, Homo sapiens
attgcactcatcatatt

SEQ ID NO: 1065474 - DNA, 15 bp, Homo sapiens
attgcactgctgttc

SEQ ID NO: 1065475 - DNA, 16 bp, Homo sapiens
attgcactttataaac

SEQ ID NO: 1065476 - DNA, 19 bp, Homo sapiens
attgcactttataaacact

SEQ ID NO: 1065477 - DNA, 14 bp, Homo sapiens
attgcagacctgtc

SEQ ID NO: 1065478 - DNA, 21 bp, Homo sapiens
attgcagcagacccagcagca

SEQ ID NO: 1065479 - DNA, 23 bp, Homo sapiens
attgcagccttgcgctgtcccag

SEQ ID NO: 1065480 - DNA, 14 bp, Homo sapiens
attgcagctttatg

SEQ ID NO: 1065481 - DNA, 21 bp, Homo sapiens
attgcagttcaaatcctcacc

SEQ ID NO: 1065482 - DNA, 14 bp, Homo sapiens
attgcagtttatca

SEQ ID NO: 1065483 - DNA, 17 bp, Homo sapiens
attgcagtttatcattc

SEQ ID NO: 1065484 - DNA, 16 bp, Homo sapiens
attgcagtttcatgta

SEQ ID NO: 1065485 - DNA, 23 bp, Homo sapiens
attgcagtttcatgtatgtatat

SEQ ID NO: 1065486 - DNA, 16 bp, Homo sapiens
attgcatataacttat

SEQ ID NO: 1065487 - DNA, 22 bp, Homo sapiens
attgcatataacttatattgta

SEQ ID NO: 1065488 - DNA, 17 bp, Homo sapiens
attgcatatagatttag

SEQ ID NO: 1065489 - DNA, 16 bp, Homo sapiens
attgcatcctgctggg

SEQ ID NO: 1065490 - DNA, 19 bp, Homo sapiens
attgcatctcaaaattatt

SEQ ID NO: 1065491 - DNA, 15 bp, Homo sapiens
attgcatctcccaga

SEQ ID NO: 1065492 - DNA, 22 bp, Homo sapiens
attgcatctgggtagctgtaag

SEQ ID NO: 1065493 - DNA, 13 bp, Homo sapiens
attgcatctgtat

SEQ ID NO: 1065494 - DNA, 15 bp, Homo sapiens
attgcatctgtataa

SEQ ID NO: 1065495 - DNA, 11 bp, Homo sapiens
attgcattgac

SEQ ID NO: 1065496 - DNA, 14 bp, Homo sapiens
attgcattgctggt

SEQ ID NO: 1065497 - DNA, 15 bp, Homo sapiens
attgcatttctgctc

SEQ ID NO: 1065498 - DNA, 14 bp, Homo sapiens
attgccaagggctt

SEQ ID NO: 1065499 - DNA, 19 bp, Homo sapiens
attgccaggagatggcccc

SEQ ID NO: 1065500 - DNA, 22 bp, Homo sapiens
attgccatattaaaatctgatg

SEQ ID NO: 1065501 - DNA, 18 bp, Homo sapiens
attgcccatccatctgct

SEQ ID NO: 1065502 - DNA, 14 bp, Homo sapiens
attgccccagagcc

SEQ ID NO: 1065503 - DNA, 19 bp, Homo sapiens
attgccccagagccccact

SEQ ID NO: 1065504 - DNA, 17 bp, Homo sapiens
attgccctatgctgtgc

SEQ ID NO: 1065505 - DNA, 11 bp, Homo sapiens
attgccctggt

SEQ ID NO: 1065506 - DNA, 23 bp, Homo sapiens
attgcctagaaatatctttctct

SEQ ID NO: 1065507 - DNA, 15 bp, Homo sapiens
attgcctataatact

SEQ ID NO: 1065508 - DNA, 15 bp, Homo sapiens
attgcctgcagagag

SEQ ID NO: 1065509 - DNA, 12 bp, Homo sapiens
attgcctgttaa

SEQ ID NO: 1065510 - DNA, 16 bp, Homo sapiens
attgcctgttaaatat

SEQ ID NO: 1065511 - DNA, 21 bp, Homo sapiens
attgccttatttgtctgtaaa

SEQ ID NO: 1065512 - DNA, 16 bp, Homo sapiens
attgccttcgctccat

SEQ ID NO: 1065513 - DNA, 17 bp, Homo sapiens
attgcgccattgcactc

SEQ ID NO: 1065514 - DNA, 17 bp, Homo sapiens
attgcgcctttgtatta

SEQ ID NO: 1065515 - DNA, 19 bp, Homo sapiens
attgcgcctttgtattata

SEQ ID NO: 1065516 - DNA, 17 bp, Homo sapiens
attgctagataaaagct

SEQ ID NO: 1065517 - DNA, 15 bp, Homo sapiens
attgctaggagctcc

SEQ ID NO: 1065518 - DNA, 20 bp, Homo sapiens
attgctatcgccctcctttc

SEQ ID NO: 1065519 - DNA, 18 bp, Homo sapiens
attgctatgttactattt

SEQ ID NO: 1065520 - DNA, 21 bp, Homo sapiens
attgctattttatttgtattc

SEQ ID NO: 1065521 - DNA, 21 bp, Homo sapiens
attgctcctcccacttctcaa

SEQ ID NO: 1065522 - DNA, 20 bp, Homo sapiens
attgctcgcccagacaccat

SEQ ID NO: 1065523 - DNA, 22 bp, Homo sapiens
attgctcgcccagacaccatgt

SEQ ID NO: 1065524 - DNA, 13 bp, Homo sapiens
attgctctgcccc

SEQ ID NO: 1065525 - DNA, 21 bp, Homo sapiens
attgctctgccccaccttgcc

SEQ ID NO: 1065526 - DNA, 12 bp, Homo sapiens
attgctctggag

SEQ ID NO: 1065527 - DNA, 18 bp, Homo sapiens
attgctgaaaatggtatt

SEQ ID NO: 1065528 - DNA, 12 bp, Homo sapiens
attgctgaaatt

SEQ ID NO: 1065529 - DNA, 22 bp, Homo sapiens
attgctgaactcttaggcacat

SEQ ID NO: 1065530 - DNA, 17 bp, Homo sapiens
attgctgagaagcaaac

SEQ ID NO: 1065531 - DNA, 16 bp, Homo sapiens
attgctgagcctctgc

SEQ ID NO: 1065532 - DNA, 23 bp, Homo sapiens
attgctgagcctctgctccccag

SEQ ID NO: 1065533 - DNA, 15 bp, Homo sapiens
attgctgccaaaacc

SEQ ID NO: 1065534 - DNA, 18 bp, Homo sapiens
attgctgccaaaaccaca

SEQ ID NO: 1065535 - DNA, 20 bp, Homo sapiens
attgctgccaaaaccacatg

SEQ ID NO: 1065536 - DNA, 12 bp, Homo sapiens
attgctgcttga

SEQ ID NO: 1065537 - DNA, 18 bp, Homo sapiens
attgctggaacccaggag

SEQ ID NO: 1065538 - DNA, 12 bp, Homo sapiens
attgctggacta

SEQ ID NO: 1065539 - DNA, 22 bp, Homo sapiens
attgctggtagagacccccagg

SEQ ID NO: 1065540 - DNA, 21 bp, Homo sapiens
attgctggttctatttaatgg

SEQ ID NO: 1065541 - DNA, 22 bp, Homo sapiens
attgctgtaccacatctgctct

SEQ ID NO: 1065542 - DNA, 13 bp, Homo sapiens
attgctgtctggt

SEQ ID NO: 1065543 - DNA, 16 bp, Homo sapiens
attgctgtctggtgag

SEQ ID NO: 1065544 - DNA, 19 bp, Homo sapiens
attgctgtcttgccccagt

SEQ ID NO: 1065545 - DNA, 21 bp, Homo sapiens
attgctgtgtctcctctcaga

SEQ ID NO: 1065546 - DNA, 17 bp, Homo sapiens
attgcttaatttctgcc

SEQ ID NO: 1065547 - DNA, 14 bp, Homo sapiens
attgcttacatttt

SEQ ID NO: 1065548 - DNA, 19 bp, Homo sapiens
attgcttacatttttacaa

SEQ ID NO: 1065549 - DNA, 15 bp, Homo sapiens
attgcttcaattaaa

SEQ ID NO: 1065550 - DNA, 15 bp, Homo sapiens
attgcttcctgatta

SEQ ID NO: 1065551 - DNA, 18 bp, Homo sapiens
attgcttgagcccaggag

SEQ ID NO: 1065552 - DNA, 13 bp, Homo sapiens
attgctttctgaa

SEQ ID NO: 1065553 - DNA, 17 bp, Homo sapiens
attgctttctgaaatta

SEQ ID NO: 1065554 - DNA, 13 bp, Homo sapiens
attgctttgaagc

SEQ ID NO: 1065555 - DNA, 21 bp, Homo sapiens
attgctttgctgcacagcagg

SEQ ID NO: 1065556 - DNA, 21 bp, Homo sapiens
attgctttgtattgtatatta

SEQ ID NO: 1065557 - DNA, 19 bp, Homo sapiens
attgcttttgttgtgactt

SEQ ID NO: 1065558 - DNA, 23 bp, Homo sapiens
attgctttttcctctcattgtct

SEQ ID NO: 1065559 - DNA, 13 bp, Homo sapiens
attggaaagacag

SEQ ID NO: 1065560 - DNA, 15 bp, Homo sapiens
attggaaagacagga

SEQ ID NO: 1065561 - DNA, 17 bp, Homo sapiens
attggaaagacaggaag

SEQ ID NO: 1065562 - DNA, 22 bp, Homo sapiens
attggaaagacaggaagaccaa

SEQ ID NO: 1065563 - DNA, 22 bp, Homo sapiens
attggaaatgtgaatcgcagct

SEQ ID NO: 1065564 - DNA, 18 bp, Homo sapiens
attggaagaaattcctgt

SEQ ID NO: 1065565 - DNA, 21 bp, Homo sapiens
attggaagtgttcaagaaata

SEQ ID NO: 1065566 - DNA, 18 bp, Homo sapiens
attggaatctgatatact

SEQ ID NO: 1065567 - DNA, 21 bp, Homo sapiens
attggaatggaactactgtac

SEQ ID NO: 1065568 - DNA, 22 bp, Homo sapiens
attggaatggaactactgtact

SEQ ID NO: 1065569 - DNA, 18 bp, Homo sapiens
attggaatgttctcagat

SEQ ID NO: 1065570 - DNA, 15 bp, Homo sapiens
attggaattaacctg

SEQ ID NO: 1065571 - DNA, 18 bp, Homo sapiens
attggaattctactggaa

SEQ ID NO: 1065572 - DNA, 21 bp, Homo sapiens
attggaatttctggcctccta

SEQ ID NO: 1065573 - DNA, 15 bp, Homo sapiens
attggaccaggccat

SEQ ID NO: 1065574 - DNA, 18 bp, Homo sapiens
attggacggtttctagcc

SEQ ID NO: 1065575 - DNA, 22 bp, Homo sapiens
attggacggtttctagcctctg

SEQ ID NO: 1065576 - DNA, 14 bp, Homo sapiens
attggagaatactt

SEQ ID NO: 1065577 - DNA, 18 bp, Homo sapiens
attggagcacctgggccc

SEQ ID NO: 1065578 - DNA, 14 bp, Homo sapiens
attggagctgaaga

SEQ ID NO: 1065579 - DNA, 22 bp, Homo sapiens
attggagggtaaatgatgtggt

SEQ ID NO: 1065580 - DNA, 19 bp, Homo sapiens
attggaggtgagatcacag

SEQ ID NO: 1065581 - DNA, 22 bp, Homo sapiens
attggatattttttactttaga

SEQ ID NO: 1065582 - DNA, 20 bp, Homo sapiens
attggattgcgcctttgtat

SEQ ID NO: 1065583 - DNA, 23 bp, Homo sapiens
attggattgcgcctttgtattat

SEQ ID NO: 1065584 - DNA, 22 bp, Homo sapiens
attggatttcctaatactgtca

SEQ ID NO: 1065585 - DNA, 23 bp, Homo sapiens
attggatttcctaatactgtcat

SEQ ID NO: 1065586 - DNA, 15 bp, Homo sapiens
attggatttgctgtg

SEQ ID NO: 1065587 - DNA, 13 bp, Homo sapiens
attggcaaaacta

SEQ ID NO: 1065588 - DNA, 18 bp, Homo sapiens
attggcaagtaacttctg

SEQ ID NO: 1065589 - DNA, 17 bp, Homo sapiens
attggcagccaaggaat

SEQ ID NO: 1065590 - DNA, 19 bp, Homo sapiens
attggcagccaaggaatgt

SEQ ID NO: 1065591 - DNA, 23 bp, Homo sapiens
attggcagccaaggaatgtgtcc

SEQ ID NO: 1065592 - DNA, 15 bp, Homo sapiens
attggcagtgacttt

SEQ ID NO: 1065593 - DNA, 17 bp, Homo sapiens
attggcagtgactttgt

SEQ ID NO: 1065594 - DNA, 21 bp, Homo sapiens
attggcatggaaatttaaagc

SEQ ID NO: 1065595 - DNA, 22 bp, Homo sapiens
attggcatggaaatttaaagca

SEQ ID NO: 1065596 - DNA, 20 bp, Homo sapiens
attggccagtgagaagctga

SEQ ID NO: 1065597 - DNA, 16 bp, Homo sapiens
attggcccaacactgt

SEQ ID NO: 1065598 - DNA, 20 bp, Homo sapiens
attggcctgtagagttgctg

SEQ ID NO: 1065599 - DNA, 21 bp, Homo sapiens
attggcctgtagagttgctga

SEQ ID NO: 1065600 - DNA, 22 bp, Homo sapiens
attggcctgtagagttgctgag

SEQ ID NO: 1065601 - DNA, 22 bp, Homo sapiens
attggctagaggttcaaagata

SEQ ID NO: 1065602 - DNA, 23 bp, Homo sapiens
atttatatcttgttattaatgtt

SEQ ID NO: 1065603 - DNA, 17 bp, Homo sapiens
atttatatgcttcacat

SEQ ID NO: 1065604 - DNA, 20 bp, Homo sapiens
atttatatggggaatatatt

SEQ ID NO: 1065605 - DNA, 23 bp, Homo sapiens
atttatattccgtatttaaagtt

SEQ ID NO: 1065606 - DNA, 18 bp, Homo sapiens
atttatattgtaaatatt

SEQ ID NO: 1065607 - DNA, 20 bp, Homo sapiens
atttatattgtaaatattgt

SEQ ID NO: 1065608 - DNA, 22 bp, Homo sapiens
atttatattgtatattctggaa

SEQ ID NO: 1065609 - DNA, 13 bp, Homo sapiens
atttatatttcac

SEQ ID NO: 1065610 - DNA, 18 bp, Homo sapiens
atttatatttggaaagag

SEQ ID NO: 1065611 - DNA, 15 bp, Homo sapiens
atttatcagtgacag

SEQ ID NO: 1065612 - DNA, 23 bp, Homo sapiens
atttatcagtgacagagttcact

SEQ ID NO: 1065613 - DNA, 17 bp, Homo sapiens
atttatccaaaatgtgt

SEQ ID NO: 1065614 - DNA, 14 bp, Homo sapiens
atttatccctttcc

SEQ ID NO: 1065615 - DNA, 21 bp, Homo sapiens
atttatcctataagatgacaa

SEQ ID NO: 1065616 - DNA, 20 bp, Homo sapiens
atttatcctcacataaaaaa

SEQ ID NO: 1065617 - DNA, 18 bp, Homo sapiens
atttatcctgaaatttca

SEQ ID NO: 1065618 - DNA, 19 bp, Homo sapiens
atttatcctgaaatttcag

SEQ ID NO: 1065619 - DNA, 20 bp, Homo sapiens
atttatcctgaaatttcaga

SEQ ID NO: 1065620 - DNA, 15 bp, Homo sapiens
atttatctaaatatg

SEQ ID NO: 1065621 - DNA, 17 bp, Homo sapiens
atttatctaaatatgga

SEQ ID NO: 1065622 - DNA, 19 bp, Homo sapiens
atttatctctatttaatat

SEQ ID NO: 1065623 - DNA, 20 bp, Homo sapiens
atttatctgggattatggtt

SEQ ID NO: 1065624 - DNA, 20 bp, Homo sapiens
atttatctgtgtttttgaaa

SEQ ID NO: 1065625 - DNA, 19 bp, Homo sapiens
atttatcttgtctctgggc

SEQ ID NO: 1065626 - DNA, 22 bp, Homo sapiens
atttatctttacttttaaacag

SEQ ID NO: 1065627 - DNA, 17 bp, Homo sapiens
atttatctttatacaga

SEQ ID NO: 1065628 - DNA, 13 bp, Homo sapiens
atttatgaaaaga

SEQ ID NO: 1065629 - DNA, 17 bp, Homo sapiens
atttatgaagcagattt

SEQ ID NO: 1065630 - DNA, 13 bp, Homo sapiens
atttatgaatata

SEQ ID NO: 1065631 - DNA, 21 bp, Homo sapiens
atttatgaattgtctaaagtt

SEQ ID NO: 1065632 - DNA, 15 bp, Homo sapiens
atttatgagtttttg

SEQ ID NO: 1065633 - DNA, 18 bp, Homo sapiens
atttatgagtttttgata

SEQ ID NO: 1065634 - DNA, 17 bp, Homo sapiens
atttatgcaagttaggg

SEQ ID NO: 1065635 - DNA, 14 bp, Homo sapiens
atttatgcatttca

SEQ ID NO: 1065636 - DNA, 16 bp, Homo sapiens
atttatgcatttcatt

SEQ ID NO: 1065637 - DNA, 20 bp, Homo sapiens
atttatgcctctgtatttaa

SEQ ID NO: 1065638 - DNA, 19 bp, Homo sapiens
atttatgcttaaaatatgt

SEQ ID NO: 1065639 - DNA, 20 bp, Homo sapiens
atttatgcttaaaatatgta

SEQ ID NO: 1065640 - DNA, 22 bp, Homo sapiens
atttatggattaaaaactgctt

SEQ ID NO: 1065641 - DNA, 12 bp, Homo sapiens
atttatgtaaac

SEQ ID NO: 1065642 - DNA, 23 bp, Homo sapiens
atttatgtaaactgcattagaaa

SEQ ID NO: 1065643 - DNA, 18 bp, Homo sapiens
atttatgtagatgtgcat

SEQ ID NO: 1065644 - DNA, 16 bp, Homo sapiens
atttatgtattttgaa

SEQ ID NO: 1065645 - DNA, 22 bp, Homo sapiens
atttatgtctatttaagcctca

SEQ ID NO: 1065646 - DNA, 15 bp, Homo sapiens
atttatgtctcatgt

SEQ ID NO: 1065647 - DNA, 14 bp, Homo sapiens
atttatgttaaaag

SEQ ID NO: 1065648 - DNA, 20 bp, Homo sapiens
atttattaaaaatgttctca

SEQ ID NO: 1065649 - DNA, 23 bp, Homo sapiens
atttattaaaaatgttctcaaat

SEQ ID NO: 1065650 - DNA, 23 bp, Homo sapiens
atttattaaacagatttttacaa

SEQ ID NO: 1065651 - DNA, 16 bp, Homo sapiens
atttattaagatggat

SEQ ID NO: 1065652 - DNA, 15 bp, Homo sapiens
atttattaagtctgg

SEQ ID NO: 1065653 - DNA, 14 bp, Homo sapiens
atttattaatattt

SEQ ID NO: 1065654 - DNA, 23 bp, Homo sapiens
atttattaatatttaacattatt

SEQ ID NO: 1065655 - DNA, 16 bp, Homo sapiens
atttattaattgcttt

SEQ ID NO: 1065656 - DNA, 21 bp, Homo sapiens
atttattacaaatcagaactt

SEQ ID NO: 1065657 - DNA, 22 bp, Homo sapiens
atttattactgtccctatctat

SEQ ID NO: 1065658 - DNA, 18 bp, Homo sapiens
atttattacttgtgcact

SEQ ID NO: 1065659 - DNA, 19 bp, Homo sapiens
atttattatatatttacag

SEQ ID NO: 1065660 - DNA, 14 bp, Homo sapiens
atttattatgagac

SEQ ID NO: 1065661 - DNA, 23 bp, Homo sapiens
atttattatgctttattggaaaa

SEQ ID NO: 1065662 - DNA, 16 bp, Homo sapiens
atttattatggcacat

SEQ ID NO: 1065663 - DNA, 13 bp, Homo sapiens
atttattattaat

SEQ ID NO: 1065664 - DNA, 11 bp, Homo sapiens
atttattattt

SEQ ID NO: 1065665 - DNA, 14 bp, Homo sapiens
atttattatttacc

SEQ ID NO: 1065666 - DNA, 21 bp, Homo sapiens
atttattattttcacctgttt

SEQ ID NO: 1065667 - DNA, 14 bp, Homo sapiens
atttattcaagaaa

SEQ ID NO: 1065668 - DNA, 18 bp, Homo sapiens
atttattcaattcctctg

SEQ ID NO: 1065669 - DNA, 21 bp, Homo sapiens
atttattcacatatatcaaag

SEQ ID NO: 1065670 - DNA, 16 bp, Homo sapiens
atttattcactgtaag

SEQ ID NO: 1065671 - DNA, 18 bp, Homo sapiens
atttattcagcttcattt

SEQ ID NO: 1065672 - DNA, 20 bp, Homo sapiens
atttattgcacattgttcaa

SEQ ID NO: 1065673 - DNA, 22 bp, Homo sapiens
atttattgcagaggatgttcat

SEQ ID NO: 1065674 - DNA, 12 bp, Homo sapiens
atttattgccat

SEQ ID NO: 1065675 - DNA, 22 bp, Homo sapiens
atttattgctgtgtaacactgt

SEQ ID NO: 1065676 - DNA, 17 bp, Homo sapiens
atttattggcagccaag

SEQ ID NO: 1065677 - DNA, 22 bp, Homo sapiens
atttattggcagccaaggaatg

SEQ ID NO: 1065678 - DNA, 14 bp, Homo sapiens
atttattggttttg

SEQ ID NO: 1065679 - DNA, 13 bp, Homo sapiens
atttattgtatta

SEQ ID NO: 1065680 - DNA, 16 bp, Homo sapiens
atttattgtcagtttt

SEQ ID NO: 1065681 - DNA, 18 bp, Homo sapiens
atttattgtcagttttgt

SEQ ID NO: 1065682 - DNA, 12 bp, Homo sapiens
atttattgttaa

SEQ ID NO: 1065683 - DNA, 14 bp, Homo sapiens
atttattgttaaat

SEQ ID NO: 1065684 - DNA, 20 bp, Homo sapiens
atttattgttaaattacatt

SEQ ID NO: 1065685 - DNA, 18 bp, Homo sapiens
atttattgttagaaaatg

SEQ ID NO: 1065686 - DNA, 22 bp, Homo sapiens
atttattgttgccttttcacgt

SEQ ID NO: 1065687 - DNA, 21 bp, Homo sapiens
atttattgtttatttatcagt

SEQ ID NO: 1065688 - DNA, 20 bp, Homo sapiens
atttattgtttgaaatgtcg

SEQ ID NO: 1065689 - DNA, 17 bp, Homo sapiens
atttatttaaaactctg

SEQ ID NO: 1065690 - DNA, 13 bp, Homo sapiens
atttatttaataa

SEQ ID NO: 1065691 - DNA, 20 bp, Homo sapiens
atttataaactaattttgta

SEQ ID NO: 1065692 - DNA, 13 bp, Homo sapiens
atttataaagcaa

SEQ ID NO: 1065693 - DNA, 14 bp, Homo sapiens
atttataaatatat

SEQ ID NO: 1065694 - DNA, 15 bp, Homo sapiens
atttataaatgctat

SEQ ID NO: 1065695 - DNA, 21 bp, Homo sapiens
atttataactcatcataaaat

SEQ ID NO: 1065696 - DNA, 22 bp, Homo sapiens
atttataactcatcataaaata

SEQ ID NO: 1065697 - DNA, 17 bp, Homo sapiens
atttataagcagattta

SEQ ID NO: 1065698 - DNA, 14 bp, Homo sapiens
atttataatgtatt

SEQ ID NO: 1065699 - DNA, 15 bp, Homo sapiens
atttataatgtattt

SEQ ID NO: 1065700 - DNA, 16 bp, Homo sapiens
atttataatgtatttg

SEQ ID NO: 1065701 - DNA, 20 bp, Homo sapiens
atttataatgtatttgaaaa

SEQ ID NO: 1065702 - DNA, 18 bp, Homo sapiens
atttataatttaaatgat

SEQ ID NO: 1065703 - DNA, 22 bp, Homo sapiens
atttataatttaaatgatattt

SEQ ID NO: 1065704 - DNA, 18 bp, Homo sapiens
atttatacaaattagaaa

SEQ ID NO: 1065705 - DNA, 22 bp, Homo sapiens
atttatacaccagcaatttaga

SEQ ID NO: 1065706 - DNA, 14 bp, Homo sapiens
atttatactattta

SEQ ID NO: 1065707 - DNA, 10 bp, Homo sapiens
atttatactc

SEQ ID NO: 1065708 - DNA, 23 bp, Homo sapiens
atttatactctagaacatgcaca

SEQ ID NO: 1065709 - DNA, 20 bp, Homo sapiens
atttatactttaaagtattt

SEQ ID NO: 1065710 - DNA, 15 bp, Homo sapiens
atttatagaagaaat

SEQ ID NO: 1065711 - DNA, 21 bp, Homo sapiens
atttatagcaagatattgatc

SEQ ID NO: 1065712 - DNA, 22 bp, Homo sapiens
atttataggccagggcatgtgt

SEQ ID NO: 1065713 - DNA, 22 bp, Homo sapiens
atttataggcgttttttgggga

SEQ ID NO: 1065714 - DNA, 16 bp, Homo sapiens
atttatatatatatgt

SEQ ID NO: 1065715 - DNA, 20 bp, Homo sapiens
atttatatatatatgtatat

SEQ ID NO: 1065716 - DNA, 23 bp, Homo sapiens
atttatatatggcatatttatat

SEQ ID NO: 1065717 - DNA, 14 bp, Homo sapiens
atttatatattgaa

SEQ ID NO: 1065718 - DNA, 19 bp, Homo sapiens
atttatatatttataactc

SEQ ID NO: 1065719 - DNA, 17 bp, Homo sapiens
atttatatcttgttatt

SEQ ID NO: 1065720 - DNA, 15 bp, Homo sapiens
atttctcaggaagag

SEQ ID NO: 1065721 - DNA, 23 bp, Homo sapiens
atttctcatgttccttttgaaat

SEQ ID NO: 1065722 - DNA, 15 bp, Homo sapiens
atttctccagaccca

SEQ ID NO: 1065723 - DNA, 17 bp, Homo sapiens
atttctccagacccaga

SEQ ID NO: 1065724 - DNA, 16 bp, Homo sapiens
atttctccagttggga

SEQ ID NO: 1065725 - DNA, 16 bp, Homo sapiens
atttctccatcccctc

SEQ ID NO: 1065726 - DNA, 17 bp, Homo sapiens
atttctccatcccctcc

SEQ ID NO: 1065727 - DNA, 18 bp, Homo sapiens
atttctccatcccctccc

SEQ ID NO: 1065728 - DNA, 20 bp, Homo sapiens
atttctctccccactgaaaa

SEQ ID NO: 1065729 - DNA, 19 bp, Homo sapiens
atttctctggcaaactttt

SEQ ID NO: 1065730 - DNA, 14 bp, Homo sapiens
atttctctgtgtat

SEQ ID NO: 1065731 - DNA, 12 bp, Homo sapiens
atttctcttctc

SEQ ID NO: 1065732 - DNA, 13 bp, Homo sapiens
atttctcttgtcc

SEQ ID NO: 1065733 - DNA, 21 bp, Homo sapiens
atttctgaaaacctaccagcc

SEQ ID NO: 1065734 - DNA, 14 bp, Homo sapiens
atttctgacatcaa

SEQ ID NO: 1065735 - DNA, 23 bp, Homo sapiens
atttctgagaaggtccttaatga

SEQ ID NO: 1065736 - DNA, 23 bp, Homo sapiens
atttctgagagtgaaaccatgac

SEQ ID NO: 1065737 - DNA, 15 bp, Homo sapiens
atttctgatgatgtc

SEQ ID NO: 1065738 - DNA, 15 bp, Homo sapiens
atttctgccatttca

SEQ ID NO: 1065739 - DNA, 18 bp, Homo sapiens
atttctgccatttcatgt

SEQ ID NO: 1065740 - DNA, 11 bp, Homo sapiens
atttctgcctc

SEQ ID NO: 1065741 - DNA, 13 bp, Homo sapiens
atttctgcctttc

SEQ ID NO: 1065742 - DNA, 16 bp, Homo sapiens
atttctgcctttcccc

SEQ ID NO: 1065743 - DNA, 22 bp, Homo sapiens
atttctgcctttcccccctcac

SEQ ID NO: 1065744 - DNA, 14 bp, Homo sapiens
atttctgctctgga

SEQ ID NO: 1065745 - DNA, 18 bp, Homo sapiens
atttctgctctggaataa

SEQ ID NO: 1065746 - DNA, 20 bp, Homo sapiens
atttctgctcttccaaagct

SEQ ID NO: 1065747 - DNA, 16 bp, Homo sapiens
atttctgggtcttttg

SEQ ID NO: 1065748 - DNA, 15 bp, Homo sapiens
atttctgtatatttg

SEQ ID NO: 1065749 - DNA, 19 bp, Homo sapiens
atttctgtcacagtaaaaa

SEQ ID NO: 1065750 - DNA, 23 bp, Homo sapiens
atttctgtctctaaccattcaaa

SEQ ID NO: 1065751 - DNA, 17 bp, Homo sapiens
atttctgtctttaagaa

SEQ ID NO: 1065752 - DNA, 16 bp, Homo sapiens
atttctgtgtacacat

SEQ ID NO: 1065753 - DNA, 14 bp, Homo sapiens
atttctgttctcat

SEQ ID NO: 1065754 - DNA, 18 bp, Homo sapiens
atttctgttgctggaggg

SEQ ID NO: 1065755 - DNA, 20 bp, Homo sapiens
atttctgttgctggaggggc

SEQ ID NO: 1065756 - DNA, 14 bp, Homo sapiens
atttctgtttagat

SEQ ID NO: 1065757 - DNA, 16 bp, Homo sapiens
atttctgtttgtttaa

SEQ ID NO: 1065758 - DNA, 17 bp, Homo sapiens
atttctgtttgtttaag

SEQ ID NO: 1065759 - DNA, 17 bp, Homo sapiens
atttcttaacctttgct

SEQ ID NO: 1065760 - DNA, 19 bp, Homo sapiens
atttcttaattattataaa

SEQ ID NO: 1065761 - DNA, 18 bp, Homo sapiens
atttcttagttcatatat

SEQ ID NO: 1065762 - DNA, 22 bp, Homo sapiens
atttcttatacgcttttctttg

SEQ ID NO: 1065763 - DNA, 18 bp, Homo sapiens
atttcttatcaccacagt

SEQ ID NO: 1065764 - DNA, 21 bp, Homo sapiens
atttgtttttaaactgtacag

SEQ ID NO: 1065765 - DNA, 19 bp, Homo sapiens
atttgtttttacctgtatt

SEQ ID NO: 1065766 - DNA, 14 bp, Homo sapiens
atttgtttttctca

SEQ ID NO: 1065767 - DNA, 13 bp, Homo sapiens
attttaaaaaagg

SEQ ID NO: 1065768 - DNA, 15 bp, Homo sapiens
attttaaaaaatcaa

SEQ ID NO: 1065769 - DNA, 16 bp, Homo sapiens
attttaaaaaatcaat

SEQ ID NO: 1065770 - DNA, 18 bp, Homo sapiens
attttaaaaaatcaatca

SEQ ID NO: 1065771 - DNA, 14 bp, Homo sapiens
attttaaaaacttt

SEQ ID NO: 1065772 - DNA, 18 bp, Homo sapiens
attttaaaaagtcttcac

SEQ ID NO: 1065773 - DNA, 21 bp, Homo sapiens
attttaaaaagtcttcactct

SEQ ID NO: 1065774 - DNA, 18 bp, Homo sapiens
attttaaaatagcgttct

SEQ ID NO: 1065775 - DNA, 13 bp, Homo sapiens
attttaaaatatt

SEQ ID NO: 1065776 - DNA, 16 bp, Homo sapiens
attttaaaatgaataa

SEQ ID NO: 1065777 - DNA, 20 bp, Homo sapiens
attttaaaatgaataattta

SEQ ID NO: 1065778 - DNA, 14 bp, Homo sapiens
attttaaaatgttt

SEQ ID NO: 1065779 - DNA, 13 bp, Homo sapiens
attttaaaatttc

SEQ ID NO: 1065780 - DNA, 15 bp, Homo sapiens
attttaaaatttgtt

SEQ ID NO: 1065781 - DNA, 17 bp, Homo sapiens
attttaaacaaaataga

SEQ ID NO: 1065782 - DNA, 22 bp, Homo sapiens
attttaaagacccaacttgcca

SEQ ID NO: 1065783 - DNA, 14 bp, Homo sapiens
attttaaaggcaga

SEQ ID NO: 1065784 - DNA, 17 bp, Homo sapiens
attttaaagtatgcatt

SEQ ID NO: 1065785 - DNA, 19 bp, Homo sapiens
attttaaagtatgcattat

SEQ ID NO: 1065786 - DNA, 22 bp, Homo sapiens
attttaaagtatgcattattaa

SEQ ID NO: 1065787 - DNA, 12 bp, Homo sapiens
attttaaagtta

SEQ ID NO: 1065788 - DNA, 17 bp, Homo sapiens
attttaaagttcttatt

SEQ ID NO: 1065789 - DNA, 18 bp, Homo sapiens
attttaaagttcttattt

SEQ ID NO: 1065790 - DNA, 21 bp, Homo sapiens
attttaaagttcttattttag

SEQ ID NO: 1065791 - DNA, 16 bp, Homo sapiens
attttaaataaaagaa

SEQ ID NO: 1065792 - DNA, 18 bp, Homo sapiens
attttaaataacctctgg

SEQ ID NO: 1065793 - DNA, 23 bp, Homo sapiens
attttaaataacctctggccctt

SEQ ID NO: 1065794 - DNA, 15 bp, Homo sapiens
attttaaatgttcac

SEQ ID NO: 1065795 - DNA, 22 bp, Homo sapiens
attttaaattataacttaaaat

SEQ ID NO: 1065796 - DNA, 16 bp, Homo sapiens
attttaaattcacaat

SEQ ID NO: 1065797 - DNA, 17 bp, Homo sapiens
attttaacaactgctct

SEQ ID NO: 1065798 - DNA, 22 bp, Homo sapiens
attttaacaataactactgtgt

SEQ ID NO: 1065799 - DNA, 13 bp, Homo sapiens
attttaacacttt

SEQ ID NO: 1065800 - DNA, 16 bp, Homo sapiens
attttaacactttgta

SEQ ID NO: 1065801 - DNA, 17 bp, Homo sapiens
attttaacactttgtat

SEQ ID NO: 1065802 - DNA, 16 bp, Homo sapiens
attttaaccaaaacat

SEQ ID NO: 1065803 - DNA, 17 bp, Homo sapiens
attttaacctagatgtt

SEQ ID NO: 1065804 - DNA, 22 bp, Homo sapiens
attttaacctagatgtttaaca

SEQ ID NO: 1065805 - DNA, 18 bp, Homo sapiens
attttaactaaattttaa

SEQ ID NO: 1065806 - DNA, 16 bp, Homo sapiens
attttaactactttac

SEQ ID NO: 1065807 - DNA, 13 bp, Homo sapiens
attttaactcata

SEQ ID NO: 1065808 - DNA, 19 bp, Homo sapiens
attttaactttatcacatt

SEQ ID NO: 1065809 - DNA, 14 bp, Homo sapiens
attttaagaaagag

SEQ ID NO: 1065810 - DNA, 17 bp, Homo sapiens
attttaagaagacatga

SEQ ID NO: 1065811 - DNA, 20 bp, Homo sapiens
attttaagccttcatttgca

SEQ ID NO: 1065812 - DNA, 16 bp, Homo sapiens
attttaagtattgcat

SEQ ID NO: 1065813 - DNA, 18 bp, Homo sapiens
attttaagtgatgtcatt

SEQ ID NO: 1065814 - DNA, 16 bp, Homo sapiens
attttaagtgctttgt

SEQ ID NO: 1065815 - DNA, 22 bp, Homo sapiens
attttaagtggggttgataaca

SEQ ID NO: 1065816 - DNA, 17 bp, Homo sapiens
attttaagtttgtagta

SEQ ID NO: 1065817 - DNA, 17 bp, Homo sapiens
attttaatacaagtaat

SEQ ID NO: 1065818 - DNA, 15 bp, Homo sapiens
attttaatagaaata

SEQ ID NO: 1065819 - DNA, 15 bp, Homo sapiens
attttaatattttgt

SEQ ID NO: 1065820 - DNA, 17 bp, Homo sapiens
attttaatattttgtat

SEQ ID NO: 1065821 - DNA, 18 bp, Homo sapiens
attttaatcaagttgaat

SEQ ID NO: 1065822 - DNA, 20 bp, Homo sapiens
attttaatgctgtttctaag

SEQ ID NO: 1065823 - DNA, 23 bp, Homo sapiens
attttaatgctgtttctaagaaa

SEQ ID NO: 1065824 - DNA, 22 bp, Homo sapiens
attttaatggtatgtacaagtt

SEQ ID NO: 1065825 - DNA, 17 bp, Homo sapiens
attttaatgtatatttg

SEQ ID NO: 1065826 - DNA, 22 bp, Homo sapiens
attttaatgtatatttgctgca

SEQ ID NO: 1065827 - DNA, 12 bp, Homo sapiens
attttaatgtga

SEQ ID NO: 1065828 - DNA, 13 bp, Homo sapiens
attttaattatta

SEQ ID NO: 1065829 - DNA, 22 bp, Homo sapiens
attttaattatttatatttcct

SEQ ID NO: 1065830 - DNA, 12 bp, Homo sapiens
attttaattcat

SEQ ID NO: 1065831 - DNA, 12 bp, Homo sapiens
attttaattctc

SEQ ID NO: 1065832 - DNA, 15 bp, Homo sapiens
attttaatttagtaa

SEQ ID NO: 1065833 - DNA, 20 bp, Homo sapiens
attttaatttagtaaatgtt

SEQ ID NO: 1065834 - DNA, 21 bp, Homo sapiens
attttaatttagtaaatgtta

SEQ ID NO: 1065835 - DNA, 16 bp, Homo sapiens
attttaatttatttgt

SEQ ID NO: 1065836 - DNA, 18 bp, Homo sapiens
attttaattttaaccaaa

SEQ ID NO: 1065837 - DNA, 19 bp, Homo sapiens
attttaattttatattcag

SEQ ID NO: 1065838 - DNA, 21 bp, Homo sapiens
attttacaagtataacagttt

SEQ ID NO: 1065839 - DNA, 20 bp, Homo sapiens
attttacaataggtgcttat

SEQ ID NO: 1065840 - DNA, 21 bp, Homo sapiens
attttacacgcttttgtgatg

SEQ ID NO: 1065841 - DNA, 20 bp, Homo sapiens
attttacagaaacgtgttaa

SEQ ID NO: 1065842 - DNA, 16 bp, Homo sapiens
attttcattgtgattt

SEQ ID NO: 1065843 - DNA, 15 bp, Homo sapiens
attttcatttgtaca

SEQ ID NO: 1065844 - DNA, 16 bp, Homo sapiens
attttcatttgtacaa

SEQ ID NO: 1065845 - DNA, 17 bp, Homo sapiens
attttcatttgtacaag

SEQ ID NO: 1065846 - DNA, 15 bp, Homo sapiens
attttccagccttat

SEQ ID NO: 1065847 - DNA, 19 bp, Homo sapiens
attttccagccttatgtgt

SEQ ID NO: 1065848 - DNA, 22 bp, Homo sapiens
attttccagccttatgtgttac

SEQ ID NO: 1065849 - DNA, 21 bp, Homo sapiens
attttccatttttatttcaaa

SEQ ID NO: 1065850 - DNA, 20 bp, Homo sapiens
attttcccactcattctgaa

SEQ ID NO: 1065851 - DNA, 15 bp, Homo sapiens
attttcccatcatcc

SEQ ID NO: 1065852 - DNA, 20 bp, Homo sapiens
attttccccgaattctattt

SEQ ID NO: 1065853 - DNA, 23 bp, Homo sapiens
attttccctttttaaaaaatacc

SEQ ID NO: 1065854 - DNA, 15 bp, Homo sapiens
attttcctaatgtga

SEQ ID NO: 1065855 - DNA, 22 bp, Homo sapiens
attttcctaatgtgatcatatg

SEQ ID NO: 1065856 - DNA, 15 bp, Homo sapiens
attttcctcctctgc

SEQ ID NO: 1065857 - DNA, 16 bp, Homo sapiens
attttcctcctctgcc

SEQ ID NO: 1065858 - DNA, 15 bp, Homo sapiens
attttcctctggccg

SEQ ID NO: 1065859 - DNA, 18 bp, Homo sapiens
attttcctcttgtcctgg

SEQ ID NO: 1065860 - DNA, 23 bp, Homo sapiens
attttcctcttgtcctggccctt

SEQ ID NO: 1065861 - DNA, 11 bp, Homo sapiens
attttcctgga

SEQ ID NO: 1065862 - DNA, 16 bp, Homo sapiens
attttcctggatttat

SEQ ID NO: 1065863 - DNA, 23 bp, Homo sapiens
attttcctggtgccaatttcaag

SEQ ID NO: 1065864 - DNA, 15 bp, Homo sapiens
attttcctgtttact

SEQ ID NO: 1065865 - DNA, 16 bp, Homo sapiens
attttcctgtttactg

SEQ ID NO: 1065866 - DNA, 17 bp, Homo sapiens
attttcctttggactgt

SEQ ID NO: 1065867 - DNA, 14 bp, Homo sapiens
attttccttttcaa

SEQ ID NO: 1065868 - DNA, 17 bp, Homo sapiens
attttcgggattctttg

SEQ ID NO: 1065869 - DNA, 21 bp, Homo sapiens
attttctaaaagctttcatgt

SEQ ID NO: 1065870 - DNA, 19 bp, Homo sapiens
atttttgatactaagcatt

SEQ ID NO: 1065871 - DNA, 21 bp, Homo sapiens
atttttgatactaagcattga

SEQ ID NO: 1065872 - DNA, 12 bp, Homo sapiens
atttttgatgta

SEQ ID NO: 1065873 - DNA, 20 bp, Homo sapiens
atttttgatgtatatatcta

SEQ ID NO: 1065874 - DNA, 13 bp, Homo sapiens
atttttgattcag

SEQ ID NO: 1065875 - DNA, 16 bp, Homo sapiens
atttttgattgtgttg

SEQ ID NO: 1065876 - DNA, 19 bp, Homo sapiens
atttttgcaaaataagttt

SEQ ID NO: 1065877 - DNA, 14 bp, Homo sapiens
atttttgcaggagc

SEQ ID NO: 1065878 - DNA, 18 bp, Homo sapiens
atttttgcctatctttaa

SEQ ID NO: 1065879 - DNA, 15 bp, Homo sapiens
atttttgctgagact

SEQ ID NO: 1065880 - DNA, 18 bp, Homo sapiens
atttttgcttttagaaaa

SEQ ID NO: 1065881 - DNA, 20 bp, Homo sapiens
atttttgggggctttccttt

SEQ ID NO: 1065882 - DNA, 21 bp, Homo sapiens
atttttggggggagagacaca

SEQ ID NO: 1065883 - DNA, 15 bp, Homo sapiens
atttttgggtgattt

SEQ ID NO: 1065884 - DNA, 19 bp, Homo sapiens
caaaatgttctatttaaca

SEQ ID NO: 1065885 - DNA, 17 bp, Homo sapiens
caaaatgttggtcattt

SEQ ID NO: 1065886 - DNA, 21 bp, Homo sapiens
caaaatgttggtcattttatg

SEQ ID NO: 1065887 - DNA, 19 bp, Homo sapiens
caaaattactaataaattg

SEQ ID NO: 1065888 - DNA, 12 bp, Homo sapiens
caaaattagaaa

SEQ ID NO: 1065889 - DNA, 23 bp, Homo sapiens
caaaattagatcctaagatgtgt

SEQ ID NO: 1065890 - DNA, 20 bp, Homo sapiens
caaaattagtacctcaaagt

SEQ ID NO: 1065891 - DNA, 15 bp, Homo sapiens
caaaattcaaagcat

SEQ ID NO: 1065892 - DNA, 18 bp, Homo sapiens
caaaattcatttctaatt

SEQ ID NO: 1065893 - DNA, 20 bp, Homo sapiens
caaaattgcctataatactt

SEQ ID NO: 1065894 - DNA, 20 bp, Homo sapiens
caaaattgttttgagctttc

SEQ ID NO: 1065895 - DNA, 18 bp, Homo sapiens
caaaatttcacagttctg

SEQ ID NO: 1065896 - DNA, 20 bp, Homo sapiens
caaaatttcacagttctgta

SEQ ID NO: 1065897 - DNA, 14 bp, Homo sapiens
caaaatttgaaatt

SEQ ID NO: 1065898 - DNA, 14 bp, Homo sapiens
caaaatttgactaa

SEQ ID NO: 1065899 - DNA, 19 bp, Homo sapiens
caaaatttgatgccaggac

SEQ ID NO: 1065900 - DNA, 11 bp, Homo sapiens
caaaatttgtt

SEQ ID NO: 1065901 - DNA, 13 bp, Homo sapiens
caaaatttgtttg

SEQ ID NO: 1065902 - DNA, 12 bp, Homo sapiens
caaaattttaaa

SEQ ID NO: 1065903 - DNA, 17 bp, Homo sapiens
caaaattttaagtagga

SEQ ID NO: 1065904 - DNA, 23 bp, Homo sapiens
caaaattttatagctcagtttat

SEQ ID NO: 1065905 - DNA, 18 bp, Homo sapiens
caaaattttattcctata

SEQ ID NO: 1065906 - DNA, 16 bp, Homo sapiens
caaaattttattttgt

SEQ ID NO: 1065907 - DNA, 22 bp, Homo sapiens
caaaattttctcattttctttt

SEQ ID NO: 1065908 - DNA, 21 bp, Homo sapiens
caaacaaaaaggttctcaggt

SEQ ID NO: 1065909 - DNA, 20 bp, Homo sapiens
caaaggagacaaagcaggag

SEQ ID NO: 1065910 - DNA, 21 bp, Homo sapiens
caaaggagacaaagcaggagt

SEQ ID NO: 1065911 - DNA, 19 bp, Homo sapiens
caaaggagctcgaaggata

SEQ ID NO: 1065912 - DNA, 19 bp, Homo sapiens
caaaggaggggaaacaatg

SEQ ID NO: 1065913 - DNA, 21 bp, Homo sapiens
caaaggaggggaaacaatgaa

SEQ ID NO: 1065914 - DNA, 13 bp, Homo sapiens
caaaggatactgt

SEQ ID NO: 1065915 - DNA, 18 bp, Homo sapiens
caaaggatgagaatgtga

SEQ ID NO: 1065916 - DNA, 13 bp, Homo sapiens
caaaggatgtgat

SEQ ID NO: 1065917 - DNA, 21 bp, Homo sapiens
caaaggatgtgatatataagt

SEQ ID NO: 1065918 - DNA, 14 bp, Homo sapiens
caaaggcagaggaa

SEQ ID NO: 1065919 - DNA, 13 bp, Homo sapiens
caaaggcagggcc

SEQ ID NO: 1065920 - DNA, 16 bp, Homo sapiens
caaaggcagtcccggg

SEQ ID NO: 1065921 - DNA, 21 bp, Homo sapiens
caaaggcattataaaaagaat

SEQ ID NO: 1065922 - DNA, 17 bp, Homo sapiens
caaaggccacaggcagt

SEQ ID NO: 1065923 - DNA, 13 bp, Homo sapiens
caaaggccagtgg

SEQ ID NO: 1065924 - DNA, 18 bp, Homo sapiens
caaaggccagtggaagaa

SEQ ID NO: 1065925 - DNA, 16 bp, Homo sapiens
caaaggcccagggagg

SEQ ID NO: 1065926 - DNA, 17 bp, Homo sapiens
caaaggcccagggaggc

SEQ ID NO: 1065927 - DNA, 19 bp, Homo sapiens
caaaggcccagggaggcag

SEQ ID NO: 1065928 - DNA, 13 bp, Homo sapiens
caaaggcccatgc

SEQ ID NO: 1065929 - DNA, 19 bp, Homo sapiens
caaaggcccatgccccctt

SEQ ID NO: 1065930 - DNA, 21 bp, Homo sapiens
caaaggcctggcgtcggccag

SEQ ID NO: 1065931 - DNA, 23 bp, Homo sapiens
caaaggcgcagtgcttctctaca

SEQ ID NO: 1065932 - DNA, 12 bp, Homo sapiens
caaaggctctgt

SEQ ID NO: 1065933 - DNA, 18 bp, Homo sapiens
caaaggcttgtggtttgt

SEQ ID NO: 1065934 - DNA, 17 bp, Homo sapiens
caaagggaaatatcatt

SEQ ID NO: 1065935 - DNA, 23 bp, Homo sapiens
caaagggaagtgaggcccaagga

SEQ ID NO: 1065936 - DNA, 22 bp, Homo sapiens
caaagggcataccttgtgcatt

SEQ ID NO: 1065937 - DNA, 20 bp, Homo sapiens
caaagggcctgcccagacaa

SEQ ID NO: 1065938 - DNA, 22 bp, Homo sapiens
caaagggctcctctccagtctg

SEQ ID NO: 1065939 - DNA, 17 bp, Homo sapiens
caaagggctgaaagcca

SEQ ID NO: 1065940 - DNA, 21 bp, Homo sapiens
caaaggggagccagaaatggg

SEQ ID NO: 1065941 - DNA, 15 bp, Homo sapiens
caaaggggctgctgg

SEQ ID NO: 1065942 - DNA, 14 bp, Homo sapiens
caaaggggggaggt

SEQ ID NO: 1065943 - DNA, 20 bp, Homo sapiens
caaagggtgaagctatttat

SEQ ID NO: 1065944 - DNA, 23 bp, Homo sapiens
caaagggtgaagctatttatctg

SEQ ID NO: 1065945 - DNA, 13 bp, Homo sapiens
caaaggtgaagga

SEQ ID NO: 1065946 - DNA, 13 bp, Homo sapiens
caaaggtgcctca

SEQ ID NO: 1065947 - DNA, 19 bp, Homo sapiens
caaaggtggaataaacatt

SEQ ID NO: 1065948 - DNA, 21 bp, Homo sapiens
caaaggtgggaggatcatttg

SEQ ID NO: 1065949 - DNA, 22 bp, Homo sapiens
caaaggtgtgcttcctgctgta

SEQ ID NO: 1065950 - DNA, 20 bp, Homo sapiens
caaaggtttgaagacacagc

SEQ ID NO: 1065951 - DNA, 21 bp, Homo sapiens
caaaggtttgaagacacagcc

SEQ ID NO: 1065952 - DNA, 19 bp, Homo sapiens
caaaggtttggaaggagca

SEQ ID NO: 1065953 - DNA, 16 bp, Homo sapiens
caaagtaaaacttgct

SEQ ID NO: 1065954 - DNA, 21 bp, Homo sapiens
caaagtaaaacttgctgcctg

SEQ ID NO: 1065955 - DNA, 20 bp, Homo sapiens
caaagtaaaatgaacatttt

SEQ ID NO: 1065956 - DNA, 16 bp, Homo sapiens
caaagtaatctactgt

SEQ ID NO: 1065957 - DNA, 20 bp, Homo sapiens
caaagtaatttggaaattag

SEQ ID NO: 1065958 - DNA, 13 bp, Homo sapiens
caaagtacaaaat

SEQ ID NO: 1065959 - DNA, 15 bp, Homo sapiens
caaagtacaaaattg

SEQ ID NO: 1065960 - DNA, 15 bp, Homo sapiens
caaagtacagaattt

SEQ ID NO: 1065961 - DNA, 16 bp, Homo sapiens
caaagtaccacactga

SEQ ID NO: 1065962 - DNA, 18 bp, Homo sapiens
caaagtaccacactgagt

SEQ ID NO: 1065963 - DNA, 17 bp, Homo sapiens
caaagtagatcatgcat

SEQ ID NO: 1065964 - DNA, 23 bp, Homo sapiens
caaagtagattcttacaaggccc

SEQ ID NO: 1065965 - DNA, 21 bp, Homo sapiens
caaagtagtacttcttctgta

SEQ ID NO: 1065966 - DNA, 19 bp, Homo sapiens
caaagtagtcctggcagct

SEQ ID NO: 1065967 - DNA, 20 bp, Homo sapiens
caaagtagtcctggcagctg

SEQ ID NO: 1065968 - DNA, 19 bp, Homo sapiens
caaagtatcaggacgagaa

SEQ ID NO: 1065969 - DNA, 19 bp, Homo sapiens
caaagtatccctactgtaa

SEQ ID NO: 1065970 - DNA, 17 bp, Homo sapiens
caaagtatctaacaaaa

SEQ ID NO: 1065971 - DNA, 19 bp, Homo sapiens
caaagtatctaacaaaacc

SEQ ID NO: 1065972 - DNA, 20 bp, Homo sapiens
caaagtatctaacaaaacca

SEQ ID NO: 1065973 - DNA, 18 bp, Homo sapiens
caaagtattgtaaattat

SEQ ID NO: 1065974 - DNA, 19 bp, Homo sapiens
caaagtattgtaaattata

SEQ ID NO: 1065975 - DNA, 17 bp, Homo sapiens
caaagtcagcagggacc

SEQ ID NO: 1065976 - DNA, 22 bp, Homo sapiens
caaagtcatcccctctcaggag

SEQ ID NO: 1065977 - DNA, 23 bp, Homo sapiens
caaagtcatcccctctcaggaga

SEQ ID NO: 1065978 - DNA, 17 bp, Homo sapiens
caaagtcattaaagaca

SEQ ID NO: 1065979 - DNA, 13 bp, Homo sapiens
caaagtcccttcc

SEQ ID NO: 1065980 - DNA, 14 bp, Homo sapiens
caaagtctaaactg

SEQ ID NO: 1065981 - DNA, 17 bp, Homo sapiens
caaagtctgccgcccac

SEQ ID NO: 1065982 - DNA, 15 bp, Homo sapiens
caaagtgcagccctt

SEQ ID NO: 1065983 - DNA, 19 bp, Homo sapiens
caaagtgcagcccttcctc

SEQ ID NO: 1065984 - DNA, 22 bp, Homo sapiens
caaagtgccactcattcctgta

SEQ ID NO: 1065985 - DNA, 20 bp, Homo sapiens
caaagtgctatgcggaggaa

SEQ ID NO: 1065986 - DNA, 16 bp, Homo sapiens
caaagtgctgggatga

SEQ ID NO: 1065987 - DNA, 14 bp, Homo sapiens
caaagtggagctgg

SEQ ID NO: 1065988 - DNA, 20 bp, Homo sapiens
caaagtgggtgtgtggcctc

SEQ ID NO: 1065989 - DNA, 22 bp, Homo sapiens
caaagtgggtgtgtggcctccc

SEQ ID NO: 1065990 - DNA, 15 bp, Homo sapiens
caaagtgtatattta

SEQ ID NO: 1065991 - DNA, 22 bp, Homo sapiens
caaagtgtattaggaagtgttt

SEQ ID NO: 1065992 - DNA, 20 bp, Homo sapiens
caaagtgtctacatgtgcca

SEQ ID NO: 1065993 - DNA, 12 bp, Homo sapiens
caaagtgtgtat

SEQ ID NO: 1065994 - DNA, 13 bp, Homo sapiens
caaagtgtgtatt

SEQ ID NO: 1065995 - DNA, 11 bp, Homo sapiens
caaagtgttaa

SEQ ID NO: 1065996 - DNA, 14 bp, Homo sapiens
caaagtgttgtgtt

SEQ ID NO: 1065997 - DNA, 18 bp, Homo sapiens
caaagtgttgtgttcctg

SEQ ID NO: 1065998 - DNA, 17 bp, Homo sapiens
caaagttaaaattgtta

SEQ ID NO: 1065999 - DNA, 20 bp, Homo sapiens
caaagttatattcacagttt

SEQ ID NO: 1066000 - DNA, 17 bp, Homo sapiens
caaagttggggcaggct

SEQ ID NO: 1066001 - DNA, 22 bp, Homo sapiens
caaagttgttgtaacctgctgt

SEQ ID NO: 1066002 - DNA, 17 bp, Homo sapiens
caaagtttacattgtcc

SEQ ID NO: 1066003 - DNA, 18 bp, Homo sapiens
caaagtttcagagtatat

SEQ ID NO: 1066004 - DNA, 15 bp, Homo sapiens
caaagtttctgttga

SEQ ID NO: 1066005 - DNA, 12 bp, Homo sapiens
caaagttttaca

SEQ ID NO: 1066006 - DNA, 15 bp, Homo sapiens
caaataaaatatcat

SEQ ID NO: 1066007 - DNA, 12 bp, Homo sapiens
caaataaagaaa

SEQ ID NO: 1066008 - DNA, 15 bp, Homo sapiens
caaataaagaaattt

SEQ ID NO: 1066009 - DNA, 15 bp, Homo sapiens
caaataaagcctttt

SEQ ID NO: 1066010 - DNA, 23 bp, Homo sapiens
caaataaagccttttaaatcatc

SEQ ID NO: 1066011 - DNA, 20 bp, Homo sapiens
caaataaatcatcctcatgt

SEQ ID NO: 1066012 - DNA, 21 bp, Homo sapiens
caaataaatcatcctcatgtc

SEQ ID NO: 1066013 - DNA, 22 bp, Homo sapiens
caaataaatcatcctcatgtcc

SEQ ID NO: 1066014 - DNA, 17 bp, Homo sapiens
caaataacttcagtcct

SEQ ID NO: 1066015 - DNA, 23 bp, Homo sapiens
caaataacttcagtcctgctcca

SEQ ID NO: 1066016 - DNA, 16 bp, Homo sapiens
caaataagtatttata

SEQ ID NO: 1066017 - DNA, 16 bp, Homo sapiens
caaataagtgtatttt

SEQ ID NO: 1066018 - DNA, 17 bp, Homo sapiens
caaataagtgtattttg

SEQ ID NO: 1066019 - DNA, 19 bp, Homo sapiens
caaataagtgtattttgaa

SEQ ID NO: 1066020 - DNA, 20 bp, Homo sapiens
caaataagtgtattttgaaa

SEQ ID NO: 1066021 - DNA, 23 bp, Homo sapiens
caaataataaagtagcaaaacaa

SEQ ID NO: 1066022 - DNA, 17 bp, Homo sapiens
caaataatggaaaaata

SEQ ID NO: 1066023 - DNA, 15 bp, Homo sapiens
caaatacctcaattt

SEQ ID NO: 1066024 - DNA, 23 bp, Homo sapiens
caaatactcattttaggaaaaaa

SEQ ID NO: 1066025 - DNA, 14 bp, Homo sapiens
caaatactcttagg

SEQ ID NO: 1066026 - DNA, 12 bp, Homo sapiens
caaatactttaa

SEQ ID NO: 1066027 - DNA, 19 bp, Homo sapiens
caaatactttaaaggaaaa

SEQ ID NO: 1066028 - DNA, 17 bp, Homo sapiens
caaatagaaaacaggaa

SEQ ID NO: 1066029 - DNA, 11 bp, Homo sapiens
caaatagattt

SEQ ID NO: 1066030 - DNA, 13 bp, Homo sapiens
caaatagattttt

SEQ ID NO: 1066031 - DNA, 19 bp, Homo sapiens
caaatagatttttgttttt

SEQ ID NO: 1066032 - DNA, 15 bp, Homo sapiens
caaataggaggaaaa

SEQ ID NO: 1066033 - DNA, 21 bp, Homo sapiens
caaataggagtgagtgtatgt

SEQ ID NO: 1066034 - DNA, 19 bp, Homo sapiens
caaataggattaaacacac

SEQ ID NO: 1066035 - DNA, 15 bp, Homo sapiens
caaataggcagaatg

SEQ ID NO: 1066036 - DNA, 17 bp, Homo sapiens
caaataggctattaaaa

SEQ ID NO: 1066037 - DNA, 17 bp, Homo sapiens
caaatatacattttcta

SEQ ID NO: 1066038 - DNA, 16 bp, Homo sapiens
caaatatagaaagttg

SEQ ID NO: 1066039 - DNA, 16 bp, Homo sapiens
caaatatgaaaaatgt

SEQ ID NO: 1066040 - DNA, 15 bp, Homo sapiens
caaatatgcactttc

SEQ ID NO: 1066041 - DNA, 20 bp, Homo sapiens
caaatatgcactttccctag

SEQ ID NO: 1066042 - DNA, 18 bp, Homo sapiens
caaatatgctttgggtca

SEQ ID NO: 1066043 - DNA, 18 bp, Homo sapiens
caaatatgtattttccta

SEQ ID NO: 1066044 - DNA, 13 bp, Homo sapiens
caaatatgtcctg

SEQ ID NO: 1066045 - DNA, 12 bp, Homo sapiens
caaatattaaag

SEQ ID NO: 1066046 - DNA, 19 bp, Homo sapiens
caaatattagcaaagaagc

SEQ ID NO: 1066047 - DNA, 21 bp, Homo sapiens
caaatattagcaaagaagctt

SEQ ID NO: 1066048 - DNA, 20 bp, Homo sapiens
caaatattattcaagtgcct

SEQ ID NO: 1066049 - DNA, 23 bp, Homo sapiens
caaatattattcaagtgcctctt

SEQ ID NO: 1066050 - DNA, 14 bp, Homo sapiens
caaatattgaagtt

SEQ ID NO: 1066051 - DNA, 16 bp, Homo sapiens
caaatattggtgttgt

SEQ ID NO: 1066052 - DNA, 18 bp, Homo sapiens
caaatattgttgacaact

SEQ ID NO: 1066053 - DNA, 12 bp, Homo sapiens
caaatatttatt

SEQ ID NO: 1066054 - DNA, 17 bp, Homo sapiens
caaatcaacagaagcat

SEQ ID NO: 1066055 - DNA, 19 bp, Homo sapiens
caaatcaacagaagcattt

SEQ ID NO: 1066056 - DNA, 14 bp, Homo sapiens
caaatcaatacact

SEQ ID NO: 1066057 - DNA, 15 bp, Homo sapiens
caaatcacacctctg

SEQ ID NO: 1066058 - DNA, 16 bp, Homo sapiens
caaatcacacctctgg

SEQ ID NO: 1066059 - DNA, 16 bp, Homo sapiens
caaatcagctgctact

SEQ ID NO: 1066060 - DNA, 16 bp, Homo sapiens
caaatcaggggccaga

SEQ ID NO: 1066061 - DNA, 17 bp, Homo sapiens
caaatcaggggccagag

SEQ ID NO: 1066062 - DNA, 23 bp, Homo sapiens
caaatcagtcttccttgtggaat

SEQ ID NO: 1066063 - DNA, 16 bp, Homo sapiens
caaatcagtgatctat

SEQ ID NO: 1066064 - DNA, 22 bp, Homo sapiens
caaatcagtgatctatgtttgt

SEQ ID NO: 1066065 - DNA, 14 bp, Homo sapiens
caaatcagttacta

SEQ ID NO: 1066066 - DNA, 20 bp, Homo sapiens
caaatcagttactaagaaga

SEQ ID NO: 1066067 - DNA, 22 bp, Homo sapiens
caaatcagttactaagaagaaa

SEQ ID NO: 1066068 - DNA, 17 bp, Homo sapiens
caaatcatttgtttaaa

SEQ ID NO: 1066069 - DNA, 16 bp, Homo sapiens
caaatccaaggaaaca

SEQ ID NO: 1066070 - DNA, 18 bp, Homo sapiens
caaatccaaggaaacatg

SEQ ID NO: 1066071 - DNA, 19 bp, Homo sapiens
caaatccaaggaaacatgc

SEQ ID NO: 1066072 - DNA, 15 bp, Homo sapiens
caaatccacaagcca

SEQ ID NO: 1066073 - DNA, 18 bp, Homo sapiens
caaatcccagggaaggac

SEQ ID NO: 1066074 - DNA, 14 bp, Homo sapiens
caaatcccatttct

SEQ ID NO: 1066075 - DNA, 20 bp, Homo sapiens
caaatccgctctcttcctgc

SEQ ID NO: 1066076 - DNA, 21 bp, Homo sapiens
caaatccgctctcttcctgcc

SEQ ID NO: 1066077 - DNA, 19 bp, Homo sapiens
caaatcctggaaggacaca

SEQ ID NO: 1066078 - DNA, 22 bp, Homo sapiens
caaatcctggaaggacacagtg

SEQ ID NO: 1066079 - DNA, 15 bp, Homo sapiens
caaatctaatctctt

SEQ ID NO: 1066080 - DNA, 18 bp, Homo sapiens
caaatctaccactgtatg

SEQ ID NO: 1066081 - DNA, 15 bp, Homo sapiens
caaatctattacttt

SEQ ID NO: 1066082 - DNA, 16 bp, Homo sapiens
caaatctcagaacctt

SEQ ID NO: 1066083 - DNA, 16 bp, Homo sapiens
caaatctcctgctgat

SEQ ID NO: 1066084 - DNA, 13 bp, Homo sapiens
caaatctggaagc

SEQ ID NO: 1066085 - DNA, 13 bp, Homo sapiens
caaatctgggctc

SEQ ID NO: 1066086 - DNA, 19 bp, Homo sapiens
caaatctgtatatgttgta

SEQ ID NO: 1066087 - DNA, 12 bp, Homo sapiens
caaatcttgaaa

SEQ ID NO: 1066088 - DNA, 19 bp, Homo sapiens
caaatcttgaaattaagaa

SEQ ID NO: 1066089 - DNA, 21 bp, Homo sapiens
caaatctttctgtaaacagaa

SEQ ID NO: 1066090 - DNA, 23 bp, Homo sapiens
caaatctttctgtaaacagaata

SEQ ID NO: 1066091 - DNA, 18 bp, Homo sapiens
caaatgaaatgtatgcat

SEQ ID NO: 1066092 - DNA, 14 bp, Homo sapiens
caaatgaactttta

SEQ ID NO: 1066093 - DNA, 16 bp, Homo sapiens
caaatgaacttttaca

SEQ ID NO: 1066094 - DNA, 18 bp, Homo sapiens
caaatgaacttttacaga

SEQ ID NO: 1066095 - DNA, 22 bp, Homo sapiens
caaatgaacttttacagaatgc

SEQ ID NO: 1066096 - DNA, 14 bp, Homo sapiens
caaatgaagaaagt

SEQ ID NO: 1066097 - DNA, 22 bp, Homo sapiens
caaatgaataatgcctttgtaa

SEQ ID NO: 1066098 - DNA, 14 bp, Homo sapiens
caaatgaatcattg

SEQ ID NO: 1066099 - DNA, 22 bp, Homo sapiens
caatgggtcttagctctttctc

SEQ ID NO: 1066100 - DNA, 22 bp, Homo sapiens
caatggtgatcctctattttgt

SEQ ID NO: 1066101 - DNA, 22 bp, Homo sapiens
caatggtgcaaaaaaaaactta

SEQ ID NO: 1066102 - DNA, 23 bp, Homo sapiens
caatggtgcaaaaaaaaacttaa

SEQ ID NO: 1066103 - DNA, 21 bp, Homo sapiens
caatggtgtcagtatccaggc

SEQ ID NO: 1066104 - DNA, 13 bp, Homo sapiens
caatggtttattc

SEQ ID NO: 1066105 - DNA, 15 bp, Homo sapiens
caatggtttgtgtca

SEQ ID NO: 1066106 - DNA, 21 bp, Homo sapiens
caatggtttttaaattttgta

SEQ ID NO: 1066107 - DNA, 12 bp, Homo sapiens
caatgtacaatt

SEQ ID NO: 1066108 - DNA, 19 bp, Homo sapiens
caatgtacaattatgtctc

SEQ ID NO: 1066109 - DNA, 17 bp, Homo sapiens
caatgtacttgtttgaa

SEQ ID NO: 1066110 - DNA, 22 bp, Homo sapiens
caatgtataaagattgtactta

SEQ ID NO: 1066111 - DNA, 18 bp, Homo sapiens
caatgtatctttattaaa

SEQ ID NO: 1066112 - DNA, 22 bp, Homo sapiens
caatgtatctttattaaaacaa

SEQ ID NO: 1066113 - DNA, 13 bp, Homo sapiens
caatgtatgtaca

SEQ ID NO: 1066114 - DNA, 17 bp, Homo sapiens
caatgtatgtgtggctg

SEQ ID NO: 1066115 - DNA, 18 bp, Homo sapiens
caatgtcacaacctctct

SEQ ID NO: 1066116 - DNA, 19 bp, Homo sapiens
caatgtcacaacctctctg

SEQ ID NO: 1066117 - DNA, 15 bp, Homo sapiens
caatgtcagcctttg

SEQ ID NO: 1066118 - DNA, 19 bp, Homo sapiens
caatgtcaggaacagaagg

SEQ ID NO: 1066119 - DNA, 22 bp, Homo sapiens
caatgtcctgaaacatgaaccc

SEQ ID NO: 1066120 - DNA, 23 bp, Homo sapiens
caatgtcctgaaacatgaaccca

SEQ ID NO: 1066121 - DNA, 14 bp, Homo sapiens
caatgtctcccaca

SEQ ID NO: 1066122 - DNA, 22 bp, Homo sapiens
caatgtctcccacacccaccct

SEQ ID NO: 1066123 - DNA, 14 bp, Homo sapiens
caatgtctgtgcta

SEQ ID NO: 1066124 - DNA, 20 bp, Homo sapiens
caattgctcttctccacgtc

SEQ ID NO: 1066125 - DNA, 20 bp, Homo sapiens
caattgggagctgccaagag

SEQ ID NO: 1066126 - DNA, 21 bp, Homo sapiens
caattgggagctgccaagagt

SEQ ID NO: 1066127 - DNA, 15 bp, Homo sapiens
caattgtattttata

SEQ ID NO: 1066128 - DNA, 17 bp, Homo sapiens
caattgtcactttttat

SEQ ID NO: 1066129 - DNA, 15 bp, Homo sapiens
caattgtcatttata

SEQ ID NO: 1066130 - DNA, 18 bp, Homo sapiens
caattgtcttaaaaccag

SEQ ID NO: 1066131 - DNA, 18 bp, Homo sapiens
caattgtgagccaccacg

SEQ ID NO: 1066132 - DNA, 19 bp, Homo sapiens
caattgtgggatgtcctct

SEQ ID NO: 1066133 - DNA, 17 bp, Homo sapiens
caattgtgtagcctttt

SEQ ID NO: 1066134 - DNA, 13 bp, Homo sapiens
caattgtgtgaat

SEQ ID NO: 1066135 - DNA, 20 bp, Homo sapiens
caattgtgtgaattaatttc

SEQ ID NO: 1066136 - DNA, 22 bp, Homo sapiens
caattgtttgggtgattcctaa

SEQ ID NO: 1066137 - DNA, 20 bp, Homo sapiens
caattgtttgttctgttttc

SEQ ID NO: 1066138 - DNA, 23 bp, Homo sapiens
caattgttttacctgttctgaaa

SEQ ID NO: 1066139 - DNA, 12 bp, Homo sapiens
caatttaaggaa

SEQ ID NO: 1066140 - DNA, 14 bp, Homo sapiens
caatttacaaagtg

SEQ ID NO: 1066141 - DNA, 15 bp, Homo sapiens
caatttacaaagtgt

SEQ ID NO: 1066142 - DNA, 21 bp, Homo sapiens
caatttacaaagtgtgtatta

SEQ ID NO: 1066143 - DNA, 13 bp, Homo sapiens
caatttagacaaa

SEQ ID NO: 1066144 - DNA, 18 bp, Homo sapiens
caatttagcaaactgatg

SEQ ID NO: 1066145 - DNA, 21 bp, Homo sapiens
caatttagcaaactgatgctg

SEQ ID NO: 1066146 - DNA, 22 bp, Homo sapiens
caatttattaaaatgattgtaa

SEQ ID NO: 1066147 - DNA, 20 bp, Homo sapiens
caatttattatggcacatca

SEQ ID NO: 1066148 - DNA, 19 bp, Homo sapiens
caatttattttattttagc

SEQ ID NO: 1066149 - DNA, 14 bp, Homo sapiens
caatttcagaacca

SEQ ID NO: 1066150 - DNA, 12 bp, Homo sapiens
caatttccccct

SEQ ID NO: 1066151 - DNA, 21 bp, Homo sapiens
caatttcctctccactgctgg

SEQ ID NO: 1066152 - DNA, 15 bp, Homo sapiens
caatttcctttatat

SEQ ID NO: 1066153 - DNA, 20 bp, Homo sapiens
caatttcctttatatttagt

SEQ ID NO: 1066154 - DNA, 14 bp, Homo sapiens
cacagagcacgcct

SEQ ID NO: 1066155 - DNA, 15 bp, Homo sapiens
cacagagccctgagg

SEQ ID NO: 1066156 - DNA, 19 bp, Homo sapiens
cacagagcctggccccagg

SEQ ID NO: 1066157 - DNA, 14 bp, Homo sapiens
cacagagcctggct

SEQ ID NO: 1066158 - DNA, 16 bp, Homo sapiens
cacagaggaagagcag

SEQ ID NO: 1066159 - DNA, 13 bp, Homo sapiens
cacagaggctgcc

SEQ ID NO: 1066160 - DNA, 18 bp, Homo sapiens
cacagaggcttcttcaga

SEQ ID NO: 1066161 - DNA, 14 bp, Homo sapiens
cacagaggggctcg

SEQ ID NO: 1066162 - DNA, 17 bp, Homo sapiens
cacagagggtcccattg

SEQ ID NO: 1066163 - DNA, 23 bp, Homo sapiens
cacagaggtagtctcactgcttg

SEQ ID NO: 1066164 - DNA, 16 bp, Homo sapiens
cacagagtgagccagt

SEQ ID NO: 1066165 - DNA, 17 bp, Homo sapiens
cacagagtgagccagtg

SEQ ID NO: 1066166 - DNA, 16 bp, Homo sapiens
cacagagtgctggact

SEQ ID NO: 1066167 - DNA, 19 bp, Homo sapiens
cacagagtgtgctgctatt

SEQ ID NO: 1066168 - DNA, 21 bp, Homo sapiens
cacagagttgttacattttta

SEQ ID NO: 1066169 - DNA, 22 bp, Homo sapiens
cacagagttgttacatttttaa

SEQ ID NO: 1066170 - DNA, 22 bp, Homo sapiens
cacagataactgaaaattattt

SEQ ID NO: 1066171 - DNA, 20 bp, Homo sapiens
cacagatattgttataaata

SEQ ID NO: 1066172 - DNA, 11 bp, Homo sapiens
cacagatcatg

SEQ ID NO: 1066173 - DNA, 20 bp, Homo sapiens
cacagatcccactggaagat

SEQ ID NO: 1066174 - DNA, 15 bp, Homo sapiens
cacagatgaccaaag

SEQ ID NO: 1066175 - DNA, 23 bp, Homo sapiens
cacagatgaggagcagctggggt

SEQ ID NO: 1066176 - DNA, 16 bp, Homo sapiens
cacagatgctccaggg

SEQ ID NO: 1066177 - DNA, 17 bp, Homo sapiens
cacagatggatttgcct

SEQ ID NO: 1066178 - DNA, 23 bp, Homo sapiens
cacagatggatttgcctgtgcca

SEQ ID NO: 1066179 - DNA, 19 bp, Homo sapiens
cacagatgggtattaaact

SEQ ID NO: 1066180 - DNA, 20 bp, Homo sapiens
cacagatgggtattaaactt

SEQ ID NO: 1066181 - DNA, 15 bp, Homo sapiens
cacagatgtaattat

SEQ ID NO: 1066182 - DNA, 16 bp, Homo sapiens
cacagatgtaattatg

SEQ ID NO: 1066183 - DNA, 15 bp, Homo sapiens
cacagatgtctctgg

SEQ ID NO: 1066184 - DNA, 16 bp, Homo sapiens
cacagatgtctctggg

SEQ ID NO: 1066185 - DNA, 15 bp, Homo sapiens
cacagattgaagaat

SEQ ID NO: 1066186 - DNA, 16 bp, Homo sapiens
cacagattgctgaaac

SEQ ID NO: 1066187 - DNA, 16 bp, Homo sapiens
cacagatttgagctca

SEQ ID NO: 1066188 - DNA, 22 bp, Homo sapiens
cacagatttgagctcagccctg

SEQ ID NO: 1066189 - DNA, 22 bp, Homo sapiens
cacagatttgtgcccattccta

SEQ ID NO: 1066190 - DNA, 23 bp, Homo sapiens
cacagatttttatgttttctttc

SEQ ID NO: 1066191 - DNA, 20 bp, Homo sapiens
cacagcaagtacagcggctc

SEQ ID NO: 1066192 - DNA, 16 bp, Homo sapiens
cacagcacaaattagt

SEQ ID NO: 1066193 - DNA, 15 bp, Homo sapiens
cacagcacaagggca

SEQ ID NO: 1066194 - DNA, 17 bp, Homo sapiens
cacagcacaccagccgc

SEQ ID NO: 1066195 - DNA, 19 bp, Homo sapiens
cacagcacaccagccgctg

SEQ ID NO: 1066196 - DNA, 15 bp, Homo sapiens
cacagcacagccaac

SEQ ID NO: 1066197 - DNA, 18 bp, Homo sapiens
cacagcaccgtgccaacc

SEQ ID NO: 1066198 - DNA, 19 bp, Homo sapiens
cacagcaccgtgccaaccc

SEQ ID NO: 1066199 - DNA, 23 bp, Homo sapiens
cacagcagcagaacaagtgcctc

SEQ ID NO: 1066200 - DNA, 12 bp, Homo sapiens
cacagcagcccc

SEQ ID NO: 1066201 - DNA, 15 bp, Homo sapiens
cacagcagcttcacc

SEQ ID NO: 1066202 - DNA, 13 bp, Homo sapiens
cacagcaggtcct

SEQ ID NO: 1066203 - DNA, 13 bp, Homo sapiens
cacagcagtattg

SEQ ID NO: 1066204 - DNA, 14 bp, Homo sapiens
cacagcatcgggag

SEQ ID NO: 1066205 - DNA, 22 bp, Homo sapiens
cacagcatcgggagcacccaga

SEQ ID NO: 1066206 - DNA, 14 bp, Homo sapiens
cacagcatgcctta

SEQ ID NO: 1066207 - DNA, 17 bp, Homo sapiens
cacagcatggaggagga

SEQ ID NO: 1066208 - DNA, 15 bp, Homo sapiens
cacagcatgtgccaa

SEQ ID NO: 1066209 - DNA, 17 bp, Homo sapiens
cacagcatgtgccaaga

SEQ ID NO: 1066210 - DNA, 13 bp, Homo sapiens
cacagcatgtgta

SEQ ID NO: 1066211 - DNA, 12 bp, Homo sapiens
cacagctgctgg

SEQ ID NO: 1066212 - DNA, 19 bp, Homo sapiens
cacagctgctgttctcagg

SEQ ID NO: 1066213 - DNA, 17 bp, Homo sapiens
cacagctgcttgtcctg

SEQ ID NO: 1066214 - DNA, 22 bp, Homo sapiens
cacagctgcttgtcctgctctc

SEQ ID NO: 1066215 - DNA, 14 bp, Homo sapiens
cacagctgggcaaa

SEQ ID NO: 1066216 - DNA, 16 bp, Homo sapiens
cacagctgggcagggt

SEQ ID NO: 1066217 - DNA, 14 bp, Homo sapiens
cacagctgtagtgg

SEQ ID NO: 1066218 - DNA, 16 bp, Homo sapiens
cacagctgtctgccag

SEQ ID NO: 1066219 - DNA, 17 bp, Homo sapiens
cacagctgtctgccagg

SEQ ID NO: 1066220 - DNA, 20 bp, Homo sapiens
cacagctgtctgccaggcac

SEQ ID NO: 1066221 - DNA, 21 bp, Homo sapiens
cacagctgtctgccaggcact

SEQ ID NO: 1066222 - DNA, 15 bp, Homo sapiens
cacagcttagatttc

SEQ ID NO: 1066223 - DNA, 12 bp, Homo sapiens
cacagcttcttc

SEQ ID NO: 1066224 - DNA, 20 bp, Homo sapiens
cacagcttgacctgaggctg

SEQ ID NO: 1066225 - DNA, 22 bp, Homo sapiens
cacagcttgacctgaggctgtg

SEQ ID NO: 1066226 - DNA, 14 bp, Homo sapiens
cacagcttttgcaa

SEQ ID NO: 1066227 - DNA, 16 bp, Homo sapiens
cacaggaaaaataaac

SEQ ID NO: 1066228 - DNA, 17 bp, Homo sapiens
cacaggaaaaataaacg

SEQ ID NO: 1066229 - DNA, 16 bp, Homo sapiens
cacaggaacggccctg

SEQ ID NO: 1066230 - DNA, 17 bp, Homo sapiens
cacaggaattctcaaga

SEQ ID NO: 1066231 - DNA, 17 bp, Homo sapiens
cacaggacacgaaggct

SEQ ID NO: 1066232 - DNA, 20 bp, Homo sapiens
cacaggacacgaaggctgcc

SEQ ID NO: 1066233 - DNA, 15 bp, Homo sapiens
cacaggacatttctc

SEQ ID NO: 1066234 - DNA, 17 bp, Homo sapiens
cacaggacccccttccc

SEQ ID NO: 1066235 - DNA, 19 bp, Homo sapiens
cacaggacccccttcccct

SEQ ID NO: 1066236 - DNA, 21 bp, Homo sapiens
cacaggagcaatcacaggaaa

SEQ ID NO: 1066237 - DNA, 13 bp, Homo sapiens
cacaggagggcca

SEQ ID NO: 1066238 - DNA, 23 bp, Homo sapiens
cacaggagtcttcagacccagag

SEQ ID NO: 1066239 - DNA, 18 bp, Homo sapiens
cacaggagtgggaaaaca

SEQ ID NO: 1066240 - DNA, 20 bp, Homo sapiens
cacaggagtgtcctcttccc

SEQ ID NO: 1066241 - DNA, 18 bp, Homo sapiens
cacaggagttgtgagccc

SEQ ID NO: 1066242 - DNA, 23 bp, Homo sapiens
cacaggatcctattctcaccagg

SEQ ID NO: 1066243 - DNA, 16 bp, Homo sapiens
cacaggcaaaatcctt

SEQ ID NO: 1066244 - DNA, 22 bp, Homo sapiens
cacaggcaactgaggcagacag

SEQ ID NO: 1066245 - DNA, 21 bp, Homo sapiens
cacaggcaagtccaccccata

SEQ ID NO: 1066246 - DNA, 21 bp, Homo sapiens
cacaggcagctggatgagact

SEQ ID NO: 1066247 - DNA, 20 bp, Homo sapiens
cacaggcagtccaggcctct

SEQ ID NO: 1066248 - DNA, 13 bp, Homo sapiens
cacaggcagtgca

SEQ ID NO: 1066249 - DNA, 23 bp, Homo sapiens
cacaggcccgccctctgcctcct

SEQ ID NO: 1066250 - DNA, 13 bp, Homo sapiens
cacaggccctagc

SEQ ID NO: 1066251 - DNA, 14 bp, Homo sapiens
cacaggccctggct

SEQ ID NO: 1066252 - DNA, 14 bp, Homo sapiens
cacaggcctgttcc

SEQ ID NO: 1066253 - DNA, 13 bp, Homo sapiens
cacaggccttctg

SEQ ID NO: 1066254 - DNA, 18 bp, Homo sapiens
cacaggccttctgtgggg

SEQ ID NO: 1066255 - DNA, 20 bp, Homo sapiens
cacaggccttctgtggggct

SEQ ID NO: 1066256 - DNA, 14 bp, Homo sapiens
cacaggctagatcc

SEQ ID NO: 1066257 - DNA, 15 bp, Homo sapiens
cacaggctagatccc

SEQ ID NO: 1066258 - DNA, 14 bp, Homo sapiens
cacaggctgggtca

SEQ ID NO: 1066259 - DNA, 18 bp, Homo sapiens
cacaggcttagggacagg

SEQ ID NO: 1066260 - DNA, 22 bp, Homo sapiens
cacagggactgaaaacctctcc

SEQ ID NO: 1066261 - DNA, 14 bp, Homo sapiens
cacagggacttgaa

SEQ ID NO: 1066262 - DNA, 16 bp, Homo sapiens
cacagggacttgaagt

SEQ ID NO: 1066263 - DNA, 20 bp, Homo sapiens
cacagggagtgcacatatcc

SEQ ID NO: 1066264 - DNA, 20 bp, Homo sapiens
cacagggattctcacaatag

SEQ ID NO: 1066265 - DNA, 19 bp, Homo sapiens
cacagggcactgactgata

SEQ ID NO: 1066266 - DNA, 13 bp, Homo sapiens
cacagggcagagc

SEQ ID NO: 1066267 - DNA, 14 bp, Homo sapiens
cacagggcagagcc

SEQ ID NO: 1066268 - DNA, 13 bp, Homo sapiens
cacagggcaggcc

SEQ ID NO: 1066269 - DNA, 14 bp, Homo sapiens
cacagggcaggcct

SEQ ID NO: 1066270 - DNA, 22 bp, Homo sapiens
cacagggcaggccttgctgggg

SEQ ID NO: 1066271 - DNA, 19 bp, Homo sapiens
cacagggccccagaaggca

SEQ ID NO: 1066272 - DNA, 22 bp, Homo sapiens
cacagggcccggccacacccag

SEQ ID NO: 1066273 - DNA, 12 bp, Homo sapiens
cacagggctcac

SEQ ID NO: 1066274 - DNA, 16 bp, Homo sapiens
cacagggctcacaggg

SEQ ID NO: 1066275 - DNA, 17 bp, Homo sapiens
cacagggctcacagggc

SEQ ID NO: 1066276 - DNA, 20 bp, Homo sapiens
cacagggctcacagggcagg

SEQ ID NO: 1066277 - DNA, 13 bp, Homo sapiens
cacagggctcttt

SEQ ID NO: 1066278 - DNA, 23 bp, Homo sapiens
cacagggctctttgatggaccca

SEQ ID NO: 1066279 - DNA, 17 bp, Homo sapiens
cacaggggaggtgatag

SEQ ID NO: 1066280 - DNA, 14 bp, Homo sapiens
cacaggggcaggcc

SEQ ID NO: 1066281 - DNA, 15 bp, Homo sapiens
cacaggggcaggcct

SEQ ID NO: 1066282 - DNA, 17 bp, Homo sapiens
cacaggggcaggcctgg

SEQ ID NO: 1066283 - DNA, 20 bp, Homo sapiens
cacaggggcaggcctgggac

SEQ ID NO: 1066284 - DNA, 18 bp, Homo sapiens
cacaggggccctgtacag

SEQ ID NO: 1066285 - DNA, 22 bp, Homo sapiens
cacagggtccccgagtgcctag

SEQ ID NO: 1066286 - DNA, 22 bp, Homo sapiens
cacaggtagcacagattttgaa

SEQ ID NO: 1066287 - DNA, 21 bp, Homo sapiens
cacaggtcagggctcagagtg

SEQ ID NO: 1066288 - DNA, 22 bp, Homo sapiens
cacaggtcatcagatgcctgct

SEQ ID NO: 1066289 - DNA, 14 bp, Homo sapiens
cacaggtcccacct

SEQ ID NO: 1066290 - DNA, 21 bp, Homo sapiens
cacaggtctcattgcttctga

SEQ ID NO: 1066291 - DNA, 20 bp, Homo sapiens
cacaggtgcgggaccatctg

SEQ ID NO: 1066292 - DNA, 21 bp, Homo sapiens
cacaggtgcgggaccatctga

SEQ ID NO: 1066293 - DNA, 13 bp, Homo sapiens
cacaggtgtggga

SEQ ID NO: 1066294 - DNA, 23 bp, Homo sapiens
cacaggttagggtgtgtgccaca

SEQ ID NO: 1066295 - DNA, 19 bp, Homo sapiens
cacaggttcatgccaccat

SEQ ID NO: 1066296 - DNA, 24 bp, Homo sapiens
cacaggtttccccaaggcctctca

SEQ ID NO: 1066297 - DNA, 14 bp, Homo sapiens
cacagtaaaaataa

SEQ ID NO: 1066298 - DNA, 21 bp, Homo sapiens
cacagtaaaaatggaaactat

SEQ ID NO: 1066299 - DNA, 15 bp, Homo sapiens
cacagtaaaattaac

SEQ ID NO: 1066300 - DNA, 19 bp, Homo sapiens
cacagtacgaacctacagt

SEQ ID NO: 1066301 - DNA, 14 bp, Homo sapiens
cacagtactcactt

SEQ ID NO: 1066302 - DNA, 16 bp, Homo sapiens
cacagtactttattgt

SEQ ID NO: 1066303 - DNA, 18 bp, Homo sapiens
cacagtactttattgtac

SEQ ID NO: 1066304 - DNA, 21 bp, Homo sapiens
cacagtactttattgtacaga

SEQ ID NO: 1066305 - DNA, 20 bp, Homo sapiens
cacagtagaactgtctgtga

SEQ ID NO: 1066306 - DNA, 16 bp, Homo sapiens
cacagtagagccagct

SEQ ID NO: 1066307 - DNA, 19 bp, Homo sapiens
cacagtagagtagggtaga

SEQ ID NO: 1066308 - DNA, 20 bp, Homo sapiens
cacagtagctccaacacttt

SEQ ID NO: 1066309 - DNA, 23 bp, Homo sapiens
cacagtattatttctccatcccc

SEQ ID NO: 1066310 - DNA, 14 bp, Homo sapiens
cacagtcaaaataa

SEQ ID NO: 1066311 - DNA, 16 bp, Homo sapiens
cacagtcactgatgta

SEQ ID NO: 1066312 - DNA, 15 bp, Homo sapiens
cacagtcaggggctg

SEQ ID NO: 1066313 - DNA, 17 bp, Homo sapiens
cacagtcattctaggat

SEQ ID NO: 1066314 - DNA, 13 bp, Homo sapiens
cacagtccaggaa

SEQ ID NO: 1066315 - DNA, 14 bp, Homo sapiens
cacagtcccccacc

SEQ ID NO: 1066316 - DNA, 17 bp, Homo sapiens
cacagtcccccacccac

SEQ ID NO: 1066317 - DNA, 19 bp, Homo sapiens
cacagtcccccacccacct

SEQ ID NO: 1066318 - DNA, 20 bp, Homo sapiens
cacagtcccccacccacctc

SEQ ID NO: 1066319 - DNA, 21 bp, Homo sapiens
cacagtcctatgtacagagct

SEQ ID NO: 1066320 - DNA, 15 bp, Homo sapiens
cacagtctatttttt

SEQ ID NO: 1066321 - DNA, 12 bp, Homo sapiens
cacagtgaaacg

SEQ ID NO: 1066322 - DNA, 15 bp, Homo sapiens
cacagtgaagcaaat

SEQ ID NO: 1066323 - DNA, 23 bp, Homo sapiens
cacagtgagaggggagggctcct

SEQ ID NO: 1066324 - DNA, 21 bp, Homo sapiens
cacagtgagagtactcacttt

SEQ ID NO: 1066325 - DNA, 15 bp, Homo sapiens
cacagtgatatattt

SEQ ID NO: 1066326 - DNA, 19 bp, Homo sapiens
cacagtgcagcttgcagtc

SEQ ID NO: 1066327 - DNA, 12 bp, Homo sapiens
cacagtgcagtt

SEQ ID NO: 1066328 - DNA, 17 bp, Homo sapiens
cacagtgcctgtacagg

SEQ ID NO: 1066329 - DNA, 14 bp, Homo sapiens
cacagtgctgcccc

SEQ ID NO: 1066330 - DNA, 15 bp, Homo sapiens
cacagtgctgcccct

SEQ ID NO: 1066331 - DNA, 19 bp, Homo sapiens
cacagtgctgccccttgca

SEQ ID NO: 1066332 - DNA, 21 bp, Homo sapiens
cacagtgctgccccttgcaag

SEQ ID NO: 1066333 - DNA, 17 bp, Homo sapiens
cacagtgctgcttctct

SEQ ID NO: 1066334 - DNA, 17 bp, Homo sapiens
cacagtggactcagcag

SEQ ID NO: 1066335 - DNA, 16 bp, Homo sapiens
cacatagctgtctaga

SEQ ID NO: 1066336 - DNA, 19 bp, Homo sapiens
cacataggctggtggcctt

SEQ ID NO: 1066337 - DNA, 21 bp, Homo sapiens
cacataggctggtggccttgg

SEQ ID NO: 1066338 - DNA, 17 bp, Homo sapiens
cacatagtgtcctgccc

SEQ ID NO: 1066339 - DNA, 13 bp, Homo sapiens
cacatatacatat

SEQ ID NO: 1066340 - DNA, 14 bp, Homo sapiens
cacatatacatata

SEQ ID NO: 1066341 - DNA, 15 bp, Homo sapiens
cacatatacatatga

SEQ ID NO: 1066342 - DNA, 22 bp, Homo sapiens
cacatatacgtgacagaattgt

SEQ ID NO: 1066343 - DNA, 18 bp, Homo sapiens
cacatatccaggcaccag

SEQ ID NO: 1066344 - DNA, 19 bp, Homo sapiens
cacatatccaggcaccagg

SEQ ID NO: 1066345 - DNA, 13 bp, Homo sapiens
cacatatgagggg

SEQ ID NO: 1066346 - DNA, 21 bp, Homo sapiens
cacatattagtgcagccaagt

SEQ ID NO: 1066347 - DNA, 22 bp, Homo sapiens
cacatcaagcatgcaataatgt

SEQ ID NO: 1066348 - DNA, 13 bp, Homo sapiens
cacatcaagcttt

SEQ ID NO: 1066349 - DNA, 13 bp, Homo sapiens
cacatcacattcc

SEQ ID NO: 1066350 - DNA, 15 bp, Homo sapiens
cacatcagaaaggaa

SEQ ID NO: 1066351 - DNA, 21 bp, Homo sapiens
cacatcagcacgatttctgtt

SEQ ID NO: 1066352 - DNA, 22 bp, Homo sapiens
cacatcagcacgatttctgttt

SEQ ID NO: 1066353 - DNA, 16 bp, Homo sapiens
cacatcagccccacag

SEQ ID NO: 1066354 - DNA, 18 bp, Homo sapiens
cacatcagccccacagga

SEQ ID NO: 1066355 - DNA, 18 bp, Homo sapiens
cacatcagctcaaaattt

SEQ ID NO: 1066356 - DNA, 22 bp, Homo sapiens
cacatcatagataaagctgatt

SEQ ID NO: 1066357 - DNA, 18 bp, Homo sapiens
cacatcatggaccaaatg

SEQ ID NO: 1066358 - DNA, 22 bp, Homo sapiens
cacatccagctgcccctccctc

SEQ ID NO: 1066359 - DNA, 16 bp, Homo sapiens
cacatccatctacttt

SEQ ID NO: 1066360 - DNA, 14 bp, Homo sapiens
cacatcccagcagc

SEQ ID NO: 1066361 - DNA, 22 bp, Homo sapiens
cacatcccagcagcccaagctt

SEQ ID NO: 1066362 - DNA, 14 bp, Homo sapiens
cacatccccagagc

SEQ ID NO: 1066363 - DNA, 19 bp, Homo sapiens
cacatccccagagcccagc

SEQ ID NO: 1066364 - DNA, 21 bp, Homo sapiens
cacatccccagagcccagctc

SEQ ID NO: 1066365 - DNA, 17 bp, Homo sapiens
cacatccccagccaggg

SEQ ID NO: 1066366 - DNA, 21 bp, Homo sapiens
cacatccccttagaggacctg

SEQ ID NO: 1066367 - DNA, 14 bp, Homo sapiens
cacatcccggcctc

SEQ ID NO: 1066368 - DNA, 19 bp, Homo sapiens
cacatcccggcctcttcca

SEQ ID NO: 1066369 - DNA, 20 bp, Homo sapiens
cacatcccggcctcttccac

SEQ ID NO: 1066370 - DNA, 22 bp, Homo sapiens
cacatcctccacgttctgctca

SEQ ID NO: 1066371 - DNA, 13 bp, Homo sapiens
cacatcctcctgc

SEQ ID NO: 1066372 - DNA, 15 bp, Homo sapiens
cacatcctcctgccc

SEQ ID NO: 1066373 - DNA, 18 bp, Homo sapiens
cacatcctcctgcccagc

SEQ ID NO: 1066374 - DNA, 18 bp, Homo sapiens
cacatccttctcactgcc

SEQ ID NO: 1066375 - DNA, 20 bp, Homo sapiens
cacatccttctcactgccat

SEQ ID NO: 1066376 - DNA, 17 bp, Homo sapiens
cacatctaacctcatct

SEQ ID NO: 1066377 - DNA, 17 bp, Homo sapiens
cacatctaagcctgaag

SEQ ID NO: 1066378 - DNA, 22 bp, Homo sapiens
cacatctaagcctgaaggggcg

SEQ ID NO: 1066379 - DNA, 14 bp, Homo sapiens
cacatctctggaaa

SEQ ID NO: 1066380 - DNA, 16 bp, Homo sapiens
cacatctgccagacct

SEQ ID NO: 1066381 - DNA, 21 bp, Homo sapiens
cacatctggctgcacaggctg

SEQ ID NO: 1066382 - DNA, 18 bp, Homo sapiens
cacatctgggtgccctga

SEQ ID NO: 1066383 - DNA, 19 bp, Homo sapiens
cacatctgggtgccctgaa

SEQ ID NO: 1066384 - DNA, 14 bp, Homo sapiens
cacatctgtcctca

SEQ ID NO: 1066385 - DNA, 17 bp, Homo sapiens
cacatctgtcctcaccc

SEQ ID NO: 1066386 - DNA, 21 bp, Homo sapiens
cacatctgtcctcaccctgtg

SEQ ID NO: 1066387 - DNA, 23 bp, Homo sapiens
cacatctgtgtcttgtttggaat

SEQ ID NO: 1066388 - DNA, 12 bp, Homo sapiens
cacatcttccct

SEQ ID NO: 1066389 - DNA, 22 bp, Homo sapiens
cacatcttccctagagggttcc

SEQ ID NO: 1066390 - DNA, 16 bp, Homo sapiens
cacatcttgctctgca

SEQ ID NO: 1066391 - DNA, 21 bp, Homo sapiens
cacatcttggctatgtaattc

SEQ ID NO: 1066392 - DNA, 13 bp, Homo sapiens
cacatctttactc

SEQ ID NO: 1066393 - DNA, 15 bp, Homo sapiens
cacatctttatctgt

SEQ ID NO: 1066394 - DNA, 21 bp, Homo sapiens
cacatgaaacctacacactgt

SEQ ID NO: 1066395 - DNA, 18 bp, Homo sapiens
cacatgaaaccttatttt

SEQ ID NO: 1066396 - DNA, 21 bp, Homo sapiens
cacatgacaactttgccagct

SEQ ID NO: 1066397 - DNA, 23 bp, Homo sapiens
cacatgacgccagataaaatgtt

SEQ ID NO: 1066398 - DNA, 20 bp, Homo sapiens
cacatgactcgggggtgggg

SEQ ID NO: 1066399 - DNA, 16 bp, Homo sapiens
cacatgaggccatctc

SEQ ID NO: 1066400 - DNA, 19 bp, Homo sapiens
cacatgcaaggtcattttt

SEQ ID NO: 1066401 - DNA, 14 bp, Homo sapiens
cacatgcagctgca

SEQ ID NO: 1066402 - DNA, 20 bp, Homo sapiens
cacatgcccctcccccagct

SEQ ID NO: 1066403 - DNA, 23 bp, Homo sapiens
cacatgcccctcccccagctgcg

SEQ ID NO: 1066404 - DNA, 13 bp, Homo sapiens
cacatgcgcactc

SEQ ID NO: 1066405 - DNA, 21 bp, Homo sapiens
cacatgcgtatatgtgcgtct

SEQ ID NO: 1066406 - DNA, 16 bp, Homo sapiens
cacatgctaaagccag

SEQ ID NO: 1066407 - DNA, 13 bp, Homo sapiens
cacatgctatgtt

SEQ ID NO: 1066408 - DNA, 19 bp, Homo sapiens
cacatgctgcctggcacag

SEQ ID NO: 1066409 - DNA, 17 bp, Homo sapiens
cacatgctgtctggccc

SEQ ID NO: 1066410 - DNA, 19 bp, Homo sapiens
cacatggattttggcaggg

SEQ ID NO: 1066411 - DNA, 20 bp, Homo sapiens
cacatggattttggcagggc

SEQ ID NO: 1066412 - DNA, 18 bp, Homo sapiens
cacatggccatagaggcc

SEQ ID NO: 1066413 - DNA, 14 bp, Homo sapiens
caccaatgagcctt

SEQ ID NO: 1066414 - DNA, 16 bp, Homo sapiens
caccaattatcatctt

SEQ ID NO: 1066415 - DNA, 24 bp, Homo sapiens
caccaattggttaatctttcctga

SEQ ID NO: 1066416 - DNA, 23 bp, Homo sapiens
caccaatttggtaaaaatgctgc

SEQ ID NO: 1066417 - DNA, 14 bp, Homo sapiens
caccacacagtcac

SEQ ID NO: 1066418 - DNA, 21 bp, Homo sapiens
caccacacagtcacccctccc

SEQ ID NO: 1066419 - DNA, 15 bp, Homo sapiens
caccacacccaggtc

SEQ ID NO: 1066420 - DNA, 18 bp, Homo sapiens
caccacacccaggtctct

SEQ ID NO: 1066421 - DNA, 14 bp, Homo sapiens
caccacagacacac

SEQ ID NO: 1066422 - DNA, 16 bp, Homo sapiens
caccacagacacacac

SEQ ID NO: 1066423 - DNA, 19 bp, Homo sapiens
caccacagacacacacacg

SEQ ID NO: 1066424 - DNA, 13 bp, Homo sapiens
caccacagcaggt

SEQ ID NO: 1066425 - DNA, 13 bp, Homo sapiens
caccacagccagc

SEQ ID NO: 1066426 - DNA, 20 bp, Homo sapiens
caccacagccggtcagagga

SEQ ID NO: 1066427 - DNA, 17 bp, Homo sapiens
caccacatagcatgctt

SEQ ID NO: 1066428 - DNA, 14 bp, Homo sapiens
caccacatctaagc

SEQ ID NO: 1066429 - DNA, 19 bp, Homo sapiens
caccacatctgccagacct

SEQ ID NO: 1066430 - DNA, 15 bp, Homo sapiens
caccaccacctgacg

SEQ ID NO: 1066431 - DNA, 14 bp, Homo sapiens
caccaccacgcctg

SEQ ID NO: 1066432 - DNA, 13 bp, Homo sapiens
caccaccactggc

SEQ ID NO: 1066433 - DNA, 18 bp, Homo sapiens
caccaccactggccacca

SEQ ID NO: 1066434 - DNA, 11 bp, Homo sapiens
caccaccagga

SEQ ID NO: 1066435 - DNA, 14 bp, Homo sapiens
caccaccaggagca

SEQ ID NO: 1066436 - DNA, 11 bp, Homo sapiens
caccacccaaa

SEQ ID NO: 1066437 - DNA, 12 bp, Homo sapiens
caccacccagcc

SEQ ID NO: 1066438 - DNA, 17 bp, Homo sapiens
cacccactctggtggcc

SEQ ID NO: 1066439 - DNA, 15 bp, Homo sapiens
cacccagagcacccc

SEQ ID NO: 1066440 - DNA, 13 bp, Homo sapiens
cacccagcaatag

SEQ ID NO: 1066441 - DNA, 19 bp, Homo sapiens
cacccagcaggcagagtgg

SEQ ID NO: 1066442 - DNA, 15 bp, Homo sapiens
cacccagcccattct

SEQ ID NO: 1066443 - DNA, 22 bp, Homo sapiens
cacccagcccattctctctcct

SEQ ID NO: 1066444 - DNA, 23 bp, Homo sapiens
cacccagcccattctctctcctg

SEQ ID NO: 1066445 - DNA, 13 bp, Homo sapiens
cacccagcccctc

SEQ ID NO: 1066446 - DNA, 23 bp, Homo sapiens
cacccagcccctctcccctctct

SEQ ID NO: 1066447 - DNA, 12 bp, Homo sapiens
cacccagccctt

SEQ ID NO: 1066448 - DNA, 14 bp, Homo sapiens
cacccagcccttcc

SEQ ID NO: 1066449 - DNA, 15 bp, Homo sapiens
cacccagcccttcct

SEQ ID NO: 1066450 - DNA, 14 bp, Homo sapiens
cacccagctccagg

SEQ ID NO: 1066451 - DNA, 12 bp, Homo sapiens
cacccaggcaat

SEQ ID NO: 1066452 - DNA, 22 bp, Homo sapiens
cacccaggcaatcttgccttct

SEQ ID NO: 1066453 - DNA, 23 bp, Homo sapiens
cacccaggctctggagccagaga

SEQ ID NO: 1066454 - DNA, 12 bp, Homo sapiens
cacccaggctgc

SEQ ID NO: 1066455 - DNA, 16 bp, Homo sapiens
cacccaggctgcactg

SEQ ID NO: 1066456 - DNA, 20 bp, Homo sapiens
cacccaggctgcactgcagt

SEQ ID NO: 1066457 - DNA, 20 bp, Homo sapiens
cacccaggctggactgcaat

SEQ ID NO: 1066458 - DNA, 15 bp, Homo sapiens
cacccagggctccct

SEQ ID NO: 1066459 - DNA, 21 bp, Homo sapiens
cacccagggctccctcctgga

SEQ ID NO: 1066460 - DNA, 22 bp, Homo sapiens
cacccagggctccctcctggag

SEQ ID NO: 1066461 - DNA, 24 bp, Homo sapiens
cacccagggctccctcctggagca

SEQ ID NO: 1066462 - DNA, 23 bp, Homo sapiens
cacccaggggaaggccctgaggc

SEQ ID NO: 1066463 - DNA, 18 bp, Homo sapiens
cacccaggtgatttcctc

SEQ ID NO: 1066464 - DNA, 23 bp, Homo sapiens
cacccaggtgatttcctctaaag

SEQ ID NO: 1066465 - DNA, 14 bp, Homo sapiens
cacccagtgctgcc

SEQ ID NO: 1066466 - DNA, 16 bp, Homo sapiens
cacccagtgctgccat

SEQ ID NO: 1066467 - DNA, 23 bp, Homo sapiens
cacccagtgctgccatgccactg

SEQ ID NO: 1066468 - DNA, 23 bp, Homo sapiens
cacccatcctaccaatgcatgca

SEQ ID NO: 1066469 - DNA, 21 bp, Homo sapiens
cacccatcgtccaccccagtg

SEQ ID NO: 1066470 - DNA, 11 bp, Homo sapiens
cacccatctgt

SEQ ID NO: 1066471 - DNA, 18 bp, Homo sapiens
cacccatctgtctgccaa

SEQ ID NO: 1066472 - DNA, 17 bp, Homo sapiens
cacccatcttcctgctg

SEQ ID NO: 1066473 - DNA, 19 bp, Homo sapiens
cacccatcttcctgctgct

SEQ ID NO: 1066474 - DNA, 21 bp, Homo sapiens
cacccatcttcctgctgctgt

SEQ ID NO: 1066475 - DNA, 22 bp, Homo sapiens
cacccatcttcctgctgctgta

SEQ ID NO: 1066476 - DNA, 15 bp, Homo sapiens
cacccatgaagacag

SEQ ID NO: 1066477 - DNA, 14 bp, Homo sapiens
cacccatgccagag

SEQ ID NO: 1066478 - DNA, 14 bp, Homo sapiens
cacccattatctgg

SEQ ID NO: 1066479 - DNA, 22 bp, Homo sapiens
cacccattcccccatgtggctg

SEQ ID NO: 1066480 - DNA, 12 bp, Homo sapiens
caccccaactct

SEQ ID NO: 1066481 - DNA, 17 bp, Homo sapiens
caccccaactctcccca

SEQ ID NO: 1066482 - DNA, 18 bp, Homo sapiens
caccccaactctccccag

SEQ ID NO: 1066483 - DNA, 16 bp, Homo sapiens
caccccacaccccagc

SEQ ID NO: 1066484 - DNA, 11 bp, Homo sapiens
caccccacact

SEQ ID NO: 1066485 - DNA, 19 bp, Homo sapiens
caccccacagactccggcc

SEQ ID NO: 1066486 - DNA, 10 bp, Homo sapiens
caccccaccc

SEQ ID NO: 1066487 - DNA, 22 bp, Homo sapiens
caccccacccccttcagtgccc

SEQ ID NO: 1066488 - DNA, 12 bp, Homo sapiens
caccccacctct

SEQ ID NO: 1066489 - DNA, 22 bp, Homo sapiens
caccccactgcaatcctgtctt

SEQ ID NO: 1066490 - DNA, 20 bp, Homo sapiens
caccccagaaatcactgtga

SEQ ID NO: 1066491 - DNA, 21 bp, Homo sapiens
caccccagaggacacaggcag

SEQ ID NO: 1066492 - DNA, 23 bp, Homo sapiens
caccccagagtgggagaggctgg

SEQ ID NO: 1066493 - DNA, 18 bp, Homo sapiens
caccccagcacagccacc

SEQ ID NO: 1066494 - DNA, 20 bp, Homo sapiens
caccccagcacagccacctc

SEQ ID NO: 1066495 - DNA, 12 bp, Homo sapiens
caccccagccca

SEQ ID NO: 1066496 - DNA, 15 bp, Homo sapiens
caccccagcctcatt

SEQ ID NO: 1066497 - DNA, 11 bp, Homo sapiens
caccccagctc

SEQ ID NO: 1066498 - DNA, 13 bp, Homo sapiens
caccccagctccg

SEQ ID NO: 1066499 - DNA, 17 bp, Homo sapiens
caccccaggacagttta

SEQ ID NO: 1066500 - DNA, 17 bp, Homo sapiens
caccccaggacgccact

SEQ ID NO: 1066501 - DNA, 18 bp, Homo sapiens
caccccaggacgccactc

SEQ ID NO: 1066502 - DNA, 23 bp, Homo sapiens
caccccagtgcggacccttccca

SEQ ID NO: 1066503 - DNA, 20 bp, Homo sapiens
caccccataataaccctgcc

SEQ ID NO: 1066504 - DNA, 19 bp, Homo sapiens
caccccatgagctcggggt

SEQ ID NO: 1066505 - DNA, 19 bp, Homo sapiens
caccccatgcacctcaggg

SEQ ID NO: 1066506 - DNA, 15 bp, Homo sapiens
caccccatgccaaag

SEQ ID NO: 1066507 - DNA, 17 bp, Homo sapiens
caccccatgccaaagct

SEQ ID NO: 1066508 - DNA, 17 bp, Homo sapiens
cacccccaacccccaga

SEQ ID NO: 1066509 - DNA, 20 bp, Homo sapiens
cacccccaacttcaccaccc

SEQ ID NO: 1066510 - DNA, 15 bp, Homo sapiens
cacccccaagcctgg

SEQ ID NO: 1066511 - DNA, 16 bp, Homo sapiens
cacccccaagcctggg

SEQ ID NO: 1066512 - DNA, 13 bp, Homo sapiens
cacccccacccac

SEQ ID NO: 1066513 - DNA, 14 bp, Homo sapiens
cacccccacccacc

SEQ ID NO: 1066514 - DNA, 15 bp, Homo sapiens
cacccccagccaggc

SEQ ID NO: 1066515 - DNA, 23 bp, Homo sapiens
cacccccagccccgactccagcc

SEQ ID NO: 1066516 - DNA, 14 bp, Homo sapiens
cacccccagctcaa

SEQ ID NO: 1066517 - DNA, 12 bp, Homo sapiens
cacccccagctg

SEQ ID NO: 1066518 - DNA, 14 bp, Homo sapiens
cacccccaggcctc

SEQ ID NO: 1066519 - DNA, 17 bp, Homo sapiens
cacccccaggcctccta

SEQ ID NO: 1066520 - DNA, 14 bp, Homo sapiens
cacccccagttcct

SEQ ID NO: 1066521 - DNA, 19 bp, Homo sapiens
cacccccatcttccacctg

SEQ ID NO: 1066522 - DNA, 15 bp, Homo sapiens
caccccccaagctgt

SEQ ID NO: 1066523 - DNA, 13 bp, Homo sapiens
caccccccactca

SEQ ID NO: 1066524 - DNA, 15 bp, Homo sapiens
caccccccactcagt

SEQ ID NO: 1066525 - DNA, 17 bp, Homo sapiens
cacccccctcctccccc

SEQ ID NO: 1066526 - DNA, 18 bp, Homo sapiens
cacccccctcctccccct

SEQ ID NO: 1066527 - DNA, 20 bp, Homo sapiens
cacccccctctctttctctg

SEQ ID NO: 1066528 - DNA, 18 bp, Homo sapiens
cacccccgacggcctcca

SEQ ID NO: 1066529 - DNA, 16 bp, Homo sapiens
cacccccgctggagga

SEQ ID NO: 1066530 - DNA, 20 bp, Homo sapiens
cacccccgggatcctgcccc

SEQ ID NO: 1066531 - DNA, 21 bp, Homo sapiens
cacccccgggatcctgccccc

SEQ ID NO: 1066532 - DNA, 20 bp, Homo sapiens
caccccctcaagccaatccc

SEQ ID NO: 1066533 - DNA, 16 bp, Homo sapiens
caccccctccccaggg

SEQ ID NO: 1066534 - DNA, 19 bp, Homo sapiens
caccccctccccgcccctg

SEQ ID NO: 1066535 - DNA, 15 bp, Homo sapiens
caccccctcctcccc

SEQ ID NO: 1066536 - DNA, 14 bp, Homo sapiens
caccccctgccctg

SEQ ID NO: 1066537 - DNA, 16 bp, Homo sapiens
caccccctgccctgca

SEQ ID NO: 1066538 - DNA, 17 bp, Homo sapiens
caccccctgccctgcac

SEQ ID NO: 1066539 - DNA, 16 bp, Homo sapiens
caccccctgggcagat

SEQ ID NO: 1066540 - DNA, 15 bp, Homo sapiens
caccccctgttccct

SEQ ID NO: 1066541 - DNA, 13 bp, Homo sapiens
cacccccttcccc

SEQ ID NO: 1066542 - DNA, 14 bp, Homo sapiens
caccccgccgttcc

SEQ ID NO: 1066543 - DNA, 20 bp, Homo sapiens
caccccgccgttccctgcgc

SEQ ID NO: 1066544 - DNA, 18 bp, Homo sapiens
caccccggcctccactcc

SEQ ID NO: 1066545 - DNA, 15 bp, Homo sapiens
caccccgggctctct

SEQ ID NO: 1066546 - DNA, 18 bp, Homo sapiens
caccccgggctctctgct

SEQ ID NO: 1066547 - DNA, 18 bp, Homo sapiens
caccccggggaccctgtg

SEQ ID NO: 1066548 - DNA, 20 bp, Homo sapiens
caccccggggaccctgtgac

SEQ ID NO: 1066549 - DNA, 22 bp, Homo sapiens
caccccgtctggggttcagccc

SEQ ID NO: 1066550 - DNA, 23 bp, Homo sapiens
caccccgtctggggttcagcccc

SEQ ID NO: 1066551 - DNA, 13 bp, Homo sapiens
cacccctcactcc

SEQ ID NO: 1066552 - DNA, 17 bp, Homo sapiens
cacccctcactctggcc

SEQ ID NO: 1066553 - DNA, 22 bp, Homo sapiens
cacccctccagaacacggctca

SEQ ID NO: 1066554 - DNA, 12 bp, Homo sapiens
cacccctcccat

SEQ ID NO: 1066555 - DNA, 13 bp, Homo sapiens
cacccctccccag

SEQ ID NO: 1066556 - DNA, 15 bp, Homo sapiens
cacccctcccctgcc

SEQ ID NO: 1066557 - DNA, 22 bp, Homo sapiens
cacccctcccctgccctagagc

SEQ ID NO: 1066558 - DNA, 21 bp, Homo sapiens
caccgcccccaccccttcccc

SEQ ID NO: 1066559 - DNA, 14 bp, Homo sapiens
caccgccgcagaag

SEQ ID NO: 1066560 - DNA, 20 bp, Homo sapiens
caccgccgcagaagcagccc

SEQ ID NO: 1066561 - DNA, 21 bp, Homo sapiens
caccgccgccaccctgcccct

SEQ ID NO: 1066562 - DNA, 20 bp, Homo sapiens
caccgcctctggccgccacc

SEQ ID NO: 1066563 - DNA, 21 bp, Homo sapiens
caccgcctctggccgccaccc

SEQ ID NO: 1066564 - DNA, 13 bp, Homo sapiens
caccgcctgccct

SEQ ID NO: 1066565 - DNA, 15 bp, Homo sapiens
caccgcctgccctcc

SEQ ID NO: 1066566 - DNA, 19 bp, Homo sapiens
caccgcgggtgtgggaaag

SEQ ID NO: 1066567 - DNA, 15 bp, Homo sapiens
caccgctcagtgtca

SEQ ID NO: 1066568 - DNA, 16 bp, Homo sapiens
caccgctcagtgtcag

SEQ ID NO: 1066569 - DNA, 12 bp, Homo sapiens
caccgctgccta

SEQ ID NO: 1066570 - DNA, 12 bp, Homo sapiens
caccgctggccc

SEQ ID NO: 1066571 - DNA, 15 bp, Homo sapiens
caccggaactgggct

SEQ ID NO: 1066572 - DNA, 17 bp, Homo sapiens
caccggaactgggctgg

SEQ ID NO: 1066573 - DNA, 22 bp, Homo sapiens
caccggagctttcaaagaagga

SEQ ID NO: 1066574 - DNA, 18 bp, Homo sapiens
caccggcctgtgggtctc

SEQ ID NO: 1066575 - DNA, 21 bp, Homo sapiens
caccggcctgtgggtctctga

SEQ ID NO: 1066576 - DNA, 15 bp, Homo sapiens
caccgggagcctccc

SEQ ID NO: 1066577 - DNA, 18 bp, Homo sapiens
caccgggctgcaggtgct

SEQ ID NO: 1066578 - DNA, 18 bp, Homo sapiens
caccgggggtggctctgt

SEQ ID NO: 1066579 - DNA, 16 bp, Homo sapiens
caccggtccagctggc

SEQ ID NO: 1066580 - DNA, 18 bp, Homo sapiens
caccggtccagctggcct

SEQ ID NO: 1066581 - DNA, 14 bp, Homo sapiens
caccgtactgtgga

SEQ ID NO: 1066582 - DNA, 15 bp, Homo sapiens
caccgtcatggctta

SEQ ID NO: 1066583 - DNA, 19 bp, Homo sapiens
caccgtcccgcacagtgga

SEQ ID NO: 1066584 - DNA, 16 bp, Homo sapiens
caccgtccgccctgct

SEQ ID NO: 1066585 - DNA, 18 bp, Homo sapiens
caccgtccgccctgctcc

SEQ ID NO: 1066586 - DNA, 16 bp, Homo sapiens
caccgtctcggccctg

SEQ ID NO: 1066587 - DNA, 15 bp, Homo sapiens
caccgtgaaccagag

SEQ ID NO: 1066588 - DNA, 24 bp, Homo sapiens
caccgtgcccagccctaaacatca

SEQ ID NO: 1066589 - DNA, 13 bp, Homo sapiens
caccgtgcctggc

SEQ ID NO: 1066590 - DNA, 15 bp, Homo sapiens
caccgtggaccttcc

SEQ ID NO: 1066591 - DNA, 17 bp, Homo sapiens
caccgtggaggaggaag

SEQ ID NO: 1066592 - DNA, 13 bp, Homo sapiens
caccgtggcctgg

SEQ ID NO: 1066593 - DNA, 14 bp, Homo sapiens
caccgtggcctggg

SEQ ID NO: 1066594 - DNA, 15 bp, Homo sapiens
caccgtggggaaggg

SEQ ID NO: 1066595 - DNA, 19 bp, Homo sapiens
caccgtgtcaagctgctct

SEQ ID NO: 1066596 - DNA, 23 bp, Homo sapiens
caccgtgtcaagctgctctgagc

SEQ ID NO: 1066597 - DNA, 15 bp, Homo sapiens
caccgtgtcctcctc

SEQ ID NO: 1066598 - DNA, 20 bp, Homo sapiens
caccgtgtcctcctctgagg

SEQ ID NO: 1066599 - DNA, 14 bp, Homo sapiens
caccgttcattcag

SEQ ID NO: 1066600 - DNA, 20 bp, Homo sapiens
caccgttcgtacgcccagga

SEQ ID NO: 1066601 - DNA, 13 bp, Homo sapiens
caccgttctgtgc

SEQ ID NO: 1066602 - DNA, 22 bp, Homo sapiens
caccgtttcttcctgccagcag

SEQ ID NO: 1066603 - DNA, 16 bp, Homo sapiens
cacctaagtctctgtg

SEQ ID NO: 1066604 - DNA, 14 bp, Homo sapiens
cacctaatgtttat

SEQ ID NO: 1066605 - DNA, 22 bp, Homo sapiens
cacctaattcgatgaaggctgc

SEQ ID NO: 1066606 - DNA, 16 bp, Homo sapiens
cacctacacaggagtc

SEQ ID NO: 1066607 - DNA, 23 bp, Homo sapiens
cacctacagtgtacagtcttgta

SEQ ID NO: 1066608 - DNA, 17 bp, Homo sapiens
cacctaccaccagggcc

SEQ ID NO: 1066609 - DNA, 19 bp, Homo sapiens
cacctaccccttggaaatg

SEQ ID NO: 1066610 - DNA, 20 bp, Homo sapiens
cacctactgcactttccccc

SEQ ID NO: 1066611 - DNA, 23 bp, Homo sapiens
cacctagacaaacaagggagaag

SEQ ID NO: 1066612 - DNA, 23 bp, Homo sapiens
caccttttccccaaccacagaga

SEQ ID NO: 1066613 - DNA, 17 bp, Homo sapiens
caccttttctgtggctg

SEQ ID NO: 1066614 - DNA, 20 bp, Homo sapiens
caccttttgggaatgtttta

SEQ ID NO: 1066615 - DNA, 15 bp, Homo sapiens
cacctttttgacttt

SEQ ID NO: 1066616 - DNA, 12 bp, Homo sapiens
cacctttttgca

SEQ ID NO: 1066617 - DNA, 14 bp, Homo sapiens
cacgaaacttgtta

SEQ ID NO: 1066618 - DNA, 16 bp, Homo sapiens
cacgaaatgttatttt

SEQ ID NO: 1066619 - DNA, 14 bp, Homo sapiens
cacgaacccacctg

SEQ ID NO: 1066620 - DNA, 14 bp, Homo sapiens
cacgaagggcatcc

SEQ ID NO: 1066621 - DNA, 15 bp, Homo sapiens
cacgaagtgttgcat

SEQ ID NO: 1066622 - DNA, 22 bp, Homo sapiens
cacgaatttgctggggaatctc

SEQ ID NO: 1066623 - DNA, 18 bp, Homo sapiens
cacgacaaaaacaagact

SEQ ID NO: 1066624 - DNA, 15 bp, Homo sapiens
cacgacccctgcctc

SEQ ID NO: 1066625 - DNA, 12 bp, Homo sapiens
cacgactcttcc

SEQ ID NO: 1066626 - DNA, 20 bp, Homo sapiens
cacgagatttcttttttatg

SEQ ID NO: 1066627 - DNA, 14 bp, Homo sapiens
cacgagcacaatgg

SEQ ID NO: 1066628 - DNA, 23 bp, Homo sapiens
cacgagcacaatggtcttacatt

SEQ ID NO: 1066629 - DNA, 22 bp, Homo sapiens
cacgagccacaagctgcactgt

SEQ ID NO: 1066630 - DNA, 20 bp, Homo sapiens
cacgagctgtttactaggga

SEQ ID NO: 1066631 - DNA, 11 bp, Homo sapiens
cacgagggctg

SEQ ID NO: 1066632 - DNA, 17 bp, Homo sapiens
cacgagggctggctggc

SEQ ID NO: 1066633 - DNA, 17 bp, Homo sapiens
cacgaggggacccatgg

SEQ ID NO: 1066634 - DNA, 18 bp, Homo sapiens
cacgaggggacccatggg

SEQ ID NO: 1066635 - DNA, 22 bp, Homo sapiens
cacgaggggacccatgggggct

SEQ ID NO: 1066636 - DNA, 14 bp, Homo sapiens
cacgagtcacctgc

SEQ ID NO: 1066637 - DNA, 23 bp, Homo sapiens
cacgagtttggatgttgtaaata

SEQ ID NO: 1066638 - DNA, 14 bp, Homo sapiens
cacgatcccctccc

SEQ ID NO: 1066639 - DNA, 23 bp, Homo sapiens
cacgatgatatctatatatgtat

SEQ ID NO: 1066640 - DNA, 21 bp, Homo sapiens
cacgatgcatttaataaagat

SEQ ID NO: 1066641 - DNA, 15 bp, Homo sapiens
cacgatgtggccctg

SEQ ID NO: 1066642 - DNA, 21 bp, Homo sapiens
cacgatgtggccctggcctgc

SEQ ID NO: 1066643 - DNA, 21 bp, Homo sapiens
cacgatttgcaggattccctt

SEQ ID NO: 1066644 - DNA, 13 bp, Homo sapiens
cacgatttgtctt

SEQ ID NO: 1066645 - DNA, 18 bp, Homo sapiens
cacgattttcaagattct

SEQ ID NO: 1066646 - DNA, 17 bp, Homo sapiens
cacgattttctccagct

SEQ ID NO: 1066647 - DNA, 19 bp, Homo sapiens
cacgattttctccagctca

SEQ ID NO: 1066648 - DNA, 17 bp, Homo sapiens
cacggccaccctccttc

SEQ ID NO: 1066649 - DNA, 16 bp, Homo sapiens
cacggcccggcccctc

SEQ ID NO: 1066650 - DNA, 20 bp, Homo sapiens
cacggcccggcccctcaccc

SEQ ID NO: 1066651 - DNA, 21 bp, Homo sapiens
cacggcccggcccctcaccct

SEQ ID NO: 1066652 - DNA, 22 bp, Homo sapiens
cacggcgggatcctccacagag

SEQ ID NO: 1066653 - DNA, 21 bp, Homo sapiens
cacggctccgagggcggccag

SEQ ID NO: 1066654 - DNA, 22 bp, Homo sapiens
cacggctccgagggcggccagg

SEQ ID NO: 1066655 - DNA, 23 bp, Homo sapiens
cacggctgcctgacactgagccc

SEQ ID NO: 1066656 - DNA, 17 bp, Homo sapiens
cacggctgcgcactgtg

SEQ ID NO: 1066657 - DNA, 18 bp, Homo sapiens
cacggctggtcactctgc

SEQ ID NO: 1066658 - DNA, 20 bp, Homo sapiens
cacggctggtcactctgccc

SEQ ID NO: 1066659 - DNA, 24 bp, Homo sapiens
cacggctggtcactctgccctctg

SEQ ID NO: 1066660 - DNA, 20 bp, Homo sapiens
cacggctgtccctcatggag

SEQ ID NO: 1066661 - DNA, 21 bp, Homo sapiens
cacgggaccgtcagcatgggc

SEQ ID NO: 1066662 - DNA, 15 bp, Homo sapiens
cacgggagatttctt

SEQ ID NO: 1066663 - DNA, 14 bp, Homo sapiens
cacgggcatgcaca

SEQ ID NO: 1066664 - DNA, 20 bp, Homo sapiens
cacgggcatgcacacggctg

SEQ ID NO: 1066665 - DNA, 13 bp, Homo sapiens
cacgggccctgcc

SEQ ID NO: 1066666 - DNA, 18 bp, Homo sapiens
cacgggcgagctttctct

SEQ ID NO: 1066667 - DNA, 17 bp, Homo sapiens
cacgggctgtctgggtg

SEQ ID NO: 1066668 - DNA, 15 bp, Homo sapiens
cacgggggccaagga

SEQ ID NO: 1066669 - DNA, 18 bp, Homo sapiens
cacggggttccctcctag

SEQ ID NO: 1066670 - DNA, 21 bp, Homo sapiens
cacggggttggctgttccaga

SEQ ID NO: 1066671 - DNA, 14 bp, Homo sapiens
cacgggtttccctc

SEQ ID NO: 1066672 - DNA, 22 bp, Homo sapiens
cacggtatttatagagagagac

SEQ ID NO: 1066673 - DNA, 13 bp, Homo sapiens
cacggtccgcggc

SEQ ID NO: 1066674 - DNA, 14 bp, Homo sapiens
cacggtctgttctt

SEQ ID NO: 1066675 - DNA, 19 bp, Homo sapiens
cacggtgacacaggtcagg

SEQ ID NO: 1066676 - DNA, 23 bp, Homo sapiens
cacggtgacacaggtcagggctc

SEQ ID NO: 1066677 - DNA, 17 bp, Homo sapiens
cacggtgccttttttca

SEQ ID NO: 1066678 - DNA, 14 bp, Homo sapiens
cacggtgcgtggct

SEQ ID NO: 1066679 - DNA, 16 bp, Homo sapiens
cacggtgcgtggctgt

SEQ ID NO: 1066680 - DNA, 20 bp, Homo sapiens
cacggtgcgtggctgtggca

SEQ ID NO: 1066681 - DNA, 21 bp, Homo sapiens
cacggtgcgtggctgtggcac

SEQ ID NO: 1066682 - DNA, 23 bp, Homo sapiens
cacggtgcgtggctgtggcacag

SEQ ID NO: 1066683 - DNA, 12 bp, Homo sapiens
cacggtgtccac

SEQ ID NO: 1066684 - DNA, 13 bp, Homo sapiens
cacggtttgtgag

SEQ ID NO: 1066685 - DNA, 18 bp, Homo sapiens
cacggttttggcagctga

SEQ ID NO: 1066686 - DNA, 12 bp, Homo sapiens
cacgtaaatatt

SEQ ID NO: 1066687 - DNA, 13 bp, Homo sapiens
cacgtagactgat

SEQ ID NO: 1066688 - DNA, 17 bp, Homo sapiens
cacgtagggggctctgg

SEQ ID NO: 1066689 - DNA, 20 bp, Homo sapiens
cacgtaggttccccagagag

SEQ ID NO: 1066690 - DNA, 15 bp, Homo sapiens
cacgtatagtcctag

SEQ ID NO: 1066691 - DNA, 17 bp, Homo sapiens
cacgtatttcacagagc

SEQ ID NO: 1066692 - DNA, 20 bp, Homo sapiens
cacgtatttcacagagcacg

SEQ ID NO: 1066693 - DNA, 20 bp, Homo sapiens
cacgtcaaatgcatacaagt

SEQ ID NO: 1066694 - DNA, 14 bp, Homo sapiens
cacgtcatgggagg

SEQ ID NO: 1066695 - DNA, 20 bp, Homo sapiens
cacgtcccagcatccctgga

SEQ ID NO: 1066696 - DNA, 13 bp, Homo sapiens
cacgtccccctgg

SEQ ID NO: 1066697 - DNA, 19 bp, Homo sapiens
cacgtcccgctgcctcctg

SEQ ID NO: 1066698 - DNA, 16 bp, Homo sapiens
cacgtcctcgaattct

SEQ ID NO: 1066699 - DNA, 19 bp, Homo sapiens
cacgtcgcccgctgagctg

SEQ ID NO: 1066700 - DNA, 16 bp, Homo sapiens
cacgtcgttctaatta

SEQ ID NO: 1066701 - DNA, 17 bp, Homo sapiens
cacgtctgccaggccca

SEQ ID NO: 1066702 - DNA, 13 bp, Homo sapiens
cacgtgacaggct

SEQ ID NO: 1066703 - DNA, 15 bp, Homo sapiens
cacgtgcaggacagc

SEQ ID NO: 1066704 - DNA, 18 bp, Homo sapiens
cacgtgcaggacagctct

SEQ ID NO: 1066705 - DNA, 13 bp, Homo sapiens
cacgtggagagct

SEQ ID NO: 1066706 - DNA, 15 bp, Homo sapiens
cacgtggagagctgg

SEQ ID NO: 1066707 - DNA, 17 bp, Homo sapiens
cacgtggcctcttgagc

SEQ ID NO: 1066708 - DNA, 18 bp, Homo sapiens
cacgtggcctcttgagca

SEQ ID NO: 1066709 - DNA, 16 bp, Homo sapiens
cacgtgggctcatatg

SEQ ID NO: 1066710 - DNA, 20 bp, Homo sapiens
cacgtggggcccactgctcg

SEQ ID NO: 1066711 - DNA, 20 bp, Homo sapiens
cacgtgtaactgtcagccgg

SEQ ID NO: 1066712 - DNA, 23 bp, Homo sapiens
cacgtgtatagtatctgtatata

SEQ ID NO: 1066713 - DNA, 21 bp, Homo sapiens
cacgtgtccgtccacccttcc

SEQ ID NO: 1066714 - DNA, 22 bp, Homo sapiens
cacgtgtccgtccacccttcca

SEQ ID NO: 1066715 - DNA, 20 bp, Homo sapiens
cacgtgtgctgtggccaggc

SEQ ID NO: 1066716 - DNA, 14 bp, Homo sapiens
cacgtgtggcctcc

SEQ ID NO: 1066717 - DNA, 16 bp, Homo sapiens
cacgtgtggcctccgt

SEQ ID NO: 1066718 - DNA, 11 bp, Homo sapiens
cacgtgtgtga

SEQ ID NO: 1066719 - DNA, 16 bp, Homo sapiens
cacgtgtttgtgctgt

SEQ ID NO: 1066720 - DNA, 22 bp, Homo sapiens
cacgtgttttattcctgtatgt

SEQ ID NO: 1066721 - DNA, 22 bp, Homo sapiens
cacgttctcacacccaccgtcc

SEQ ID NO: 1066722 - DNA, 14 bp, Homo sapiens
cacgttgccagggg

SEQ ID NO: 1066723 - DNA, 23 bp, Homo sapiens
cacgttggggagctggcggcggc

SEQ ID NO: 1066724 - DNA, 12 bp, Homo sapiens
cacgtttctaaa

SEQ ID NO: 1066725 - DNA, 14 bp, Homo sapiens
cacgtttctaaagg

SEQ ID NO: 1066726 - DNA, 23 bp, Homo sapiens
cacgtttctaaaggctacctttg

SEQ ID NO: 1066727 - DNA, 14 bp, Homo sapiens
cacgtttcttcccc

SEQ ID NO: 1066728 - DNA, 22 bp, Homo sapiens
cactaaaaatattgtttctgca

SEQ ID NO: 1066729 - DNA, 18 bp, Homo sapiens
cactaaaccacttctctg

SEQ ID NO: 1066730 - DNA, 22 bp, Homo sapiens
cactaaaccacttctctgctgc

SEQ ID NO: 1066731 - DNA, 15 bp, Homo sapiens
cactaaactctgggg

SEQ ID NO: 1066732 - DNA, 15 bp, Homo sapiens
cactaaagcttcaga

SEQ ID NO: 1066733 - DNA, 18 bp, Homo sapiens
cactaaagcttcagactc

SEQ ID NO: 1066734 - DNA, 17 bp, Homo sapiens
cactaaagtatcctgac

SEQ ID NO: 1066735 - DNA, 15 bp, Homo sapiens
cactaaagtatgtaa

SEQ ID NO: 1066736 - DNA, 22 bp, Homo sapiens
cactaaagtatgtaaagtatgt

SEQ ID NO: 1066737 - DNA, 23 bp, Homo sapiens
cactaacactttagttatattca

SEQ ID NO: 1066738 - DNA, 23 bp, Homo sapiens
cactaaccaagctgagtttccta

SEQ ID NO: 1066739 - DNA, 23 bp, Homo sapiens
cactaaccaatgcctttttagat

SEQ ID NO: 1066740 - DNA, 20 bp, Homo sapiens
cactaacgttgagcccctgg

SEQ ID NO: 1066741 - DNA, 16 bp, Homo sapiens
cactaagcagaggagg

SEQ ID NO: 1066742 - DNA, 17 bp, Homo sapiens
cactaagcagaggaggg

SEQ ID NO: 1066743 - DNA, 20 bp, Homo sapiens
cactaagtttgcaacattta

SEQ ID NO: 1066744 - DNA, 12 bp, Homo sapiens
cactaattcata

SEQ ID NO: 1066745 - DNA, 17 bp, Homo sapiens
cactaatttgatgttta

SEQ ID NO: 1066746 - DNA, 23 bp, Homo sapiens
cactaatttttgtattatttttg

SEQ ID NO: 1066747 - DNA, 15 bp, Homo sapiens
cactacacctggctg

SEQ ID NO: 1066748 - DNA, 20 bp, Homo sapiens
cactacatgtggtttataga

SEQ ID NO: 1066749 - DNA, 15 bp, Homo sapiens
cactccagccaaaga

SEQ ID NO: 1066750 - DNA, 13 bp, Homo sapiens
cactccagcctga

SEQ ID NO: 1066751 - DNA, 14 bp, Homo sapiens
cactccagcctggg

SEQ ID NO: 1066752 - DNA, 21 bp, Homo sapiens
cactccagcctgggcgacaga

SEQ ID NO: 1066753 - DNA, 13 bp, Homo sapiens
cactccagggaca

SEQ ID NO: 1066754 - DNA, 18 bp, Homo sapiens
cactccagtccactcctg

SEQ ID NO: 1066755 - DNA, 13 bp, Homo sapiens
cactccagtggca

SEQ ID NO: 1066756 - DNA, 19 bp, Homo sapiens
cactccagttttctcctct

SEQ ID NO: 1066757 - DNA, 22 bp, Homo sapiens
cactccatgcttagtcactgcc

SEQ ID NO: 1066758 - DNA, 15 bp, Homo sapiens
cactccatggccacc

SEQ ID NO: 1066759 - DNA, 20 bp, Homo sapiens
cactccatttggtcctttct

SEQ ID NO: 1066760 - DNA, 14 bp, Homo sapiens
cactcccaaccctg

SEQ ID NO: 1066761 - DNA, 20 bp, Homo sapiens
cactcccaaggttggagccc

SEQ ID NO: 1066762 - DNA, 17 bp, Homo sapiens
cactcccacctgacaca

SEQ ID NO: 1066763 - DNA, 23 bp, Homo sapiens
cactcccacctgacacaccaggc

SEQ ID NO: 1066764 - DNA, 15 bp, Homo sapiens
cactcccatctcctt

SEQ ID NO: 1066765 - DNA, 17 bp, Homo sapiens
cactccccactccccca

SEQ ID NO: 1066766 - DNA, 17 bp, Homo sapiens
cactccccagagctgtg

SEQ ID NO: 1066767 - DNA, 12 bp, Homo sapiens
cactccccaggg

SEQ ID NO: 1066768 - DNA, 21 bp, Homo sapiens
cactccccagggagctctggg

SEQ ID NO: 1066769 - DNA, 23 bp, Homo sapiens
cactccccagggagctctgggga

SEQ ID NO: 1066770 - DNA, 19 bp, Homo sapiens
cactccccatgccacgttc

SEQ ID NO: 1066771 - DNA, 22 bp, Homo sapiens
cactcccccacccatggggagg

SEQ ID NO: 1066772 - DNA, 16 bp, Homo sapiens
cactcccccacctgac

SEQ ID NO: 1066773 - DNA, 22 bp, Homo sapiens
cactccccctaaacccctgtcc

SEQ ID NO: 1066774 - DNA, 16 bp, Homo sapiens
cactcccgaccttagc

SEQ ID NO: 1066775 - DNA, 15 bp, Homo sapiens
cactcccgctgcaca

SEQ ID NO: 1066776 - DNA, 17 bp, Homo sapiens
cactcccgctgcacaca

SEQ ID NO: 1066777 - DNA, 24 bp, Homo sapiens
cactcccgctgcacacagacggcc

SEQ ID NO: 1066778 - DNA, 17 bp, Homo sapiens
cactctgtaattgcaaa

SEQ ID NO: 1066779 - DNA, 15 bp, Homo sapiens
cactctgtatctatg

SEQ ID NO: 1066780 - DNA, 16 bp, Homo sapiens
cactctgtatctatgc

SEQ ID NO: 1066781 - DNA, 22 bp, Homo sapiens
cactctgtccctgtccttccct

SEQ ID NO: 1066782 - DNA, 19 bp, Homo sapiens
cactctgtcgctcaggctg

SEQ ID NO: 1066783 - DNA, 16 bp, Homo sapiens
cactcttaagcttccg

SEQ ID NO: 1066784 - DNA, 19 bp, Homo sapiens
cactcttattgtccttcta

SEQ ID NO: 1066785 - DNA, 23 bp, Homo sapiens
cactcttcacttgagttggctgt

SEQ ID NO: 1066786 - DNA, 11 bp, Homo sapiens
cactcttccaa

SEQ ID NO: 1066787 - DNA, 18 bp, Homo sapiens
cactcttcctcatcctgc

SEQ ID NO: 1066788 - DNA, 22 bp, Homo sapiens
cactcttctctcctttctccct

SEQ ID NO: 1066789 - DNA, 16 bp, Homo sapiens
cactcttcttgagcag

SEQ ID NO: 1066790 - DNA, 18 bp, Homo sapiens
cactcttcttgagcagac

SEQ ID NO: 1066791 - DNA, 16 bp, Homo sapiens
cactcttgtttgcttt

SEQ ID NO: 1066792 - DNA, 15 bp, Homo sapiens
cactctttaccttta

SEQ ID NO: 1066793 - DNA, 23 bp, Homo sapiens
cactcttttgctttattccagaa

SEQ ID NO: 1066794 - DNA, 14 bp, Homo sapiens
cactgaaaaaatac

SEQ ID NO: 1066795 - DNA, 14 bp, Homo sapiens
cactgaaaaattat

SEQ ID NO: 1066796 - DNA, 22 bp, Homo sapiens
cactgaaaagctttcctgacaa

SEQ ID NO: 1066797 - DNA, 12 bp, Homo sapiens
cactgaaaccaa

SEQ ID NO: 1066798 - DNA, 13 bp, Homo sapiens
cactgaaagtttt

SEQ ID NO: 1066799 - DNA, 20 bp, Homo sapiens
cactgaaagttttgtaaaag

SEQ ID NO: 1066800 - DNA, 16 bp, Homo sapiens
cactgaacaaaaccta

SEQ ID NO: 1066801 - DNA, 22 bp, Homo sapiens
cactgaacaaactaaaggtgca

SEQ ID NO: 1066802 - DNA, 12 bp, Homo sapiens
cactgaacatgc

SEQ ID NO: 1066803 - DNA, 14 bp, Homo sapiens
cactgaacatgcct

SEQ ID NO: 1066804 - DNA, 18 bp, Homo sapiens
cactgaaccactgcttct

SEQ ID NO: 1066805 - DNA, 23 bp, Homo sapiens
cactgaagaagtcactgaacaaa

SEQ ID NO: 1066806 - DNA, 14 bp, Homo sapiens
cactgaagcctgcg

SEQ ID NO: 1066807 - DNA, 17 bp, Homo sapiens
cactgaagcctgcgttg

SEQ ID NO: 1066808 - DNA, 13 bp, Homo sapiens
cactgaagctggg

SEQ ID NO: 1066809 - DNA, 17 bp, Homo sapiens
cactgaagctgggattc

SEQ ID NO: 1066810 - DNA, 19 bp, Homo sapiens
cactgaatcatgttaatag

SEQ ID NO: 1066811 - DNA, 19 bp, Homo sapiens
cactgacaaagtcatcccc

SEQ ID NO: 1066812 - DNA, 14 bp, Homo sapiens
cactgacagcctcc

SEQ ID NO: 1066813 - DNA, 15 bp, Homo sapiens
cactgacagcctccc

SEQ ID NO: 1066814 - DNA, 14 bp, Homo sapiens
cactgaccaggccc

SEQ ID NO: 1066815 - DNA, 18 bp, Homo sapiens
cactgacctgtcatgccc

SEQ ID NO: 1066816 - DNA, 14 bp, Homo sapiens
cactgactcctgtg

SEQ ID NO: 1066817 - DNA, 14 bp, Homo sapiens
cactgactggaagg

SEQ ID NO: 1066818 - DNA, 19 bp, Homo sapiens
cactgagaagattgtgaat

SEQ ID NO: 1066819 - DNA, 15 bp, Homo sapiens
cactgagagctgcct

SEQ ID NO: 1066820 - DNA, 13 bp, Homo sapiens
cactgagcacagt

SEQ ID NO: 1066821 - DNA, 14 bp, Homo sapiens
cactgagctcccca

SEQ ID NO: 1066822 - DNA, 14 bp, Homo sapiens
cactgagcttctga

SEQ ID NO: 1066823 - DNA, 16 bp, Homo sapiens
cactgagcttctgaga

SEQ ID NO: 1066824 - DNA, 18 bp, Homo sapiens
cactgagggccacactat

SEQ ID NO: 1066825 - DNA, 17 bp, Homo sapiens
cactgaggtccacagac

SEQ ID NO: 1066826 - DNA, 15 bp, Homo sapiens
cactgagttctatca

SEQ ID NO: 1066827 - DNA, 16 bp, Homo sapiens
cactgatacataaaaa

SEQ ID NO: 1066828 - DNA, 20 bp, Homo sapiens
cactgatatatcatgagtga

SEQ ID NO: 1066829 - DNA, 15 bp, Homo sapiens
cactgatcacccaat

SEQ ID NO: 1066830 - DNA, 22 bp, Homo sapiens
cactgatctctactaccacaag

SEQ ID NO: 1066831 - DNA, 24 bp, Homo sapiens
cactgatctctactaccacaagga

SEQ ID NO: 1066832 - DNA, 21 bp, Homo sapiens
cactgatctgctagtgctgta

SEQ ID NO: 1066833 - DNA, 17 bp, Homo sapiens
cactgatgaactagtga

SEQ ID NO: 1066834 - DNA, 20 bp, Homo sapiens
cactgatgagtttcactgta

SEQ ID NO: 1066835 - DNA, 15 bp, Homo sapiens
cactgatgcttagat

SEQ ID NO: 1066836 - DNA, 14 bp, Homo sapiens
cactgatggaaggt

SEQ ID NO: 1066837 - DNA, 15 bp, Homo sapiens
cactgatggctcaag

SEQ ID NO: 1066838 - DNA, 16 bp, Homo sapiens
cactgatggctcaaga

SEQ ID NO: 1066839 - DNA, 20 bp, Homo sapiens
cactgatggctcaagacaag

SEQ ID NO: 1066840 - DNA, 15 bp, Homo sapiens
cactgatgggctggg

SEQ ID NO: 1066841 - DNA, 19 bp, Homo sapiens
cactgatgttgtgttttta

SEQ ID NO: 1066842 - DNA, 19 bp, Homo sapiens
cactgattaaaataggatt

SEQ ID NO: 1066843 - DNA, 16 bp, Homo sapiens
cactgcaaataaagcc

SEQ ID NO: 1066844 - DNA, 13 bp, Homo sapiens
cactgcaacctcc

SEQ ID NO: 1066845 - DNA, 20 bp, Homo sapiens
cactgcaacctccaactccc

SEQ ID NO: 1066846 - DNA, 16 bp, Homo sapiens
cactgcaacttctgcc

SEQ ID NO: 1066847 - DNA, 21 bp, Homo sapiens
cactgcaacttgtgaactcca

SEQ ID NO: 1066848 - DNA, 22 bp, Homo sapiens
cactgcaacttgtgaactccat

SEQ ID NO: 1066849 - DNA, 16 bp, Homo sapiens
cactgcaagagccttg

SEQ ID NO: 1066850 - DNA, 18 bp, Homo sapiens
cactgcaagagccttggt

SEQ ID NO: 1066851 - DNA, 20 bp, Homo sapiens
cactgcaatctccacctccc

SEQ ID NO: 1066852 - DNA, 17 bp, Homo sapiens
cactgcacctgcccagc

SEQ ID NO: 1066853 - DNA, 20 bp, Homo sapiens
cactgcacctgcccagctcc

SEQ ID NO: 1066854 - DNA, 12 bp, Homo sapiens
cactgcactcca

SEQ ID NO: 1066855 - DNA, 15 bp, Homo sapiens
cactgcactccagcc

SEQ ID NO: 1066856 - DNA, 16 bp, Homo sapiens
cactgcactccagcct

SEQ ID NO: 1066857 - DNA, 19 bp, Homo sapiens
cactgcactccagcctggg

SEQ ID NO: 1066858 - DNA, 13 bp, Homo sapiens
cactgcactttgt

SEQ ID NO: 1066859 - DNA, 15 bp, Homo sapiens
cactgcactttgttt

SEQ ID NO: 1066860 - DNA, 12 bp, Homo sapiens
cactgcagacgg

SEQ ID NO: 1066861 - DNA, 13 bp, Homo sapiens
cactgcagcctca

SEQ ID NO: 1066862 - DNA, 23 bp, Homo sapiens
cactgcagcctcaacctcctggg

SEQ ID NO: 1066863 - DNA, 18 bp, Homo sapiens
cactgcagcgcgctcctg

SEQ ID NO: 1066864 - DNA, 22 bp, Homo sapiens
cactgcatgagcttttatacta

SEQ ID NO: 1066865 - DNA, 17 bp, Homo sapiens
cactgcattcctgtgcc

SEQ ID NO: 1066866 - DNA, 21 bp, Homo sapiens
cactgccaagcttcctgtgcc

SEQ ID NO: 1066867 - DNA, 20 bp, Homo sapiens
cactgccacactctccatca

SEQ ID NO: 1066868 - DNA, 12 bp, Homo sapiens
cactgccagcag

SEQ ID NO: 1066869 - DNA, 13 bp, Homo sapiens
cactgccagcagc

SEQ ID NO: 1066870 - DNA, 14 bp, Homo sapiens
cactgccagcagca

SEQ ID NO: 1066871 - DNA, 16 bp, Homo sapiens
cactgccagcagcagc

SEQ ID NO: 1066872 - DNA, 14 bp, Homo sapiens
cactgccaggcacc

SEQ ID NO: 1066873 - DNA, 19 bp, Homo sapiens
cactgccaggcacctggcc

SEQ ID NO: 1066874 - DNA, 12 bp, Homo sapiens
cactgccaggcc

SEQ ID NO: 1066875 - DNA, 20 bp, Homo sapiens
cactgccaggggttcttgag

SEQ ID NO: 1066876 - DNA, 21 bp, Homo sapiens
cactgccaggggttcttgagc

SEQ ID NO: 1066877 - DNA, 17 bp, Homo sapiens
cactgccataaaacatt

SEQ ID NO: 1066878 - DNA, 17 bp, Homo sapiens
cactgccatctgatgcc

SEQ ID NO: 1066879 - DNA, 22 bp, Homo sapiens
cactgccatcttagtttggatt

SEQ ID NO: 1066880 - DNA, 11 bp, Homo sapiens
cactgccatga

SEQ ID NO: 1066881 - DNA, 23 bp, Homo sapiens
cactgccatggaattccctcctg

SEQ ID NO: 1066882 - DNA, 20 bp, Homo sapiens
cactgcccacatgggacctg

SEQ ID NO: 1066883 - DNA, 15 bp, Homo sapiens
cactgcccaccaaag

SEQ ID NO: 1066884 - DNA, 17 bp, Homo sapiens
cactgcccaccaaaggt

SEQ ID NO: 1066885 - DNA, 18 bp, Homo sapiens
cactgcccaccaaaggtc

SEQ ID NO: 1066886 - DNA, 18 bp, Homo sapiens
cactgcccaccccctcaa

SEQ ID NO: 1066887 - DNA, 24 bp, Homo sapiens
cactgccccacttctggcatggga

SEQ ID NO: 1066888 - DNA, 22 bp, Homo sapiens
cactgccccccgaggctgctag

SEQ ID NO: 1066889 - DNA, 19 bp, Homo sapiens
cactgccccctgctgccat

SEQ ID NO: 1066890 - DNA, 15 bp, Homo sapiens
cactgccccctgctt

SEQ ID NO: 1066891 - DNA, 20 bp, Homo sapiens
cactgccccgtgtgaatgta

SEQ ID NO: 1066892 - DNA, 20 bp, Homo sapiens
cactgccctgcctgcccact

SEQ ID NO: 1066893 - DNA, 19 bp, Homo sapiens
cactgccctggcagcagca

SEQ ID NO: 1066894 - DNA, 18 bp, Homo sapiens
cactgccgacatcagcat

SEQ ID NO: 1066895 - DNA, 19 bp, Homo sapiens
cactgcctaggaggctggc

SEQ ID NO: 1066896 - DNA, 11 bp, Homo sapiens
cactgcctcct

SEQ ID NO: 1066897 - DNA, 12 bp, Homo sapiens
cactgcctcctg

SEQ ID NO: 1066898 - DNA, 20 bp, Homo sapiens
cactgcctcctgcctggggt

SEQ ID NO: 1066899 - DNA, 13 bp, Homo sapiens
cactgcctcctgt

SEQ ID NO: 1066900 - DNA, 19 bp, Homo sapiens
cactgcctcctgttttctc

SEQ ID NO: 1066901 - DNA, 16 bp, Homo sapiens
cactgcctctatgccc

SEQ ID NO: 1066902 - DNA, 17 bp, Homo sapiens
cactgcctctatgccct

SEQ ID NO: 1066903 - DNA, 13 bp, Homo sapiens
cactgcctctgag

SEQ ID NO: 1066904 - DNA, 23 bp, Homo sapiens
cactgcctgcagaggtctgtgct

SEQ ID NO: 1066905 - DNA, 15 bp, Homo sapiens
cactgcctgcccacc

SEQ ID NO: 1066906 - DNA, 14 bp, Homo sapiens
cactgccttagcct

SEQ ID NO: 1066907 - DNA, 17 bp, Homo sapiens
cactgccttagcctctt

SEQ ID NO: 1066908 - DNA, 21 bp, Homo sapiens
cactgccttagcctcttggaa

SEQ ID NO: 1066909 - DNA, 22 bp, Homo sapiens
cactgccttcgatacaccgggc

SEQ ID NO: 1066910 - DNA, 18 bp, Homo sapiens
cactgccttcgcttcttg

SEQ ID NO: 1066911 - DNA, 17 bp, Homo sapiens
cactgccttctcctctc

SEQ ID NO: 1066912 - DNA, 21 bp, Homo sapiens
cactgccttggcccctccctc

SEQ ID NO: 1066913 - DNA, 20 bp, Homo sapiens
cactgcgaagaccctcttgc

SEQ ID NO: 1066914 - DNA, 14 bp, Homo sapiens
cactgcgcccagcc

SEQ ID NO: 1066915 - DNA, 16 bp, Homo sapiens
cactgcgcccagcctg

SEQ ID NO: 1066916 - DNA, 17 bp, Homo sapiens
cactgcgcccagcctga

SEQ ID NO: 1066917 - DNA, 18 bp, Homo sapiens
cactgctaaggctgctgg

SEQ ID NO: 1066918 - DNA, 22 bp, Homo sapiens
cactgctcaagaagacatggag

SEQ ID NO: 1066919 - DNA, 16 bp, Homo sapiens
cactgctccaagggac

SEQ ID NO: 1066920 - DNA, 23 bp, Homo sapiens
cactgctccaagggacaggtggg

SEQ ID NO: 1066921 - DNA, 22 bp, Homo sapiens
cactgctccatttataacccca

SEQ ID NO: 1066922 - DNA, 22 bp, Homo sapiens
cactgctccctaagccagcctg

SEQ ID NO: 1066923 - DNA, 19 bp, Homo sapiens
cactgctcgtggactgtgc

SEQ ID NO: 1066924 - DNA, 21 bp, Homo sapiens
cactgctcgtggactgtgctg

SEQ ID NO: 1066925 - DNA, 19 bp, Homo sapiens
cactgctctaacagccctc

SEQ ID NO: 1066926 - DNA, 22 bp, Homo sapiens
cactgctgatcgtagaaaattt

SEQ ID NO: 1066927 - DNA, 13 bp, Homo sapiens
cactgctgcacca

SEQ ID NO: 1066928 - DNA, 18 bp, Homo sapiens
cactgctgcaccagagtg

SEQ ID NO: 1066929 - DNA, 15 bp, Homo sapiens
cactgctgcccagcc

SEQ ID NO: 1066930 - DNA, 15 bp, Homo sapiens
cactgctgctactgc

SEQ ID NO: 1066931 - DNA, 15 bp, Homo sapiens
cactgctgctcctct

SEQ ID NO: 1066932 - DNA, 23 bp, Homo sapiens
cactgctgcttctccatggccac

SEQ ID NO: 1066933 - DNA, 23 bp, Homo sapiens
cactgctgtccacatgacctcca

SEQ ID NO: 1066934 - DNA, 21 bp, Homo sapiens
cactgctgtcctctccccctt

SEQ ID NO: 1066935 - DNA, 18 bp, Homo sapiens
cactgggtgtaaacacat

SEQ ID NO: 1066936 - DNA, 18 bp, Homo sapiens
cactggtaggttgggaca

SEQ ID NO: 1066937 - DNA, 15 bp, Homo sapiens
cactggtcagggcag

SEQ ID NO: 1066938 - DNA, 20 bp, Homo sapiens
cactggtcagggcagtggcc

SEQ ID NO: 1066939 - DNA, 17 bp, Homo sapiens
cactggtctaatgtttg

SEQ ID NO: 1066940 - DNA, 18 bp, Homo sapiens
cactggtctaatgtttgt

SEQ ID NO: 1066941 - DNA, 14 bp, Homo sapiens
cactggtctgctgt

SEQ ID NO: 1066942 - DNA, 15 bp, Homo sapiens
cactggtctgctgtc

SEQ ID NO: 1066943 - DNA, 16 bp, Homo sapiens
cactggtctgtctttg

SEQ ID NO: 1066944 - DNA, 22 bp, Homo sapiens
cactggtggcccgacagcctgg

SEQ ID NO: 1066945 - DNA, 18 bp, Homo sapiens
cactggtgggcagctgag

SEQ ID NO: 1066946 - DNA, 19 bp, Homo sapiens
cactggtgggcagctgagg

SEQ ID NO: 1066947 - DNA, 13 bp, Homo sapiens
cactgtaaagaca

SEQ ID NO: 1066948 - DNA, 14 bp, Homo sapiens
cactgtaaagacaa

SEQ ID NO: 1066949 - DNA, 23 bp, Homo sapiens
cactgtaaatatccctcccctct

SEQ ID NO: 1066950 - DNA, 15 bp, Homo sapiens
cactgtaagtttatt

SEQ ID NO: 1066951 - DNA, 16 bp, Homo sapiens
cactgtaatcttaaaa

SEQ ID NO: 1066952 - DNA, 21 bp, Homo sapiens
cactgtacaaatgacactgca

SEQ ID NO: 1066953 - DNA, 14 bp, Homo sapiens
cactgtacacataa

SEQ ID NO: 1066954 - DNA, 15 bp, Homo sapiens
cactgtactgcatgt

SEQ ID NO: 1066955 - DNA, 22 bp, Homo sapiens
cactgtagctattagcggctcc

SEQ ID NO: 1066956 - DNA, 21 bp, Homo sapiens
cactgtagtttttgaaaatta

SEQ ID NO: 1066957 - DNA, 17 bp, Homo sapiens
cactgtatataaacata

SEQ ID NO: 1066958 - DNA, 22 bp, Homo sapiens
cactgtatattttttaatgtat

SEQ ID NO: 1066959 - DNA, 14 bp, Homo sapiens
cactgtatccaggt

SEQ ID NO: 1066960 - DNA, 16 bp, Homo sapiens
cactgtatgctggacg

SEQ ID NO: 1066961 - DNA, 15 bp, Homo sapiens
cactgtattgctcct

SEQ ID NO: 1066962 - DNA, 22 bp, Homo sapiens
cactgtattgctcctcccactt

SEQ ID NO: 1066963 - DNA, 20 bp, Homo sapiens
cactgtcaccctccacctct

SEQ ID NO: 1066964 - DNA, 19 bp, Homo sapiens
cactgtcactgtttctctg

SEQ ID NO: 1066965 - DNA, 17 bp, Homo sapiens
cactgtcactttgctct

SEQ ID NO: 1066966 - DNA, 19 bp, Homo sapiens
cactgtcactttgctctgg

SEQ ID NO: 1066967 - DNA, 18 bp, Homo sapiens
cactgtccctcaaatgac

SEQ ID NO: 1066968 - DNA, 18 bp, Homo sapiens
cactgtcccttgcctcaa

SEQ ID NO: 1066969 - DNA, 17 bp, Homo sapiens
cactgtccgcctctgcc

SEQ ID NO: 1066970 - DNA, 22 bp, Homo sapiens
cactgtcctaccagttgcccta

SEQ ID NO: 1066971 - DNA, 17 bp, Homo sapiens
cactgtcctccaagcca

SEQ ID NO: 1066972 - DNA, 20 bp, Homo sapiens
cactgtcctccttggcggca

SEQ ID NO: 1066973 - DNA, 13 bp, Homo sapiens
cactgtcctgggc

SEQ ID NO: 1066974 - DNA, 12 bp, Homo sapiens
cactgtcctgtt

SEQ ID NO: 1066975 - DNA, 24 bp, Homo sapiens
cactgtctggggccccatcagctg

SEQ ID NO: 1066976 - DNA, 18 bp, Homo sapiens
cactgtctttaattctgt

SEQ ID NO: 1066977 - DNA, 16 bp, Homo sapiens
cagaggtttcttgaat

SEQ ID NO: 1066978 - DNA, 15 bp, Homo sapiens
cagagtaggtgggta

SEQ ID NO: 1066979 - DNA, 21 bp, Homo sapiens
cagagtatgaacacctgggct

SEQ ID NO: 1066980 - DNA, 13 bp, Homo sapiens
cagagtatttctg

SEQ ID NO: 1066981 - DNA, 21 bp, Homo sapiens
cagagtcaccttttctgtggc

SEQ ID NO: 1066982 - DNA, 15 bp, Homo sapiens
cagagtcactcacac

SEQ ID NO: 1066983 - DNA, 16 bp, Homo sapiens
cagagtccaggcccca

SEQ ID NO: 1066984 - DNA, 18 bp, Homo sapiens
cagagtccagtgctctgc

SEQ ID NO: 1066985 - DNA, 22 bp, Homo sapiens
cagagtccagtgctctgcctca

SEQ ID NO: 1066986 - DNA, 21 bp, Homo sapiens
cagagtccatttcccacatct

SEQ ID NO: 1066987 - DNA, 23 bp, Homo sapiens
cagagtccatttcccacatcttt

SEQ ID NO: 1066988 - DNA, 14 bp, Homo sapiens
cagagtcctttcca

SEQ ID NO: 1066989 - DNA, 15 bp, Homo sapiens
cagagtcgctggcat

SEQ ID NO: 1066990 - DNA, 18 bp, Homo sapiens
cagagtctcactctgttg

SEQ ID NO: 1066991 - DNA, 23 bp, Homo sapiens
cagagtctcgctctgttgcccag

SEQ ID NO: 1066992 - DNA, 13 bp, Homo sapiens
cagagtctgagcc

SEQ ID NO: 1066993 - DNA, 14 bp, Homo sapiens
cagagtctgggcct

SEQ ID NO: 1066994 - DNA, 20 bp, Homo sapiens
cagagtctgggcctctgact

SEQ ID NO: 1066995 - DNA, 15 bp, Homo sapiens
cagagtctgtctctt

SEQ ID NO: 1066996 - DNA, 21 bp, Homo sapiens
cagagtgaaaaatcttaagta

SEQ ID NO: 1066997 - DNA, 15 bp, Homo sapiens
cagagtgaagaatct

SEQ ID NO: 1066998 - DNA, 14 bp, Homo sapiens
cagagtgaatttca

SEQ ID NO: 1066999 - DNA, 20 bp, Homo sapiens
cagagtgaccctcagctgtc

SEQ ID NO: 1067000 - DNA, 22 bp, Homo sapiens
cagagtgaccctcagctgtcac

SEQ ID NO: 1067001 - DNA, 20 bp, Homo sapiens
cagagtgagacccagccctc

SEQ ID NO: 1067002 - DNA, 19 bp, Homo sapiens
cagagtgagaccctgtctc

SEQ ID NO: 1067003 - DNA, 21 bp, Homo sapiens
cagagtgagcaagggggccca

SEQ ID NO: 1067004 - DNA, 15 bp, Homo sapiens
cagagtgagccagtg

SEQ ID NO: 1067005 - DNA, 23 bp, Homo sapiens
cagagtgaggatgtgttttgcac

SEQ ID NO: 1067006 - DNA, 22 bp, Homo sapiens
cagagtgattcgggggctgacc

SEQ ID NO: 1067007 - DNA, 23 bp, Homo sapiens
cagagtgattcgggggctgacct

SEQ ID NO: 1067008 - DNA, 22 bp, Homo sapiens
cagagtgctggactgttccagg

SEQ ID NO: 1067009 - DNA, 21 bp, Homo sapiens
cagagtgctgtcgggaccaca

SEQ ID NO: 1067010 - DNA, 23 bp, Homo sapiens
cagagtgctttaaaaaattctct

SEQ ID NO: 1067011 - DNA, 15 bp, Homo sapiens
cagagtgcttttctg

SEQ ID NO: 1067012 - DNA, 20 bp, Homo sapiens
cagagtggaataagacagag

SEQ ID NO: 1067013 - DNA, 12 bp, Homo sapiens
cagagtggaggc

SEQ ID NO: 1067014 - DNA, 12 bp, Homo sapiens
cagagtggccca

SEQ ID NO: 1067015 - DNA, 14 bp, Homo sapiens
cagagtggcccacc

SEQ ID NO: 1067016 - DNA, 17 bp, Homo sapiens
cagagtggcctagagca

SEQ ID NO: 1067017 - DNA, 18 bp, Homo sapiens
cagagtggcctccctgct

SEQ ID NO: 1067018 - DNA, 23 bp, Homo sapiens
cagagtggcctccctgctgtgcc

SEQ ID NO: 1067019 - DNA, 16 bp, Homo sapiens
cagagtggcctggcca

SEQ ID NO: 1067020 - DNA, 22 bp, Homo sapiens
cagagtggcctggccaggagct

SEQ ID NO: 1067021 - DNA, 19 bp, Homo sapiens
cagagtggcgtgagctgcc

SEQ ID NO: 1067022 - DNA, 21 bp, Homo sapiens
cagagtggcgtgagctgcccg

SEQ ID NO: 1067023 - DNA, 18 bp, Homo sapiens
cagagtggcgtggcctcc

SEQ ID NO: 1067024 - DNA, 21 bp, Homo sapiens
cagagtggctcactggctggg

SEQ ID NO: 1067025 - DNA, 23 bp, Homo sapiens
cagagtggctcactggctgggag

SEQ ID NO: 1067026 - DNA, 12 bp, Homo sapiens
cagagtggctgc

SEQ ID NO: 1067027 - DNA, 19 bp, Homo sapiens
cagagtgggacttggagag

SEQ ID NO: 1067028 - DNA, 14 bp, Homo sapiens
cagagtgggagagg

SEQ ID NO: 1067029 - DNA, 15 bp, Homo sapiens
cagagtggtctttct

SEQ ID NO: 1067030 - DNA, 22 bp, Homo sapiens
cagagtggtctttctggagagg

SEQ ID NO: 1067031 - DNA, 15 bp, Homo sapiens
cagagtggtggggga

SEQ ID NO: 1067032 - DNA, 18 bp, Homo sapiens
cagagtgtacaaattgtc

SEQ ID NO: 1067033 - DNA, 19 bp, Homo sapiens
cagagtgtgggaagggaga

SEQ ID NO: 1067034 - DNA, 20 bp, Homo sapiens
cagagtgtgggaagggagag

SEQ ID NO: 1067035 - DNA, 16 bp, Homo sapiens
cagagttacagttctg

SEQ ID NO: 1067036 - DNA, 18 bp, Homo sapiens
cagagttacagttctgtg

SEQ ID NO: 1067037 - DNA, 20 bp, Homo sapiens
cagagttcactataaatggt

SEQ ID NO: 1067038 - DNA, 16 bp, Homo sapiens
cagagttgtaaatata

SEQ ID NO: 1067039 - DNA, 18 bp, Homo sapiens
cagagttgtaaatatata

SEQ ID NO: 1067040 - DNA, 16 bp, Homo sapiens
cagagtttacattcta

SEQ ID NO: 1067041 - DNA, 17 bp, Homo sapiens
cagagtttgccttcctt

SEQ ID NO: 1067042 - DNA, 20 bp, Homo sapiens
cagagtttgccttcctttct

SEQ ID NO: 1067043 - DNA, 16 bp, Homo sapiens
cagagtttgtgtgtat

SEQ ID NO: 1067044 - DNA, 22 bp, Homo sapiens
cagagtttgtgtgttgtcttga

SEQ ID NO: 1067045 - DNA, 17 bp, Homo sapiens
cagataaaatgttcagt

SEQ ID NO: 1067046 - DNA, 16 bp, Homo sapiens
cagataaatagaacta

SEQ ID NO: 1067047 - DNA, 17 bp, Homo sapiens
cagataatcagcctctt

SEQ ID NO: 1067048 - DNA, 17 bp, Homo sapiens
cagataattcatttgta

SEQ ID NO: 1067049 - DNA, 18 bp, Homo sapiens
cagataattctggaccag

SEQ ID NO: 1067050 - DNA, 21 bp, Homo sapiens
cagataattctggaccagaga

SEQ ID NO: 1067051 - DNA, 14 bp, Homo sapiens
cagatacacacaca

SEQ ID NO: 1067052 - DNA, 22 bp, Homo sapiens
cagatacctcatcatccacccg

SEQ ID NO: 1067053 - DNA, 23 bp, Homo sapiens
cagatacctcatcatccacccgc

SEQ ID NO: 1067054 - DNA, 19 bp, Homo sapiens
cagatacctccaaccctgc

SEQ ID NO: 1067055 - DNA, 17 bp, Homo sapiens
cagatctgatcaagagt

SEQ ID NO: 1067056 - DNA, 12 bp, Homo sapiens
cagatctgcctg

SEQ ID NO: 1067057 - DNA, 13 bp, Homo sapiens
cagatctgcctgg

SEQ ID NO: 1067058 - DNA, 16 bp, Homo sapiens
cagatctgcctgggcc

SEQ ID NO: 1067059 - DNA, 20 bp, Homo sapiens
cagatctgcctgggcctgtg

SEQ ID NO: 1067060 - DNA, 22 bp, Homo sapiens
cagatctgcctgggcctgtgca

SEQ ID NO: 1067061 - DNA, 17 bp, Homo sapiens
cagatctggtcccttgc

SEQ ID NO: 1067062 - DNA, 15 bp, Homo sapiens
cagatctgtctccaa

SEQ ID NO: 1067063 - DNA, 20 bp, Homo sapiens
cagatctgtgccccatgcct

SEQ ID NO: 1067064 - DNA, 14 bp, Homo sapiens
cagatctgtgcctg

SEQ ID NO: 1067065 - DNA, 16 bp, Homo sapiens
cagatctgtgcctggg

SEQ ID NO: 1067066 - DNA, 23 bp, Homo sapiens
cagatctgttttgtggtttggaa

SEQ ID NO: 1067067 - DNA, 15 bp, Homo sapiens
cagatcttaatataa

SEQ ID NO: 1067068 - DNA, 13 bp, Homo sapiens
cagatcttgacag

SEQ ID NO: 1067069 - DNA, 23 bp, Homo sapiens
cagatcttgacagtatatttgaa

SEQ ID NO: 1067070 - DNA, 15 bp, Homo sapiens
cagatctttctcttc

SEQ ID NO: 1067071 - DNA, 13 bp, Homo sapiens
cagatgaacattt

SEQ ID NO: 1067072 - DNA, 20 bp, Homo sapiens
cagatgaactcttagaaatg

SEQ ID NO: 1067073 - DNA, 23 bp, Homo sapiens
cagatgaactctttctggcctgc

SEQ ID NO: 1067074 - DNA, 20 bp, Homo sapiens
cagatgaactgactgaagga

SEQ ID NO: 1067075 - DNA, 23 bp, Homo sapiens
cagatgaatgtatttatttggga

SEQ ID NO: 1067076 - DNA, 23 bp, Homo sapiens
cagatgacaaattatatttgaaa

SEQ ID NO: 1067077 - DNA, 18 bp, Homo sapiens
cagatgaccgtgtacaat

SEQ ID NO: 1067078 - DNA, 20 bp, Homo sapiens
cagatgaccgtgtacaatac

SEQ ID NO: 1067079 - DNA, 18 bp, Homo sapiens
cagatgagaacaaagctg

SEQ ID NO: 1067080 - DNA, 15 bp, Homo sapiens
cagatgaggacagag

SEQ ID NO: 1067081 - DNA, 19 bp, Homo sapiens
cagatgaggagcagctggg

SEQ ID NO: 1067082 - DNA, 15 bp, Homo sapiens
cagatgaggggccac

SEQ ID NO: 1067083 - DNA, 21 bp, Homo sapiens
cagatgaggtcaacacaggta

SEQ ID NO: 1067084 - DNA, 14 bp, Homo sapiens
cagatgagtcacac

SEQ ID NO: 1067085 - DNA, 15 bp, Homo sapiens
cagatgataaatatt

SEQ ID NO: 1067086 - DNA, 15 bp, Homo sapiens
cagatgatctctcca

SEQ ID NO: 1067087 - DNA, 18 bp, Homo sapiens
cagatgatctctccacgg

SEQ ID NO: 1067088 - DNA, 15 bp, Homo sapiens
cagatgatgaagaaa

SEQ ID NO: 1067089 - DNA, 23 bp, Homo sapiens
cagatgatgccaacctctggagc

SEQ ID NO: 1067090 - DNA, 18 bp, Homo sapiens
cagatgatggccatttct

SEQ ID NO: 1067091 - DNA, 18 bp, Homo sapiens
cagatgatttcccccctc

SEQ ID NO: 1067092 - DNA, 15 bp, Homo sapiens
cagatgcaatgtgct

SEQ ID NO: 1067093 - DNA, 16 bp, Homo sapiens
cagatgccaacttccc

SEQ ID NO: 1067094 - DNA, 18 bp, Homo sapiens
cagatgccaacttcccac

SEQ ID NO: 1067095 - DNA, 20 bp, Homo sapiens
cagatgccaccctagccaat

SEQ ID NO: 1067096 - DNA, 14 bp, Homo sapiens
cagatgccagtgaa

SEQ ID NO: 1067097 - DNA, 15 bp, Homo sapiens
cagatgcctcagagg

SEQ ID NO: 1067098 - DNA, 15 bp, Homo sapiens
cagatgcctgcttga

SEQ ID NO: 1067099 - DNA, 12 bp, Homo sapiens
cagatgcgggga

SEQ ID NO: 1067100 - DNA, 16 bp, Homo sapiens
cagatgcggggacagg

SEQ ID NO: 1067101 - DNA, 21 bp, Homo sapiens
cagatgcggggacaggctgga

SEQ ID NO: 1067102 - DNA, 16 bp, Homo sapiens
cagatgcgtgcccagc

SEQ ID NO: 1067103 - DNA, 22 bp, Homo sapiens
cagatgcgttcgcctctggccc

SEQ ID NO: 1067104 - DNA, 22 bp, Homo sapiens
cagatgctgaattgagaataag

SEQ ID NO: 1067105 - DNA, 19 bp, Homo sapiens
cagatgctgctgaagagag

SEQ ID NO: 1067106 - DNA, 22 bp, Homo sapiens
cagatgctgtcactggcagagc

SEQ ID NO: 1067107 - DNA, 17 bp, Homo sapiens
cagatgcttctgggaga

SEQ ID NO: 1067108 - DNA, 23 bp, Homo sapiens
cagatgcttgcggcaaaaggaaa

SEQ ID NO: 1067109 - DNA, 16 bp, Homo sapiens
cagatgcttttgtgag

SEQ ID NO: 1067110 - DNA, 18 bp, Homo sapiens
cagatggaaaaactgagg

SEQ ID NO: 1067111 - DNA, 21 bp, Homo sapiens
cagatggaaagacgtttttgt

SEQ ID NO: 1067112 - DNA, 13 bp, Homo sapiens
cagatggacactg

SEQ ID NO: 1067113 - DNA, 14 bp, Homo sapiens
cagatggacactgc

SEQ ID NO: 1067114 - DNA, 15 bp, Homo sapiens
cagatggacactgcc

SEQ ID NO: 1067115 - DNA, 18 bp, Homo sapiens
cagatggacactgccaag

SEQ ID NO: 1067116 - DNA, 20 bp, Homo sapiens
cagatggacgcaggccctgt

SEQ ID NO: 1067117 - DNA, 18 bp, Homo sapiens
cagatggagcaaatgtcc

SEQ ID NO: 1067118 - DNA, 22 bp, Homo sapiens
cagatggaggttctcagagcca

SEQ ID NO: 1067119 - DNA, 22 bp, Homo sapiens
cagatggatttgcctgtgccac

SEQ ID NO: 1067120 - DNA, 19 bp, Homo sapiens
cagatggcttcggagggcc

SEQ ID NO: 1067121 - DNA, 18 bp, Homo sapiens
cagatggctttcagggca

SEQ ID NO: 1067122 - DNA, 22 bp, Homo sapiens
cagatggggtctgtgactggat

SEQ ID NO: 1067123 - DNA, 22 bp, Homo sapiens
cagatgggtctgatattaatca

SEQ ID NO: 1067124 - DNA, 17 bp, Homo sapiens
cagatggtactgctgag

SEQ ID NO: 1067125 - DNA, 15 bp, Homo sapiens
cagatggttgcaatt

SEQ ID NO: 1067126 - DNA, 22 bp, Homo sapiens
cagatggtttccacatttagat

SEQ ID NO: 1067127 - DNA, 14 bp, Homo sapiens
cagatggtttccta

SEQ ID NO: 1067128 - DNA, 12 bp, Homo sapiens
cagatgtaatgt

SEQ ID NO: 1067129 - DNA, 13 bp, Homo sapiens
cagatgtaatgtt

SEQ ID NO: 1067130 - DNA, 14 bp, Homo sapiens
cagatgtaatgttt

SEQ ID NO: 1067131 - DNA, 22 bp, Homo sapiens
cagatgtaatgttttctttgca

SEQ ID NO: 1067132 - DNA, 20 bp, Homo sapiens
cagatgtaattatgttttca

SEQ ID NO: 1067133 - DNA, 12 bp, Homo sapiens
cagatgtattga

SEQ ID NO: 1067134 - DNA, 17 bp, Homo sapiens
cagatgtattgactgta

SEQ ID NO: 1067135 - DNA, 22 bp, Homo sapiens
cagatgtcccttgatgcacaga

SEQ ID NO: 1067136 - DNA, 16 bp, Homo sapiens
cagatgtctctggggc

SEQ ID NO: 1067137 - DNA, 17 bp, Homo sapiens
cagatgtcttccctggg

SEQ ID NO: 1067138 - DNA, 19 bp, Homo sapiens
cagatgtcttccctgggct

SEQ ID NO: 1067139 - DNA, 23 bp, Homo sapiens
cagatgtcttccctgggctgcca

SEQ ID NO: 1067140 - DNA, 15 bp, Homo sapiens
cagatgtgagccacc

SEQ ID NO: 1067141 - DNA, 14 bp, Homo sapiens
cagatgtgcaataa

SEQ ID NO: 1067142 - DNA, 18 bp, Homo sapiens
cagatgtgcaataatttg

SEQ ID NO: 1067143 - DNA, 11 bp, Homo sapiens
cagatgtgcat

SEQ ID NO: 1067144 - DNA, 18 bp, Homo sapiens
cagatgtgctataatctg

SEQ ID NO: 1067145 - DNA, 23 bp, Homo sapiens
cagatgtggctactgacatatct

SEQ ID NO: 1067146 - DNA, 23 bp, Homo sapiens
cagatgtggggctgagctgggga

SEQ ID NO: 1067147 - DNA, 22 bp, Homo sapiens
cagatgtgtcccccccaggcct

SEQ ID NO: 1067148 - DNA, 13 bp, Homo sapiens
cagatgtgtctgg

SEQ ID NO: 1067149 - DNA, 18 bp, Homo sapiens
cagatgtgtctgggagag

SEQ ID NO: 1067150 - DNA, 22 bp, Homo sapiens
cagatgtgtctgggagagcctg

SEQ ID NO: 1067151 - DNA, 20 bp, Homo sapiens
cagatgttaaaataaatggt

SEQ ID NO: 1067152 - DNA, 21 bp, Homo sapiens
cagatgttaaaataaatggtt

SEQ ID NO: 1067153 - DNA, 14 bp, Homo sapiens
cagatgtttccaga

SEQ ID NO: 1067154 - DNA, 14 bp, Homo sapiens
cagatgtttctttt

SEQ ID NO: 1067155 - DNA, 19 bp, Homo sapiens
cagatgtttcttttgtatg

SEQ ID NO: 1067156 - DNA, 18 bp, Homo sapiens
cagatgttttacgtctgg

SEQ ID NO: 1067157 - DNA, 13 bp, Homo sapiens
cagattacactga

SEQ ID NO: 1067158 - DNA, 23 bp, Homo sapiens
cagattcaataatgagagctcag

SEQ ID NO: 1067159 - DNA, 23 bp, Homo sapiens
cagattcactttgtttatgcata

SEQ ID NO: 1067160 - DNA, 20 bp, Homo sapiens
cagattcaggccagcccagc

SEQ ID NO: 1067161 - DNA, 15 bp, Homo sapiens
cagattcatttttct

SEQ ID NO: 1067162 - DNA, 14 bp, Homo sapiens
cagattcccactgc

SEQ ID NO: 1067163 - DNA, 18 bp, Homo sapiens
cagattcccagagcaaaa

SEQ ID NO: 1067164 - DNA, 19 bp, Homo sapiens
cagattcccagagcaaaat

SEQ ID NO: 1067165 - DNA, 21 bp, Homo sapiens
cagattcccagagcaaaataa

SEQ ID NO: 1067166 - DNA, 16 bp, Homo sapiens
cagattcccctgtgtc

SEQ ID NO: 1067167 - DNA, 17 bp, Homo sapiens
cagattcccctgtgtca

SEQ ID NO: 1067168 - DNA, 17 bp, Homo sapiens
cagattcctgggcctgt

SEQ ID NO: 1067169 - DNA, 20 bp, Homo sapiens
cagattcctgggcctgtccc

SEQ ID NO: 1067170 - DNA, 21 bp, Homo sapiens
cagattcctgggcctgtcccc

SEQ ID NO: 1067171 - DNA, 15 bp, Homo sapiens
cagattctatattat

SEQ ID NO: 1067172 - DNA, 22 bp, Homo sapiens
cagattctatattattatatat

SEQ ID NO: 1067173 - DNA, 18 bp, Homo sapiens
cagattctatcctcatct

SEQ ID NO: 1067174 - DNA, 19 bp, Homo sapiens
cagattctgacatttatat

SEQ ID NO: 1067175 - DNA, 15 bp, Homo sapiens
cagattctgcctctc

SEQ ID NO: 1067176 - DNA, 12 bp, Homo sapiens
cagattgaaaag

SEQ ID NO: 1067177 - DNA, 16 bp, Homo sapiens
cagattgaagaatctg

SEQ ID NO: 1067178 - DNA, 20 bp, Homo sapiens
cagattgaagaatctgcccc

SEQ ID NO: 1067179 - DNA, 21 bp, Homo sapiens
cagattgaagaatctgcccct

SEQ ID NO: 1067180 - DNA, 22 bp, Homo sapiens
cagattgaagaatctgcccctg

SEQ ID NO: 1067181 - DNA, 23 bp, Homo sapiens
cagattgagacctacaggctgac

SEQ ID NO: 1067182 - DNA, 18 bp, Homo sapiens
cagattgctgaatcccat

SEQ ID NO: 1067183 - DNA, 20 bp, Homo sapiens
cagattggcacccctttcta

SEQ ID NO: 1067184 - DNA, 16 bp, Homo sapiens
cagattgggataaggc

SEQ ID NO: 1067185 - DNA, 23 bp, Homo sapiens
cagattgttaggagtggttctca

SEQ ID NO: 1067186 - DNA, 14 bp, Homo sapiens
cagattgttatcta

SEQ ID NO: 1067187 - DNA, 13 bp, Homo sapiens
cagattgtttgca

SEQ ID NO: 1067188 - DNA, 19 bp, Homo sapiens
cagatttcagtaatgtctt

SEQ ID NO: 1067189 - DNA, 17 bp, Homo sapiens
cagatttctgaggaaat

SEQ ID NO: 1067190 - DNA, 14 bp, Homo sapiens
cagatttctggttg

SEQ ID NO: 1067191 - DNA, 17 bp, Homo sapiens
cagatttctggttgatt

SEQ ID NO: 1067192 - DNA, 13 bp, Homo sapiens
cagatttgagctc

SEQ ID NO: 1067193 - DNA, 16 bp, Homo sapiens
cagatttgagctcagc

SEQ ID NO: 1067194 - DNA, 22 bp, Homo sapiens
cagatttggggtataggtctca

SEQ ID NO: 1067195 - DNA, 24 bp, Homo sapiens
cagatttgtctttttgttgtaaaa

SEQ ID NO: 1067196 - DNA, 18 bp, Homo sapiens
cagattttacaaaagatg

SEQ ID NO: 1067197 - DNA, 15 bp, Homo sapiens
cagattttacagagc

SEQ ID NO: 1067198 - DNA, 18 bp, Homo sapiens
cagattttatattttcta

SEQ ID NO: 1067199 - DNA, 21 bp, Homo sapiens
cagattttatattttctattt

SEQ ID NO: 1067200 - DNA, 13 bp, Homo sapiens
cagattttcagca

SEQ ID NO: 1067201 - DNA, 15 bp, Homo sapiens
cagattttcagcaaa

SEQ ID NO: 1067202 - DNA, 14 bp, Homo sapiens
cagatttttacaaa

SEQ ID NO: 1067203 - DNA, 17 bp, Homo sapiens
cagatttttgtaataaa

SEQ ID NO: 1067204 - DNA, 14 bp, Homo sapiens
cagattttttaaaa

SEQ ID NO: 1067205 - DNA, 20 bp, Homo sapiens
cagattttttttggactgtt

SEQ ID NO: 1067206 - DNA, 18 bp, Homo sapiens
cagcaaaaaagtccaatt

SEQ ID NO: 1067207 - DNA, 15 bp, Homo sapiens
cagcaaaaagcaaaa

SEQ ID NO: 1067208 - DNA, 13 bp, Homo sapiens
cagcaaaatggaa

SEQ ID NO: 1067209 - DNA, 16 bp, Homo sapiens
cagcaaaatggaagca

SEQ ID NO: 1067210 - DNA, 21 bp, Homo sapiens
cagcaaacactccaccctcca

SEQ ID NO: 1067211 - DNA, 21 bp, Homo sapiens
cagcaaaccatttttaaagta

SEQ ID NO: 1067212 - DNA, 16 bp, Homo sapiens
cagcaaaccggggcct

SEQ ID NO: 1067213 - DNA, 14 bp, Homo sapiens
cagcaaagaggggc

SEQ ID NO: 1067214 - DNA, 15 bp, Homo sapiens
cagcaaagaggggcg

SEQ ID NO: 1067215 - DNA, 23 bp, Homo sapiens
cagcaaagaggggcgctgtcctg

SEQ ID NO: 1067216 - DNA, 13 bp, Homo sapiens
cagcaaataaata

SEQ ID NO: 1067217 - DNA, 19 bp, Homo sapiens
cagcaaatgaaagactctt

SEQ ID NO: 1067218 - DNA, 15 bp, Homo sapiens
cagcaacaagactgc

SEQ ID NO: 1067219 - DNA, 19 bp, Homo sapiens
cagcaacaagactgccagg

SEQ ID NO: 1067220 - DNA, 14 bp, Homo sapiens
cagcaacactccgg

SEQ ID NO: 1067221 - DNA, 19 bp, Homo sapiens
cagcaacactccggtcagc

SEQ ID NO: 1067222 - DNA, 18 bp, Homo sapiens
cagcaacagcaagaaata

SEQ ID NO: 1067223 - DNA, 12 bp, Homo sapiens
cagcaaccccag

SEQ ID NO: 1067224 - DNA, 14 bp, Homo sapiens
cagcaaccctccta

SEQ ID NO: 1067225 - DNA, 13 bp, Homo sapiens
cagcaacgcccct

SEQ ID NO: 1067226 - DNA, 18 bp, Homo sapiens
cagcaacgcccctccaaa

SEQ ID NO: 1067227 - DNA, 23 bp, Homo sapiens
cagcaacgcccctccaaacctcc

SEQ ID NO: 1067228 - DNA, 18 bp, Homo sapiens
cagcaacgcttgtagaac

SEQ ID NO: 1067229 - DNA, 20 bp, Homo sapiens
cagcaacggcacagctaatt

SEQ ID NO: 1067230 - DNA, 13 bp, Homo sapiens
cagcaactgacct

SEQ ID NO: 1067231 - DNA, 13 bp, Homo sapiens
cagcaactgccct

SEQ ID NO: 1067232 - DNA, 14 bp, Homo sapiens
cagcaactgccctt

SEQ ID NO: 1067233 - DNA, 22 bp, Homo sapiens
cagcaacttcttctccatccct

SEQ ID NO: 1067234 - DNA, 16 bp, Homo sapiens
cagcaagaagcagcct

SEQ ID NO: 1067235 - DNA, 12 bp, Homo sapiens
cagcaagaagct

SEQ ID NO: 1067236 - DNA, 16 bp, Homo sapiens
cagcaagaagggagtt

SEQ ID NO: 1067237 - DNA, 16 bp, Homo sapiens
cagcaagaataaaaaa

SEQ ID NO: 1067238 - DNA, 16 bp, Homo sapiens
cagcaagagcacaaga

SEQ ID NO: 1067239 - DNA, 21 bp, Homo sapiens
cagcaagagggaacaaaactg

SEQ ID NO: 1067240 - DNA, 21 bp, Homo sapiens
cagcaagcagtctaccctgtc

SEQ ID NO: 1067241 - DNA, 19 bp, Homo sapiens
cagcaagccctacagagct

SEQ ID NO: 1067242 - DNA, 21 bp, Homo sapiens
cagcaagccggccccccctct

SEQ ID NO: 1067243 - DNA, 20 bp, Homo sapiens
cagcaagcgggagcccgtgg

SEQ ID NO: 1067244 - DNA, 17 bp, Homo sapiens
cagcaaggagatttaca

SEQ ID NO: 1067245 - DNA, 13 bp, Homo sapiens
cagcaaggcaggt

SEQ ID NO: 1067246 - DNA, 14 bp, Homo sapiens
cagcaaggcaggtt

SEQ ID NO: 1067247 - DNA, 12 bp, Homo sapiens
cagcaaggctgc

SEQ ID NO: 1067248 - DNA, 15 bp, Homo sapiens
cagcaaggctgctgc

SEQ ID NO: 1067249 - DNA, 15 bp, Homo sapiens
cagcaagggacctgc

SEQ ID NO: 1067250 - DNA, 22 bp, Homo sapiens
cagcaagggagatttttgaatc

SEQ ID NO: 1067251 - DNA, 23 bp, Homo sapiens
cagcaagtacagcggctcccctc

SEQ ID NO: 1067252 - DNA, 16 bp, Homo sapiens
cagcaagtgagcagag

SEQ ID NO: 1067253 - DNA, 17 bp, Homo sapiens
cagcaagtgagcagaga

SEQ ID NO: 1067254 - DNA, 20 bp, Homo sapiens
cagcaagtgtttgtgggaca

SEQ ID NO: 1067255 - DNA, 15 bp, Homo sapiens
cagcaataagaaatg

SEQ ID NO: 1067256 - DNA, 19 bp, Homo sapiens
cagcaatactcatcagagc

SEQ ID NO: 1067257 - DNA, 17 bp, Homo sapiens
cagcaatagggtgcagt

SEQ ID NO: 1067258 - DNA, 21 bp, Homo sapiens
cagcaatagggtgcagttttc

SEQ ID NO: 1067259 - DNA, 19 bp, Homo sapiens
cagcaatatattaccagca

SEQ ID NO: 1067260 - DNA, 20 bp, Homo sapiens
cagcaatatattaccagcaa

SEQ ID NO: 1067261 - DNA, 22 bp, Homo sapiens
cagcaatatattaccagcaaga

SEQ ID NO: 1067262 - DNA, 18 bp, Homo sapiens
cagcaatgacatctcagg

SEQ ID NO: 1067263 - DNA, 21 bp, Homo sapiens
cagcaatgacatctcaggggc

SEQ ID NO: 1067264 - DNA, 22 bp, Homo sapiens
cagcaatgatgtccagaagaat

SEQ ID NO: 1067265 - DNA, 20 bp, Homo sapiens
cagcaatggcgctgtgcggc

SEQ ID NO: 1067266 - DNA, 15 bp, Homo sapiens
cagcaattattatat

SEQ ID NO: 1067267 - DNA, 17 bp, Homo sapiens
cagcaattcagacccct

SEQ ID NO: 1067268 - DNA, 20 bp, Homo sapiens
cagcagccctgccccacacc

SEQ ID NO: 1067269 - DNA, 22 bp, Homo sapiens
cagcagccgccttaagctgatc

SEQ ID NO: 1067270 - DNA, 22 bp, Homo sapiens
cagcagccggaatagagcctcg

SEQ ID NO: 1067271 - DNA, 15 bp, Homo sapiens
cagcagcctggaccc

SEQ ID NO: 1067272 - DNA, 18 bp, Homo sapiens
cagcagcctggaccctgt

SEQ ID NO: 1067273 - DNA, 21 bp, Homo sapiens
cagcagcctggggctggcctc

SEQ ID NO: 1067274 - DNA, 13 bp, Homo sapiens
cagcagcctgtat

SEQ ID NO: 1067275 - DNA, 16 bp, Homo sapiens
cagcagcctgtatgtg

SEQ ID NO: 1067276 - DNA, 13 bp, Homo sapiens
cagcagcctgtga

SEQ ID NO: 1067277 - DNA, 14 bp, Homo sapiens
cagcagcctgtgag

SEQ ID NO: 1067278 - DNA, 17 bp, Homo sapiens
cagcagcctttaatgca

SEQ ID NO: 1067279 - DNA, 15 bp, Homo sapiens
cagcagctaggactg

SEQ ID NO: 1067280 - DNA, 23 bp, Homo sapiens
cagcagctaggactgaggagtgg

SEQ ID NO: 1067281 - DNA, 15 bp, Homo sapiens
cagcagctcaggcac

SEQ ID NO: 1067282 - DNA, 16 bp, Homo sapiens
cagcagctcaggcaca

SEQ ID NO: 1067283 - DNA, 11 bp, Homo sapiens
cagcagctcat

SEQ ID NO: 1067284 - DNA, 18 bp, Homo sapiens
cagcagctgaagtctctt

SEQ ID NO: 1067285 - DNA, 22 bp, Homo sapiens
cagcagctgcgggtctgaagga

SEQ ID NO: 1067286 - DNA, 19 bp, Homo sapiens
cagcagctgggacccctcc

SEQ ID NO: 1067287 - DNA, 17 bp, Homo sapiens
cagcagcttcaccagag

SEQ ID NO: 1067288 - DNA, 20 bp, Homo sapiens
cagcagcttggggagaggga

SEQ ID NO: 1067289 - DNA, 17 bp, Homo sapiens
cagcagcttttaataca

SEQ ID NO: 1067290 - DNA, 12 bp, Homo sapiens
cagcaggaaggc

SEQ ID NO: 1067291 - DNA, 15 bp, Homo sapiens
cagcaggaagggtgg

SEQ ID NO: 1067292 - DNA, 16 bp, Homo sapiens
cagcaggaagggtggg

SEQ ID NO: 1067293 - DNA, 22 bp, Homo sapiens
cagcaggacctgtgctttgaga

SEQ ID NO: 1067294 - DNA, 19 bp, Homo sapiens
cagcaggagagactgagca

SEQ ID NO: 1067295 - DNA, 21 bp, Homo sapiens
cagcaggagagactgagcagc

SEQ ID NO: 1067296 - DNA, 23 bp, Homo sapiens
cagcaggagagactgagcagccg

SEQ ID NO: 1067297 - DNA, 17 bp, Homo sapiens
cagcaggaggagtggaa

SEQ ID NO: 1067298 - DNA, 22 bp, Homo sapiens
cagcaggagtggtgcagacaga

SEQ ID NO: 1067299 - DNA, 18 bp, Homo sapiens
cagcaggatgggctgagc

SEQ ID NO: 1067300 - DNA, 19 bp, Homo sapiens
cagcaggatgggctgagct

SEQ ID NO: 1067301 - DNA, 20 bp, Homo sapiens
cagcaggatgggctgagcta

SEQ ID NO: 1067302 - DNA, 15 bp, Homo sapiens
cagcaggcagagtgg

SEQ ID NO: 1067303 - DNA, 20 bp, Homo sapiens
cagcaggcaggcactgtggc

SEQ ID NO: 1067304 - DNA, 14 bp, Homo sapiens
cagcaggcaggctg

SEQ ID NO: 1067305 - DNA, 19 bp, Homo sapiens
cagcaggccagggactcag

SEQ ID NO: 1067306 - DNA, 18 bp, Homo sapiens
cagcaggccatcttttta

SEQ ID NO: 1067307 - DNA, 15 bp, Homo sapiens
cagcaggcccagcat

SEQ ID NO: 1067308 - DNA, 20 bp, Homo sapiens
cagcaggcccagcatgcagg

SEQ ID NO: 1067309 - DNA, 15 bp, Homo sapiens
cagcaggcctctggt

SEQ ID NO: 1067310 - DNA, 22 bp, Homo sapiens
cagcaggcctctggttgcctcc

SEQ ID NO: 1067311 - DNA, 11 bp, Homo sapiens
cagcaggctca

SEQ ID NO: 1067312 - DNA, 16 bp, Homo sapiens
cagcaggctcaggcac

SEQ ID NO: 1067313 - DNA, 17 bp, Homo sapiens
cagcaggctcctggctg

SEQ ID NO: 1067314 - DNA, 22 bp, Homo sapiens
cagcagggaaaatgcagcaggg

SEQ ID NO: 1067315 - DNA, 18 bp, Homo sapiens
cagcagggatgccctgga

SEQ ID NO: 1067316 - DNA, 21 bp, Homo sapiens
cagcagggatgccctggaggt

SEQ ID NO: 1067317 - DNA, 17 bp, Homo sapiens
cagcagggccactcccg

SEQ ID NO: 1067318 - DNA, 11 bp, Homo sapiens
cagcagggctg

SEQ ID NO: 1067319 - DNA, 15 bp, Homo sapiens
cagcagggctgggcc

SEQ ID NO: 1067320 - DNA, 12 bp, Homo sapiens
cagcaggggagc

SEQ ID NO: 1067321 - DNA, 16 bp, Homo sapiens
cagcaggggagccctg

SEQ ID NO: 1067322 - DNA, 16 bp, Homo sapiens
cagcaggggctggccc

SEQ ID NO: 1067323 - DNA, 15 bp, Homo sapiens
cagcaggggggctgt

SEQ ID NO: 1067324 - DNA, 20 bp, Homo sapiens
cagcagggtcttttcatctg

SEQ ID NO: 1067325 - DNA, 21 bp, Homo sapiens
cagcagggtcttttcatctgg

SEQ ID NO: 1067326 - DNA, 23 bp, Homo sapiens
cagcaggtgattggaccaggcca

SEQ ID NO: 1067327 - DNA, 24 bp, Homo sapiens
cagcaggtgctgggctggactggc

SEQ ID NO: 1067328 - DNA, 13 bp, Homo sapiens
cagcaggtgctgt

SEQ ID NO: 1067329 - DNA, 16 bp, Homo sapiens
cagcaggtgtggccaa

SEQ ID NO: 1067330 - DNA, 19 bp, Homo sapiens
cagcaggtgtggtggctca

SEQ ID NO: 1067331 - DNA, 20 bp, Homo sapiens
cagcaggtgtggtggctcat

SEQ ID NO: 1067332 - DNA, 16 bp, Homo sapiens
cagcagtagtgagcca

SEQ ID NO: 1067333 - DNA, 23 bp, Homo sapiens
cagcagtcccagtattctcagag

SEQ ID NO: 1067334 - DNA, 14 bp, Homo sapiens
cagcagtgaccaca

SEQ ID NO: 1067335 - DNA, 15 bp, Homo sapiens
cagcagtgaccacac

SEQ ID NO: 1067336 - DNA, 19 bp, Homo sapiens
cagcagtgaccacaccaac

SEQ ID NO: 1067337 - DNA, 20 bp, Homo sapiens
cagcagtgtgaatagcctgg

SEQ ID NO: 1067338 - DNA, 22 bp, Homo sapiens
cagcagtgtgaatagcctggcc

SEQ ID NO: 1067339 - DNA, 12 bp, Homo sapiens
cagcagtgttcc

SEQ ID NO: 1067340 - DNA, 23 bp, Homo sapiens
cagcagttgaatgacaacagaag

SEQ ID NO: 1067341 - DNA, 13 bp, Homo sapiens
cagcagttgacat

SEQ ID NO: 1067342 - DNA, 17 bp, Homo sapiens
cagcagtttgggaggtc

SEQ ID NO: 1067343 - DNA, 19 bp, Homo sapiens
cagcatacattttctggtg

SEQ ID NO: 1067344 - DNA, 16 bp, Homo sapiens
cagcataggggggagg

SEQ ID NO: 1067345 - DNA, 22 bp, Homo sapiens
cagcatatttgtatagttgctt

SEQ ID NO: 1067346 - DNA, 15 bp, Homo sapiens
cagcatcactggtat

SEQ ID NO: 1067347 - DNA, 13 bp, Homo sapiens
cagcatcagggtt

SEQ ID NO: 1067348 - DNA, 19 bp, Homo sapiens
cagcatcattttgcattca

SEQ ID NO: 1067349 - DNA, 23 bp, Homo sapiens
cagcatcattttgcattcaaatt

SEQ ID NO: 1067350 - DNA, 14 bp, Homo sapiens
cagcatccagcctg

SEQ ID NO: 1067351 - DNA, 15 bp, Homo sapiens
cagcatccagcctgt

SEQ ID NO: 1067352 - DNA, 15 bp, Homo sapiens
cagcatcccagcctt

SEQ ID NO: 1067353 - DNA, 13 bp, Homo sapiens
cagcatccctgga

SEQ ID NO: 1067354 - DNA, 15 bp, Homo sapiens
cagcatcccttccca

SEQ ID NO: 1067355 - DNA, 20 bp, Homo sapiens
cagcatccgcaggtgctggt

SEQ ID NO: 1067356 - DNA, 23 bp, Homo sapiens
cagcatccttttctgcagagggg

SEQ ID NO: 1067357 - DNA, 20 bp, Homo sapiens
cagcatcgggagcacccaga

SEQ ID NO: 1067358 - DNA, 19 bp, Homo sapiens
cagcatcgggggcctgcaa

SEQ ID NO: 1067359 - DNA, 22 bp, Homo sapiens
cagcatcgtgatcactgagcca

SEQ ID NO: 1067360 - DNA, 23 bp, Homo sapiens
cagcatctcccagcaagacctca

SEQ ID NO: 1067361 - DNA, 13 bp, Homo sapiens
cagcatctggctg

SEQ ID NO: 1067362 - DNA, 15 bp, Homo sapiens
cagcatctggctgtc

SEQ ID NO: 1067363 - DNA, 20 bp, Homo sapiens
cagcatctggctgtctagaa

SEQ ID NO: 1067364 - DNA, 23 bp, Homo sapiens
cagcatctggctgtctagaatgt

SEQ ID NO: 1067365 - DNA, 15 bp, Homo sapiens
cagcatctggtcttg

SEQ ID NO: 1067366 - DNA, 22 bp, Homo sapiens
cagcatgaataaaacactcatc

SEQ ID NO: 1067367 - DNA, 17 bp, Homo sapiens
cagcatgacaaaaataa

SEQ ID NO: 1067368 - DNA, 21 bp, Homo sapiens
cagcatgacctgtgaccagca

SEQ ID NO: 1067369 - DNA, 23 bp, Homo sapiens
cagcatgacctgtgaccagcact

SEQ ID NO: 1067370 - DNA, 21 bp, Homo sapiens
cagcatgcccagattcccaga

SEQ ID NO: 1067371 - DNA, 23 bp, Homo sapiens
cagcatgcttgggctgacccagc

SEQ ID NO: 1067372 - DNA, 13 bp, Homo sapiens
cagcatggaaaaa

SEQ ID NO: 1067373 - DNA, 14 bp, Homo sapiens
cagcatggaaaaat

SEQ ID NO: 1067374 - DNA, 17 bp, Homo sapiens
cagcatggaaaaatggt

SEQ ID NO: 1067375 - DNA, 22 bp, Homo sapiens
cagcatgtacggattttcagtt

SEQ ID NO: 1067376 - DNA, 18 bp, Homo sapiens
cagcatgtctattcagct

SEQ ID NO: 1067377 - DNA, 15 bp, Homo sapiens
cagcatgtgccaaga

SEQ ID NO: 1067378 - DNA, 19 bp, Homo sapiens
cagcatgtgccaagattct

SEQ ID NO: 1067379 - DNA, 17 bp, Homo sapiens
cagcatgttgctgagga

SEQ ID NO: 1067380 - DNA, 18 bp, Homo sapiens
cagcatgttgctgaggag

SEQ ID NO: 1067381 - DNA, 20 bp, Homo sapiens
cagcattaaaattttacctc

SEQ ID NO: 1067382 - DNA, 21 bp, Homo sapiens
cagcattagagaaatgaatta

SEQ ID NO: 1067383 - DNA, 15 bp, Homo sapiens
cagcattaggctttt

SEQ ID NO: 1067384 - DNA, 21 bp, Homo sapiens
cagcattccagcccctctggt

SEQ ID NO: 1067385 - DNA, 20 bp, Homo sapiens
cagcattccagctctgcccc

SEQ ID NO: 1067386 - DNA, 15 bp, Homo sapiens
cagcattccatgacc

SEQ ID NO: 1067387 - DNA, 17 bp, Homo sapiens
cagcattcccaccaaca

SEQ ID NO: 1067388 - DNA, 14 bp, Homo sapiens
cagcattctcactc

SEQ ID NO: 1067389 - DNA, 19 bp, Homo sapiens
cagcattctggaggggaga

SEQ ID NO: 1067390 - DNA, 19 bp, Homo sapiens
cagcattcttgtcacaata

SEQ ID NO: 1067391 - DNA, 14 bp, Homo sapiens
cagcattgactcag

SEQ ID NO: 1067392 - DNA, 16 bp, Homo sapiens
cagcattgtatatgtg

SEQ ID NO: 1067393 - DNA, 18 bp, Homo sapiens
cagcattgtgacttggag

SEQ ID NO: 1067394 - DNA, 18 bp, Homo sapiens
cagcattgtttcaaaata

SEQ ID NO: 1067395 - DNA, 18 bp, Homo sapiens
cagcatttggcagcacgc

SEQ ID NO: 1067396 - DNA, 13 bp, Homo sapiens
cagcatttgtcct

SEQ ID NO: 1067397 - DNA, 21 bp, Homo sapiens
cagcatttgtccttttgtgaa

SEQ ID NO: 1067398 - DNA, 15 bp, Homo sapiens
cagcattttcacatt

SEQ ID NO: 1067399 - DNA, 19 bp, Homo sapiens
cagcattttcacattttgc

SEQ ID NO: 1067400 - DNA, 21 bp, Homo sapiens
cagcattttcacattttgcct

SEQ ID NO: 1067401 - DNA, 16 bp, Homo sapiens
cagccaaaccctgtct

SEQ ID NO: 1067402 - DNA, 23 bp, Homo sapiens
cagccaaagaaatgggcctgcct

SEQ ID NO: 1067403 - DNA, 17 bp, Homo sapiens
cagccaaagataatctc

SEQ ID NO: 1067404 - DNA, 15 bp, Homo sapiens
cagccaaagcctcct

SEQ ID NO: 1067405 - DNA, 19 bp, Homo sapiens
cagccaaaggggagccaga

SEQ ID NO: 1067406 - DNA, 17 bp, Homo sapiens
cagccaaatgcagggag

SEQ ID NO: 1067407 - DNA, 22 bp, Homo sapiens
cagccaaatgtaattgaataaa

SEQ ID NO: 1067408 - DNA, 22 bp, Homo sapiens
cagccaaatttaaaactgttgg

SEQ ID NO: 1067409 - DNA, 15 bp, Homo sapiens
cagccaaatttcctg

SEQ ID NO: 1067410 - DNA, 21 bp, Homo sapiens
cagccaaatttcctgtttgaa

SEQ ID NO: 1067411 - DNA, 23 bp, Homo sapiens
cagccaacacgcacctgcctcag

SEQ ID NO: 1067412 - DNA, 22 bp, Homo sapiens
cagccaacaggtggcaggacca

SEQ ID NO: 1067413 - DNA, 23 bp, Homo sapiens
cagccaacaggtggcaggaccag

SEQ ID NO: 1067414 - DNA, 14 bp, Homo sapiens
cagccaacccctgt

SEQ ID NO: 1067415 - DNA, 15 bp, Homo sapiens
cagccaacccctgtg

SEQ ID NO: 1067416 - DNA, 21 bp, Homo sapiens
cagccaacccctgtggagccc

SEQ ID NO: 1067417 - DNA, 16 bp, Homo sapiens
cagccaactagcccct

SEQ ID NO: 1067418 - DNA, 17 bp, Homo sapiens
cagccaactagcccctg

SEQ ID NO: 1067419 - DNA, 13 bp, Homo sapiens
cagccaactcatt

SEQ ID NO: 1067420 - DNA, 16 bp, Homo sapiens
cagccaactgccccgg

SEQ ID NO: 1067421 - DNA, 17 bp, Homo sapiens
cagccaagacaaggagg

SEQ ID NO: 1067422 - DNA, 23 bp, Homo sapiens
cagccaagattttcctcttgtga

SEQ ID NO: 1067423 - DNA, 16 bp, Homo sapiens
cagccaagcacctcca

SEQ ID NO: 1067424 - DNA, 11 bp, Homo sapiens
cagccaaggaa

SEQ ID NO: 1067425 - DNA, 21 bp, Homo sapiens
cagccaaggccgaagctctgg

SEQ ID NO: 1067426 - DNA, 13 bp, Homo sapiens
cagccaagggtcc

SEQ ID NO: 1067427 - DNA, 16 bp, Homo sapiens
cagccaagggtcctca

SEQ ID NO: 1067428 - DNA, 17 bp, Homo sapiens
cagccaatttgtctcct

SEQ ID NO: 1067429 - DNA, 23 bp, Homo sapiens
cagccacacctggactgaccctg

SEQ ID NO: 1067430 - DNA, 19 bp, Homo sapiens
cagccacacgcaggcggcc

SEQ ID NO: 1067431 - DNA, 22 bp, Homo sapiens
cagccacacgcaggcggccagg

SEQ ID NO: 1067432 - DNA, 17 bp, Homo sapiens
cagccacactgggcctg

SEQ ID NO: 1067433 - DNA, 19 bp, Homo sapiens
cagccacactgggcctgga

SEQ ID NO: 1067434 - DNA, 12 bp, Homo sapiens
cagccacactgt

SEQ ID NO: 1067435 - DNA, 13 bp, Homo sapiens
cagccacagagca

SEQ ID NO: 1067436 - DNA, 13 bp, Homo sapiens
cagccacaggact

SEQ ID NO: 1067437 - DNA, 14 bp, Homo sapiens
cagccacaggactg

SEQ ID NO: 1067438 - DNA, 15 bp, Homo sapiens
cagccacaggactga

SEQ ID NO: 1067439 - DNA, 19 bp, Homo sapiens
cagccacaggactgagccc

SEQ ID NO: 1067440 - DNA, 23 bp, Homo sapiens
cagccacaggactgagccctctc

SEQ ID NO: 1067441 - DNA, 24 bp, Homo sapiens
cagccacaggactgagccctctca

SEQ ID NO: 1067442 - DNA, 21 bp, Homo sapiens
cagccacagtgttatgctctg

SEQ ID NO: 1067443 - DNA, 15 bp, Homo sapiens
cagccaccacatccc

SEQ ID NO: 1067444 - DNA, 20 bp, Homo sapiens
cagccaccaccctcaggtgc

SEQ ID NO: 1067445 - DNA, 11 bp, Homo sapiens
cagccacccaa

SEQ ID NO: 1067446 - DNA, 21 bp, Homo sapiens
cagccaccccgggctctctgc

SEQ ID NO: 1067447 - DNA, 22 bp, Homo sapiens
cagccaccccgggctctctgct

SEQ ID NO: 1067448 - DNA, 13 bp, Homo sapiens
cagccacccctca

SEQ ID NO: 1067449 - DNA, 15 bp, Homo sapiens
cagccacccctcaga

SEQ ID NO: 1067450 - DNA, 14 bp, Homo sapiens
cagccacccctgcc

SEQ ID NO: 1067451 - DNA, 17 bp, Homo sapiens
cagccacccctgccact

SEQ ID NO: 1067452 - DNA, 22 bp, Homo sapiens
cagccacccctgccactcaccc

SEQ ID NO: 1067453 - DNA, 21 bp, Homo sapiens
cagccacccgtggggtgctgc

SEQ ID NO: 1067454 - DNA, 16 bp, Homo sapiens
cagccaccgtttcttc

SEQ ID NO: 1067455 - DNA, 14 bp, Homo sapiens
cagccacctccgcc

SEQ ID NO: 1067456 - DNA, 16 bp, Homo sapiens
cagccacctccgccag

SEQ ID NO: 1067457 - DNA, 20 bp, Homo sapiens
cagccacctccgccagaccc

SEQ ID NO: 1067458 - DNA, 18 bp, Homo sapiens
cagccacgaggtgcaaca

SEQ ID NO: 1067459 - DNA, 16 bp, Homo sapiens
cagccacgattggaga

SEQ ID NO: 1067460 - DNA, 19 bp, Homo sapiens
cagccactaagaacccctc

SEQ ID NO: 1067461 - DNA, 18 bp, Homo sapiens
cagccactccaagccccc

SEQ ID NO: 1067462 - DNA, 21 bp, Homo sapiens
cagccactcgggaggctgaga

SEQ ID NO: 1067463 - DNA, 23 bp, Homo sapiens
cagccactcgggaggctgagaca

SEQ ID NO: 1067464 - DNA, 15 bp, Homo sapiens
cagccactgcacagg

SEQ ID NO: 1067465 - DNA, 12 bp, Homo sapiens
cagccactgcca

SEQ ID NO: 1067466 - DNA, 20 bp, Homo sapiens
cagccactgccaagcttcct

SEQ ID NO: 1067467 - DNA, 21 bp, Homo sapiens
cagccactgccaagcttcctg

SEQ ID NO: 1067468 - DNA, 21 bp, Homo sapiens
cagccagaacgtggctctgct

SEQ ID NO: 1067469 - DNA, 20 bp, Homo sapiens
cagccagaaggggctgcttg

SEQ ID NO: 1067470 - DNA, 16 bp, Homo sapiens
cagccagaccagcagg

SEQ ID NO: 1067471 - DNA, 11 bp, Homo sapiens
cagccagagct

SEQ ID NO: 1067472 - DNA, 16 bp, Homo sapiens
cagccagagctgggtg

SEQ ID NO: 1067473 - DNA, 13 bp, Homo sapiens
cagccagagctgt

SEQ ID NO: 1067474 - DNA, 14 bp, Homo sapiens
cagccagagctgtg

SEQ ID NO: 1067475 - DNA, 16 bp, Homo sapiens
cagccagagctgtgcc

SEQ ID NO: 1067476 - DNA, 19 bp, Homo sapiens
cagccagaggagggcagag

SEQ ID NO: 1067477 - DNA, 21 bp, Homo sapiens
cagccagaggagggcagaggg

SEQ ID NO: 1067478 - DNA, 19 bp, Homo sapiens
cagccagaggcatctgagg

SEQ ID NO: 1067479 - DNA, 12 bp, Homo sapiens
cagccagcacct

SEQ ID NO: 1067480 - DNA, 14 bp, Homo sapiens
cagccagcacctgg

SEQ ID NO: 1067481 - DNA, 11 bp, Homo sapiens
cagccagcagc

SEQ ID NO: 1067482 - DNA, 17 bp, Homo sapiens
cagccagcagcagccca

SEQ ID NO: 1067483 - DNA, 17 bp, Homo sapiens
cagccagcagcaggatg

SEQ ID NO: 1067484 - DNA, 15 bp, Homo sapiens
cagccagcagccagc

SEQ ID NO: 1067485 - DNA, 17 bp, Homo sapiens
cagccagcagccagctc

SEQ ID NO: 1067486 - DNA, 13 bp, Homo sapiens
cagccagccaccc

SEQ ID NO: 1067487 - DNA, 15 bp, Homo sapiens
cagccagccacccct

SEQ ID NO: 1067488 - DNA, 13 bp, Homo sapiens
cagccagccagtc

SEQ ID NO: 1067489 - DNA, 17 bp, Homo sapiens
cagccagccagtcttgc

SEQ ID NO: 1067490 - DNA, 20 bp, Homo sapiens
cagccagcccaaaccttggg

SEQ ID NO: 1067491 - DNA, 14 bp, Homo sapiens
cagccagcccagcc

SEQ ID NO: 1067492 - DNA, 17 bp, Homo sapiens
cagccagcccagcccag

SEQ ID NO: 1067493 - DNA, 23 bp, Homo sapiens
cagccagcccatggcccccaata

SEQ ID NO: 1067494 - DNA, 16 bp, Homo sapiens
cagccagccctggccc

SEQ ID NO: 1067495 - DNA, 17 bp, Homo sapiens
cagccagccctggccca

SEQ ID NO: 1067496 - DNA, 22 bp, Homo sapiens
cagccagcccttccctggcccc

SEQ ID NO: 1067497 - DNA, 19 bp, Homo sapiens
cagccagccggtgcctggc

SEQ ID NO: 1067498 - DNA, 13 bp, Homo sapiens
cagccagccttcc

SEQ ID NO: 1067499 - DNA, 17 bp, Homo sapiens
cagccagccttccccac

SEQ ID NO: 1067500 - DNA, 16 bp, Homo sapiens
cagccagcgcctccct

SEQ ID NO: 1067501 - DNA, 19 bp, Homo sapiens
cagccagcgcctccctcca

SEQ ID NO: 1067502 - DNA, 21 bp, Homo sapiens
cagccagctctcagccaacga

SEQ ID NO: 1067503 - DNA, 12 bp, Homo sapiens
cagccagctgca

SEQ ID NO: 1067504 - DNA, 13 bp, Homo sapiens
cagcacacagggc

SEQ ID NO: 1067505 - DNA, 14 bp, Homo sapiens
cagcacacagggca

SEQ ID NO: 1067506 - DNA, 15 bp, Homo sapiens
cagcacacagggcag

SEQ ID NO: 1067507 - DNA, 18 bp, Homo sapiens
cagcacacagggcagtga

SEQ ID NO: 1067508 - DNA, 23 bp, Homo sapiens
cagcacaccaagtggctgggtgc

SEQ ID NO: 1067509 - DNA, 17 bp, Homo sapiens
cagcacaccagccgctg

SEQ ID NO: 1067510 - DNA, 15 bp, Homo sapiens
cagcacacctctggg

SEQ ID NO: 1067511 - DNA, 16 bp, Homo sapiens
cagcacagatgaggag

SEQ ID NO: 1067512 - DNA, 17 bp, Homo sapiens
cagcacagcccagggcc

SEQ ID NO: 1067513 - DNA, 17 bp, Homo sapiens
cagcacagcttgacctg

SEQ ID NO: 1067514 - DNA, 14 bp, Homo sapiens
cagcacatcacctc

SEQ ID NO: 1067515 - DNA, 16 bp, Homo sapiens
cagcacatcacctctt

SEQ ID NO: 1067516 - DNA, 23 bp, Homo sapiens
cagcacattcgggaccaatatat

SEQ ID NO: 1067517 - DNA, 22 bp, Homo sapiens
cagcaccacactgggtgcgtct

SEQ ID NO: 1067518 - DNA, 13 bp, Homo sapiens
cagcaccacagcc

SEQ ID NO: 1067519 - DNA, 17 bp, Homo sapiens
cagcaccacattgcctc

SEQ ID NO: 1067520 - DNA, 22 bp, Homo sapiens
cagcaccaccctagtcccttcc

SEQ ID NO: 1067521 - DNA, 20 bp, Homo sapiens
cagcaccacctacacaggag

SEQ ID NO: 1067522 - DNA, 15 bp, Homo sapiens
cagcaccactgctga

SEQ ID NO: 1067523 - DNA, 17 bp, Homo sapiens
cagcaccactgctgagg

SEQ ID NO: 1067524 - DNA, 13 bp, Homo sapiens
cagcacccccacc

SEQ ID NO: 1067525 - DNA, 15 bp, Homo sapiens
cagcacccccaccca

SEQ ID NO: 1067526 - DNA, 20 bp, Homo sapiens
cagcacccctagcatgaact

SEQ ID NO: 1067527 - DNA, 11 bp, Homo sapiens
cagcaccctcc

SEQ ID NO: 1067528 - DNA, 18 bp, Homo sapiens
cagcaccctcccccgcag

SEQ ID NO: 1067529 - DNA, 16 bp, Homo sapiens
cagcaccctctcctgg

SEQ ID NO: 1067530 - DNA, 23 bp, Homo sapiens
cagcaccctctcctgggggtggc

SEQ ID NO: 1067531 - DNA, 11 bp, Homo sapiens
cagcaccctgg

SEQ ID NO: 1067532 - DNA, 12 bp, Homo sapiens
cagcaccctggg

SEQ ID NO: 1067533 - DNA, 18 bp, Homo sapiens
cagcacccttctcggaga

SEQ ID NO: 1067534 - DNA, 15 bp, Homo sapiens
cagcacctgcctcct

SEQ ID NO: 1067535 - DNA, 19 bp, Homo sapiens
cagcacctgcctcctcgtt

SEQ ID NO: 1067536 - DNA, 12 bp, Homo sapiens
cagcacctggca

SEQ ID NO: 1067537 - DNA, 17 bp, Homo sapiens
cagcaccttctttctgg

SEQ ID NO: 1067538 - DNA, 18 bp, Homo sapiens
cagcaccttctttctgga

SEQ ID NO: 1067539 - DNA, 22 bp, Homo sapiens
cagcaccttctttctggactgg

SEQ ID NO: 1067540 - DNA, 23 bp, Homo sapiens
cagcaccttctttctggactggc

SEQ ID NO: 1067541 - DNA, 21 bp, Homo sapiens
cagcaccttgcagattttctt

SEQ ID NO: 1067542 - DNA, 14 bp, Homo sapiens
cagcaccttggccc

SEQ ID NO: 1067543 - DNA, 18 bp, Homo sapiens
cagcaccttggcccagga

SEQ ID NO: 1067544 - DNA, 20 bp, Homo sapiens
cagcaccttggcccaggagc

SEQ ID NO: 1067545 - DNA, 22 bp, Homo sapiens
cagcaccttggcccaggagctc

SEQ ID NO: 1067546 - DNA, 14 bp, Homo sapiens
cagcacgatttctg

SEQ ID NO: 1067547 - DNA, 20 bp, Homo sapiens
cagcacgatttctgtttaga

SEQ ID NO: 1067548 - DNA, 19 bp, Homo sapiens
cagcacgcaggcggggcag

SEQ ID NO: 1067549 - DNA, 21 bp, Homo sapiens
cagcacggcccggcccctcac

SEQ ID NO: 1067550 - DNA, 14 bp, Homo sapiens
cagcactaaagcag

SEQ ID NO: 1067551 - DNA, 17 bp, Homo sapiens
cagcactaaagcagtgg

SEQ ID NO: 1067552 - DNA, 19 bp, Homo sapiens
cagcactaaagcagtggac

SEQ ID NO: 1067553 - DNA, 18 bp, Homo sapiens
cagcactaaggccgtgtc

SEQ ID NO: 1067554 - DNA, 15 bp, Homo sapiens
cagcactactgggtg

SEQ ID NO: 1067555 - DNA, 19 bp, Homo sapiens
cagcactactgggtgtcat

SEQ ID NO: 1067556 - DNA, 15 bp, Homo sapiens
cagcactcacacagg

SEQ ID NO: 1067557 - DNA, 22 bp, Homo sapiens
cagcactcacacaggaccccct

SEQ ID NO: 1067558 - DNA, 18 bp, Homo sapiens
cagcactccccagagctg

SEQ ID NO: 1067559 - DNA, 20 bp, Homo sapiens
cagcactccccagagctgtg

SEQ ID NO: 1067560 - DNA, 21 bp, Homo sapiens
cagcactccccagagctgtgc

SEQ ID NO: 1067561 - DNA, 22 bp, Homo sapiens
cagcactccccagagctgtgcc

SEQ ID NO: 1067562 - DNA, 19 bp, Homo sapiens
cagcactcccgctgcacac

SEQ ID NO: 1067563 - DNA, 17 bp, Homo sapiens
cagcactgactggaagg

SEQ ID NO: 1067564 - DNA, 14 bp, Homo sapiens
cagcactgatttca

SEQ ID NO: 1067565 - DNA, 13 bp, Homo sapiens
cagcactgcctcc

SEQ ID NO: 1067566 - DNA, 18 bp, Homo sapiens
cagcactgcttgaggaaa

SEQ ID NO: 1067567 - DNA, 14 bp, Homo sapiens
cagcactggctctc

SEQ ID NO: 1067568 - DNA, 20 bp, Homo sapiens
cagcactggctctctccagg

SEQ ID NO: 1067569 - DNA, 21 bp, Homo sapiens
cagcactggctctctccagga

SEQ ID NO: 1067570 - DNA, 18 bp, Homo sapiens
cagcactgggaagctgga

SEQ ID NO: 1067571 - DNA, 21 bp, Homo sapiens
cagcactgggaagctggagtg

SEQ ID NO: 1067572 - DNA, 12 bp, Homo sapiens
cagcactgtccc

SEQ ID NO: 1067573 - DNA, 18 bp, Homo sapiens
cagcactgtcccttgcct

SEQ ID NO: 1067574 - DNA, 23 bp, Homo sapiens
cagcactgtctcagtttcacttt

SEQ ID NO: 1067575 - DNA, 12 bp, Homo sapiens
cagcacttccat

SEQ ID NO: 1067576 - DNA, 23 bp, Homo sapiens
cagcacttgggggttcaggcccg

SEQ ID NO: 1067577 - DNA, 19 bp, Homo sapiens
cagcactttaaccctctct

SEQ ID NO: 1067578 - DNA, 20 bp, Homo sapiens
cagcactttaaccctctctt

SEQ ID NO: 1067579 - DNA, 22 bp, Homo sapiens
cagcactttgggaggcctaggc

SEQ ID NO: 1067580 - DNA, 20 bp, Homo sapiens
cagcactttgggaggctgag

SEQ ID NO: 1067581 - DNA, 15 bp, Homo sapiens
cagcagaaatgcctt

SEQ ID NO: 1067582 - DNA, 17 bp, Homo sapiens
cagcagaaatgccttac

SEQ ID NO: 1067583 - DNA, 17 bp, Homo sapiens
cagcagaacctgcacac

SEQ ID NO: 1067584 - DNA, 19 bp, Homo sapiens
cagcagaacctgcacacag

SEQ ID NO: 1067585 - DNA, 24 bp, Homo sapiens
cagcagaacctgcacacaggacag

SEQ ID NO: 1067586 - DNA, 21 bp, Homo sapiens
cagcagaatggtgatcactcc

SEQ ID NO: 1067587 - DNA, 17 bp, Homo sapiens
cagcagacagagccagg

SEQ ID NO: 1067588 - DNA, 18 bp, Homo sapiens
cagcagacagagccagga

SEQ ID NO: 1067589 - DNA, 15 bp, Homo sapiens
cagcagactcagctc

SEQ ID NO: 1067590 - DNA, 11 bp, Homo sapiens
cagcagaggag

SEQ ID NO: 1067591 - DNA, 15 bp, Homo sapiens
cagcagaggcaggct

SEQ ID NO: 1067592 - DNA, 17 bp, Homo sapiens
cagcagaggcaggctgg

SEQ ID NO: 1067593 - DNA, 13 bp, Homo sapiens
cagcagaggtgag

SEQ ID NO: 1067594 - DNA, 20 bp, Homo sapiens
cagcagaggtttgctgacag

SEQ ID NO: 1067595 - DNA, 16 bp, Homo sapiens
cagcagagtgagcaag

SEQ ID NO: 1067596 - DNA, 18 bp, Homo sapiens
cagcagatgccagtgaag

SEQ ID NO: 1067597 - DNA, 14 bp, Homo sapiens
cagcagatgctgtt

SEQ ID NO: 1067598 - DNA, 17 bp, Homo sapiens
cagcagatgctgttgtg

SEQ ID NO: 1067599 - DNA, 22 bp, Homo sapiens
cagcagattccacaggacacga

SEQ ID NO: 1067600 - DNA, 10 bp, Homo sapiens
cagcagcaca

SEQ ID NO: 1067601 - DNA, 20 bp, Homo sapiens
cagcagcacaattctgtccc

SEQ ID NO: 1067602 - DNA, 14 bp, Homo sapiens
cagcagcacctttc

SEQ ID NO: 1067603 - DNA, 14 bp, Homo sapiens
cagcagcagagagc

SEQ ID NO: 1067604 - DNA, 15 bp, Homo sapiens
cagcagcagagagcc

SEQ ID NO: 1067605 - DNA, 18 bp, Homo sapiens
cagcagcagagagccctg

SEQ ID NO: 1067606 - DNA, 14 bp, Homo sapiens
cagcagcagcagca

SEQ ID NO: 1067607 - DNA, 14 bp, Homo sapiens
cagcagcagcaggt

SEQ ID NO: 1067608 - DNA, 16 bp, Homo sapiens
cagcagcagcaggtga

SEQ ID NO: 1067609 - DNA, 16 bp, Homo sapiens
cagcagcagcccaagc

SEQ ID NO: 1067610 - DNA, 14 bp, Homo sapiens
cagcagcagccctg

SEQ ID NO: 1067611 - DNA, 15 bp, Homo sapiens
cagcagcagccctgc

SEQ ID NO: 1067612 - DNA, 21 bp, Homo sapiens
cagcagcaggatgggctgagc

SEQ ID NO: 1067613 - DNA, 13 bp, Homo sapiens
cagcagcaggtga

SEQ ID NO: 1067614 - DNA, 11 bp, Homo sapiens
cagcagcatcc

SEQ ID NO: 1067615 - DNA, 14 bp, Homo sapiens
cagcagccagctct

SEQ ID NO: 1067616 - DNA, 19 bp, Homo sapiens
cagcagccagctctcagcc

SEQ ID NO: 1067617 - DNA, 11 bp, Homo sapiens
cagcagccagt

SEQ ID NO: 1067618 - DNA, 13 bp, Homo sapiens
cagcagccagtct

SEQ ID NO: 1067619 - DNA, 14 bp, Homo sapiens
cagcagccagtctc

SEQ ID NO: 1067620 - DNA, 13 bp, Homo sapiens
cagcagcccagct

SEQ ID NO: 1067621 - DNA, 16 bp, Homo sapiens
cagcagcccagcttcc

SEQ ID NO: 1067622 - DNA, 13 bp, Homo sapiens
cagcagcccccca

SEQ ID NO: 1067623 - DNA, 22 bp, Homo sapiens
cagccaggcccaggccagcccc

SEQ ID NO: 1067624 - DNA, 17 bp, Homo sapiens
cagccaggccctgccag

SEQ ID NO: 1067625 - DNA, 13 bp, Homo sapiens
cagccaggcgggc

SEQ ID NO: 1067626 - DNA, 19 bp, Homo sapiens
cagccaggcgggctcaagg

SEQ ID NO: 1067627 - DNA, 22 bp, Homo sapiens
cagccagggagcttgccacact

SEQ ID NO: 1067628 - DNA, 18 bp, Homo sapiens
cagccagtctcagagacc

SEQ ID NO: 1067629 - DNA, 15 bp, Homo sapiens
cagccagtcttgcct

SEQ ID NO: 1067630 - DNA, 21 bp, Homo sapiens
cagccagtcttgcctaggcca

SEQ ID NO: 1067631 - DNA, 23 bp, Homo sapiens
cagccagtcttgcctaggccaaa

SEQ ID NO: 1067632 - DNA, 18 bp, Homo sapiens
cagccagtgagatgaggg

SEQ ID NO: 1067633 - DNA, 17 bp, Homo sapiens
cagccagtggcacagga

SEQ ID NO: 1067634 - DNA, 21 bp, Homo sapiens
cagccataaaagcattgtctc

SEQ ID NO: 1067635 - DNA, 13 bp, Homo sapiens
cagccatcaaaat

SEQ ID NO: 1067636 - DNA, 17 bp, Homo sapiens
cagccatcaaaatgctt

SEQ ID NO: 1067637 - DNA, 21 bp, Homo sapiens
cagccatcaagagactgagtc

SEQ ID NO: 1067638 - DNA, 15 bp, Homo sapiens
cagccatcagccatg

SEQ ID NO: 1067639 - DNA, 19 bp, Homo sapiens
cagccatcccgcttagcct

SEQ ID NO: 1067640 - DNA, 22 bp, Homo sapiens
cagccatcccgcttagcctgcc

SEQ ID NO: 1067641 - DNA, 14 bp, Homo sapiens
cagccatccgcaga

SEQ ID NO: 1067642 - DNA, 23 bp, Homo sapiens
cagccatcctccctccacctcaa

SEQ ID NO: 1067643 - DNA, 16 bp, Homo sapiens
cagccatcgtcctggg

SEQ ID NO: 1067644 - DNA, 19 bp, Homo sapiens
cagccatctcatgagggga

SEQ ID NO: 1067645 - DNA, 13 bp, Homo sapiens
cagccatctgccc

SEQ ID NO: 1067646 - DNA, 15 bp, Homo sapiens
cagccatctgcccag

SEQ ID NO: 1067647 - DNA, 16 bp, Homo sapiens
cagccatctgcccagg

SEQ ID NO: 1067648 - DNA, 20 bp, Homo sapiens
cagccatgccagctggcctt

SEQ ID NO: 1067649 - DNA, 21 bp, Homo sapiens
cagccatgccagctggccttt

SEQ ID NO: 1067650 - DNA, 11 bp, Homo sapiens
cagccatgcct

SEQ ID NO: 1067651 - DNA, 20 bp, Homo sapiens
cagccatgcctcatgccaca

SEQ ID NO: 1067652 - DNA, 13 bp, Homo sapiens
cagccatggccct

SEQ ID NO: 1067653 - DNA, 13 bp, Homo sapiens
cagccatgtttgg

SEQ ID NO: 1067654 - DNA, 14 bp, Homo sapiens
cagccatgtttggt

SEQ ID NO: 1067655 - DNA, 15 bp, Homo sapiens
cagccattaaaataa

SEQ ID NO: 1067656 - DNA, 16 bp, Homo sapiens
cagccattaaaataaa

SEQ ID NO: 1067657 - DNA, 21 bp, Homo sapiens
cagccattaaaataaaacaag

SEQ ID NO: 1067658 - DNA, 17 bp, Homo sapiens
cagccattcttcaggtc

SEQ ID NO: 1067659 - DNA, 15 bp, Homo sapiens
cagccatttccccct

SEQ ID NO: 1067660 - DNA, 17 bp, Homo sapiens
cagccatttccccctcc

SEQ ID NO: 1067661 - DNA, 19 bp, Homo sapiens
cagccatttccccctcctc

SEQ ID NO: 1067662 - DNA, 20 bp, Homo sapiens
cagccatttccccctcctca

SEQ ID NO: 1067663 - DNA, 13 bp, Homo sapiens
cagccatttttaa

SEQ ID NO: 1067664 - DNA, 19 bp, Homo sapiens
cagccatttttagattggt

SEQ ID NO: 1067665 - DNA, 20 bp, Homo sapiens
cagcccaaaacccagggcaa

SEQ ID NO: 1067666 - DNA, 21 bp, Homo sapiens
cagcccaaaggggacaggcct

SEQ ID NO: 1067667 - DNA, 23 bp, Homo sapiens
cagcccaaaggggacaggcctca

SEQ ID NO: 1067668 - DNA, 17 bp, Homo sapiens
cagcccaacttccagag

SEQ ID NO: 1067669 - DNA, 22 bp, Homo sapiens
cagcccaccagacgtcaggccc

SEQ ID NO: 1067670 - DNA, 13 bp, Homo sapiens
cagcccaccagga

SEQ ID NO: 1067671 - DNA, 12 bp, Homo sapiens
cagcccaccccc

SEQ ID NO: 1067672 - DNA, 19 bp, Homo sapiens
cagcccaccctgctcctcc

SEQ ID NO: 1067673 - DNA, 20 bp, Homo sapiens
cagcccacggggatcacagc

SEQ ID NO: 1067674 - DNA, 14 bp, Homo sapiens
cagcccactgagaa

SEQ ID NO: 1067675 - DNA, 19 bp, Homo sapiens
cagcccagacccccagtgt

SEQ ID NO: 1067676 - DNA, 13 bp, Homo sapiens
cagcccagagact

SEQ ID NO: 1067677 - DNA, 21 bp, Homo sapiens
cagcccagagactttgtagat

SEQ ID NO: 1067678 - DNA, 18 bp, Homo sapiens
cagccgcattggtgactc

SEQ ID NO: 1067679 - DNA, 15 bp, Homo sapiens
cagccgccccagccc

SEQ ID NO: 1067680 - DNA, 16 bp, Homo sapiens
cagccgccctgggctg

SEQ ID NO: 1067681 - DNA, 20 bp, Homo sapiens
cagccgccgccgcccacgcc

SEQ ID NO: 1067682 - DNA, 17 bp, Homo sapiens
cagccgctcctgtctgc

SEQ ID NO: 1067683 - DNA, 19 bp, Homo sapiens
cagccgctcctgtctgcca

SEQ ID NO: 1067684 - DNA, 23 bp, Homo sapiens
cagccgctcctgtctgccagcca

SEQ ID NO: 1067685 - DNA, 20 bp, Homo sapiens
cagccgctgagcgaggagat

SEQ ID NO: 1067686 - DNA, 18 bp, Homo sapiens
cagccgcttctgactgct

SEQ ID NO: 1067687 - DNA, 17 bp, Homo sapiens
cagccggaggaggagat

SEQ ID NO: 1067688 - DNA, 15 bp, Homo sapiens
cagccggagggaggc

SEQ ID NO: 1067689 - DNA, 15 bp, Homo sapiens
cagcctgctctggag

SEQ ID NO: 1067690 - DNA, 11 bp, Homo sapiens
cagcctgctga

SEQ ID NO: 1067691 - DNA, 13 bp, Homo sapiens
cagcctgctgaca

SEQ ID NO: 1067692 - DNA, 14 bp, Homo sapiens
cagcctgctgacag

SEQ ID NO: 1067693 - DNA, 21 bp, Homo sapiens
cagctcctccctgtgccccca

SEQ ID NO: 1067694 - DNA, 22 bp, Homo sapiens
cagctcctcccttgttctctaa

SEQ ID NO: 1067695 - DNA, 17 bp, Homo sapiens
cagctcctctaggggca

SEQ ID NO: 1067696 - DNA, 20 bp, Homo sapiens
cagctcctctaggggcagcc

SEQ ID NO: 1067697 - DNA, 13 bp, Homo sapiens
cagctcctctcct

SEQ ID NO: 1067698 - DNA, 14 bp, Homo sapiens
cagctcctctcctt

SEQ ID NO: 1067699 - DNA, 18 bp, Homo sapiens
cagctcctctccttgggc

SEQ ID NO: 1067700 - DNA, 22 bp, Homo sapiens
cagctcctctccttgggctcct

SEQ ID NO: 1067701 - DNA, 13 bp, Homo sapiens
cagctcctctctg

SEQ ID NO: 1067702 - DNA, 14 bp, Homo sapiens
cagctcctctctga

SEQ ID NO: 1067703 - DNA, 11 bp, Homo sapiens
cagctcctctg

SEQ ID NO: 1067704 - DNA, 14 bp, Homo sapiens
cagctcctctgagc

SEQ ID NO: 1067705 - DNA, 16 bp, Homo sapiens
cagctcctctgagcca

SEQ ID NO: 1067706 - DNA, 18 bp, Homo sapiens
cagctcctctgagccata

SEQ ID NO: 1067707 - DNA, 10 bp, Homo sapiens
cagctcctga

SEQ ID NO: 1067708 - DNA, 20 bp, Homo sapiens
cagctcctgagtagctgggc

SEQ ID NO: 1067709 - DNA, 15 bp, Homo sapiens
cagctcctgtaacat

SEQ ID NO: 1067710 - DNA, 18 bp, Homo sapiens
cagctcctttctcctgtg

SEQ ID NO: 1067711 - DNA, 21 bp, Homo sapiens
cagctccttttgtccccaggg

SEQ ID NO: 1067712 - DNA, 22 bp, Homo sapiens
cagctccttttgtccccagggc

SEQ ID NO: 1067713 - DNA, 20 bp, Homo sapiens
cagctcgtttttcagcaccc

SEQ ID NO: 1067714 - DNA, 15 bp, Homo sapiens
cagctctactggtct

SEQ ID NO: 1067715 - DNA, 13 bp, Homo sapiens
cagctctccagtc

SEQ ID NO: 1067716 - DNA, 12 bp, Homo sapiens
cagctctcccct

SEQ ID NO: 1067717 - DNA, 14 bp, Homo sapiens
cagctctccctctg

SEQ ID NO: 1067718 - DNA, 16 bp, Homo sapiens
cagctctccctctggc

SEQ ID NO: 1067719 - DNA, 17 bp, Homo sapiens
cagctctccctctggcc

SEQ ID NO: 1067720 - DNA, 21 bp, Homo sapiens
cagctctccctctggccctgc

SEQ ID NO: 1067721 - DNA, 16 bp, Homo sapiens
cagctctcctggctcc

SEQ ID NO: 1067722 - DNA, 13 bp, Homo sapiens
cagctctctgacg

SEQ ID NO: 1067723 - DNA, 18 bp, Homo sapiens
cagctctctgacgcttgt

SEQ ID NO: 1067724 - DNA, 14 bp, Homo sapiens
cagctctctgccct

SEQ ID NO: 1067725 - DNA, 21 bp, Homo sapiens
cagctctctgccctgtgtact

SEQ ID NO: 1067726 - DNA, 12 bp, Homo sapiens
cagctctctgct

SEQ ID NO: 1067727 - DNA, 12 bp, Homo sapiens
cagctctgaaag

SEQ ID NO: 1067728 - DNA, 17 bp, Homo sapiens
cagctctgacatccctt

SEQ ID NO: 1067729 - DNA, 20 bp, Homo sapiens
cagctctgacatcccttcct

SEQ ID NO: 1067730 - DNA, 20 bp, Homo sapiens
cagctctgacattctgattc

SEQ ID NO: 1067731 - DNA, 23 bp, Homo sapiens
cagctctgagacccttttctcag

SEQ ID NO: 1067732 - DNA, 13 bp, Homo sapiens
cagctctgagatc

SEQ ID NO: 1067733 - DNA, 12 bp, Homo sapiens
cagctctgaggc

SEQ ID NO: 1067734 - DNA, 16 bp, Homo sapiens
cagctctgcaagaatt

SEQ ID NO: 1067735 - DNA, 21 bp, Homo sapiens
cagctctgcaagaattgaagc

SEQ ID NO: 1067736 - DNA, 13 bp, Homo sapiens
cagctctgccccc

SEQ ID NO: 1067737 - DNA, 16 bp, Homo sapiens
cagctctgctatgagt

SEQ ID NO: 1067738 - DNA, 16 bp, Homo sapiens
cagctctgggcctctt

SEQ ID NO: 1067739 - DNA, 13 bp, Homo sapiens
cagctctggggta

SEQ ID NO: 1067740 - DNA, 13 bp, Homo sapiens
cagctctgtggcc

SEQ ID NO: 1067741 - DNA, 22 bp, Homo sapiens
cagctctgtggcctgtgtccag

SEQ ID NO: 1067742 - DNA, 23 bp, Homo sapiens
cagctctgtggcctgtgtccagc

SEQ ID NO: 1067743 - DNA, 15 bp, Homo sapiens
cagctcttaaatgta

SEQ ID NO: 1067744 - DNA, 19 bp, Homo sapiens
cagctcttctgggcagagc

SEQ ID NO: 1067745 - DNA, 21 bp, Homo sapiens
cagctcttctgggcagagcct

SEQ ID NO: 1067746 - DNA, 16 bp, Homo sapiens
cagctcttgcccttcc

SEQ ID NO: 1067747 - DNA, 18 bp, Homo sapiens
cagctcttgcccttccct

SEQ ID NO: 1067748 - DNA, 15 bp, Homo sapiens
cagctcttggcattt

SEQ ID NO: 1067749 - DNA, 14 bp, Homo sapiens
cagctctttccaaa

SEQ ID NO: 1067750 - DNA, 13 bp, Homo sapiens
cagctgaaagagg

SEQ ID NO: 1067751 - DNA, 21 bp, Homo sapiens
cagctgaatgcctcctgtggg

SEQ ID NO: 1067752 - DNA, 16 bp, Homo sapiens
cagctgacctttgtca

SEQ ID NO: 1067753 - DNA, 18 bp, Homo sapiens
cagctgactaaacttttt

SEQ ID NO: 1067754 - DNA, 15 bp, Homo sapiens
cagctgactgtggcc

SEQ ID NO: 1067755 - DNA, 22 bp, Homo sapiens
cagctgacttggttctgaagcc

SEQ ID NO: 1067756 - DNA, 17 bp, Homo sapiens
cagctgagaccagggtc

SEQ ID NO: 1067757 - DNA, 16 bp, Homo sapiens
cagctgagagccctgc

SEQ ID NO: 1067758 - DNA, 21 bp, Homo sapiens
cagctgaggctgggggagagc

SEQ ID NO: 1067759 - DNA, 20 bp, Homo sapiens
cagctgaggtctcttgaggg

SEQ ID NO: 1067760 - DNA, 13 bp, Homo sapiens
cagctgagtgaga

SEQ ID NO: 1067761 - DNA, 20 bp, Homo sapiens
cagctgatacttcatttaaa

SEQ ID NO: 1067762 - DNA, 21 bp, Homo sapiens
cagctgatacttcatttaaaa

SEQ ID NO: 1067763 - DNA, 19 bp, Homo sapiens
cagctgatattatggcaag

SEQ ID NO: 1067764 - DNA, 16 bp, Homo sapiens
cagctgatccatagga

SEQ ID NO: 1067765 - DNA, 15 bp, Homo sapiens
cagctgattttaaca

SEQ ID NO: 1067766 - DNA, 17 bp, Homo sapiens
cagctgattttaacaat

SEQ ID NO: 1067767 - DNA, 18 bp, Homo sapiens
cagctgattttaacaata

SEQ ID NO: 1067768 - DNA, 21 bp, Homo sapiens
cagctgattttaacaataact

SEQ ID NO: 1067769 - DNA, 19 bp, Homo sapiens
cagctgcaaggtactctgg

SEQ ID NO: 1067770 - DNA, 16 bp, Homo sapiens
cagctgcacattcctg

SEQ ID NO: 1067771 - DNA, 19 bp, Homo sapiens
cagctgcaccagagcaacc

SEQ ID NO: 1067772 - DNA, 22 bp, Homo sapiens
cagctgcaccccagcgtcaggc

SEQ ID NO: 1067773 - DNA, 23 bp, Homo sapiens
cagctgcaccccagcgtcaggcc

SEQ ID NO: 1067774 - DNA, 17 bp, Homo sapiens
cagctgcacctgccagc

SEQ ID NO: 1067775 - DNA, 13 bp, Homo sapiens
cagctgcagctga

SEQ ID NO: 1067776 - DNA, 22 bp, Homo sapiens
cagctgcagctgatccatagga

SEQ ID NO: 1067777 - DNA, 18 bp, Homo sapiens
cagctgcatggagcctgg

SEQ ID NO: 1067778 - DNA, 21 bp, Homo sapiens
cagctgcatggagcctggaac

SEQ ID NO: 1067779 - DNA, 12 bp, Homo sapiens
cagctgccaagc

SEQ ID NO: 1067780 - DNA, 23 bp, Homo sapiens
cagctgccaagcactcgagacca

SEQ ID NO: 1067781 - DNA, 14 bp, Homo sapiens
cagctgccagagaa

SEQ ID NO: 1067782 - DNA, 12 bp, Homo sapiens
cagctgccaggc

SEQ ID NO: 1067783 - DNA, 17 bp, Homo sapiens
cagctgccaggcggccc

SEQ ID NO: 1067784 - DNA, 19 bp, Homo sapiens
cagctgccaggcggccctg

SEQ ID NO: 1067785 - DNA, 20 bp, Homo sapiens
cagctgccaggcggccctgg

SEQ ID NO: 1067786 - DNA, 14 bp, Homo sapiens
cagctgcccctccc

SEQ ID NO: 1067787 - DNA, 18 bp, Homo sapiens
cagctgcccctccctcag

SEQ ID NO: 1067788 - DNA, 23 bp, Homo sapiens
cagctgcccctccctcagggagc

SEQ ID NO: 1067789 - DNA, 14 bp, Homo sapiens
cagctgcccctcct

SEQ ID NO: 1067790 - DNA, 16 bp, Homo sapiens
cagctgcccctcctgg

SEQ ID NO: 1067791 - DNA, 20 bp, Homo sapiens
cagctgcccctcctggagca

SEQ ID NO: 1067792 - DNA, 11 bp, Homo sapiens
cagctgcccta

SEQ ID NO: 1067793 - DNA, 16 bp, Homo sapiens
cagctgccctagctga

SEQ ID NO: 1067794 - DNA, 13 bp, Homo sapiens
cagctgccctgct

SEQ ID NO: 1067795 - DNA, 18 bp, Homo sapiens
cagctgccctgctgccac

SEQ ID NO: 1067796 - DNA, 15 bp, Homo sapiens
cagctgcccttccgc

SEQ ID NO: 1067797 - DNA, 17 bp, Homo sapiens
cagctgccgaccagagc

SEQ ID NO: 1067798 - DNA, 17 bp, Homo sapiens
cagctgcctcacttcct

SEQ ID NO: 1067799 - DNA, 18 bp, Homo sapiens
cagctgcctctgctccct

SEQ ID NO: 1067800 - DNA, 12 bp, Homo sapiens
cagctgcctctt

SEQ ID NO: 1067801 - DNA, 11 bp, Homo sapiens
cagctgcctgg

SEQ ID NO: 1067802 - DNA, 13 bp, Homo sapiens
cagctgcctggcc

SEQ ID NO: 1067803 - DNA, 14 bp, Homo sapiens
cagctgcctggcca

SEQ ID NO: 1067804 - DNA, 21 bp, Homo sapiens
cagctgcctggccatgctgtc

SEQ ID NO: 1067805 - DNA, 13 bp, Homo sapiens
cagctgcctgggg

SEQ ID NO: 1067806 - DNA, 23 bp, Homo sapiens
cagctgctatccccatctccctg

SEQ ID NO: 1067807 - DNA, 22 bp, Homo sapiens
cagctgctatttattttcctaa

SEQ ID NO: 1067808 - DNA, 21 bp, Homo sapiens
cagctgctcaataaagtacaa

SEQ ID NO: 1067809 - DNA, 18 bp, Homo sapiens
cagctgctccctggcatt

SEQ ID NO: 1067810 - DNA, 14 bp, Homo sapiens
cagctgctctgccc

SEQ ID NO: 1067811 - DNA, 20 bp, Homo sapiens
cagctgctctgccccttggg

SEQ ID NO: 1067812 - DNA, 16 bp, Homo sapiens
cagctgctcttagtgc

SEQ ID NO: 1067813 - DNA, 20 bp, Homo sapiens
cagctgctcttagtgcccgc

SEQ ID NO: 1067814 - DNA, 15 bp, Homo sapiens
cagctgctgtgcccc

SEQ ID NO: 1067815 - DNA, 16 bp, Homo sapiens
cagctgctgtgcccca

SEQ ID NO: 1067816 - DNA, 12 bp, Homo sapiens
cagctgctgtgg

SEQ ID NO: 1067817 - DNA, 14 bp, Homo sapiens
cagctgctgttctc

SEQ ID NO: 1067818 - DNA, 21 bp, Homo sapiens
cagctgctgttctcaggacag

SEQ ID NO: 1067819 - DNA, 11 bp, Homo sapiens
cagctgcttct

SEQ ID NO: 1067820 - DNA, 17 bp, Homo sapiens
cagctgcttctcccccc

SEQ ID NO: 1067821 - DNA, 13 bp, Homo sapiens
caggccctccctc

SEQ ID NO: 1067822 - DNA, 21 bp, Homo sapiens
caggccctccctctactcttc

SEQ ID NO: 1067823 - DNA, 13 bp, Homo sapiens
caggccctctgcc

SEQ ID NO: 1067824 - DNA, 15 bp, Homo sapiens
caggccctctgcctg

SEQ ID NO: 1067825 - DNA, 18 bp, Homo sapiens
caggccctctgcctgcac

SEQ ID NO: 1067826 - DNA, 21 bp, Homo sapiens
caggccctctgcctgcactcc

SEQ ID NO: 1067827 - DNA, 23 bp, Homo sapiens
caggccctctgcctgcactccct

SEQ ID NO: 1067828 - DNA, 17 bp, Homo sapiens
caggccctctgtggcct

SEQ ID NO: 1067829 - DNA, 20 bp, Homo sapiens
caggccctctgtggcctgtc

SEQ ID NO: 1067830 - DNA, 19 bp, Homo sapiens
caggccctgactcctctgg

SEQ ID NO: 1067831 - DNA, 20 bp, Homo sapiens
caggccctgactcctctggc

SEQ ID NO: 1067832 - DNA, 13 bp, Homo sapiens
caggccctgctcc

SEQ ID NO: 1067833 - DNA, 14 bp, Homo sapiens
caggccctgctcct

SEQ ID NO: 1067834 - DNA, 17 bp, Homo sapiens
caggccctgctcctgca

SEQ ID NO: 1067835 - DNA, 22 bp, Homo sapiens
caggccctgctcctgcagcatg

SEQ ID NO: 1067836 - DNA, 20 bp, Homo sapiens
caggccctggcctcccctgc

SEQ ID NO: 1067837 - DNA, 22 bp, Homo sapiens
caggccctggcctcccctgcca

SEQ ID NO: 1067838 - DNA, 20 bp, Homo sapiens
caggccctgtccagccccca

SEQ ID NO: 1067839 - DNA, 23 bp, Homo sapiens
caggcccttcctctccactgcct

SEQ ID NO: 1067840 - DNA, 22 bp, Homo sapiens
caggccctttgaagcctcagct

SEQ ID NO: 1067841 - DNA, 13 bp, Homo sapiens
caggccgcagctc

SEQ ID NO: 1067842 - DNA, 14 bp, Homo sapiens
caggccgcagctct

SEQ ID NO: 1067843 - DNA, 14 bp, Homo sapiens
caggccgccctgcg

SEQ ID NO: 1067844 - DNA, 20 bp, Homo sapiens
caggccggcttgccacaccc

SEQ ID NO: 1067845 - DNA, 17 bp, Homo sapiens
caggccgggaagagcca

SEQ ID NO: 1067846 - DNA, 22 bp, Homo sapiens
caggccgggaagagccacctgg

SEQ ID NO: 1067847 - DNA, 23 bp, Homo sapiens
caggccgggaagagccacctggc

SEQ ID NO: 1067848 - DNA, 19 bp, Homo sapiens
caggccggggtggagcatg

SEQ ID NO: 1067849 - DNA, 19 bp, Homo sapiens
caggccgttccccttggct

SEQ ID NO: 1067850 - DNA, 13 bp, Homo sapiens
caggcctacagaa

SEQ ID NO: 1067851 - DNA, 19 bp, Homo sapiens
caggcctaggtgcagctcc

SEQ ID NO: 1067852 - DNA, 20 bp, Homo sapiens
caggcctaggtgcagctcct

SEQ ID NO: 1067853 - DNA, 22 bp, Homo sapiens
caggcctaggtgcagctcctca

SEQ ID NO: 1067854 - DNA, 23 bp, Homo sapiens
caggcctaggtgcagctcctcag

SEQ ID NO: 1067855 - DNA, 12 bp, Homo sapiens
caggcctcacct

SEQ ID NO: 1067856 - DNA, 13 bp, Homo sapiens
caggcctcacctc

SEQ ID NO: 1067857 - DNA, 21 bp, Homo sapiens
caggcctcacctctacccaaa

SEQ ID NO: 1067858 - DNA, 15 bp, Homo sapiens
caggcctcactggct

SEQ ID NO: 1067859 - DNA, 16 bp, Homo sapiens
caggcctcactggctc

SEQ ID NO: 1067860 - DNA, 23 bp, Homo sapiens
caggcctcactggctcatgcccc

SEQ ID NO: 1067861 - DNA, 14 bp, Homo sapiens
caggctgcagctgg

SEQ ID NO: 1067862 - DNA, 18 bp, Homo sapiens
caggctgcagctggacag

SEQ ID NO: 1067863 - DNA, 17 bp, Homo sapiens
caggctgcaggagggca

SEQ ID NO: 1067864 - DNA, 20 bp, Homo sapiens
caggctgcaggagggcactg

SEQ ID NO: 1067865 - DNA, 12 bp, Homo sapiens
caggctgcctcg

SEQ ID NO: 1067866 - DNA, 19 bp, Homo sapiens
caggctgcctcggactcca

SEQ ID NO: 1067867 - DNA, 20 bp, Homo sapiens
caggctgcctcggactccat

SEQ ID NO: 1067868 - DNA, 12 bp, Homo sapiens
caggctgctaac

SEQ ID NO: 1067869 - DNA, 16 bp, Homo sapiens
caggctggaatgaggg

SEQ ID NO: 1067870 - DNA, 17 bp, Homo sapiens
caggctggaatgaggga

SEQ ID NO: 1067871 - DNA, 19 bp, Homo sapiens
caggctggaatgagggagg

SEQ ID NO: 1067872 - DNA, 14 bp, Homo sapiens
caggctggacgtgg

SEQ ID NO: 1067873 - DNA, 15 bp, Homo sapiens
caggctggagacccc

SEQ ID NO: 1067874 - DNA, 16 bp, Homo sapiens
caggctggagaccccc

SEQ ID NO: 1067875 - DNA, 15 bp, Homo sapiens
caggctggagactgg

SEQ ID NO: 1067876 - DNA, 21 bp, Homo sapiens
caggctggaggtaaggccttt

SEQ ID NO: 1067877 - DNA, 17 bp, Homo sapiens
caggctggagtgtagtg

SEQ ID NO: 1067878 - DNA, 19 bp, Homo sapiens
caggctggcagctctccag

SEQ ID NO: 1067879 - DNA, 18 bp, Homo sapiens
caggctggccagtccagg

SEQ ID NO: 1067880 - DNA, 15 bp, Homo sapiens
caggctggcgcagcc

SEQ ID NO: 1067881 - DNA, 18 bp, Homo sapiens
caggctggcgcagccaag

SEQ ID NO: 1067882 - DNA, 16 bp, Homo sapiens
caggctggctccagat

SEQ ID NO: 1067883 - DNA, 18 bp, Homo sapiens
caggctggctccagatgc

SEQ ID NO: 1067884 - DNA, 20 bp, Homo sapiens
caggctggctccagatgcag

SEQ ID NO: 1067885 - DNA, 22 bp, Homo sapiens
caggctgggcacggctccgagg

SEQ ID NO: 1067886 - DNA, 12 bp, Homo sapiens
caggctgggcca

SEQ ID NO: 1067887 - DNA, 13 bp, Homo sapiens
caggctgggccat

SEQ ID NO: 1067888 - DNA, 17 bp, Homo sapiens
caggctgggccatgtcc

SEQ ID NO: 1067889 - DNA, 13 bp, Homo sapiens
caggctgggccgc

SEQ ID NO: 1067890 - DNA, 22 bp, Homo sapiens
caggctgggccgcaagggcctg

SEQ ID NO: 1067891 - DNA, 13 bp, Homo sapiens
caggctggggagg

SEQ ID NO: 1067892 - DNA, 19 bp, Homo sapiens
caggctggggaggtgctgg

SEQ ID NO: 1067893 - DNA, 21 bp, Homo sapiens
caggctggggaggtgctgggg

SEQ ID NO: 1067894 - DNA, 14 bp, Homo sapiens
caggctggggcctt

SEQ ID NO: 1067895 - DNA, 15 bp, Homo sapiens
caggctggggccttt

SEQ ID NO: 1067896 - DNA, 20 bp, Homo sapiens
caggctgggtcaaaagagcc

SEQ ID NO: 1067897 - DNA, 20 bp, Homo sapiens
caggctggtctcaaactcct

SEQ ID NO: 1067898 - DNA, 20 bp, Homo sapiens
caggctggtctcgaactcct

SEQ ID NO: 1067899 - DNA, 18 bp, Homo sapiens
caggctggtcttgaattc

SEQ ID NO: 1067900 - DNA, 22 bp, Homo sapiens
caggctgtaagcattctgagct

SEQ ID NO: 1067901 - DNA, 16 bp, Homo sapiens
caggctgtaaggcatg

SEQ ID NO: 1067902 - DNA, 16 bp, Homo sapiens
caggctgtctggccag

SEQ ID NO: 1067903 - DNA, 19 bp, Homo sapiens
caggctgtgcgctgacaac

SEQ ID NO: 1067904 - DNA, 17 bp, Homo sapiens
caggctgtgggcctcaa

SEQ ID NO: 1067905 - DNA, 17 bp, Homo sapiens
caggcttagggacagga

SEQ ID NO: 1067906 - DNA, 16 bp, Homo sapiens
caggcttccgcgccca

SEQ ID NO: 1067907 - DNA, 21 bp, Homo sapiens
caggcttccgcgcccagcgct

SEQ ID NO: 1067908 - DNA, 14 bp, Homo sapiens
caggcttccttggc

SEQ ID NO: 1067909 - DNA, 15 bp, Homo sapiens
caggcttgagggagg

SEQ ID NO: 1067910 - DNA, 14 bp, Homo sapiens
caggcttgcctcaa

SEQ ID NO: 1067911 - DNA, 15 bp, Homo sapiens
caggcttgcctgggc

SEQ ID NO: 1067912 - DNA, 17 bp, Homo sapiens
caggcttgcctgggctg

SEQ ID NO: 1067913 - DNA, 21 bp, Homo sapiens
caggcttgcctgggctgggca

SEQ ID NO: 1067914 - DNA, 18 bp, Homo sapiens
caggcttggatggaacat

SEQ ID NO: 1067915 - DNA, 17 bp, Homo sapiens
caggcttggcaaagaag

SEQ ID NO: 1067916 - DNA, 19 bp, Homo sapiens
caggctttgtacagagtgc

SEQ ID NO: 1067917 - DNA, 15 bp, Homo sapiens
caggcttttgctaga

SEQ ID NO: 1067918 - DNA, 17 bp, Homo sapiens
cagggaaaagcagctct

SEQ ID NO: 1067919 - DNA, 18 bp, Homo sapiens
cagggaaaggtcagcccg

SEQ ID NO: 1067920 - DNA, 16 bp, Homo sapiens
cagggaaccccagggg

SEQ ID NO: 1067921 - DNA, 16 bp, Homo sapiens
cagggaagagggcagt

SEQ ID NO: 1067922 - DNA, 20 bp, Homo sapiens
cagggaagagggcagtacct

SEQ ID NO: 1067923 - DNA, 19 bp, Homo sapiens
cagggaagaggggtgcaga

SEQ ID NO: 1067924 - DNA, 22 bp, Homo sapiens
cagggaagcgtcgccccagtgg

SEQ ID NO: 1067925 - DNA, 19 bp, Homo sapiens
cagggaaggacttggagag

SEQ ID NO: 1067926 - DNA, 16 bp, Homo sapiens
cagggaaggcctgact

SEQ ID NO: 1067927 - DNA, 19 bp, Homo sapiens
cagggaaggggaggcagcc

SEQ ID NO: 1067928 - DNA, 19 bp, Homo sapiens
cagggaaggtggccacagc

SEQ ID NO: 1067929 - DNA, 23 bp, Homo sapiens
cagggaatccaagcctccacagc

SEQ ID NO: 1067930 - DNA, 15 bp, Homo sapiens
cagggaatccagctc

SEQ ID NO: 1067931 - DNA, 17 bp, Homo sapiens
cagggaatccagctccc

SEQ ID NO: 1067932 - DNA, 22 bp, Homo sapiens
cagggaatccagctccctagac

SEQ ID NO: 1067933 - DNA, 20 bp, Homo sapiens
cagggaatgctgaggcctcg

SEQ ID NO: 1067934 - DNA, 23 bp, Homo sapiens
cagggacaaagaggcctttaacc

SEQ ID NO: 1067935 - DNA, 14 bp, Homo sapiens
cagggacagagaca

SEQ ID NO: 1067936 - DNA, 20 bp, Homo sapiens
cagggacagagacacctgca

SEQ ID NO: 1067937 - DNA, 21 bp, Homo sapiens
cagggacagagacacctgcac

SEQ ID NO: 1067938 - DNA, 23 bp, Homo sapiens
cagggacagagacacctgcacct

SEQ ID NO: 1067939 - DNA, 16 bp, Homo sapiens
cagggacagagccatg

SEQ ID NO: 1067940 - DNA, 20 bp, Homo sapiens
cagggacatgccctgtgtgg

SEQ ID NO: 1067941 - DNA, 21 bp, Homo sapiens
cagggacatggggcaagccag

SEQ ID NO: 1067942 - DNA, 22 bp, Homo sapiens
cagggaccactgggtgagagag

SEQ ID NO: 1067943 - DNA, 18 bp, Homo sapiens
cagggaccagcaccttca

SEQ ID NO: 1067944 - DNA, 23 bp, Homo sapiens
cagggacccggggtctcctggac

SEQ ID NO: 1067945 - DNA, 16 bp, Homo sapiens
cagggacccttgcctg

SEQ ID NO: 1067946 - DNA, 23 bp, Homo sapiens
cagggacccttgcctgcctccta

SEQ ID NO: 1067947 - DNA, 18 bp, Homo sapiens
cagggaccgtccagggga

SEQ ID NO: 1067948 - DNA, 14 bp, Homo sapiens
cagggacctcaggg

SEQ ID NO: 1067949 - DNA, 15 bp, Homo sapiens
cagggacctcagggg

SEQ ID NO: 1067950 - DNA, 17 bp, Homo sapiens
cagggacctcaggggca

SEQ ID NO: 1067951 - DNA, 20 bp, Homo sapiens
cagggacctcaggggcacct

SEQ ID NO: 1067952 - DNA, 16 bp, Homo sapiens
cagggacttgcctcca

SEQ ID NO: 1067953 - DNA, 19 bp, Homo sapiens
cagggagaccgagcgcttt

SEQ ID NO: 1067954 - DNA, 19 bp, Homo sapiens
cagggagagcgcctcttcc

SEQ ID NO: 1067955 - DNA, 22 bp, Homo sapiens
cagggagagcgcctcttcctct

SEQ ID NO: 1067956 - DNA, 16 bp, Homo sapiens
cagggagaggccatga

SEQ ID NO: 1067957 - DNA, 19 bp, Homo sapiens
cagggagaggtcaccagct

SEQ ID NO: 1067958 - DNA, 20 bp, Homo sapiens
cagggagaggtcaccagctg

SEQ ID NO: 1067959 - DNA, 20 bp, Homo sapiens
cagggagcaactctccactc

SEQ ID NO: 1067960 - DNA, 23 bp, Homo sapiens
cagggagcaactctccactccat

SEQ ID NO: 1067961 - DNA, 16 bp, Homo sapiens
cagggagcaagacaga

SEQ ID NO: 1067962 - DNA, 13 bp, Homo sapiens
caggggcggggca

SEQ ID NO: 1067963 - DNA, 17 bp, Homo sapiens
caggggcggggcaggaa

SEQ ID NO: 1067964 - DNA, 18 bp, Homo sapiens
caggggcggggcaggaat

SEQ ID NO: 1067965 - DNA, 18 bp, Homo sapiens
caggggcgtgtggctcac

SEQ ID NO: 1067966 - DNA, 17 bp, Homo sapiens
caggggctccagcacct

SEQ ID NO: 1067967 - DNA, 14 bp, Homo sapiens
caggggctcctggg

SEQ ID NO: 1067968 - DNA, 18 bp, Homo sapiens
caggggctcctgggttgg

SEQ ID NO: 1067969 - DNA, 21 bp, Homo sapiens
caggggctcctgggttggagg

SEQ ID NO: 1067970 - DNA, 16 bp, Homo sapiens
caggggctctgagccc

SEQ ID NO: 1067971 - DNA, 15 bp, Homo sapiens
caggggctctgtgtt

SEQ ID NO: 1067972 - DNA, 13 bp, Homo sapiens
caggggctgctgc

SEQ ID NO: 1067973 - DNA, 16 bp, Homo sapiens
caggggctgcttcctc

SEQ ID NO: 1067974 - DNA, 20 bp, Homo sapiens
caggggctgcttcctcctgg

SEQ ID NO: 1067975 - DNA, 22 bp, Homo sapiens
caggggctgcttcctcctggaa

SEQ ID NO: 1067976 - DNA, 20 bp, Homo sapiens
caggggcttcccactttggc

SEQ ID NO: 1067977 - DNA, 14 bp, Homo sapiens
caggggcttgagaa

SEQ ID NO: 1067978 - DNA, 16 bp, Homo sapiens
caggggcttgagaagg

SEQ ID NO: 1067979 - DNA, 14 bp, Homo sapiens
caggggctttgggc

SEQ ID NO: 1067980 - DNA, 18 bp, Homo sapiens
caggggctttgggcccaa

SEQ ID NO: 1067981 - DNA, 19 bp, Homo sapiens
caggggctttgggcccaag

SEQ ID NO: 1067982 - DNA, 11 bp, Homo sapiens
cagggggaagg

SEQ ID NO: 1067983 - DNA, 22 bp, Homo sapiens
cagggggatatgggtcctctgg

SEQ ID NO: 1067984 - DNA, 19 bp, Homo sapiens
cagggggccagctggggag

SEQ ID NO: 1067985 - DNA, 22 bp, Homo sapiens
cagggggccagctggggagatg

SEQ ID NO: 1067986 - DNA, 12 bp, Homo sapiens
cagggggccccg

SEQ ID NO: 1067987 - DNA, 19 bp, Homo sapiens
cagggggccccgccagggc

SEQ ID NO: 1067988 - DNA, 21 bp, Homo sapiens
cagggggccccgccagggctg

SEQ ID NO: 1067989 - DNA, 23 bp, Homo sapiens
cagggggccccgccagggctggg

SEQ ID NO: 1067990 - DNA, 11 bp, Homo sapiens
cagggggccct

SEQ ID NO: 1067991 - DNA, 13 bp, Homo sapiens
caggggggctgtg

SEQ ID NO: 1067992 - DNA, 14 bp, Homo sapiens
cagggggtaggaga

SEQ ID NO: 1067993 - DNA, 20 bp, Homo sapiens
caggggtcccagccaccccg

SEQ ID NO: 1067994 - DNA, 16 bp, Homo sapiens
caggggtccctgctag

SEQ ID NO: 1067995 - DNA, 17 bp, Homo sapiens
caggggtccctgctagt

SEQ ID NO: 1067996 - DNA, 14 bp, Homo sapiens
caggggtctccctg

SEQ ID NO: 1067997 - DNA, 16 bp, Homo sapiens
caggggtctccctgga

SEQ ID NO: 1067998 - DNA, 16 bp, Homo sapiens
caggggtctccctggc

SEQ ID NO: 1067999 - DNA, 17 bp, Homo sapiens
caggggtctccctggct

SEQ ID NO: 1068000 - DNA, 14 bp, Homo sapiens
caggggtgagagca

SEQ ID NO: 1068001 - DNA, 20 bp, Homo sapiens
caggggtgatttcagagagg

SEQ ID NO: 1068002 - DNA, 13 bp, Homo sapiens
caggggtgccccc

SEQ ID NO: 1068003 - DNA, 16 bp, Homo sapiens
caggggtgccccctcc

SEQ ID NO: 1068004 - DNA, 23 bp, Homo sapiens
caggggtgccccctcctctccca

SEQ ID NO: 1068005 - DNA, 13 bp, Homo sapiens
caggggtggagaa

SEQ ID NO: 1068006 - DNA, 16 bp, Homo sapiens
caggggtgggagagcc

SEQ ID NO: 1068007 - DNA, 22 bp, Homo sapiens
caggggtgggagagccagctct

SEQ ID NO: 1068008 - DNA, 12 bp, Homo sapiens
caggggtggggg

SEQ ID NO: 1068009 - DNA, 21 bp, Homo sapiens
caggggttcgagaccagtctg

SEQ ID NO: 1068010 - DNA, 13 bp, Homo sapiens
caggggttgcagt

SEQ ID NO: 1068011 - DNA, 20 bp, Homo sapiens
caggggtttgggtgggggct

SEQ ID NO: 1068012 - DNA, 21 bp, Homo sapiens
cagggtaccctttggggagca

SEQ ID NO: 1068013 - DNA, 14 bp, Homo sapiens
cagggtacctcaag

SEQ ID NO: 1068014 - DNA, 17 bp, Homo sapiens
cagggtagatttctctt

SEQ ID NO: 1068015 - DNA, 18 bp, Homo sapiens
cagggtagatttctcttg

SEQ ID NO: 1068016 - DNA, 19 bp, Homo sapiens
cagggtagatttctcttgg

SEQ ID NO: 1068017 - DNA, 21 bp, Homo sapiens
cagggtagatttctcttgggc

SEQ ID NO: 1068018 - DNA, 16 bp, Homo sapiens
cagggtagcaggtacc

SEQ ID NO: 1068019 - DNA, 13 bp, Homo sapiens
cagggtaggaaag

SEQ ID NO: 1068020 - DNA, 13 bp, Homo sapiens
cagggtataaatt

SEQ ID NO: 1068021 - DNA, 19 bp, Homo sapiens
cagggtcaaagacagaatg

SEQ ID NO: 1068022 - DNA, 21 bp, Homo sapiens
cagggtcaaagtgttttctct

SEQ ID NO: 1068023 - DNA, 23 bp, Homo sapiens
cagggtcaaagtgttttctctga

SEQ ID NO: 1068024 - DNA, 13 bp, Homo sapiens
cagggtcaagcct

SEQ ID NO: 1068025 - DNA, 21 bp, Homo sapiens
cagggtcactgaaccactgct

SEQ ID NO: 1068026 - DNA, 18 bp, Homo sapiens
cagggtcatgtttgcagg

SEQ ID NO: 1068027 - DNA, 16 bp, Homo sapiens
cagggtccacgcctct

SEQ ID NO: 1068028 - DNA, 21 bp, Homo sapiens
cagggtccaggagagcctggg

SEQ ID NO: 1068029 - DNA, 15 bp, Homo sapiens
cagggtcccaccccc

SEQ ID NO: 1068030 - DNA, 21 bp, Homo sapiens
cagggtcccatttctcactga

SEQ ID NO: 1068031 - DNA, 12 bp, Homo sapiens
cagggtcccctc

SEQ ID NO: 1068032 - DNA, 16 bp, Homo sapiens
cagggtcccctcccca

SEQ ID NO: 1068033 - DNA, 17 bp, Homo sapiens
cagggtcccctccccag

SEQ ID NO: 1068034 - DNA, 13 bp, Homo sapiens
cagggtcccctgc

SEQ ID NO: 1068035 - DNA, 16 bp, Homo sapiens
cagggtcccctgccac

SEQ ID NO: 1068036 - DNA, 16 bp, Homo sapiens
cagggtccctctgtgt

SEQ ID NO: 1068037 - DNA, 15 bp, Homo sapiens
cagggtccgcaccag

SEQ ID NO: 1068038 - DNA, 23 bp, Homo sapiens
cagggtccgcaccagctgctctg

SEQ ID NO: 1068039 - DNA, 21 bp, Homo sapiens
cagggtcctgccctccggagg

SEQ ID NO: 1068040 - DNA, 23 bp, Homo sapiens
cagggtcctgccctccggaggag

SEQ ID NO: 1068041 - DNA, 15 bp, Homo sapiens
cagggtcctgtgcct

SEQ ID NO: 1068042 - DNA, 19 bp, Homo sapiens
cagggtccttttgacactg

SEQ ID NO: 1068043 - DNA, 20 bp, Homo sapiens
cagggtcgtctttgtgtatg

SEQ ID NO: 1068044 - DNA, 20 bp, Homo sapiens
cagggtctaaggagcgctag

SEQ ID NO: 1068045 - DNA, 15 bp, Homo sapiens
cagggtctctccctc

SEQ ID NO: 1068046 - DNA, 18 bp, Homo sapiens
cagggtctctccctcagg

SEQ ID NO: 1068047 - DNA, 13 bp, Homo sapiens
cagggtctgctct

SEQ ID NO: 1068048 - DNA, 22 bp, Homo sapiens
cagggtctgctctttctctgcc

SEQ ID NO: 1068049 - DNA, 17 bp, Homo sapiens
cagggtctggcagagcc

SEQ ID NO: 1068050 - DNA, 14 bp, Homo sapiens
cagggtctgggctg

SEQ ID NO: 1068051 - DNA, 21 bp, Homo sapiens
cagggtctgggctgggcacct

SEQ ID NO: 1068052 - DNA, 23 bp, Homo sapiens
cagggtctgggctgggcacctga

SEQ ID NO: 1068053 - DNA, 21 bp, Homo sapiens
caggtctgcaagggcccagag

SEQ ID NO: 1068054 - DNA, 21 bp, Homo sapiens
caggtctgtaactgcccagcc

SEQ ID NO: 1068055 - DNA, 20 bp, Homo sapiens
caggtcttgactcatggcag

SEQ ID NO: 1068056 - DNA, 23 bp, Homo sapiens
caggtcttgactcatggcagctg

SEQ ID NO: 1068057 - DNA, 13 bp, Homo sapiens
caggtctttccta

SEQ ID NO: 1068058 - DNA, 21 bp, Homo sapiens
caggtctttcctaaggctgca

SEQ ID NO: 1068059 - DNA, 13 bp, Homo sapiens
caggtcttttctt

SEQ ID NO: 1068060 - DNA, 14 bp, Homo sapiens
caggtgaacttttt

SEQ ID NO: 1068061 - DNA, 18 bp, Homo sapiens
caggtgactgtgctgtgc

SEQ ID NO: 1068062 - DNA, 19 bp, Homo sapiens
caggtgacttctagcagag

SEQ ID NO: 1068063 - DNA, 21 bp, Homo sapiens
caggtgaggggcaggacctga

SEQ ID NO: 1068064 - DNA, 19 bp, Homo sapiens
caggtgatccgcccacctc

SEQ ID NO: 1068065 - DNA, 15 bp, Homo sapiens
caggtgatgctctgg

SEQ ID NO: 1068066 - DNA, 23 bp, Homo sapiens
caggtgatgtctggtcaactggc

SEQ ID NO: 1068067 - DNA, 21 bp, Homo sapiens
caggtgattggaccaggccat

SEQ ID NO: 1068068 - DNA, 22 bp, Homo sapiens
caggtgcacacatcaccaggtg

SEQ ID NO: 1068069 - DNA, 17 bp, Homo sapiens
caggtgcagaccttggg

SEQ ID NO: 1068070 - DNA, 14 bp, Homo sapiens
caggtgcagcccca

SEQ ID NO: 1068071 - DNA, 15 bp, Homo sapiens
caggtgcagccccag

SEQ ID NO: 1068072 - DNA, 16 bp, Homo sapiens
caggtgcagccccagg

SEQ ID NO: 1068073 - DNA, 18 bp, Homo sapiens
caggtgcagccccagggc

SEQ ID NO: 1068074 - DNA, 13 bp, Homo sapiens
caggtgcagtggc

SEQ ID NO: 1068075 - DNA, 19 bp, Homo sapiens
caggtgcatctgcaggcac

SEQ ID NO: 1068076 - DNA, 14 bp, Homo sapiens
caggtgccactccc

SEQ ID NO: 1068077 - DNA, 15 bp, Homo sapiens
caggtgccactgacc

SEQ ID NO: 1068078 - DNA, 12 bp, Homo sapiens
caggtgcctcca

SEQ ID NO: 1068079 - DNA, 14 bp, Homo sapiens
caggtgcctccagg

SEQ ID NO: 1068080 - DNA, 14 bp, Homo sapiens
caggtgcctgtcct

SEQ ID NO: 1068081 - DNA, 14 bp, Homo sapiens
caggtgcctttcaa

SEQ ID NO: 1068082 - DNA, 14 bp, Homo sapiens
caggtgcggcctgg

SEQ ID NO: 1068083 - DNA, 16 bp, Homo sapiens
caggtgcggcctgggg

SEQ ID NO: 1068084 - DNA, 19 bp, Homo sapiens
caggtgcggcctgggggga

SEQ ID NO: 1068085 - DNA, 21 bp, Homo sapiens
caggtgctatgtcccaagagc

SEQ ID NO: 1068086 - DNA, 22 bp, Homo sapiens
caggtgctgacaatactgctgc

SEQ ID NO: 1068087 - DNA, 20 bp, Homo sapiens
caggtgctgacttcatctcc

SEQ ID NO: 1068088 - DNA, 21 bp, Homo sapiens
caggtgctgacttcatctccc

SEQ ID NO: 1068089 - DNA, 23 bp, Homo sapiens
caggtgctgacttcatctcccac

SEQ ID NO: 1068090 - DNA, 18 bp, Homo sapiens
caggtgctgggctggact

SEQ ID NO: 1068091 - DNA, 19 bp, Homo sapiens
caggtgctgggctggactg

SEQ ID NO: 1068092 - DNA, 19 bp, Homo sapiens
caggtggaaggcagacagc

SEQ ID NO: 1068093 - DNA, 14 bp, Homo sapiens
caggtggagagcac

SEQ ID NO: 1068094 - DNA, 18 bp, Homo sapiens
cagtaaagaaagcagaat

SEQ ID NO: 1068095 - DNA, 18 bp, Homo sapiens
cagtaaatacttgcagtt

SEQ ID NO: 1068096 - DNA, 21 bp, Homo sapiens
cagtaaatacttgcagttgtg

SEQ ID NO: 1068097 - DNA, 23 bp, Homo sapiens
cagtaaatacttgcagttgtgat

SEQ ID NO: 1068098 - DNA, 23 bp, Homo sapiens
cagtaaatagtgtcatataaact

SEQ ID NO: 1068099 - DNA, 18 bp, Homo sapiens
cagtaaatgggggtgcat

SEQ ID NO: 1068100 - DNA, 17 bp, Homo sapiens
cagtaacctagtgaatt

SEQ ID NO: 1068101 - DNA, 20 bp, Homo sapiens
cagtaacgcgtcttcctgag

SEQ ID NO: 1068102 - DNA, 9 bp, Homo sapiens
cagtaactg

SEQ ID NO: 1068103 - DNA, 20 bp, Homo sapiens
cagtaacttatgtacaagga

SEQ ID NO: 1068104 - DNA, 23 bp, Homo sapiens
cagtaacttgcaaaaagtagact

SEQ ID NO: 1068105 - DNA, 14 bp, Homo sapiens
cagtaactttatgt

SEQ ID NO: 1068106 - DNA, 16 bp, Homo sapiens
cagtaactttatgtgt

SEQ ID NO: 1068107 - DNA, 17 bp, Homo sapiens
cagtaactttatgtgta

SEQ ID NO: 1068108 - DNA, 17 bp, Homo sapiens
cagtaacttttttgtgt

SEQ ID NO: 1068109 - DNA, 20 bp, Homo sapiens
cagtaagttatctttgaata

SEQ ID NO: 1068110 - DNA, 12 bp, Homo sapiens
cagtaataactc

SEQ ID NO: 1068111 - DNA, 14 bp, Homo sapiens
cagtaatctaggtg

SEQ ID NO: 1068112 - DNA, 16 bp, Homo sapiens
cagtaatctatgtgtt

SEQ ID NO: 1068113 - DNA, 22 bp, Homo sapiens
cagtaatctatgtgtttctgta

SEQ ID NO: 1068114 - DNA, 11 bp, Homo sapiens
cagtaatgaaa

SEQ ID NO: 1068115 - DNA, 18 bp, Homo sapiens
cagtaattgtgtcctctc

SEQ ID NO: 1068116 - DNA, 15 bp, Homo sapiens
cagtaattttcggat

SEQ ID NO: 1068117 - DNA, 15 bp, Homo sapiens
cagtacaatcagcag

SEQ ID NO: 1068118 - DNA, 22 bp, Homo sapiens
cagtacacatccccagaatcca

SEQ ID NO: 1068119 - DNA, 23 bp, Homo sapiens
cagtacactgtcagcagggactg

SEQ ID NO: 1068120 - DNA, 23 bp, Homo sapiens
cagtacagagaaattctgtggtg

SEQ ID NO: 1068121 - DNA, 18 bp, Homo sapiens
cagtacagtattctttta

SEQ ID NO: 1068122 - DNA, 16 bp, Homo sapiens
cagtacatacgtctgc

SEQ ID NO: 1068123 - DNA, 18 bp, Homo sapiens
cagtacatacgtctgcca

SEQ ID NO: 1068124 - DNA, 20 bp, Homo sapiens
cagtacatttaaattttttg

SEQ ID NO: 1068125 - DNA, 19 bp, Homo sapiens
cagtaccctctcagctcca

SEQ ID NO: 1068126 - DNA, 20 bp, Homo sapiens
cagtacctataaagtaaagc

SEQ ID NO: 1068127 - DNA, 22 bp, Homo sapiens
cagtacctataaagtaaagcta

SEQ ID NO: 1068128 - DNA, 23 bp, Homo sapiens
cagtacctatgacttttttaaac

SEQ ID NO: 1068129 - DNA, 13 bp, Homo sapiens
cagtacctctcaa

SEQ ID NO: 1068130 - DNA, 14 bp, Homo sapiens
cagtacctgggaaa

SEQ ID NO: 1068131 - DNA, 22 bp, Homo sapiens
cagtacctgggaaaggacccac

SEQ ID NO: 1068132 - DNA, 23 bp, Homo sapiens
cagtacctgggaaaggacccacc

SEQ ID NO: 1068133 - DNA, 15 bp, Homo sapiens
cagtacctttgtcac

SEQ ID NO: 1068134 - DNA, 22 bp, Homo sapiens
cagtacgatcaagttgttgact

SEQ ID NO: 1068135 - DNA, 17 bp, Homo sapiens
cagtacgtcccgctgct

SEQ ID NO: 1068136 - DNA, 22 bp, Homo sapiens
cagtacgtcccgctgctgtgct

SEQ ID NO: 1068137 - DNA, 17 bp, Homo sapiens
cagtactcagtatagca

SEQ ID NO: 1068138 - DNA, 19 bp, Homo sapiens
cagtactgactttctgatt

SEQ ID NO: 1068139 - DNA, 12 bp, Homo sapiens
cagtacttgtca

SEQ ID NO: 1068140 - DNA, 15 bp, Homo sapiens
cagtactttattgta

SEQ ID NO: 1068141 - DNA, 18 bp, Homo sapiens
cagtagaaataatatgca

SEQ ID NO: 1068142 - DNA, 19 bp, Homo sapiens
cagtagaaataatatgcat

SEQ ID NO: 1068143 - DNA, 15 bp, Homo sapiens
cagtagaattttagt

SEQ ID NO: 1068144 - DNA, 17 bp, Homo sapiens
cagtagaattttagtcc

SEQ ID NO: 1068145 - DNA, 14 bp, Homo sapiens
cagtagagccagct

SEQ ID NO: 1068146 - DNA, 15 bp, Homo sapiens
cagtagagccagctt

SEQ ID NO: 1068147 - DNA, 12 bp, Homo sapiens
cagtgacagcta

SEQ ID NO: 1068148 - DNA, 20 bp, Homo sapiens
cagtgacatgattctgaact

SEQ ID NO: 1068149 - DNA, 15 bp, Homo sapiens
cagtgactccctggg

SEQ ID NO: 1068150 - DNA, 12 bp, Homo sapiens
cagtgactggca

SEQ ID NO: 1068151 - DNA, 13 bp, Homo sapiens
cagtgactggcag

SEQ ID NO: 1068152 - DNA, 14 bp, Homo sapiens
cagtgactggcagg

SEQ ID NO: 1068153 - DNA, 18 bp, Homo sapiens
cagtgactggcaggtgca

SEQ ID NO: 1068154 - DNA, 15 bp, Homo sapiens
cagtgacttctgaga

SEQ ID NO: 1068155 - DNA, 18 bp, Homo sapiens
cagtgactttacaggagg

SEQ ID NO: 1068156 - DNA, 19 bp, Homo sapiens
cagtgactttacaggaggt

SEQ ID NO: 1068157 - DNA, 15 bp, Homo sapiens
cagtgactttgtata

SEQ ID NO: 1068158 - DNA, 22 bp, Homo sapiens
cagtgactttttctgagctttt

SEQ ID NO: 1068159 - DNA, 19 bp, Homo sapiens
cagtgagaaaaagctcctg

SEQ ID NO: 1068160 - DNA, 21 bp, Homo sapiens
cagtgagaaaaagctcctgtc

SEQ ID NO: 1068161 - DNA, 22 bp, Homo sapiens
cagtgagaaaaagctcctgtcc

SEQ ID NO: 1068162 - DNA, 21 bp, Homo sapiens
cagtgagaactctctccctgg

SEQ ID NO: 1068163 - DNA, 21 bp, Homo sapiens
cagtgagaagctgaggcctat

SEQ ID NO: 1068164 - DNA, 17 bp, Homo sapiens
cagtgagacagtctgga

SEQ ID NO: 1068165 - DNA, 18 bp, Homo sapiens
cagtgagacagtctggaa

SEQ ID NO: 1068166 - DNA, 19 bp, Homo sapiens
cagtgagacagtctggaaa

SEQ ID NO: 1068167 - DNA, 21 bp, Homo sapiens
cagtgagacagtctggaaagt

SEQ ID NO: 1068168 - DNA, 17 bp, Homo sapiens
cagtgagactgccccac

SEQ ID NO: 1068169 - DNA, 23 bp, Homo sapiens
cagtgagagacgccctatttcta

SEQ ID NO: 1068170 - DNA, 15 bp, Homo sapiens
cagtgagaggggagg

SEQ ID NO: 1068171 - DNA, 16 bp, Homo sapiens
cagtgagaggggaggg

SEQ ID NO: 1068172 - DNA, 22 bp, Homo sapiens
cagtgagaggggagggctcctg

SEQ ID NO: 1068173 - DNA, 18 bp, Homo sapiens
cagtgagagtactcactt

SEQ ID NO: 1068174 - DNA, 20 bp, Homo sapiens
cagtgagagtactcactttt

SEQ ID NO: 1068175 - DNA, 19 bp, Homo sapiens
cagtgagattacagaggaa

SEQ ID NO: 1068176 - DNA, 20 bp, Homo sapiens
cagtgagattacagaggaag

SEQ ID NO: 1068177 - DNA, 23 bp, Homo sapiens
cagtgagccaagatcgcgccact

SEQ ID NO: 1068178 - DNA, 13 bp, Homo sapiens
cagtgagcccctc

SEQ ID NO: 1068179 - DNA, 14 bp, Homo sapiens
cagtgagcccctcc

SEQ ID NO: 1068180 - DNA, 15 bp, Homo sapiens
cagtgagcccctccc

SEQ ID NO: 1068181 - DNA, 20 bp, Homo sapiens
cagtgagcccctccccagcc

SEQ ID NO: 1068182 - DNA, 18 bp, Homo sapiens
cagtgagccgagattgca

SEQ ID NO: 1068183 - DNA, 20 bp, Homo sapiens
cagtgagcctcctgtgcctg

SEQ ID NO: 1068184 - DNA, 21 bp, Homo sapiens
cagtgagcctcctgtgcctgg

SEQ ID NO: 1068185 - DNA, 22 bp, Homo sapiens
cagtgagcctcctgtgcctggc

SEQ ID NO: 1068186 - DNA, 23 bp, Homo sapiens
cagtgagcctcctgtgcctggcc

SEQ ID NO: 1068187 - DNA, 12 bp, Homo sapiens
cagtgagcctga

SEQ ID NO: 1068188 - DNA, 17 bp, Homo sapiens
cagtgagcggagatcgc

SEQ ID NO: 1068189 - DNA, 12 bp, Homo sapiens
cagtgagctcta

SEQ ID NO: 1068190 - DNA, 22 bp, Homo sapiens
cagtgaggactcggccactgtg

SEQ ID NO: 1068191 - DNA, 12 bp, Homo sapiens
cagtgaggaggg

SEQ ID NO: 1068192 - DNA, 14 bp, Homo sapiens
cagtgaggatgaca

SEQ ID NO: 1068193 - DNA, 17 bp, Homo sapiens
cagtgaggcccagggag

SEQ ID NO: 1068194 - DNA, 12 bp, Homo sapiens
cagtgaggtgag

SEQ ID NO: 1068195 - DNA, 20 bp, Homo sapiens
cagtgagtaatcaatacaga

SEQ ID NO: 1068196 - DNA, 17 bp, Homo sapiens
cagtgagtcacatcctg

SEQ ID NO: 1068197 - DNA, 21 bp, Homo sapiens
cagtgagtcgagattgcactg

SEQ ID NO: 1068198 - DNA, 17 bp, Homo sapiens
cagtgagtctcttcaga

SEQ ID NO: 1068199 - DNA, 14 bp, Homo sapiens
cagtgagtgtaaat

SEQ ID NO: 1068200 - DNA, 16 bp, Homo sapiens
cagtgagtgtaaataa

SEQ ID NO: 1068201 - DNA, 20 bp, Homo sapiens
cagtgagtgtaaataatttt

SEQ ID NO: 1068202 - DNA, 23 bp, Homo sapiens
cagtgagttacagcgagaggcag

SEQ ID NO: 1068203 - DNA, 18 bp, Homo sapiens
cagtgatacgtacagcca

SEQ ID NO: 1068204 - DNA, 19 bp, Homo sapiens
cagtgataggcccaaggtc

SEQ ID NO: 1068205 - DNA, 22 bp, Homo sapiens
cagtgatctatgtttgtgtgat

SEQ ID NO: 1068206 - DNA, 16 bp, Homo sapiens
cagtgatctcagggca

SEQ ID NO: 1068207 - DNA, 18 bp, Homo sapiens
cagtgatctcagggcaga

SEQ ID NO: 1068208 - DNA, 13 bp, Homo sapiens
cagtgatctccat

SEQ ID NO: 1068209 - DNA, 18 bp, Homo sapiens
cagtgatgacttgctgtc

SEQ ID NO: 1068210 - DNA, 19 bp, Homo sapiens
cagtgatgacttgctgtcc

SEQ ID NO: 1068211 - DNA, 13 bp, Homo sapiens
cagtgatgatgtt

SEQ ID NO: 1068212 - DNA, 21 bp, Homo sapiens
cagtgatgcaatcttggctca

SEQ ID NO: 1068213 - DNA, 21 bp, Homo sapiens
cagtgatgccgggcgccagga

SEQ ID NO: 1068214 - DNA, 22 bp, Homo sapiens
cagtgatgccgggcgccaggac

SEQ ID NO: 1068215 - DNA, 23 bp, Homo sapiens
cagtgatgccgggcgccaggaca

SEQ ID NO: 1068216 - DNA, 17 bp, Homo sapiens
cagtgatgggagagtag

SEQ ID NO: 1068217 - DNA, 20 bp, Homo sapiens
cagtgattgtcttaatattg

SEQ ID NO: 1068218 - DNA, 19 bp, Homo sapiens
cagtgatttttttcttgta

SEQ ID NO: 1068219 - DNA, 17 bp, Homo sapiens
cagtgcaaaccacttct

SEQ ID NO: 1068220 - DNA, 20 bp, Homo sapiens
cagtgcaaattgtatcttat

SEQ ID NO: 1068221 - DNA, 15 bp, Homo sapiens
cagtgcacctccctc

SEQ ID NO: 1068222 - DNA, 16 bp, Homo sapiens
cagtttagaacagagg

SEQ ID NO: 1068223 - DNA, 13 bp, Homo sapiens
cagtttagtgctt

SEQ ID NO: 1068224 - DNA, 12 bp, Homo sapiens
cagtttatacag

SEQ ID NO: 1068225 - DNA, 18 bp, Homo sapiens
cagtttataccctagtta

SEQ ID NO: 1068226 - DNA, 17 bp, Homo sapiens
cagtttatattgtggaa

SEQ ID NO: 1068227 - DNA, 14 bp, Homo sapiens
cagtttatatttaa

SEQ ID NO: 1068228 - DNA, 14 bp, Homo sapiens
cagtttatcattca

SEQ ID NO: 1068229 - DNA, 19 bp, Homo sapiens
cagtttatcattcaagtgt

SEQ ID NO: 1068230 - DNA, 13 bp, Homo sapiens
cagtttattctgt

SEQ ID NO: 1068231 - DNA, 14 bp, Homo sapiens
cagtttcacagaaa

SEQ ID NO: 1068232 - DNA, 21 bp, Homo sapiens
cagtttcacagaaaataaggc

SEQ ID NO: 1068233 - DNA, 15 bp, Homo sapiens
cagtttcactccctc

SEQ ID NO: 1068234 - DNA, 13 bp, Homo sapiens
cagtttcaggctt

SEQ ID NO: 1068235 - DNA, 15 bp, Homo sapiens
cagtttcatcaggac

SEQ ID NO: 1068236 - DNA, 14 bp, Homo sapiens
cagtttcctggaaa

SEQ ID NO: 1068237 - DNA, 19 bp, Homo sapiens
cagtttctctgccttcttc

SEQ ID NO: 1068238 - DNA, 13 bp, Homo sapiens
cagtttcttctta

SEQ ID NO: 1068239 - DNA, 16 bp, Homo sapiens
cagtttcttgtgtaga

SEQ ID NO: 1068240 - DNA, 23 bp, Homo sapiens
cagtttcttttcacattaggctg

SEQ ID NO: 1068241 - DNA, 18 bp, Homo sapiens
cagtttgaaaatattttg

SEQ ID NO: 1068242 - DNA, 13 bp, Homo sapiens
cagtttgactttt

SEQ ID NO: 1068243 - DNA, 14 bp, Homo sapiens
cagtttgacttttt

SEQ ID NO: 1068244 - DNA, 16 bp, Homo sapiens
cagtttgagacaggag

SEQ ID NO: 1068245 - DNA, 21 bp, Homo sapiens
cagtttgaggaagtggctgtc

SEQ ID NO: 1068246 - DNA, 18 bp, Homo sapiens
cagtttgcacctgtcccc

SEQ ID NO: 1068247 - DNA, 12 bp, Homo sapiens
cagtttgcagag

SEQ ID NO: 1068248 - DNA, 12 bp, Homo sapiens
cagtttgcatga

SEQ ID NO: 1068249 - DNA, 13 bp, Homo sapiens
cagtttgcatgat

SEQ ID NO: 1068250 - DNA, 21 bp, Homo sapiens
cagtttgccggatacaaactg

SEQ ID NO: 1068251 - DNA, 16 bp, Homo sapiens
cagtttgcctgctgta

SEQ ID NO: 1068252 - DNA, 14 bp, Homo sapiens
cagtttgctttgta

SEQ ID NO: 1068253 - DNA, 19 bp, Homo sapiens
cagtttggccctggagcca

SEQ ID NO: 1068254 - DNA, 21 bp, Homo sapiens
cagtttggggtgccaagatgg

SEQ ID NO: 1068255 - DNA, 18 bp, Homo sapiens
cagtttgtagtgccactg

SEQ ID NO: 1068256 - DNA, 20 bp, Homo sapiens
cagtttgtggcatcttgcca

SEQ ID NO: 1068257 - DNA, 21 bp, Homo sapiens
cagtttgtgtgtcttaattat

SEQ ID NO: 1068258 - DNA, 21 bp, Homo sapiens
cagtttgtgttttaaaaaaac

SEQ ID NO: 1068259 - DNA, 22 bp, Homo sapiens
cagtttgtgttttaaaaaaact

SEQ ID NO: 1068260 - DNA, 12 bp, Homo sapiens
cagttttaactg

SEQ ID NO: 1068261 - DNA, 18 bp, Homo sapiens
cagttttaactgtggata

SEQ ID NO: 1068262 - DNA, 20 bp, Homo sapiens
cagttttaactgtggatatt

SEQ ID NO: 1068263 - DNA, 14 bp, Homo sapiens
cagttttagcagca

SEQ ID NO: 1068264 - DNA, 22 bp, Homo sapiens
cagttttcaagtcaaattaata

SEQ ID NO: 1068265 - DNA, 13 bp, Homo sapiens
cagttttcatagt

SEQ ID NO: 1068266 - DNA, 15 bp, Homo sapiens
cagttttcatagtat

SEQ ID NO: 1068267 - DNA, 16 bp, Homo sapiens
cagttttccatgaaaa

SEQ ID NO: 1068268 - DNA, 19 bp, Homo sapiens
cagttttccatgaaaacgt

SEQ ID NO: 1068269 - DNA, 13 bp, Homo sapiens
cagttttccttct

SEQ ID NO: 1068270 - DNA, 16 bp, Homo sapiens
cagttttgaaagaaaa

SEQ ID NO: 1068271 - DNA, 23 bp, Homo sapiens
cagttttgagtgtactgtgcctg

SEQ ID NO: 1068272 - DNA, 18 bp, Homo sapiens
cagttttgtaagccctct

SEQ ID NO: 1068273 - DNA, 15 bp, Homo sapiens
cagtttttattgctt

SEQ ID NO: 1068274 - DNA, 12 bp, Homo sapiens
cagtttttcatt

SEQ ID NO: 1068275 - DNA, 13 bp, Homo sapiens
cagtttttcattt

SEQ ID NO: 1068276 - DNA, 19 bp, Homo sapiens
cagtttttcatttgttttg

SEQ ID NO: 1068277 - DNA, 20 bp, Homo sapiens
cagtttttcattttaaaaag

SEQ ID NO: 1068278 - DNA, 17 bp, Homo sapiens
cagtttttggagtgtta

SEQ ID NO: 1068279 - DNA, 20 bp, Homo sapiens
cagtttttgtttttgcatga

SEQ ID NO: 1068280 - DNA, 23 bp, Homo sapiens
cagtttttgtttttgcatgaaat

SEQ ID NO: 1068281 - DNA, 16 bp, Homo sapiens
cagttttttatgctaa

SEQ ID NO: 1068282 - DNA, 21 bp, Homo sapiens
cagttttttttttcttgtcta

SEQ ID NO: 1068283 - DNA, 17 bp, Homo sapiens
cataaaaaagaagcact

SEQ ID NO: 1068284 - DNA, 20 bp, Homo sapiens
catccaactggaaattccag

SEQ ID NO: 1068285 - DNA, 14 bp, Homo sapiens
catccaacttatgt

SEQ ID NO: 1068286 - DNA, 16 bp, Homo sapiens
catccaacttccaaga

SEQ ID NO: 1068287 - DNA, 22 bp, Homo sapiens
catccaaggagaaacagagaca

SEQ ID NO: 1068288 - DNA, 23 bp, Homo sapiens
catccaaggagaaacagagacag

SEQ ID NO: 1068289 - DNA, 19 bp, Homo sapiens
catccaaggcaaacaatcc

SEQ ID NO: 1068290 - DNA, 22 bp, Homo sapiens
catccaagtctttcttcttttt

SEQ ID NO: 1068291 - DNA, 13 bp, Homo sapiens
catccaatcctca

SEQ ID NO: 1068292 - DNA, 16 bp, Homo sapiens
catccaatcctcactg

SEQ ID NO: 1068293 - DNA, 20 bp, Homo sapiens
catccacaactaatgaggga

SEQ ID NO: 1068294 - DNA, 18 bp, Homo sapiens
catccacacacgcaggaa

SEQ ID NO: 1068295 - DNA, 16 bp, Homo sapiens
catccacccagtgctg

SEQ ID NO: 1068296 - DNA, 23 bp, Homo sapiens
catccacccagtgctgccatgcc

SEQ ID NO: 1068297 - DNA, 12 bp, Homo sapiens
catccaccccat

SEQ ID NO: 1068298 - DNA, 12 bp, Homo sapiens
catccacccgct

SEQ ID NO: 1068299 - DNA, 22 bp, Homo sapiens
catccacccgctgcccctcccc

SEQ ID NO: 1068300 - DNA, 21 bp, Homo sapiens
catccacccgggggagcccag

SEQ ID NO: 1068301 - DNA, 14 bp, Homo sapiens
catccaccttccct

SEQ ID NO: 1068302 - DNA, 16 bp, Homo sapiens
catccacgtggcctct

SEQ ID NO: 1068303 - DNA, 21 bp, Homo sapiens
catccacgtggcctctctctc

SEQ ID NO: 1068304 - DNA, 21 bp, Homo sapiens
catccactagtgcaaatcata

SEQ ID NO: 1068305 - DNA, 18 bp, Homo sapiens
catccactctaccctccc

SEQ ID NO: 1068306 - DNA, 19 bp, Homo sapiens
catccacttaagttctttg

SEQ ID NO: 1068307 - DNA, 15 bp, Homo sapiens
catccagaaagctga

SEQ ID NO: 1068308 - DNA, 20 bp, Homo sapiens
catccagagattcattttct

SEQ ID NO: 1068309 - DNA, 17 bp, Homo sapiens
catccagattgggtgcc

SEQ ID NO: 1068310 - DNA, 12 bp, Homo sapiens
catccagcaaga

SEQ ID NO: 1068311 - DNA, 13 bp, Homo sapiens
catccagcaagaa

SEQ ID NO: 1068312 - DNA, 13 bp, Homo sapiens
catccagctcctc

SEQ ID NO: 1068313 - DNA, 21 bp, Homo sapiens
catccagctcctctaggggca

SEQ ID NO: 1068314 - DNA, 15 bp, Homo sapiens
catccagctgcccct

SEQ ID NO: 1068315 - DNA, 16 bp, Homo sapiens
catccaggactgagat

SEQ ID NO: 1068316 - DNA, 12 bp, Homo sapiens
catccaggcagt

SEQ ID NO: 1068317 - DNA, 11 bp, Homo sapiens
catccagggcc

SEQ ID NO: 1068318 - DNA, 18 bp, Homo sapiens
catccagggtctggcaga

SEQ ID NO: 1068319 - DNA, 22 bp, Homo sapiens
catccagggtctggcagagcct

SEQ ID NO: 1068320 - DNA, 13 bp, Homo sapiens
catccagttcatg

SEQ ID NO: 1068321 - DNA, 16 bp, Homo sapiens
catccagtttgttctc

SEQ ID NO: 1068322 - DNA, 16 bp, Homo sapiens
catccatagtagtatg

SEQ ID NO: 1068323 - DNA, 13 bp, Homo sapiens
catccatcatcat

SEQ ID NO: 1068324 - DNA, 14 bp, Homo sapiens
catccatcatcatg

SEQ ID NO: 1068325 - DNA, 12 bp, Homo sapiens
catccatcccta

SEQ ID NO: 1068326 - DNA, 14 bp, Homo sapiens
catccatccctaga

SEQ ID NO: 1068327 - DNA, 18 bp, Homo sapiens
catccatctgtccgtcca

SEQ ID NO: 1068328 - DNA, 15 bp, Homo sapiens
catccatgcacttta

SEQ ID NO: 1068329 - DNA, 23 bp, Homo sapiens
catccatgcactttaattgaaga

SEQ ID NO: 1068330 - DNA, 19 bp, Homo sapiens
catccatgttccgagaaga

SEQ ID NO: 1068331 - DNA, 16 bp, Homo sapiens
catccattcctcaggg

SEQ ID NO: 1068332 - DNA, 13 bp, Homo sapiens
catccattgttgt

SEQ ID NO: 1068333 - DNA, 18 bp, Homo sapiens
catccatttactgacact

SEQ ID NO: 1068334 - DNA, 15 bp, Homo sapiens
catcccaaactttaa

SEQ ID NO: 1068335 - DNA, 19 bp, Homo sapiens
catcccaaactttaaaatg

SEQ ID NO: 1068336 - DNA, 21 bp, Homo sapiens
catcccaaactttaaaatgcg

SEQ ID NO: 1068337 - DNA, 15 bp, Homo sapiens
catcccaaaggatga

SEQ ID NO: 1068338 - DNA, 14 bp, Homo sapiens
catcccaacagcca

SEQ ID NO: 1068339 - DNA, 18 bp, Homo sapiens
catcccaaccaggcacct

SEQ ID NO: 1068340 - DNA, 21 bp, Homo sapiens
catcccaacctctttttcctc

SEQ ID NO: 1068341 - DNA, 15 bp, Homo sapiens
catcccacaagtggt

SEQ ID NO: 1068342 - DNA, 16 bp, Homo sapiens
catcccaccagccccg

SEQ ID NO: 1068343 - DNA, 15 bp, Homo sapiens
catcccactgactgt

SEQ ID NO: 1068344 - DNA, 19 bp, Homo sapiens
catcccacttagccgcacc

SEQ ID NO: 1068345 - DNA, 22 bp, Homo sapiens
catcccacttagccgcaccctg

SEQ ID NO: 1068346 - DNA, 15 bp, Homo sapiens
catcccacttccttt

SEQ ID NO: 1068347 - DNA, 16 bp, Homo sapiens
catcccacttcctttc

SEQ ID NO: 1068348 - DNA, 15 bp, Homo sapiens
catcccagccttgag

SEQ ID NO: 1068349 - DNA, 11 bp, Homo sapiens
catcccagctt

SEQ ID NO: 1068350 - DNA, 14 bp, Homo sapiens
catcccagcttgcc

SEQ ID NO: 1068351 - DNA, 22 bp, Homo sapiens
catcccaggcgggcggcacgcc

SEQ ID NO: 1068352 - DNA, 13 bp, Homo sapiens
catcccagggtcc

SEQ ID NO: 1068353 - DNA, 15 bp, Homo sapiens
catcccagggtccca

SEQ ID NO: 1068354 - DNA, 20 bp, Homo sapiens
catcccagggtcccaccccc

SEQ ID NO: 1068355 - DNA, 13 bp, Homo sapiens
catcccagtggcc

SEQ ID NO: 1068356 - DNA, 18 bp, Homo sapiens
catcccatgatgtagtgc

SEQ ID NO: 1068357 - DNA, 16 bp, Homo sapiens
catcccattgccctgg

SEQ ID NO: 1068358 - DNA, 14 bp, Homo sapiens
catccccaactcca

SEQ ID NO: 1068359 - DNA, 15 bp, Homo sapiens
catccccaactccat

SEQ ID NO: 1068360 - DNA, 14 bp, Homo sapiens
catccccaccagct

SEQ ID NO: 1068361 - DNA, 14 bp, Homo sapiens
catccccaccccac

SEQ ID NO: 1068362 - DNA, 14 bp, Homo sapiens
catccccagagccc

SEQ ID NO: 1068363 - DNA, 20 bp, Homo sapiens
catccccagagcccagctct

SEQ ID NO: 1068364 - DNA, 23 bp, Homo sapiens
catccccagagcccagctcttgc

SEQ ID NO: 1068365 - DNA, 18 bp, Homo sapiens
catccccaggggtcccag

SEQ ID NO: 1068366 - DNA, 18 bp, Homo sapiens
catccccatcctccagct

SEQ ID NO: 1068367 - DNA, 15 bp, Homo sapiens
catcccccctgctgc

SEQ ID NO: 1068368 - DNA, 19 bp, Homo sapiens
catcccccctgctgcccag

SEQ ID NO: 1068369 - DNA, 11 bp, Homo sapiens
catccccctgc

SEQ ID NO: 1068370 - DNA, 15 bp, Homo sapiens
catccccctgcctcc

SEQ ID NO: 1068371 - DNA, 14 bp, Homo sapiens
catccccctgtgga

SEQ ID NO: 1068372 - DNA, 13 bp, Homo sapiens
catcccccttctt

SEQ ID NO: 1068373 - DNA, 22 bp, Homo sapiens
catcccccttcttcctcccctc

SEQ ID NO: 1068374 - DNA, 23 bp, Homo sapiens
catcccctcaacaccctgcttct

SEQ ID NO: 1068375 - DNA, 20 bp, Homo sapiens
catcccctccctgcctgctc

SEQ ID NO: 1068376 - DNA, 21 bp, Homo sapiens
catcccctccctgcctgctcc

SEQ ID NO: 1068377 - DNA, 22 bp, Homo sapiens
catcccctccctgcctgctcct

SEQ ID NO: 1068378 - DNA, 16 bp, Homo sapiens
catcccctcctagcac

SEQ ID NO: 1068379 - DNA, 17 bp, Homo sapiens
catcccctcgtcctgtc

SEQ ID NO: 1068380 - DNA, 18 bp, Homo sapiens
catcccctcgtcctgtcc

SEQ ID NO: 1068381 - DNA, 20 bp, Homo sapiens
catcccctcgtcctgtccca

SEQ ID NO: 1068382 - DNA, 22 bp, Homo sapiens
catcccctcgtcctgtcccaga

SEQ ID NO: 1068383 - DNA, 14 bp, Homo sapiens
catcccctgtagag

SEQ ID NO: 1068384 - DNA, 21 bp, Homo sapiens
catcccctgtagagtgggagc

SEQ ID NO: 1068385 - DNA, 18 bp, Homo sapiens
catccccttagaggacct

SEQ ID NO: 1068386 - DNA, 23 bp, Homo sapiens
catccccttagaggacctgagtt

SEQ ID NO: 1068387 - DNA, 20 bp, Homo sapiens
catccccttcccccatccct

SEQ ID NO: 1068388 - DNA, 14 bp, Homo sapiens
catcccctttcctc

SEQ ID NO: 1068389 - DNA, 23 bp, Homo sapiens
catccctgcttgcccgctcccac

SEQ ID NO: 1068390 - DNA, 22 bp, Homo sapiens
catccctggagcaggagccccg

SEQ ID NO: 1068391 - DNA, 11 bp, Homo sapiens
catccctgggc

SEQ ID NO: 1068392 - DNA, 12 bp, Homo sapiens
catccctgggcc

SEQ ID NO: 1068393 - DNA, 13 bp, Homo sapiens
catccctgggccc

SEQ ID NO: 1068394 - DNA, 13 bp, Homo sapiens
catcccttcccac

SEQ ID NO: 1068395 - DNA, 21 bp, Homo sapiens
catcccttcctggaaacagca

SEQ ID NO: 1068396 - DNA, 22 bp, Homo sapiens
catcccttcctggaaacagcat

SEQ ID NO: 1068397 - DNA, 15 bp, Homo sapiens
catccctttttcaat

SEQ ID NO: 1068398 - DNA, 13 bp, Homo sapiens
catccctttttga

SEQ ID NO: 1068399 - DNA, 18 bp, Homo sapiens
catccctttttgaagtgt

SEQ ID NO: 1068400 - DNA, 18 bp, Homo sapiens
catccctttttttacatt

SEQ ID NO: 1068401 - DNA, 21 bp, Homo sapiens
catccctttttttacatttca

SEQ ID NO: 1068402 - DNA, 20 bp, Homo sapiens
catccgaagatggtggccac

SEQ ID NO: 1068403 - DNA, 14 bp, Homo sapiens
catccgaggcaggg

SEQ ID NO: 1068404 - DNA, 14 bp, Homo sapiens
catccgcagactgc

SEQ ID NO: 1068405 - DNA, 23 bp, Homo sapiens
catccgcagactgcttggccaga

SEQ ID NO: 1068406 - DNA, 13 bp, Homo sapiens
catccgcaggtgc

SEQ ID NO: 1068407 - DNA, 14 bp, Homo sapiens
catccgcaggtgct

SEQ ID NO: 1068408 - DNA, 20 bp, Homo sapiens
catccgcaggtgctggtccc

SEQ ID NO: 1068409 - DNA, 18 bp, Homo sapiens
catccgtagttccctgaa

SEQ ID NO: 1068410 - DNA, 21 bp, Homo sapiens
catccgtagttccctgaaaac

SEQ ID NO: 1068411 - DNA, 18 bp, Homo sapiens
catccgtcattgctgctg

SEQ ID NO: 1068412 - DNA, 13 bp, Homo sapiens
catccgtcctggg

SEQ ID NO: 1068413 - DNA, 15 bp, Homo sapiens
catccgtcctgggcg

SEQ ID NO: 1068414 - DNA, 22 bp, Homo sapiens
catccgtctgtctgtcgccctt

SEQ ID NO: 1068415 - DNA, 17 bp, Homo sapiens
catcctacaagacacag

SEQ ID NO: 1068416 - DNA, 19 bp, Homo sapiens
catcctacaagacacagtg

SEQ ID NO: 1068417 - DNA, 19 bp, Homo sapiens
catcctaccaatgcatgca

SEQ ID NO: 1068418 - DNA, 19 bp, Homo sapiens
catcctaccctcgggccca

SEQ ID NO: 1068419 - DNA, 15 bp, Homo sapiens
catcctaccgtcttt

SEQ ID NO: 1068420 - DNA, 22 bp, Homo sapiens
catcctcaaacgacagaggagc

SEQ ID NO: 1068421 - DNA, 22 bp, Homo sapiens
catcctcaaagaaagtgtattg

SEQ ID NO: 1068422 - DNA, 13 bp, Homo sapiens
catcctcacccag

SEQ ID NO: 1068423 - DNA, 17 bp, Homo sapiens
catcctcagaagcctcg

SEQ ID NO: 1068424 - DNA, 12 bp, Homo sapiens
catcctcagagg

SEQ ID NO: 1068425 - DNA, 19 bp, Homo sapiens
catcctcagaggctgagcc

SEQ ID NO: 1068426 - DNA, 15 bp, Homo sapiens
catcctcatccctga

SEQ ID NO: 1068427 - DNA, 20 bp, Homo sapiens
catcctcatccctgactggc

SEQ ID NO: 1068428 - DNA, 19 bp, Homo sapiens
catcctcattgcctcctgt

SEQ ID NO: 1068429 - DNA, 20 bp, Homo sapiens
catcctcattgcctcctgtt

SEQ ID NO: 1068430 - DNA, 21 bp, Homo sapiens
catcctcattgcctcctgttc

SEQ ID NO: 1068431 - DNA, 23 bp, Homo sapiens
catcctcattgcctcctgttctg

SEQ ID NO: 1068432 - DNA, 19 bp, Homo sapiens
catcctccaaacctggcct

SEQ ID NO: 1068433 - DNA, 17 bp, Homo sapiens
catcctccagatagtgt

SEQ ID NO: 1068434 - DNA, 14 bp, Homo sapiens
catcctccagcagg

SEQ ID NO: 1068435 - DNA, 13 bp, Homo sapiens
catcctccagccc

SEQ ID NO: 1068436 - DNA, 19 bp, Homo sapiens
catcctccccttccctgca

SEQ ID NO: 1068437 - DNA, 11 bp, Homo sapiens
catcctccctc

SEQ ID NO: 1068438 - DNA, 13 bp, Homo sapiens
catcctcccttgc

SEQ ID NO: 1068439 - DNA, 23 bp, Homo sapiens
catcctcccttgccccaggccag

SEQ ID NO: 1068440 - DNA, 19 bp, Homo sapiens
catcctccgtccagccgcc

SEQ ID NO: 1068441 - DNA, 20 bp, Homo sapiens
catcctccgtccagccgcca

SEQ ID NO: 1068442 - DNA, 19 bp, Homo sapiens
catcctcctcagcccccag

SEQ ID NO: 1068443 - DNA, 13 bp, Homo sapiens
catcctcctccca

SEQ ID NO: 1068444 - DNA, 22 bp, Homo sapiens
catcctcctggaaccttgctgt

SEQ ID NO: 1068445 - DNA, 13 bp, Homo sapiens
catcctcctttca

SEQ ID NO: 1068446 - DNA, 17 bp, Homo sapiens
catcctctaaagcagag

SEQ ID NO: 1068447 - DNA, 21 bp, Homo sapiens
catcctctgatagctgtttca

SEQ ID NO: 1068448 - DNA, 18 bp, Homo sapiens
catcctcttctgcttagg

SEQ ID NO: 1068449 - DNA, 19 bp, Homo sapiens
catcctcttgactcttcta

SEQ ID NO: 1068450 - DNA, 22 bp, Homo sapiens
catcctgaccaagactgagcca

SEQ ID NO: 1068451 - DNA, 14 bp, Homo sapiens
catcctgagcccaa

SEQ ID NO: 1068452 - DNA, 22 bp, Homo sapiens
catcctgagcccaaccaggccc

SEQ ID NO: 1068453 - DNA, 13 bp, Homo sapiens
catcctgagcccc

SEQ ID NO: 1068454 - DNA, 16 bp, Homo sapiens
catcctgagccccgcc

SEQ ID NO: 1068455 - DNA, 22 bp, Homo sapiens
catcctgagccccgccctcttc

SEQ ID NO: 1068456 - DNA, 21 bp, Homo sapiens
ccacagagaagtttgtagcca

SEQ ID NO: 1068457 - DNA, 13 bp, Homo sapiens
ccacagagcctgg

SEQ ID NO: 1068458 - DNA, 14 bp, Homo sapiens
ccacagagcctggc

SEQ ID NO: 1068459 - DNA, 18 bp, Homo sapiens
ccacagagtgctggactg

SEQ ID NO: 1068460 - DNA, 18 bp, Homo sapiens
ccacagataactgaaaat

SEQ ID NO: 1068461 - DNA, 22 bp, Homo sapiens
ccacagataccagacctcttct

SEQ ID NO: 1068462 - DNA, 18 bp, Homo sapiens
ccacagatgtctctgggg

SEQ ID NO: 1068463 - DNA, 13 bp, Homo sapiens
ccacagatgtgtc

SEQ ID NO: 1068464 - DNA, 16 bp, Homo sapiens
ccacagattcactttg

SEQ ID NO: 1068465 - DNA, 16 bp, Homo sapiens
ccacagcaactgacct

SEQ ID NO: 1068466 - DNA, 22 bp, Homo sapiens
ccacagcaaggaaatgtcctgc

SEQ ID NO: 1068467 - DNA, 22 bp, Homo sapiens
ccacagcaagtacagcggctcc

SEQ ID NO: 1068468 - DNA, 17 bp, Homo sapiens
ccacagcagcctctgaa

SEQ ID NO: 1068469 - DNA, 12 bp, Homo sapiens
ccacagcaggtg

SEQ ID NO: 1068470 - DNA, 20 bp, Homo sapiens
ccacagcatcattttgcatt

SEQ ID NO: 1068471 - DNA, 22 bp, Homo sapiens
ccacagcatcgggagcacccag

SEQ ID NO: 1068472 - DNA, 21 bp, Homo sapiens
ccacagccagaggagggcaga

SEQ ID NO: 1068473 - DNA, 18 bp, Homo sapiens
ccaccccaactctcccca

SEQ ID NO: 1068474 - DNA, 15 bp, Homo sapiens
ccaccccaagagaac

SEQ ID NO: 1068475 - DNA, 19 bp, Homo sapiens
ccaccccaagagaactcgc

SEQ ID NO: 1068476 - DNA, 13 bp, Homo sapiens
ccaccccacctct

SEQ ID NO: 1068477 - DNA, 16 bp, Homo sapiens
ccaccccagaaatcac

SEQ ID NO: 1068478 - DNA, 20 bp, Homo sapiens
ccaccccagaaatcactgtg

SEQ ID NO: 1068479 - DNA, 23 bp, Homo sapiens
ccaccccagaaatcactgtgaaa

SEQ ID NO: 1068480 - DNA, 14 bp, Homo sapiens
ccaccccagcctaa

SEQ ID NO: 1068481 - DNA, 23 bp, Homo sapiens
ccagaaatgggcagttctcccag

SEQ ID NO: 1068482 - DNA, 15 bp, Homo sapiens
ccagaaattccagta

SEQ ID NO: 1068483 - DNA, 13 bp, Homo sapiens
ccagaaccagtta

SEQ ID NO: 1068484 - DNA, 18 bp, Homo sapiens
ccagaacgtggctctgct

SEQ ID NO: 1068485 - DNA, 19 bp, Homo sapiens
ccagaacgtggctctgctg

SEQ ID NO: 1068486 - DNA, 21 bp, Homo sapiens
ccagaacgtggctctgctggc

SEQ ID NO: 1068487 - DNA, 16 bp, Homo sapiens
ccagaactgcccccac

SEQ ID NO: 1068488 - DNA, 21 bp, Homo sapiens
ccagaactgcccccactgtcc

SEQ ID NO: 1068489 - DNA, 23 bp, Homo sapiens
ccagaactggctgggcccctggg

SEQ ID NO: 1068490 - DNA, 14 bp, Homo sapiens
ccagaacttccctg

SEQ ID NO: 1068491 - DNA, 15 bp, Homo sapiens
ccagaacttccctga

SEQ ID NO: 1068492 - DNA, 22 bp, Homo sapiens
ccagaagaagagaagctgctga

SEQ ID NO: 1068493 - DNA, 11 bp, Homo sapiens
ccagaagaagt

SEQ ID NO: 1068494 - DNA, 18 bp, Homo sapiens
ccagaagaagtgtgagaa

SEQ ID NO: 1068495 - DNA, 19 bp, Homo sapiens
ccagaagaatattcaggac

SEQ ID NO: 1068496 - DNA, 13 bp, Homo sapiens
ccagaagagccca

SEQ ID NO: 1068497 - DNA, 14 bp, Homo sapiens
ccagaagagcccat

SEQ ID NO: 1068498 - DNA, 22 bp, Homo sapiens
ccagaagatagcttcaccccaa

SEQ ID NO: 1068499 - DNA, 21 bp, Homo sapiens
ccagaagatgccagcttctct

SEQ ID NO: 1068500 - DNA, 16 bp, Homo sapiens
ccagaagatgccctcc

SEQ ID NO: 1068501 - DNA, 19 bp, Homo sapiens
ccagaagcctctggctaga

SEQ ID NO: 1068502 - DNA, 16 bp, Homo sapiens
ccagaaggagggcaga

SEQ ID NO: 1068503 - DNA, 22 bp, Homo sapiens
ccagaaggagggcagagccatg

SEQ ID NO: 1068504 - DNA, 23 bp, Homo sapiens
ccagaaggagggcagagccatgg

SEQ ID NO: 1068505 - DNA, 14 bp, Homo sapiens
ccagaaggaggggg

SEQ ID NO: 1068506 - DNA, 14 bp, Homo sapiens
ccagaagggcttca

SEQ ID NO: 1068507 - DNA, 13 bp, Homo sapiens
ccagaaggggagc

SEQ ID NO: 1068508 - DNA, 15 bp, Homo sapiens
ccagaagtccctccc

SEQ ID NO: 1068509 - DNA, 17 bp, Homo sapiens
ccagaatactgggttct

SEQ ID NO: 1068510 - DNA, 22 bp, Homo sapiens
ccagaatactgggttcttagtt

SEQ ID NO: 1068511 - DNA, 19 bp, Homo sapiens
ccagaatccataaatgtgt

SEQ ID NO: 1068512 - DNA, 21 bp, Homo sapiens
ccagaatccccaagtgcctgc

SEQ ID NO: 1068513 - DNA, 16 bp, Homo sapiens
ccagaatcttgacttt

SEQ ID NO: 1068514 - DNA, 18 bp, Homo sapiens
ccagaattggtaaaaaca

SEQ ID NO: 1068515 - DNA, 21 bp, Homo sapiens
ccagaatttattagtttaaaa

SEQ ID NO: 1068516 - DNA, 23 bp, Homo sapiens
ccagaatttggaaatcctagttt

SEQ ID NO: 1068517 - DNA, 19 bp, Homo sapiens
ccagacaaataggagtgag

SEQ ID NO: 1068518 - DNA, 17 bp, Homo sapiens
ccagacaacagcccagg

SEQ ID NO: 1068519 - DNA, 14 bp, Homo sapiens
ccagacaaccaaaa

SEQ ID NO: 1068520 - DNA, 22 bp, Homo sapiens
ccagacaacgggcccatggcct

SEQ ID NO: 1068521 - DNA, 15 bp, Homo sapiens
ccagacaaggagagc

SEQ ID NO: 1068522 - DNA, 22 bp, Homo sapiens
ccagacacagactggcaataaa

SEQ ID NO: 1068523 - DNA, 20 bp, Homo sapiens
ccagacaccatgtgcaataa

SEQ ID NO: 1068524 - DNA, 13 bp, Homo sapiens
ccagacactctgc

SEQ ID NO: 1068525 - DNA, 15 bp, Homo sapiens
ccagacactctgctc

SEQ ID NO: 1068526 - DNA, 23 bp, Homo sapiens
ccagacactgaccatccactcta

SEQ ID NO: 1068527 - DNA, 13 bp, Homo sapiens
ccagacactggtt

SEQ ID NO: 1068528 - DNA, 19 bp, Homo sapiens
ccagacagacatctctgca

SEQ ID NO: 1068529 - DNA, 21 bp, Homo sapiens
ccagacagcaacggggaggcc

SEQ ID NO: 1068530 - DNA, 17 bp, Homo sapiens
ccagacaggccctccct

SEQ ID NO: 1068531 - DNA, 20 bp, Homo sapiens
ccagacagggtgggcttcct

SEQ ID NO: 1068532 - DNA, 21 bp, Homo sapiens
ccagacagtcgctcagtctgt

SEQ ID NO: 1068533 - DNA, 21 bp, Homo sapiens
ccagaccaacgttactcaggg

SEQ ID NO: 1068534 - DNA, 17 bp, Homo sapiens
ccagacccacctggagc

SEQ ID NO: 1068535 - DNA, 20 bp, Homo sapiens
ccagacccacctggagcccg

SEQ ID NO: 1068536 - DNA, 20 bp, Homo sapiens
ccagacccactctgcggccc

SEQ ID NO: 1068537 - DNA, 17 bp, Homo sapiens
ccagacccagaggccct

SEQ ID NO: 1068538 - DNA, 21 bp, Homo sapiens
ccagacccagcccgcggcctg

SEQ ID NO: 1068539 - DNA, 15 bp, Homo sapiens
ccagaccccacgctg

SEQ ID NO: 1068540 - DNA, 19 bp, Homo sapiens
ccagacccccaccccttcc

SEQ ID NO: 1068541 - DNA, 21 bp, Homo sapiens
ccagacccccaccccttcccc

SEQ ID NO: 1068542 - DNA, 14 bp, Homo sapiens
ccagaccccgtggc

SEQ ID NO: 1068543 - DNA, 17 bp, Homo sapiens
ccagaccccgtggctct

SEQ ID NO: 1068544 - DNA, 19 bp, Homo sapiens
ccagaccccgtggctctgg

SEQ ID NO: 1068545 - DNA, 19 bp, Homo sapiens
ccagacccctctggccagg

SEQ ID NO: 1068546 - DNA, 20 bp, Homo sapiens
ccagacccctctggccagga

SEQ ID NO: 1068547 - DNA, 13 bp, Homo sapiens
ccagaccctgcct

SEQ ID NO: 1068548 - DNA, 22 bp, Homo sapiens
ccagacctagcaggctgttcca

SEQ ID NO: 1068549 - DNA, 20 bp, Homo sapiens
ccagacctgttagcagacag

SEQ ID NO: 1068550 - DNA, 17 bp, Homo sapiens
ccagacgcatagactga

SEQ ID NO: 1068551 - DNA, 19 bp, Homo sapiens
ccagacgccttcctctctg

SEQ ID NO: 1068552 - DNA, 20 bp, Homo sapiens
ccagacgccttcctctctgg

SEQ ID NO: 1068553 - DNA, 22 bp, Homo sapiens
ccagacgtcaggccctgactcc

SEQ ID NO: 1068554 - DNA, 20 bp, Homo sapiens
ccagacgtgctcctgctgac

SEQ ID NO: 1068555 - DNA, 19 bp, Homo sapiens
ccagactaaaggatccaga

SEQ ID NO: 1068556 - DNA, 21 bp, Homo sapiens
ccagactaaaggatccagaga

SEQ ID NO: 1068557 - DNA, 23 bp, Homo sapiens
ccagactaacatgtcagttttat

SEQ ID NO: 1068558 - DNA, 16 bp, Homo sapiens
ccagactcacttgcca

SEQ ID NO: 1068559 - DNA, 18 bp, Homo sapiens
ccagactcaggttccaga

SEQ ID NO: 1068560 - DNA, 17 bp, Homo sapiens
ccagactcctttcctct

SEQ ID NO: 1068561 - DNA, 18 bp, Homo sapiens
ccagactcctttcctctg

SEQ ID NO: 1068562 - DNA, 21 bp, Homo sapiens
ccagactctaggttatacaat

SEQ ID NO: 1068563 - DNA, 18 bp, Homo sapiens
ccagactcttgcctgttt

SEQ ID NO: 1068564 - DNA, 17 bp, Homo sapiens
ccagactctttttttga

SEQ ID NO: 1068565 - DNA, 19 bp, Homo sapiens
ccagactgagctctccagg

SEQ ID NO: 1068566 - DNA, 22 bp, Homo sapiens
ccagactgagctctccaggcca

SEQ ID NO: 1068567 - DNA, 24 bp, Homo sapiens
ccagactgagctctccaggccagg

SEQ ID NO: 1068568 - DNA, 17 bp, Homo sapiens
ccagactgatgagcaca

SEQ ID NO: 1068569 - DNA, 13 bp, Homo sapiens
ccagactggaaga

SEQ ID NO: 1068570 - DNA, 20 bp, Homo sapiens
ccagactggaagacacttca

SEQ ID NO: 1068571 - DNA, 15 bp, Homo sapiens
ccagactgggcccag

SEQ ID NO: 1068572 - DNA, 17 bp, Homo sapiens
ccagactgggcccaggc

SEQ ID NO: 1068573 - DNA, 20 bp, Homo sapiens
ccagactgggcccaggcagg

SEQ ID NO: 1068574 - DNA, 13 bp, Homo sapiens
ccagactgtggag

SEQ ID NO: 1068575 - DNA, 16 bp, Homo sapiens
ccagactgtggagaaa

SEQ ID NO: 1068576 - DNA, 13 bp, Homo sapiens
ccagacttccttg

SEQ ID NO: 1068577 - DNA, 16 bp, Homo sapiens
ccagacttctggagga

SEQ ID NO: 1068578 - DNA, 16 bp, Homo sapiens
ccagagaactgcagac

SEQ ID NO: 1068579 - DNA, 14 bp, Homo sapiens
ccagagtctcccag

SEQ ID NO: 1068580 - DNA, 15 bp, Homo sapiens
ccagagtctcccagt

SEQ ID NO: 1068581 - DNA, 14 bp, Homo sapiens
ccagagtctgagcc

SEQ ID NO: 1068582 - DNA, 15 bp, Homo sapiens
ccagagtctgagccc

SEQ ID NO: 1068583 - DNA, 16 bp, Homo sapiens
ccagagtctgagcccc

SEQ ID NO: 1068584 - DNA, 18 bp, Homo sapiens
ccagagtctgagcccccg

SEQ ID NO: 1068585 - DNA, 23 bp, Homo sapiens
ccagagtctgagcccccggctag

SEQ ID NO: 1068586 - DNA, 21 bp, Homo sapiens
ccagagtgaaagggctatggc

SEQ ID NO: 1068587 - DNA, 18 bp, Homo sapiens
ccagagtgctgaaggaat

SEQ ID NO: 1068588 - DNA, 15 bp, Homo sapiens
ccagagtgctgggat

SEQ ID NO: 1068589 - DNA, 22 bp, Homo sapiens
ccagagtgctgtcgggaccaca

SEQ ID NO: 1068590 - DNA, 14 bp, Homo sapiens
ccagagtggcccac

SEQ ID NO: 1068591 - DNA, 15 bp, Homo sapiens
ccagagtggcctggc

SEQ ID NO: 1068592 - DNA, 16 bp, Homo sapiens
ccagagtggcctggcc

SEQ ID NO: 1068593 - DNA, 21 bp, Homo sapiens
ccagagtggcctggccaggag

SEQ ID NO: 1068594 - DNA, 12 bp, Homo sapiens
ccagagtggctg

SEQ ID NO: 1068595 - DNA, 16 bp, Homo sapiens
ccagagtgggatccac

SEQ ID NO: 1068596 - DNA, 18 bp, Homo sapiens
ccagagtgtagggggcct

SEQ ID NO: 1068597 - DNA, 21 bp, Homo sapiens
ccagagtgtgggaagggagag

SEQ ID NO: 1068598 - DNA, 13 bp, Homo sapiens
ccagagttcctgc

SEQ ID NO: 1068599 - DNA, 11 bp, Homo sapiens
ccagagttgct

SEQ ID NO: 1068600 - DNA, 22 bp, Homo sapiens
ccagataaaatgttcagtgcaa

SEQ ID NO: 1068601 - DNA, 15 bp, Homo sapiens
ccagatagagctggg

SEQ ID NO: 1068602 - DNA, 13 bp, Homo sapiens
ccagatataactg

SEQ ID NO: 1068603 - DNA, 14 bp, Homo sapiens
ccagatataactgt

SEQ ID NO: 1068604 - DNA, 15 bp, Homo sapiens
ccagatataactgtc

SEQ ID NO: 1068605 - DNA, 21 bp, Homo sapiens
ccagatataactgtcttgttt

SEQ ID NO: 1068606 - DNA, 23 bp, Homo sapiens
ccagatatccacataaatgctcc

SEQ ID NO: 1068607 - DNA, 18 bp, Homo sapiens
ccagatcaccagcccggc

SEQ ID NO: 1068608 - DNA, 21 bp, Homo sapiens
ccagatcaccagcccggcctg

SEQ ID NO: 1068609 - DNA, 18 bp, Homo sapiens
ccagatcactgccacact

SEQ ID NO: 1068610 - DNA, 21 bp, Homo sapiens
ccagatcaggaaccagggcct

SEQ ID NO: 1068611 - DNA, 22 bp, Homo sapiens
ccagatcaggaaccagggcctc

SEQ ID NO: 1068612 - DNA, 15 bp, Homo sapiens
ccagatccgctccag

SEQ ID NO: 1068613 - DNA, 21 bp, Homo sapiens
ccagatccttttccagaaata

SEQ ID NO: 1068614 - DNA, 14 bp, Homo sapiens
ccagatcgtctcca

SEQ ID NO: 1068615 - DNA, 13 bp, Homo sapiens
ccagatctgcctg

SEQ ID NO: 1068616 - DNA, 14 bp, Homo sapiens
ccagatctgcctgg

SEQ ID NO: 1068617 - DNA, 21 bp, Homo sapiens
ccagatctgcctgggcctgtg

SEQ ID NO: 1068618 - DNA, 22 bp, Homo sapiens
ccagatctgcctgggcctgtgc

SEQ ID NO: 1068619 - DNA, 13 bp, Homo sapiens
ccagatctggtcc

SEQ ID NO: 1068620 - DNA, 13 bp, Homo sapiens
ccagatctttctc

SEQ ID NO: 1068621 - DNA, 15 bp, Homo sapiens
ccagatgaacatttc

SEQ ID NO: 1068622 - DNA, 16 bp, Homo sapiens
ccagatgaactgactg

SEQ ID NO: 1068623 - DNA, 19 bp, Homo sapiens
ccagatgaggctggccaag

SEQ ID NO: 1068624 - DNA, 19 bp, Homo sapiens
ccagatgatcccagtcact

SEQ ID NO: 1068625 - DNA, 22 bp, Homo sapiens
ccagatgatcccagtcactcct

SEQ ID NO: 1068626 - DNA, 15 bp, Homo sapiens
ccagatgattttcct

SEQ ID NO: 1068627 - DNA, 18 bp, Homo sapiens
ccagatgattttcctccc

SEQ ID NO: 1068628 - DNA, 22 bp, Homo sapiens
ccagatgccctttggaaagcca

SEQ ID NO: 1068629 - DNA, 16 bp, Homo sapiens
ccagatgccttctaga

SEQ ID NO: 1068630 - DNA, 16 bp, Homo sapiens
ccagatgcggggacag

SEQ ID NO: 1068631 - DNA, 17 bp, Homo sapiens
ccagatgctactggact

SEQ ID NO: 1068632 - DNA, 19 bp, Homo sapiens
ccagatggcccctccactg

SEQ ID NO: 1068633 - DNA, 19 bp, Homo sapiens
ccagatggcttcggagggc

SEQ ID NO: 1068634 - DNA, 21 bp, Homo sapiens
ccagatggcttcggagggccg

SEQ ID NO: 1068635 - DNA, 22 bp, Homo sapiens
ccagatggcttcggagggccgc

SEQ ID NO: 1068636 - DNA, 15 bp, Homo sapiens
ccagatggtttccta

SEQ ID NO: 1068637 - DNA, 12 bp, Homo sapiens
ccagatgtaaag

SEQ ID NO: 1068638 - DNA, 23 bp, Homo sapiens
ccagatgtgacggggtgtgtggc

SEQ ID NO: 1068639 - DNA, 20 bp, Homo sapiens
ccagatgtgcttttatttag

SEQ ID NO: 1068640 - DNA, 12 bp, Homo sapiens
ccagatgttttg

SEQ ID NO: 1068641 - DNA, 17 bp, Homo sapiens
ccagattagagcctgta

SEQ ID NO: 1068642 - DNA, 14 bp, Homo sapiens
ccagattcccagac

SEQ ID NO: 1068643 - DNA, 18 bp, Homo sapiens
ccagattgacgacaagtg

SEQ ID NO: 1068644 - DNA, 14 bp, Homo sapiens
ccagcctcagccca

SEQ ID NO: 1068645 - DNA, 17 bp, Homo sapiens
ccagcctcagcccaact

SEQ ID NO: 1068646 - DNA, 20 bp, Homo sapiens
ccagcctcattgtgccaagc

SEQ ID NO: 1068647 - DNA, 22 bp, Homo sapiens
ccagcctcattgtgccaagcct

SEQ ID NO: 1068648 - DNA, 13 bp, Homo sapiens
ccagcctccaggc

SEQ ID NO: 1068649 - DNA, 16 bp, Homo sapiens
ccagcctccaggcccc

SEQ ID NO: 1068650 - DNA, 16 bp, Homo sapiens
ccagcctccatgctgc

SEQ ID NO: 1068651 - DNA, 14 bp, Homo sapiens
ccagcctcccctcc

SEQ ID NO: 1068652 - DNA, 13 bp, Homo sapiens
ccagcctccctgt

SEQ ID NO: 1068653 - DNA, 17 bp, Homo sapiens
ccagcctccctgtctcc

SEQ ID NO: 1068654 - DNA, 21 bp, Homo sapiens
ccagcctccctgtctccagct

SEQ ID NO: 1068655 - DNA, 21 bp, Homo sapiens
ccagcctccgagagggagaga

SEQ ID NO: 1068656 - DNA, 12 bp, Homo sapiens
ccagcctcctct

SEQ ID NO: 1068657 - DNA, 20 bp, Homo sapiens
ccagcctcgttggagagcag

SEQ ID NO: 1068658 - DNA, 17 bp, Homo sapiens
ccagcctctccccgctc

SEQ ID NO: 1068659 - DNA, 13 bp, Homo sapiens
ccagcctctcccg

SEQ ID NO: 1068660 - DNA, 21 bp, Homo sapiens
ccagcctctcccggctgcctg

SEQ ID NO: 1068661 - DNA, 18 bp, Homo sapiens
ccagcctgaaagatacag

SEQ ID NO: 1068662 - DNA, 18 bp, Homo sapiens
ccagcctgcctggcaggc

SEQ ID NO: 1068663 - DNA, 17 bp, Homo sapiens
ccagcctgctgacagac

SEQ ID NO: 1068664 - DNA, 10 bp, Homo sapiens
ccagcctggc

SEQ ID NO: 1068665 - DNA, 13 bp, Homo sapiens
ccagcctggccag

SEQ ID NO: 1068666 - DNA, 17 bp, Homo sapiens
ccagcctggccagacaa

SEQ ID NO: 1068667 - DNA, 15 bp, Homo sapiens
ccagcctggctctgc

SEQ ID NO: 1068668 - DNA, 18 bp, Homo sapiens
ccagcctggctctgcccc

SEQ ID NO: 1068669 - DNA, 18 bp, Homo sapiens
ccagcctggcttctggag

SEQ ID NO: 1068670 - DNA, 20 bp, Homo sapiens
ccagcctggcttctggagcc

SEQ ID NO: 1068671 - DNA, 21 bp, Homo sapiens
ccagcctggcttctggagccc

SEQ ID NO: 1068672 - DNA, 14 bp, Homo sapiens
ccagcctgggacac

SEQ ID NO: 1068673 - DNA, 15 bp, Homo sapiens
ccagcctgggacaca

SEQ ID NO: 1068674 - DNA, 18 bp, Homo sapiens
ccagcctgggacacacac

SEQ ID NO: 1068675 - DNA, 16 bp, Homo sapiens
ccagcctgggagccca

SEQ ID NO: 1068676 - DNA, 19 bp, Homo sapiens
ccagcctgggcaacagagc

SEQ ID NO: 1068677 - DNA, 23 bp, Homo sapiens
ccagcctgggcagccaggctgcc

SEQ ID NO: 1068678 - DNA, 12 bp, Homo sapiens
ccagcctgggcc

SEQ ID NO: 1068679 - DNA, 18 bp, Homo sapiens
ccagcctgggccatctct

SEQ ID NO: 1068680 - DNA, 14 bp, Homo sapiens
ccagcctgggccca

SEQ ID NO: 1068681 - DNA, 21 bp, Homo sapiens
ccagcctgggcccatctccct

SEQ ID NO: 1068682 - DNA, 13 bp, Homo sapiens
ccagcctggggct

SEQ ID NO: 1068683 - DNA, 19 bp, Homo sapiens
ccagcctggggctccctct

SEQ ID NO: 1068684 - DNA, 13 bp, Homo sapiens
ccagcctgggtga

SEQ ID NO: 1068685 - DNA, 22 bp, Homo sapiens
ccagcctgtaccttgctgtggg

SEQ ID NO: 1068686 - DNA, 14 bp, Homo sapiens
ccagcctgtcaccc

SEQ ID NO: 1068687 - DNA, 17 bp, Homo sapiens
ccagcctgtcacccagc

SEQ ID NO: 1068688 - DNA, 19 bp, Homo sapiens
ccagcctgtggttacagtg

SEQ ID NO: 1068689 - DNA, 18 bp, Homo sapiens
ccagcctgtgtgttctgt

SEQ ID NO: 1068690 - DNA, 14 bp, Homo sapiens
ccagcctgttggac

SEQ ID NO: 1068691 - DNA, 21 bp, Homo sapiens
ccagccttatgtgttacatta

SEQ ID NO: 1068692 - DNA, 15 bp, Homo sapiens
ccagccttcctctgc

SEQ ID NO: 1068693 - DNA, 21 bp, Homo sapiens
ccagccttcctctgcagctga

SEQ ID NO: 1068694 - DNA, 22 bp, Homo sapiens
ccagccttcctctgcagctgac

SEQ ID NO: 1068695 - DNA, 22 bp, Homo sapiens
ccagccttgagatgcttcactt

SEQ ID NO: 1068696 - DNA, 17 bp, Homo sapiens
ccagcctttgctccctc

SEQ ID NO: 1068697 - DNA, 23 bp, Homo sapiens
ccagcctttgctccctccccgct

SEQ ID NO: 1068698 - DNA, 18 bp, Homo sapiens
ccagcctttgggtcctgg

SEQ ID NO: 1068699 - DNA, 18 bp, Homo sapiens
ccagcgacctctctgcct

SEQ ID NO: 1068700 - DNA, 14 bp, Homo sapiens
ccagcgagccacag

SEQ ID NO: 1068701 - DNA, 15 bp, Homo sapiens
ccagcgagctctcaa

SEQ ID NO: 1068702 - DNA, 19 bp, Homo sapiens
ccagcgccagggcccaggc

SEQ ID NO: 1068703 - DNA, 14 bp, Homo sapiens
ccagcgcccccaga

SEQ ID NO: 1068704 - DNA, 19 bp, Homo sapiens
ccagcgcccgctgggctga

SEQ ID NO: 1068705 - DNA, 15 bp, Homo sapiens
ccagcgcctccctcc

SEQ ID NO: 1068706 - DNA, 12 bp, Homo sapiens
ccagcgctcgcc

SEQ ID NO: 1068707 - DNA, 13 bp, Homo sapiens
ccagcgctcgcca

SEQ ID NO: 1068708 - DNA, 14 bp, Homo sapiens
ccagcgctcgccac

SEQ ID NO: 1068709 - DNA, 18 bp, Homo sapiens
ccagcgctcgccacgctc

SEQ ID NO: 1068710 - DNA, 12 bp, Homo sapiens
ccagcggaaaca

SEQ ID NO: 1068711 - DNA, 20 bp, Homo sapiens
ccagcggccccccgcacagc

SEQ ID NO: 1068712 - DNA, 14 bp, Homo sapiens
ccagcggcccctcc

SEQ ID NO: 1068713 - DNA, 15 bp, Homo sapiens
ccagcggcctcaggg

SEQ ID NO: 1068714 - DNA, 23 bp, Homo sapiens
ccagcggcctcagggtctaagga

SEQ ID NO: 1068715 - DNA, 19 bp, Homo sapiens
ccagcggcttagccaagcc

SEQ ID NO: 1068716 - DNA, 23 bp, Homo sapiens
ccagcgggaatggcagctgccac

SEQ ID NO: 1068717 - DNA, 14 bp, Homo sapiens
ccagcggtccctgc

SEQ ID NO: 1068718 - DNA, 14 bp, Homo sapiens
ccagcggtgaccag

SEQ ID NO: 1068719 - DNA, 22 bp, Homo sapiens
ccagcggtgaccagcctgtcac

SEQ ID NO: 1068720 - DNA, 16 bp, Homo sapiens
ccagcggttcctgtgc

SEQ ID NO: 1068721 - DNA, 18 bp, Homo sapiens
ccagcggttcctgtgcag

SEQ ID NO: 1068722 - DNA, 23 bp, Homo sapiens
ccagcgtcagctgctccctggca

SEQ ID NO: 1068723 - DNA, 15 bp, Homo sapiens
ccagcgtcaggccta

SEQ ID NO: 1068724 - DNA, 22 bp, Homo sapiens
ccagcgtcccagtctctggcag

SEQ ID NO: 1068725 - DNA, 13 bp, Homo sapiens
ccagcgtcctcct

SEQ ID NO: 1068726 - DNA, 13 bp, Homo sapiens
ccagcgtctgcag

SEQ ID NO: 1068727 - DNA, 18 bp, Homo sapiens
ccagcgtctgcagggtga

SEQ ID NO: 1068728 - DNA, 20 bp, Homo sapiens
ccagcgtgacggagcccaca

SEQ ID NO: 1068729 - DNA, 13 bp, Homo sapiens
ccagcgtggccca

SEQ ID NO: 1068730 - DNA, 15 bp, Homo sapiens
ccagcgtgtggagca

SEQ ID NO: 1068731 - DNA, 22 bp, Homo sapiens
ccagcgtgtggagcagagctct

SEQ ID NO: 1068732 - DNA, 23 bp, Homo sapiens
ccagcgttcccttctcccccttg

SEQ ID NO: 1068733 - DNA, 17 bp, Homo sapiens
ccagcgtttgaggggct

SEQ ID NO: 1068734 - DNA, 21 bp, Homo sapiens
ccagctaatctgtagggctgg

SEQ ID NO: 1068735 - DNA, 14 bp, Homo sapiens
ccagctaatttttg

SEQ ID NO: 1068736 - DNA, 17 bp, Homo sapiens
ccagctacattcctcag

SEQ ID NO: 1068737 - DNA, 19 bp, Homo sapiens
ccagctacattcctcagct

SEQ ID NO: 1068738 - DNA, 14 bp, Homo sapiens
ccagctaccccttc

SEQ ID NO: 1068739 - DNA, 21 bp, Homo sapiens
ccagctaccctttttctccag

SEQ ID NO: 1068740 - DNA, 22 bp, Homo sapiens
ccagctaccctttttctccagc

SEQ ID NO: 1068741 - DNA, 16 bp, Homo sapiens
ccagctactcagaagc

SEQ ID NO: 1068742 - DNA, 19 bp, Homo sapiens
ccagctactcaggaggctg

SEQ ID NO: 1068743 - DNA, 15 bp, Homo sapiens
ccagctactctgtcc

SEQ ID NO: 1068744 - DNA, 18 bp, Homo sapiens
ccagctactctgtccagg

SEQ ID NO: 1068745 - DNA, 17 bp, Homo sapiens
ccagctacttgggaagc

SEQ ID NO: 1068746 - DNA, 14 bp, Homo sapiens
ccagctatctgtca

SEQ ID NO: 1068747 - DNA, 21 bp, Homo sapiens
ccagctatctgtcatctctct

SEQ ID NO: 1068748 - DNA, 22 bp, Homo sapiens
ccagctatgttatattgaaaaa

SEQ ID NO: 1068749 - DNA, 13 bp, Homo sapiens
ccagctcacagtg

SEQ ID NO: 1068750 - DNA, 16 bp, Homo sapiens
ccagctcagaacccag

SEQ ID NO: 1068751 - DNA, 17 bp, Homo sapiens
ccagctcagaacccagg

SEQ ID NO: 1068752 - DNA, 20 bp, Homo sapiens
ccagctcagaacccagggct

SEQ ID NO: 1068753 - DNA, 12 bp, Homo sapiens
ccagctcagccc

SEQ ID NO: 1068754 - DNA, 21 bp, Homo sapiens
ccagctcagccctggcctggc

SEQ ID NO: 1068755 - DNA, 12 bp, Homo sapiens
ccagctcatctc

SEQ ID NO: 1068756 - DNA, 16 bp, Homo sapiens
ccagctcatctccaag

SEQ ID NO: 1068757 - DNA, 17 bp, Homo sapiens
ccagctcatctccaagg

SEQ ID NO: 1068758 - DNA, 15 bp, Homo sapiens
ccagctccaggggcc

SEQ ID NO: 1068759 - DNA, 24 bp, Homo sapiens
ccagctccagtgccgctcctgctt

SEQ ID NO: 1068760 - DNA, 17 bp, Homo sapiens
ccagctcccagggtgga

SEQ ID NO: 1068761 - DNA, 13 bp, Homo sapiens
ccagctccctaga

SEQ ID NO: 1068762 - DNA, 17 bp, Homo sapiens
ccagctccctagactgc

SEQ ID NO: 1068763 - DNA, 13 bp, Homo sapiens
ccagctccctgca

SEQ ID NO: 1068764 - DNA, 14 bp, Homo sapiens
ccagctccctgcac

SEQ ID NO: 1068765 - DNA, 15 bp, Homo sapiens
ccagctccctgcacc

SEQ ID NO: 1068766 - DNA, 15 bp, Homo sapiens
ccagctcccttggga

SEQ ID NO: 1068767 - DNA, 18 bp, Homo sapiens
ccagctcccttgggaagg

SEQ ID NO: 1068768 - DNA, 19 bp, Homo sapiens
ccagctccgacctctctca

SEQ ID NO: 1068769 - DNA, 16 bp, Homo sapiens
ccagctccgcctgctg

SEQ ID NO: 1068770 - DNA, 14 bp, Homo sapiens
ccagctcctcacat

SEQ ID NO: 1068771 - DNA, 14 bp, Homo sapiens
ccagctcctccagc

SEQ ID NO: 1068772 - DNA, 14 bp, Homo sapiens
ccagctcctccctt

SEQ ID NO: 1068773 - DNA, 14 bp, Homo sapiens
ccagctcctctctg

SEQ ID NO: 1068774 - DNA, 15 bp, Homo sapiens
ccagctcctctctga

SEQ ID NO: 1068775 - DNA, 14 bp, Homo sapiens
ccagctcctctgag

SEQ ID NO: 1068776 - DNA, 16 bp, Homo sapiens
ccagctcctctgagcc

SEQ ID NO: 1068777 - DNA, 18 bp, Homo sapiens
ccagctccttggctgcag

SEQ ID NO: 1068778 - DNA, 22 bp, Homo sapiens
ccagctccttggctgcagccat

SEQ ID NO: 1068779 - DNA, 18 bp, Homo sapiens
ccagctcctttctcctgt

SEQ ID NO: 1068780 - DNA, 22 bp, Homo sapiens
ccagctcctttctcctgtgaat

SEQ ID NO: 1068781 - DNA, 20 bp, Homo sapiens
ccagctccttttgtccccag

SEQ ID NO: 1068782 - DNA, 22 bp, Homo sapiens
ccagctccttttgtccccaggg

SEQ ID NO: 1068783 - DNA, 17 bp, Homo sapiens
ccagctcgtgggctggg

SEQ ID NO: 1068784 - DNA, 20 bp, Homo sapiens
ccagctctaagcagccagga

SEQ ID NO: 1068785 - DNA, 17 bp, Homo sapiens
ccagctctagacaaccc

SEQ ID NO: 1068786 - DNA, 18 bp, Homo sapiens
ccagctctagacaaccct

SEQ ID NO: 1068787 - DNA, 19 bp, Homo sapiens
ccagctctagacaaccctg

SEQ ID NO: 1068788 - DNA, 21 bp, Homo sapiens
ccagctctagacaaccctgca

SEQ ID NO: 1068789 - DNA, 12 bp, Homo sapiens
ccagctctcagc

SEQ ID NO: 1068790 - DNA, 14 bp, Homo sapiens
ccagctctccctct

SEQ ID NO: 1068791 - DNA, 20 bp, Homo sapiens
ccagctctccctctggccct

SEQ ID NO: 1068792 - DNA, 22 bp, Homo sapiens
ccagctctccctctggccctgc

SEQ ID NO: 1068793 - DNA, 23 bp, Homo sapiens
ccagctctccctctggccctgcc

SEQ ID NO: 1068794 - DNA, 20 bp, Homo sapiens
ccagctctgaaaccagtgtt

SEQ ID NO: 1068795 - DNA, 15 bp, Homo sapiens
ccagctctgacatcc

SEQ ID NO: 1068796 - DNA, 12 bp, Homo sapiens
ccagctctgagg

SEQ ID NO: 1068797 - DNA, 15 bp, Homo sapiens
ccagctctgcccccg

SEQ ID NO: 1068798 - DNA, 21 bp, Homo sapiens
ccagctctgccgtctctggag

SEQ ID NO: 1068799 - DNA, 22 bp, Homo sapiens
ccagctctgccgtctctggagc

SEQ ID NO: 1068800 - DNA, 11 bp, Homo sapiens
ccagctctgga

SEQ ID NO: 1068801 - DNA, 14 bp, Homo sapiens
ccagctctggatga

SEQ ID NO: 1068802 - DNA, 12 bp, Homo sapiens
ccagctctggct

SEQ ID NO: 1068803 - DNA, 14 bp, Homo sapiens
ccagctctggcttc

SEQ ID NO: 1068804 - DNA, 21 bp, Homo sapiens
ccagctctgtatcaggaccca

SEQ ID NO: 1068805 - DNA, 14 bp, Homo sapiens
ccagctctgtggcc

SEQ ID NO: 1068806 - DNA, 19 bp, Homo sapiens
ccagctctgtggcctgtgt

SEQ ID NO: 1068807 - DNA, 19 bp, Homo sapiens
ccagctcttctccccaggt

SEQ ID NO: 1068808 - DNA, 17 bp, Homo sapiens
ccagctcttgctctctt

SEQ ID NO: 1068809 - DNA, 20 bp, Homo sapiens
ccagctgagcgccaggatgg

SEQ ID NO: 1068810 - DNA, 10 bp, Homo sapiens
ccagctgcac

SEQ ID NO: 1068811 - DNA, 17 bp, Homo sapiens
ccagctgcaccagagca

SEQ ID NO: 1068812 - DNA, 12 bp, Homo sapiens
ccagctgcagat

SEQ ID NO: 1068813 - DNA, 12 bp, Homo sapiens
ccagctgccagg

SEQ ID NO: 1068814 - DNA, 16 bp, Homo sapiens
ccagctgccaggcggc

SEQ ID NO: 1068815 - DNA, 17 bp, Homo sapiens
ccagctgccaggcggcc

SEQ ID NO: 1068816 - DNA, 18 bp, Homo sapiens
ccagctgccccagccaga

SEQ ID NO: 1068817 - DNA, 18 bp, Homo sapiens
ccagctgccccggcccct

SEQ ID NO: 1068818 - DNA, 21 bp, Homo sapiens
ccagctgcccctccctcaggg

SEQ ID NO: 1068819 - DNA, 14 bp, Homo sapiens
ccagctgcctgggc

SEQ ID NO: 1068820 - DNA, 14 bp, Homo sapiens
ccagctgccttcct

SEQ ID NO: 1068821 - DNA, 17 bp, Homo sapiens
ccagctgcgcttgcttt

SEQ ID NO: 1068822 - DNA, 19 bp, Homo sapiens
ccagctgcgcttgcttttc

SEQ ID NO: 1068823 - DNA, 21 bp, Homo sapiens
ccagctgcgcttgcttttctg

SEQ ID NO: 1068824 - DNA, 14 bp, Homo sapiens
ccagctgctcccct

SEQ ID NO: 1068825 - DNA, 18 bp, Homo sapiens
ccagctgctcccctggag

SEQ ID NO: 1068826 - DNA, 22 bp, Homo sapiens
ccagctgctccgaggacccagg

SEQ ID NO: 1068827 - DNA, 15 bp, Homo sapiens
ccagctgctctgccc

SEQ ID NO: 1068828 - DNA, 22 bp, Homo sapiens
ccagctgctctgccccttgggc

SEQ ID NO: 1068829 - DNA, 14 bp, Homo sapiens
ccagctgctgtctt

SEQ ID NO: 1068830 - DNA, 15 bp, Homo sapiens
ccagctgcttgacct

SEQ ID NO: 1068831 - DNA, 13 bp, Homo sapiens
ccagctgcttttt

SEQ ID NO: 1068832 - DNA, 23 bp, Homo sapiens
ccagctggagtgagggcctcaga

SEQ ID NO: 1068833 - DNA, 19 bp, Homo sapiens
ccagctggcccgtgacaga

SEQ ID NO: 1068834 - DNA, 13 bp, Homo sapiens
ccagctggcctgg

SEQ ID NO: 1068835 - DNA, 15 bp, Homo sapiens
ccagctggcctggac

SEQ ID NO: 1068836 - DNA, 14 bp, Homo sapiens
ccagctggcctggg

SEQ ID NO: 1068837 - DNA, 12 bp, Homo sapiens
ccagctggcctt

SEQ ID NO: 1068838 - DNA, 14 bp, Homo sapiens
ccagctggcctttg

SEQ ID NO: 1068839 - DNA, 20 bp, Homo sapiens
ccagctgggacctaatgctg

SEQ ID NO: 1068840 - DNA, 19 bp, Homo sapiens
ccagctgggaggcaagagg

SEQ ID NO: 1068841 - DNA, 21 bp, Homo sapiens
ccagctgggaggcaagagggg

SEQ ID NO: 1068842 - DNA, 16 bp, Homo sapiens
ccagctgggctctgcc

SEQ ID NO: 1068843 - DNA, 21 bp, Homo sapiens
ccagctgggctctgccaccct

SEQ ID NO: 1068844 - DNA, 15 bp, Homo sapiens
ccagctggggccaga

SEQ ID NO: 1068845 - DNA, 20 bp, Homo sapiens
ccagctggggccagaggctg

SEQ ID NO: 1068846 - DNA, 19 bp, Homo sapiens
ccagctggggcgtggggag

SEQ ID NO: 1068847 - DNA, 20 bp, Homo sapiens
ccagctggggcgtggggagg

SEQ ID NO: 1068848 - DNA, 22 bp, Homo sapiens
ccagctggggcgtggggagggc

SEQ ID NO: 1068849 - DNA, 18 bp, Homo sapiens
ccagctggtcctgtggat

SEQ ID NO: 1068850 - DNA, 15 bp, Homo sapiens
ccagctgtagccatg

SEQ ID NO: 1068851 - DNA, 17 bp, Homo sapiens
ccagctgtagccatggc

SEQ ID NO: 1068852 - DNA, 22 bp, Homo sapiens
ccagctgtagccatggctcagg

SEQ ID NO: 1068853 - DNA, 23 bp, Homo sapiens
ccagctgtagccatggctcaggc

SEQ ID NO: 1068854 - DNA, 20 bp, Homo sapiens
ccagctgtgcccctccccca

SEQ ID NO: 1068855 - DNA, 14 bp, Homo sapiens
ccagctgtgctgtg

SEQ ID NO: 1068856 - DNA, 16 bp, Homo sapiens
ccagctgtgctgtgga

SEQ ID NO: 1068857 - DNA, 17 bp, Homo sapiens
ccagctgtgctgtggag

SEQ ID NO: 1068858 - DNA, 14 bp, Homo sapiens
ccagctgttcttag

SEQ ID NO: 1068859 - DNA, 22 bp, Homo sapiens
ccagcttaaacccatacaatgt

SEQ ID NO: 1068860 - DNA, 19 bp, Homo sapiens
ccagcttaaaggggctaga

SEQ ID NO: 1068861 - DNA, 18 bp, Homo sapiens
ccagcttaatagctgtag

SEQ ID NO: 1068862 - DNA, 11 bp, Homo sapiens
ccagcttcagc

SEQ ID NO: 1068863 - DNA, 19 bp, Homo sapiens
ccagcttcgtgctggagga

SEQ ID NO: 1068864 - DNA, 21 bp, Homo sapiens
ccagcttcgtgctggaggaac

SEQ ID NO: 1068865 - DNA, 18 bp, Homo sapiens
ccagcttctccaggctct

SEQ ID NO: 1068866 - DNA, 23 bp, Homo sapiens
ccagcttgctcttcagtgggaga

SEQ ID NO: 1068867 - DNA, 19 bp, Homo sapiens
ccagcttgggcccagctgg

SEQ ID NO: 1068868 - DNA, 16 bp, Homo sapiens
ccagcttggggccacc

SEQ ID NO: 1068869 - DNA, 21 bp, Homo sapiens
ccagcttggggccaccaaagc

SEQ ID NO: 1068870 - DNA, 22 bp, Homo sapiens
ccagcttggggccaccaaagct

SEQ ID NO: 1068871 - DNA, 22 bp, Homo sapiens
ccagctttaagggttgtgagcc

SEQ ID NO: 1068872 - DNA, 20 bp, Homo sapiens
ccagctttgctaccaaagca

SEQ ID NO: 1068873 - DNA, 19 bp, Homo sapiens
ccaggaaaaaataaaaaga

SEQ ID NO: 1068874 - DNA, 19 bp, Homo sapiens
ccaggaaactccacatctg

SEQ ID NO: 1068875 - DNA, 21 bp, Homo sapiens
ccaggaaactccacatctgcc

SEQ ID NO: 1068876 - DNA, 22 bp, Homo sapiens
ccaggaaactccacatctgcct

SEQ ID NO: 1068877 - DNA, 23 bp, Homo sapiens
ccaggaaactctgcattctagta

SEQ ID NO: 1068878 - DNA, 15 bp, Homo sapiens
ccaggaaagaggcat

SEQ ID NO: 1068879 - DNA, 22 bp, Homo sapiens
ccaggaaccgaacatatcattt

SEQ ID NO: 1068880 - DNA, 15 bp, Homo sapiens
ccaggaagcagggag

SEQ ID NO: 1068881 - DNA, 17 bp, Homo sapiens
ccaggaagcagggagag

SEQ ID NO: 1068882 - DNA, 13 bp, Homo sapiens
ccaggaagccaga

SEQ ID NO: 1068883 - DNA, 12 bp, Homo sapiens
ccaggaaggcag

SEQ ID NO: 1068884 - DNA, 17 bp, Homo sapiens
ccaggaaggcagctgct

SEQ ID NO: 1068885 - DNA, 16 bp, Homo sapiens
ccaggaagtgtttatg

SEQ ID NO: 1068886 - DNA, 21 bp, Homo sapiens
ccaggaagtgtttatgaggaa

SEQ ID NO: 1068887 - DNA, 17 bp, Homo sapiens
ccaggaatagtggacat

SEQ ID NO: 1068888 - DNA, 20 bp, Homo sapiens
ccaggaatattgtcatcctt

SEQ ID NO: 1068889 - DNA, 22 bp, Homo sapiens
ccaggaatgctgggcccccagc

SEQ ID NO: 1068890 - DNA, 21 bp, Homo sapiens
ccaggacaagcacgaggcctc

SEQ ID NO: 1068891 - DNA, 14 bp, Homo sapiens
ccaggacagcagca

SEQ ID NO: 1068892 - DNA, 15 bp, Homo sapiens
ccaggacagcagcac

SEQ ID NO: 1068893 - DNA, 17 bp, Homo sapiens
ccaggacagcagcactc

SEQ ID NO: 1068894 - DNA, 18 bp, Homo sapiens
ccaggacagcagcactcc

SEQ ID NO: 1068895 - DNA, 17 bp, Homo sapiens
ccaggacagctggttcg

SEQ ID NO: 1068896 - DNA, 13 bp, Homo sapiens
ccaggacaggacc

SEQ ID NO: 1068897 - DNA, 17 bp, Homo sapiens
ccaggacaggatccagg

SEQ ID NO: 1068898 - DNA, 14 bp, Homo sapiens
ccaggacagtttat

SEQ ID NO: 1068899 - DNA, 13 bp, Homo sapiens
ccaggaccagcct

SEQ ID NO: 1068900 - DNA, 14 bp, Homo sapiens
ccaggaccagctgg

SEQ ID NO: 1068901 - DNA, 19 bp, Homo sapiens
ccaggacccagggtcccct

SEQ ID NO: 1068902 - DNA, 20 bp, Homo sapiens
ccaggacccctcagctcccc

SEQ ID NO: 1068903 - DNA, 16 bp, Homo sapiens
ccaggacccgccagcc

SEQ ID NO: 1068904 - DNA, 19 bp, Homo sapiens
ccaggacccgccagccccg

SEQ ID NO: 1068905 - DNA, 15 bp, Homo sapiens
ccaggaccctccact

SEQ ID NO: 1068906 - DNA, 22 bp, Homo sapiens
ccaggaccctccactcactgct

SEQ ID NO: 1068907 - DNA, 15 bp, Homo sapiens
ccaggacctggctgc

SEQ ID NO: 1068908 - DNA, 15 bp, Homo sapiens
ccaggacgccactca

SEQ ID NO: 1068909 - DNA, 23 bp, Homo sapiens
ccaggacgccactcatttcatct

SEQ ID NO: 1068910 - DNA, 19 bp, Homo sapiens
ccaggacgcttctgaatgc

SEQ ID NO: 1068911 - DNA, 15 bp, Homo sapiens
ccaggactccccagg

SEQ ID NO: 1068912 - DNA, 16 bp, Homo sapiens
ccaggactccctcctc

SEQ ID NO: 1068913 - DNA, 14 bp, Homo sapiens
ccaggactgaaaga

SEQ ID NO: 1068914 - DNA, 13 bp, Homo sapiens
ccaggactgagat

SEQ ID NO: 1068915 - DNA, 22 bp, Homo sapiens
ccaggagaaagccgggggaggg

SEQ ID NO: 1068916 - DNA, 23 bp, Homo sapiens
ccaggagaaagccgggggagggg

SEQ ID NO: 1068917 - DNA, 11 bp, Homo sapiens
ccaggagaagc

SEQ ID NO: 1068918 - DNA, 13 bp, Homo sapiens
ccaggagaagctc

SEQ ID NO: 1068919 - DNA, 22 bp, Homo sapiens
ccaggagaagctcagctgcatt

SEQ ID NO: 1068920 - DNA, 20 bp, Homo sapiens
ccaggagaaggccaattcct

SEQ ID NO: 1068921 - DNA, 16 bp, Homo sapiens
ccaggagaagggggct

SEQ ID NO: 1068922 - DNA, 22 bp, Homo sapiens
ccaggagaagggggctctgccc

SEQ ID NO: 1068923 - DNA, 12 bp, Homo sapiens
ccaggagaaggt

SEQ ID NO: 1068924 - DNA, 15 bp, Homo sapiens
ccaggagacagacca

SEQ ID NO: 1068925 - DNA, 17 bp, Homo sapiens
ccaggagacagaccact

SEQ ID NO: 1068926 - DNA, 22 bp, Homo sapiens
ccaggagacagaccacttgcca

SEQ ID NO: 1068927 - DNA, 13 bp, Homo sapiens
ccaggagagccag

SEQ ID NO: 1068928 - DNA, 20 bp, Homo sapiens
ccaggagagcccccaccagc

SEQ ID NO: 1068929 - DNA, 15 bp, Homo sapiens
ccaggagagcctggg

SEQ ID NO: 1068930 - DNA, 12 bp, Homo sapiens
ccaggagatggg

SEQ ID NO: 1068931 - DNA, 18 bp, Homo sapiens
ccaggagatgggtccagg

SEQ ID NO: 1068932 - DNA, 19 bp, Homo sapiens
ccaggagcaaatgtttctg

SEQ ID NO: 1068933 - DNA, 23 bp, Homo sapiens
ccaggagcaaatgtttctgcagt

SEQ ID NO: 1068934 - DNA, 19 bp, Homo sapiens
ccaggagcagatggacagc

SEQ ID NO: 1068935 - DNA, 14 bp, Homo sapiens
ccaggagcagcagc

SEQ ID NO: 1068936 - DNA, 17 bp, Homo sapiens
ccaggagcagcagccag

SEQ ID NO: 1068937 - DNA, 19 bp, Homo sapiens
ccaggagcagcagccagca

SEQ ID NO: 1068938 - DNA, 22 bp, Homo sapiens
ccaggagcagcagccagcacca

SEQ ID NO: 1068939 - DNA, 13 bp, Homo sapiens
ccaggagcataga

SEQ ID NO: 1068940 - DNA, 17 bp, Homo sapiens
ccaggagcctgtgcctc

SEQ ID NO: 1068941 - DNA, 12 bp, Homo sapiens
ccaggagctctg

SEQ ID NO: 1068942 - DNA, 14 bp, Homo sapiens
ccaggagctctgcg

SEQ ID NO: 1068943 - DNA, 16 bp, Homo sapiens
ccaggagctctgcgcc

SEQ ID NO: 1068944 - DNA, 17 bp, Homo sapiens
ccaggagctgagtcacc

SEQ ID NO: 1068945 - DNA, 21 bp, Homo sapiens
ccaggagctgagtcacctcct

SEQ ID NO: 1068946 - DNA, 22 bp, Homo sapiens
ccaggagctgagtcacctcctc

SEQ ID NO: 1068947 - DNA, 19 bp, Homo sapiens
ccaggagctgatggcagct

SEQ ID NO: 1068948 - DNA, 23 bp, Homo sapiens
ccaggagctgtcaccaaggaaac

SEQ ID NO: 1068949 - DNA, 13 bp, Homo sapiens
ccaggaggcggca

SEQ ID NO: 1068950 - DNA, 22 bp, Homo sapiens
ccaggaggcggcagctcttctg

SEQ ID NO: 1068951 - DNA, 22 bp, Homo sapiens
ccaggaggctttaagctccagc

SEQ ID NO: 1068952 - DNA, 22 bp, Homo sapiens
ccaggagggaggcaggggaggg

SEQ ID NO: 1068953 - DNA, 12 bp, Homo sapiens
ccaggaggggcc

SEQ ID NO: 1068954 - DNA, 22 bp, Homo sapiens
ccaggaggtggaggttgcagtg

SEQ ID NO: 1068955 - DNA, 23 bp, Homo sapiens
ccaggaggttcccccgaccaggt

SEQ ID NO: 1068956 - DNA, 19 bp, Homo sapiens
ccaggaggttggtgactga

SEQ ID NO: 1068957 - DNA, 16 bp, Homo sapiens
ccaggagtctgtgctc

SEQ ID NO: 1068958 - DNA, 18 bp, Homo sapiens
ccaggagtgcccccggga

SEQ ID NO: 1068959 - DNA, 21 bp, Homo sapiens
ccaggagtttaagaccagcct

SEQ ID NO: 1068960 - DNA, 18 bp, Homo sapiens
ccaggagtttgagaccag

SEQ ID NO: 1068961 - DNA, 20 bp, Homo sapiens
ccaggagtttgaggctgcag

SEQ ID NO: 1068962 - DNA, 22 bp, Homo sapiens
ccaggagtttgaggctgcagcg

SEQ ID NO: 1068963 - DNA, 17 bp, Homo sapiens
ccaggataaggagactg

SEQ ID NO: 1068964 - DNA, 22 bp, Homo sapiens
ccaggataaggagactgaggct

SEQ ID NO: 1068965 - DNA, 15 bp, Homo sapiens
ccaggatactggcac

SEQ ID NO: 1068966 - DNA, 17 bp, Homo sapiens
ccaggatactggcacag

SEQ ID NO: 1068967 - DNA, 16 bp, Homo sapiens
ccaggatatttctgag

SEQ ID NO: 1068968 - DNA, 18 bp, Homo sapiens
ccaggatcccaagcctcc

SEQ ID NO: 1068969 - DNA, 22 bp, Homo sapiens
ccaggatcccaagcctcctgct

SEQ ID NO: 1068970 - DNA, 16 bp, Homo sapiens
ccaggatcctgcagga

SEQ ID NO: 1068971 - DNA, 17 bp, Homo sapiens
ccaggatcctgcaggaa

SEQ ID NO: 1068972 - DNA, 21 bp, Homo sapiens
ccaggatctgggttaggtggc

SEQ ID NO: 1068973 - DNA, 21 bp, Homo sapiens
ccaggatgctaaagatgatga

SEQ ID NO: 1068974 - DNA, 21 bp, Homo sapiens
ccaggatggaacacggccaca

SEQ ID NO: 1068975 - DNA, 14 bp, Homo sapiens
ccaggatggcagca

SEQ ID NO: 1068976 - DNA, 20 bp, Homo sapiens
ccaggatggcccttcccact

SEQ ID NO: 1068977 - DNA, 17 bp, Homo sapiens
ccaggattcccccagcc

SEQ ID NO: 1068978 - DNA, 21 bp, Homo sapiens
ccaggattccttaaacctgaa

SEQ ID NO: 1068979 - DNA, 16 bp, Homo sapiens
ccaggattgaagagca

SEQ ID NO: 1068980 - DNA, 17 bp, Homo sapiens
ccaggatttataaagca

SEQ ID NO: 1068981 - DNA, 20 bp, Homo sapiens
ccaggattttaacaaaagca

SEQ ID NO: 1068982 - DNA, 15 bp, Homo sapiens
ccaggattttgtgtt

SEQ ID NO: 1068983 - DNA, 19 bp, Homo sapiens
ccaggcaaatcagttacta

SEQ ID NO: 1068984 - DNA, 14 bp, Homo sapiens
ccaggcaaggctga

SEQ ID NO: 1068985 - DNA, 16 bp, Homo sapiens
ccaggcaaggctgact

SEQ ID NO: 1068986 - DNA, 19 bp, Homo sapiens
ccaggcacacacagcccct

SEQ ID NO: 1068987 - DNA, 14 bp, Homo sapiens
ccaggcacagctga

SEQ ID NO: 1068988 - DNA, 11 bp, Homo sapiens
ccaggcacagg

SEQ ID NO: 1068989 - DNA, 21 bp, Homo sapiens
ccaggcaccaccaggagcagc

SEQ ID NO: 1068990 - DNA, 16 bp, Homo sapiens
ccaggcaccctcaggg

SEQ ID NO: 1068991 - DNA, 19 bp, Homo sapiens
ccaggcacctggcctgctg

SEQ ID NO: 1068992 - DNA, 22 bp, Homo sapiens
ccaggcacctggcctgctggga

SEQ ID NO: 1068993 - DNA, 18 bp, Homo sapiens
ccaggcacgaacccacct

SEQ ID NO: 1068994 - DNA, 19 bp, Homo sapiens
ccaggcacgaacccacctg

SEQ ID NO: 1068995 - DNA, 21 bp, Homo sapiens
ccaggcacgaacccacctgct

SEQ ID NO: 1068996 - DNA, 23 bp, Homo sapiens
ccaggcacgaacccacctgctga

SEQ ID NO: 1068997 - DNA, 12 bp, Homo sapiens
ccaggcactctc

SEQ ID NO: 1068998 - DNA, 18 bp, Homo sapiens
ccaggcactgtttggagc

SEQ ID NO: 1068999 - DNA, 19 bp, Homo sapiens
ccaggcagaatggctgcac

SEQ ID NO: 1069000 - DNA, 13 bp, Homo sapiens
ccaggcagagctg

SEQ ID NO: 1069001 - DNA, 18 bp, Homo sapiens
ccaggcagagctgagggc

SEQ ID NO: 1069002 - DNA, 12 bp, Homo sapiens
ccaggcagaggg

SEQ ID NO: 1069003 - DNA, 22 bp, Homo sapiens
ccaggcagatcctctggacacg

SEQ ID NO: 1069004 - DNA, 13 bp, Homo sapiens
ccaggcagatctg

SEQ ID NO: 1069005 - DNA, 18 bp, Homo sapiens
ccaggcagatctgtgccc

SEQ ID NO: 1069006 - DNA, 23 bp, Homo sapiens
ccaggcagatctgtgccccatgc

SEQ ID NO: 1069007 - DNA, 10 bp, Homo sapiens
ccaggcagcc

SEQ ID NO: 1069008 - DNA, 17 bp, Homo sapiens
ccaggcagccaccagtg

SEQ ID NO: 1069009 - DNA, 18 bp, Homo sapiens
ccaggcagccaccagtgg

SEQ ID NO: 1069010 - DNA, 19 bp, Homo sapiens
ccaggcagcctccgggcgt

SEQ ID NO: 1069011 - DNA, 23 bp, Homo sapiens
ccaggcagctatttcagcctcct

SEQ ID NO: 1069012 - DNA, 24 bp, Homo sapiens
ccaggcagctatttcagcctcctg

SEQ ID NO: 1069013 - DNA, 14 bp, Homo sapiens
ccaggcagctccct

SEQ ID NO: 1069014 - DNA, 23 bp, Homo sapiens
ccaggcagctccctcctgcacac

SEQ ID NO: 1069015 - DNA, 15 bp, Homo sapiens
ccaggcagctgagac

SEQ ID NO: 1069016 - DNA, 21 bp, Homo sapiens
ccaggcaggccaggctgcctc

SEQ ID NO: 1069017 - DNA, 23 bp, Homo sapiens
ccataccgaccatcgtccagccc

SEQ ID NO: 1069018 - DNA, 23 bp, Homo sapiens
ccatacctgcccctgcctgacag

SEQ ID NO: 1069019 - DNA, 24 bp, Homo sapiens
ccataccttccttccctgggctgt

SEQ ID NO: 1069020 - DNA, 15 bp, Homo sapiens
ccatacctttccagg

SEQ ID NO: 1069021 - DNA, 12 bp, Homo sapiens
ccatactaatga

SEQ ID NO: 1069022 - DNA, 14 bp, Homo sapiens
ccatactgagcctg

SEQ ID NO: 1069023 - DNA, 19 bp, Homo sapiens
ccatactgtctctggagtg

SEQ ID NO: 1069024 - DNA, 19 bp, Homo sapiens
ccatactttgtctgaaaaa

SEQ ID NO: 1069025 - DNA, 17 bp, Homo sapiens
ccatacttttggctcct

SEQ ID NO: 1069026 - DNA, 20 bp, Homo sapiens
ccatagaaaaatgtataaaa

SEQ ID NO: 1069027 - DNA, 19 bp, Homo sapiens
ccatagaccctgaggccct

SEQ ID NO: 1069028 - DNA, 15 bp, Homo sapiens
ccatagaggcccagg

SEQ ID NO: 1069029 - DNA, 17 bp, Homo sapiens
ccatagaggcccaggca

SEQ ID NO: 1069030 - DNA, 18 bp, Homo sapiens
ccatagaggcccaggcac

SEQ ID NO: 1069031 - DNA, 20 bp, Homo sapiens
ccatagaggcccaggcacca

SEQ ID NO: 1069032 - DNA, 16 bp, Homo sapiens
ccatagatcttctgaa

SEQ ID NO: 1069033 - DNA, 20 bp, Homo sapiens
ccatagatcttctgaaatga

SEQ ID NO: 1069034 - DNA, 17 bp, Homo sapiens
ccatagatttattttac

SEQ ID NO: 1069035 - DNA, 21 bp, Homo sapiens
ccatagcaagattgcttaaaa

SEQ ID NO: 1069036 - DNA, 16 bp, Homo sapiens
ccatagctgatcatgt

SEQ ID NO: 1069037 - DNA, 19 bp, Homo sapiens
ccatcccgcttagcctgcc

SEQ ID NO: 1069038 - DNA, 12 bp, Homo sapiens
ccatccctacca

SEQ ID NO: 1069039 - DNA, 17 bp, Homo sapiens
ccatccctaccactgtg

SEQ ID NO: 1069040 - DNA, 12 bp, Homo sapiens
ccatccctgctc

SEQ ID NO: 1069041 - DNA, 13 bp, Homo sapiens
ccatccctgctct

SEQ ID NO: 1069042 - DNA, 12 bp, Homo sapiens
ccatccctgctt

SEQ ID NO: 1069043 - DNA, 13 bp, Homo sapiens
ccatccctgggcc

SEQ ID NO: 1069044 - DNA, 16 bp, Homo sapiens
ccatccctgggcccct

SEQ ID NO: 1069045 - DNA, 17 bp, Homo sapiens
ccatccctgggcccctc

SEQ ID NO: 1069046 - DNA, 19 bp, Homo sapiens
ccatccctgggcccctcca

SEQ ID NO: 1069047 - DNA, 17 bp, Homo sapiens
ccatcccttcggagcca

SEQ ID NO: 1069048 - DNA, 18 bp, Homo sapiens
ccatcccttttcctttct

SEQ ID NO: 1069049 - DNA, 14 bp, Homo sapiens
ccatccgcagactg

SEQ ID NO: 1069050 - DNA, 20 bp, Homo sapiens
ccatccggtttgccatgttg

SEQ ID NO: 1069051 - DNA, 19 bp, Homo sapiens
ccatcctaccaatgcatgc

SEQ ID NO: 1069052 - DNA, 15 bp, Homo sapiens
ccatcctacccagcg

SEQ ID NO: 1069053 - DNA, 17 bp, Homo sapiens
ccatcctaccctcgggc

SEQ ID NO: 1069054 - DNA, 18 bp, Homo sapiens
ccatcctaccctcgggcc

SEQ ID NO: 1069055 - DNA, 18 bp, Homo sapiens
ccatcctcaaacgacaga

SEQ ID NO: 1069056 - DNA, 19 bp, Homo sapiens
ccatcctcacccagatcag

SEQ ID NO: 1069057 - DNA, 18 bp, Homo sapiens
ccatcctcagaggctgag

SEQ ID NO: 1069058 - DNA, 23 bp, Homo sapiens
ccatcctcagaggctgagccctg

SEQ ID NO: 1069059 - DNA, 17 bp, Homo sapiens
ccatcctcatccctgac

SEQ ID NO: 1069060 - DNA, 16 bp, Homo sapiens
ccatcctccagccctg

SEQ ID NO: 1069061 - DNA, 16 bp, Homo sapiens
ccatcctccagcttct

SEQ ID NO: 1069062 - DNA, 15 bp, Homo sapiens
ccatcctccccttcc

SEQ ID NO: 1069063 - DNA, 17 bp, Homo sapiens
ccatcctccccttccct

SEQ ID NO: 1069064 - DNA, 18 bp, Homo sapiens
ccatcctccccttccctg

SEQ ID NO: 1069065 - DNA, 13 bp, Homo sapiens
ccatcctccctcc

SEQ ID NO: 1069066 - DNA, 14 bp, Homo sapiens
ccatcctccctcca

SEQ ID NO: 1069067 - DNA, 20 bp, Homo sapiens
ccatcctccctccacctcaa

SEQ ID NO: 1069068 - DNA, 11 bp, Homo sapiens
ccatcctgacc

SEQ ID NO: 1069069 - DNA, 18 bp, Homo sapiens
ccatcctgatcccagacc

SEQ ID NO: 1069070 - DNA, 18 bp, Homo sapiens
ccatcctgatggacctgc

SEQ ID NO: 1069071 - DNA, 19 bp, Homo sapiens
ccatcctgatggacctgcc

SEQ ID NO: 1069072 - DNA, 20 bp, Homo sapiens
ccatcctgcaaaggcccttg

SEQ ID NO: 1069073 - DNA, 21 bp, Homo sapiens
ccatcctgcagcctcctcctg

SEQ ID NO: 1069074 - DNA, 17 bp, Homo sapiens
ccatcctgccatcctca

SEQ ID NO: 1069075 - DNA, 12 bp, Homo sapiens
ccatcctggccc

SEQ ID NO: 1069076 - DNA, 12 bp, Homo sapiens
ccatcctggcta

SEQ ID NO: 1069077 - DNA, 12 bp, Homo sapiens
ccatcctggggc

SEQ ID NO: 1069078 - DNA, 20 bp, Homo sapiens
ccatcctggggcagcactcc

SEQ ID NO: 1069079 - DNA, 13 bp, Homo sapiens
ccatccttgctgc

SEQ ID NO: 1069080 - DNA, 19 bp, Homo sapiens
ccatcgccatcttcttccc

SEQ ID NO: 1069081 - DNA, 18 bp, Homo sapiens
ccatcgcccaggcctggg

SEQ ID NO: 1069082 - DNA, 13 bp, Homo sapiens
ccatcgcctctgt

SEQ ID NO: 1069083 - DNA, 14 bp, Homo sapiens
ccatcgctgtgtgt

SEQ ID NO: 1069084 - DNA, 23 bp, Homo sapiens
ccatcgctgtgtgttagttccca

SEQ ID NO: 1069085 - DNA, 17 bp, Homo sapiens
ccatcggacaggaggat

SEQ ID NO: 1069086 - DNA, 13 bp, Homo sapiens
ccatcggccctgt

SEQ ID NO: 1069087 - DNA, 22 bp, Homo sapiens
ccatcggccctgtcccctggag

SEQ ID NO: 1069088 - DNA, 18 bp, Homo sapiens
ccatcgtccagccctcct

SEQ ID NO: 1069089 - DNA, 16 bp, Homo sapiens
ccatcgtcctgggact

SEQ ID NO: 1069090 - DNA, 20 bp, Homo sapiens
ccatcgtctcatcctccttt

SEQ ID NO: 1069091 - DNA, 21 bp, Homo sapiens
ccatcgtctcatcctcctttc

SEQ ID NO: 1069092 - DNA, 23 bp, Homo sapiens
ccatcgtctcatcctcctttcag

SEQ ID NO: 1069093 - DNA, 17 bp, Homo sapiens
ccatctaatggcttcag

SEQ ID NO: 1069094 - DNA, 16 bp, Homo sapiens
ccatctagcagctggc

SEQ ID NO: 1069095 - DNA, 20 bp, Homo sapiens
ccatctatgtcccttgctgt

SEQ ID NO: 1069096 - DNA, 16 bp, Homo sapiens
ccatctcagattctgt

SEQ ID NO: 1069097 - DNA, 17 bp, Homo sapiens
ccatctcagcctcctga

SEQ ID NO: 1069098 - DNA, 17 bp, Homo sapiens
ccatctcaggccacctg

SEQ ID NO: 1069099 - DNA, 20 bp, Homo sapiens
ccatctcaggccacctgccc

SEQ ID NO: 1069100 - DNA, 13 bp, Homo sapiens
ccatctcaggtgc

SEQ ID NO: 1069101 - DNA, 22 bp, Homo sapiens
ccatctcaggtgccactccctg

SEQ ID NO: 1069102 - DNA, 23 bp, Homo sapiens
ccatctcaggtgccactccctga

SEQ ID NO: 1069103 - DNA, 15 bp, Homo sapiens
ccatctcatcctggc

SEQ ID NO: 1069104 - DNA, 21 bp, Homo sapiens
ccatctcatgcccctggctgg

SEQ ID NO: 1069105 - DNA, 14 bp, Homo sapiens
ccatctccagggaa

SEQ ID NO: 1069106 - DNA, 12 bp, Homo sapiens
ccatctccccag

SEQ ID NO: 1069107 - DNA, 15 bp, Homo sapiens
ccatctccccaggcc

SEQ ID NO: 1069108 - DNA, 19 bp, Homo sapiens
ccatctccccaggcctcca

SEQ ID NO: 1069109 - DNA, 23 bp, Homo sapiens
ccatctccccaggcctccagcct

SEQ ID NO: 1069110 - DNA, 13 bp, Homo sapiens
ccatctccctgcc

SEQ ID NO: 1069111 - DNA, 14 bp, Homo sapiens
ccatctccctgcct

SEQ ID NO: 1069112 - DNA, 18 bp, Homo sapiens
ccatctccctgcctggcc

SEQ ID NO: 1069113 - DNA, 13 bp, Homo sapiens
ccatctccctgct

SEQ ID NO: 1069114 - DNA, 20 bp, Homo sapiens
ccatctcctataatctgtca

SEQ ID NO: 1069115 - DNA, 22 bp, Homo sapiens
ccatctcctataatctgtcaaa

SEQ ID NO: 1069116 - DNA, 13 bp, Homo sapiens
ccatctcggagca

SEQ ID NO: 1069117 - DNA, 22 bp, Homo sapiens
ccatctcggagcatcccggagg

SEQ ID NO: 1069118 - DNA, 23 bp, Homo sapiens
ccatctcggagcatcccggagga

SEQ ID NO: 1069119 - DNA, 17 bp, Homo sapiens
ccatctcggggctgctg

SEQ ID NO: 1069120 - DNA, 18 bp, Homo sapiens
ccatctcggggctgctgt

SEQ ID NO: 1069121 - DNA, 13 bp, Homo sapiens
ccatctctcccac

SEQ ID NO: 1069122 - DNA, 20 bp, Homo sapiens
ccatctctctactcctacct

SEQ ID NO: 1069123 - DNA, 14 bp, Homo sapiens
ccatctcttccttg

SEQ ID NO: 1069124 - DNA, 17 bp, Homo sapiens
ccatctgattaaaacaa

SEQ ID NO: 1069125 - DNA, 17 bp, Homo sapiens
ccatctgcaccccttct

SEQ ID NO: 1069126 - DNA, 20 bp, Homo sapiens
ccatctgcaccccttctctc

SEQ ID NO: 1069127 - DNA, 17 bp, Homo sapiens
ccatctgcccaggggtg

SEQ ID NO: 1069128 - DNA, 20 bp, Homo sapiens
ccatctgcccaggggtgccc

SEQ ID NO: 1069129 - DNA, 20 bp, Homo sapiens
ccatctgcgtgacaataaaa

SEQ ID NO: 1069130 - DNA, 23 bp, Homo sapiens
ccatctgcgtgacaataaaacat

SEQ ID NO: 1069131 - DNA, 11 bp, Homo sapiens
ccatctgctgc

SEQ ID NO: 1069132 - DNA, 15 bp, Homo sapiens
ccatctgctgcagtt

SEQ ID NO: 1069133 - DNA, 19 bp, Homo sapiens
ccatctgcttggttggctg

SEQ ID NO: 1069134 - DNA, 23 bp, Homo sapiens
ccatctgcttttattaaatttgt

SEQ ID NO: 1069135 - DNA, 16 bp, Homo sapiens
ccatctgggctcctcc

SEQ ID NO: 1069136 - DNA, 15 bp, Homo sapiens
ccatctgtccagctg

SEQ ID NO: 1069137 - DNA, 19 bp, Homo sapiens
ccatctgtccgtccagagc

SEQ ID NO: 1069138 - DNA, 14 bp, Homo sapiens
ccatctgtgaataa

SEQ ID NO: 1069139 - DNA, 19 bp, Homo sapiens
ccatctgtttggtgggggt

SEQ ID NO: 1069140 - DNA, 17 bp, Homo sapiens
ccatcttcactcttcac

SEQ ID NO: 1069141 - DNA, 22 bp, Homo sapiens
ccatcttcactcttcacttgag

SEQ ID NO: 1069142 - DNA, 15 bp, Homo sapiens
ccatcttcataattt

SEQ ID NO: 1069143 - DNA, 18 bp, Homo sapiens
ccatcttccacctgtgcc

SEQ ID NO: 1069144 - DNA, 18 bp, Homo sapiens
ccatcttcctgctgctgt

SEQ ID NO: 1069145 - DNA, 13 bp, Homo sapiens
ccatcttcttccc

SEQ ID NO: 1069146 - DNA, 21 bp, Homo sapiens
ccatcttgatctttgagccca

SEQ ID NO: 1069147 - DNA, 20 bp, Homo sapiens
ccatcttgcttccctaatct

SEQ ID NO: 1069148 - DNA, 20 bp, Homo sapiens
ccatcttggtagttctgtgc

SEQ ID NO: 1069149 - DNA, 23 bp, Homo sapiens
ccatctttatagaaggaatttgt

SEQ ID NO: 1069150 - DNA, 16 bp, Homo sapiens
ccatcttttattcttt

SEQ ID NO: 1069151 - DNA, 21 bp, Homo sapiens
ccatgaaaaaaatgatcccca

SEQ ID NO: 1069152 - DNA, 13 bp, Homo sapiens
ccatgaaacaaag

SEQ ID NO: 1069153 - DNA, 10 bp, Homo sapiens
ccatgaaaga

SEQ ID NO: 1069154 - DNA, 17 bp, Homo sapiens
ccatgaagaaagcccct

SEQ ID NO: 1069155 - DNA, 13 bp, Homo sapiens
ccatgaagacagg

SEQ ID NO: 1069156 - DNA, 16 bp, Homo sapiens
cccaacccccctcctg

SEQ ID NO: 1069157 - DNA, 20 bp, Homo sapiens
cccaacccccctcctgctcc

SEQ ID NO: 1069158 - DNA, 14 bp, Homo sapiens
cccaaccccctgca

SEQ ID NO: 1069159 - DNA, 15 bp, Homo sapiens
cccaaccctgcccct

SEQ ID NO: 1069160 - DNA, 16 bp, Homo sapiens
cccaaccctgcccctg

SEQ ID NO: 1069161 - DNA, 13 bp, Homo sapiens
cccaaccctgggc

SEQ ID NO: 1069162 - DNA, 22 bp, Homo sapiens
cccaaccggggagcccccgccc

SEQ ID NO: 1069163 - DNA, 19 bp, Homo sapiens
cccaacctcaatgccctgc

SEQ ID NO: 1069164 - DNA, 12 bp, Homo sapiens
cccaacctcaga

SEQ ID NO: 1069165 - DNA, 17 bp, Homo sapiens
cccaacctttccctcac

SEQ ID NO: 1069166 - DNA, 20 bp, Homo sapiens
cccaacctttccctcacccc

SEQ ID NO: 1069167 - DNA, 16 bp, Homo sapiens
cccaacggggtgggga

SEQ ID NO: 1069168 - DNA, 15 bp, Homo sapiens
cccaactcctggaag

SEQ ID NO: 1069169 - DNA, 20 bp, Homo sapiens
cccaactcgggctcccgggt

SEQ ID NO: 1069170 - DNA, 21 bp, Homo sapiens
cccaactctagctgggggtgg

SEQ ID NO: 1069171 - DNA, 23 bp, Homo sapiens
cccaactctccccagtgcctgcc

SEQ ID NO: 1069172 - DNA, 20 bp, Homo sapiens
cccaactctcccctgacctg

SEQ ID NO: 1069173 - DNA, 17 bp, Homo sapiens
cccaactctgagcccat

SEQ ID NO: 1069174 - DNA, 18 bp, Homo sapiens
cccaactcttcctcccct

SEQ ID NO: 1069175 - DNA, 18 bp, Homo sapiens
cccaactgggggcaaagg

SEQ ID NO: 1069176 - DNA, 15 bp, Homo sapiens
cccaactgtcttttt

SEQ ID NO: 1069177 - DNA, 19 bp, Homo sapiens
cccaacttcatactggcag

SEQ ID NO: 1069178 - DNA, 22 bp, Homo sapiens
cccaagaaaccaaagtctgccg

SEQ ID NO: 1069179 - DNA, 12 bp, Homo sapiens
cccaagaactgc

SEQ ID NO: 1069180 - DNA, 23 bp, Homo sapiens
cccaagaactgcagatagcccag

SEQ ID NO: 1069181 - DNA, 20 bp, Homo sapiens
cccaagaatagatgctgact

SEQ ID NO: 1069182 - DNA, 17 bp, Homo sapiens
cccaagacacttcccct

SEQ ID NO: 1069183 - DNA, 20 bp, Homo sapiens
cccaagacagatgccccaga

SEQ ID NO: 1069184 - DNA, 15 bp, Homo sapiens
cccaagagaggaagg

SEQ ID NO: 1069185 - DNA, 20 bp, Homo sapiens
cccaagagaggaaggacccc

SEQ ID NO: 1069186 - DNA, 15 bp, Homo sapiens
cccaagagatgaaga

SEQ ID NO: 1069187 - DNA, 22 bp, Homo sapiens
cccaagagcagagtctgggcct

SEQ ID NO: 1069188 - DNA, 23 bp, Homo sapiens
cccaagagcagagtctgggcctc

SEQ ID NO: 1069189 - DNA, 23 bp, Homo sapiens
cccaagagccataagggggtggg

SEQ ID NO: 1069190 - DNA, 14 bp, Homo sapiens
cccaagaggactga

SEQ ID NO: 1069191 - DNA, 16 bp, Homo sapiens
cccaagaggtctgagc

SEQ ID NO: 1069192 - DNA, 21 bp, Homo sapiens
cccaagataggagttctctga

SEQ ID NO: 1069193 - DNA, 12 bp, Homo sapiens
cccaagcagcca

SEQ ID NO: 1069194 - DNA, 13 bp, Homo sapiens
cccaagcagccag

SEQ ID NO: 1069195 - DNA, 16 bp, Homo sapiens
cccaagcagccagcca

SEQ ID NO: 1069196 - DNA, 17 bp, Homo sapiens
cccaagcagccagccag

SEQ ID NO: 1069197 - DNA, 15 bp, Homo sapiens
cccaagccagaggct

SEQ ID NO: 1069198 - DNA, 15 bp, Homo sapiens
cccaagccctccttt

SEQ ID NO: 1069199 - DNA, 16 bp, Homo sapiens
cccaagccctcctttg

SEQ ID NO: 1069200 - DNA, 17 bp, Homo sapiens
cccaagcctgctggctg

SEQ ID NO: 1069201 - DNA, 13 bp, Homo sapiens
cccaagcggcctt

SEQ ID NO: 1069202 - DNA, 21 bp, Homo sapiens
cccaagcgttcctggccttct

SEQ ID NO: 1069203 - DNA, 22 bp, Homo sapiens
cccaagcgttcctggccttctg

SEQ ID NO: 1069204 - DNA, 13 bp, Homo sapiens
cccaagctcctcc

SEQ ID NO: 1069205 - DNA, 13 bp, Homo sapiens
cccaagctctggg

SEQ ID NO: 1069206 - DNA, 18 bp, Homo sapiens
cccaagctgtggcagccg

SEQ ID NO: 1069207 - DNA, 13 bp, Homo sapiens
cccaagcttctga

SEQ ID NO: 1069208 - DNA, 20 bp, Homo sapiens
cccaagcttggcagccgagc

SEQ ID NO: 1069209 - DNA, 21 bp, Homo sapiens
cccaaggaagctccttcctgt

SEQ ID NO: 1069210 - DNA, 17 bp, Homo sapiens
cccaaggaatcagcagg

SEQ ID NO: 1069211 - DNA, 18 bp, Homo sapiens
cccaaggaatcagcagga

SEQ ID NO: 1069212 - DNA, 18 bp, Homo sapiens
cccaaggactgagggcag

SEQ ID NO: 1069213 - DNA, 20 bp, Homo sapiens
cccaaggactgagggcagtg

SEQ ID NO: 1069214 - DNA, 18 bp, Homo sapiens
cccaaggagcacaggtcc

SEQ ID NO: 1069215 - DNA, 20 bp, Homo sapiens
cccaaggagcacaggtccca

SEQ ID NO: 1069216 - DNA, 15 bp, Homo sapiens
cccaaggagcttacc

SEQ ID NO: 1069217 - DNA, 22 bp, Homo sapiens
cccaaggagcttacccaagctg

SEQ ID NO: 1069218 - DNA, 16 bp, Homo sapiens
cccaaggatgaccaca

SEQ ID NO: 1069219 - DNA, 18 bp, Homo sapiens
cccaaggatgaccacacc

SEQ ID NO: 1069220 - DNA, 17 bp, Homo sapiens
cccaaggccccagggac

SEQ ID NO: 1069221 - DNA, 17 bp, Homo sapiens
cccaaggctcactgcag

SEQ ID NO: 1069222 - DNA, 16 bp, Homo sapiens
cccaagggcctcccac

SEQ ID NO: 1069223 - DNA, 19 bp, Homo sapiens
cccaagggcctcccaccag

SEQ ID NO: 1069224 - DNA, 17 bp, Homo sapiens
cccaaggtcccctccac

SEQ ID NO: 1069225 - DNA, 17 bp, Homo sapiens
cccaaggtcctctcagt

SEQ ID NO: 1069226 - DNA, 18 bp, Homo sapiens
cccaaggttactcagcag

SEQ ID NO: 1069227 - DNA, 20 bp, Homo sapiens
cccaaggttccagaggccct

SEQ ID NO: 1069228 - DNA, 21 bp, Homo sapiens
cccaagtcccagagcacctca

SEQ ID NO: 1069229 - DNA, 18 bp, Homo sapiens
cccaagtccctgttttct

SEQ ID NO: 1069230 - DNA, 23 bp, Homo sapiens
cccagcagaggtttgctgacagg

SEQ ID NO: 1069231 - DNA, 22 bp, Homo sapiens
cccagcaggcaggcactgtggc

SEQ ID NO: 1069232 - DNA, 24 bp, Homo sapiens
cccagcaggcaggcactgtggccc

SEQ ID NO: 1069233 - DNA, 17 bp, Homo sapiens
cccagcaggcccagcat

SEQ ID NO: 1069234 - DNA, 18 bp, Homo sapiens
cccagcagggccactccc

SEQ ID NO: 1069235 - DNA, 19 bp, Homo sapiens
cccagcagggcctcaaagt

SEQ ID NO: 1069236 - DNA, 22 bp, Homo sapiens
cccagcagggtcttttcatctg

SEQ ID NO: 1069237 - DNA, 18 bp, Homo sapiens
cccagcatcagcctgtag

SEQ ID NO: 1069238 - DNA, 17 bp, Homo sapiens
cccagcatccctggagc

SEQ ID NO: 1069239 - DNA, 13 bp, Homo sapiens
cccagcatgcagg

SEQ ID NO: 1069240 - DNA, 18 bp, Homo sapiens
cccagcattccagcccct

SEQ ID NO: 1069241 - DNA, 20 bp, Homo sapiens
cccagcattccagcccctct

SEQ ID NO: 1069242 - DNA, 22 bp, Homo sapiens
cccagcattccagcccctctgg

SEQ ID NO: 1069243 - DNA, 15 bp, Homo sapiens
cccagcattccagct

SEQ ID NO: 1069244 - DNA, 20 bp, Homo sapiens
cccagcattccagctctgcc

SEQ ID NO: 1069245 - DNA, 15 bp, Homo sapiens
cccagcattgctggt

SEQ ID NO: 1069246 - DNA, 17 bp, Homo sapiens
cccagccaaaccctgtc

SEQ ID NO: 1069247 - DNA, 14 bp, Homo sapiens
cccagccaacgaga

SEQ ID NO: 1069248 - DNA, 23 bp, Homo sapiens
cccagccaccaccctcaggtgcc

SEQ ID NO: 1069249 - DNA, 22 bp, Homo sapiens
cccagccaccccgggctctctg

SEQ ID NO: 1069250 - DNA, 14 bp, Homo sapiens
cccagccacccctc

SEQ ID NO: 1069251 - DNA, 15 bp, Homo sapiens
cccagccacccctca

SEQ ID NO: 1069252 - DNA, 19 bp, Homo sapiens
cccagccacgactgccatg

SEQ ID NO: 1069253 - DNA, 10 bp, Homo sapiens
cccagccact

SEQ ID NO: 1069254 - DNA, 15 bp, Homo sapiens
cccagccactccaag

SEQ ID NO: 1069255 - DNA, 22 bp, Homo sapiens
cccagccagatggactccagcc

SEQ ID NO: 1069256 - DNA, 13 bp, Homo sapiens
cccagccagccac

SEQ ID NO: 1069257 - DNA, 14 bp, Homo sapiens
cccagccagccacc

SEQ ID NO: 1069258 - DNA, 15 bp, Homo sapiens
cccagccagccaccc

SEQ ID NO: 1069259 - DNA, 14 bp, Homo sapiens
cccagccagcccgc

SEQ ID NO: 1069260 - DNA, 16 bp, Homo sapiens
cccagccagctgcagg

SEQ ID NO: 1069261 - DNA, 22 bp, Homo sapiens
cccagccaggccaacagcacct

SEQ ID NO: 1069262 - DNA, 24 bp, Homo sapiens
cccagccataaaagcattgtctct

SEQ ID NO: 1069263 - DNA, 16 bp, Homo sapiens
cccagccatctgccca

SEQ ID NO: 1069264 - DNA, 18 bp, Homo sapiens
cccagccatctgcccagg

SEQ ID NO: 1069265 - DNA, 21 bp, Homo sapiens
cccagccatctgcccaggggt

SEQ ID NO: 1069266 - DNA, 23 bp, Homo sapiens
cccagccatctgcccaggggtgc

SEQ ID NO: 1069267 - DNA, 15 bp, Homo sapiens
cccagccatgccagc

SEQ ID NO: 1069268 - DNA, 18 bp, Homo sapiens
cccagccatgccagctgg

SEQ ID NO: 1069269 - DNA, 12 bp, Homo sapiens
cccagccatgtg

SEQ ID NO: 1069270 - DNA, 20 bp, Homo sapiens
cccagccattaccatggaga

SEQ ID NO: 1069271 - DNA, 22 bp, Homo sapiens
cccagccattaccatggagaca

SEQ ID NO: 1069272 - DNA, 12 bp, Homo sapiens
cccagcccacag

SEQ ID NO: 1069273 - DNA, 13 bp, Homo sapiens
cccagcccacaga

SEQ ID NO: 1069274 - DNA, 19 bp, Homo sapiens
cccagcccacagagcctga

SEQ ID NO: 1069275 - DNA, 11 bp, Homo sapiens
cccagcccacc

SEQ ID NO: 1069276 - DNA, 23 bp, Homo sapiens
cccagcccaccctgctcctcctg

SEQ ID NO: 1069277 - DNA, 21 bp, Homo sapiens
cccagcccacctcaacccaga

SEQ ID NO: 1069278 - DNA, 21 bp, Homo sapiens
cccagcccagagccacctgga

SEQ ID NO: 1069279 - DNA, 12 bp, Homo sapiens
cccagcccagat

SEQ ID NO: 1069280 - DNA, 20 bp, Homo sapiens
cccagcccagattcccctgt

SEQ ID NO: 1069281 - DNA, 11 bp, Homo sapiens
cccagcccagg

SEQ ID NO: 1069282 - DNA, 18 bp, Homo sapiens
cccagcccagggctcctg

SEQ ID NO: 1069283 - DNA, 21 bp, Homo sapiens
cccagcccagggttcccccag

SEQ ID NO: 1069284 - DNA, 22 bp, Homo sapiens
cccagcccatccattaggccag

SEQ ID NO: 1069285 - DNA, 21 bp, Homo sapiens
cccagcccattctctctcctg

SEQ ID NO: 1069286 - DNA, 16 bp, Homo sapiens
cccagcccattgctgc

SEQ ID NO: 1069287 - DNA, 12 bp, Homo sapiens
cccagccccagg

SEQ ID NO: 1069288 - DNA, 17 bp, Homo sapiens
cccagccccaggcctgg

SEQ ID NO: 1069289 - DNA, 18 bp, Homo sapiens
cccagccccgactccagc

SEQ ID NO: 1069290 - DNA, 20 bp, Homo sapiens
cccagccccgactccagcca

SEQ ID NO: 1069291 - DNA, 21 bp, Homo sapiens
cccagccccgactccagccag

SEQ ID NO: 1069292 - DNA, 15 bp, Homo sapiens
cccagccccggggtg

SEQ ID NO: 1069293 - DNA, 22 bp, Homo sapiens
cccagcccctagaaacccaagc

SEQ ID NO: 1069294 - DNA, 17 bp, Homo sapiens
cccagccccttctccca

SEQ ID NO: 1069295 - DNA, 15 bp, Homo sapiens
cccagccccttttct

SEQ ID NO: 1069296 - DNA, 18 bp, Homo sapiens
cccagccccttttctctg

SEQ ID NO: 1069297 - DNA, 20 bp, Homo sapiens
cccagccccttttctctgct

SEQ ID NO: 1069298 - DNA, 21 bp, Homo sapiens
cccagccccttttctctgctc

SEQ ID NO: 1069299 - DNA, 18 bp, Homo sapiens
cccagcccgcggcctgga

SEQ ID NO: 1069300 - DNA, 19 bp, Homo sapiens
cccagcccgcggcctggac

SEQ ID NO: 1069301 - DNA, 20 bp, Homo sapiens
cccagcccgcggcctggacc

SEQ ID NO: 1069302 - DNA, 21 bp, Homo sapiens
cccagcccgcggcctggaccc

SEQ ID NO: 1069303 - DNA, 20 bp, Homo sapiens
cccagcccggaccttggcag

SEQ ID NO: 1069304 - DNA, 18 bp, Homo sapiens
cccagccctatggatgtg

SEQ ID NO: 1069305 - DNA, 15 bp, Homo sapiens
cccagccctcagtca

SEQ ID NO: 1069306 - DNA, 15 bp, Homo sapiens
cccagccctggctct

SEQ ID NO: 1069307 - DNA, 16 bp, Homo sapiens
cccagccctggctctg

SEQ ID NO: 1069308 - DNA, 13 bp, Homo sapiens
cccagccctggga

SEQ ID NO: 1069309 - DNA, 14 bp, Homo sapiens
cccagccctgggct

SEQ ID NO: 1069310 - DNA, 15 bp, Homo sapiens
cccagccctggggga

SEQ ID NO: 1069311 - DNA, 16 bp, Homo sapiens
cccagccctgtggaag

SEQ ID NO: 1069312 - DNA, 15 bp, Homo sapiens
cccagcccttagcac

SEQ ID NO: 1069313 - DNA, 22 bp, Homo sapiens
cccagcccttagcacagagagg

SEQ ID NO: 1069314 - DNA, 17 bp, Homo sapiens
cccagcccttccttggg

SEQ ID NO: 1069315 - DNA, 16 bp, Homo sapiens
cccagccggcctctct

SEQ ID NO: 1069316 - DNA, 21 bp, Homo sapiens
cccagccggcctctctggcct

SEQ ID NO: 1069317 - DNA, 19 bp, Homo sapiens
cccagcctagtcagggcac

SEQ ID NO: 1069318 - DNA, 15 bp, Homo sapiens
cccagcctatgagca

SEQ ID NO: 1069319 - DNA, 20 bp, Homo sapiens
cccagcctcaatgtcacttg

SEQ ID NO: 1069320 - DNA, 16 bp, Homo sapiens
cccagcctcagcccaa

SEQ ID NO: 1069321 - DNA, 14 bp, Homo sapiens
cccagcctccaggc

SEQ ID NO: 1069322 - DNA, 16 bp, Homo sapiens
cccagcctcctgaggg

SEQ ID NO: 1069323 - DNA, 23 bp, Homo sapiens
cccagcctctccccgctctggat

SEQ ID NO: 1069324 - DNA, 10 bp, Homo sapiens
cccagcctga

SEQ ID NO: 1069325 - DNA, 18 bp, Homo sapiens
cccagcctgacctgagac

SEQ ID NO: 1069326 - DNA, 12 bp, Homo sapiens
cccagcctgctg

SEQ ID NO: 1069327 - DNA, 22 bp, Homo sapiens
cccagcctgctgagagccccca

SEQ ID NO: 1069328 - DNA, 12 bp, Homo sapiens
cccagcctggcc

SEQ ID NO: 1069329 - DNA, 13 bp, Homo sapiens
cccagcctgggcc

SEQ ID NO: 1069330 - DNA, 14 bp, Homo sapiens
cccagcctggggct

SEQ ID NO: 1069331 - DNA, 19 bp, Homo sapiens
cccagcctggggctccctc

SEQ ID NO: 1069332 - DNA, 12 bp, Homo sapiens
cccagcctgtgg

SEQ ID NO: 1069333 - DNA, 15 bp, Homo sapiens
cccagccttagatgc

SEQ ID NO: 1069334 - DNA, 17 bp, Homo sapiens
cccagcgagccacagga

SEQ ID NO: 1069335 - DNA, 18 bp, Homo sapiens
cccagcgagccacaggaa

SEQ ID NO: 1069336 - DNA, 23 bp, Homo sapiens
cccagcgagccacaggaacggcc

SEQ ID NO: 1069337 - DNA, 23 bp, Homo sapiens
cccagcggccccccgcacagcca

SEQ ID NO: 1069338 - DNA, 22 bp, Homo sapiens
cccagcggcttagccaagccct

SEQ ID NO: 1069339 - DNA, 15 bp, Homo sapiens
cccagcggtccctgc

SEQ ID NO: 1069340 - DNA, 21 bp, Homo sapiens
cccagcgtcaggcctacctca

SEQ ID NO: 1069341 - DNA, 20 bp, Homo sapiens
cccagcgtcagtttcactcc

SEQ ID NO: 1069342 - DNA, 14 bp, Homo sapiens
cccagcgtctgcag

SEQ ID NO: 1069343 - DNA, 16 bp, Homo sapiens
cccagcgtctgcaggg

SEQ ID NO: 1069344 - DNA, 17 bp, Homo sapiens
cccagcgtggcccaggc

SEQ ID NO: 1069345 - DNA, 18 bp, Homo sapiens
cccagctaatctgtaggg

SEQ ID NO: 1069346 - DNA, 23 bp, Homo sapiens
cccagctaatctgtagggctgga

SEQ ID NO: 1069347 - DNA, 17 bp, Homo sapiens
cccagctacattcctca

SEQ ID NO: 1069348 - DNA, 17 bp, Homo sapiens
cccaggttcgagaccca

SEQ ID NO: 1069349 - DNA, 17 bp, Homo sapiens
cccagtattactgctgc

SEQ ID NO: 1069350 - DNA, 20 bp, Homo sapiens
cccagtattactgctgctgt

SEQ ID NO: 1069351 - DNA, 13 bp, Homo sapiens
cccagtcactcct

SEQ ID NO: 1069352 - DNA, 19 bp, Homo sapiens
cccagtccaaatgtcctcc

SEQ ID NO: 1069353 - DNA, 23 bp, Homo sapiens
cccagtccaaatgtcctccagaa

SEQ ID NO: 1069354 - DNA, 17 bp, Homo sapiens
cccagtcccacactgtg

SEQ ID NO: 1069355 - DNA, 19 bp, Homo sapiens
cccagtccccacccctgcc

SEQ ID NO: 1069356 - DNA, 23 bp, Homo sapiens
cccagtccccacccctgccccca

SEQ ID NO: 1069357 - DNA, 17 bp, Homo sapiens
cccagtccccagccctg

SEQ ID NO: 1069358 - DNA, 18 bp, Homo sapiens
cccagtccccagccctgg

SEQ ID NO: 1069359 - DNA, 19 bp, Homo sapiens
cccagtccccagccctggg

SEQ ID NO: 1069360 - DNA, 20 bp, Homo sapiens
cccagtccccagccctgggc

SEQ ID NO: 1069361 - DNA, 12 bp, Homo sapiens
cccagtcctggg

SEQ ID NO: 1069362 - DNA, 13 bp, Homo sapiens
cccagtcctgggt

SEQ ID NO: 1069363 - DNA, 15 bp, Homo sapiens
cccagtcctgggttg

SEQ ID NO: 1069364 - DNA, 16 bp, Homo sapiens
cccagtcctgggttgt

SEQ ID NO: 1069365 - DNA, 16 bp, Homo sapiens
cccagtccttccacct

SEQ ID NO: 1069366 - DNA, 14 bp, Homo sapiens
cccagtcgagacct

SEQ ID NO: 1069367 - DNA, 18 bp, Homo sapiens
cccaggcatgcagctgcc

SEQ ID NO: 1069368 - DNA, 18 bp, Homo sapiens
cccaggccacccccatgg

SEQ ID NO: 1069369 - DNA, 20 bp, Homo sapiens
cccaggccagcccccccacc

SEQ ID NO: 1069370 - DNA, 22 bp, Homo sapiens
cccaggccagcccccccaccca

SEQ ID NO: 1069371 - DNA, 13 bp, Homo sapiens
cccaggccaggcc

SEQ ID NO: 1069372 - DNA, 22 bp, Homo sapiens
cccaggccaggccaccaggatg

SEQ ID NO: 1069373 - DNA, 13 bp, Homo sapiens
cccaggccaggtg

SEQ ID NO: 1069374 - DNA, 20 bp, Homo sapiens
cccaggccaggtgaggtcca

SEQ ID NO: 1069375 - DNA, 17 bp, Homo sapiens
cccaggccatgtggcct

SEQ ID NO: 1069376 - DNA, 23 bp, Homo sapiens
cccaggccatgtggcctgcccag

SEQ ID NO: 1069377 - DNA, 18 bp, Homo sapiens
cccaggcccaccatcacc

SEQ ID NO: 1069378 - DNA, 22 bp, Homo sapiens
cccaggcccactgtgcctcaga

SEQ ID NO: 1069379 - DNA, 12 bp, Homo sapiens
cccaggcccagc

SEQ ID NO: 1069380 - DNA, 17 bp, Homo sapiens
cccaggccccagacagg

SEQ ID NO: 1069381 - DNA, 14 bp, Homo sapiens
cccaggccctacaa

SEQ ID NO: 1069382 - DNA, 13 bp, Homo sapiens
cccaggccctcca

SEQ ID NO: 1069383 - DNA, 13 bp, Homo sapiens
cccaggccctccc

SEQ ID NO: 1069384 - DNA, 17 bp, Homo sapiens
cccaggccctccctgac

SEQ ID NO: 1069385 - DNA, 17 bp, Homo sapiens
cccaggcccttggctgc

SEQ ID NO: 1069386 - DNA, 14 bp, Homo sapiens
cccaggccgcagct

SEQ ID NO: 1069387 - DNA, 16 bp, Homo sapiens
cccaggccgcagctct

SEQ ID NO: 1069388 - DNA, 19 bp, Homo sapiens
cccaggccggagcccagat

SEQ ID NO: 1069389 - DNA, 17 bp, Homo sapiens
ccccagggaaggaaaaa

SEQ ID NO: 1069390 - DNA, 17 bp, Homo sapiens
ccccagggacagaggcc

SEQ ID NO: 1069391 - DNA, 23 bp, Homo sapiens
ccccagggcagggtgggcagcct

SEQ ID NO: 1069392 - DNA, 11 bp, Homo sapiens
ccccagggccc

SEQ ID NO: 1069393 - DNA, 21 bp, Homo sapiens
ccccagggcccctccctctgc

SEQ ID NO: 1069394 - DNA, 15 bp, Homo sapiens
ccccagggcctccag

SEQ ID NO: 1069395 - DNA, 12 bp, Homo sapiens
ccccagggcctg

SEQ ID NO: 1069396 - DNA, 13 bp, Homo sapiens
ccccagggcctgg

SEQ ID NO: 1069397 - DNA, 19 bp, Homo sapiens
ccccagggcctgtctccct

SEQ ID NO: 1069398 - DNA, 20 bp, Homo sapiens
ccccagggcctgtctccctt

SEQ ID NO: 1069399 - DNA, 21 bp, Homo sapiens
ccccagggcctgtctcccttc

SEQ ID NO: 1069400 - DNA, 16 bp, Homo sapiens
ccccaggggaaaatga

SEQ ID NO: 1069401 - DNA, 19 bp, Homo sapiens
ccccaggggaaagatgagc

SEQ ID NO: 1069402 - DNA, 21 bp, Homo sapiens
ccccaggggacgtgggccctg

SEQ ID NO: 1069403 - DNA, 11 bp, Homo sapiens
ccccagggtgg

SEQ ID NO: 1069404 - DNA, 17 bp, Homo sapiens
ccccaggtcagccctgt

SEQ ID NO: 1069405 - DNA, 21 bp, Homo sapiens
ccccaggtcagccctgtgtct

SEQ ID NO: 1069406 - DNA, 24 bp, Homo sapiens
ccccaggtcaggggctccctacat

SEQ ID NO: 1069407 - DNA, 22 bp, Homo sapiens
ccccaggtccagctctggaggg

SEQ ID NO: 1069408 - DNA, 16 bp, Homo sapiens
ccccaggtccccaaac

SEQ ID NO: 1069409 - DNA, 17 bp, Homo sapiens
ccccaggtcttcctgct

SEQ ID NO: 1069410 - DNA, 14 bp, Homo sapiens
ccccaggtcttttc

SEQ ID NO: 1069411 - DNA, 16 bp, Homo sapiens
ccccaggtcttttctt

SEQ ID NO: 1069412 - DNA, 20 bp, Homo sapiens
ccccaggtgcagccccaggg

SEQ ID NO: 1069413 - DNA, 22 bp, Homo sapiens
ccccaggtgcagccccagggcc

SEQ ID NO: 1069414 - DNA, 23 bp, Homo sapiens
ccccaggtggctgacccagtccc

SEQ ID NO: 1069415 - DNA, 11 bp, Homo sapiens
ccccagtccca

SEQ ID NO: 1069416 - DNA, 15 bp, Homo sapiens
ccccagtccccagcc

SEQ ID NO: 1069417 - DNA, 19 bp, Homo sapiens
ccccagtcctcactgtcct

SEQ ID NO: 1069418 - DNA, 20 bp, Homo sapiens
ccccagtcctcactgtcctg

SEQ ID NO: 1069419 - DNA, 21 bp, Homo sapiens
ccccagtcctcactgtcctgt

SEQ ID NO: 1069420 - DNA, 22 bp, Homo sapiens
ccccagtcgtgatgtggaggaa

SEQ ID NO: 1069421 - DNA, 13 bp, Homo sapiens
ccccagtcttcct

SEQ ID NO: 1069422 - DNA, 15 bp, Homo sapiens
ccccagtcttccttg

SEQ ID NO: 1069423 - DNA, 19 bp, Homo sapiens
ccccagtgcagggctggtc

SEQ ID NO: 1069424 - DNA, 14 bp, Homo sapiens
ccccagtgcctgcc

SEQ ID NO: 1069425 - DNA, 24 bp, Homo sapiens
ccccagtgcctgccactctctggg

SEQ ID NO: 1069426 - DNA, 18 bp, Homo sapiens
ccccagtgtattttgtcc

SEQ ID NO: 1069427 - DNA, 21 bp, Homo sapiens
ccccagtgtattttgtccaag

SEQ ID NO: 1069428 - DNA, 23 bp, Homo sapiens
ccccagttaatactccagagaca

SEQ ID NO: 1069429 - DNA, 23 bp, Homo sapiens
ccccagttctaggggagaagagc

SEQ ID NO: 1069430 - DNA, 15 bp, Homo sapiens
ccccagttctgctcc

SEQ ID NO: 1069431 - DNA, 23 bp, Homo sapiens
ccccagttctgctcctctccagg

SEQ ID NO: 1069432 - DNA, 13 bp, Homo sapiens
ccccagtttgggg

SEQ ID NO: 1069433 - DNA, 16 bp, Homo sapiens
ccccagtttggggtgc

SEQ ID NO: 1069434 - DNA, 19 bp, Homo sapiens
ccccataataaccctgcca

SEQ ID NO: 1069435 - DNA, 22 bp, Homo sapiens
ccccataataaccctgccagtg

SEQ ID NO: 1069436 - DNA, 13 bp, Homo sapiens
ccccatacccctt

SEQ ID NO: 1069437 - DNA, 23 bp, Homo sapiens
ccccataccccttattgctgcca

SEQ ID NO: 1069438 - DNA, 14 bp, Homo sapiens
ccccatatggtcat

SEQ ID NO: 1069439 - DNA, 22 bp, Homo sapiens
ccccatcacctctactgtctcc

SEQ ID NO: 1069440 - DNA, 19 bp, Homo sapiens
ccccatcactgcgccactg

SEQ ID NO: 1069441 - DNA, 19 bp, Homo sapiens
ccccatcagaacctgagct

SEQ ID NO: 1069442 - DNA, 13 bp, Homo sapiens
ccccatcagtgct

SEQ ID NO: 1069443 - DNA, 20 bp, Homo sapiens
ccccatcagtgctccctcac

SEQ ID NO: 1069444 - DNA, 18 bp, Homo sapiens
ccccatcagttcccccag

SEQ ID NO: 1069445 - DNA, 16 bp, Homo sapiens
ccccatccagccacgg

SEQ ID NO: 1069446 - DNA, 16 bp, Homo sapiens
ccccatcccacaccct

SEQ ID NO: 1069447 - DNA, 22 bp, Homo sapiens
ccccatcccattttcatcctga

SEQ ID NO: 1069448 - DNA, 12 bp, Homo sapiens
ccccatccccac

SEQ ID NO: 1069449 - DNA, 13 bp, Homo sapiens
ccccatccctacc

SEQ ID NO: 1069450 - DNA, 18 bp, Homo sapiens
ccccatcctcatccctga

SEQ ID NO: 1069451 - DNA, 19 bp, Homo sapiens
ccccatcctcatccctgac

SEQ ID NO: 1069452 - DNA, 14 bp, Homo sapiens
ccccatcctccagc

SEQ ID NO: 1069453 - DNA, 17 bp, Homo sapiens
ccccatcctccccttcc

SEQ ID NO: 1069454 - DNA, 19 bp, Homo sapiens
ccccatcggccctgtcccc

SEQ ID NO: 1069455 - DNA, 15 bp, Homo sapiens
ccccatctcatcctg

SEQ ID NO: 1069456 - DNA, 14 bp, Homo sapiens
ccccatctccccag

SEQ ID NO: 1069457 - DNA, 19 bp, Homo sapiens
ccccatctccccaggcctc

SEQ ID NO: 1069458 - DNA, 18 bp, Homo sapiens
ccccatctccctgcctgg

SEQ ID NO: 1069459 - DNA, 16 bp, Homo sapiens
ccccatctcggggctg

SEQ ID NO: 1069460 - DNA, 20 bp, Homo sapiens
ccccatctcggggctgctgt

SEQ ID NO: 1069461 - DNA, 15 bp, Homo sapiens
ccccatctctcatcc

SEQ ID NO: 1069462 - DNA, 19 bp, Homo sapiens
ccccatctctccctcccct

SEQ ID NO: 1069463 - DNA, 11 bp, Homo sapiens
ccccatctctg

SEQ ID NO: 1069464 - DNA, 12 bp, Homo sapiens
ccccatctctga

SEQ ID NO: 1069465 - DNA, 16 bp, Homo sapiens
ccccatctctgtctgg

SEQ ID NO: 1069466 - DNA, 18 bp, Homo sapiens
ccccatctctgtctgggg

SEQ ID NO: 1069467 - DNA, 19 bp, Homo sapiens
ccccatctgtccagctggg

SEQ ID NO: 1069468 - DNA, 21 bp, Homo sapiens
ccccatctgtccagctggggc

SEQ ID NO: 1069469 - DNA, 12 bp, Homo sapiens
ccccatctgtct

SEQ ID NO: 1069470 - DNA, 13 bp, Homo sapiens
ccccatctgtgaa

SEQ ID NO: 1069471 - DNA, 21 bp, Homo sapiens
ccccatcttccacctgtgccc

SEQ ID NO: 1069472 - DNA, 20 bp, Homo sapiens
ccccatcttgatctttgagc

SEQ ID NO: 1069473 - DNA, 21 bp, Homo sapiens
ccccatcttgatctttgagcc

SEQ ID NO: 1069474 - DNA, 12 bp, Homo sapiens
ccccatcttgct

SEQ ID NO: 1069475 - DNA, 21 bp, Homo sapiens
ccccatctttgatccttctga

SEQ ID NO: 1069476 - DNA, 15 bp, Homo sapiens
ccccatgaggaagga

SEQ ID NO: 1069477 - DNA, 15 bp, Homo sapiens
ccccatgcctgtcca

SEQ ID NO: 1069478 - DNA, 19 bp, Homo sapiens
ccccatgcctgtccagcct

SEQ ID NO: 1069479 - DNA, 22 bp, Homo sapiens
ccccatgcctgtccagcctggg

SEQ ID NO: 1069480 - DNA, 13 bp, Homo sapiens
ccccatgctctgc

SEQ ID NO: 1069481 - DNA, 21 bp, Homo sapiens
ccccatgctctgccccaagcc

SEQ ID NO: 1069482 - DNA, 22 bp, Homo sapiens
ccccatgctctgccccaagccc

SEQ ID NO: 1069483 - DNA, 21 bp, Homo sapiens
ccccatggcttgttctctgga

SEQ ID NO: 1069484 - DNA, 14 bp, Homo sapiens
ccccatgggcacag

SEQ ID NO: 1069485 - DNA, 17 bp, Homo sapiens
ccccatgggctgtgtcc

SEQ ID NO: 1069486 - DNA, 15 bp, Homo sapiens
ccccatgggcttgga

SEQ ID NO: 1069487 - DNA, 21 bp, Homo sapiens
ccccatggtgctaggaagagg

SEQ ID NO: 1069488 - DNA, 21 bp, Homo sapiens
ccccatgtgccttgtccagga

SEQ ID NO: 1069489 - DNA, 23 bp, Homo sapiens
ccccatgtgccttgtccaggaac

SEQ ID NO: 1069490 - DNA, 15 bp, Homo sapiens
ccccatgtgccttta

SEQ ID NO: 1069491 - DNA, 18 bp, Homo sapiens
ccccatgtggcagcccat

SEQ ID NO: 1069492 - DNA, 20 bp, Homo sapiens
ccccatgtggcagcccatgg

SEQ ID NO: 1069493 - DNA, 18 bp, Homo sapiens
ccccatgtgtcctggttc

SEQ ID NO: 1069494 - DNA, 21 bp, Homo sapiens
ccccatgttgtaatgctgcac

SEQ ID NO: 1069495 - DNA, 13 bp, Homo sapiens
ccccattctcatc

SEQ ID NO: 1069496 - DNA, 15 bp, Homo sapiens
ccccattctcccagt

SEQ ID NO: 1069497 - DNA, 16 bp, Homo sapiens
ccccattctgagctcc

SEQ ID NO: 1069498 - DNA, 23 bp, Homo sapiens
ccccattcttcctagttttctcc

SEQ ID NO: 1069499 - DNA, 19 bp, Homo sapiens
ccccatttcccatctgcac

SEQ ID NO: 1069500 - DNA, 20 bp, Homo sapiens
ccccatttcccatctgcacc

SEQ ID NO: 1069501 - DNA, 14 bp, Homo sapiens
ccccatttcccgca

SEQ ID NO: 1069502 - DNA, 14 bp, Homo sapiens
ccccatttcctgta

SEQ ID NO: 1069503 - DNA, 21 bp, Homo sapiens
ccccatttcctgtacaatcat

SEQ ID NO: 1069504 - DNA, 16 bp, Homo sapiens
ccccatttgtcccaga

SEQ ID NO: 1069505 - DNA, 22 bp, Homo sapiens
cccccaaacatagcccctgccc

SEQ ID NO: 1069506 - DNA, 21 bp, Homo sapiens
cccccaaacatctggcatggc

SEQ ID NO: 1069507 - DNA, 17 bp, Homo sapiens
cccccaaagtgctggga

SEQ ID NO: 1069508 - DNA, 23 bp, Homo sapiens
cccccaacactgtgccctggtgg

SEQ ID NO: 1069509 - DNA, 16 bp, Homo sapiens
cccccaacccccagag

SEQ ID NO: 1069510 - DNA, 16 bp, Homo sapiens
cccttgcctgcctcct

SEQ ID NO: 1069511 - DNA, 17 bp, Homo sapiens
cccttgcctgcctccta

SEQ ID NO: 1069512 - DNA, 20 bp, Homo sapiens
cccttgcctgcctcctaggc

SEQ ID NO: 1069513 - DNA, 22 bp, Homo sapiens
cccttgctgatgctcctccggg

SEQ ID NO: 1069514 - DNA, 23 bp, Homo sapiens
cccttgctgatgctcctccgggt

SEQ ID NO: 1069515 - DNA, 13 bp, Homo sapiens
cccttgctgcccg

SEQ ID NO: 1069516 - DNA, 13 bp, Homo sapiens
cccttgctggccc

SEQ ID NO: 1069517 - DNA, 16 bp, Homo sapiens
cccttgctggccccag

SEQ ID NO: 1069518 - DNA, 20 bp, Homo sapiens
cccttgctggccccagccct

SEQ ID NO: 1069519 - DNA, 21 bp, Homo sapiens
cccttgctgtatgctgatcat

SEQ ID NO: 1069520 - DNA, 20 bp, Homo sapiens
cccttgctttcctgggcctt

SEQ ID NO: 1069521 - DNA, 17 bp, Homo sapiens
cccttggaaacctgccc

SEQ ID NO: 1069522 - DNA, 16 bp, Homo sapiens
cccttggacctccagg

SEQ ID NO: 1069523 - DNA, 17 bp, Homo sapiens
cccttggacctccaggg

SEQ ID NO: 1069524 - DNA, 19 bp, Homo sapiens
cccttggacctccaggggc

SEQ ID NO: 1069525 - DNA, 14 bp, Homo sapiens
cccttggagggaga

SEQ ID NO: 1069526 - DNA, 16 bp, Homo sapiens
cccttggcaccaccag

SEQ ID NO: 1069527 - DNA, 21 bp, Homo sapiens
cccttggcaccaccagggtgg

SEQ ID NO: 1069528 - DNA, 14 bp, Homo sapiens
cccttggccccaga

SEQ ID NO: 1069529 - DNA, 15 bp, Homo sapiens
cccttggcccctcac

SEQ ID NO: 1069530 - DNA, 13 bp, Homo sapiens
cccttggcctcag

SEQ ID NO: 1069531 - DNA, 14 bp, Homo sapiens
cccttggcctcaga

SEQ ID NO: 1069532 - DNA, 20 bp, Homo sapiens
cccttggcctccatttctgt

SEQ ID NO: 1069533 - DNA, 16 bp, Homo sapiens
cccttggcctgtctca

SEQ ID NO: 1069534 - DNA, 15 bp, Homo sapiens
cccttggctcaatcc

SEQ ID NO: 1069535 - DNA, 19 bp, Homo sapiens
cccttggctggatcaggga

SEQ ID NO: 1069536 - DNA, 19 bp, Homo sapiens
cccttggcttcctccgtcc

SEQ ID NO: 1069537 - DNA, 18 bp, Homo sapiens
cccttggcttctgtgatg

SEQ ID NO: 1069538 - DNA, 18 bp, Homo sapiens
cccttgggaaggacacag

SEQ ID NO: 1069539 - DNA, 15 bp, Homo sapiens
cccttgggcagttct

SEQ ID NO: 1069540 - DNA, 18 bp, Homo sapiens
cccttgggcggctgagag

SEQ ID NO: 1069541 - DNA, 18 bp, Homo sapiens
cccttggggcctggcttg

SEQ ID NO: 1069542 - DNA, 16 bp, Homo sapiens
cccttgggttctgata

SEQ ID NO: 1069543 - DNA, 19 bp, Homo sapiens
cccttggtcccaagcctga

SEQ ID NO: 1069544 - DNA, 22 bp, Homo sapiens
cccttggtgtttcccttcctcg

SEQ ID NO: 1069545 - DNA, 14 bp, Homo sapiens
cccttggttctgca

SEQ ID NO: 1069546 - DNA, 18 bp, Homo sapiens
cccttgtcctgccagctg

SEQ ID NO: 1069547 - DNA, 23 bp, Homo sapiens
cccttgtcgcgcgtctcccatcc

SEQ ID NO: 1069548 - DNA, 14 bp, Homo sapiens
cccttgtctcagat

SEQ ID NO: 1069549 - DNA, 19 bp, Homo sapiens
cccttgtcttcccccctct

SEQ ID NO: 1069550 - DNA, 23 bp, Homo sapiens
cccttgtcttcccccctctcctc

SEQ ID NO: 1069551 - DNA, 18 bp, Homo sapiens
cccttgtgctcctctcgc

SEQ ID NO: 1069552 - DNA, 18 bp, Homo sapiens
cccttgtgtgtgccctgg

SEQ ID NO: 1069553 - DNA, 16 bp, Homo sapiens
cccttgttccagcttt

SEQ ID NO: 1069554 - DNA, 19 bp, Homo sapiens
cccttgtttgtcccttcta

SEQ ID NO: 1069555 - DNA, 17 bp, Homo sapiens
ccctttaaatcaccata

SEQ ID NO: 1069556 - DNA, 17 bp, Homo sapiens
ccctttagggctgttgc

SEQ ID NO: 1069557 - DNA, 16 bp, Homo sapiens
ccctttcacactggat

SEQ ID NO: 1069558 - DNA, 16 bp, Homo sapiens
ccctttcagagacagc

SEQ ID NO: 1069559 - DNA, 20 bp, Homo sapiens
ccctttcagatgtcttctgc

SEQ ID NO: 1069560 - DNA, 20 bp, Homo sapiens
ccctttcatcggtgcctggt

SEQ ID NO: 1069561 - DNA, 16 bp, Homo sapiens
ccctttccccacgccc

SEQ ID NO: 1069562 - DNA, 15 bp, Homo sapiens
ccctttccctacctt

SEQ ID NO: 1069563 - DNA, 12 bp, Homo sapiens
ccctttcctccc

SEQ ID NO: 1069564 - DNA, 22 bp, Homo sapiens
ccctttcctccccatacacaca

SEQ ID NO: 1069565 - DNA, 13 bp, Homo sapiens
ccctttcctgcgg

SEQ ID NO: 1069566 - DNA, 14 bp, Homo sapiens
ccctttcctgtccc

SEQ ID NO: 1069567 - DNA, 13 bp, Homo sapiens
ccctttccttcca

SEQ ID NO: 1069568 - DNA, 21 bp, Homo sapiens
ccctttccttccttccctggc

SEQ ID NO: 1069569 - DNA, 14 bp, Homo sapiens
ccctttcctttgga

SEQ ID NO: 1069570 - DNA, 13 bp, Homo sapiens
ccctttctctctc

SEQ ID NO: 1069571 - DNA, 23 bp, Homo sapiens
ccctttctctctcctctctgctt

SEQ ID NO: 1069572 - DNA, 14 bp, Homo sapiens
ccctttctcttctt

SEQ ID NO: 1069573 - DNA, 12 bp, Homo sapiens
ccctttctgtgt

SEQ ID NO: 1069574 - DNA, 17 bp, Homo sapiens
ccctttcttgacaaaac

SEQ ID NO: 1069575 - DNA, 15 bp, Homo sapiens
ccctttcttggccag

SEQ ID NO: 1069576 - DNA, 16 bp, Homo sapiens
ccctttgaagataata

SEQ ID NO: 1069577 - DNA, 23 bp, Homo sapiens
ccctttgaagataataatcttgg

SEQ ID NO: 1069578 - DNA, 17 bp, Homo sapiens
ccctttgaagcctcagc

SEQ ID NO: 1069579 - DNA, 18 bp, Homo sapiens
ccctttgaagcctcagct

SEQ ID NO: 1069580 - DNA, 21 bp, Homo sapiens
ccctttgaagcctcagctacc

SEQ ID NO: 1069581 - DNA, 15 bp, Homo sapiens
ccctttgaccttccc

SEQ ID NO: 1069582 - DNA, 15 bp, Homo sapiens
ccctttgacttcagc

SEQ ID NO: 1069583 - DNA, 21 bp, Homo sapiens
ccctttgacttcagctgcctg

SEQ ID NO: 1069584 - DNA, 22 bp, Homo sapiens
ccctttgcagtgtgcagggtgg

SEQ ID NO: 1069585 - DNA, 22 bp, Homo sapiens
ccctttgcatagctctccttcc

SEQ ID NO: 1069586 - DNA, 12 bp, Homo sapiens
ccctttgcctct

SEQ ID NO: 1069587 - DNA, 18 bp, Homo sapiens
ccctttgcctctgtcctc

SEQ ID NO: 1069588 - DNA, 21 bp, Homo sapiens
ccctttgcctctgtcctccca

SEQ ID NO: 1069589 - DNA, 22 bp, Homo sapiens
ccctttgccttaaacctgaaga

SEQ ID NO: 1069590 - DNA, 20 bp, Homo sapiens
ccctttgctctgatttcctt

SEQ ID NO: 1069591 - DNA, 18 bp, Homo sapiens
ccgccgcagaagcagccc

SEQ ID NO: 1069592 - DNA, 18 bp, Homo sapiens
ccgccgcctcccacggca

SEQ ID NO: 1069593 - DNA, 22 bp, Homo sapiens
ccgcctactggacgctgccctg

SEQ ID NO: 1069594 - DNA, 16 bp, Homo sapiens
ccgcctagtttactgt

SEQ ID NO: 1069595 - DNA, 21 bp, Homo sapiens
ccgcctccactctagttctag

SEQ ID NO: 1069596 - DNA, 13 bp, Homo sapiens
ccgcctccagcac

SEQ ID NO: 1069597 - DNA, 12 bp, Homo sapiens
ccgcctccagga

SEQ ID NO: 1069598 - DNA, 23 bp, Homo sapiens
ccgcctcccaccactccactcct

SEQ ID NO: 1069599 - DNA, 15 bp, Homo sapiens
ccgcctcccacggca

SEQ ID NO: 1069600 - DNA, 15 bp, Homo sapiens
ccgcctcccagcctg

SEQ ID NO: 1069601 - DNA, 15 bp, Homo sapiens
ccgcctcccatcccg

SEQ ID NO: 1069602 - DNA, 17 bp, Homo sapiens
ccgcctcgtgccagcag

SEQ ID NO: 1069603 - DNA, 21 bp, Homo sapiens
ccgcctcgtgccagcagcctc

SEQ ID NO: 1069604 - DNA, 13 bp, Homo sapiens
ccgcctctcccgt

SEQ ID NO: 1069605 - DNA, 23 bp, Homo sapiens
ccgcctctcctcggttcaaggtc

SEQ ID NO: 1069606 - DNA, 16 bp, Homo sapiens
ccgcctctgcccgcag

SEQ ID NO: 1069607 - DNA, 18 bp, Homo sapiens
ccgcctctgcccgcagag

SEQ ID NO: 1069608 - DNA, 16 bp, Homo sapiens
ccgcctctggccgcca

SEQ ID NO: 1069609 - DNA, 19 bp, Homo sapiens
ccgcctctggccgccaccc

SEQ ID NO: 1069610 - DNA, 22 bp, Homo sapiens
ccgcctgagtcagtgctctcag

SEQ ID NO: 1069611 - DNA, 12 bp, Homo sapiens
ccgcctgccctc

SEQ ID NO: 1069612 - DNA, 16 bp, Homo sapiens
ccgcctgccctcatgg

SEQ ID NO: 1069613 - DNA, 22 bp, Homo sapiens
ccgcctgccctcccgcaccttc

SEQ ID NO: 1069614 - DNA, 13 bp, Homo sapiens
ccgcctgccctgc

SEQ ID NO: 1069615 - DNA, 22 bp, Homo sapiens
ccgcctgccctgccttgccgct

SEQ ID NO: 1069616 - DNA, 15 bp, Homo sapiens
ccgcctgccttagca

SEQ ID NO: 1069617 - DNA, 13 bp, Homo sapiens
ccgcctgctcctc

SEQ ID NO: 1069618 - DNA, 16 bp, Homo sapiens
ccgcctgctgggaaga

SEQ ID NO: 1069619 - DNA, 20 bp, Homo sapiens
ccgcctgctgggaagagctc

SEQ ID NO: 1069620 - DNA, 12 bp, Homo sapiens
ccgcctggcaga

SEQ ID NO: 1069621 - DNA, 13 bp, Homo sapiens
ccgcctggccagg

SEQ ID NO: 1069622 - DNA, 14 bp, Homo sapiens
ccgcctggccagga

SEQ ID NO: 1069623 - DNA, 17 bp, Homo sapiens
ccgcctggccctccctc

SEQ ID NO: 1069624 - DNA, 16 bp, Homo sapiens
ccgcctgggatctgag

SEQ ID NO: 1069625 - DNA, 16 bp, Homo sapiens
ccgccttaagctgatc

SEQ ID NO: 1069626 - DNA, 22 bp, Homo sapiens
ccgccttaatctggaaggcccc

SEQ ID NO: 1069627 - DNA, 13 bp, Homo sapiens
ccgccttaccagg

SEQ ID NO: 1069628 - DNA, 17 bp, Homo sapiens
ccgccttcgtgtgctgc

SEQ ID NO: 1069629 - DNA, 19 bp, Homo sapiens
ccgccttcgtgtgctgctg

SEQ ID NO: 1069630 - DNA, 16 bp, Homo sapiens
ccgccttctcccctct

SEQ ID NO: 1069631 - DNA, 15 bp, Homo sapiens
ccgcgaccatgtggc

SEQ ID NO: 1069632 - DNA, 18 bp, Homo sapiens
ccgcgaccatgtggccac

SEQ ID NO: 1069633 - DNA, 23 bp, Homo sapiens
ccgcgcccagcgctcgccacgct

SEQ ID NO: 1069634 - DNA, 16 bp, Homo sapiens
ccgcgcccgcgccctc

SEQ ID NO: 1069635 - DNA, 23 bp, Homo sapiens
ccgcgccctccctccgcctccca

SEQ ID NO: 1069636 - DNA, 16 bp, Homo sapiens
ccgcgccctcctgccc

SEQ ID NO: 1069637 - DNA, 22 bp, Homo sapiens
ccgcgccctcctgcccacggga

SEQ ID NO: 1069638 - DNA, 15 bp, Homo sapiens
ccgcgctcaggaggt

SEQ ID NO: 1069639 - DNA, 16 bp, Homo sapiens
ccgcgctcgcccagca

SEQ ID NO: 1069640 - DNA, 17 bp, Homo sapiens
ccgcggacgtgctggcc

SEQ ID NO: 1069641 - DNA, 20 bp, Homo sapiens
ccgcggccggccgagctgcc

SEQ ID NO: 1069642 - DNA, 15 bp, Homo sapiens
ccgcggcctccccga

SEQ ID NO: 1069643 - DNA, 18 bp, Homo sapiens
ccgcggcgcgaccctccc

SEQ ID NO: 1069644 - DNA, 21 bp, Homo sapiens
ccgcggcgcgaccctccccgg

SEQ ID NO: 1069645 - DNA, 16 bp, Homo sapiens
ccgcgggactgacacc

SEQ ID NO: 1069646 - DNA, 20 bp, Homo sapiens
ccgcgggagacagcttctct

SEQ ID NO: 1069647 - DNA, 21 bp, Homo sapiens
ccgcgggagacagcttctctg

SEQ ID NO: 1069648 - DNA, 23 bp, Homo sapiens
ccgcgggagacagcttctctgca

SEQ ID NO: 1069649 - DNA, 17 bp, Homo sapiens
ccgcgggcacagccagc

SEQ ID NO: 1069650 - DNA, 19 bp, Homo sapiens
ccgcgggttccgcaggcag

SEQ ID NO: 1069651 - DNA, 14 bp, Homo sapiens
ccgcgggttctaga

SEQ ID NO: 1069652 - DNA, 15 bp, Homo sapiens
ccgcgggttctagac

SEQ ID NO: 1069653 - DNA, 21 bp, Homo sapiens
ccgcgggttctagacgcccct

SEQ ID NO: 1069654 - DNA, 16 bp, Homo sapiens
ccgcggtgctctggcg

SEQ ID NO: 1069655 - DNA, 17 bp, Homo sapiens
ccgcggtgctctggcgg

SEQ ID NO: 1069656 - DNA, 15 bp, Homo sapiens
ccgcgtcccggcaag

SEQ ID NO: 1069657 - DNA, 17 bp, Homo sapiens
ccgcgtctggtgacaac

SEQ ID NO: 1069658 - DNA, 22 bp, Homo sapiens
ccgcgtgatcaaagccacactc

SEQ ID NO: 1069659 - DNA, 17 bp, Homo sapiens
ccgcgttgtaaaatata

SEQ ID NO: 1069660 - DNA, 18 bp, Homo sapiens
ccgctaaaagaaactttc

SEQ ID NO: 1069661 - DNA, 15 bp, Homo sapiens
ccgctaaatatttac

SEQ ID NO: 1069662 - DNA, 23 bp, Homo sapiens
ccgctaaatatttaccttgaaaa

SEQ ID NO: 1069663 - DNA, 20 bp, Homo sapiens
ccgctaggctcgccttccct

SEQ ID NO: 1069664 - DNA, 22 bp, Homo sapiens
ccgctaggctcgccttccctcc

SEQ ID NO: 1069665 - DNA, 15 bp, Homo sapiens
ccgctcacctagagc

SEQ ID NO: 1069666 - DNA, 18 bp, Homo sapiens
ccgctcacctagagccag

SEQ ID NO: 1069667 - DNA, 19 bp, Homo sapiens
ccgctcacctagagccaga

SEQ ID NO: 1069668 - DNA, 20 bp, Homo sapiens
ccgctcacctagagccagac

SEQ ID NO: 1069669 - DNA, 15 bp, Homo sapiens
ccgctcagccctccc

SEQ ID NO: 1069670 - DNA, 21 bp, Homo sapiens
ccgctcagccctccctgcccc

SEQ ID NO: 1069671 - DNA, 13 bp, Homo sapiens
ccgctcagtatta

SEQ ID NO: 1069672 - DNA, 19 bp, Homo sapiens
ccgctcccacagcttcctg

SEQ ID NO: 1069673 - DNA, 18 bp, Homo sapiens
ccgctcccaccgccccca

SEQ ID NO: 1069674 - DNA, 23 bp, Homo sapiens
ccgctcccaccgcccccacccct

SEQ ID NO: 1069675 - DNA, 14 bp, Homo sapiens
ccgctccccacagc

SEQ ID NO: 1069676 - DNA, 15 bp, Homo sapiens
ccgctccccacagct

SEQ ID NO: 1069677 - DNA, 12 bp, Homo sapiens
ccgctccccagc

SEQ ID NO: 1069678 - DNA, 13 bp, Homo sapiens
ccgctccccttgg

SEQ ID NO: 1069679 - DNA, 17 bp, Homo sapiens
ccgctccccttggacct

SEQ ID NO: 1069680 - DNA, 18 bp, Homo sapiens
ccgctcccgctcccaggt

SEQ ID NO: 1069681 - DNA, 11 bp, Homo sapiens
ccgctccctgg

SEQ ID NO: 1069682 - DNA, 15 bp, Homo sapiens
ccgctccgtctctgt

SEQ ID NO: 1069683 - DNA, 19 bp, Homo sapiens
ccgctccgtctctgtcctc

SEQ ID NO: 1069684 - DNA, 19 bp, Homo sapiens
ccgctcctcccctcttgag

SEQ ID NO: 1069685 - DNA, 15 bp, Homo sapiens
ccgctcctccctgct

SEQ ID NO: 1069686 - DNA, 17 bp, Homo sapiens
ccgctcctccctgctcc

SEQ ID NO: 1069687 - DNA, 13 bp, Homo sapiens
ccgctcctgcttc

SEQ ID NO: 1069688 - DNA, 14 bp, Homo sapiens
ccgctcctgtctgc

SEQ ID NO: 1069689 - DNA, 17 bp, Homo sapiens
ccgctcctgtctgccag

SEQ ID NO: 1069690 - DNA, 22 bp, Homo sapiens
ccgctctcttcctgcccctctt

SEQ ID NO: 1069691 - DNA, 14 bp, Homo sapiens
ccgctctggaccaa

SEQ ID NO: 1069692 - DNA, 22 bp, Homo sapiens
ccgctgagcgcccccgagccct

SEQ ID NO: 1069693 - DNA, 23 bp, Homo sapiens
ccgctgagcgcccccgagccctg

SEQ ID NO: 1069694 - DNA, 14 bp, Homo sapiens
ccgctgcagggctc

SEQ ID NO: 1069695 - DNA, 16 bp, Homo sapiens
ccgctgcagggctccc

SEQ ID NO: 1069696 - DNA, 21 bp, Homo sapiens
ccgctgccaccacgtctgcca

SEQ ID NO: 1069697 - DNA, 23 bp, Homo sapiens
ccgctgccaccacgtctgccagg

SEQ ID NO: 1069698 - DNA, 24 bp, Homo sapiens
ccgctgccaccacgtctgccaggc

SEQ ID NO: 1069699 - DNA, 17 bp, Homo sapiens
ccgctgccacccacctc

SEQ ID NO: 1069700 - DNA, 18 bp, Homo sapiens
ccgctgccagcacagagc

SEQ ID NO: 1069701 - DNA, 13 bp, Homo sapiens
ccgctgccagcct

SEQ ID NO: 1069702 - DNA, 13 bp, Homo sapiens
ccgctgcccctcc

SEQ ID NO: 1069703 - DNA, 23 bp, Homo sapiens
ccgctgcccctccccgtccctgt

SEQ ID NO: 1069704 - DNA, 19 bp, Homo sapiens
ccgctgccctttggccaac

SEQ ID NO: 1069705 - DNA, 16 bp, Homo sapiens
ccgctgccgctgcacc

SEQ ID NO: 1069706 - DNA, 20 bp, Homo sapiens
ccgctgcctaagtggctgct

SEQ ID NO: 1069707 - DNA, 20 bp, Homo sapiens
ccgctgcctcctgctctctg

SEQ ID NO: 1069708 - DNA, 14 bp, Homo sapiens
ccgctgctgctgct

SEQ ID NO: 1069709 - DNA, 20 bp, Homo sapiens
ccgctgctgtgctctgggga

SEQ ID NO: 1069710 - DNA, 19 bp, Homo sapiens
ccgctgcttccaggctggg

SEQ ID NO: 1069711 - DNA, 22 bp, Homo sapiens
ccgctggagcccacagcgagcc

SEQ ID NO: 1069712 - DNA, 11 bp, Homo sapiens
ccgctggagga

SEQ ID NO: 1069713 - DNA, 15 bp, Homo sapiens
ccggccgagctgcct

SEQ ID NO: 1069714 - DNA, 16 bp, Homo sapiens
ccggccgagctgcctg

SEQ ID NO: 1069715 - DNA, 19 bp, Homo sapiens
ccggccgagctgcctggcg

SEQ ID NO: 1069716 - DNA, 15 bp, Homo sapiens
ccggccggacctctg

SEQ ID NO: 1069717 - DNA, 17 bp, Homo sapiens
ccggccggacctctgag

SEQ ID NO: 1069718 - DNA, 15 bp, Homo sapiens
ccggcctccactccc

SEQ ID NO: 1069719 - DNA, 11 bp, Homo sapiens
ccggcctcctc

SEQ ID NO: 1069720 - DNA, 13 bp, Homo sapiens
ccggcctctctgg

SEQ ID NO: 1069721 - DNA, 13 bp, Homo sapiens
ccggcctcttcca

SEQ ID NO: 1069722 - DNA, 16 bp, Homo sapiens
ccggcctgctcccagc

SEQ ID NO: 1069723 - DNA, 16 bp, Homo sapiens
ccggcgccccgcaccc

SEQ ID NO: 1069724 - DNA, 14 bp, Homo sapiens
ccggcgcctgccct

SEQ ID NO: 1069725 - DNA, 16 bp, Homo sapiens
ccggcgcctgccctgc

SEQ ID NO: 1069726 - DNA, 21 bp, Homo sapiens
ccggcgctgattcctcgtgtc

SEQ ID NO: 1069727 - DNA, 13 bp, Homo sapiens
ccggcgctgcagg

SEQ ID NO: 1069728 - DNA, 23 bp, Homo sapiens
ccggcggaattcaccagtgttcc

SEQ ID NO: 1069729 - DNA, 14 bp, Homo sapiens
ccggcggctctgag

SEQ ID NO: 1069730 - DNA, 17 bp, Homo sapiens
ccggcggctctgagcag

SEQ ID NO: 1069731 - DNA, 19 bp, Homo sapiens
ccggctgagggtgggaggc

SEQ ID NO: 1069732 - DNA, 17 bp, Homo sapiens
ccggctgctcctccagc

SEQ ID NO: 1069733 - DNA, 17 bp, Homo sapiens
ccggctgctgcttggat

SEQ ID NO: 1069734 - DNA, 13 bp, Homo sapiens
ccggctggcctgg

SEQ ID NO: 1069735 - DNA, 12 bp, Homo sapiens
ccggctgggcct

SEQ ID NO: 1069736 - DNA, 16 bp, Homo sapiens
ccggctgggcctcctt

SEQ ID NO: 1069737 - DNA, 22 bp, Homo sapiens
ccggctgggtcggccctgccca

SEQ ID NO: 1069738 - DNA, 15 bp, Homo sapiens
ccggctgtggagcaa

SEQ ID NO: 1069739 - DNA, 16 bp, Homo sapiens
ccggctttcctccgga

SEQ ID NO: 1069740 - DNA, 16 bp, Homo sapiens
ccgggaagagccacct

SEQ ID NO: 1069741 - DNA, 17 bp, Homo sapiens
ccgggaccattgacctc

SEQ ID NO: 1069742 - DNA, 21 bp, Homo sapiens
ccgggaccattgacctcagct

SEQ ID NO: 1069743 - DNA, 15 bp, Homo sapiens
ccgggaccctcaggt

SEQ ID NO: 1069744 - DNA, 23 bp, Homo sapiens
ccgggaccctgctcacaggcagg

SEQ ID NO: 1069745 - DNA, 20 bp, Homo sapiens
ccgggagaggactctgcctt

SEQ ID NO: 1069746 - DNA, 17 bp, Homo sapiens
ccgggagcctaggacca

SEQ ID NO: 1069747 - DNA, 23 bp, Homo sapiens
ccgggagcctgatcacctgccct

SEQ ID NO: 1069748 - DNA, 12 bp, Homo sapiens
ccgggagctggt

SEQ ID NO: 1069749 - DNA, 12 bp, Homo sapiens
ccgggaggcaga

SEQ ID NO: 1069750 - DNA, 22 bp, Homo sapiens
ccgggaggtggagcttgcagtg

SEQ ID NO: 1069751 - DNA, 21 bp, Homo sapiens
ccgggatcctgcccccaagtc

SEQ ID NO: 1069752 - DNA, 13 bp, Homo sapiens
ccgggatgcaagg

SEQ ID NO: 1069753 - DNA, 13 bp, Homo sapiens
ccgggcactggca

SEQ ID NO: 1069754 - DNA, 11 bp, Homo sapiens
ccgggcagggg

SEQ ID NO: 1069755 - DNA, 18 bp, Homo sapiens
ccgggcaggggagccagg

SEQ ID NO: 1069756 - DNA, 15 bp, Homo sapiens
ccgggcagggtgtgg

SEQ ID NO: 1069757 - DNA, 16 bp, Homo sapiens
ccgggcaggtcctgcc

SEQ ID NO: 1069758 - DNA, 19 bp, Homo sapiens
ccgggcaggtcctgcccat

SEQ ID NO: 1069759 - DNA, 18 bp, Homo sapiens
ccgggccacgcaggggct

SEQ ID NO: 1069760 - DNA, 13 bp, Homo sapiens
ccgggccagggct

SEQ ID NO: 1069761 - DNA, 12 bp, Homo sapiens
ccgggcccccct

SEQ ID NO: 1069762 - DNA, 14 bp, Homo sapiens
ccgggcccctgggc

SEQ ID NO: 1069763 - DNA, 15 bp, Homo sapiens
ccgggccctgagtaa

SEQ ID NO: 1069764 - DNA, 17 bp, Homo sapiens
ccgggccgaccctgcgg

SEQ ID NO: 1069765 - DNA, 21 bp, Homo sapiens
ccgggccgaccctgcggcctc

SEQ ID NO: 1069766 - DNA, 17 bp, Homo sapiens
ccgggcctcagggtcct

SEQ ID NO: 1069767 - DNA, 12 bp, Homo sapiens
ccgggcctgcac

SEQ ID NO: 1069768 - DNA, 15 bp, Homo sapiens
ccgggcctgcacaga

SEQ ID NO: 1069769 - DNA, 17 bp, Homo sapiens
ccgggcctgcacagata

SEQ ID NO: 1069770 - DNA, 19 bp, Homo sapiens
ccgggcctggagaactaga

SEQ ID NO: 1069771 - DNA, 16 bp, Homo sapiens
ccgggcgccaggacag

SEQ ID NO: 1069772 - DNA, 21 bp, Homo sapiens
ccgggcgcggtggcgggcacc

SEQ ID NO: 1069773 - DNA, 20 bp, Homo sapiens
ccgggcgcggtggctcacgc

SEQ ID NO: 1069774 - DNA, 13 bp, Homo sapiens
ccgggctctctgc

SEQ ID NO: 1069775 - DNA, 16 bp, Homo sapiens
ccgggctctctgctgt

SEQ ID NO: 1069776 - DNA, 15 bp, Homo sapiens
ccgggctgagggcct

SEQ ID NO: 1069777 - DNA, 18 bp, Homo sapiens
ccgggctgagggcctgct

SEQ ID NO: 1069778 - DNA, 23 bp, Homo sapiens
ccgggctgcctgcccctgctgct

SEQ ID NO: 1069779 - DNA, 17 bp, Homo sapiens
ccgggctgcctgggctg

SEQ ID NO: 1069780 - DNA, 18 bp, Homo sapiens
ccgggctgcctgggctgt

SEQ ID NO: 1069781 - DNA, 21 bp, Homo sapiens
ccgggctgcctgggctgttgg

SEQ ID NO: 1069782 - DNA, 18 bp, Homo sapiens
ccgggctggccctgtgca

SEQ ID NO: 1069783 - DNA, 21 bp, Homo sapiens
ccgggctgtagatcaggtttg

SEQ ID NO: 1069784 - DNA, 15 bp, Homo sapiens
ccggggaaaggcaag

SEQ ID NO: 1069785 - DNA, 15 bp, Homo sapiens
ccggggaggggcaga

SEQ ID NO: 1069786 - DNA, 13 bp, Homo sapiens
ccggggagggggc

SEQ ID NO: 1069787 - DNA, 17 bp, Homo sapiens
ccggggagggggcacgg

SEQ ID NO: 1069788 - DNA, 18 bp, Homo sapiens
ccggggcagcagcagccc

SEQ ID NO: 1069789 - DNA, 19 bp, Homo sapiens
ccggggcagcagcagccct

SEQ ID NO: 1069790 - DNA, 18 bp, Homo sapiens
ccggggcagctgccagag

SEQ ID NO: 1069791 - DNA, 14 bp, Homo sapiens
ccggggcatggaca

SEQ ID NO: 1069792 - DNA, 19 bp, Homo sapiens
ccggggccttatcgggctc

SEQ ID NO: 1069793 - DNA, 11 bp, Homo sapiens
ccggggctgag

SEQ ID NO: 1069794 - DNA, 14 bp, Homo sapiens
ccgggggagcccag

SEQ ID NO: 1069795 - DNA, 13 bp, Homo sapiens
ccgggggaggggc

SEQ ID NO: 1069796 - DNA, 16 bp, Homo sapiens
ccgggggaggggccct

SEQ ID NO: 1069797 - DNA, 17 bp, Homo sapiens
ccgggggaggggccctc

SEQ ID NO: 1069798 - DNA, 23 bp, Homo sapiens
ccgggggaggggccctcaggcca

SEQ ID NO: 1069799 - DNA, 17 bp, Homo sapiens
ccgggggcagggtgggg

SEQ ID NO: 1069800 - DNA, 13 bp, Homo sapiens
ccgggggccccac

SEQ ID NO: 1069801 - DNA, 13 bp, Homo sapiens
ccgggggctgctg

SEQ ID NO: 1069802 - DNA, 15 bp, Homo sapiens
ccgggggctgctggg

SEQ ID NO: 1069803 - DNA, 18 bp, Homo sapiens
ccgggggctgctgggcgt

SEQ ID NO: 1069804 - DNA, 16 bp, Homo sapiens
ccggggggaggggaca

SEQ ID NO: 1069805 - DNA, 21 bp, Homo sapiens
ccggggggaggggacagagct

SEQ ID NO: 1069806 - DNA, 19 bp, Homo sapiens
ccggggggggtaggagagg

SEQ ID NO: 1069807 - DNA, 20 bp, Homo sapiens
ccggggtctgtgctgtgcct

SEQ ID NO: 1069808 - DNA, 22 bp, Homo sapiens
ccggggtctgtgctgtgcctgc

SEQ ID NO: 1069809 - DNA, 20 bp, Homo sapiens
ccggggtgcccacaggccgc

SEQ ID NO: 1069810 - DNA, 18 bp, Homo sapiens
ccggggtgtaacttcctg

SEQ ID NO: 1069811 - DNA, 22 bp, Homo sapiens
ccggggtgtaacttcctgctgc

SEQ ID NO: 1069812 - DNA, 23 bp, Homo sapiens
ccggggttccccacacagggcac

SEQ ID NO: 1069813 - DNA, 17 bp, Homo sapiens
ccgggtcaccctgtgac

SEQ ID NO: 1069814 - DNA, 13 bp, Homo sapiens
ccgggtcactgct

SEQ ID NO: 1069815 - DNA, 18 bp, Homo sapiens
ccgggtccttggccccct

SEQ ID NO: 1069816 - DNA, 14 bp, Homo sapiens
ccgggtctccttgg

SEQ ID NO: 1069817 - DNA, 18 bp, Homo sapiens
ccgggtctcgcagcctga

SEQ ID NO: 1069818 - DNA, 20 bp, Homo sapiens
ccgggtgcctcagagcaggc

SEQ ID NO: 1069819 - DNA, 17 bp, Homo sapiens
ccgggtgggcctggcct

SEQ ID NO: 1069820 - DNA, 21 bp, Homo sapiens
ccgggtgggcctggcctgagc

SEQ ID NO: 1069821 - DNA, 13 bp, Homo sapiens
ccgggtgtggcct

SEQ ID NO: 1069822 - DNA, 15 bp, Homo sapiens
ccgggtgtggcctca

SEQ ID NO: 1069823 - DNA, 20 bp, Homo sapiens
ccgggtgtggcctcagccct

SEQ ID NO: 1069824 - DNA, 22 bp, Homo sapiens
ccgggtttggcgggccaaggac

SEQ ID NO: 1069825 - DNA, 14 bp, Homo sapiens
ccggtcacccaggc

SEQ ID NO: 1069826 - DNA, 19 bp, Homo sapiens
ccggtcacctagcaagctg

SEQ ID NO: 1069827 - DNA, 13 bp, Homo sapiens
ccggtcagtgcct

SEQ ID NO: 1069828 - DNA, 14 bp, Homo sapiens
ccggtccccacaga

SEQ ID NO: 1069829 - DNA, 18 bp, Homo sapiens
ccggtcccttgagacctc

SEQ ID NO: 1069830 - DNA, 16 bp, Homo sapiens
ccggtcgggcagccag

SEQ ID NO: 1069831 - DNA, 14 bp, Homo sapiens
ccggtgcctgggtg

SEQ ID NO: 1069832 - DNA, 15 bp, Homo sapiens
ccggtgcctgggtgg

SEQ ID NO: 1069833 - DNA, 22 bp, Homo sapiens
ccggtgcctgggtggccatcct

SEQ ID NO: 1069834 - DNA, 13 bp, Homo sapiens
ccggtgctgcagg

SEQ ID NO: 1069835 - DNA, 14 bp, Homo sapiens
ccggtgctgggggc

SEQ ID NO: 1069836 - DNA, 18 bp, Homo sapiens
ccggtgctgggggcacag

SEQ ID NO: 1069837 - DNA, 20 bp, Homo sapiens
ccggtgctgggggcacagct

SEQ ID NO: 1069838 - DNA, 22 bp, Homo sapiens
ccggtgctgggggcacagctgt

SEQ ID NO: 1069839 - DNA, 16 bp, Homo sapiens
ccgtggggctccggag

SEQ ID NO: 1069840 - DNA, 18 bp, Homo sapiens
ccgtggggtctgcgcttg

SEQ ID NO: 1069841 - DNA, 15 bp, Homo sapiens
ccgtggggtgctgcc

SEQ ID NO: 1069842 - DNA, 14 bp, Homo sapiens
ccgtggtccctgag

SEQ ID NO: 1069843 - DNA, 17 bp, Homo sapiens
cctaattccacagctgc

SEQ ID NO: 1069844 - DNA, 14 bp, Homo sapiens
cctaattcctggca

SEQ ID NO: 1069845 - DNA, 17 bp, Homo sapiens
cctaattctatgcctgt

SEQ ID NO: 1069846 - DNA, 15 bp, Homo sapiens
cctaattcttctgtc

SEQ ID NO: 1069847 - DNA, 13 bp, Homo sapiens
cctaattgtggat

SEQ ID NO: 1069848 - DNA, 17 bp, Homo sapiens
cctaatttctcctccct

SEQ ID NO: 1069849 - DNA, 17 bp, Homo sapiens
cctacaaccccagcctc

SEQ ID NO: 1069850 - DNA, 17 bp, Homo sapiens
cctacaagagcagcctg

SEQ ID NO: 1069851 - DNA, 19 bp, Homo sapiens
cctacaagagcagcctgtg

SEQ ID NO: 1069852 - DNA, 16 bp, Homo sapiens
cctacaagatttcctt

SEQ ID NO: 1069853 - DNA, 17 bp, Homo sapiens
cctataaagtaaagcta

SEQ ID NO: 1069854 - DNA, 21 bp, Homo sapiens
cctataatacaaatacacaat

SEQ ID NO: 1069855 - DNA, 12 bp, Homo sapiens
cctatactgaaa

SEQ ID NO: 1069856 - DNA, 13 bp, Homo sapiens
cctatagagaggg

SEQ ID NO: 1069857 - DNA, 18 bp, Homo sapiens
cctatataataaagctac

SEQ ID NO: 1069858 - DNA, 23 bp, Homo sapiens
cctatataggaaactaagcattg

SEQ ID NO: 1069859 - DNA, 16 bp, Homo sapiens
cctatatagtttattg

SEQ ID NO: 1069860 - DNA, 13 bp, Homo sapiens
cctatatatttct

SEQ ID NO: 1069861 - DNA, 17 bp, Homo sapiens
cctatatcattatttag

SEQ ID NO: 1069862 - DNA, 20 bp, Homo sapiens
cctatatccagaaggggagc

SEQ ID NO: 1069863 - DNA, 16 bp, Homo sapiens
cctatatctgtttgta

SEQ ID NO: 1069864 - DNA, 20 bp, Homo sapiens
cctatatctgtttgtatatt

SEQ ID NO: 1069865 - DNA, 14 bp, Homo sapiens
cctatcatgttaac

SEQ ID NO: 1069866 - DNA, 12 bp, Homo sapiens
cctatccaccca

SEQ ID NO: 1069867 - DNA, 14 bp, Homo sapiens
cctatccacccagc

SEQ ID NO: 1069868 - DNA, 16 bp, Homo sapiens
cctatccacccagccc

SEQ ID NO: 1069869 - DNA, 17 bp, Homo sapiens
cctatccgctgccagcc

SEQ ID NO: 1069870 - DNA, 15 bp, Homo sapiens
cctatcctcactgcc

SEQ ID NO: 1069871 - DNA, 15 bp, Homo sapiens
cctatcctccccttt

SEQ ID NO: 1069872 - DNA, 17 bp, Homo sapiens
cctatccttccagtggc

SEQ ID NO: 1069873 - DNA, 16 bp, Homo sapiens
cctatccttggagagc

SEQ ID NO: 1069874 - DNA, 20 bp, Homo sapiens
cctatccttggagagcagct

SEQ ID NO: 1069875 - DNA, 22 bp, Homo sapiens
cctatccttggagagcagctgg

SEQ ID NO: 1069876 - DNA, 23 bp, Homo sapiens
cctatctagcatttatttctctg

SEQ ID NO: 1069877 - DNA, 21 bp, Homo sapiens
cctatctattaaagtgacttt

SEQ ID NO: 1069878 - DNA, 14 bp, Homo sapiens
cctatctcagccat

SEQ ID NO: 1069879 - DNA, 16 bp, Homo sapiens
cctatctcagggaggg

SEQ ID NO: 1069880 - DNA, 20 bp, Homo sapiens
cctatctcgtgggagagcca

SEQ ID NO: 1069881 - DNA, 19 bp, Homo sapiens
cctatctgtgattccccca

SEQ ID NO: 1069882 - DNA, 13 bp, Homo sapiens
cctatcttgtcct

SEQ ID NO: 1069883 - DNA, 14 bp, Homo sapiens
cctatcttgtcctg

SEQ ID NO: 1069884 - DNA, 18 bp, Homo sapiens
cctatcttttagttttag

SEQ ID NO: 1069885 - DNA, 22 bp, Homo sapiens
cctatgaagttggcacatttca

SEQ ID NO: 1069886 - DNA, 24 bp, Homo sapiens
cctatgaatgaaattcttttataa

SEQ ID NO: 1069887 - DNA, 18 bp, Homo sapiens
cctatgagatggccatgc

SEQ ID NO: 1069888 - DNA, 21 bp, Homo sapiens
cctatgagcatcctgagcccc

SEQ ID NO: 1069889 - DNA, 14 bp, Homo sapiens
cctatgatcccagc

SEQ ID NO: 1069890 - DNA, 22 bp, Homo sapiens
cctatgatggatggcagactct

SEQ ID NO: 1069891 - DNA, 19 bp, Homo sapiens
cctatgcagacatctctgg

SEQ ID NO: 1069892 - DNA, 23 bp, Homo sapiens
cctatgcagacatctctggagcc

SEQ ID NO: 1069893 - DNA, 15 bp, Homo sapiens
cctatgcagggaggc

SEQ ID NO: 1069894 - DNA, 22 bp, Homo sapiens
cctatgcagggaggccacgtcc

SEQ ID NO: 1069895 - DNA, 19 bp, Homo sapiens
cctatgccctgcccttcct

SEQ ID NO: 1069896 - DNA, 19 bp, Homo sapiens
cctatgcctgtggtgaagt

SEQ ID NO: 1069897 - DNA, 23 bp, Homo sapiens
cctatgctattgacaataaaata

SEQ ID NO: 1069898 - DNA, 17 bp, Homo sapiens
cctatgcttaataaaag

SEQ ID NO: 1069899 - DNA, 13 bp, Homo sapiens
cctatggaaaaaa

SEQ ID NO: 1069900 - DNA, 21 bp, Homo sapiens
cctatggaaaagggtcttctt

SEQ ID NO: 1069901 - DNA, 23 bp, Homo sapiens
cctatggaaacattttatactgt

SEQ ID NO: 1069902 - DNA, 19 bp, Homo sapiens
cctatggaagttgttgcta

SEQ ID NO: 1069903 - DNA, 11 bp, Homo sapiens
cctatggatgt

SEQ ID NO: 1069904 - DNA, 19 bp, Homo sapiens
cctatgtacagagctttct

SEQ ID NO: 1069905 - DNA, 24 bp, Homo sapiens
cctatgtactctacgccaaagtgc

SEQ ID NO: 1069906 - DNA, 14 bp, Homo sapiens
cctatgtagtgtct

SEQ ID NO: 1069907 - DNA, 19 bp, Homo sapiens
cctatgtagtgtctttatt

SEQ ID NO: 1069908 - DNA, 15 bp, Homo sapiens
cctatgtcctaagga

SEQ ID NO: 1069909 - DNA, 20 bp, Homo sapiens
cctatgtcctaaggacacac

SEQ ID NO: 1069910 - DNA, 21 bp, Homo sapiens
cctatgtcctaaggacacact

SEQ ID NO: 1069911 - DNA, 23 bp, Homo sapiens
cctatgtcctaaggacacactaa

SEQ ID NO: 1069912 - DNA, 16 bp, Homo sapiens
cctatgtctaaattca

SEQ ID NO: 1069913 - DNA, 22 bp, Homo sapiens
cctatgtttttgttcaaagcca

SEQ ID NO: 1069914 - DNA, 19 bp, Homo sapiens
cctattcaccctccacttc

SEQ ID NO: 1069915 - DNA, 11 bp, Homo sapiens
cctattctcac

SEQ ID NO: 1069916 - DNA, 13 bp, Homo sapiens
cctattctcacca

SEQ ID NO: 1069917 - DNA, 14 bp, Homo sapiens
cctattctgttgcc

SEQ ID NO: 1069918 - DNA, 22 bp, Homo sapiens
cctattgcaaaggttccaactg

SEQ ID NO: 1069919 - DNA, 12 bp, Homo sapiens
cctattgggaca

SEQ ID NO: 1069920 - DNA, 13 bp, Homo sapiens
cctattgtaatat

SEQ ID NO: 1069921 - DNA, 19 bp, Homo sapiens
cctattgtgcaatgtaaat

SEQ ID NO: 1069922 - DNA, 19 bp, Homo sapiens
cctatttattgactttgac

SEQ ID NO: 1069923 - DNA, 16 bp, Homo sapiens
cctatttccagaaata

SEQ ID NO: 1069924 - DNA, 17 bp, Homo sapiens
cctatttctatgtcatt

SEQ ID NO: 1069925 - DNA, 18 bp, Homo sapiens
cctatttctatgtcattt

SEQ ID NO: 1069926 - DNA, 17 bp, Homo sapiens
cctatttctgatgatgt

SEQ ID NO: 1069927 - DNA, 14 bp, Homo sapiens
cctatttgacttac

SEQ ID NO: 1069928 - DNA, 16 bp, Homo sapiens
cctattttctatcccc

SEQ ID NO: 1069929 - DNA, 17 bp, Homo sapiens
cctattttcttttccat

SEQ ID NO: 1069930 - DNA, 13 bp, Homo sapiens
cctatttttgtag

SEQ ID NO: 1069931 - DNA, 16 bp, Homo sapiens
cctcaaaagcaccctt

SEQ ID NO: 1069932 - DNA, 23 bp, Homo sapiens
cctcaaaatttaacagttacctg

SEQ ID NO: 1069933 - DNA, 22 bp, Homo sapiens
cctcaaacagtaggttggcagt

SEQ ID NO: 1069934 - DNA, 15 bp, Homo sapiens
cctcaaacctcctct

SEQ ID NO: 1069935 - DNA, 16 bp, Homo sapiens
cctcaaacctcctctt

SEQ ID NO: 1069936 - DNA, 17 bp, Homo sapiens
cctcaaagcaacccgct

SEQ ID NO: 1069937 - DNA, 20 bp, Homo sapiens
cctcaaagcaacccgctgga

SEQ ID NO: 1069938 - DNA, 21 bp, Homo sapiens
cctcaaagcaacccgctggag

SEQ ID NO: 1069939 - DNA, 23 bp, Homo sapiens
cctcaaagcaacccgctggagcc

SEQ ID NO: 1069940 - DNA, 24 bp, Homo sapiens
cctcaaagcttggattaaatacat

SEQ ID NO: 1069941 - DNA, 16 bp, Homo sapiens
cctcaaagtaaaaatt

SEQ ID NO: 1069942 - DNA, 19 bp, Homo sapiens
cctcaaagtcccttgagac

SEQ ID NO: 1069943 - DNA, 20 bp, Homo sapiens
cctcaaagtcccttgagact

SEQ ID NO: 1069944 - DNA, 21 bp, Homo sapiens
cctcaaagtcccttgagactc

SEQ ID NO: 1069945 - DNA, 20 bp, Homo sapiens
cctcaaataagtcttcctta

SEQ ID NO: 1069946 - DNA, 17 bp, Homo sapiens
cctcaaatgtcagagct

SEQ ID NO: 1069947 - DNA, 15 bp, Homo sapiens
cctcaaattttttga

SEQ ID NO: 1069948 - DNA, 17 bp, Homo sapiens
cctcaacaagggagaga

SEQ ID NO: 1069949 - DNA, 18 bp, Homo sapiens
cctcaacaagggagagac

SEQ ID NO: 1069950 - DNA, 21 bp, Homo sapiens
cctcaacaagggagagacctc

SEQ ID NO: 1069951 - DNA, 17 bp, Homo sapiens
cctcaacagtgttttca

SEQ ID NO: 1069952 - DNA, 22 bp, Homo sapiens
cctcaaccctccctcagcccct

SEQ ID NO: 1069953 - DNA, 16 bp, Homo sapiens
cctcaacctcctgggt

SEQ ID NO: 1069954 - DNA, 20 bp, Homo sapiens
cctcaacctcttctggctca

SEQ ID NO: 1069955 - DNA, 21 bp, Homo sapiens
cctcaactcacctaatgttta

SEQ ID NO: 1069956 - DNA, 13 bp, Homo sapiens
cctcaactgaagg

SEQ ID NO: 1069957 - DNA, 15 bp, Homo sapiens
cctcaagactttgat

SEQ ID NO: 1069958 - DNA, 21 bp, Homo sapiens
cctcaagactttgatccttgg

SEQ ID NO: 1069959 - DNA, 23 bp, Homo sapiens
cctcaagactttgatccttggaa

SEQ ID NO: 1069960 - DNA, 13 bp, Homo sapiens
cctcaagcaacca

SEQ ID NO: 1069961 - DNA, 22 bp, Homo sapiens
cctcaagcaataattgtttcca

SEQ ID NO: 1069962 - DNA, 13 bp, Homo sapiens
cctcaagcaatcc

SEQ ID NO: 1069963 - DNA, 22 bp, Homo sapiens
cctcaagcaatccacctgcctt

SEQ ID NO: 1069964 - DNA, 20 bp, Homo sapiens
cctcaagccaatcccctcct

SEQ ID NO: 1069965 - DNA, 20 bp, Homo sapiens
cctcaagccccatttcctca

SEQ ID NO: 1069966 - DNA, 16 bp, Homo sapiens
cctcaagcctgtgggc

SEQ ID NO: 1069967 - DNA, 21 bp, Homo sapiens
cctcaagcctgtgggcagcat

SEQ ID NO: 1069968 - DNA, 20 bp, Homo sapiens
cctcaaggacttgaaagcat

SEQ ID NO: 1069969 - DNA, 21 bp, Homo sapiens
cctcaaggccctcggagctgg

SEQ ID NO: 1069970 - DNA, 15 bp, Homo sapiens
cctcaaggctgggag

SEQ ID NO: 1069971 - DNA, 18 bp, Homo sapiens
cctcaatagatctccagc

SEQ ID NO: 1069972 - DNA, 18 bp, Homo sapiens
cctcaatccagctatgtt

SEQ ID NO: 1069973 - DNA, 23 bp, Homo sapiens
cctcaatgcagtcagtgtttctt

SEQ ID NO: 1069974 - DNA, 15 bp, Homo sapiens
cctcaatgccctgcc

SEQ ID NO: 1069975 - DNA, 17 bp, Homo sapiens
cctcaatgccctgccat

SEQ ID NO: 1069976 - DNA, 19 bp, Homo sapiens
cctcaatgccctgccatta

SEQ ID NO: 1069977 - DNA, 21 bp, Homo sapiens
cctcaatgtgaatcagaccct

SEQ ID NO: 1069978 - DNA, 22 bp, Homo sapiens
cctcaatgtgaatcagacccta

SEQ ID NO: 1069979 - DNA, 15 bp, Homo sapiens
cctcacacacacagc

SEQ ID NO: 1069980 - DNA, 22 bp, Homo sapiens
cctcacacacacagctgggcaa

SEQ ID NO: 1069981 - DNA, 17 bp, Homo sapiens
cctcacacacacccccc

SEQ ID NO: 1069982 - DNA, 12 bp, Homo sapiens
cctcacacccct

SEQ ID NO: 1069983 - DNA, 20 bp, Homo sapiens
cctcacactgctgtcctctc

SEQ ID NO: 1069984 - DNA, 20 bp, Homo sapiens
cctcacagacctctgcttgg

SEQ ID NO: 1069985 - DNA, 13 bp, Homo sapiens
cctcacagtgaac

SEQ ID NO: 1069986 - DNA, 23 bp, Homo sapiens
cctcacatacccacacattccag

SEQ ID NO: 1069987 - DNA, 16 bp, Homo sapiens
cctcacatcctctcca

SEQ ID NO: 1069988 - DNA, 13 bp, Homo sapiens
cctcaccaccccc

SEQ ID NO: 1069989 - DNA, 12 bp, Homo sapiens
cctcacccacac

SEQ ID NO: 1069990 - DNA, 21 bp, Homo sapiens
cctcacccacccctgcacagt

SEQ ID NO: 1069991 - DNA, 13 bp, Homo sapiens
cctcacccacctc

SEQ ID NO: 1069992 - DNA, 20 bp, Homo sapiens
cctcacccagatcaggaacc

SEQ ID NO: 1069993 - DNA, 23 bp, Homo sapiens
cctcacccagatcaggaaccagg

SEQ ID NO: 1069994 - DNA, 13 bp, Homo sapiens
cctcaccccagct

SEQ ID NO: 1069995 - DNA, 19 bp, Homo sapiens
cctcacccccagctttgct

SEQ ID NO: 1069996 - DNA, 21 bp, Homo sapiens
cctcacccccaggtgttgcca

SEQ ID NO: 1069997 - DNA, 22 bp, Homo sapiens
cctcacccccgacggtgtggct

SEQ ID NO: 1069998 - DNA, 21 bp, Homo sapiens
cctcaccccctcccaccccca

SEQ ID NO: 1069999 - DNA, 18 bp, Homo sapiens
cctcaccccctcctggca

SEQ ID NO: 1070000 - DNA, 19 bp, Homo sapiens
cctcaccccctcctggcaa

SEQ ID NO: 1070001 - DNA, 16 bp, Homo sapiens
cctcacccctgtaggg

SEQ ID NO: 1070002 - DNA, 13 bp, Homo sapiens
cctcaccctctgt

SEQ ID NO: 1070003 - DNA, 22 bp, Homo sapiens
cctcaccctgccttatcttgca

SEQ ID NO: 1070004 - DNA, 13 bp, Homo sapiens
cctcaccctgtgg

SEQ ID NO: 1070005 - DNA, 16 bp, Homo sapiens
cctcaccctgtgggac

SEQ ID NO: 1070006 - DNA, 18 bp, Homo sapiens
cctcaccgagtgggggca

SEQ ID NO: 1070007 - DNA, 14 bp, Homo sapiens
cctcacctcatgcc

SEQ ID NO: 1070008 - DNA, 22 bp, Homo sapiens
cctcacctcatgcccaccccct

SEQ ID NO: 1070009 - DNA, 13 bp, Homo sapiens
cctcacctcctct

SEQ ID NO: 1070010 - DNA, 13 bp, Homo sapiens
cctcagcccaact

SEQ ID NO: 1070011 - DNA, 11 bp, Homo sapiens
cctcagccccc

SEQ ID NO: 1070012 - DNA, 13 bp, Homo sapiens
cctcagcccccag

SEQ ID NO: 1070013 - DNA, 20 bp, Homo sapiens
cctcagcccccaggccaggt

SEQ ID NO: 1070014 - DNA, 13 bp, Homo sapiens
cctcagcccctct

SEQ ID NO: 1070015 - DNA, 19 bp, Homo sapiens
cctcagcccctcttgcccc

SEQ ID NO: 1070016 - DNA, 23 bp, Homo sapiens
cctcagcccctcttgccccccac

SEQ ID NO: 1070017 - DNA, 11 bp, Homo sapiens
cctcagccctc

SEQ ID NO: 1070018 - DNA, 17 bp, Homo sapiens
cctcagccctgaccctg

SEQ ID NO: 1070019 - DNA, 11 bp, Homo sapiens
cctcagccctt

SEQ ID NO: 1070020 - DNA, 23 bp, Homo sapiens
cctcagccgactgcacagcggcc

SEQ ID NO: 1070021 - DNA, 19 bp, Homo sapiens
cctcagccgagaaattggg

SEQ ID NO: 1070022 - DNA, 16 bp, Homo sapiens
cctcagccgtcagcca

SEQ ID NO: 1070023 - DNA, 19 bp, Homo sapiens
cctcagccgtcagccatca

SEQ ID NO: 1070024 - DNA, 20 bp, Homo sapiens
cctcagcctagaccctcctc

SEQ ID NO: 1070025 - DNA, 11 bp, Homo sapiens
cctcagcctcc

SEQ ID NO: 1070026 - DNA, 23 bp, Homo sapiens
cctcagcctcccaaagtgctggg

SEQ ID NO: 1070027 - DNA, 14 bp, Homo sapiens
cctcagcctcccag

SEQ ID NO: 1070028 - DNA, 22 bp, Homo sapiens
cctcagcctccccttcttcccg

SEQ ID NO: 1070029 - DNA, 20 bp, Homo sapiens
cctcagcctctgcaactgca

SEQ ID NO: 1070030 - DNA, 13 bp, Homo sapiens
cctcagcctcttc

SEQ ID NO: 1070031 - DNA, 12 bp, Homo sapiens
cctcagcctgcc

SEQ ID NO: 1070032 - DNA, 16 bp, Homo sapiens
cctcagcctgcccacc

SEQ ID NO: 1070033 - DNA, 17 bp, Homo sapiens
cctcagcctgcccacct

SEQ ID NO: 1070034 - DNA, 21 bp, Homo sapiens
cctcagcctgcccacctctcc

SEQ ID NO: 1070035 - DNA, 11 bp, Homo sapiens
cctcagcctgg

SEQ ID NO: 1070036 - DNA, 13 bp, Homo sapiens
cctcagcctggag

SEQ ID NO: 1070037 - DNA, 14 bp, Homo sapiens
cctcagcctggaga

SEQ ID NO: 1070038 - DNA, 12 bp, Homo sapiens
cctcagcctggg

SEQ ID NO: 1070039 - DNA, 15 bp, Homo sapiens
cctcagcctggggct

SEQ ID NO: 1070040 - DNA, 20 bp, Homo sapiens
cctcagcctggggctctctg

SEQ ID NO: 1070041 - DNA, 22 bp, Homo sapiens
cctcagcctggggctctctgac

SEQ ID NO: 1070042 - DNA, 11 bp, Homo sapiens
cctcagcctgt

SEQ ID NO: 1070043 - DNA, 23 bp, Homo sapiens
cctcagccttggataatgctgtt

SEQ ID NO: 1070044 - DNA, 17 bp, Homo sapiens
cctcagcgagaggcagc

SEQ ID NO: 1070045 - DNA, 16 bp, Homo sapiens
cctcagcgcaggctgc

SEQ ID NO: 1070046 - DNA, 22 bp, Homo sapiens
cctcagcgcaggctgcagagcc

SEQ ID NO: 1070047 - DNA, 22 bp, Homo sapiens
cctcagctccccggcactgcag

SEQ ID NO: 1070048 - DNA, 15 bp, Homo sapiens
cctcagctctctggg

SEQ ID NO: 1070049 - DNA, 16 bp, Homo sapiens
cctcagctctctggga

SEQ ID NO: 1070050 - DNA, 11 bp, Homo sapiens
cctcagctctg

SEQ ID NO: 1070051 - DNA, 13 bp, Homo sapiens
cctcagctctggg

SEQ ID NO: 1070052 - DNA, 14 bp, Homo sapiens
cctcagctctggga

SEQ ID NO: 1070053 - DNA, 15 bp, Homo sapiens
cctcagctctgggag

SEQ ID NO: 1070054 - DNA, 17 bp, Homo sapiens
cctcagctctgggagag

SEQ ID NO: 1070055 - DNA, 20 bp, Homo sapiens
cctcagctctgggagaggat

SEQ ID NO: 1070056 - DNA, 11 bp, Homo sapiens
cctcagctgca

SEQ ID NO: 1070057 - DNA, 19 bp, Homo sapiens
cctcagctgcatggagcct

SEQ ID NO: 1070058 - DNA, 12 bp, Homo sapiens
cctcagctgcca

SEQ ID NO: 1070059 - DNA, 13 bp, Homo sapiens
cctcagctgccaa

SEQ ID NO: 1070060 - DNA, 22 bp, Homo sapiens
cctcagtcagttcccggagcac

SEQ ID NO: 1070061 - DNA, 23 bp, Homo sapiens
cctcagtcagttcccggagcaca

SEQ ID NO: 1070062 - DNA, 13 bp, Homo sapiens
cctcagtgaccca

SEQ ID NO: 1070063 - DNA, 14 bp, Homo sapiens
cctcagtgactcag

SEQ ID NO: 1070064 - DNA, 15 bp, Homo sapiens
cctcagtgccacttg

SEQ ID NO: 1070065 - DNA, 19 bp, Homo sapiens
cctcagtgccacttgacat

SEQ ID NO: 1070066 - DNA, 18 bp, Homo sapiens
cctcagtggactttccac

SEQ ID NO: 1070067 - DNA, 18 bp, Homo sapiens
cctcagtggatcttcaga

SEQ ID NO: 1070068 - DNA, 23 bp, Homo sapiens
cctcagtgtcatttatgaaaaga

SEQ ID NO: 1070069 - DNA, 22 bp, Homo sapiens
cctcagttcccagctccccccg

SEQ ID NO: 1070070 - DNA, 15 bp, Homo sapiens
cctcagttcccttgg

SEQ ID NO: 1070071 - DNA, 16 bp, Homo sapiens
cctcagttcccttggc

SEQ ID NO: 1070072 - DNA, 17 bp, Homo sapiens
cctcagttcccttggcc

SEQ ID NO: 1070073 - DNA, 21 bp, Homo sapiens
cctcagttcccttggcctcag

SEQ ID NO: 1070074 - DNA, 20 bp, Homo sapiens
cctcagtttggtagtgcccc

SEQ ID NO: 1070075 - DNA, 14 bp, Homo sapiens
cctcagttttcctt

SEQ ID NO: 1070076 - DNA, 16 bp, Homo sapiens
cctcagttttccttct

SEQ ID NO: 1070077 - DNA, 17 bp, Homo sapiens
cctcatactcctgggct

SEQ ID NO: 1070078 - DNA, 23 bp, Homo sapiens
cctcatagccctcagacatttat

SEQ ID NO: 1070079 - DNA, 16 bp, Homo sapiens
cctcatcaccatcgtg

SEQ ID NO: 1070080 - DNA, 15 bp, Homo sapiens
cctcatcactggact

SEQ ID NO: 1070081 - DNA, 21 bp, Homo sapiens
cctcatcactggactgcatgg

SEQ ID NO: 1070082 - DNA, 12 bp, Homo sapiens
cctcatccaggg

SEQ ID NO: 1070083 - DNA, 13 bp, Homo sapiens
cctcatccagggc

SEQ ID NO: 1070084 - DNA, 14 bp, Homo sapiens
cctcatccagggcc

SEQ ID NO: 1070085 - DNA, 13 bp, Homo sapiens
cctcatccatttc

SEQ ID NO: 1070086 - DNA, 14 bp, Homo sapiens
cctcatccatttct

SEQ ID NO: 1070087 - DNA, 15 bp, Homo sapiens
cctcatccatttctt

SEQ ID NO: 1070088 - DNA, 12 bp, Homo sapiens
cctcatccccca

SEQ ID NO: 1070089 - DNA, 23 bp, Homo sapiens
cctcatcccctcgtcctgtccca

SEQ ID NO: 1070090 - DNA, 14 bp, Homo sapiens
cctcatcccgagca

SEQ ID NO: 1070091 - DNA, 20 bp, Homo sapiens
cctcatcccgagcacctcca

SEQ ID NO: 1070092 - DNA, 20 bp, Homo sapiens
cctcatcccgtgttctcctt

SEQ ID NO: 1070093 - DNA, 11 bp, Homo sapiens
cctcatccctc

SEQ ID NO: 1070094 - DNA, 13 bp, Homo sapiens
cctcatccctgac

SEQ ID NO: 1070095 - DNA, 13 bp, Homo sapiens
cctcatcctgctt

SEQ ID NO: 1070096 - DNA, 17 bp, Homo sapiens
cctcatcctttccctct

SEQ ID NO: 1070097 - DNA, 18 bp, Homo sapiens
cctcatcctttccctctc

SEQ ID NO: 1070098 - DNA, 16 bp, Homo sapiens
cctcatctatgaggaa

SEQ ID NO: 1070099 - DNA, 21 bp, Homo sapiens
cctcatctatgaggaaaggtt

SEQ ID NO: 1070100 - DNA, 12 bp, Homo sapiens
cctcatctcacc

SEQ ID NO: 1070101 - DNA, 18 bp, Homo sapiens
cctcatctgagaggctct

SEQ ID NO: 1070102 - DNA, 18 bp, Homo sapiens
cctcatctgtggagctgc

SEQ ID NO: 1070103 - DNA, 15 bp, Homo sapiens
cctcatgccacacct

SEQ ID NO: 1070104 - DNA, 14 bp, Homo sapiens
cctcatgcccaccc

SEQ ID NO: 1070105 - DNA, 13 bp, Homo sapiens
cctcatgcccagc

SEQ ID NO: 1070106 - DNA, 22 bp, Homo sapiens
cctcatggagacctcatgccat

SEQ ID NO: 1070107 - DNA, 23 bp, Homo sapiens
cctcatggagacctcatgccatg

SEQ ID NO: 1070108 - DNA, 21 bp, Homo sapiens
cctcatggattgccacagctc

SEQ ID NO: 1070109 - DNA, 23 bp, Homo sapiens
cctcatggattgccacagctcaa

SEQ ID NO: 1070110 - DNA, 18 bp, Homo sapiens
cctcatggcccctctgac

SEQ ID NO: 1070111 - DNA, 22 bp, Homo sapiens
cctcatggcccctctgacctgc

SEQ ID NO: 1070112 - DNA, 22 bp, Homo sapiens
cctcatgggaagatgtctcaga

SEQ ID NO: 1070113 - DNA, 13 bp, Homo sapiens
cctcatgggtcct

SEQ ID NO: 1070114 - DNA, 19 bp, Homo sapiens
cctcatggtgggttcaggg

SEQ ID NO: 1070115 - DNA, 20 bp, Homo sapiens
cctcatgtaacattggtgaa

SEQ ID NO: 1070116 - DNA, 23 bp, Homo sapiens
cctcatgtggctggaagatcctg

SEQ ID NO: 1070117 - DNA, 18 bp, Homo sapiens
cctcatgttactcagtgt

SEQ ID NO: 1070118 - DNA, 23 bp, Homo sapiens
cctcatgttctcttcccaggcct

SEQ ID NO: 1070119 - DNA, 14 bp, Homo sapiens
cctcatgttgctga

SEQ ID NO: 1070120 - DNA, 15 bp, Homo sapiens
cctcatgttgctgaa

SEQ ID NO: 1070121 - DNA, 21 bp, Homo sapiens
cctcatgttgctgaatttgta

SEQ ID NO: 1070122 - DNA, 13 bp, Homo sapiens
cctcattataaaa

SEQ ID NO: 1070123 - DNA, 16 bp, Homo sapiens
cctccaccaccctttc

SEQ ID NO: 1070124 - DNA, 16 bp, Homo sapiens
cctccaccagcctgct

SEQ ID NO: 1070125 - DNA, 17 bp, Homo sapiens
cctccaccagcctgctg

SEQ ID NO: 1070126 - DNA, 20 bp, Homo sapiens
cctccaccagcctgctgaca

SEQ ID NO: 1070127 - DNA, 15 bp, Homo sapiens
cctccacccatccag

SEQ ID NO: 1070128 - DNA, 23 bp, Homo sapiens
cctccacccccatgtggcagccc

SEQ ID NO: 1070129 - DNA, 15 bp, Homo sapiens
cctccaccccccact

SEQ ID NO: 1070130 - DNA, 18 bp, Homo sapiens
cctccaccccccactcag

SEQ ID NO: 1070131 - DNA, 16 bp, Homo sapiens
cctccaccctgtcccc

SEQ ID NO: 1070132 - DNA, 23 bp, Homo sapiens
cctccacctctcacgggccctgc

SEQ ID NO: 1070133 - DNA, 23 bp, Homo sapiens
cctccacctcttcaccccccact

SEQ ID NO: 1070134 - DNA, 19 bp, Homo sapiens
cctccaccttgctcttctt

SEQ ID NO: 1070135 - DNA, 18 bp, Homo sapiens
cctccacgccactgcctc

SEQ ID NO: 1070136 - DNA, 17 bp, Homo sapiens
cctccacgcctcctggc

SEQ ID NO: 1070137 - DNA, 19 bp, Homo sapiens
cctccacgcctcctggcca

SEQ ID NO: 1070138 - DNA, 21 bp, Homo sapiens
cctccacggtccgcggcctgc

SEQ ID NO: 1070139 - DNA, 23 bp, Homo sapiens
cctccacggtccgcggcctgcac

SEQ ID NO: 1070140 - DNA, 23 bp, Homo sapiens
cctccacgtgtccgtccaccctt

SEQ ID NO: 1070141 - DNA, 20 bp, Homo sapiens
cctccactcaccacaagctg

SEQ ID NO: 1070142 - DNA, 21 bp, Homo sapiens
cctccactcagctgtcctgca

SEQ ID NO: 1070143 - DNA, 14 bp, Homo sapiens
cctccactccacct

SEQ ID NO: 1070144 - DNA, 16 bp, Homo sapiens
cctccactccacctcc

SEQ ID NO: 1070145 - DNA, 21 bp, Homo sapiens
cctccactcccccacctgaca

SEQ ID NO: 1070146 - DNA, 16 bp, Homo sapiens
cctccactcctctcaa

SEQ ID NO: 1070147 - DNA, 20 bp, Homo sapiens
cctccactctgtatctatgc

SEQ ID NO: 1070148 - DNA, 12 bp, Homo sapiens
cctccactgtca

SEQ ID NO: 1070149 - DNA, 15 bp, Homo sapiens
cctccacttcccgtc

SEQ ID NO: 1070150 - DNA, 22 bp, Homo sapiens
cctccagaactcactggggcct

SEQ ID NO: 1070151 - DNA, 12 bp, Homo sapiens
cctccagaagcc

SEQ ID NO: 1070152 - DNA, 22 bp, Homo sapiens
cctccagaagcctctggctaga

SEQ ID NO: 1070153 - DNA, 18 bp, Homo sapiens
cctccagaccaccagccg

SEQ ID NO: 1070154 - DNA, 15 bp, Homo sapiens
cctccagaccctgcc

SEQ ID NO: 1070155 - DNA, 15 bp, Homo sapiens
cctccagagccagcc

SEQ ID NO: 1070156 - DNA, 16 bp, Homo sapiens
cctccagaggtcctcc

SEQ ID NO: 1070157 - DNA, 14 bp, Homo sapiens
cctccagaggtgga

SEQ ID NO: 1070158 - DNA, 17 bp, Homo sapiens
cctccagcccctgtccc

SEQ ID NO: 1070159 - DNA, 15 bp, Homo sapiens
cctccagcccgggag

SEQ ID NO: 1070160 - DNA, 17 bp, Homo sapiens
cctccagcccgggagcc

SEQ ID NO: 1070161 - DNA, 18 bp, Homo sapiens
cctccagcccgggagcct

SEQ ID NO: 1070162 - DNA, 19 bp, Homo sapiens
cctccagcccgggagccta

SEQ ID NO: 1070163 - DNA, 14 bp, Homo sapiens
cctccagccctgcc

SEQ ID NO: 1070164 - DNA, 13 bp, Homo sapiens
cctccagcccttc

SEQ ID NO: 1070165 - DNA, 11 bp, Homo sapiens
cctccagcctc

SEQ ID NO: 1070166 - DNA, 12 bp, Homo sapiens
cctccagcctcc

SEQ ID NO: 1070167 - DNA, 13 bp, Homo sapiens
cctccagcctccc

SEQ ID NO: 1070168 - DNA, 14 bp, Homo sapiens
cctccagcctcccc

SEQ ID NO: 1070169 - DNA, 22 bp, Homo sapiens
cctccagcctcccctcccctgg

SEQ ID NO: 1070170 - DNA, 17 bp, Homo sapiens
cctccagcctccctgtc

SEQ ID NO: 1070171 - DNA, 23 bp, Homo sapiens
cctccagcctccctgtctccagc

SEQ ID NO: 1070172 - DNA, 12 bp, Homo sapiens
cctccagcctct

SEQ ID NO: 1070173 - DNA, 17 bp, Homo sapiens
cctccagcctctcccgg

SEQ ID NO: 1070174 - DNA, 17 bp, Homo sapiens
cctccagctgttcttag

SEQ ID NO: 1070175 - DNA, 20 bp, Homo sapiens
cctccagcttcaggcaggcc

SEQ ID NO: 1070176 - DNA, 21 bp, Homo sapiens
cctccagcttctggtactctc

SEQ ID NO: 1070177 - DNA, 15 bp, Homo sapiens
cctccaggagagagc

SEQ ID NO: 1070178 - DNA, 11 bp, Homo sapiens
cctccaggagg

SEQ ID NO: 1070179 - DNA, 19 bp, Homo sapiens
cctccaggaggggcctggg

SEQ ID NO: 1070180 - DNA, 21 bp, Homo sapiens
cctccaggcaggccaggctgc

SEQ ID NO: 1070181 - DNA, 20 bp, Homo sapiens
cctccaggcctgcctcccac

SEQ ID NO: 1070182 - DNA, 21 bp, Homo sapiens
cctccaggcctgcctcccact

SEQ ID NO: 1070183 - DNA, 19 bp, Homo sapiens
cctccagggaaggtggcca

SEQ ID NO: 1070184 - DNA, 20 bp, Homo sapiens
cctccagggccacgtgccag

SEQ ID NO: 1070185 - DNA, 22 bp, Homo sapiens
cctccagggccacgtgccaggc

SEQ ID NO: 1070186 - DNA, 14 bp, Homo sapiens
cctccagggccccc

SEQ ID NO: 1070187 - DNA, 17 bp, Homo sapiens
cctccaggggctcctgg

SEQ ID NO: 1070188 - DNA, 18 bp, Homo sapiens
cctccaggggctcctggg

SEQ ID NO: 1070189 - DNA, 21 bp, Homo sapiens
cctccagggtggcagcaacaa

SEQ ID NO: 1070190 - DNA, 19 bp, Homo sapiens
cctccaggtgtgcacgtgg

SEQ ID NO: 1070191 - DNA, 21 bp, Homo sapiens
cctccagtacgtcccgctgct

SEQ ID NO: 1070192 - DNA, 22 bp, Homo sapiens
cctccagtacgtcccgctgctg

SEQ ID NO: 1070193 - DNA, 23 bp, Homo sapiens
cctccagtacgtcccgctgctgt

SEQ ID NO: 1070194 - DNA, 12 bp, Homo sapiens
cctccagtcaca

SEQ ID NO: 1070195 - DNA, 18 bp, Homo sapiens
cctccagtcgttatttct

SEQ ID NO: 1070196 - DNA, 23 bp, Homo sapiens
cctccagtgggctgatgctggga

SEQ ID NO: 1070197 - DNA, 19 bp, Homo sapiens
cctccagtgtcagggtcca

SEQ ID NO: 1070198 - DNA, 23 bp, Homo sapiens
cctccatccacgtggcctctctc

SEQ ID NO: 1070199 - DNA, 20 bp, Homo sapiens
cctccatccatctgtccgtc

SEQ ID NO: 1070200 - DNA, 23 bp, Homo sapiens
cctccatccatctgtccgtccag

SEQ ID NO: 1070201 - DNA, 21 bp, Homo sapiens
cctccatccccatcggccctg

SEQ ID NO: 1070202 - DNA, 15 bp, Homo sapiens
cctccatcccgacat

SEQ ID NO: 1070203 - DNA, 15 bp, Homo sapiens
cctccatccctgctc

SEQ ID NO: 1070204 - DNA, 14 bp, Homo sapiens
cctccatccgtgct

SEQ ID NO: 1070205 - DNA, 15 bp, Homo sapiens
cctccatctttctac

SEQ ID NO: 1070206 - DNA, 20 bp, Homo sapiens
cctccatgccccagctctgg

SEQ ID NO: 1070207 - DNA, 11 bp, Homo sapiens
cctccatggga

SEQ ID NO: 1070208 - DNA, 13 bp, Homo sapiens
cctccatgggcta

SEQ ID NO: 1070209 - DNA, 17 bp, Homo sapiens
cctccatggtcctgtct

SEQ ID NO: 1070210 - DNA, 18 bp, Homo sapiens
cctccatggtcctgtctg

SEQ ID NO: 1070211 - DNA, 19 bp, Homo sapiens
cctccatggtcctgtctgt

SEQ ID NO: 1070212 - DNA, 18 bp, Homo sapiens
cctccatggtggaagggg

SEQ ID NO: 1070213 - DNA, 11 bp, Homo sapiens
cctccatgtgg

SEQ ID NO: 1070214 - DNA, 21 bp, Homo sapiens
cctccattgggcacagtccag

SEQ ID NO: 1070215 - DNA, 13 bp, Homo sapiens
cctccatttccca

SEQ ID NO: 1070216 - DNA, 16 bp, Homo sapiens
cctccatttgagaaaa

SEQ ID NO: 1070217 - DNA, 12 bp, Homo sapiens
cctccattttct

SEQ ID NO: 1070218 - DNA, 22 bp, Homo sapiens
cctccatttttatttcttcgtg

SEQ ID NO: 1070219 - DNA, 16 bp, Homo sapiens
cctcccaaagtgctgg

SEQ ID NO: 1070220 - DNA, 21 bp, Homo sapiens
cctcccaaagtgctgggatga

SEQ ID NO: 1070221 - DNA, 15 bp, Homo sapiens
cctcccaacagcgct

SEQ ID NO: 1070222 - DNA, 20 bp, Homo sapiens
cctcccaaccaaccagcagg

SEQ ID NO: 1070223 - DNA, 12 bp, Homo sapiens
cctcccaacctc

SEQ ID NO: 1070224 - DNA, 13 bp, Homo sapiens
cctcccaacctca

SEQ ID NO: 1070225 - DNA, 22 bp, Homo sapiens
cctcccaaggggcccaaattct

SEQ ID NO: 1070226 - DNA, 23 bp, Homo sapiens
cctcccacaattaaaccgcatgt

SEQ ID NO: 1070227 - DNA, 15 bp, Homo sapiens
cctcccacactccca

SEQ ID NO: 1070228 - DNA, 19 bp, Homo sapiens
cctcccacactcccaaggt

SEQ ID NO: 1070229 - DNA, 14 bp, Homo sapiens
cctcccacacttcc

SEQ ID NO: 1070230 - DNA, 12 bp, Homo sapiens
cctcccacagac

SEQ ID NO: 1070231 - DNA, 14 bp, Homo sapiens
cctcccacagacct

SEQ ID NO: 1070232 - DNA, 19 bp, Homo sapiens
cctcccacagacctgcagt

SEQ ID NO: 1070233 - DNA, 14 bp, Homo sapiens
cctcccaccacagc

SEQ ID NO: 1070234 - DNA, 16 bp, Homo sapiens
cctcccaccaccccat

SEQ ID NO: 1070235 - DNA, 13 bp, Homo sapiens
cctcccaccagag

SEQ ID NO: 1070236 - DNA, 14 bp, Homo sapiens
cctcccacggcacc

SEQ ID NO: 1070237 - DNA, 13 bp, Homo sapiens
cctcccactggga

SEQ ID NO: 1070238 - DNA, 14 bp, Homo sapiens
cctcccactgggac

SEQ ID NO: 1070239 - DNA, 19 bp, Homo sapiens
cctcccactttgtctgtac

SEQ ID NO: 1070240 - DNA, 22 bp, Homo sapiens
cctcccactttgtctgtacata

SEQ ID NO: 1070241 - DNA, 23 bp, Homo sapiens
cctcccactttgtctgtacatac

SEQ ID NO: 1070242 - DNA, 14 bp, Homo sapiens
cctcccagacaggc

SEQ ID NO: 1070243 - DNA, 17 bp, Homo sapiens
cctcccagacaggccct

SEQ ID NO: 1070244 - DNA, 19 bp, Homo sapiens
cctcccagacaggccctcc

SEQ ID NO: 1070245 - DNA, 21 bp, Homo sapiens
cctcccagaggagccaccagt

SEQ ID NO: 1070246 - DNA, 23 bp, Homo sapiens
cctcccagaggagccaccagttc

SEQ ID NO: 1070247 - DNA, 12 bp, Homo sapiens
cctcccagaggt

SEQ ID NO: 1070248 - DNA, 16 bp, Homo sapiens
cctcccagaggtccag

SEQ ID NO: 1070249 - DNA, 18 bp, Homo sapiens
cctcccagaggtccagcc

SEQ ID NO: 1070250 - DNA, 20 bp, Homo sapiens
cctcccagaggtccagccca

SEQ ID NO: 1070251 - DNA, 21 bp, Homo sapiens
cctcccagaggtccagcccat

SEQ ID NO: 1070252 - DNA, 23 bp, Homo sapiens
cctcccagaggtccagcccatct

SEQ ID NO: 1070253 - DNA, 9 bp, Homo sapiens
cctcccagc

SEQ ID NO: 1070254 - DNA, 15 bp, Homo sapiens
cctcccagcccataa

SEQ ID NO: 1070255 - DNA, 23 bp, Homo sapiens
cctcccagcccattgctgccaag

SEQ ID NO: 1070256 - DNA, 13 bp, Homo sapiens
cctcccagcccta

SEQ ID NO: 1070257 - DNA, 18 bp, Homo sapiens
cctcccagccctatggat

SEQ ID NO: 1070258 - DNA, 20 bp, Homo sapiens
cctcccagccctatggatgt

SEQ ID NO: 1070259 - DNA, 12 bp, Homo sapiens
cctcccagcctg

SEQ ID NO: 1070260 - DNA, 17 bp, Homo sapiens
cctcccagcgctctggg

SEQ ID NO: 1070261 - DNA, 11 bp, Homo sapiens
cctcccagctg

SEQ ID NO: 1070262 - DNA, 12 bp, Homo sapiens
cctcccagctgc

SEQ ID NO: 1070263 - DNA, 14 bp, Homo sapiens
cctcccaggggact

SEQ ID NO: 1070264 - DNA, 16 bp, Homo sapiens
cctcccaggggactgt

SEQ ID NO: 1070265 - DNA, 13 bp, Homo sapiens
cctcccaggggag

SEQ ID NO: 1070266 - DNA, 19 bp, Homo sapiens
cctcccaggggagccagct

SEQ ID NO: 1070267 - DNA, 22 bp, Homo sapiens
cctcccaggggagccagctgct

SEQ ID NO: 1070268 - DNA, 16 bp, Homo sapiens
cctcccagtgagactg

SEQ ID NO: 1070269 - DNA, 12 bp, Homo sapiens
cctcccatcccc

SEQ ID NO: 1070270 - DNA, 17 bp, Homo sapiens
cctcccatcccctcaac

SEQ ID NO: 1070271 - DNA, 17 bp, Homo sapiens
cctcccatcccctggac

SEQ ID NO: 1070272 - DNA, 13 bp, Homo sapiens
cctcccattctgc

SEQ ID NO: 1070273 - DNA, 18 bp, Homo sapiens
cctccccaaatggctgct

SEQ ID NO: 1070274 - DNA, 20 bp, Homo sapiens
cctccccaaggatgaccaca

SEQ ID NO: 1070275 - DNA, 17 bp, Homo sapiens
cctccccacacacaggc

SEQ ID NO: 1070276 - DNA, 19 bp, Homo sapiens
cctccccacacacaggcct

SEQ ID NO: 1070277 - DNA, 13 bp, Homo sapiens
cctccccacccaa

SEQ ID NO: 1070278 - DNA, 16 bp, Homo sapiens
cctccccacccaagag

SEQ ID NO: 1070279 - DNA, 13 bp, Homo sapiens
cctccccacctgt

SEQ ID NO: 1070280 - DNA, 15 bp, Homo sapiens
cctccccaccttccc

SEQ ID NO: 1070281 - DNA, 12 bp, Homo sapiens
cctccccagaat

SEQ ID NO: 1070282 - DNA, 13 bp, Homo sapiens
cctccccagaatc

SEQ ID NO: 1070283 - DNA, 16 bp, Homo sapiens
cctccccagcaggtgg

SEQ ID NO: 1070284 - DNA, 20 bp, Homo sapiens
cctccccagcaggtggggag

SEQ ID NO: 1070285 - DNA, 12 bp, Homo sapiens
cctccccagcca

SEQ ID NO: 1070286 - DNA, 22 bp, Homo sapiens
cctccccaggggagagggtctg

SEQ ID NO: 1070287 - DNA, 18 bp, Homo sapiens
cctccccatctgtccagc

SEQ ID NO: 1070288 - DNA, 20 bp, Homo sapiens
cctccccatttcccatctgc

SEQ ID NO: 1070289 - DNA, 22 bp, Homo sapiens
cctcccccaacccccaccccac

SEQ ID NO: 1070290 - DNA, 12 bp, Homo sapiens
cctcccccaaga

SEQ ID NO: 1070291 - DNA, 14 bp, Homo sapiens
cctcccccactcct

SEQ ID NO: 1070292 - DNA, 16 bp, Homo sapiens
cctcccccactcctct

SEQ ID NO: 1070293 - DNA, 11 bp, Homo sapiens
cctcccccagc

SEQ ID NO: 1070294 - DNA, 16 bp, Homo sapiens
cctcccccatgggctg

SEQ ID NO: 1070295 - DNA, 18 bp, Homo sapiens
cctccccccactgcaggc

SEQ ID NO: 1070296 - DNA, 13 bp, Homo sapiens
cctccccccactt

SEQ ID NO: 1070297 - DNA, 16 bp, Homo sapiens
cctccccccagctccc

SEQ ID NO: 1070298 - DNA, 13 bp, Homo sapiens
cctccccctaacc

SEQ ID NO: 1070299 - DNA, 13 bp, Homo sapiens
cctccccctaccc

SEQ ID NO: 1070300 - DNA, 14 bp, Homo sapiens
cctccccctcaacc

SEQ ID NO: 1070301 - DNA, 14 bp, Homo sapiens
cctccccctgcaac

SEQ ID NO: 1070302 - DNA, 15 bp, Homo sapiens
cctccccctgccagt

SEQ ID NO: 1070303 - DNA, 19 bp, Homo sapiens
cctccccctgccagtgcct

SEQ ID NO: 1070304 - DNA, 14 bp, Homo sapiens
cctccccctgtccc

SEQ ID NO: 1070305 - DNA, 20 bp, Homo sapiens
cctccccctttcacactgga

SEQ ID NO: 1070306 - DNA, 17 bp, Homo sapiens
cctccccctttggggta

SEQ ID NO: 1070307 - DNA, 18 bp, Homo sapiens
cctccccctttggggtag

SEQ ID NO: 1070308 - DNA, 13 bp, Homo sapiens
cctccccgcccct

SEQ ID NO: 1070309 - DNA, 15 bp, Homo sapiens
cctccccgcccctgt

SEQ ID NO: 1070310 - DNA, 19 bp, Homo sapiens
cctccccgctgccctttgg

SEQ ID NO: 1070311 - DNA, 15 bp, Homo sapiens
cctccccgctgggaa

SEQ ID NO: 1070312 - DNA, 23 bp, Homo sapiens
cctccccggctcgagcagtcctg

SEQ ID NO: 1070313 - DNA, 14 bp, Homo sapiens
cctccccgtccctg

SEQ ID NO: 1070314 - DNA, 23 bp, Homo sapiens
cctccccgtccctgtcccccagc

SEQ ID NO: 1070315 - DNA, 18 bp, Homo sapiens
cctcccctatccacccag

SEQ ID NO: 1070316 - DNA, 13 bp, Homo sapiens
cctcccctcagag

SEQ ID NO: 1070317 - DNA, 20 bp, Homo sapiens
cctcccctcagagcccatgg

SEQ ID NO: 1070318 - DNA, 15 bp, Homo sapiens
cctctctccttggcc

SEQ ID NO: 1070319 - DNA, 14 bp, Homo sapiens
cctctctcctttgc

SEQ ID NO: 1070320 - DNA, 17 bp, Homo sapiens
cctctctcggagccctc

SEQ ID NO: 1070321 - DNA, 21 bp, Homo sapiens
cctctctcggagccctcagac

SEQ ID NO: 1070322 - DNA, 10 bp, Homo sapiens
cctctctctc

SEQ ID NO: 1070323 - DNA, 15 bp, Homo sapiens
cctctctctctctat

SEQ ID NO: 1070324 - DNA, 17 bp, Homo sapiens
cctctctctctctcctc

SEQ ID NO: 1070325 - DNA, 18 bp, Homo sapiens
cctctctctctctcctca

SEQ ID NO: 1070326 - DNA, 13 bp, Homo sapiens
cctctctctcttc

SEQ ID NO: 1070327 - DNA, 14 bp, Homo sapiens
cctctctctcttct

SEQ ID NO: 1070328 - DNA, 14 bp, Homo sapiens
cctctctctgctcc

SEQ ID NO: 1070329 - DNA, 16 bp, Homo sapiens
cctctctcttctgctc

SEQ ID NO: 1070330 - DNA, 22 bp, Homo sapiens
cctctctcttctgctccaccct

SEQ ID NO: 1070331 - DNA, 21 bp, Homo sapiens
cctctctgaagcgactctcct

SEQ ID NO: 1070332 - DNA, 21 bp, Homo sapiens
cctctctgatcttgtgctcag

SEQ ID NO: 1070333 - DNA, 20 bp, Homo sapiens
cctctctgatgtcccagtgc

SEQ ID NO: 1070334 - DNA, 21 bp, Homo sapiens
cctctctgcagacttcccagc

SEQ ID NO: 1070335 - DNA, 12 bp, Homo sapiens
cctctctgcctc

SEQ ID NO: 1070336 - DNA, 16 bp, Homo sapiens
cctctctgcctctctt

SEQ ID NO: 1070337 - DNA, 19 bp, Homo sapiens
cctctctgcctctcttctt

SEQ ID NO: 1070338 - DNA, 17 bp, Homo sapiens
cctctctgctccttcac

SEQ ID NO: 1070339 - DNA, 21 bp, Homo sapiens
cctcttggagaagtctcagct

SEQ ID NO: 1070340 - DNA, 17 bp, Homo sapiens
cctcttggataccagct

SEQ ID NO: 1070341 - DNA, 19 bp, Homo sapiens
cctcttggataccagctca

SEQ ID NO: 1070342 - DNA, 20 bp, Homo sapiens
cctcttggattaaggaagac

SEQ ID NO: 1070343 - DNA, 16 bp, Homo sapiens
cctcttggcttctcag

SEQ ID NO: 1070344 - DNA, 17 bp, Homo sapiens
cctcttggcttctcagc

SEQ ID NO: 1070345 - DNA, 18 bp, Homo sapiens
cctcttggcttctcagcc

SEQ ID NO: 1070346 - DNA, 22 bp, Homo sapiens
cctcttggtgtgattgcacaga

SEQ ID NO: 1070347 - DNA, 17 bp, Homo sapiens
cctcttgtaaagactgg

SEQ ID NO: 1070348 - DNA, 18 bp, Homo sapiens
cctcttgtaaataaagcc

SEQ ID NO: 1070349 - DNA, 20 bp, Homo sapiens
cctcttgtaaataaagccct

SEQ ID NO: 1070350 - DNA, 12 bp, Homo sapiens
cctcttgtccct

SEQ ID NO: 1070351 - DNA, 18 bp, Homo sapiens
cctcttgtcctggccctt

SEQ ID NO: 1070352 - DNA, 20 bp, Homo sapiens
cctcttgtcctggcccttca

SEQ ID NO: 1070353 - DNA, 13 bp, Homo sapiens
cctcttgtctccc

SEQ ID NO: 1070354 - DNA, 22 bp, Homo sapiens
cctcttgtttctgggtccctgc

SEQ ID NO: 1070355 - DNA, 16 bp, Homo sapiens
cctcttgtttctgtgc

SEQ ID NO: 1070356 - DNA, 15 bp, Homo sapiens
cctctttcatccact

SEQ ID NO: 1070357 - DNA, 19 bp, Homo sapiens
cctctttcatctcctgagt

SEQ ID NO: 1070358 - DNA, 15 bp, Homo sapiens
cctctttcatctgta

SEQ ID NO: 1070359 - DNA, 22 bp, Homo sapiens
cctctttcatctgtaagggact

SEQ ID NO: 1070360 - DNA, 14 bp, Homo sapiens
cctctttcccctcc

SEQ ID NO: 1070361 - DNA, 18 bp, Homo sapiens
cctctttcccctcctttg

SEQ ID NO: 1070362 - DNA, 15 bp, Homo sapiens
cctctttccctagga

SEQ ID NO: 1070363 - DNA, 21 bp, Homo sapiens
cctctttctctccccaacccc

SEQ ID NO: 1070364 - DNA, 11 bp, Homo sapiens
cctctttctgc

SEQ ID NO: 1070365 - DNA, 18 bp, Homo sapiens
cctctttctgctctgcca

SEQ ID NO: 1070366 - DNA, 19 bp, Homo sapiens
cctctttctgctctgccat

SEQ ID NO: 1070367 - DNA, 15 bp, Homo sapiens
cctctttcttataat

SEQ ID NO: 1070368 - DNA, 18 bp, Homo sapiens
cctctttgaatctctgta

SEQ ID NO: 1070369 - DNA, 13 bp, Homo sapiens
cctctttgctttg

SEQ ID NO: 1070370 - DNA, 14 bp, Homo sapiens
cctctttgctttgc

SEQ ID NO: 1070371 - DNA, 17 bp, Homo sapiens
cctctttgctttgcttt

SEQ ID NO: 1070372 - DNA, 14 bp, Homo sapiens
cctctttggctccc

SEQ ID NO: 1070373 - DNA, 16 bp, Homo sapiens
cctctttgtaataaaa

SEQ ID NO: 1070374 - DNA, 16 bp, Homo sapiens
cctcttttcctggcag

SEQ ID NO: 1070375 - DNA, 17 bp, Homo sapiens
cctcttttcctggcagc

SEQ ID NO: 1070376 - DNA, 19 bp, Homo sapiens
cctcttttcctggcagctg

SEQ ID NO: 1070377 - DNA, 20 bp, Homo sapiens
cctcttttcctggcagctgc

SEQ ID NO: 1070378 - DNA, 15 bp, Homo sapiens
cctcttttcttactc

SEQ ID NO: 1070379 - DNA, 14 bp, Homo sapiens
cctcttttggcctt

SEQ ID NO: 1070380 - DNA, 22 bp, Homo sapiens
cctcttttgttgtccttgcccc

SEQ ID NO: 1070381 - DNA, 13 bp, Homo sapiens
cctctttttcctc

SEQ ID NO: 1070382 - DNA, 13 bp, Homo sapiens
cctctttttcctt

SEQ ID NO: 1070383 - DNA, 19 bp, Homo sapiens
cctctttttgccctttagg

SEQ ID NO: 1070384 - DNA, 22 bp, Homo sapiens
cctgaaaatgtttttctgccag

SEQ ID NO: 1070385 - DNA, 19 bp, Homo sapiens
cctgaaacacgaaacttgt

SEQ ID NO: 1070386 - DNA, 11 bp, Homo sapiens
cctgaaacact

SEQ ID NO: 1070387 - DNA, 16 bp, Homo sapiens
cctgaaacactgcttc

SEQ ID NO: 1070388 - DNA, 17 bp, Homo sapiens
cctgaaacactggacct

SEQ ID NO: 1070389 - DNA, 18 bp, Homo sapiens
cctgaaacactggacctg

SEQ ID NO: 1070390 - DNA, 19 bp, Homo sapiens
cctgaaacactggacctgg

SEQ ID NO: 1070391 - DNA, 16 bp, Homo sapiens
cctgaaacagccatgt

SEQ ID NO: 1070392 - DNA, 17 bp, Homo sapiens
cctgaaacgctcctttg

SEQ ID NO: 1070393 - DNA, 18 bp, Homo sapiens
cctgaaacttacacacaa

SEQ ID NO: 1070394 - DNA, 14 bp, Homo sapiens
cctgaaagcctgtc

SEQ ID NO: 1070395 - DNA, 19 bp, Homo sapiens
cctgaaagcctgtctcttt

SEQ ID NO: 1070396 - DNA, 13 bp, Homo sapiens
cctgaaagggccc

SEQ ID NO: 1070397 - DNA, 15 bp, Homo sapiens
cctgaaatttcagat

SEQ ID NO: 1070398 - DNA, 15 bp, Homo sapiens
cctgaacaagaattg

SEQ ID NO: 1070399 - DNA, 16 bp, Homo sapiens
cctgaacaagaattgg

SEQ ID NO: 1070400 - DNA, 17 bp, Homo sapiens
cctgaacaagaattgga

SEQ ID NO: 1070401 - DNA, 21 bp, Homo sapiens
cctgaacaagaattggaagct

SEQ ID NO: 1070402 - DNA, 20 bp, Homo sapiens
cctgaacatccttccttccc

SEQ ID NO: 1070403 - DNA, 16 bp, Homo sapiens
cctgaacccacacctg

SEQ ID NO: 1070404 - DNA, 16 bp, Homo sapiens
cctgaaccccatgggc

SEQ ID NO: 1070405 - DNA, 23 bp, Homo sapiens
cctgaaccccatgggcttggact

SEQ ID NO: 1070406 - DNA, 17 bp, Homo sapiens
cctgaacccctggccag

SEQ ID NO: 1070407 - DNA, 18 bp, Homo sapiens
cctgaaccgcacagctca

SEQ ID NO: 1070408 - DNA, 21 bp, Homo sapiens
cctgaacgttttcttctttcc

SEQ ID NO: 1070409 - DNA, 14 bp, Homo sapiens
cctgaactccagag

SEQ ID NO: 1070410 - DNA, 16 bp, Homo sapiens
cctgaactccagaggt

SEQ ID NO: 1070411 - DNA, 21 bp, Homo sapiens
cctgaactcctggctttccag

SEQ ID NO: 1070412 - DNA, 14 bp, Homo sapiens
cctgaagactgagg

SEQ ID NO: 1070413 - DNA, 17 bp, Homo sapiens
cctgaagagacaggcac

SEQ ID NO: 1070414 - DNA, 18 bp, Homo sapiens
cctgaagagacaggcacc

SEQ ID NO: 1070415 - DNA, 17 bp, Homo sapiens
cctgaagagcgctcctc

SEQ ID NO: 1070416 - DNA, 20 bp, Homo sapiens
cctgaagagcgctcctctgc

SEQ ID NO: 1070417 - DNA, 22 bp, Homo sapiens
cctgaagagcgctcctctgcct

SEQ ID NO: 1070418 - DNA, 18 bp, Homo sapiens
cctgaagaggcgggccag

SEQ ID NO: 1070419 - DNA, 19 bp, Homo sapiens
cctgaagaggcgggccagc

SEQ ID NO: 1070420 - DNA, 15 bp, Homo sapiens
cctgaagatgtctcc

SEQ ID NO: 1070421 - DNA, 18 bp, Homo sapiens
cctgaagatgtctcctca

SEQ ID NO: 1070422 - DNA, 12 bp, Homo sapiens
cctgaagccaga

SEQ ID NO: 1070423 - DNA, 23 bp, Homo sapiens
cctgaagcccagcgacacagaag

SEQ ID NO: 1070424 - DNA, 12 bp, Homo sapiens
cctgaagcctcc

SEQ ID NO: 1070425 - DNA, 16 bp, Homo sapiens
cctgaagcctccgtgg

SEQ ID NO: 1070426 - DNA, 23 bp, Homo sapiens
cctgaagcctctgccctgcctcc

SEQ ID NO: 1070427 - DNA, 18 bp, Homo sapiens
cctgaagcctggattcca

SEQ ID NO: 1070428 - DNA, 13 bp, Homo sapiens
cctgaagctgctg

SEQ ID NO: 1070429 - DNA, 18 bp, Homo sapiens
cctgaagctggcctggac

SEQ ID NO: 1070430 - DNA, 15 bp, Homo sapiens
cctgaagggaactag

SEQ ID NO: 1070431 - DNA, 16 bp, Homo sapiens
cctgaagggaaggcaa

SEQ ID NO: 1070432 - DNA, 22 bp, Homo sapiens
cctgaagggaaggcaaaggcag

SEQ ID NO: 1070433 - DNA, 16 bp, Homo sapiens
cctgaaggggcgtctg

SEQ ID NO: 1070434 - DNA, 14 bp, Homo sapiens
cctgaatcagctgg

SEQ ID NO: 1070435 - DNA, 15 bp, Homo sapiens
cctgaatcagctgga

SEQ ID NO: 1070436 - DNA, 16 bp, Homo sapiens
cctgaatcatgagcct

SEQ ID NO: 1070437 - DNA, 12 bp, Homo sapiens
cctgaatcattc

SEQ ID NO: 1070438 - DNA, 17 bp, Homo sapiens
cctgaatccaaactaat

SEQ ID NO: 1070439 - DNA, 19 bp, Homo sapiens
cctgaatctgtgcaaacag

SEQ ID NO: 1070440 - DNA, 20 bp, Homo sapiens
cctgaatggttccatgcctg

SEQ ID NO: 1070441 - DNA, 22 bp, Homo sapiens
cctgaatggttccatgcctgag

SEQ ID NO: 1070442 - DNA, 23 bp, Homo sapiens
cctgaatggttccatgcctgagg

SEQ ID NO: 1070443 - DNA, 16 bp, Homo sapiens
cctgaatttgtaagca

SEQ ID NO: 1070444 - DNA, 13 bp, Homo sapiens
cctgacaaatttt

SEQ ID NO: 1070445 - DNA, 15 bp, Homo sapiens
cctgacacaccaggc

SEQ ID NO: 1070446 - DNA, 17 bp, Homo sapiens
cctgacacaccaggcgc

SEQ ID NO: 1070447 - DNA, 14 bp, Homo sapiens
cctgacacactaac

SEQ ID NO: 1070448 - DNA, 16 bp, Homo sapiens
cctcccctcagcgcag

SEQ ID NO: 1070449 - DNA, 14 bp, Homo sapiens
cctcccctcccagt

SEQ ID NO: 1070450 - DNA, 14 bp, Homo sapiens
cctcccctctcaga

SEQ ID NO: 1070451 - DNA, 20 bp, Homo sapiens
cctcccctctcatccccctg

SEQ ID NO: 1070452 - DNA, 17 bp, Homo sapiens
cctcccctctccttcct

SEQ ID NO: 1070453 - DNA, 16 bp, Homo sapiens
cctcccctctctgcac

SEQ ID NO: 1070454 - DNA, 16 bp, Homo sapiens
cctcccctctcttgca

SEQ ID NO: 1070455 - DNA, 14 bp, Homo sapiens
cctcccctgaggct

SEQ ID NO: 1070456 - DNA, 22 bp, Homo sapiens
cctcccctgaggctcagggaaa

SEQ ID NO: 1070457 - DNA, 14 bp, Homo sapiens
cctcccctgccacc

SEQ ID NO: 1070458 - DNA, 16 bp, Homo sapiens
cctcccctgccagggc

SEQ ID NO: 1070459 - DNA, 13 bp, Homo sapiens
cctcccctgccct

SEQ ID NO: 1070460 - DNA, 15 bp, Homo sapiens
cctcccctgccctgg

SEQ ID NO: 1070461 - DNA, 17 bp, Homo sapiens
cctccccttccctgcaa

SEQ ID NO: 1070462 - DNA, 12 bp, Homo sapiens
cctccccttggg

SEQ ID NO: 1070463 - DNA, 16 bp, Homo sapiens
cctccccttttctatg

SEQ ID NO: 1070464 - DNA, 15 bp, Homo sapiens
cctcccgaaaaatgt

SEQ ID NO: 1070465 - DNA, 15 bp, Homo sapiens
cctcccgacagccca

SEQ ID NO: 1070466 - DNA, 20 bp, Homo sapiens
cctcccgagtagctgggatt

SEQ ID NO: 1070467 - DNA, 14 bp, Homo sapiens
cctcccgcaccttc

SEQ ID NO: 1070468 - DNA, 16 bp, Homo sapiens
cctcccggctgccccc

SEQ ID NO: 1070469 - DNA, 16 bp, Homo sapiens
cctcccgggccctccc

SEQ ID NO: 1070470 - DNA, 17 bp, Homo sapiens
cctcccgggccctccct

SEQ ID NO: 1070471 - DNA, 21 bp, Homo sapiens
cctcccgggccctcccttgga

SEQ ID NO: 1070472 - DNA, 20 bp, Homo sapiens
cctcccgtagtctcctgggt

SEQ ID NO: 1070473 - DNA, 21 bp, Homo sapiens
cctcccgtagtctcctgggtg

SEQ ID NO: 1070474 - DNA, 19 bp, Homo sapiens
cctccctagcccttccagc

SEQ ID NO: 1070475 - DNA, 22 bp, Homo sapiens
cctccctagcccttccagcctg

SEQ ID NO: 1070476 - DNA, 23 bp, Homo sapiens
cctccctagcccttccagcctgg

SEQ ID NO: 1070477 - DNA, 14 bp, Homo sapiens
cctccctcaccctg

SEQ ID NO: 1070478 - DNA, 22 bp, Homo sapiens
cctccctcaccctgagcccctt

SEQ ID NO: 1070479 - DNA, 12 bp, Homo sapiens
cctccctcagcc

SEQ ID NO: 1070480 - DNA, 15 bp, Homo sapiens
cctccctcattcatc

SEQ ID NO: 1070481 - DNA, 20 bp, Homo sapiens
cctccctccaagcctggcac

SEQ ID NO: 1070482 - DNA, 12 bp, Homo sapiens
cctccctccacc

SEQ ID NO: 1070483 - DNA, 15 bp, Homo sapiens
cctccctcccacact

SEQ ID NO: 1070484 - DNA, 20 bp, Homo sapiens
cctccgtccacccaggctgc

SEQ ID NO: 1070485 - DNA, 13 bp, Homo sapiens
cctccgtcttccc

SEQ ID NO: 1070486 - DNA, 14 bp, Homo sapiens
cctccgtcttccca

SEQ ID NO: 1070487 - DNA, 16 bp, Homo sapiens
cctccgtgatccatcc

SEQ ID NO: 1070488 - DNA, 23 bp, Homo sapiens
cctccgtgatccatccatctcca

SEQ ID NO: 1070489 - DNA, 14 bp, Homo sapiens
cctccgtggaacat

SEQ ID NO: 1070490 - DNA, 15 bp, Homo sapiens
cctccgtgtggagca

SEQ ID NO: 1070491 - DNA, 17 bp, Homo sapiens
cctccgtttatgggcct

SEQ ID NO: 1070492 - DNA, 19 bp, Homo sapiens
cctccgtttatgggccttg

SEQ ID NO: 1070493 - DNA, 14 bp, Homo sapiens
cctcctaaaacaac

SEQ ID NO: 1070494 - DNA, 18 bp, Homo sapiens
cctcctaaatgtcagctg

SEQ ID NO: 1070495 - DNA, 21 bp, Homo sapiens
cctcctaaatgtcagctgttg

SEQ ID NO: 1070496 - DNA, 20 bp, Homo sapiens
cctcctaaggctccccaccc

SEQ ID NO: 1070497 - DNA, 21 bp, Homo sapiens
cctcctaaggctccccacccc

SEQ ID NO: 1070498 - DNA, 16 bp, Homo sapiens
cctcctaagtcccttc

SEQ ID NO: 1070499 - DNA, 19 bp, Homo sapiens
cctcctaagtcccttccta

SEQ ID NO: 1070500 - DNA, 17 bp, Homo sapiens
cctcctaccccttcctg

SEQ ID NO: 1070501 - DNA, 17 bp, Homo sapiens
cctcctaccctcccacc

SEQ ID NO: 1070502 - DNA, 23 bp, Homo sapiens
cctcctaccctcccaccagaacg

SEQ ID NO: 1070503 - DNA, 14 bp, Homo sapiens
cctcctacctcagc

SEQ ID NO: 1070504 - DNA, 22 bp, Homo sapiens
cctcctacctggggactcctca

SEQ ID NO: 1070505 - DNA, 23 bp, Homo sapiens
cctcctacctggggactcctcaa

SEQ ID NO: 1070506 - DNA, 20 bp, Homo sapiens
cctcctagaggtgggcagct

SEQ ID NO: 1070507 - DNA, 15 bp, Homo sapiens
cctcctagagtgcag

SEQ ID NO: 1070508 - DNA, 14 bp, Homo sapiens
cctcctagcccctt

SEQ ID NO: 1070509 - DNA, 14 bp, Homo sapiens
cctcctaggctgga

SEQ ID NO: 1070510 - DNA, 20 bp, Homo sapiens
cctcctagggcattgtatct

SEQ ID NO: 1070511 - DNA, 13 bp, Homo sapiens
cctcctagggggt

SEQ ID NO: 1070512 - DNA, 19 bp, Homo sapiens
cctcctatatcattattta

SEQ ID NO: 1070513 - DNA, 19 bp, Homo sapiens
cctcctatcacctcccctc

SEQ ID NO: 1070514 - DNA, 14 bp, Homo sapiens
cctcctcacccacc

SEQ ID NO: 1070515 - DNA, 16 bp, Homo sapiens
cctctaagctgctcta

SEQ ID NO: 1070516 - DNA, 19 bp, Homo sapiens
cctctaaggttgggcaggg

SEQ ID NO: 1070517 - DNA, 14 bp, Homo sapiens
cctctaatgagact

SEQ ID NO: 1070518 - DNA, 13 bp, Homo sapiens
cctctacacaggg

SEQ ID NO: 1070519 - DNA, 18 bp, Homo sapiens
cctctacagagcttccct

SEQ ID NO: 1070520 - DNA, 20 bp, Homo sapiens
cctctacagagcttccctga

SEQ ID NO: 1070521 - DNA, 14 bp, Homo sapiens
cctctacagccgtc

SEQ ID NO: 1070522 - DNA, 14 bp, Homo sapiens
cctctacctctctc

SEQ ID NO: 1070523 - DNA, 15 bp, Homo sapiens
cctctacctctctcc

SEQ ID NO: 1070524 - DNA, 15 bp, Homo sapiens
cctctactcttcctg

SEQ ID NO: 1070525 - DNA, 16 bp, Homo sapiens
cctctactcttcctgt

SEQ ID NO: 1070526 - DNA, 11 bp, Homo sapiens
cctctactgtc

SEQ ID NO: 1070527 - DNA, 15 bp, Homo sapiens
cctctactgtctcct

SEQ ID NO: 1070528 - DNA, 23 bp, Homo sapiens
cctctactgtctcctccctgggc

SEQ ID NO: 1070529 - DNA, 14 bp, Homo sapiens
cctctactgttgca

SEQ ID NO: 1070530 - DNA, 16 bp, Homo sapiens
cctctactgttgcaca

SEQ ID NO: 1070531 - DNA, 20 bp, Homo sapiens
cctctactgttgcacagcca

SEQ ID NO: 1070532 - DNA, 17 bp, Homo sapiens
cctctagaaatttttca

SEQ ID NO: 1070533 - DNA, 18 bp, Homo sapiens
cctctagaagccaaggga

SEQ ID NO: 1070534 - DNA, 22 bp, Homo sapiens
cctctagagagatgagaagcca

SEQ ID NO: 1070535 - DNA, 14 bp, Homo sapiens
cctctagaggcaag

SEQ ID NO: 1070536 - DNA, 22 bp, Homo sapiens
cctctagctgttcttttttgta

SEQ ID NO: 1070537 - DNA, 13 bp, Homo sapiens
cctctagggcagg

SEQ ID NO: 1070538 - DNA, 16 bp, Homo sapiens
cctctagggcagggtg

SEQ ID NO: 1070539 - DNA, 13 bp, Homo sapiens
cctctaggggcag

SEQ ID NO: 1070540 - DNA, 14 bp, Homo sapiens
cctctaggggcagc

SEQ ID NO: 1070541 - DNA, 20 bp, Homo sapiens
cctgcaactcaaggactttg

SEQ ID NO: 1070542 - DNA, 17 bp, Homo sapiens
cctgcaacttccgctga

SEQ ID NO: 1070543 - DNA, 22 bp, Homo sapiens
cctgcaacttctatcctttctt

SEQ ID NO: 1070544 - DNA, 17 bp, Homo sapiens
cctgcaagaccacggag

SEQ ID NO: 1070545 - DNA, 14 bp, Homo sapiens
cctgcctcagcctt

SEQ ID NO: 1070546 - DNA, 16 bp, Homo sapiens
cctgcctcagccttcc

SEQ ID NO: 1070547 - DNA, 18 bp, Homo sapiens
cctgcctccacccgtcct

SEQ ID NO: 1070548 - DNA, 19 bp, Homo sapiens
cctgcctccctttctggga

SEQ ID NO: 1070549 - DNA, 21 bp, Homo sapiens
cctgcctccctttctgggagg

SEQ ID NO: 1070550 - DNA, 12 bp, Homo sapiens
cctgcctcctgc

SEQ ID NO: 1070551 - DNA, 14 bp, Homo sapiens
cctgcctcgagggc

SEQ ID NO: 1070552 - DNA, 20 bp, Homo sapiens
cctgcctcgagggccgcctg

SEQ ID NO: 1070553 - DNA, 22 bp, Homo sapiens
cctgcctcgagggccgcctgcc

SEQ ID NO: 1070554 - DNA, 23 bp, Homo sapiens
cctgcctctcatcaactgaatga

SEQ ID NO: 1070555 - DNA, 13 bp, Homo sapiens
cctgcctctcccc

SEQ ID NO: 1070556 - DNA, 16 bp, Homo sapiens
cctgcctctccccaaa

SEQ ID NO: 1070557 - DNA, 15 bp, Homo sapiens
cctgcctcttctcta

SEQ ID NO: 1070558 - DNA, 22 bp, Homo sapiens
cctgcctgacagccttccccag

SEQ ID NO: 1070559 - DNA, 12 bp, Homo sapiens
cctgcctgaccc

SEQ ID NO: 1070560 - DNA, 17 bp, Homo sapiens
cctgcctgacccatccc

SEQ ID NO: 1070561 - DNA, 18 bp, Homo sapiens
cctgcctgacccatccct

SEQ ID NO: 1070562 - DNA, 22 bp, Homo sapiens
cctgcctgaggaggaggacaca

SEQ ID NO: 1070563 - DNA, 14 bp, Homo sapiens
cctgcctgatccct

SEQ ID NO: 1070564 - DNA, 15 bp, Homo sapiens
cctgcctgatccctg

SEQ ID NO: 1070565 - DNA, 18 bp, Homo sapiens
cctgcctgatccctgaac

SEQ ID NO: 1070566 - DNA, 14 bp, Homo sapiens
cctgcctgcacctc

SEQ ID NO: 1070567 - DNA, 16 bp, Homo sapiens
cctgcctgcacctccg

SEQ ID NO: 1070568 - DNA, 20 bp, Homo sapiens
cctgcctgcatggcatcaga

SEQ ID NO: 1070569 - DNA, 23 bp, Homo sapiens
cctgcctgccctgcctcagccag

SEQ ID NO: 1070570 - DNA, 16 bp, Homo sapiens
cctgcctgccgctgca

SEQ ID NO: 1070571 - DNA, 16 bp, Homo sapiens
cctgcctgcctccacc

SEQ ID NO: 1070572 - DNA, 12 bp, Homo sapiens
cctgcctggaac

SEQ ID NO: 1070573 - DNA, 14 bp, Homo sapiens
cctgcctggccagg

SEQ ID NO: 1070574 - DNA, 13 bp, Homo sapiens
cctgcctggcccc

SEQ ID NO: 1070575 - DNA, 15 bp, Homo sapiens
cctgcctggccccca

SEQ ID NO: 1070576 - DNA, 13 bp, Homo sapiens
cctgcctgggcct

SEQ ID NO: 1070577 - DNA, 18 bp, Homo sapiens
cctgcctgtcacctggga

SEQ ID NO: 1070578 - DNA, 22 bp, Homo sapiens
cctgcctgtctgtctctccatc

SEQ ID NO: 1070579 - DNA, 11 bp, Homo sapiens
cctgcctgtgc

SEQ ID NO: 1070580 - DNA, 22 bp, Homo sapiens
cctgcctgttcccattcttgca

SEQ ID NO: 1070581 - DNA, 16 bp, Homo sapiens
cctgccttatcttgca

SEQ ID NO: 1070582 - DNA, 17 bp, Homo sapiens
cctgccttcctcctggg

SEQ ID NO: 1070583 - DNA, 16 bp, Homo sapiens
cctgccttcctctgag

SEQ ID NO: 1070584 - DNA, 18 bp, Homo sapiens
cctgccttcctctgagga

SEQ ID NO: 1070585 - DNA, 17 bp, Homo sapiens
cctgccttgaagccact

SEQ ID NO: 1070586 - DNA, 19 bp, Homo sapiens
cctgccttgccgctcccct

SEQ ID NO: 1070587 - DNA, 22 bp, Homo sapiens
cctgcctttaaatgaaacaagt

SEQ ID NO: 1070588 - DNA, 15 bp, Homo sapiens
cctgcctttaagcca

SEQ ID NO: 1070589 - DNA, 13 bp, Homo sapiens
cctgcgcacaggt

SEQ ID NO: 1070590 - DNA, 15 bp, Homo sapiens
cctgcgcacaggtgg

SEQ ID NO: 1070591 - DNA, 20 bp, Homo sapiens
cctgcgccaccgcccagaga

SEQ ID NO: 1070592 - DNA, 16 bp, Homo sapiens
cctgcgccagtcctgc

SEQ ID NO: 1070593 - DNA, 17 bp, Homo sapiens
cctgcgccagtcctgct

SEQ ID NO: 1070594 - DNA, 14 bp, Homo sapiens
cctgcgcccagagc

SEQ ID NO: 1070595 - DNA, 15 bp, Homo sapiens
cctgcgcccagagct

SEQ ID NO: 1070596 - DNA, 16 bp, Homo sapiens
cctgcgcccagagctg

SEQ ID NO: 1070597 - DNA, 13 bp, Homo sapiens
cctgcgcctccag

SEQ ID NO: 1070598 - DNA, 16 bp, Homo sapiens
cctgcgcctccagagg

SEQ ID NO: 1070599 - DNA, 17 bp, Homo sapiens
cctgcgcctccagaggt

SEQ ID NO: 1070600 - DNA, 14 bp, Homo sapiens
cctgcgcctccatc

SEQ ID NO: 1070601 - DNA, 22 bp, Homo sapiens
cctgcgcctccatccatctgtc

SEQ ID NO: 1070602 - DNA, 14 bp, Homo sapiens
cctgcgcctgtgat

SEQ ID NO: 1070603 - DNA, 15 bp, Homo sapiens
cctgcgcctgtgatg

SEQ ID NO: 1070604 - DNA, 18 bp, Homo sapiens
cctgcggagtgaagaggg

SEQ ID NO: 1070605 - DNA, 23 bp, Homo sapiens
cctgcggctgcctgccccccagt

SEQ ID NO: 1070606 - DNA, 20 bp, Homo sapiens
cctgcgggaccatctggggc

SEQ ID NO: 1070607 - DNA, 13 bp, Homo sapiens
cctgcgggccaca

SEQ ID NO: 1070608 - DNA, 17 bp, Homo sapiens
cctgcgggccacagggc

SEQ ID NO: 1070609 - DNA, 18 bp, Homo sapiens
cctgcgggccacagggca

SEQ ID NO: 1070610 - DNA, 12 bp, Homo sapiens
cctgcgggccag

SEQ ID NO: 1070611 - DNA, 13 bp, Homo sapiens
cctgcgggccagg

SEQ ID NO: 1070612 - DNA, 14 bp, Homo sapiens
cctgcgggccaggg

SEQ ID NO: 1070613 - DNA, 18 bp, Homo sapiens
cctgcgggccagggtcct

SEQ ID NO: 1070614 - DNA, 17 bp, Homo sapiens
cctgcgggcgcgggcag

SEQ ID NO: 1070615 - DNA, 15 bp, Homo sapiens
cctgcggggccaccc

SEQ ID NO: 1070616 - DNA, 14 bp, Homo sapiens
cctgcgggtcctca

SEQ ID NO: 1070617 - DNA, 17 bp, Homo sapiens
cctgcgggtcctcagct

SEQ ID NO: 1070618 - DNA, 18 bp, Homo sapiens
cctgcgggtcctcagctg

SEQ ID NO: 1070619 - DNA, 20 bp, Homo sapiens
cctgcgggtggggcttgggg

SEQ ID NO: 1070620 - DNA, 24 bp, Homo sapiens
cctgcgggtggggcttggggctca

SEQ ID NO: 1070621 - DNA, 16 bp, Homo sapiens
cctgcgggttttaatt

SEQ ID NO: 1070622 - DNA, 15 bp, Homo sapiens
cctgcgtcctcctca

SEQ ID NO: 1070623 - DNA, 17 bp, Homo sapiens
cctgcgtcctcctcacc

SEQ ID NO: 1070624 - DNA, 22 bp, Homo sapiens
cctgcgtcctcctcacctcatg

SEQ ID NO: 1070625 - DNA, 15 bp, Homo sapiens
cctgcgtcggccctg

SEQ ID NO: 1070626 - DNA, 20 bp, Homo sapiens
cctgcgtctccatatgtgta

SEQ ID NO: 1070627 - DNA, 17 bp, Homo sapiens
cctgcgtctgtttttaa

SEQ ID NO: 1070628 - DNA, 13 bp, Homo sapiens
cctgcgtgggggc

SEQ ID NO: 1070629 - DNA, 17 bp, Homo sapiens
cctgcgttcagcccctg

SEQ ID NO: 1070630 - DNA, 21 bp, Homo sapiens
cctgcgttcagcccctgatct

SEQ ID NO: 1070631 - DNA, 22 bp, Homo sapiens
cctgcgttcagcccctgatctc

SEQ ID NO: 1070632 - DNA, 22 bp, Homo sapiens
cctgcgttttggaagctctgaa

SEQ ID NO: 1070633 - DNA, 20 bp, Homo sapiens
cctgctacaacttcagcagt

SEQ ID NO: 1070634 - DNA, 16 bp, Homo sapiens
cctgctactctgttcc

SEQ ID NO: 1070635 - DNA, 15 bp, Homo sapiens
cctgctagagcaacc

SEQ ID NO: 1070636 - DNA, 19 bp, Homo sapiens
cctgctagagcaacccctg

SEQ ID NO: 1070637 - DNA, 16 bp, Homo sapiens
cctgctagcaggcccc

SEQ ID NO: 1070638 - DNA, 16 bp, Homo sapiens
cctgctatgacagctg

SEQ ID NO: 1070639 - DNA, 21 bp, Homo sapiens
cctgctatgacagctggctag

SEQ ID NO: 1070640 - DNA, 23 bp, Homo sapiens
cctgctcaactctacccctgctc

SEQ ID NO: 1070641 - DNA, 14 bp, Homo sapiens
cctgctcacaggca

SEQ ID NO: 1070642 - DNA, 14 bp, Homo sapiens
cctgctcacaggga

SEQ ID NO: 1070643 - DNA, 19 bp, Homo sapiens
cctgctcacgtcaaatgca

SEQ ID NO: 1070644 - DNA, 23 bp, Homo sapiens
cctgctcagtgcttgggctccac

SEQ ID NO: 1070645 - DNA, 18 bp, Homo sapiens
cctgctcatcatattcca

SEQ ID NO: 1070646 - DNA, 15 bp, Homo sapiens
cctgctccaccagca

SEQ ID NO: 1070647 - DNA, 17 bp, Homo sapiens
cctgctccaccagcagc

SEQ ID NO: 1070648 - DNA, 18 bp, Homo sapiens
cctgctccaccagcagca

SEQ ID NO: 1070649 - DNA, 22 bp, Homo sapiens
cctgctccaccagcagcatggc

SEQ ID NO: 1070650 - DNA, 13 bp, Homo sapiens
cctgctccagaag

SEQ ID NO: 1070651 - DNA, 16 bp, Homo sapiens
cctgctccagaagatg

SEQ ID NO: 1070652 - DNA, 21 bp, Homo sapiens
cctgctccagaatttggaaat

SEQ ID NO: 1070653 - DNA, 22 bp, Homo sapiens
cctgctccagaatttggaaatc

SEQ ID NO: 1070654 - DNA, 13 bp, Homo sapiens
cctgctccagctg

SEQ ID NO: 1070655 - DNA, 14 bp, Homo sapiens
cctgctccagctgt

SEQ ID NO: 1070656 - DNA, 22 bp, Homo sapiens
cctgctccagctgttcagctgg

SEQ ID NO: 1070657 - DNA, 18 bp, Homo sapiens
cctgctccagtgtatctc

SEQ ID NO: 1070658 - DNA, 20 bp, Homo sapiens
cctgctccatgactggctgt

SEQ ID NO: 1070659 - DNA, 16 bp, Homo sapiens
cctgctcccagcagcc

SEQ ID NO: 1070660 - DNA, 17 bp, Homo sapiens
cctgctcccagcctgct

SEQ ID NO: 1070661 - DNA, 18 bp, Homo sapiens
cctgctcccagcctgctg

SEQ ID NO: 1070662 - DNA, 18 bp, Homo sapiens
cctgctcccccaccccct

SEQ ID NO: 1070663 - DNA, 23 bp, Homo sapiens
cctgctcccccaccccctcccca

SEQ ID NO: 1070664 - DNA, 12 bp, Homo sapiens
cctgctcccctt

SEQ ID NO: 1070665 - DNA, 22 bp, Homo sapiens
cctggaaggacatccatgttcc

SEQ ID NO: 1070666 - DNA, 20 bp, Homo sapiens
cctggaaggtgccactccag

SEQ ID NO: 1070667 - DNA, 22 bp, Homo sapiens
cctggaataaaatataaaactg

SEQ ID NO: 1070668 - DNA, 18 bp, Homo sapiens
cctggaatatataaccag

SEQ ID NO: 1070669 - DNA, 16 bp, Homo sapiens
cctggaattcagcacc

SEQ ID NO: 1070670 - DNA, 17 bp, Homo sapiens
cctggaattcagcaccc

SEQ ID NO: 1070671 - DNA, 18 bp, Homo sapiens
cctggaattcagcaccct

SEQ ID NO: 1070672 - DNA, 11 bp, Homo sapiens
cctggacacac

SEQ ID NO: 1070673 - DNA, 11 bp, Homo sapiens
cctggacacat

SEQ ID NO: 1070674 - DNA, 20 bp, Homo sapiens
cctggacacccctgctctac

SEQ ID NO: 1070675 - DNA, 13 bp, Homo sapiens
cctggacacctcc

SEQ ID NO: 1070676 - DNA, 18 bp, Homo sapiens
cctggacacctcccaggg

SEQ ID NO: 1070677 - DNA, 20 bp, Homo sapiens
cctggacagatggcccaagg

SEQ ID NO: 1070678 - DNA, 14 bp, Homo sapiens
cctggacaggcagc

SEQ ID NO: 1070679 - DNA, 18 bp, Homo sapiens
cctggacaggcagcctcc

SEQ ID NO: 1070680 - DNA, 22 bp, Homo sapiens
cctggacaggcagcctcctttg

SEQ ID NO: 1070681 - DNA, 13 bp, Homo sapiens
cctggaccaaagg

SEQ ID NO: 1070682 - DNA, 20 bp, Homo sapiens
cctggaccaccagccccagc

SEQ ID NO: 1070683 - DNA, 14 bp, Homo sapiens
cctggaccccctgc

SEQ ID NO: 1070684 - DNA, 16 bp, Homo sapiens
cctggaccccctgccc

SEQ ID NO: 1070685 - DNA, 19 bp, Homo sapiens
cctggaccccctgcccgcc

SEQ ID NO: 1070686 - DNA, 17 bp, Homo sapiens
cctggacccctggggtg

SEQ ID NO: 1070687 - DNA, 21 bp, Homo sapiens
cctggacccctggggtggcca

SEQ ID NO: 1070688 - DNA, 13 bp, Homo sapiens
cctggaccctgtg

SEQ ID NO: 1070689 - DNA, 16 bp, Homo sapiens
cctggaccgagatgtg

SEQ ID NO: 1070690 - DNA, 14 bp, Homo sapiens
cctggacctatgca

SEQ ID NO: 1070691 - DNA, 18 bp, Homo sapiens
cctggacctatgcaggga

SEQ ID NO: 1070692 - DNA, 20 bp, Homo sapiens
cctggacctatgcagggagg

SEQ ID NO: 1070693 - DNA, 23 bp, Homo sapiens
cctggacctgccctgggccacac

SEQ ID NO: 1070694 - DNA, 16 bp, Homo sapiens
cctggacctgcctcct

SEQ ID NO: 1070695 - DNA, 13 bp, Homo sapiens
cctggacctggaa

SEQ ID NO: 1070696 - DNA, 15 bp, Homo sapiens
cctggacctgggaac

SEQ ID NO: 1070697 - DNA, 18 bp, Homo sapiens
cctggacgggccctcctt

SEQ ID NO: 1070698 - DNA, 20 bp, Homo sapiens
cctggactaaaggcatcctt

SEQ ID NO: 1070699 - DNA, 19 bp, Homo sapiens
cctggactccggaggactg

SEQ ID NO: 1070700 - DNA, 21 bp, Homo sapiens
cctggactccggaggactgag

SEQ ID NO: 1070701 - DNA, 23 bp, Homo sapiens
cctggactctgccccacgctgtg

SEQ ID NO: 1070702 - DNA, 18 bp, Homo sapiens
cctggactgaccctgcag

SEQ ID NO: 1070703 - DNA, 18 bp, Homo sapiens
cctggactgggaggtaga

SEQ ID NO: 1070704 - DNA, 14 bp, Homo sapiens
cctggactgttttc

SEQ ID NO: 1070705 - DNA, 13 bp, Homo sapiens
cctggacttgcct

SEQ ID NO: 1070706 - DNA, 16 bp, Homo sapiens
cctggacttgcctctg

SEQ ID NO: 1070707 - DNA, 16 bp, Homo sapiens
cctggactttcctgca

SEQ ID NO: 1070708 - DNA, 16 bp, Homo sapiens
cctggagaactagaga

SEQ ID NO: 1070709 - DNA, 16 bp, Homo sapiens
cctggagaagcaccag

SEQ ID NO: 1070710 - DNA, 17 bp, Homo sapiens
cctggagaagcaccagc

SEQ ID NO: 1070711 - DNA, 17 bp, Homo sapiens
cctggagacaaggtgct

SEQ ID NO: 1070712 - DNA, 19 bp, Homo sapiens
cctggagacaaggtgctaa

SEQ ID NO: 1070713 - DNA, 19 bp, Homo sapiens
cctggagacttagggcacc

SEQ ID NO: 1070714 - DNA, 23 bp, Homo sapiens
cctggagacttagggcaccaggg

SEQ ID NO: 1070715 - DNA, 22 bp, Homo sapiens
cctggagaggacggccctgcct

SEQ ID NO: 1070716 - DNA, 23 bp, Homo sapiens
cctggagaggacggccctgcctg

SEQ ID NO: 1070717 - DNA, 15 bp, Homo sapiens
cctggagaggcctgg

SEQ ID NO: 1070718 - DNA, 16 bp, Homo sapiens
cctggagaggcctggg

SEQ ID NO: 1070719 - DNA, 15 bp, Homo sapiens
cctggagatagctgg

SEQ ID NO: 1070720 - DNA, 23 bp, Homo sapiens
cctggagatattataagggagag

SEQ ID NO: 1070721 - DNA, 19 bp, Homo sapiens
cctggagatcctcctgcag

SEQ ID NO: 1070722 - DNA, 14 bp, Homo sapiens
cctggagcaggagc

SEQ ID NO: 1070723 - DNA, 17 bp, Homo sapiens
cctggagcatcccaggc

SEQ ID NO: 1070724 - DNA, 16 bp, Homo sapiens
cctggagccagactct

SEQ ID NO: 1070725 - DNA, 13 bp, Homo sapiens
cctggagccatcc

SEQ ID NO: 1070726 - DNA, 16 bp, Homo sapiens
cctggagcccacaacc

SEQ ID NO: 1070727 - DNA, 13 bp, Homo sapiens
cctggagcccgct

SEQ ID NO: 1070728 - DNA, 22 bp, Homo sapiens
cctggagcccgcttcaagctct

SEQ ID NO: 1070729 - DNA, 19 bp, Homo sapiens
cctggagccctgggcggag

SEQ ID NO: 1070730 - DNA, 14 bp, Homo sapiens
cctggagccctgtt

SEQ ID NO: 1070731 - DNA, 16 bp, Homo sapiens
cctggagccctgttgg

SEQ ID NO: 1070732 - DNA, 19 bp, Homo sapiens
cctggaggaattcagctca

SEQ ID NO: 1070733 - DNA, 20 bp, Homo sapiens
cctggaggaattcagctcag

SEQ ID NO: 1070734 - DNA, 14 bp, Homo sapiens
cctggaggcactga

SEQ ID NO: 1070735 - DNA, 22 bp, Homo sapiens
cctggaggcactgaagtgctta

SEQ ID NO: 1070736 - DNA, 17 bp, Homo sapiens
cctggaggcggtgcggc

SEQ ID NO: 1070737 - DNA, 21 bp, Homo sapiens
cctggaggcggtgcggcaggg

SEQ ID NO: 1070738 - DNA, 14 bp, Homo sapiens
cctggaggctcagc

SEQ ID NO: 1070739 - DNA, 21 bp, Homo sapiens
cctggagggaagagtggaggt

SEQ ID NO: 1070740 - DNA, 13 bp, Homo sapiens
cctggagggcact

SEQ ID NO: 1070741 - DNA, 19 bp, Homo sapiens
cctggaggggctggggact

SEQ ID NO: 1070742 - DNA, 20 bp, Homo sapiens
cctggagggtaactgggggg

SEQ ID NO: 1070743 - DNA, 21 bp, Homo sapiens
cctggagggtaactggggggc

SEQ ID NO: 1070744 - DNA, 23 bp, Homo sapiens
cctggaggtggctgagcccctgt

SEQ ID NO: 1070745 - DNA, 14 bp, Homo sapiens
cctggagtgcagtt

SEQ ID NO: 1070746 - DNA, 22 bp, Homo sapiens
cctggagtgtatgactgcacat

SEQ ID NO: 1070747 - DNA, 13 bp, Homo sapiens
cctggagttcttg

SEQ ID NO: 1070748 - DNA, 17 bp, Homo sapiens
cctggagttttgatttg

SEQ ID NO: 1070749 - DNA, 16 bp, Homo sapiens
cctggatagacgagtt

SEQ ID NO: 1070750 - DNA, 17 bp, Homo sapiens
cctggatagttaagggc

SEQ ID NO: 1070751 - DNA, 19 bp, Homo sapiens
cctggatagttaagggctt

SEQ ID NO: 1070752 - DNA, 15 bp, Homo sapiens
cctggatccagcact

SEQ ID NO: 1070753 - DNA, 18 bp, Homo sapiens
cctggatctacctggagg

SEQ ID NO: 1070754 - DNA, 19 bp, Homo sapiens
cctggatctccccactcta

SEQ ID NO: 1070755 - DNA, 21 bp, Homo sapiens
cctggatgatttcatcttctg

SEQ ID NO: 1070756 - DNA, 14 bp, Homo sapiens
cctggatgcccagg

SEQ ID NO: 1070757 - DNA, 14 bp, Homo sapiens
cctggatggcccct

SEQ ID NO: 1070758 - DNA, 18 bp, Homo sapiens
cctggatggcccctcctt

SEQ ID NO: 1070759 - DNA, 19 bp, Homo sapiens
cctggatggcccctccttg

SEQ ID NO: 1070760 - DNA, 21 bp, Homo sapiens
cctggatggcccctccttgca

SEQ ID NO: 1070761 - DNA, 21 bp, Homo sapiens
cctggatgggcattgggctga

SEQ ID NO: 1070762 - DNA, 14 bp, Homo sapiens
cctggatgggggtg

SEQ ID NO: 1070763 - DNA, 22 bp, Homo sapiens
cctggatgggggtgcaggcagc

SEQ ID NO: 1070764 - DNA, 20 bp, Homo sapiens
cctggatgtcccctgtccca

SEQ ID NO: 1070765 - DNA, 14 bp, Homo sapiens
cctggattcatttc

SEQ ID NO: 1070766 - DNA, 17 bp, Homo sapiens
cctggattcatttcctg

SEQ ID NO: 1070767 - DNA, 22 bp, Homo sapiens
cctggattccagcagtgaatgc

SEQ ID NO: 1070768 - DNA, 23 bp, Homo sapiens
cctggatttatagtatgtgactt

SEQ ID NO: 1070769 - DNA, 17 bp, Homo sapiens
cctggattttgccctct

SEQ ID NO: 1070770 - DNA, 23 bp, Homo sapiens
cctggcaacagagcgagattcca

SEQ ID NO: 1070771 - DNA, 21 bp, Homo sapiens
cctggcaatcaatacagcttc

SEQ ID NO: 1070772 - DNA, 16 bp, Homo sapiens
cctggcaatcccacca

SEQ ID NO: 1070773 - DNA, 23 bp, Homo sapiens
cctggcacaccttaggttgacat

SEQ ID NO: 1070774 - DNA, 14 bp, Homo sapiens
cctggcacccaccg

SEQ ID NO: 1070775 - DNA, 17 bp, Homo sapiens
cctggcacgccctactc

SEQ ID NO: 1070776 - DNA, 21 bp, Homo sapiens
cctggcacgccctactccact

SEQ ID NO: 1070777 - DNA, 18 bp, Homo sapiens
cctggcacggtggctcag

SEQ ID NO: 1070778 - DNA, 22 bp, Homo sapiens
cctggcacggtggctcaggcct

SEQ ID NO: 1070779 - DNA, 13 bp, Homo sapiens
cctggcactggga

SEQ ID NO: 1070780 - DNA, 19 bp, Homo sapiens
cctggcactgggaggcagg

SEQ ID NO: 1070781 - DNA, 13 bp, Homo sapiens
cctggcagaactg

SEQ ID NO: 1070782 - DNA, 20 bp, Homo sapiens
cctggcagaactgagctcct

SEQ ID NO: 1070783 - DNA, 23 bp, Homo sapiens
cctggcagaactgagctcctctg

SEQ ID NO: 1070784 - DNA, 19 bp, Homo sapiens
cctggcagacacaacccaa

SEQ ID NO: 1070785 - DNA, 18 bp, Homo sapiens
cctggcagcacagcccag

SEQ ID NO: 1070786 - DNA, 14 bp, Homo sapiens
cctggctctggggg

SEQ ID NO: 1070787 - DNA, 23 bp, Homo sapiens
cctggctctgggggacccaggtg

SEQ ID NO: 1070788 - DNA, 22 bp, Homo sapiens
cctggctgaccccaaagagcct

SEQ ID NO: 1070789 - DNA, 20 bp, Homo sapiens
cctggctgaggttcctctgc

SEQ ID NO: 1070790 - DNA, 22 bp, Homo sapiens
cctggctgaggttcctctgcct

SEQ ID NO: 1070791 - DNA, 24 bp, Homo sapiens
cctggctgaggttcctctgcctgc

SEQ ID NO: 1070792 - DNA, 15 bp, Homo sapiens
cctggctgccaggcg

SEQ ID NO: 1070793 - DNA, 23 bp, Homo sapiens
cctggctgcccatcatgtggccc

SEQ ID NO: 1070794 - DNA, 12 bp, Homo sapiens
cctggctgccct

SEQ ID NO: 1070795 - DNA, 15 bp, Homo sapiens
cctggctgccctggc

SEQ ID NO: 1070796 - DNA, 16 bp, Homo sapiens
cctggctgccctggcc

SEQ ID NO: 1070797 - DNA, 22 bp, Homo sapiens
cctggctgctaggccagagcca

SEQ ID NO: 1070798 - DNA, 13 bp, Homo sapiens
cctggctgctgcc

SEQ ID NO: 1070799 - DNA, 16 bp, Homo sapiens
cctgtcacctgggagg

SEQ ID NO: 1070800 - DNA, 15 bp, Homo sapiens
cctgtcactcactga

SEQ ID NO: 1070801 - DNA, 17 bp, Homo sapiens
cctgtcactcactgagg

SEQ ID NO: 1070802 - DNA, 19 bp, Homo sapiens
cctgtcactcactgaggcc

SEQ ID NO: 1070803 - DNA, 21 bp, Homo sapiens
cctgtcactcactgaggccat

SEQ ID NO: 1070804 - DNA, 15 bp, Homo sapiens
cctgtcactgagcac

SEQ ID NO: 1070805 - DNA, 23 bp, Homo sapiens
cctgtcactgagcacagtcaggg

SEQ ID NO: 1070806 - DNA, 16 bp, Homo sapiens
cctgtcagaggctaag

SEQ ID NO: 1070807 - DNA, 14 bp, Homo sapiens
cctgtcagtttccc

SEQ ID NO: 1070808 - DNA, 18 bp, Homo sapiens
cctgtcagtttcccctct

SEQ ID NO: 1070809 - DNA, 20 bp, Homo sapiens
cctgtcatagagctgcaggg

SEQ ID NO: 1070810 - DNA, 14 bp, Homo sapiens
cctgtcatcaccag

SEQ ID NO: 1070811 - DNA, 15 bp, Homo sapiens
cctgtcatgcccccc

SEQ ID NO: 1070812 - DNA, 16 bp, Homo sapiens
cctgtcatgcccccct

SEQ ID NO: 1070813 - DNA, 18 bp, Homo sapiens
cctgtcatgcccccctca

SEQ ID NO: 1070814 - DNA, 13 bp, Homo sapiens
cctgtcattcctc

SEQ ID NO: 1070815 - DNA, 20 bp, Homo sapiens
cctgtcattgtattcagata

SEQ ID NO: 1070816 - DNA, 20 bp, Homo sapiens
cctgtcatttgaacctggat

SEQ ID NO: 1070817 - DNA, 16 bp, Homo sapiens
cctgtccaatctttga

SEQ ID NO: 1070818 - DNA, 17 bp, Homo sapiens
cctgtccaccctgccaa

SEQ ID NO: 1070819 - DNA, 17 bp, Homo sapiens
cctgtccacctgtgctg

SEQ ID NO: 1070820 - DNA, 19 bp, Homo sapiens
cctgtccacctgtgctgct

SEQ ID NO: 1070821 - DNA, 14 bp, Homo sapiens
cctgtccagcctgg

SEQ ID NO: 1070822 - DNA, 14 bp, Homo sapiens
cctgtgcagcagcc

SEQ ID NO: 1070823 - DNA, 15 bp, Homo sapiens
cctgtgcagcagccc

SEQ ID NO: 1070824 - DNA, 18 bp, Homo sapiens
cctgtgcagcagcccagc

SEQ ID NO: 1070825 - DNA, 22 bp, Homo sapiens
cctgtgcagcagcccagcttcc

SEQ ID NO: 1070826 - DNA, 20 bp, Homo sapiens
cctgtgcagccgctgagcga

SEQ ID NO: 1070827 - DNA, 21 bp, Homo sapiens
cctgtgcagccgctgagcgag

SEQ ID NO: 1070828 - DNA, 13 bp, Homo sapiens
cctgtgccaacct

SEQ ID NO: 1070829 - DNA, 19 bp, Homo sapiens
cctgtgccacccaccaggg

SEQ ID NO: 1070830 - DNA, 17 bp, Homo sapiens
cctgtgccagcaccaca

SEQ ID NO: 1070831 - DNA, 16 bp, Homo sapiens
cctgtgccatgcccaa

SEQ ID NO: 1070832 - DNA, 16 bp, Homo sapiens
cctgtgcccacccgtc

SEQ ID NO: 1070833 - DNA, 18 bp, Homo sapiens
cctgtgcccccagcctca

SEQ ID NO: 1070834 - DNA, 20 bp, Homo sapiens
cctgtgcccccagcctcagc

SEQ ID NO: 1070835 - DNA, 18 bp, Homo sapiens
cctgtgccctcaccacca

SEQ ID NO: 1070836 - DNA, 18 bp, Homo sapiens
cctgtgccctcaccccaa

SEQ ID NO: 1070837 - DNA, 14 bp, Homo sapiens
cctgtgccgcactc

SEQ ID NO: 1070838 - DNA, 15 bp, Homo sapiens
cctgtgccgcactct

SEQ ID NO: 1070839 - DNA, 21 bp, Homo sapiens
cctgtgcctcctcacccccag

SEQ ID NO: 1070840 - DNA, 15 bp, Homo sapiens
cctgtgcctgggccc

SEQ ID NO: 1070841 - DNA, 23 bp, Homo sapiens
cctgtgcctgggccctgggctga

SEQ ID NO: 1070842 - DNA, 19 bp, Homo sapiens
cctgtgctaagtctttccc

SEQ ID NO: 1070843 - DNA, 19 bp, Homo sapiens
cctgtgctagttttacaga

SEQ ID NO: 1070844 - DNA, 19 bp, Homo sapiens
cctgtgctccgtgcctcca

SEQ ID NO: 1070845 - DNA, 18 bp, Homo sapiens
cctgtgctctggaggctg

SEQ ID NO: 1070846 - DNA, 20 bp, Homo sapiens
cctgtgctctgggggtccct

SEQ ID NO: 1070847 - DNA, 13 bp, Homo sapiens
ccttatttttagc

SEQ ID NO: 1070848 - DNA, 15 bp, Homo sapiens
ccttattttttccca

SEQ ID NO: 1070849 - DNA, 22 bp, Homo sapiens
ccttcaacaattctaaaatgat

SEQ ID NO: 1070850 - DNA, 14 bp, Homo sapiens
ccttcaactcctgg

SEQ ID NO: 1070851 - DNA, 13 bp, Homo sapiens
ccttcaactgaaa

SEQ ID NO: 1070852 - DNA, 24 bp, Homo sapiens
ccttcaactgaaaagactcagtgt

SEQ ID NO: 1070853 - DNA, 16 bp, Homo sapiens
ccttcaagcgctccag

SEQ ID NO: 1070854 - DNA, 20 bp, Homo sapiens
ccttcaagcgctccagggcc

SEQ ID NO: 1070855 - DNA, 14 bp, Homo sapiens
ccttcaaggcctcc

SEQ ID NO: 1070856 - DNA, 12 bp, Homo sapiens
ccttcacaaagc

SEQ ID NO: 1070857 - DNA, 18 bp, Homo sapiens
ccttcacaaagcccaagg

SEQ ID NO: 1070858 - DNA, 18 bp, Homo sapiens
ccttcacaggcagtgcat

SEQ ID NO: 1070859 - DNA, 14 bp, Homo sapiens
ccttcaccgctccc

SEQ ID NO: 1070860 - DNA, 17 bp, Homo sapiens
ccttcacctcggaggga

SEQ ID NO: 1070861 - DNA, 14 bp, Homo sapiens
ccttcactcatttt

SEQ ID NO: 1070862 - DNA, 20 bp, Homo sapiens
ccttcactccggtgtgcctg

SEQ ID NO: 1070863 - DNA, 19 bp, Homo sapiens
ccttcactgccatgatagc

SEQ ID NO: 1070864 - DNA, 21 bp, Homo sapiens
ccttcactgccccacttctgg

SEQ ID NO: 1070865 - DNA, 22 bp, Homo sapiens
ccttcactgccccacttctggc

SEQ ID NO: 1070866 - DNA, 14 bp, Homo sapiens
ccttcactgttccc

SEQ ID NO: 1070867 - DNA, 10 bp, Homo sapiens
ccttcagaca

SEQ ID NO: 1070868 - DNA, 11 bp, Homo sapiens
ccttcagacac

SEQ ID NO: 1070869 - DNA, 23 bp, Homo sapiens
ccttcagacacatgctatgttct

SEQ ID NO: 1070870 - DNA, 18 bp, Homo sapiens
ccttcagactttgcttcc

SEQ ID NO: 1070871 - DNA, 14 bp, Homo sapiens
ccttcagccctggc

SEQ ID NO: 1070872 - DNA, 15 bp, Homo sapiens
ccttcagccctggcc

SEQ ID NO: 1070873 - DNA, 15 bp, Homo sapiens
ccttcagctcctgag

SEQ ID NO: 1070874 - DNA, 20 bp, Homo sapiens
ccttcagctcctgagtagct

SEQ ID NO: 1070875 - DNA, 13 bp, Homo sapiens
ccttcaggactct

SEQ ID NO: 1070876 - DNA, 15 bp, Homo sapiens
ccttcaggactctgc

SEQ ID NO: 1070877 - DNA, 16 bp, Homo sapiens
ccttcagggagacagg

SEQ ID NO: 1070878 - DNA, 19 bp, Homo sapiens
ccttcagggagacaggcag

SEQ ID NO: 1070879 - DNA, 18 bp, Homo sapiens
ccttcagggattccctgt

SEQ ID NO: 1070880 - DNA, 19 bp, Homo sapiens
ccttcagggattccctgtc

SEQ ID NO: 1070881 - DNA, 21 bp, Homo sapiens
ccttcagggattccctgtccc

SEQ ID NO: 1070882 - DNA, 12 bp, Homo sapiens
ccttcagggcca

SEQ ID NO: 1070883 - DNA, 22 bp, Homo sapiens
ccttcagggccagaaggagggc

SEQ ID NO: 1070884 - DNA, 16 bp, Homo sapiens
ccttcagggctgagtt

SEQ ID NO: 1070885 - DNA, 12 bp, Homo sapiens
ccttcaggtttt

SEQ ID NO: 1070886 - DNA, 24 bp, Homo sapiens
ccttcagtaccctctcagctccag

SEQ ID NO: 1070887 - DNA, 12 bp, Homo sapiens
ccttcagtctgc

SEQ ID NO: 1070888 - DNA, 17 bp, Homo sapiens
ccttcagtctgctccac

SEQ ID NO: 1070889 - DNA, 21 bp, Homo sapiens
ccttcagtcttaatactttat

SEQ ID NO: 1070890 - DNA, 15 bp, Homo sapiens
ccttcagtgagcccc

SEQ ID NO: 1070891 - DNA, 18 bp, Homo sapiens
ccttcagttatgattttt

SEQ ID NO: 1070892 - DNA, 12 bp, Homo sapiens
ccttcagtttat

SEQ ID NO: 1070893 - DNA, 13 bp, Homo sapiens
ccttcagtttatt

SEQ ID NO: 1070894 - DNA, 22 bp, Homo sapiens
ccttcataccgcctcgtgccag

SEQ ID NO: 1070895 - DNA, 17 bp, Homo sapiens
ccttcatccgcctgtgg

SEQ ID NO: 1070896 - DNA, 18 bp, Homo sapiens
ccttcatccgcctgtggg

SEQ ID NO: 1070897 - DNA, 18 bp, Homo sapiens
ccttcatcttcctgtgtc

SEQ ID NO: 1070898 - DNA, 17 bp, Homo sapiens
ccttcatgaatctttca

SEQ ID NO: 1070899 - DNA, 17 bp, Homo sapiens
ccttcatgacagcctcc

SEQ ID NO: 1070900 - DNA, 19 bp, Homo sapiens
ccttcattctgagaccaaa

SEQ ID NO: 1070901 - DNA, 18 bp, Homo sapiens
ccttcatttcaggaggga

SEQ ID NO: 1070902 - DNA, 19 bp, Homo sapiens
ccttcatttcaggagggat

SEQ ID NO: 1070903 - DNA, 18 bp, Homo sapiens
ccttcatttttaagactg

SEQ ID NO: 1070904 - DNA, 23 bp, Homo sapiens
ccttccaaaacctgcttccttca

SEQ ID NO: 1070905 - DNA, 20 bp, Homo sapiens
ccttccaaggtcactcttgg

SEQ ID NO: 1070906 - DNA, 22 bp, Homo sapiens
ccttccaaggtcactcttggtc

SEQ ID NO: 1070907 - DNA, 12 bp, Homo sapiens
ccttccacctca

SEQ ID NO: 1070908 - DNA, 14 bp, Homo sapiens
ccttccacctcagt

SEQ ID NO: 1070909 - DNA, 16 bp, Homo sapiens
ccttccacctccctcc

SEQ ID NO: 1070910 - DNA, 18 bp, Homo sapiens
ccttccacgctgtctcca

SEQ ID NO: 1070911 - DNA, 21 bp, Homo sapiens
ccttccacggatccatgtagc

SEQ ID NO: 1070912 - DNA, 15 bp, Homo sapiens
ccttccactgagggc

SEQ ID NO: 1070913 - DNA, 12 bp, Homo sapiens
ccttccactgta

SEQ ID NO: 1070914 - DNA, 22 bp, Homo sapiens
ccttccagcccagacccccagt

SEQ ID NO: 1070915 - DNA, 13 bp, Homo sapiens
ccttccagcctgg

SEQ ID NO: 1070916 - DNA, 12 bp, Homo sapiens
ccttccagctcc

SEQ ID NO: 1070917 - DNA, 13 bp, Homo sapiens
ccttccagctcct

SEQ ID NO: 1070918 - DNA, 16 bp, Homo sapiens
ccttccagctgctgtc

SEQ ID NO: 1070919 - DNA, 15 bp, Homo sapiens
ccttccaggtcagga

SEQ ID NO: 1070920 - DNA, 12 bp, Homo sapiens
ccttccagtggg

SEQ ID NO: 1070921 - DNA, 22 bp, Homo sapiens
ccttccagtgtccttagaacat

SEQ ID NO: 1070922 - DNA, 12 bp, Homo sapiens
ccttccataatt

SEQ ID NO: 1070923 - DNA, 19 bp, Homo sapiens
ccttccatacacagaggag

SEQ ID NO: 1070924 - DNA, 16 bp, Homo sapiens
ccttccatatccctgc

SEQ ID NO: 1070925 - DNA, 19 bp, Homo sapiens
ccttccatatccctgccca

SEQ ID NO: 1070926 - DNA, 12 bp, Homo sapiens
ccttccatccct

SEQ ID NO: 1070927 - DNA, 20 bp, Homo sapiens
ccttccatctagcagctggc

SEQ ID NO: 1070928 - DNA, 13 bp, Homo sapiens
ccttccatcttgt

SEQ ID NO: 1070929 - DNA, 18 bp, Homo sapiens
ccttccatcttgtggggc

SEQ ID NO: 1070930 - DNA, 20 bp, Homo sapiens
ccttccatcttgtggggcca

SEQ ID NO: 1070931 - DNA, 14 bp, Homo sapiens
ccttccatgacctc

SEQ ID NO: 1070932 - DNA, 18 bp, Homo sapiens
ccttccatgtcaggccag

SEQ ID NO: 1070933 - DNA, 19 bp, Homo sapiens
ccttccatgtcgcctctgc

SEQ ID NO: 1070934 - DNA, 17 bp, Homo sapiens
ccttccattttccccca

SEQ ID NO: 1070935 - DNA, 19 bp, Homo sapiens
ccttccattttcccccact

SEQ ID NO: 1070936 - DNA, 19 bp, Homo sapiens
cctgttccctcctggtcct

SEQ ID NO: 1070937 - DNA, 13 bp, Homo sapiens
cctgttccctgga

SEQ ID NO: 1070938 - DNA, 15 bp, Homo sapiens
cctgttctgcttcga

SEQ ID NO: 1070939 - DNA, 12 bp, Homo sapiens
cctgttctgtag

SEQ ID NO: 1070940 - DNA, 18 bp, Homo sapiens
cctgttctgtagctttct

SEQ ID NO: 1070941 - DNA, 21 bp, Homo sapiens
cctgttcttagagtgtagctg

SEQ ID NO: 1070942 - DNA, 13 bp, Homo sapiens
cctgttcttcctc

SEQ ID NO: 1070943 - DNA, 22 bp, Homo sapiens
cctgttgaattttgttctctgg

SEQ ID NO: 1070944 - DNA, 23 bp, Homo sapiens
cctgttgaggtgggtgggcctga

SEQ ID NO: 1070945 - DNA, 15 bp, Homo sapiens
cctgttgatgggaaa

SEQ ID NO: 1070946 - DNA, 22 bp, Homo sapiens
cctgttgattaatttctgccat

SEQ ID NO: 1070947 - DNA, 17 bp, Homo sapiens
cctgttgattatcttca

SEQ ID NO: 1070948 - DNA, 19 bp, Homo sapiens
cctgttgctttcttcctgc

SEQ ID NO: 1070949 - DNA, 20 bp, Homo sapiens
cctgttgctttcttcctgca

SEQ ID NO: 1070950 - DNA, 20 bp, Homo sapiens
cctgttggacccgctctgga

SEQ ID NO: 1070951 - DNA, 23 bp, Homo sapiens
cctgttggacccgctctggacca

SEQ ID NO: 1070952 - DNA, 17 bp, Homo sapiens
cctgttggcagctctag

SEQ ID NO: 1070953 - DNA, 13 bp, Homo sapiens
cctgttggcctgt

SEQ ID NO: 1070954 - DNA, 15 bp, Homo sapiens
cctgttggcctgtgg

SEQ ID NO: 1070955 - DNA, 23 bp, Homo sapiens
cctgttgtatttatggattaaaa

SEQ ID NO: 1070956 - DNA, 14 bp, Homo sapiens
cctgtttaatattt

SEQ ID NO: 1070957 - DNA, 16 bp, Homo sapiens
cctgtttaatatttaa

SEQ ID NO: 1070958 - DNA, 21 bp, Homo sapiens
cctgtttaatgttatgaggac

SEQ ID NO: 1070959 - DNA, 18 bp, Homo sapiens
cctgtttataatctgaag

SEQ ID NO: 1070960 - DNA, 19 bp, Homo sapiens
cctgtttcagaccccccca

SEQ ID NO: 1070961 - DNA, 12 bp, Homo sapiens
cctgtttcctga

SEQ ID NO: 1070962 - DNA, 15 bp, Homo sapiens
cctgtttctccacaa

SEQ ID NO: 1070963 - DNA, 23 bp, Homo sapiens
cctgtttctccacaacagcctgg

SEQ ID NO: 1070964 - DNA, 17 bp, Homo sapiens
cctgtttctggaagact

SEQ ID NO: 1070965 - DNA, 14 bp, Homo sapiens
cctgtttgaaatat

SEQ ID NO: 1070966 - DNA, 22 bp, Homo sapiens
ccttccccttttgcctggctgt

SEQ ID NO: 1070967 - DNA, 16 bp, Homo sapiens
ccttcccgacccagcc

SEQ ID NO: 1070968 - DNA, 15 bp, Homo sapiens
ccttcccgccttcca

SEQ ID NO: 1070969 - DNA, 16 bp, Homo sapiens
ccttcccgccttccaa

SEQ ID NO: 1070970 - DNA, 15 bp, Homo sapiens
ccttccctcactctt

SEQ ID NO: 1070971 - DNA, 13 bp, Homo sapiens
ccttccctccaaa

SEQ ID NO: 1070972 - DNA, 15 bp, Homo sapiens
ccttccctcctgctt

SEQ ID NO: 1070973 - DNA, 10 bp, Homo sapiens
ccttccctgc

SEQ ID NO: 1070974 - DNA, 12 bp, Homo sapiens
ccttccctgcac

SEQ ID NO: 1070975 - DNA, 13 bp, Homo sapiens
ccttccctgcact

SEQ ID NO: 1070976 - DNA, 11 bp, Homo sapiens
ccttccctggc

SEQ ID NO: 1070977 - DNA, 14 bp, Homo sapiens
ccttccctgggaag

SEQ ID NO: 1070978 - DNA, 13 bp, Homo sapiens
ccttccctgggga

SEQ ID NO: 1070979 - DNA, 14 bp, Homo sapiens
ccttccctggggag

SEQ ID NO: 1070980 - DNA, 16 bp, Homo sapiens
ccttccctggggagcc

SEQ ID NO: 1070981 - DNA, 19 bp, Homo sapiens
ccttccctggggagccctc

SEQ ID NO: 1070982 - DNA, 22 bp, Homo sapiens
ccttccctggggagccctcagg

SEQ ID NO: 1070983 - DNA, 23 bp, Homo sapiens
ccttccctggggagccctcaggc

SEQ ID NO: 1070984 - DNA, 13 bp, Homo sapiens
ccttccctgtccc

SEQ ID NO: 1070985 - DNA, 22 bp, Homo sapiens
ccttcccttgagatgagtttct

SEQ ID NO: 1070986 - DNA, 12 bp, Homo sapiens
ccttcccttgcc

SEQ ID NO: 1070987 - DNA, 19 bp, Homo sapiens
ccttcccttgccactttgc

SEQ ID NO: 1070988 - DNA, 14 bp, Homo sapiens
ccttccgaccctct

SEQ ID NO: 1070989 - DNA, 16 bp, Homo sapiens
ccttccgaccctctgg

SEQ ID NO: 1070990 - DNA, 21 bp, Homo sapiens
ccttccgggtctcgcagcctg

SEQ ID NO: 1070991 - DNA, 18 bp, Homo sapiens
ccttccgggttcaagtga

SEQ ID NO: 1070992 - DNA, 15 bp, Homo sapiens
ccttccgtccatccc

SEQ ID NO: 1070993 - DNA, 16 bp, Homo sapiens
ccttccgtccatcccc

SEQ ID NO: 1070994 - DNA, 21 bp, Homo sapiens
ccttccgtccatcccccttct

SEQ ID NO: 1070995 - DNA, 17 bp, Homo sapiens
ccttcctactcctcata

SEQ ID NO: 1070996 - DNA, 18 bp, Homo sapiens
ccttcctattctcctgcc

SEQ ID NO: 1070997 - DNA, 19 bp, Homo sapiens
ccttcctattctcctgcca

SEQ ID NO: 1070998 - DNA, 14 bp, Homo sapiens
ccttcctcactgcc

SEQ ID NO: 1070999 - DNA, 15 bp, Homo sapiens
ccttcctcagcctcc

SEQ ID NO: 1071000 - DNA, 12 bp, Homo sapiens
ccttcctcatcc

SEQ ID NO: 1071001 - DNA, 17 bp, Homo sapiens
ccttcctcatccacccc

SEQ ID NO: 1071002 - DNA, 18 bp, Homo sapiens
ccttcctcatccacccca

SEQ ID NO: 1071003 - DNA, 20 bp, Homo sapiens
ccttcctccccacactccac

SEQ ID NO: 1071004 - DNA, 14 bp, Homo sapiens
ccttcctcctccac

SEQ ID NO: 1071005 - DNA, 12 bp, Homo sapiens
ccttcctcctgg

SEQ ID NO: 1071006 - DNA, 13 bp, Homo sapiens
ccttcctcctggg

SEQ ID NO: 1071007 - DNA, 12 bp, Homo sapiens
ccttcctcctta

SEQ ID NO: 1071008 - DNA, 17 bp, Homo sapiens
ccttcctcggtggctct

SEQ ID NO: 1071009 - DNA, 22 bp, Homo sapiens
ccttcctcggtggctctggggt

SEQ ID NO: 1071010 - DNA, 14 bp, Homo sapiens
ccttcctctccact

SEQ ID NO: 1071011 - DNA, 16 bp, Homo sapiens
ccttcctctccactgc

SEQ ID NO: 1071012 - DNA, 17 bp, Homo sapiens
ccttcctctccactgcc

SEQ ID NO: 1071013 - DNA, 20 bp, Homo sapiens
ccttcctctccactgccttc

SEQ ID NO: 1071014 - DNA, 17 bp, Homo sapiens
ccttcctctctccagat

SEQ ID NO: 1071015 - DNA, 15 bp, Homo sapiens
ccttcctctgagcct

SEQ ID NO: 1071016 - DNA, 15 bp, Homo sapiens
ccttcctctgcagct

SEQ ID NO: 1071017 - DNA, 17 bp, Homo sapiens
ccttcctcttcctgccc

SEQ ID NO: 1071018 - DNA, 20 bp, Homo sapiens
ccttcctcttcctgcccttg

SEQ ID NO: 1071019 - DNA, 17 bp, Homo sapiens
ccttcctgaattcttta

SEQ ID NO: 1071020 - DNA, 13 bp, Homo sapiens
ccttcctgacctc

SEQ ID NO: 1071021 - DNA, 19 bp, Homo sapiens
ccttcctgaggagccggga

SEQ ID NO: 1071022 - DNA, 12 bp, Homo sapiens
ccttcctgccac

SEQ ID NO: 1071023 - DNA, 16 bp, Homo sapiens
ccttcctgcttcctgt

SEQ ID NO: 1071024 - DNA, 20 bp, Homo sapiens
ccttcctgcttcctgttacc

SEQ ID NO: 1071025 - DNA, 11 bp, Homo sapiens
ccttcctggaa

SEQ ID NO: 1071026 - DNA, 18 bp, Homo sapiens
ccttcctggaaacagcat

SEQ ID NO: 1071027 - DNA, 21 bp, Homo sapiens
ccttcctggaaacagcatgaa

SEQ ID NO: 1071028 - DNA, 17 bp, Homo sapiens
ccttcctggacacactc

SEQ ID NO: 1071029 - DNA, 18 bp, Homo sapiens
ccttcctggacacactct

SEQ ID NO: 1071030 - DNA, 20 bp, Homo sapiens
ccttcctggagactgcccag

SEQ ID NO: 1071031 - DNA, 13 bp, Homo sapiens
ccttcctggccca

SEQ ID NO: 1071032 - DNA, 13 bp, Homo sapiens
ccttcctggcctc

SEQ ID NO: 1071033 - DNA, 20 bp, Homo sapiens
ccttcctggcctcactggct

SEQ ID NO: 1071034 - DNA, 20 bp, Homo sapiens
ccttcctgggaccccctcgc

SEQ ID NO: 1071035 - DNA, 17 bp, Homo sapiens
ccttcctgggaggacag

SEQ ID NO: 1071036 - DNA, 22 bp, Homo sapiens
ccttcctgggaggacaggcagg

SEQ ID NO: 1071037 - DNA, 16 bp, Homo sapiens
ccttcctgtccctgag

SEQ ID NO: 1071038 - DNA, 17 bp, Homo sapiens
ccttcctgtcctgcctc

SEQ ID NO: 1071039 - DNA, 19 bp, Homo sapiens
ccttcctgtcctgcctcct

SEQ ID NO: 1071040 - DNA, 24 bp, Homo sapiens
ccttcctgtcctgcctcctcatca

SEQ ID NO: 1071041 - DNA, 17 bp, Homo sapiens
ccttcctgttccctcct

SEQ ID NO: 1071042 - DNA, 21 bp, Homo sapiens
ccttcctgttcttccttccta

SEQ ID NO: 1071043 - DNA, 22 bp, Homo sapiens
ccttcctgttcttccttcctag

SEQ ID NO: 1071044 - DNA, 22 bp, Homo sapiens
ccttcctgtttttcacattttc

SEQ ID NO: 1071045 - DNA, 12 bp, Homo sapiens
ccttccttcagg

SEQ ID NO: 1071046 - DNA, 17 bp, Homo sapiens
ccttccttcaggactct

SEQ ID NO: 1071047 - DNA, 19 bp, Homo sapiens
ccttccttcaggactctgc

SEQ ID NO: 1071048 - DNA, 13 bp, Homo sapiens
ccttccttcaggg

SEQ ID NO: 1071049 - DNA, 20 bp, Homo sapiens
ccttccttgctgtcctaggc

SEQ ID NO: 1071050 - DNA, 13 bp, Homo sapiens
ccttcctttcctc

SEQ ID NO: 1071051 - DNA, 17 bp, Homo sapiens
ccttctcctcttgtaaa

SEQ ID NO: 1071052 - DNA, 16 bp, Homo sapiens
ccttctcctgcccttt

SEQ ID NO: 1071053 - DNA, 23 bp, Homo sapiens
ccttctcgtgtttgcttaaaata

SEQ ID NO: 1071054 - DNA, 20 bp, Homo sapiens
ccttctctcacttctaaatt

SEQ ID NO: 1071055 - DNA, 17 bp, Homo sapiens
ccttctctcctccccaa

SEQ ID NO: 1071056 - DNA, 20 bp, Homo sapiens
ccttctctcctccccaaatc

SEQ ID NO: 1071057 - DNA, 20 bp, Homo sapiens
ccttctctctcaatttttgg

SEQ ID NO: 1071058 - DNA, 15 bp, Homo sapiens
ccttctctctccaga

SEQ ID NO: 1071059 - DNA, 13 bp, Homo sapiens
ccttctctgctcc

SEQ ID NO: 1071060 - DNA, 14 bp, Homo sapiens
ccttctctgctcca

SEQ ID NO: 1071061 - DNA, 17 bp, Homo sapiens
ccttctctgctccacca

SEQ ID NO: 1071062 - DNA, 20 bp, Homo sapiens
ccttctctgggtctgatttt

SEQ ID NO: 1071063 - DNA, 20 bp, Homo sapiens
ccttctcttgaggcctgtgc

SEQ ID NO: 1071064 - DNA, 16 bp, Homo sapiens
ccttctgacagcccaa

SEQ ID NO: 1071065 - DNA, 15 bp, Homo sapiens
ccttctgagctccac

SEQ ID NO: 1071066 - DNA, 16 bp, Homo sapiens
ccttctgagctccacc

SEQ ID NO: 1071067 - DNA, 12 bp, Homo sapiens
ccttctgctcag

SEQ ID NO: 1071068 - DNA, 20 bp, Homo sapiens
ccttctgctcccaccccaga

SEQ ID NO: 1071069 - DNA, 20 bp, Homo sapiens
ccttctgctggataaaatga

SEQ ID NO: 1071070 - DNA, 17 bp, Homo sapiens
ccttctgggcaagggct

SEQ ID NO: 1071071 - DNA, 21 bp, Homo sapiens
ccttctgggcaagggctccta

SEQ ID NO: 1071072 - DNA, 14 bp, Homo sapiens
ccttctggttgctt

SEQ ID NO: 1071073 - DNA, 15 bp, Homo sapiens
ccttctggttgcttc

SEQ ID NO: 1071074 - DNA, 22 bp, Homo sapiens
ccttctgtaaaggtttttggaa

SEQ ID NO: 1071075 - DNA, 18 bp, Homo sapiens
ccttctgtccaccagacc

SEQ ID NO: 1071076 - DNA, 20 bp, Homo sapiens
ccttctgtccaccagaccca

SEQ ID NO: 1071077 - DNA, 14 bp, Homo sapiens
ccttctgtccccag

SEQ ID NO: 1071078 - DNA, 15 bp, Homo sapiens
ccttctgtggggctg

SEQ ID NO: 1071079 - DNA, 17 bp, Homo sapiens
ccttctgtggggctggg

SEQ ID NO: 1071080 - DNA, 16 bp, Homo sapiens
ccttctgttaagaaag

SEQ ID NO: 1071081 - DNA, 21 bp, Homo sapiens
ccttctgttaagaaaggatat

SEQ ID NO: 1071082 - DNA, 18 bp, Homo sapiens
ccttcttattctcactcc

SEQ ID NO: 1071083 - DNA, 20 bp, Homo sapiens
ccttcttattctcactccac

SEQ ID NO: 1071084 - DNA, 15 bp, Homo sapiens
ccttcttcacccagc

SEQ ID NO: 1071085 - DNA, 23 bp, Homo sapiens
ccttcttcacccagctaatctgt

SEQ ID NO: 1071086 - DNA, 13 bp, Homo sapiens
ccttcttcagcag

SEQ ID NO: 1071087 - DNA, 18 bp, Homo sapiens
ccttcttcagcaggaagg

SEQ ID NO: 1071088 - DNA, 13 bp, Homo sapiens
ccttcttccaagg

SEQ ID NO: 1071089 - DNA, 14 bp, Homo sapiens
ccttcttcccgccc

SEQ ID NO: 1071090 - DNA, 15 bp, Homo sapiens
ccttcttcctcccct

SEQ ID NO: 1071091 - DNA, 13 bp, Homo sapiens
ccttcttcgctgc

SEQ ID NO: 1071092 - DNA, 21 bp, Homo sapiens
ccttcttcggggaactcctgg

SEQ ID NO: 1071093 - DNA, 22 bp, Homo sapiens
ccttcttcggggaactcctgga

SEQ ID NO: 1071094 - DNA, 15 bp, Homo sapiens
ccttcttctgccact

SEQ ID NO: 1071095 - DNA, 14 bp, Homo sapiens
ccttcttgctgccc

SEQ ID NO: 1071096 - DNA, 18 bp, Homo sapiens
ccttcttggcttctggga

SEQ ID NO: 1071097 - DNA, 17 bp, Homo sapiens
ccttcttgggccccaga

SEQ ID NO: 1071098 - DNA, 18 bp, Homo sapiens
ccttcttgggccccagac

SEQ ID NO: 1071099 - DNA, 12 bp, Homo sapiens
ccttcttgtagt

SEQ ID NO: 1071100 - DNA, 15 bp, Homo sapiens
ccttctttctggact

SEQ ID NO: 1071101 - DNA, 13 bp, Homo sapiens
ccttctttgtata

SEQ ID NO: 1071102 - DNA, 16 bp, Homo sapiens
ccttctttttctggac

SEQ ID NO: 1071103 - DNA, 15 bp, Homo sapiens
ccttgaaaatatttt

SEQ ID NO: 1071104 - DNA, 16 bp, Homo sapiens
ccttgaaacagttcca

SEQ ID NO: 1071105 - DNA, 22 bp, Homo sapiens
ccttgaaaggcaggaagggaag

SEQ ID NO: 1071106 - DNA, 18 bp, Homo sapiens
ccttgaaccacttccctc

SEQ ID NO: 1071107 - DNA, 19 bp, Homo sapiens
ccttgaaccacttccctca

SEQ ID NO: 1071108 - DNA, 20 bp, Homo sapiens
ccttgaaccccctccctgtc

SEQ ID NO: 1071109 - DNA, 17 bp, Homo sapiens
ccttgaactgaggccct

SEQ ID NO: 1071110 - DNA, 18 bp, Homo sapiens
ccttgaactgaggccctg

SEQ ID NO: 1071111 - DNA, 15 bp, Homo sapiens
ccttgaagaaaatga

SEQ ID NO: 1071112 - DNA, 17 bp, Homo sapiens
ccttgaagaacctctca

SEQ ID NO: 1071113 - DNA, 22 bp, Homo sapiens
ccttgaagaactgcaggccctg

SEQ ID NO: 1071114 - DNA, 14 bp, Homo sapiens
ccttgaagcaataa

SEQ ID NO: 1071115 - DNA, 22 bp, Homo sapiens
ccttgaagcaataactccaagc

SEQ ID NO: 1071116 - DNA, 23 bp, Homo sapiens
ccttgaagcaataactccaagca

SEQ ID NO: 1071117 - DNA, 19 bp, Homo sapiens
ccttgaagccactgaagct

SEQ ID NO: 1071118 - DNA, 23 bp, Homo sapiens
ccttgaatcttctcccttgtcct

SEQ ID NO: 1071119 - DNA, 18 bp, Homo sapiens
ccttgaatgctgccagtg

SEQ ID NO: 1071120 - DNA, 19 bp, Homo sapiens
ccttgaatgctgccagtgt

SEQ ID NO: 1071121 - DNA, 16 bp, Homo sapiens
ccttgaattgtgtatt

SEQ ID NO: 1071122 - DNA, 14 bp, Homo sapiens
ccttgacatcagtt

SEQ ID NO: 1071123 - DNA, 23 bp, Homo sapiens
ccttgacattgtagagcttctgg

SEQ ID NO: 1071124 - DNA, 14 bp, Homo sapiens
ccttgaccattggc

SEQ ID NO: 1071125 - DNA, 18 bp, Homo sapiens
ccttgactgtctagccac

SEQ ID NO: 1071126 - DNA, 22 bp, Homo sapiens
ccttgactgtctagccactccc

SEQ ID NO: 1071127 - DNA, 24 bp, Homo sapiens
ccttgactgtctagccactccctc

SEQ ID NO: 1071128 - DNA, 16 bp, Homo sapiens
ccttgagaccacaggg

SEQ ID NO: 1071129 - DNA, 16 bp, Homo sapiens
ccttgagacctcagcc

SEQ ID NO: 1071130 - DNA, 18 bp, Homo sapiens
ccttgagagacccagctg

SEQ ID NO: 1071131 - DNA, 13 bp, Homo sapiens
cgatgtcccctgc

SEQ ID NO: 1071132 - DNA, 22 bp, Homo sapiens
cgatgtggacgtcacgctccct

SEQ ID NO: 1071133 - DNA, 13 bp, Homo sapiens
cgatgtggccctg

SEQ ID NO: 1071134 - DNA, 16 bp, Homo sapiens
cgatgtggccctggcc

SEQ ID NO: 1071135 - DNA, 19 bp, Homo sapiens
cgatgtgtctcccagaact

SEQ ID NO: 1071136 - DNA, 20 bp, Homo sapiens
cgatgttgtcaaggatggtt

SEQ ID NO: 1071137 - DNA, 12 bp, Homo sapiens
cgattctctgcc

SEQ ID NO: 1071138 - DNA, 18 bp, Homo sapiens
cgattgagaactgacaaa

SEQ ID NO: 1071139 - DNA, 19 bp, Homo sapiens
cgattggagaatactttgc

SEQ ID NO: 1071140 - DNA, 13 bp, Homo sapiens
cgatttctgtaaa

SEQ ID NO: 1071141 - DNA, 23 bp, Homo sapiens
cgatttgcaggattcccttctgg

SEQ ID NO: 1071142 - DNA, 19 bp, Homo sapiens
cgcaaagggctgaaagcca

SEQ ID NO: 1071143 - DNA, 17 bp, Homo sapiens
cgcaaccaagtgtgcta

SEQ ID NO: 1071144 - DNA, 13 bp, Homo sapiens
cgcaaccctgcct

SEQ ID NO: 1071145 - DNA, 18 bp, Homo sapiens
cgcaacgtctaactggac

SEQ ID NO: 1071146 - DNA, 20 bp, Homo sapiens
cgcaagcctgtaatcccagc

SEQ ID NO: 1071147 - DNA, 19 bp, Homo sapiens
cgcaaggaaggacttaccc

SEQ ID NO: 1071148 - DNA, 18 bp, Homo sapiens
cgcaagggcatcaggcac

SEQ ID NO: 1071149 - DNA, 19 bp, Homo sapiens
cgcaagggcatcaggcact

SEQ ID NO: 1071150 - DNA, 14 bp, Homo sapiens
cgcaagggcctgga

SEQ ID NO: 1071151 - DNA, 16 bp, Homo sapiens
cgcaagggcctggacg

SEQ ID NO: 1071152 - DNA, 21 bp, Homo sapiens
cgcaattgtgggatgtcctct

SEQ ID NO: 1071153 - DNA, 23 bp, Homo sapiens
cgcacaaatgaccgcacgttctc

SEQ ID NO: 1071154 - DNA, 16 bp, Homo sapiens
cgcacaaggctgacca

SEQ ID NO: 1071155 - DNA, 10 bp, Homo sapiens
cgcacacaca

SEQ ID NO: 1071156 - DNA, 17 bp, Homo sapiens
cgcacacacacatacag

SEQ ID NO: 1071157 - DNA, 19 bp, Homo sapiens
cgcacacacacatacagag

SEQ ID NO: 1071158 - DNA, 13 bp, Homo sapiens
cgcacacagggct

SEQ ID NO: 1071159 - DNA, 19 bp, Homo sapiens
cgcacacatcttacctctc

SEQ ID NO: 1071160 - DNA, 15 bp, Homo sapiens
cgcacacgcacacat

SEQ ID NO: 1071161 - DNA, 21 bp, Homo sapiens
cgcacacgcacgcacacacac

SEQ ID NO: 1071162 - DNA, 22 bp, Homo sapiens
cgcacactgtgattttgccctc

SEQ ID NO: 1071163 - DNA, 13 bp, Homo sapiens
cgcaccactgcca

SEQ ID NO: 1071164 - DNA, 20 bp, Homo sapiens
cgcaccagctgctctgcccc

SEQ ID NO: 1071165 - DNA, 23 bp, Homo sapiens
cgcaccagctgctctgccccttg

SEQ ID NO: 1071166 - DNA, 16 bp, Homo sapiens
cgcaccatgtgggcac

SEQ ID NO: 1071167 - DNA, 16 bp, Homo sapiens
cgcaccattctcctgc

SEQ ID NO: 1071168 - DNA, 15 bp, Homo sapiens
cgcaccattctgact

SEQ ID NO: 1071169 - DNA, 14 bp, Homo sapiens
cgcaccccagagtg

SEQ ID NO: 1071170 - DNA, 13 bp, Homo sapiens
cgcacccccaccc

SEQ ID NO: 1071171 - DNA, 15 bp, Homo sapiens
cgcacccccaccctt

SEQ ID NO: 1071172 - DNA, 19 bp, Homo sapiens
cgcacccccaccctttggg

SEQ ID NO: 1071173 - DNA, 13 bp, Homo sapiens
cgcacccccgcca

SEQ ID NO: 1071174 - DNA, 16 bp, Homo sapiens
cgcacctaccatcagg

SEQ ID NO: 1071175 - DNA, 14 bp, Homo sapiens
cgcacctccacgcc

SEQ ID NO: 1071176 - DNA, 19 bp, Homo sapiens
cgcacctgtagtcccagct

SEQ ID NO: 1071177 - DNA, 14 bp, Homo sapiens
cgcacgcacacaca

SEQ ID NO: 1071178 - DNA, 23 bp, Homo sapiens
cgcacgcacacacacatacagag

SEQ ID NO: 1071179 - DNA, 13 bp, Homo sapiens
cgcacgcctctcc

SEQ ID NO: 1071180 - DNA, 22 bp, Homo sapiens
cgcactacatgtggtttataga

SEQ ID NO: 1071181 - DNA, 18 bp, Homo sapiens
cgcactgcccacatggga

SEQ ID NO: 1071182 - DNA, 15 bp, Homo sapiens
cgcacttacaagtgg

SEQ ID NO: 1071183 - DNA, 19 bp, Homo sapiens
cgcacttaccgccctgcgg

SEQ ID NO: 1071184 - DNA, 22 bp, Homo sapiens
cgcacttcagaattccatatct

SEQ ID NO: 1071185 - DNA, 23 bp, Homo sapiens
cgcacttcgggaggtcgaggcag

SEQ ID NO: 1071186 - DNA, 22 bp, Homo sapiens
cgcacttgcagaggagcccagt

SEQ ID NO: 1071187 - DNA, 13 bp, Homo sapiens
cgcagaagcagcc

SEQ ID NO: 1071188 - DNA, 14 bp, Homo sapiens
cgcgtcttcctgag

SEQ ID NO: 1071189 - DNA, 15 bp, Homo sapiens
cgcgtgagtgtgtga

SEQ ID NO: 1071190 - DNA, 19 bp, Homo sapiens
cgcgtgataaaactgggtt

SEQ ID NO: 1071191 - DNA, 16 bp, Homo sapiens
cgcgtggcgtggcccg

SEQ ID NO: 1071192 - DNA, 21 bp, Homo sapiens
cgctaaagagcccttgcctcc

SEQ ID NO: 1071193 - DNA, 21 bp, Homo sapiens
cgctaaatatttaccttgaaa

SEQ ID NO: 1071194 - DNA, 12 bp, Homo sapiens
cgctacctccct

SEQ ID NO: 1071195 - DNA, 20 bp, Homo sapiens
cgctagaaaaaaaaaacact

SEQ ID NO: 1071196 - DNA, 13 bp, Homo sapiens
cgctagaggcctg

SEQ ID NO: 1071197 - DNA, 14 bp, Homo sapiens
cgctagcagccctt

SEQ ID NO: 1071198 - DNA, 21 bp, Homo sapiens
cgctaggctcgccttccctcc

SEQ ID NO: 1071199 - DNA, 22 bp, Homo sapiens
cgctaggctcgccttccctcct

SEQ ID NO: 1071200 - DNA, 23 bp, Homo sapiens
cgctaggctcgccttccctcctg

SEQ ID NO: 1071201 - DNA, 14 bp, Homo sapiens
cgctagtgccttgc

SEQ ID NO: 1071202 - DNA, 17 bp, Homo sapiens
cgctcaccgctggccct

SEQ ID NO: 1071203 - DNA, 17 bp, Homo sapiens
cgctcacctagagccag

SEQ ID NO: 1071204 - DNA, 12 bp, Homo sapiens
cgctcagacccc

SEQ ID NO: 1071205 - DNA, 16 bp, Homo sapiens
cgctcagccctccctg

SEQ ID NO: 1071206 - DNA, 13 bp, Homo sapiens
cgctcaggaccca

SEQ ID NO: 1071207 - DNA, 19 bp, Homo sapiens
cgctcaggacccaggccct

SEQ ID NO: 1071208 - DNA, 22 bp, Homo sapiens
cgctcaggcctaggaggccccc

SEQ ID NO: 1071209 - DNA, 12 bp, Homo sapiens
cgctcaggctgg

SEQ ID NO: 1071210 - DNA, 15 bp, Homo sapiens
cgctcagtaaacggg

SEQ ID NO: 1071211 - DNA, 12 bp, Homo sapiens
cgctcagtatta

SEQ ID NO: 1071212 - DNA, 17 bp, Homo sapiens
cgctcatctctggaagg

SEQ ID NO: 1071213 - DNA, 18 bp, Homo sapiens
cgctcatgttgagccagt

SEQ ID NO: 1071214 - DNA, 12 bp, Homo sapiens
cgctccagggcc

SEQ ID NO: 1071215 - DNA, 23 bp, Homo sapiens
cgctccatcgcccaggcctggga

SEQ ID NO: 1071216 - DNA, 18 bp, Homo sapiens
cgctcccaacccccctcc

SEQ ID NO: 1071217 - DNA, 15 bp, Homo sapiens
cgctcccaccgcccc

SEQ ID NO: 1071218 - DNA, 22 bp, Homo sapiens
cgctcccacctagtgccccaga

SEQ ID NO: 1071219 - DNA, 24 bp, Homo sapiens
cgctcccaggttcccccagcaagc

SEQ ID NO: 1071220 - DNA, 12 bp, Homo sapiens
cgctcccctcca

SEQ ID NO: 1071221 - DNA, 16 bp, Homo sapiens
cgctcccgctcccagg

SEQ ID NO: 1071222 - DNA, 18 bp, Homo sapiens
cgctcccgggcctcaggg

SEQ ID NO: 1071223 - DNA, 22 bp, Homo sapiens
cgctcccgggcctcagggtcct

SEQ ID NO: 1071224 - DNA, 23 bp, Homo sapiens
cgctcccgggcctcagggtcctg

SEQ ID NO: 1071225 - DNA, 17 bp, Homo sapiens
cgctcccttccctccat

SEQ ID NO: 1071226 - DNA, 18 bp, Homo sapiens
cgctcccttcctgccact

SEQ ID NO: 1071227 - DNA, 23 bp, Homo sapiens
cgctccgggctttcacggaaact

SEQ ID NO: 1071228 - DNA, 14 bp, Homo sapiens
cgctccgtctctgt

SEQ ID NO: 1071229 - DNA, 15 bp, Homo sapiens
cgctccgtctctgtc

SEQ ID NO: 1071230 - DNA, 18 bp, Homo sapiens
cgctcctcccagatggct

SEQ ID NO: 1071231 - DNA, 13 bp, Homo sapiens
cgctcctcctctc

SEQ ID NO: 1071232 - DNA, 15 bp, Homo sapiens
cgctcctccttccca

SEQ ID NO: 1071233 - DNA, 13 bp, Homo sapiens
cgctcctctgcct

SEQ ID NO: 1071234 - DNA, 14 bp, Homo sapiens
cgctcctctgcctt

SEQ ID NO: 1071235 - DNA, 16 bp, Homo sapiens
cgctcctctgccttgg

SEQ ID NO: 1071236 - DNA, 22 bp, Homo sapiens
cgctcctgacccctccctgcag

SEQ ID NO: 1071237 - DNA, 18 bp, Homo sapiens
cgctcctgcagccccagc

SEQ ID NO: 1071238 - DNA, 13 bp, Homo sapiens
cgctcctgccctc

SEQ ID NO: 1071239 - DNA, 13 bp, Homo sapiens
cgctcctgcttcc

SEQ ID NO: 1071240 - DNA, 21 bp, Homo sapiens
cgctcctgtctgccagccagc

SEQ ID NO: 1071241 - DNA, 20 bp, Homo sapiens
cgctcctttgtgtgtgtgtc

SEQ ID NO: 1071242 - DNA, 12 bp, Homo sapiens
cgctctccacca

SEQ ID NO: 1071243 - DNA, 14 bp, Homo sapiens
cgctctcctcgagc

SEQ ID NO: 1071244 - DNA, 14 bp, Homo sapiens
cgctctcttcctgc

SEQ ID NO: 1071245 - DNA, 18 bp, Homo sapiens
cgctctgctggcctggcc

SEQ ID NO: 1071246 - DNA, 12 bp, Homo sapiens
cgctctggacat

SEQ ID NO: 1071247 - DNA, 19 bp, Homo sapiens
cgctctgggagccacgcct

SEQ ID NO: 1071248 - DNA, 22 bp, Homo sapiens
cgctcttgaggaagcccaggct

SEQ ID NO: 1071249 - DNA, 16 bp, Homo sapiens
cgctcttggtccctgg

SEQ ID NO: 1071250 - DNA, 16 bp, Homo sapiens
cgctcttttccactcc

SEQ ID NO: 1071251 - DNA, 20 bp, Homo sapiens
cgctgaactgacaatgaagg

SEQ ID NO: 1071252 - DNA, 13 bp, Homo sapiens
cgctgacaatcag

SEQ ID NO: 1071253 - DNA, 17 bp, Homo sapiens
cgctgagactgtgctgt

SEQ ID NO: 1071254 - DNA, 21 bp, Homo sapiens
cgctgagcgcccccgagccct

SEQ ID NO: 1071255 - DNA, 22 bp, Homo sapiens
cgctgagcgcccccgagccctg

SEQ ID NO: 1071256 - DNA, 23 bp, Homo sapiens
cgctgagtggggggtcgtgggcc

SEQ ID NO: 1071257 - DNA, 13 bp, Homo sapiens
cgctgatatatgt

SEQ ID NO: 1071258 - DNA, 16 bp, Homo sapiens
cgctgcacacagacgg

SEQ ID NO: 1071259 - DNA, 17 bp, Homo sapiens
cgctgccaccacgtctg

SEQ ID NO: 1071260 - DNA, 17 bp, Homo sapiens
cgctgccacccacctcc

SEQ ID NO: 1071261 - DNA, 21 bp, Homo sapiens
cgctgccagccttgagccctg

SEQ ID NO: 1071262 - DNA, 23 bp, Homo sapiens
cgctgccagccttgagccctggc

SEQ ID NO: 1071263 - DNA, 19 bp, Homo sapiens
cgctgccatcaccgctggg

SEQ ID NO: 1071264 - DNA, 20 bp, Homo sapiens
cgctgccatcaccgctgggt

SEQ ID NO: 1071265 - DNA, 22 bp, Homo sapiens
cgctgccatcaccgctgggtgg

SEQ ID NO: 1071266 - DNA, 12 bp, Homo sapiens
cgcattccctga

SEQ ID NO: 1071267 - DNA, 24 bp, Homo sapiens
cgcattgccacggaaacatacaga

SEQ ID NO: 1071268 - DNA, 16 bp, Homo sapiens
cgcattggtgactcac

SEQ ID NO: 1071269 - DNA, 14 bp, Homo sapiens
cgcatttctcatgc

SEQ ID NO: 1071270 - DNA, 15 bp, Homo sapiens
cgccaaatgttcatc

SEQ ID NO: 1071271 - DNA, 14 bp, Homo sapiens
cgccaacagccccc

SEQ ID NO: 1071272 - DNA, 22 bp, Homo sapiens
cgccaacttctcccaccccttg

SEQ ID NO: 1071273 - DNA, 17 bp, Homo sapiens
cgccaccaccacctgac

SEQ ID NO: 1071274 - DNA, 10 bp, Homo sapiens
cgccaccccc

SEQ ID NO: 1071275 - DNA, 13 bp, Homo sapiens
cgccacccccatc

SEQ ID NO: 1071276 - DNA, 19 bp, Homo sapiens
cgccacccccatcttccac

SEQ ID NO: 1071277 - DNA, 16 bp, Homo sapiens
cgccaccgtgcctggc

SEQ ID NO: 1071278 - DNA, 13 bp, Homo sapiens
cgccacctcaggg

SEQ ID NO: 1071279 - DNA, 14 bp, Homo sapiens
cgccacctcagggc

SEQ ID NO: 1071280 - DNA, 20 bp, Homo sapiens
cgccacctggcattccttct

SEQ ID NO: 1071281 - DNA, 21 bp, Homo sapiens
cgccacctggcattccttctg

SEQ ID NO: 1071282 - DNA, 17 bp, Homo sapiens
cgccacgctcagtgccc

SEQ ID NO: 1071283 - DNA, 19 bp, Homo sapiens
cgccacgctcagtgcccgt

SEQ ID NO: 1071284 - DNA, 15 bp, Homo sapiens
cgccacggccaccct

SEQ ID NO: 1071285 - DNA, 16 bp, Homo sapiens
cgccacggccaccctc

SEQ ID NO: 1071286 - DNA, 15 bp, Homo sapiens
cgccacgtcccagca

SEQ ID NO: 1071287 - DNA, 21 bp, Homo sapiens
cgccacgtcccagcatccctg

SEQ ID NO: 1071288 - DNA, 16 bp, Homo sapiens
cgccactaggtgtccc

SEQ ID NO: 1071289 - DNA, 14 bp, Homo sapiens
cgccactcatttca

SEQ ID NO: 1071290 - DNA, 19 bp, Homo sapiens
cgccactcatttcatctca

SEQ ID NO: 1071291 - DNA, 23 bp, Homo sapiens
cgccactgcactccagcctgggc

SEQ ID NO: 1071292 - DNA, 13 bp, Homo sapiens
cgccactgccatc

SEQ ID NO: 1071293 - DNA, 21 bp, Homo sapiens
cgccagaccccgtggctctgg

SEQ ID NO: 1071294 - DNA, 17 bp, Homo sapiens
cgccagaggtgcttcac

SEQ ID NO: 1071295 - DNA, 22 bp, Homo sapiens
cgccagcacagaaacagaggag

SEQ ID NO: 1071296 - DNA, 16 bp, Homo sapiens
cgccagccccaagctg

SEQ ID NO: 1071297 - DNA, 17 bp, Homo sapiens
cgccagccccgctccca

SEQ ID NO: 1071298 - DNA, 15 bp, Homo sapiens
cgccagctaattttt

SEQ ID NO: 1071299 - DNA, 17 bp, Homo sapiens
cgccagctcctctctga

SEQ ID NO: 1071300 - DNA, 21 bp, Homo sapiens
cgccaggaagccagagcccca

SEQ ID NO: 1071301 - DNA, 14 bp, Homo sapiens
cgccaggacagcag

SEQ ID NO: 1071302 - DNA, 15 bp, Homo sapiens
cgccaggacagcagc

SEQ ID NO: 1071303 - DNA, 23 bp, Homo sapiens
cgccaggatggaacacggccaca

SEQ ID NO: 1071304 - DNA, 15 bp, Homo sapiens
cgccaggcagagctg

SEQ ID NO: 1071305 - DNA, 17 bp, Homo sapiens
cgccagggcccaggcca

SEQ ID NO: 1071306 - DNA, 11 bp, Homo sapiens
cgccagggctg

SEQ ID NO: 1071307 - DNA, 14 bp, Homo sapiens
cgccagggctgggg

SEQ ID NO: 1071308 - DNA, 16 bp, Homo sapiens
cgccagggctggggac

SEQ ID NO: 1071309 - DNA, 23 bp, Homo sapiens
cgccaggggaaaatcagcctgct

SEQ ID NO: 1071310 - DNA, 14 bp, Homo sapiens
cgccagtcactgct

SEQ ID NO: 1071311 - DNA, 15 bp, Homo sapiens
cgccagtcactgctg

SEQ ID NO: 1071312 - DNA, 14 bp, Homo sapiens
cgccagtctcccag

SEQ ID NO: 1071313 - DNA, 14 bp, Homo sapiens
cgccatagccccag

SEQ ID NO: 1071314 - DNA, 19 bp, Homo sapiens
cgccataggccaaggtgca

SEQ ID NO: 1071315 - DNA, 17 bp, Homo sapiens
cgccatcaaggtccagt

SEQ ID NO: 1071316 - DNA, 18 bp, Homo sapiens
cgccatcaaggtccagtg

SEQ ID NO: 1071317 - DNA, 19 bp, Homo sapiens
cgccatcaaggtccagtgg

SEQ ID NO: 1071318 - DNA, 20 bp, Homo sapiens
cgccatccagggtctggcag

SEQ ID NO: 1071319 - DNA, 15 bp, Homo sapiens
cgccatgctcctggc

SEQ ID NO: 1071320 - DNA, 20 bp, Homo sapiens
cgccatggggtcggctcctg

SEQ ID NO: 1071321 - DNA, 16 bp, Homo sapiens
cggagagcagcagcac

SEQ ID NO: 1071322 - DNA, 17 bp, Homo sapiens
cggagagcagcagcacc

SEQ ID NO: 1071323 - DNA, 15 bp, Homo sapiens
cggagagctggtgac

SEQ ID NO: 1071324 - DNA, 16 bp, Homo sapiens
cggagagctggtgact

SEQ ID NO: 1071325 - DNA, 19 bp, Homo sapiens
cggagagtacagtgagcca

SEQ ID NO: 1071326 - DNA, 16 bp, Homo sapiens
cggagcaaactctgct

SEQ ID NO: 1071327 - DNA, 17 bp, Homo sapiens
cggagcacagccctggg

SEQ ID NO: 1071328 - DNA, 18 bp, Homo sapiens
cggagcacagccctggga

SEQ ID NO: 1071329 - DNA, 12 bp, Homo sapiens
cggagcagcagg

SEQ ID NO: 1071330 - DNA, 22 bp, Homo sapiens
cggagcatcccggaggaaatct

SEQ ID NO: 1071331 - DNA, 16 bp, Homo sapiens
cggagccaacaagacc

SEQ ID NO: 1071332 - DNA, 13 bp, Homo sapiens
cggagccactcct

SEQ ID NO: 1071333 - DNA, 17 bp, Homo sapiens
cggagccactcctctga

SEQ ID NO: 1071334 - DNA, 19 bp, Homo sapiens
cggagccatcaccctcacc

SEQ ID NO: 1071335 - DNA, 14 bp, Homo sapiens
cggagcccagcctg

SEQ ID NO: 1071336 - DNA, 21 bp, Homo sapiens
cggagcccagcctgggagccc

SEQ ID NO: 1071337 - DNA, 22 bp, Homo sapiens
cggagcccagcctgggagccca

SEQ ID NO: 1071338 - DNA, 22 bp, Homo sapiens
cggagccccaggcctctgtgtc

SEQ ID NO: 1071339 - DNA, 21 bp, Homo sapiens
cggagcccctgaaagcctcac

SEQ ID NO: 1071340 - DNA, 22 bp, Homo sapiens
cggagcccctgaaagcctcacg

SEQ ID NO: 1071341 - DNA, 11 bp, Homo sapiens
cggagctgcct

SEQ ID NO: 1071342 - DNA, 14 bp, Homo sapiens
cggagctgcctgca

SEQ ID NO: 1071343 - DNA, 17 bp, Homo sapiens
cggagctgcctgcagca

SEQ ID NO: 1071344 - DNA, 13 bp, Homo sapiens
cggagctggcccc

SEQ ID NO: 1071345 - DNA, 12 bp, Homo sapiens
cggagctggctg

SEQ ID NO: 1071346 - DNA, 18 bp, Homo sapiens
cggagctggctgtgcctg

SEQ ID NO: 1071347 - DNA, 14 bp, Homo sapiens
cggagctggggtct

SEQ ID NO: 1071348 - DNA, 20 bp, Homo sapiens
cggagctggggtctgggcag

SEQ ID NO: 1071349 - DNA, 21 bp, Homo sapiens
cggagctggggtctgggcagt

SEQ ID NO: 1071350 - DNA, 12 bp, Homo sapiens
cggaggaaatct

SEQ ID NO: 1071351 - DNA, 14 bp, Homo sapiens
cggaggactcacca

SEQ ID NO: 1071352 - DNA, 12 bp, Homo sapiens
cggaggagcagc

SEQ ID NO: 1071353 - DNA, 21 bp, Homo sapiens
cggaggagcagcctcgaggct

SEQ ID NO: 1071354 - DNA, 18 bp, Homo sapiens
cggaggaggaagagggta

SEQ ID NO: 1071355 - DNA, 13 bp, Homo sapiens
cggaggaggagat

SEQ ID NO: 1071356 - DNA, 13 bp, Homo sapiens
cggaggaggctgc

SEQ ID NO: 1071357 - DNA, 21 bp, Homo sapiens
cggaggagttttggcagccag

SEQ ID NO: 1071358 - DNA, 17 bp, Homo sapiens
cggaggatagtatgagc

SEQ ID NO: 1071359 - DNA, 12 bp, Homo sapiens
cggaggcagcag

SEQ ID NO: 1071360 - DNA, 17 bp, Homo sapiens
cggaggcgtggaggaga

SEQ ID NO: 1071361 - DNA, 19 bp, Homo sapiens
cggaggctgggcccctggg

SEQ ID NO: 1071362 - DNA, 20 bp, Homo sapiens
cggaggctgggcccctggga

SEQ ID NO: 1071363 - DNA, 21 bp, Homo sapiens
cggaggcttgtcagagctggg

SEQ ID NO: 1071364 - DNA, 23 bp, Homo sapiens
cggaggcttgtcagagctgggag

SEQ ID NO: 1071365 - DNA, 20 bp, Homo sapiens
cggagggacgcggaggagga

SEQ ID NO: 1071366 - DNA, 16 bp, Homo sapiens
cggagggaggcaccat

SEQ ID NO: 1071367 - DNA, 20 bp, Homo sapiens
cggagggagtcccagagccc

SEQ ID NO: 1071368 - DNA, 21 bp, Homo sapiens
cggagggagtcccagagccct

SEQ ID NO: 1071369 - DNA, 19 bp, Homo sapiens
cggagggccgcagggccca

SEQ ID NO: 1071370 - DNA, 21 bp, Homo sapiens
cggagggccgtgtgacactct

SEQ ID NO: 1071371 - DNA, 14 bp, Homo sapiens
cggaggggagtaga

SEQ ID NO: 1071372 - DNA, 15 bp, Homo sapiens
cggaggggcctggca

SEQ ID NO: 1071373 - DNA, 18 bp, Homo sapiens
cggaggggcctggcagcc

SEQ ID NO: 1071374 - DNA, 17 bp, Homo sapiens
cggaggtcactccacca

SEQ ID NO: 1071375 - DNA, 16 bp, Homo sapiens
cggagtaatcaggcag

SEQ ID NO: 1071376 - DNA, 17 bp, Homo sapiens
cggagtaatcaggcagc

SEQ ID NO: 1071377 - DNA, 22 bp, Homo sapiens
cggagtcgtggggtgtgctggg

SEQ ID NO: 1071378 - DNA, 20 bp, Homo sapiens
cggagtgaagaggggcagcc

SEQ ID NO: 1071379 - DNA, 22 bp, Homo sapiens
cggagtgaagaggggcagccct

SEQ ID NO: 1071380 - DNA, 18 bp, Homo sapiens
cggagtgagttttttagt

SEQ ID NO: 1071381 - DNA, 22 bp, Homo sapiens
cggagtggggggacagagactc

SEQ ID NO: 1071382 - DNA, 16 bp, Homo sapiens
cggagttcctaacagg

SEQ ID NO: 1071383 - DNA, 20 bp, Homo sapiens
cggagttcctaacaggatga

SEQ ID NO: 1071384 - DNA, 23 bp, Homo sapiens
cggatcaccgagagtagccgaga

SEQ ID NO: 1071385 - DNA, 18 bp, Homo sapiens
cggatcatatggagctca

SEQ ID NO: 1071386 - DNA, 21 bp, Homo sapiens
cggatcatatggagctcatgt

SEQ ID NO: 1071387 - DNA, 16 bp, Homo sapiens
cggatctgagaatctt

SEQ ID NO: 1071388 - DNA, 16 bp, Homo sapiens
cggatctgctgggctc

SEQ ID NO: 1071389 - DNA, 15 bp, Homo sapiens
cggatgacaccctgg

SEQ ID NO: 1071390 - DNA, 20 bp, Homo sapiens
cggatgacaccctggcctga

SEQ ID NO: 1071391 - DNA, 18 bp, Homo sapiens
cggatggaccaacctgct

SEQ ID NO: 1071392 - DNA, 16 bp, Homo sapiens
cggatggatggaaggt

SEQ ID NO: 1071393 - DNA, 15 bp, Homo sapiens
cggatggcaggatcc

SEQ ID NO: 1071394 - DNA, 14 bp, Homo sapiens
cggatgtataaatg

SEQ ID NO: 1071395 - DNA, 12 bp, Homo sapiens
cggattccagcc

SEQ ID NO: 1071396 - DNA, 15 bp, Homo sapiens
cggattgctctggag

SEQ ID NO: 1071397 - DNA, 20 bp, Homo sapiens
cggattgctctggagcagcc

SEQ ID NO: 1071398 - DNA, 13 bp, Homo sapiens
cggattttttcca

SEQ ID NO: 1071399 - DNA, 15 bp, Homo sapiens
cggcaaaagcccatt

SEQ ID NO: 1071400 - DNA, 12 bp, Homo sapiens
cggcaacatcaa

SEQ ID NO: 1071401 - DNA, 19 bp, Homo sapiens
cggcaaccccagttctgct

SEQ ID NO: 1071402 - DNA, 19 bp, Homo sapiens
cggcaacgtagcctgggct

SEQ ID NO: 1071403 - DNA, 14 bp, Homo sapiens
cggcaagccacagg

SEQ ID NO: 1071404 - DNA, 14 bp, Homo sapiens
cggcacagggtctg

SEQ ID NO: 1071405 - DNA, 20 bp, Homo sapiens
cggcaccctggtctgtggag

SEQ ID NO: 1071406 - DNA, 16 bp, Homo sapiens
cggcagaactctctgt

SEQ ID NO: 1071407 - DNA, 21 bp, Homo sapiens
cggcagagtccttagtggagg

SEQ ID NO: 1071408 - DNA, 13 bp, Homo sapiens
cggcagcagccat

SEQ ID NO: 1071409 - DNA, 20 bp, Homo sapiens
cggcagctcttctgggcaga

SEQ ID NO: 1071410 - DNA, 17 bp, Homo sapiens
cggcaggcctgagaatg

SEQ ID NO: 1071411 - DNA, 18 bp, Homo sapiens
cggcaggcctgagaatga

SEQ ID NO: 1071412 - DNA, 21 bp, Homo sapiens
cggcaggcctgagaatgagtg

SEQ ID NO: 1071413 - DNA, 17 bp, Homo sapiens
cggcaggcgtgtggcag

SEQ ID NO: 1071414 - DNA, 20 bp, Homo sapiens
cggcaggcgtgtggcagcca

SEQ ID NO: 1071415 - DNA, 17 bp, Homo sapiens
cggcaggctcactgcca

SEQ ID NO: 1071416 - DNA, 18 bp, Homo sapiens
cggcaggctcactgccag

SEQ ID NO: 1071417 - DNA, 20 bp, Homo sapiens
cggcaggctcactgccaggc

SEQ ID NO: 1071418 - DNA, 14 bp, Homo sapiens
cggcaggggcctgg

SEQ ID NO: 1071419 - DNA, 15 bp, Homo sapiens
cggcaggggcctgga

SEQ ID NO: 1071420 - DNA, 18 bp, Homo sapiens
cggcaggggcctggagat

SEQ ID NO: 1071421 - DNA, 13 bp, Homo sapiens
cggcagtgggcct

SEQ ID NO: 1071422 - DNA, 19 bp, Homo sapiens
cggcatccttgcctgtcta

SEQ ID NO: 1071423 - DNA, 15 bp, Homo sapiens
cggcatgccaggacc

SEQ ID NO: 1071424 - DNA, 16 bp, Homo sapiens
cggcatgccaggaccc

SEQ ID NO: 1071425 - DNA, 21 bp, Homo sapiens
cggcatgggaaagccacctct

SEQ ID NO: 1071426 - DNA, 13 bp, Homo sapiens
cggcatttaactt

SEQ ID NO: 1071427 - DNA, 14 bp, Homo sapiens
cggcatttcaaatg

SEQ ID NO: 1071428 - DNA, 19 bp, Homo sapiens
cggccaagataggaccttg

SEQ ID NO: 1071429 - DNA, 22 bp, Homo sapiens
cggccaagataggaccttgggc

SEQ ID NO: 1071430 - DNA, 12 bp, Homo sapiens
cggccaatggaa

SEQ ID NO: 1071431 - DNA, 15 bp, Homo sapiens
cggccaatggaaacc

SEQ ID NO: 1071432 - DNA, 16 bp, Homo sapiens
cggccacacccagcgg

SEQ ID NO: 1071433 - DNA, 17 bp, Homo sapiens
cggccacacccagcggc

SEQ ID NO: 1071434 - DNA, 16 bp, Homo sapiens
cggccaccactgcagc

SEQ ID NO: 1071435 - DNA, 18 bp, Homo sapiens
cggccactgtgtctctgt

SEQ ID NO: 1071436 - DNA, 15 bp, Homo sapiens
cggccagccatgtct

SEQ ID NO: 1071437 - DNA, 21 bp, Homo sapiens
cggccaggcattggctcagcc

SEQ ID NO: 1071438 - DNA, 23 bp, Homo sapiens
cggccagggacccaaagcaggat

SEQ ID NO: 1071439 - DNA, 21 bp, Homo sapiens
cggccagggcggccagggacc

SEQ ID NO: 1071440 - DNA, 18 bp, Homo sapiens
cggccaggttgtgtccca

SEQ ID NO: 1071441 - DNA, 19 bp, Homo sapiens
cggccatgagactgatccc

SEQ ID NO: 1071442 - DNA, 17 bp, Homo sapiens
cggcccagagacccctt

SEQ ID NO: 1071443 - DNA, 16 bp, Homo sapiens
cggcccagtgccactg

SEQ ID NO: 1071444 - DNA, 20 bp, Homo sapiens
cggcccagtgccactgcccc

SEQ ID NO: 1071445 - DNA, 20 bp, Homo sapiens
cggcccatccccaggcacct

SEQ ID NO: 1071446 - DNA, 21 bp, Homo sapiens
cggccccaccccctgggcaga

SEQ ID NO: 1071447 - DNA, 16 bp, Homo sapiens
cggccccacctccctg

SEQ ID NO: 1071448 - DNA, 20 bp, Homo sapiens
cggccccacctccctgcgcc

SEQ ID NO: 1071449 - DNA, 14 bp, Homo sapiens
cggccccagccaga

SEQ ID NO: 1071450 - DNA, 16 bp, Homo sapiens
cggccccagccagagt

SEQ ID NO: 1071451 - DNA, 15 bp, Homo sapiens
cggccccggccccag

SEQ ID NO: 1071452 - DNA, 21 bp, Homo sapiens
cggcccgctgcagcctctgcc

SEQ ID NO: 1071453 - DNA, 15 bp, Homo sapiens
cggcccggagcagca

SEQ ID NO: 1071454 - DNA, 20 bp, Homo sapiens
cggcccggagcagcaggaag

SEQ ID NO: 1071455 - DNA, 17 bp, Homo sapiens
cggccctcactaagccc

SEQ ID NO: 1071456 - DNA, 23 bp, Homo sapiens
cggccctcctaccctgcgcccag

SEQ ID NO: 1071457 - DNA, 16 bp, Homo sapiens
cggccctgaaccacga

SEQ ID NO: 1071458 - DNA, 21 bp, Homo sapiens
cggccctgaaccacgaggctg

SEQ ID NO: 1071459 - DNA, 22 bp, Homo sapiens
cggccctgaaccacgaggctgc

SEQ ID NO: 1071460 - DNA, 19 bp, Homo sapiens
cggccctgcagccagctca

SEQ ID NO: 1071461 - DNA, 15 bp, Homo sapiens
cggccctgcaggagc

SEQ ID NO: 1071462 - DNA, 19 bp, Homo sapiens
cggccctgcaggagcaggg

SEQ ID NO: 1071463 - DNA, 13 bp, Homo sapiens
cggccctgcccaa

SEQ ID NO: 1071464 - DNA, 18 bp, Homo sapiens
cggccctgcgtcggccct

SEQ ID NO: 1071465 - DNA, 15 bp, Homo sapiens
cggccctgctggggc

SEQ ID NO: 1071466 - DNA, 13 bp, Homo sapiens
cggccctggggag

SEQ ID NO: 1071467 - DNA, 15 bp, Homo sapiens
cggccctgtcccctg

SEQ ID NO: 1071468 - DNA, 18 bp, Homo sapiens
cggccctgtcccctggag

SEQ ID NO: 1071469 - DNA, 14 bp, Homo sapiens
cggccgagctgcct

SEQ ID NO: 1071470 - DNA, 18 bp, Homo sapiens
cggccgccgccaggactg

SEQ ID NO: 1071471 - DNA, 14 bp, Homo sapiens
cggccgcgccaccc

SEQ ID NO: 1071472 - DNA, 14 bp, Homo sapiens
cggccggccagccc

SEQ ID NO: 1071473 - DNA, 16 bp, Homo sapiens
cggccggccagcccct

SEQ ID NO: 1071474 - DNA, 16 bp, Homo sapiens
cggccggccggacctc

SEQ ID NO: 1071475 - DNA, 19 bp, Homo sapiens
cggccgtgggccgggaggc

SEQ ID NO: 1071476 - DNA, 22 bp, Homo sapiens
cggcctaggggtggcgctcaga

SEQ ID NO: 1071477 - DNA, 14 bp, Homo sapiens
cggcctcaccaggc

SEQ ID NO: 1071478 - DNA, 21 bp, Homo sapiens
cggcctcaccaggcccacgag

SEQ ID NO: 1071479 - DNA, 16 bp, Homo sapiens
cggcctccacacctga

SEQ ID NO: 1071480 - DNA, 22 bp, Homo sapiens
cggcctccactcccccacctga

SEQ ID NO: 1071481 - DNA, 13 bp, Homo sapiens
cggcctccaggag

SEQ ID NO: 1071482 - DNA, 14 bp, Homo sapiens
cggcctcccaaagt

SEQ ID NO: 1071483 - DNA, 20 bp, Homo sapiens
cggcctcccaaagtgctggg

SEQ ID NO: 1071484 - DNA, 13 bp, Homo sapiens
cggcctccccgag

SEQ ID NO: 1071485 - DNA, 14 bp, Homo sapiens
cggcctccccgagg

SEQ ID NO: 1071486 - DNA, 18 bp, Homo sapiens
cggcctcctcggagagca

SEQ ID NO: 1071487 - DNA, 23 bp, Homo sapiens
cggcctcctcggagagcagcagc

SEQ ID NO: 1071488 - DNA, 14 bp, Homo sapiens
cggcctctctggcc

SEQ ID NO: 1071489 - DNA, 19 bp, Homo sapiens
cggcctctctggcctccca

SEQ ID NO: 1071490 - DNA, 20 bp, Homo sapiens
cggcctctctggcctcccac

SEQ ID NO: 1071491 - DNA, 15 bp, Homo sapiens
cggcctctgctgccc

SEQ ID NO: 1071492 - DNA, 16 bp, Homo sapiens
cggcctctgctgcccc

SEQ ID NO: 1071493 - DNA, 17 bp, Homo sapiens
cggcctctgctgccccc

SEQ ID NO: 1071494 - DNA, 18 bp, Homo sapiens
cggcctctgctgccccct

SEQ ID NO: 1071495 - DNA, 12 bp, Homo sapiens
cggcctcttcca

SEQ ID NO: 1071496 - DNA, 17 bp, Homo sapiens
cggcctgatgctccctc

SEQ ID NO: 1071497 - DNA, 22 bp, Homo sapiens
cggcctgcaccgacccgaggcc

SEQ ID NO: 1071498 - DNA, 14 bp, Homo sapiens
cggcctgctcccag

SEQ ID NO: 1071499 - DNA, 12 bp, Homo sapiens
cggcctgtcctc

SEQ ID NO: 1071500 - DNA, 21 bp, Homo sapiens
cggcctgtcctccaacaccaa

SEQ ID NO: 1071501 - DNA, 18 bp, Homo sapiens
cggcctgtgggtctctga

SEQ ID NO: 1071502 - DNA, 21 bp, Homo sapiens
cggcctgtgggtctctgaagg

SEQ ID NO: 1071503 - DNA, 18 bp, Homo sapiens
cggccttgctttgtctgg

SEQ ID NO: 1071504 - DNA, 23 bp, Homo sapiens
cggccttgctttgtctggcctca

SEQ ID NO: 1071505 - DNA, 13 bp, Homo sapiens
cggcgccagcctc

SEQ ID NO: 1071506 - DNA, 17 bp, Homo sapiens
cggcgcccccagtgtgc

SEQ ID NO: 1071507 - DNA, 20 bp, Homo sapiens
cggcgccccgcacccccgcc

SEQ ID NO: 1071508 - DNA, 22 bp, Homo sapiens
cggcgcctgccctgcccaagtg

SEQ ID NO: 1071509 - DNA, 20 bp, Homo sapiens
cggcgcggtggctcacgcct

SEQ ID NO: 1071510 - DNA, 13 bp, Homo sapiens
cggcgctgcaggt

SEQ ID NO: 1071511 - DNA, 13 bp, Homo sapiens
cggcgctgcctca

SEQ ID NO: 1071512 - DNA, 15 bp, Homo sapiens
cggcgctgcctcagg

SEQ ID NO: 1071513 - DNA, 16 bp, Homo sapiens
cggcgctgcctcaggc

SEQ ID NO: 1071514 - DNA, 22 bp, Homo sapiens
cggcggaattcaccagtgttcc

SEQ ID NO: 1071515 - DNA, 13 bp, Homo sapiens
cggcggctctgag

SEQ ID NO: 1071516 - DNA, 18 bp, Homo sapiens
cggcggctctgcccacct

SEQ ID NO: 1071517 - DNA, 20 bp, Homo sapiens
cggcgggatcctccacagag

SEQ ID NO: 1071518 - DNA, 18 bp, Homo sapiens
cggcgtcttgcccagcag

SEQ ID NO: 1071519 - DNA, 15 bp, Homo sapiens
cggcgtgggggcact

SEQ ID NO: 1071520 - DNA, 19 bp, Homo sapiens
cggctactcagcagccctc

SEQ ID NO: 1071521 - DNA, 13 bp, Homo sapiens
cggctcagcctcc

SEQ ID NO: 1071522 - DNA, 15 bp, Homo sapiens
cggctcagccttgca

SEQ ID NO: 1071523 - DNA, 17 bp, Homo sapiens
cggctcagccttgcaca

SEQ ID NO: 1071524 - DNA, 17 bp, Homo sapiens
cggctccccatgtgtcc

SEQ ID NO: 1071525 - DNA, 21 bp, Homo sapiens
cggctccgagggcggccaggg

SEQ ID NO: 1071526 - DNA, 13 bp, Homo sapiens
cggctcctcagag

SEQ ID NO: 1071527 - DNA, 16 bp, Homo sapiens
cggctctcacctggcc

SEQ ID NO: 1071528 - DNA, 11 bp, Homo sapiens
cggctctgagc

SEQ ID NO: 1071529 - DNA, 15 bp, Homo sapiens
cggctctgagcaggg

SEQ ID NO: 1071530 - DNA, 22 bp, Homo sapiens
cggctctgagcaggggcaggcg

SEQ ID NO: 1071531 - DNA, 13 bp, Homo sapiens
cggctctgcagtc

SEQ ID NO: 1071532 - DNA, 11 bp, Homo sapiens
cggctctgccc

SEQ ID NO: 1071533 - DNA, 14 bp, Homo sapiens
cggctctgcccacc

SEQ ID NO: 1071534 - DNA, 14 bp, Homo sapiens
cggctgaccatgct

SEQ ID NO: 1071535 - DNA, 15 bp, Homo sapiens
cggctgagagcccca

SEQ ID NO: 1071536 - DNA, 18 bp, Homo sapiens
cggctgagagccccagct

SEQ ID NO: 1071537 - DNA, 20 bp, Homo sapiens
cggctgagtcatgatctccc

SEQ ID NO: 1071538 - DNA, 22 bp, Homo sapiens
cggctgagtcatgatctccctg

SEQ ID NO: 1071539 - DNA, 13 bp, Homo sapiens
cggctgcacaaca

SEQ ID NO: 1071540 - DNA, 15 bp, Homo sapiens
cggctgcagaggcca

SEQ ID NO: 1071541 - DNA, 20 bp, Homo sapiens
cggctgcagaggccagaggc

SEQ ID NO: 1071542 - DNA, 16 bp, Homo sapiens
cggctgcccccatcac

SEQ ID NO: 1071543 - DNA, 24 bp, Homo sapiens
cggctgcccccatcacctctactg

SEQ ID NO: 1071544 - DNA, 11 bp, Homo sapiens
cggctgcctgc

SEQ ID NO: 1071545 - DNA, 11 bp, Homo sapiens
cggctgctgct

SEQ ID NO: 1071546 - DNA, 20 bp, Homo sapiens
cggctggaaatgctgggctg

SEQ ID NO: 1071547 - DNA, 23 bp, Homo sapiens
cggctggcagcccacccctcaac

SEQ ID NO: 1071548 - DNA, 14 bp, Homo sapiens
cggctggccgggaa

SEQ ID NO: 1071549 - DNA, 14 bp, Homo sapiens
cggctggcctggag

SEQ ID NO: 1071550 - DNA, 17 bp, Homo sapiens
cggctgggcacacgcct

SEQ ID NO: 1071551 - DNA, 14 bp, Homo sapiens
cggctgggcctcct

SEQ ID NO: 1071552 - DNA, 21 bp, Homo sapiens
cggctgggtcggccctgccca

SEQ ID NO: 1071553 - DNA, 22 bp, Homo sapiens
cggctggtcactctgccctctg

SEQ ID NO: 1071554 - DNA, 23 bp, Homo sapiens
cggctggtcactctgccctctgc

SEQ ID NO: 1071555 - DNA, 23 bp, Homo sapiens
cggctggttttgtaagatgctgg

SEQ ID NO: 1071556 - DNA, 18 bp, Homo sapiens
cggctgtccctcatggag

SEQ ID NO: 1071557 - DNA, 21 bp, Homo sapiens
cggctgttccccctgccgcag

SEQ ID NO: 1071558 - DNA, 16 bp, Homo sapiens
cggcttagccaagccc

SEQ ID NO: 1071559 - DNA, 16 bp, Homo sapiens
cggcttcctgtccact

SEQ ID NO: 1071560 - DNA, 18 bp, Homo sapiens
cggcttcttggaccttgg

SEQ ID NO: 1071561 - DNA, 16 bp, Homo sapiens
cggctttcctccggag

SEQ ID NO: 1071562 - DNA, 19 bp, Homo sapiens
cggctttctctgcctctgg

SEQ ID NO: 1071563 - DNA, 20 bp, Homo sapiens
cggctttctctgcctctggg

SEQ ID NO: 1071564 - DNA, 18 bp, Homo sapiens
cggctttttgccatctgt

SEQ ID NO: 1071565 - DNA, 20 bp, Homo sapiens
cgggaacagtgtttcccata

SEQ ID NO: 1071566 - DNA, 16 bp, Homo sapiens
cgggaacatgccccct

SEQ ID NO: 1071567 - DNA, 13 bp, Homo sapiens
cgggaagggaggg

SEQ ID NO: 1071568 - DNA, 20 bp, Homo sapiens
cgggaagggcatgcacgggc

SEQ ID NO: 1071569 - DNA, 17 bp, Homo sapiens
cgggaataaccttccat

SEQ ID NO: 1071570 - DNA, 20 bp, Homo sapiens
cgggaatgaccgctctccct

SEQ ID NO: 1071571 - DNA, 15 bp, Homo sapiens
cgggacacctgccct

SEQ ID NO: 1071572 - DNA, 18 bp, Homo sapiens
cgggacacctgccctgcc

SEQ ID NO: 1071573 - DNA, 22 bp, Homo sapiens
cgggaccattgacctcagctgc

SEQ ID NO: 1071574 - DNA, 15 bp, Homo sapiens
cgggaccgtcagcat

SEQ ID NO: 1071575 - DNA, 15 bp, Homo sapiens
cgggactcagtgagc

SEQ ID NO: 1071576 - DNA, 20 bp, Homo sapiens
cgggagaaaagacggatggc

SEQ ID NO: 1071577 - DNA, 19 bp, Homo sapiens
cgggagaagccaccttccc

SEQ ID NO: 1071578 - DNA, 18 bp, Homo sapiens
cgggagacagcttctctg

SEQ ID NO: 1071579 - DNA, 16 bp, Homo sapiens
cgggagacctgtgcta

SEQ ID NO: 1071580 - DNA, 12 bp, Homo sapiens
cgggagagccag

SEQ ID NO: 1071581 - DNA, 15 bp, Homo sapiens
cgggagagccaggct

SEQ ID NO: 1071582 - DNA, 15 bp, Homo sapiens
cgggagaggactctg

SEQ ID NO: 1071583 - DNA, 21 bp, Homo sapiens
cgggagatggacccctccctt

SEQ ID NO: 1071584 - DNA, 14 bp, Homo sapiens
cgggagcatctctt

SEQ ID NO: 1071585 - DNA, 22 bp, Homo sapiens
cgggagcatctcttgaggccag

SEQ ID NO: 1071586 - DNA, 14 bp, Homo sapiens
cgggagcctccccc

SEQ ID NO: 1071587 - DNA, 18 bp, Homo sapiens
cgggagcctccccctcag

SEQ ID NO: 1071588 - DNA, 19 bp, Homo sapiens
cgggagcctccccctcaga

SEQ ID NO: 1071589 - DNA, 21 bp, Homo sapiens
cgggagcctgatcacctgccc

SEQ ID NO: 1071590 - DNA, 13 bp, Homo sapiens
cgggagctgcaca

SEQ ID NO: 1071591 - DNA, 10 bp, Homo sapiens
cgggagctgg

SEQ ID NO: 1071592 - DNA, 21 bp, Homo sapiens
cgggaggaaaaggcccctgca

SEQ ID NO: 1071593 - DNA, 13 bp, Homo sapiens
cgggaggcaccag

SEQ ID NO: 1071594 - DNA, 20 bp, Homo sapiens
cgggaggcaccagctctgtg

SEQ ID NO: 1071595 - DNA, 23 bp, Homo sapiens
cgggaggcaccagctctgtggcc

SEQ ID NO: 1071596 - DNA, 18 bp, Homo sapiens
cgggaggctgagacagga

SEQ ID NO: 1071597 - DNA, 23 bp, Homo sapiens
cgggaggctgagacaggagaatc

SEQ ID NO: 1071598 - DNA, 16 bp, Homo sapiens
cgggaggctgaggcag

SEQ ID NO: 1071599 - DNA, 18 bp, Homo sapiens
cgggaggctgaggcagga

SEQ ID NO: 1071600 - DNA, 15 bp, Homo sapiens
cgggatattatagaa

SEQ ID NO: 1071601 - DNA, 20 bp, Homo sapiens
cgggatcctccacagagagg

SEQ ID NO: 1071602 - DNA, 13 bp, Homo sapiens
cgggatcctgccc

SEQ ID NO: 1071603 - DNA, 20 bp, Homo sapiens
cgggatcctgcccccaagtc

SEQ ID NO: 1071604 - DNA, 17 bp, Homo sapiens
cgggattagtacacact

SEQ ID NO: 1071605 - DNA, 20 bp, Homo sapiens
cgggcaaagagctcccgagg

SEQ ID NO: 1071606 - DNA, 18 bp, Homo sapiens
cgggcaaatgccagggcc

SEQ ID NO: 1071607 - DNA, 20 bp, Homo sapiens
cgggcaaatgccagggcccg

SEQ ID NO: 1071608 - DNA, 21 bp, Homo sapiens
cgggcaagtgagaggggaggg

SEQ ID NO: 1071609 - DNA, 15 bp, Homo sapiens
cgggcacacagactg

SEQ ID NO: 1071610 - DNA, 16 bp, Homo sapiens
cgggcaccagccagcg

SEQ ID NO: 1071611 - DNA, 14 bp, Homo sapiens
cgggcagagggctg

SEQ ID NO: 1071612 - DNA, 15 bp, Homo sapiens
cgggcagagggctgg

SEQ ID NO: 1071613 - DNA, 16 bp, Homo sapiens
cgggcagagggctgga

SEQ ID NO: 1071614 - DNA, 22 bp, Homo sapiens
cgggcagagggctggaggccca

SEQ ID NO: 1071615 - DNA, 9 bp, Homo sapiens
cgggcagcc

SEQ ID NO: 1071616 - DNA, 10 bp, Homo sapiens
cgggcagcca

SEQ ID NO: 1071617 - DNA, 11 bp, Homo sapiens
cgggcagccac

SEQ ID NO: 1071618 - DNA, 12 bp, Homo sapiens
cgggcagccaca

SEQ ID NO: 1071619 - DNA, 19 bp, Homo sapiens
cgggcagccacccaagcct

SEQ ID NO: 1071620 - DNA, 12 bp, Homo sapiens
cgggcagccagc

SEQ ID NO: 1071621 - DNA, 13 bp, Homo sapiens
cgggcagccagca

SEQ ID NO: 1071622 - DNA, 18 bp, Homo sapiens
cgggcagccaggctgggc

SEQ ID NO: 1071623 - DNA, 11 bp, Homo sapiens
cgggcagcccc

SEQ ID NO: 1071624 - DNA, 20 bp, Homo sapiens
cgggcagcctggggcggtgt

SEQ ID NO: 1071625 - DNA, 17 bp, Homo sapiens
cgggcaggggagccagg

SEQ ID NO: 1071626 - DNA, 15 bp, Homo sapiens
cgggcagtctgctct

SEQ ID NO: 1071627 - DNA, 16 bp, Homo sapiens
cgggcagtctgctctg

SEQ ID NO: 1071628 - DNA, 17 bp, Homo sapiens
cgggcagtctgctctgc

SEQ ID NO: 1071629 - DNA, 19 bp, Homo sapiens
cgggcagtctgctctgctg

SEQ ID NO: 1071630 - DNA, 14 bp, Homo sapiens
cgggcatgggcctc

SEQ ID NO: 1071631 - DNA, 17 bp, Homo sapiens
cgggcatgggcctctct

SEQ ID NO: 1071632 - DNA, 20 bp, Homo sapiens
cgggcatgggcctctctggg

SEQ ID NO: 1071633 - DNA, 21 bp, Homo sapiens
cgggcatggtggctcatgcct

SEQ ID NO: 1071634 - DNA, 17 bp, Homo sapiens
cgggccaagacagatgg

SEQ ID NO: 1071635 - DNA, 16 bp, Homo sapiens
cgggccacgccccagc

SEQ ID NO: 1071636 - DNA, 18 bp, Homo sapiens
cgggccacgccccagccc

SEQ ID NO: 1071637 - DNA, 21 bp, Homo sapiens
cgggccagccaggcgggctca

SEQ ID NO: 1071638 - DNA, 12 bp, Homo sapiens
cgggccagggtg

SEQ ID NO: 1071639 - DNA, 15 bp, Homo sapiens
cgggccagggtggga

SEQ ID NO: 1071640 - DNA, 15 bp, Homo sapiens
cgggcccacctggcc

SEQ ID NO: 1071641 - DNA, 16 bp, Homo sapiens
cgggcccacctggcca

SEQ ID NO: 1071642 - DNA, 14 bp, Homo sapiens
cgggcccccgcccc

SEQ ID NO: 1071643 - DNA, 15 bp, Homo sapiens
cgggcccctgggctt

SEQ ID NO: 1071644 - DNA, 17 bp, Homo sapiens
cgggcccgggcccccgc

SEQ ID NO: 1071645 - DNA, 15 bp, Homo sapiens
cgggccctccctccc

SEQ ID NO: 1071646 - DNA, 18 bp, Homo sapiens
cgggccctccctcccagc

SEQ ID NO: 1071647 - DNA, 21 bp, Homo sapiens
cgggccctccttccctcctgt

SEQ ID NO: 1071648 - DNA, 11 bp, Homo sapiens
cgggccctgcc

SEQ ID NO: 1071649 - DNA, 15 bp, Homo sapiens
cgggccctgggttcc

SEQ ID NO: 1071650 - DNA, 20 bp, Homo sapiens
cgggcccttcttgctgccct

SEQ ID NO: 1071651 - DNA, 15 bp, Homo sapiens
cgggccgcaggaggg

SEQ ID NO: 1071652 - DNA, 17 bp, Homo sapiens
cgggccgcaggagggag

SEQ ID NO: 1071653 - DNA, 22 bp, Homo sapiens
cgggccgcaggagggaggcggg

SEQ ID NO: 1071654 - DNA, 15 bp, Homo sapiens
cgggccggacctgag

SEQ ID NO: 1071655 - DNA, 16 bp, Homo sapiens
cgggccggacctgagc

SEQ ID NO: 1071656 - DNA, 21 bp, Homo sapiens
cgggccggacctgagcccgca

SEQ ID NO: 1071657 - DNA, 20 bp, Homo sapiens
cgggcctggagaactagaga

SEQ ID NO: 1071658 - DNA, 16 bp, Homo sapiens
cgggcgccaggacagc

SEQ ID NO: 1071659 - DNA, 19 bp, Homo sapiens
cgggcgccaggacagcagc

SEQ ID NO: 1071660 - DNA, 24 bp, Homo sapiens
cgggcgcccgcggcgcgaccctcc

SEQ ID NO: 1071661 - DNA, 21 bp, Homo sapiens
cgggcgtgggtctctggggac

SEQ ID NO: 1071662 - DNA, 10 bp, Homo sapiens
cgggctcaga

SEQ ID NO: 1071663 - DNA, 13 bp, Homo sapiens
cgggctcagagct

SEQ ID NO: 1071664 - DNA, 15 bp, Homo sapiens
cgggctcagcaaaag

SEQ ID NO: 1071665 - DNA, 19 bp, Homo sapiens
cgggctcagcaaaagatgc

SEQ ID NO: 1071666 - DNA, 14 bp, Homo sapiens
cgggctccagccat

SEQ ID NO: 1071667 - DNA, 13 bp, Homo sapiens
cgggctccctcct

SEQ ID NO: 1071668 - DNA, 22 bp, Homo sapiens
cgggctccctcctctggcaggc

SEQ ID NO: 1071669 - DNA, 14 bp, Homo sapiens
cgggctccttcccc

SEQ ID NO: 1071670 - DNA, 16 bp, Homo sapiens
cgggctccttcccctg

SEQ ID NO: 1071671 - DNA, 23 bp, Homo sapiens
cgggctctatgcctgcactggga

SEQ ID NO: 1071672 - DNA, 17 bp, Homo sapiens
cgggctgcaggtgctgc

SEQ ID NO: 1071673 - DNA, 14 bp, Homo sapiens
cgggctgccctgcc

SEQ ID NO: 1071674 - DNA, 15 bp, Homo sapiens
cgggctgcctgcccc

SEQ ID NO: 1071675 - DNA, 13 bp, Homo sapiens
cgggctggccctg

SEQ ID NO: 1071676 - DNA, 14 bp, Homo sapiens
cgggctggccctgt

SEQ ID NO: 1071677 - DNA, 18 bp, Homo sapiens
cgggctgggggtagcctg

SEQ ID NO: 1071678 - DNA, 16 bp, Homo sapiens
cgggctgtagatcagg

SEQ ID NO: 1071679 - DNA, 19 bp, Homo sapiens
cgggctgtagatcaggttt

SEQ ID NO: 1071680 - DNA, 20 bp, Homo sapiens
cgggctgtagatcaggtttg

SEQ ID NO: 1071681 - DNA, 13 bp, Homo sapiens
cgggctgtgcccg

SEQ ID NO: 1071682 - DNA, 22 bp, Homo sapiens
cgggctgtgcccggccccaccc

SEQ ID NO: 1071683 - DNA, 20 bp, Homo sapiens
cgggctttaatagtcacctt

SEQ ID NO: 1071684 - DNA, 16 bp, Homo sapiens
cggggaagctggcttt

SEQ ID NO: 1071685 - DNA, 12 bp, Homo sapiens
cggggaccctgt

SEQ ID NO: 1071686 - DNA, 16 bp, Homo sapiens
cggggactgctggctc

SEQ ID NO: 1071687 - DNA, 22 bp, Homo sapiens
cggggactgctggctcacgccc

SEQ ID NO: 1071688 - DNA, 16 bp, Homo sapiens
cggggagagggggagg

SEQ ID NO: 1071689 - DNA, 22 bp, Homo sapiens
cggggaggaggaacgggcagcc

SEQ ID NO: 1071690 - DNA, 23 bp, Homo sapiens
cggggaggaggaacgggcagcca

SEQ ID NO: 1071691 - DNA, 13 bp, Homo sapiens
cggggaggcagag

SEQ ID NO: 1071692 - DNA, 14 bp, Homo sapiens
cggggaggccaagt

SEQ ID NO: 1071693 - DNA, 19 bp, Homo sapiens
cggggaggccaagtgcagg

SEQ ID NO: 1071694 - DNA, 10 bp, Homo sapiens
cggggagggc

SEQ ID NO: 1071695 - DNA, 15 bp, Homo sapiens
cggggaggggcagag

SEQ ID NO: 1071696 - DNA, 22 bp, Homo sapiens
cggggagggtgacagtggccgc

SEQ ID NO: 1071697 - DNA, 13 bp, Homo sapiens
cggggatctgatg

SEQ ID NO: 1071698 - DNA, 15 bp, Homo sapiens
cggggcaagagggaa

SEQ ID NO: 1071699 - DNA, 21 bp, Homo sapiens
cggggcagcagcagccctgcc

SEQ ID NO: 1071700 - DNA, 14 bp, Homo sapiens
cggggcagctgcca

SEQ ID NO: 1071701 - DNA, 14 bp, Homo sapiens
cggggcaggcgctg

SEQ ID NO: 1071702 - DNA, 21 bp, Homo sapiens
cggggcagttagagcagcctc

SEQ ID NO: 1071703 - DNA, 22 bp, Homo sapiens
cggggcagttagagcagcctcg

SEQ ID NO: 1071704 - DNA, 19 bp, Homo sapiens
cggggcatggacagggcca

SEQ ID NO: 1071705 - DNA, 15 bp, Homo sapiens
cggggcccaggactc

SEQ ID NO: 1071706 - DNA, 16 bp, Homo sapiens
cggggccccactggct

SEQ ID NO: 1071707 - DNA, 18 bp, Homo sapiens
cggggccccactggctgg

SEQ ID NO: 1071708 - DNA, 14 bp, Homo sapiens
cggggccccagggc

SEQ ID NO: 1071709 - DNA, 20 bp, Homo sapiens
cggggcccttggggcctggc

SEQ ID NO: 1071710 - DNA, 21 bp, Homo sapiens
cggggcccttggggcctggct

SEQ ID NO: 1071711 - DNA, 18 bp, Homo sapiens
cggggcctcgggacctca

SEQ ID NO: 1071712 - DNA, 11 bp, Homo sapiens
cggggctggca

SEQ ID NO: 1071713 - DNA, 23 bp, Homo sapiens
cgggggacgcctgccctgcccag

SEQ ID NO: 1071714 - DNA, 17 bp, Homo sapiens
cgggggagcagagagag

SEQ ID NO: 1071715 - DNA, 15 bp, Homo sapiens
cgggggagcccagtg

SEQ ID NO: 1071716 - DNA, 17 bp, Homo sapiens
cgggggaggggccctca

SEQ ID NO: 1071717 - DNA, 19 bp, Homo sapiens
cgggggaggggccctcagg

SEQ ID NO: 1071718 - DNA, 20 bp, Homo sapiens
cgggggaggggccctcaggc

SEQ ID NO: 1071719 - DNA, 21 bp, Homo sapiens
cgggggaggggccctcaggcc

SEQ ID NO: 1071720 - DNA, 16 bp, Homo sapiens
cgggggcacgtgtggg

SEQ ID NO: 1071721 - DNA, 21 bp, Homo sapiens
cgggggcacgtgtgggccgtg

SEQ ID NO: 1071722 - DNA, 22 bp, Homo sapiens
cgggggcatctgagtccagctc

SEQ ID NO: 1071723 - DNA, 16 bp, Homo sapiens
cgggggcggaggagga

SEQ ID NO: 1071724 - DNA, 20 bp, Homo sapiens
cgggggctcttcccctagac

SEQ ID NO: 1071725 - DNA, 16 bp, Homo sapiens
cgggggctgaggggca

SEQ ID NO: 1071726 - DNA, 15 bp, Homo sapiens
cgggggctggcctag

SEQ ID NO: 1071727 - DNA, 11 bp, Homo sapiens
cggggggaggg

SEQ ID NO: 1071728 - DNA, 12 bp, Homo sapiens
cggggggctggg

SEQ ID NO: 1071729 - DNA, 19 bp, Homo sapiens
cggggggggtaggagagga

SEQ ID NO: 1071730 - DNA, 11 bp, Homo sapiens
cggggggtgga

SEQ ID NO: 1071731 - DNA, 17 bp, Homo sapiens
cgggggtgctggggcca

SEQ ID NO: 1071732 - DNA, 23 bp, Homo sapiens
cgggggtgctggggccagggcag

SEQ ID NO: 1071733 - DNA, 15 bp, Homo sapiens
cgggggtggctctgt

SEQ ID NO: 1071734 - DNA, 16 bp, Homo sapiens
cgggggtggctctgtc

SEQ ID NO: 1071735 - DNA, 14 bp, Homo sapiens
cgggggtgggaggt

SEQ ID NO: 1071736 - DNA, 15 bp, Homo sapiens
cggggtaaaaagtgg

SEQ ID NO: 1071737 - DNA, 18 bp, Homo sapiens
cggggtaaaaagtggctg

SEQ ID NO: 1071738 - DNA, 19 bp, Homo sapiens
cggggtccaccagtgtgtg

SEQ ID NO: 1071739 - DNA, 18 bp, Homo sapiens
cggggtccaggcccgtgg

SEQ ID NO: 1071740 - DNA, 18 bp, Homo sapiens
cggggtcccctctgtgct

SEQ ID NO: 1071741 - DNA, 13 bp, Homo sapiens
cggggtctgtgct

SEQ ID NO: 1071742 - DNA, 15 bp, Homo sapiens
cggggtggggagggt

SEQ ID NO: 1071743 - DNA, 17 bp, Homo sapiens
cggggtggggtgcactc

SEQ ID NO: 1071744 - DNA, 18 bp, Homo sapiens
cggggtgtaacttcctgc

SEQ ID NO: 1071745 - DNA, 19 bp, Homo sapiens
cggggtgtaacttcctgct

SEQ ID NO: 1071746 - DNA, 20 bp, Homo sapiens
cggggtgtaacttcctgctg

SEQ ID NO: 1071747 - DNA, 18 bp, Homo sapiens
cggggttagagccaagct

SEQ ID NO: 1071748 - DNA, 20 bp, Homo sapiens
cggggttccccacacagggc

SEQ ID NO: 1071749 - DNA, 13 bp, Homo sapiens
cggggttccctcc

SEQ ID NO: 1071750 - DNA, 21 bp, Homo sapiens
cggggttggctgttccagact

SEQ ID NO: 1071751 - DNA, 15 bp, Homo sapiens
cggggttggggtggg

SEQ ID NO: 1071752 - DNA, 19 bp, Homo sapiens
cggggttggggtgggaggg

SEQ ID NO: 1071753 - DNA, 20 bp, Homo sapiens
cggggttggggtgggagggc

SEQ ID NO: 1071754 - DNA, 21 bp, Homo sapiens
cggggttggggtgggagggcg

SEQ ID NO: 1071755 - DNA, 12 bp, Homo sapiens
cgggtcactgct

SEQ ID NO: 1071756 - DNA, 14 bp, Homo sapiens
cgggtcctcagctg

SEQ ID NO: 1071757 - DNA, 13 bp, Homo sapiens
cgggtctccctcc

SEQ ID NO: 1071758 - DNA, 19 bp, Homo sapiens
cgggtctcctcccagcggc

SEQ ID NO: 1071759 - DNA, 21 bp, Homo sapiens
cgggtctcctcccagcggcct

SEQ ID NO: 1071760 - DNA, 13 bp, Homo sapiens
cgggtctccttgg

SEQ ID NO: 1071761 - DNA, 20 bp, Homo sapiens
cgggtctccttggctgtctg

SEQ ID NO: 1071762 - DNA, 13 bp, Homo sapiens
cgggtctgagact

SEQ ID NO: 1071763 - DNA, 18 bp, Homo sapiens
cgggtgacgtgtgttctt

SEQ ID NO: 1071764 - DNA, 22 bp, Homo sapiens
cgggtgcatttgagagaagcca

SEQ ID NO: 1071765 - DNA, 23 bp, Homo sapiens
cgggtgctggaagtctccatgaa

SEQ ID NO: 1071766 - DNA, 18 bp, Homo sapiens
cgggtggctagtcagaga

SEQ ID NO: 1071767 - DNA, 14 bp, Homo sapiens
cgggtgggcctggc

SEQ ID NO: 1071768 - DNA, 15 bp, Homo sapiens
cgggtgggcctggcc

SEQ ID NO: 1071769 - DNA, 20 bp, Homo sapiens
cgggtgggcctggcctgagc

SEQ ID NO: 1071770 - DNA, 14 bp, Homo sapiens
cgggtggggaaagg

SEQ ID NO: 1071771 - DNA, 19 bp, Homo sapiens
cgggtgtgcctgccctgga

SEQ ID NO: 1071772 - DNA, 16 bp, Homo sapiens
cgggtgtggcctcagc

SEQ ID NO: 1071773 - DNA, 18 bp, Homo sapiens
cgggtgtggcctcagccc

SEQ ID NO: 1071774 - DNA, 12 bp, Homo sapiens
cgggttctagac

SEQ ID NO: 1071775 - DNA, 19 bp, Homo sapiens
cgggtttggcgggccaagg

SEQ ID NO: 1071776 - DNA, 17 bp, Homo sapiens
cggtaactgtcctgtcc

SEQ ID NO: 1071777 - DNA, 18 bp, Homo sapiens
cggtaactgtcctgtcct

SEQ ID NO: 1071778 - DNA, 15 bp, Homo sapiens
cggtaagtgttctca

SEQ ID NO: 1071779 - DNA, 20 bp, Homo sapiens
cggtaagtgttctcatgaag

SEQ ID NO: 1071780 - DNA, 12 bp, Homo sapiens
cggtactcccat

SEQ ID NO: 1071781 - DNA, 21 bp, Homo sapiens
cggtagccagcacacagggca

SEQ ID NO: 1071782 - DNA, 22 bp, Homo sapiens
cggtagccagcacacagggcag

SEQ ID NO: 1071783 - DNA, 18 bp, Homo sapiens
cggtaggtcatgtctgta

SEQ ID NO: 1071784 - DNA, 18 bp, Homo sapiens
cggtaggttcagccaagg

SEQ ID NO: 1071785 - DNA, 22 bp, Homo sapiens
cggtatccccccatcttgcttc

SEQ ID NO: 1071786 - DNA, 17 bp, Homo sapiens
cggtatcctccctgccc

SEQ ID NO: 1071787 - DNA, 18 bp, Homo sapiens
cggtatcctccctgccca

SEQ ID NO: 1071788 - DNA, 15 bp, Homo sapiens
cggtcagaacaactt

SEQ ID NO: 1071789 - DNA, 22 bp, Homo sapiens
cggtcagaggagcgcaggcagc

SEQ ID NO: 1071790 - DNA, 20 bp, Homo sapiens
cggtcagatttgctgttcac

SEQ ID NO: 1071791 - DNA, 16 bp, Homo sapiens
cggtcagcccctggca

SEQ ID NO: 1071792 - DNA, 21 bp, Homo sapiens
cggtcaggtttaacatttgcc

SEQ ID NO: 1071793 - DNA, 23 bp, Homo sapiens
cggtcatgcttttgccactttgg

SEQ ID NO: 1071794 - DNA, 18 bp, Homo sapiens
cggtcatgtgtgcatgtg

SEQ ID NO: 1071795 - DNA, 14 bp, Homo sapiens
cggtcatttgaatg

SEQ ID NO: 1071796 - DNA, 23 bp, Homo sapiens
cggtccccacagactgccccagc

SEQ ID NO: 1071797 - DNA, 12 bp, Homo sapiens
cggtccccatcc

SEQ ID NO: 1071798 - DNA, 17 bp, Homo sapiens
cggtccccatccccacc

SEQ ID NO: 1071799 - DNA, 18 bp, Homo sapiens
cggtccccatccccacca

SEQ ID NO: 1071800 - DNA, 23 bp, Homo sapiens
cggtccccatccccaccagctcg

SEQ ID NO: 1071801 - DNA, 18 bp, Homo sapiens
cggtcccctgcctggaac

SEQ ID NO: 1071802 - DNA, 16 bp, Homo sapiens
cggtccctgcagaagc

SEQ ID NO: 1071803 - DNA, 14 bp, Homo sapiens
cggtccctgtccct

SEQ ID NO: 1071804 - DNA, 22 bp, Homo sapiens
cggtccggcgccccgcaccccc

SEQ ID NO: 1071805 - DNA, 17 bp, Homo sapiens
cggtcctttaggcagcc

SEQ ID NO: 1071806 - DNA, 19 bp, Homo sapiens
cggtcctttaggcagcctg

SEQ ID NO: 1071807 - DNA, 21 bp, Homo sapiens
cggtctcccaaagtgctggga

SEQ ID NO: 1071808 - DNA, 21 bp, Homo sapiens
cggtgacaaagatggctcaga

SEQ ID NO: 1071809 - DNA, 16 bp, Homo sapiens
cggtgacacaggtcag

SEQ ID NO: 1071810 - DNA, 16 bp, Homo sapiens
cggtgaccactcttct

SEQ ID NO: 1071811 - DNA, 22 bp, Homo sapiens
cggtgaggggaggggcctcccc

SEQ ID NO: 1071812 - DNA, 16 bp, Homo sapiens
cggtgcagtctgggtg

SEQ ID NO: 1071813 - DNA, 20 bp, Homo sapiens
cggtgccaagggccccaggg

SEQ ID NO: 1071814 - DNA, 15 bp, Homo sapiens
cggtgcccaagccag

SEQ ID NO: 1071815 - DNA, 14 bp, Homo sapiens
cggtgccgcgctcc

SEQ ID NO: 1071816 - DNA, 21 bp, Homo sapiens
cggtgcctgggtggccatcct

SEQ ID NO: 1071817 - DNA, 17 bp, Homo sapiens
cggtgcgtggctgtggc

SEQ ID NO: 1071818 - DNA, 19 bp, Homo sapiens
cggtgcgtggctgtggcac

SEQ ID NO: 1071819 - DNA, 20 bp, Homo sapiens
cggtgcgtggctgtggcaca

SEQ ID NO: 1071820 - DNA, 22 bp, Homo sapiens
cggtgctatatccagttcctgc

SEQ ID NO: 1071821 - DNA, 15 bp, Homo sapiens
cgctgcccaggggct

SEQ ID NO: 1071822 - DNA, 13 bp, Homo sapiens
cgctgccctgcat

SEQ ID NO: 1071823 - DNA, 13 bp, Homo sapiens
cgctgccctttgg

SEQ ID NO: 1071824 - DNA, 14 bp, Homo sapiens
cgctgccctttggc

SEQ ID NO: 1071825 - DNA, 16 bp, Homo sapiens
cgctgccgctgcacca

SEQ ID NO: 1071826 - DNA, 18 bp, Homo sapiens
cgctgccgctgccgctgc

SEQ ID NO: 1071827 - DNA, 20 bp, Homo sapiens
cgctgcctcttggcttctca

SEQ ID NO: 1071828 - DNA, 22 bp, Homo sapiens
cgctgcctcttggcttctcagc

SEQ ID NO: 1071829 - DNA, 20 bp, Homo sapiens
cgctgcctgccaaagtagtc

SEQ ID NO: 1071830 - DNA, 22 bp, Homo sapiens
cgctgcctggtctgtctggatc

SEQ ID NO: 1071831 - DNA, 22 bp, Homo sapiens
cgctgccttttgtttctagaat

SEQ ID NO: 1071832 - DNA, 19 bp, Homo sapiens
cgctgcggacaccgtggcc

SEQ ID NO: 1071833 - DNA, 23 bp, Homo sapiens
cgctgctacatcagactctagaa

SEQ ID NO: 1071834 - DNA, 18 bp, Homo sapiens
cgctgctctagctggcag

SEQ ID NO: 1071835 - DNA, 20 bp, Homo sapiens
cgctgctctagctggcagga

SEQ ID NO: 1071836 - DNA, 11 bp, Homo sapiens
cgctgctgcta

SEQ ID NO: 1071837 - DNA, 15 bp, Homo sapiens
cgctgctgctgctgc

SEQ ID NO: 1071838 - DNA, 20 bp, Homo sapiens
cgctgctgctgctgcgccct

SEQ ID NO: 1071839 - DNA, 14 bp, Homo sapiens
cgctgctgtgctct

SEQ ID NO: 1071840 - DNA, 14 bp, Homo sapiens
cgctgcttccagga

SEQ ID NO: 1071841 - DNA, 17 bp, Homo sapiens
cgctgcttccaggctgg

SEQ ID NO: 1071842 - DNA, 14 bp, Homo sapiens
cgctggagagtcaa

SEQ ID NO: 1071843 - DNA, 14 bp, Homo sapiens
cgctggagcccaca

SEQ ID NO: 1071844 - DNA, 16 bp, Homo sapiens
cgctggagcccacagc

SEQ ID NO: 1071845 - DNA, 11 bp, Homo sapiens
cgctggcccag

SEQ ID NO: 1071846 - DNA, 16 bp, Homo sapiens
cgctggcccagccggc

SEQ ID NO: 1071847 - DNA, 23 bp, Homo sapiens
cgctggcgacacactccgtccat

SEQ ID NO: 1071848 - DNA, 12 bp, Homo sapiens
cgctgggaaggg

SEQ ID NO: 1071849 - DNA, 21 bp, Homo sapiens
cgctgggatttcttcgctgct

SEQ ID NO: 1071850 - DNA, 15 bp, Homo sapiens
cgctgggctgagccc

SEQ ID NO: 1071851 - DNA, 14 bp, Homo sapiens
cgctgggtgcctgc

SEQ ID NO: 1071852 - DNA, 19 bp, Homo sapiens
cgctgtcaaggccgagggc

SEQ ID NO: 1071853 - DNA, 13 bp, Homo sapiens
cgctgtcccaggc

SEQ ID NO: 1071854 - DNA, 16 bp, Homo sapiens
cgctgtcccaggcatg

SEQ ID NO: 1071855 - DNA, 22 bp, Homo sapiens
cgctgtcccaggcatgcagctg

SEQ ID NO: 1071856 - DNA, 16 bp, Homo sapiens
cgctgtcctctcgagc

SEQ ID NO: 1071857 - DNA, 23 bp, Homo sapiens
cgctgtcctctcgagcccagatg

SEQ ID NO: 1071858 - DNA, 16 bp, Homo sapiens
cgctgtctccagaccc

SEQ ID NO: 1071859 - DNA, 22 bp, Homo sapiens
cgctgtctccagacccccaccc

SEQ ID NO: 1071860 - DNA, 15 bp, Homo sapiens
cgctgtgatgctgtg

SEQ ID NO: 1071861 - DNA, 15 bp, Homo sapiens
cgctgtgccacaggc

SEQ ID NO: 1071862 - DNA, 15 bp, Homo sapiens
cgcttaatccaatat

SEQ ID NO: 1071863 - DNA, 12 bp, Homo sapiens
cgcttagcctgc

SEQ ID NO: 1071864 - DNA, 15 bp, Homo sapiens
cgcttagcctgcctc

SEQ ID NO: 1071865 - DNA, 18 bp, Homo sapiens
cggtgctcggagaagagc

SEQ ID NO: 1071866 - DNA, 11 bp, Homo sapiens
cggtgctctgg

SEQ ID NO: 1071867 - DNA, 13 bp, Homo sapiens
cggtgctctggcg

SEQ ID NO: 1071868 - DNA, 14 bp, Homo sapiens
cggtgctgcaggag

SEQ ID NO: 1071869 - DNA, 15 bp, Homo sapiens
cggtgctgcaggagt

SEQ ID NO: 1071870 - DNA, 18 bp, Homo sapiens
cggtgctgggggcacagc

SEQ ID NO: 1071871 - DNA, 16 bp, Homo sapiens
cggtggacccagacac

SEQ ID NO: 1071872 - DNA, 12 bp, Homo sapiens
cggtggaggaag

SEQ ID NO: 1071873 - DNA, 15 bp, Homo sapiens
cggtggaggccaggg

SEQ ID NO: 1071874 - DNA, 19 bp, Homo sapiens
cggtggccacagcgtgctg

SEQ ID NO: 1071875 - DNA, 13 bp, Homo sapiens
cggtggctgcccc

SEQ ID NO: 1071876 - DNA, 16 bp, Homo sapiens
cggtggctgccccggc

SEQ ID NO: 1071877 - DNA, 13 bp, Homo sapiens
cggtggctgcctt

SEQ ID NO: 1071878 - DNA, 20 bp, Homo sapiens
cggtgggaaggaaaggcaga

SEQ ID NO: 1071879 - DNA, 14 bp, Homo sapiens
cggtgggccagagc

SEQ ID NO: 1071880 - DNA, 15 bp, Homo sapiens
cggtgggccagagct

SEQ ID NO: 1071881 - DNA, 16 bp, Homo sapiens
cggtggtttgccatgt

SEQ ID NO: 1071882 - DNA, 21 bp, Homo sapiens
cggtggtttgccatgtcgctt

SEQ ID NO: 1071883 - DNA, 16 bp, Homo sapiens
cggtggtttgtaattc

SEQ ID NO: 1071884 - DNA, 15 bp, Homo sapiens
cggtgtatcctggcc

SEQ ID NO: 1071885 - DNA, 13 bp, Homo sapiens
cggtgtcaggtcc

SEQ ID NO: 1071886 - DNA, 15 bp, Homo sapiens
cggtgtccaccatcc

SEQ ID NO: 1071887 - DNA, 20 bp, Homo sapiens
cggtgtccaccatccccagc

SEQ ID NO: 1071888 - DNA, 21 bp, Homo sapiens
cggtgtccatttatagaataa

SEQ ID NO: 1071889 - DNA, 13 bp, Homo sapiens
cggtgtccctgga

SEQ ID NO: 1071890 - DNA, 15 bp, Homo sapiens
cggtgtgcctgcagc

SEQ ID NO: 1071891 - DNA, 14 bp, Homo sapiens
cgtgcactgacagc

SEQ ID NO: 1071892 - DNA, 17 bp, Homo sapiens
cgtgcactgacagcctt

SEQ ID NO: 1071893 - DNA, 13 bp, Homo sapiens
cgtgcagagctgg

SEQ ID NO: 1071894 - DNA, 16 bp, Homo sapiens
cgtgcaggacagctct

SEQ ID NO: 1071895 - DNA, 18 bp, Homo sapiens
cgtgcaggacagctcttg

SEQ ID NO: 1071896 - DNA, 14 bp, Homo sapiens
cgtgcataccactt

SEQ ID NO: 1071897 - DNA, 19 bp, Homo sapiens
cgtgcataccacttttgtt

SEQ ID NO: 1071898 - DNA, 23 bp, Homo sapiens
cgtgcataccacttttgttcttg

SEQ ID NO: 1071899 - DNA, 17 bp, Homo sapiens
cgtgcatccttgtaata

SEQ ID NO: 1071900 - DNA, 23 bp, Homo sapiens
cgtgcatttaaactctgccagaa

SEQ ID NO: 1071901 - DNA, 14 bp, Homo sapiens
cgtgccaaccccac

SEQ ID NO: 1071902 - DNA, 19 bp, Homo sapiens
cgtgccaccccgagggctg

SEQ ID NO: 1071903 - DNA, 19 bp, Homo sapiens
cgtgccagatataactgtc

SEQ ID NO: 1071904 - DNA, 17 bp, Homo sapiens
cgtgccagcagcctcgc

SEQ ID NO: 1071905 - DNA, 18 bp, Homo sapiens
cgtgccagcagcctcgca

SEQ ID NO: 1071906 - DNA, 13 bp, Homo sapiens
cgtgccaggcccg

SEQ ID NO: 1071907 - DNA, 21 bp, Homo sapiens
cgtgccagtcaagaagaaaaa

SEQ ID NO: 1071908 - DNA, 22 bp, Homo sapiens
cgtgccattgtactccagcctg

SEQ ID NO: 1071909 - DNA, 24 bp, Homo sapiens
cgtgccattgtactccagcctggg

SEQ ID NO: 1071910 - DNA, 20 bp, Homo sapiens
cgtgcccaggcccttggctg

SEQ ID NO: 1071911 - DNA, 14 bp, Homo sapiens
cgtgcccccctcct

SEQ ID NO: 1071912 - DNA, 17 bp, Homo sapiens
cgtgcccccctcctcca

SEQ ID NO: 1071913 - DNA, 19 bp, Homo sapiens
cgtgcccccctcctccagt

SEQ ID NO: 1071914 - DNA, 19 bp, Homo sapiens
cgtgcccctttccttcact

SEQ ID NO: 1071915 - DNA, 21 bp, Homo sapiens
cgtgccgggagaggactctgc

SEQ ID NO: 1071916 - DNA, 19 bp, Homo sapiens
cgtgccgttactctccaac

SEQ ID NO: 1071917 - DNA, 17 bp, Homo sapiens
cgtgcctccaccaccac

SEQ ID NO: 1071918 - DNA, 22 bp, Homo sapiens
cgtgcctccaccaccactggcc

SEQ ID NO: 1071919 - DNA, 23 bp, Homo sapiens
cgtgcctccttccacctccctcc

SEQ ID NO: 1071920 - DNA, 13 bp, Homo sapiens
cgtgcctggccag

SEQ ID NO: 1071921 - DNA, 14 bp, Homo sapiens
cgtgcctggccaga

SEQ ID NO: 1071922 - DNA, 16 bp, Homo sapiens
cgtgcctgggcccctc

SEQ ID NO: 1071923 - DNA, 15 bp, Homo sapiens
cgtgcctgtagtgcc

SEQ ID NO: 1071924 - DNA, 15 bp, Homo sapiens
cgtgcctgtgtccat

SEQ ID NO: 1071925 - DNA, 18 bp, Homo sapiens
cgtgccttcagctctaca

SEQ ID NO: 1071926 - DNA, 16 bp, Homo sapiens
cgtgccttttgcaccc

SEQ ID NO: 1071927 - DNA, 21 bp, Homo sapiens
cgtgccttttgcacccctccc

SEQ ID NO: 1071928 - DNA, 21 bp, Homo sapiens
cgtgcgcccgtggggtctgcg

SEQ ID NO: 1071929 - DNA, 15 bp, Homo sapiens
cgtgctgacagctgc

SEQ ID NO: 1071930 - DNA, 16 bp, Homo sapiens
cgtgctgacagctgct

SEQ ID NO: 1071931 - DNA, 17 bp, Homo sapiens
cgtgctgacagctgctc

SEQ ID NO: 1071932 - DNA, 21 bp, Homo sapiens
cgtgctgagaggcgagctcct

SEQ ID NO: 1071933 - DNA, 15 bp, Homo sapiens
cgtgctggcgacact

SEQ ID NO: 1071934 - DNA, 15 bp, Homo sapiens
cgtgctgggcggctg

SEQ ID NO: 1071935 - DNA, 15 bp, Homo sapiens
cgtgctgtgggcctc

SEQ ID NO: 1071936 - DNA, 19 bp, Homo sapiens
cgtgctgtgggcctcaggc

SEQ ID NO: 1071937 - DNA, 12 bp, Homo sapiens
cgtggaaacaca

SEQ ID NO: 1071938 - DNA, 18 bp, Homo sapiens
cgtggaacctctgtctca

SEQ ID NO: 1071939 - DNA, 14 bp, Homo sapiens
cgtggaagggggag

SEQ ID NO: 1071940 - DNA, 19 bp, Homo sapiens
cgtggacaccccagacctg

SEQ ID NO: 1071941 - DNA, 18 bp, Homo sapiens
cgtggaccacctagtctg

SEQ ID NO: 1071942 - DNA, 16 bp, Homo sapiens
cgtggactcctcttgg

SEQ ID NO: 1071943 - DNA, 15 bp, Homo sapiens
cgtggactgagtggg

SEQ ID NO: 1071944 - DNA, 14 bp, Homo sapiens
cgtggactgcagtc

SEQ ID NO: 1071945 - DNA, 21 bp, Homo sapiens
cgtggagatagtgccaggtgg

SEQ ID NO: 1071946 - DNA, 23 bp, Homo sapiens
cgtggagatagtgccaggtggct

SEQ ID NO: 1071947 - DNA, 22 bp, Homo sapiens
cgtggagccattgaacagctgt

SEQ ID NO: 1071948 - DNA, 20 bp, Homo sapiens
cgtggagcggggtatgaaga

SEQ ID NO: 1071949 - DNA, 21 bp, Homo sapiens
cgtggagcggggtatgaagag

SEQ ID NO: 1071950 - DNA, 12 bp, Homo sapiens
cgtggaggagag

SEQ ID NO: 1071951 - DNA, 20 bp, Homo sapiens
cgtggaggaggagggaggcc

SEQ ID NO: 1071952 - DNA, 19 bp, Homo sapiens
cgtggaggaggttgggagg

SEQ ID NO: 1071953 - DNA, 15 bp, Homo sapiens
cgtggatcgagtgta

SEQ ID NO: 1071954 - DNA, 18 bp, Homo sapiens
cgtggatgcgcagtgcct

SEQ ID NO: 1071955 - DNA, 20 bp, Homo sapiens
cgtggcacagctgggagcct

SEQ ID NO: 1071956 - DNA, 16 bp, Homo sapiens
cgtggcatcttaaaag

SEQ ID NO: 1071957 - DNA, 19 bp, Homo sapiens
cgtggcatgtggcctgtgg

SEQ ID NO: 1071958 - DNA, 20 bp, Homo sapiens
cgtggcatgtggcctgtggc

SEQ ID NO: 1071959 - DNA, 21 bp, Homo sapiens
cgtggcatgtggcctgtggcc

SEQ ID NO: 1071960 - DNA, 13 bp, Homo sapiens
cgtggccagcccg

SEQ ID NO: 1071961 - DNA, 19 bp, Homo sapiens
cgtggccagcccggctggt

SEQ ID NO: 1071962 - DNA, 11 bp, Homo sapiens
cgtggcccagg

SEQ ID NO: 1071963 - DNA, 16 bp, Homo sapiens
cgtggcccgtggcctg

SEQ ID NO: 1071964 - DNA, 19 bp, Homo sapiens
cgtggcctccgcagtgtct

SEQ ID NO: 1071965 - DNA, 15 bp, Homo sapiens
cgtggcctcttgagc

SEQ ID NO: 1071966 - DNA, 23 bp, Homo sapiens
cgtggcctcttgagcagtggctg

SEQ ID NO: 1071967 - DNA, 17 bp, Homo sapiens
cgtggcctggcatctgt

SEQ ID NO: 1071968 - DNA, 21 bp, Homo sapiens
cgtggcctggcatctgtgtgc

SEQ ID NO: 1071969 - DNA, 21 bp, Homo sapiens
cgtggccttccccttttgcct

SEQ ID NO: 1071970 - DNA, 17 bp, Homo sapiens
cgtggccttgggaggac

SEQ ID NO: 1071971 - DNA, 15 bp, Homo sapiens
cgtggcgtggcccgt

SEQ ID NO: 1071972 - DNA, 20 bp, Homo sapiens
cgtggctccaccttgatggg

SEQ ID NO: 1071973 - DNA, 15 bp, Homo sapiens
cgtggctctgctggc

SEQ ID NO: 1071974 - DNA, 15 bp, Homo sapiens
cgtggctctgggaga

SEQ ID NO: 1071975 - DNA, 22 bp, Homo sapiens
cgtggctctgggagagccagct

SEQ ID NO: 1071976 - DNA, 17 bp, Homo sapiens
cgtggctgtggcacaga

SEQ ID NO: 1071977 - DNA, 19 bp, Homo sapiens
cgtggcttcccgctcagcc

SEQ ID NO: 1071978 - DNA, 13 bp, Homo sapiens
cgtgggaggctga

SEQ ID NO: 1071979 - DNA, 17 bp, Homo sapiens
cgtgggcagtgccaccc

SEQ ID NO: 1071980 - DNA, 18 bp, Homo sapiens
cgtgggccagtccccgag

SEQ ID NO: 1071981 - DNA, 14 bp, Homo sapiens
cgtgggccctgcag

SEQ ID NO: 1071982 - DNA, 18 bp, Homo sapiens
cgtgggccctgcaggctg

SEQ ID NO: 1071983 - DNA, 21 bp, Homo sapiens
cgtgggcgcaaaggtgcctca

SEQ ID NO: 1071984 - DNA, 22 bp, Homo sapiens
cgtgggcgcaaaggtgcctcat

SEQ ID NO: 1071985 - DNA, 13 bp, Homo sapiens
cgtgggctccctg

SEQ ID NO: 1071986 - DNA, 19 bp, Homo sapiens
cgtgggcttgtgctcggga

SEQ ID NO: 1071987 - DNA, 11 bp, Homo sapiens
cgtggggaggt

SEQ ID NO: 1071988 - DNA, 20 bp, Homo sapiens
cgtgggggaactgacgctgg

SEQ ID NO: 1071989 - DNA, 21 bp, Homo sapiens
cgtgggggaactgacgctgga

SEQ ID NO: 1071990 - DNA, 17 bp, Homo sapiens
cgtgggtctctggggac

SEQ ID NO: 1071991 - DNA, 15 bp, Homo sapiens
cgtggtagaagccag

SEQ ID NO: 1071992 - DNA, 15 bp, Homo sapiens
cgtggtatgtctgcc

SEQ ID NO: 1071993 - DNA, 14 bp, Homo sapiens
cgtggtcaccttcg

SEQ ID NO: 1071994 - DNA, 19 bp, Homo sapiens
cgtggtccaaccaggagct

SEQ ID NO: 1071995 - DNA, 16 bp, Homo sapiens
cgtggtccctgaggat

SEQ ID NO: 1071996 - DNA, 19 bp, Homo sapiens
cgtggtggctcatgcctgt

SEQ ID NO: 1071997 - DNA, 15 bp, Homo sapiens
cgtggtgtggcccgt

SEQ ID NO: 1071998 - DNA, 21 bp, Homo sapiens
cgtggtgtggcccgtggcctg

SEQ ID NO: 1071999 - DNA, 22 bp, Homo sapiens
cgtggtgtggcccgtggcctgg

SEQ ID NO: 1072000 - DNA, 14 bp, Homo sapiens
cgtggttccaagaa

SEQ ID NO: 1072001 - DNA, 14 bp, Homo sapiens
cgtggttcttaaat

SEQ ID NO: 1072002 - DNA, 19 bp, Homo sapiens
cgtggtttgcctgaggctg

SEQ ID NO: 1072003 - DNA, 12 bp, Homo sapiens
cgtgtaaaccaa

SEQ ID NO: 1072004 - DNA, 19 bp, Homo sapiens
cgtgtaaattgcacagagc

SEQ ID NO: 1072005 - DNA, 16 bp, Homo sapiens
cgtgtatagtatctgt

SEQ ID NO: 1072006 - DNA, 22 bp, Homo sapiens
cgtgtatagtgcctaaaattgt

SEQ ID NO: 1072007 - DNA, 23 bp, Homo sapiens
cgtgtatagtgcctaaaattgta

SEQ ID NO: 1072008 - DNA, 14 bp, Homo sapiens
cgtgtatcctgggg

SEQ ID NO: 1072009 - DNA, 17 bp, Homo sapiens
cgtgtatgtttcttctt

SEQ ID NO: 1072010 - DNA, 17 bp, Homo sapiens
cgtgtattgagatttct

SEQ ID NO: 1072011 - DNA, 13 bp, Homo sapiens
cgtgtcagtaatt

SEQ ID NO: 1072012 - DNA, 14 bp, Homo sapiens
cgtgtcccaaggag

SEQ ID NO: 1072013 - DNA, 19 bp, Homo sapiens
cgtgtccgtccacccttcc

SEQ ID NO: 1072014 - DNA, 12 bp, Homo sapiens
cgtgtcctctcc

SEQ ID NO: 1072015 - DNA, 16 bp, Homo sapiens
cgtgtcctctccccca

SEQ ID NO: 1072016 - DNA, 21 bp, Homo sapiens
cgtgtctataatggaaacatt

SEQ ID NO: 1072017 - DNA, 22 bp, Homo sapiens
cgtgtctgtatttatgtgtgag

SEQ ID NO: 1072018 - DNA, 14 bp, Homo sapiens
cgtgtgaatgtagc

SEQ ID NO: 1072019 - DNA, 21 bp, Homo sapiens
cgtgtgaatgtagcttccacc

SEQ ID NO: 1072020 - DNA, 17 bp, Homo sapiens
cgtgtgagtgtgacagg

SEQ ID NO: 1072021 - DNA, 18 bp, Homo sapiens
cgtgtgcatagcgtcctg

SEQ ID NO: 1072022 - DNA, 20 bp, Homo sapiens
cgtgtgcatagcgtcctgcc

SEQ ID NO: 1072023 - DNA, 24 bp, Homo sapiens
cgtgtgcatagcgtcctgccctgc

SEQ ID NO: 1072024 - DNA, 13 bp, Homo sapiens
cgtgtgccaggca

SEQ ID NO: 1072025 - DNA, 13 bp, Homo sapiens
cgtgtgctgctgc

SEQ ID NO: 1072026 - DNA, 14 bp, Homo sapiens
cgtgtgctgctgct

SEQ ID NO: 1072027 - DNA, 13 bp, Homo sapiens
cgtgtggcagcca

SEQ ID NO: 1072028 - DNA, 16 bp, Homo sapiens
cgtgtggcgtggcccg

SEQ ID NO: 1072029 - DNA, 17 bp, Homo sapiens
cgtgtggcgtggcccgt

SEQ ID NO: 1072030 - DNA, 23 bp, Homo sapiens
cgtgtgggccgtggcttgggctg

SEQ ID NO: 1072031 - DNA, 21 bp, Homo sapiens
cgtgtgggtcccgcactctgc

SEQ ID NO: 1072032 - DNA, 21 bp, Homo sapiens
cgtgtggtaccttcagccctg

SEQ ID NO: 1072033 - DNA, 23 bp, Homo sapiens
cgtgtggtaccttcagccctggc

SEQ ID NO: 1072034 - DNA, 14 bp, Homo sapiens
cgtgtgtatttcta

SEQ ID NO: 1072035 - DNA, 21 bp, Homo sapiens
cgtgtgtccaggctctgggca

SEQ ID NO: 1072036 - DNA, 18 bp, Homo sapiens
cgtgtgtcccagatgctg

SEQ ID NO: 1072037 - DNA, 13 bp, Homo sapiens
cgtgtgtgacact

SEQ ID NO: 1072038 - DNA, 13 bp, Homo sapiens
cgtgttcagcaga

SEQ ID NO: 1072039 - DNA, 20 bp, Homo sapiens
cgtgttcagcagaacctgca

SEQ ID NO: 1072040 - DNA, 20 bp, Homo sapiens
cgtgttcccctcttgtctcc

SEQ ID NO: 1072041 - DNA, 16 bp, Homo sapiens
cgtgttctccttttcc

SEQ ID NO: 1072042 - DNA, 15 bp, Homo sapiens
cgtgttgtatctaca

SEQ ID NO: 1072043 - DNA, 20 bp, Homo sapiens
cgtgtttctgactctgagct

SEQ ID NO: 1072044 - DNA, 12 bp, Homo sapiens
cgtgtttgctta

SEQ ID NO: 1072045 - DNA, 13 bp, Homo sapiens
cgtgtttgcttaa

SEQ ID NO: 1072046 - DNA, 16 bp, Homo sapiens
cgtgtttgcttaaaat

SEQ ID NO: 1072047 - DNA, 13 bp, Homo sapiens
cgttaaaatacca

SEQ ID NO: 1072048 - DNA, 17 bp, Homo sapiens
cgttaactgtgtatgta

SEQ ID NO: 1072049 - DNA, 23 bp, Homo sapiens
cgttactcagggctcctcccagc

SEQ ID NO: 1072050 - DNA, 13 bp, Homo sapiens
cgttagctcctgt

SEQ ID NO: 1072051 - DNA, 14 bp, Homo sapiens
cgttaggcatttcc

SEQ ID NO: 1072052 - DNA, 20 bp, Homo sapiens
cgttaggcatttcctgctga

SEQ ID NO: 1072053 - DNA, 11 bp, Homo sapiens
cgttatattaa

SEQ ID NO: 1072054 - DNA, 16 bp, Homo sapiens
cgttcaagaggcgtgt

SEQ ID NO: 1072055 - DNA, 18 bp, Homo sapiens
cgttcaagaggcgtgtgc

SEQ ID NO: 1072056 - DNA, 16 bp, Homo sapiens
cgttcacctccctgct

SEQ ID NO: 1072057 - DNA, 17 bp, Homo sapiens
cgttcacctccctgctc

SEQ ID NO: 1072058 - DNA, 13 bp, Homo sapiens
cgttcagggaggg

SEQ ID NO: 1072059 - DNA, 15 bp, Homo sapiens
cgttcagggaggggc

SEQ ID NO: 1072060 - DNA, 17 bp, Homo sapiens
cgttcagggaggggccg

SEQ ID NO: 1072061 - DNA, 21 bp, Homo sapiens
cgttcatatgctctgctttta

SEQ ID NO: 1072062 - DNA, 21 bp, Homo sapiens
cgttccaccccaagagaactc

SEQ ID NO: 1072063 - DNA, 14 bp, Homo sapiens
cgttccccttggct

SEQ ID NO: 1072064 - DNA, 18 bp, Homo sapiens
cgttccccttggcttcct

SEQ ID NO: 1072065 - DNA, 18 bp, Homo sapiens
cgttccctgtcagaggct

SEQ ID NO: 1072066 - DNA, 13 bp, Homo sapiens
cgttcccttctcc

SEQ ID NO: 1072067 - DNA, 17 bp, Homo sapiens
cgttcccttctccccct

SEQ ID NO: 1072068 - DNA, 22 bp, Homo sapiens
cgttccgggcaaatgccagggc

SEQ ID NO: 1072069 - DNA, 20 bp, Homo sapiens
cgttcctattgtcattaaag

SEQ ID NO: 1072070 - DNA, 12 bp, Homo sapiens
cgttcctggcct

SEQ ID NO: 1072071 - DNA, 16 bp, Homo sapiens
cgttcgcctctggccc

SEQ ID NO: 1072072 - DNA, 18 bp, Homo sapiens
cgttctaggtaggaagag

SEQ ID NO: 1072073 - DNA, 12 bp, Homo sapiens
cgttctcaagaa

SEQ ID NO: 1072074 - DNA, 16 bp, Homo sapiens
cgttctcacacccacc

SEQ ID NO: 1072075 - DNA, 18 bp, Homo sapiens
cgttctcacacccaccgt

SEQ ID NO: 1072076 - DNA, 21 bp, Homo sapiens
cgttctcccagcactgcctcc

SEQ ID NO: 1072077 - DNA, 11 bp, Homo sapiens
cgttctcctgc

SEQ ID NO: 1072078 - DNA, 14 bp, Homo sapiens
cgttctccttcccc

SEQ ID NO: 1072079 - DNA, 22 bp, Homo sapiens
cgttctctgccccgtttcttgc

SEQ ID NO: 1072080 - DNA, 12 bp, Homo sapiens
cgttctctgcct

SEQ ID NO: 1072081 - DNA, 22 bp, Homo sapiens
cgttctctgtccccaggtcctg

SEQ ID NO: 1072082 - DNA, 18 bp, Homo sapiens
cgttctctttaaaagctg

SEQ ID NO: 1072083 - DNA, 18 bp, Homo sapiens
cgttcttgtaattttaca

SEQ ID NO: 1072084 - DNA, 22 bp, Homo sapiens
cgttgaaccacgtgaaactgct

SEQ ID NO: 1072085 - DNA, 18 bp, Homo sapiens
cgttgaatctgggaggga

SEQ ID NO: 1072086 - DNA, 20 bp, Homo sapiens
cgttgcttgaaattactgtg

SEQ ID NO: 1072087 - DNA, 22 bp, Homo sapiens
cgttggagagcagcaggtgctg

SEQ ID NO: 1072088 - DNA, 19 bp, Homo sapiens
cgttggatgtctgtgagta

SEQ ID NO: 1072089 - DNA, 15 bp, Homo sapiens
cgttgggagcctagc

SEQ ID NO: 1072090 - DNA, 20 bp, Homo sapiens
cgttgggtttgctcatgtaa

SEQ ID NO: 1072091 - DNA, 15 bp, Homo sapiens
cgttggtccagagcg

SEQ ID NO: 1072092 - DNA, 21 bp, Homo sapiens
cgttgtaaaatatagctgtac

SEQ ID NO: 1072093 - DNA, 12 bp, Homo sapiens
cgttgtgagctg

SEQ ID NO: 1072094 - DNA, 11 bp, Homo sapiens
cgttgttgtca

SEQ ID NO: 1072095 - DNA, 21 bp, Homo sapiens
cgtttaaagtgcagtcatttg

SEQ ID NO: 1072096 - DNA, 18 bp, Homo sapiens
cgtttaagccaaaacaat

SEQ ID NO: 1072097 - DNA, 20 bp, Homo sapiens
cgtttacttatcttatgcca

SEQ ID NO: 1072098 - DNA, 15 bp, Homo sapiens
cgtttattttcaaga

SEQ ID NO: 1072099 - DNA, 22 bp, Homo sapiens
cgtttcatcaggctctgttcct

SEQ ID NO: 1072100 - DNA, 11 bp, Homo sapiens
cgtttccatca

SEQ ID NO: 1072101 - DNA, 11 bp, Homo sapiens
cgtttctggcc

SEQ ID NO: 1072102 - DNA, 15 bp, Homo sapiens
cgtttctgtggagta

SEQ ID NO: 1072103 - DNA, 16 bp, Homo sapiens
cgtttgcaccgcctgc

SEQ ID NO: 1072104 - DNA, 18 bp, Homo sapiens
cgtttgcaccgcctgccc

SEQ ID NO: 1072105 - DNA, 20 bp, Homo sapiens
cgtttgcaccgcctgccctc

SEQ ID NO: 1072106 - DNA, 14 bp, Homo sapiens
cgtttgctgtgcca

SEQ ID NO: 1072107 - DNA, 15 bp, Homo sapiens
cgtttgctgtgccag

SEQ ID NO: 1072108 - DNA, 15 bp, Homo sapiens
cgtttggttaaagta

SEQ ID NO: 1072109 - DNA, 19 bp, Homo sapiens
cgtttggttaaagtatgtc

SEQ ID NO: 1072110 - DNA, 14 bp, Homo sapiens
cgtttgtatgtgtg

SEQ ID NO: 1072111 - DNA, 23 bp, Homo sapiens
cgtttgtgaacgctgtgatgctg

SEQ ID NO: 1072112 - DNA, 16 bp, Homo sapiens
cgtttgtgcatatctg

SEQ ID NO: 1072113 - DNA, 19 bp, Homo sapiens
cgtttgtttgtttgtttaa

SEQ ID NO: 1072114 - DNA, 20 bp, Homo sapiens
cgttttaccaataaactgag

SEQ ID NO: 1072115 - DNA, 17 bp, Homo sapiens
cgttttcatcctggcct

SEQ ID NO: 1072116 - DNA, 14 bp, Homo sapiens
cgttttccaaagag

SEQ ID NO: 1072117 - DNA, 22 bp, Homo sapiens
cgttttcctcatcctttccctc

SEQ ID NO: 1072118 - DNA, 12 bp, Homo sapiens
cgttttcttaca

SEQ ID NO: 1072119 - DNA, 19 bp, Homo sapiens
cgttttcttctttccctgg

SEQ ID NO: 1072120 - DNA, 21 bp, Homo sapiens
cgttttgaagacgtggactcc

SEQ ID NO: 1072121 - DNA, 20 bp, Homo sapiens
cgttttgaagctactgtgtg

SEQ ID NO: 1072122 - DNA, 18 bp, Homo sapiens
cgttttgtattgcttcct

SEQ ID NO: 1072123 - DNA, 21 bp, Homo sapiens
cgtttttatattacttttgta

SEQ ID NO: 1072124 - DNA, 23 bp, Homo sapiens
cgtttttctcgtccccctccctg

SEQ ID NO: 1072125 - DNA, 18 bp, Homo sapiens
cgtttttgtgctgtgggc

SEQ ID NO: 1072126 - DNA, 15 bp, Homo sapiens
cgtttttttggtcac

SEQ ID NO: 1072127 - DNA, 17 bp, Homo sapiens
ctaaaaaaaaaaaggcc

SEQ ID NO: 1072128 - DNA, 22 bp, Homo sapiens
ctaaaaaacataaatttcttta

SEQ ID NO: 1072129 - DNA, 13 bp, Homo sapiens
ctaaaaaagatat

SEQ ID NO: 1072130 - DNA, 20 bp, Homo sapiens
ctaaaaacatttactgacca

SEQ ID NO: 1072131 - DNA, 12 bp, Homo sapiens
ctaaaaagcaac

SEQ ID NO: 1072132 - DNA, 18 bp, Homo sapiens
ctaaaaagtcagatgttt

SEQ ID NO: 1072133 - DNA, 13 bp, Homo sapiens
ctaaaaatccaga

SEQ ID NO: 1072134 - DNA, 23 bp, Homo sapiens
ctaaaaatgagcttgattaaatc

SEQ ID NO: 1072135 - DNA, 13 bp, Homo sapiens
ctaaaaatgcaac

SEQ ID NO: 1072136 - DNA, 19 bp, Homo sapiens
ctaaaaattcccttcctgt

SEQ ID NO: 1072137 - DNA, 22 bp, Homo sapiens
ctaaaaatttttacaaaactgc

SEQ ID NO: 1072138 - DNA, 17 bp, Homo sapiens
ctaaaacattcccctcc

SEQ ID NO: 1072139 - DNA, 19 bp, Homo sapiens
ctaaaacttggatggactt

SEQ ID NO: 1072140 - DNA, 14 bp, Homo sapiens
ctaaaagaaacttt

SEQ ID NO: 1072141 - DNA, 20 bp, Homo sapiens
ctaaaagatcctttttaaat

SEQ ID NO: 1072142 - DNA, 22 bp, Homo sapiens
ctaaaaggaaaaggttgttgtt

SEQ ID NO: 1072143 - DNA, 23 bp, Homo sapiens
ctaaaaggtatgcaatcaaatct

SEQ ID NO: 1072144 - DNA, 14 bp, Homo sapiens
ctaaaagtaaacat

SEQ ID NO: 1072145 - DNA, 19 bp, Homo sapiens
ctaaaagtgcatttaagga

SEQ ID NO: 1072146 - DNA, 14 bp, Homo sapiens
ctaaaagttttcta

SEQ ID NO: 1072147 - DNA, 15 bp, Homo sapiens
ctaaaagttttctaa

SEQ ID NO: 1072148 - DNA, 18 bp, Homo sapiens
ctaaaataattttgtaat

SEQ ID NO: 1072149 - DNA, 11 bp, Homo sapiens
ctaaaatgatt

SEQ ID NO: 1072150 - DNA, 22 bp, Homo sapiens
ctaaaatgcctcagtgtatttg

SEQ ID NO: 1072151 - DNA, 16 bp, Homo sapiens
ctaaaatggacatttt

SEQ ID NO: 1072152 - DNA, 17 bp, Homo sapiens
ctaaaatggacattttc

SEQ ID NO: 1072153 - DNA, 12 bp, Homo sapiens
ctaaaattacta

SEQ ID NO: 1072154 - DNA, 17 bp, Homo sapiens
ctaaaattactattctt

SEQ ID NO: 1072155 - DNA, 17 bp, Homo sapiens
ctaaaattaggactgta

SEQ ID NO: 1072156 - DNA, 18 bp, Homo sapiens
ctaaaattaggactgtat

SEQ ID NO: 1072157 - DNA, 16 bp, Homo sapiens
ctaaaattgtatgaaa

SEQ ID NO: 1072158 - DNA, 17 bp, Homo sapiens
ctaaaattgtatgaaaa

SEQ ID NO: 1072159 - DNA, 14 bp, Homo sapiens
ctaaacaagatttt

SEQ ID NO: 1072160 - DNA, 12 bp, Homo sapiens
ctaaacagatat

SEQ ID NO: 1072161 - DNA, 11 bp, Homo sapiens
ctaaacataat

SEQ ID NO: 1072162 - DNA, 24 bp, Homo sapiens
ctaaacataattgtggattataaa

SEQ ID NO: 1072163 - DNA, 13 bp, Homo sapiens
ctaaacatcattc

SEQ ID NO: 1072164 - DNA, 17 bp, Homo sapiens
ctaaacattttgttatt

SEQ ID NO: 1072165 - DNA, 17 bp, Homo sapiens
ctaaaccaaggactgag

SEQ ID NO: 1072166 - DNA, 17 bp, Homo sapiens
ctaaaccacttctctgc

SEQ ID NO: 1072167 - DNA, 20 bp, Homo sapiens
ctaaaccacttctctgctgc

SEQ ID NO: 1072168 - DNA, 19 bp, Homo sapiens
ctaaacccaatccaaatgg

SEQ ID NO: 1072169 - DNA, 20 bp, Homo sapiens
ctaaacccgcaccccagtgc

SEQ ID NO: 1072170 - DNA, 19 bp, Homo sapiens
ctaaaccttacatgtgtaa

SEQ ID NO: 1072171 - DNA, 16 bp, Homo sapiens
ctaaacggattccaaa

SEQ ID NO: 1072172 - DNA, 17 bp, Homo sapiens
ctaaacggattccaaag

SEQ ID NO: 1072173 - DNA, 16 bp, Homo sapiens
ctaaacgtggtcacct

SEQ ID NO: 1072174 - DNA, 16 bp, Homo sapiens
ctaaactagtttttcc

SEQ ID NO: 1072175 - DNA, 19 bp, Homo sapiens
ctaaactccaggatttata

SEQ ID NO: 1072176 - DNA, 17 bp, Homo sapiens
ctaaactccttcctggc

SEQ ID NO: 1072177 - DNA, 22 bp, Homo sapiens
ctaaactctctttgggaatgtt

SEQ ID NO: 1072178 - DNA, 14 bp, Homo sapiens
ctaaactctggggc

SEQ ID NO: 1072179 - DNA, 17 bp, Homo sapiens
ctaaactctggggcttg

SEQ ID NO: 1072180 - DNA, 19 bp, Homo sapiens
ctaaactgaatctatggct

SEQ ID NO: 1072181 - DNA, 22 bp, Homo sapiens
ctaaactgaatctatggcttta

SEQ ID NO: 1072182 - DNA, 16 bp, Homo sapiens
ctaaactgcaaacaga

SEQ ID NO: 1072183 - DNA, 11 bp, Homo sapiens
ctaaactgcat

SEQ ID NO: 1072184 - DNA, 20 bp, Homo sapiens
ctaaacttggtgcttattga

SEQ ID NO: 1072185 - DNA, 14 bp, Homo sapiens
ctaaactttagact

SEQ ID NO: 1072186 - DNA, 15 bp, Homo sapiens
ctaaactttatttgt

SEQ ID NO: 1072187 - DNA, 22 bp, Homo sapiens
ctaaactttatttgtaaaccat

SEQ ID NO: 1072188 - DNA, 17 bp, Homo sapiens
ctaaactttggcctttg

SEQ ID NO: 1072189 - DNA, 20 bp, Homo sapiens
ctaaagaaaaacaaactcgt

SEQ ID NO: 1072190 - DNA, 14 bp, Homo sapiens
ctaaagaagataaa

SEQ ID NO: 1072191 - DNA, 19 bp, Homo sapiens
ctaaagaagataaacacaa

SEQ ID NO: 1072192 - DNA, 18 bp, Homo sapiens
ctaaagagagaatgtaga

SEQ ID NO: 1072193 - DNA, 19 bp, Homo sapiens
ctaaagagagaatgtagat

SEQ ID NO: 1072194 - DNA, 18 bp, Homo sapiens
ctaaagagcccttgcctc

SEQ ID NO: 1072195 - DNA, 20 bp, Homo sapiens
ctaaagagcccttgcctccc

SEQ ID NO: 1072196 - DNA, 14 bp, Homo sapiens
ctaaagagctgcac

SEQ ID NO: 1072197 - DNA, 21 bp, Homo sapiens
ctaaagcactttgcacttaat

SEQ ID NO: 1072198 - DNA, 11 bp, Homo sapiens
ctaaagcagtg

SEQ ID NO: 1072199 - DNA, 17 bp, Homo sapiens
ctaaagcattttttaaa

SEQ ID NO: 1072200 - DNA, 15 bp, Homo sapiens
ctaaagccaaagttt

SEQ ID NO: 1072201 - DNA, 16 bp, Homo sapiens
ctaaagccaaagtttc

SEQ ID NO: 1072202 - DNA, 23 bp, Homo sapiens
ctaaagccaagcactttatattt

SEQ ID NO: 1072203 - DNA, 16 bp, Homo sapiens
ctaaagctatgttaca

SEQ ID NO: 1072204 - DNA, 14 bp, Homo sapiens
ctaaagctggagag

SEQ ID NO: 1072205 - DNA, 16 bp, Homo sapiens
ctaaaggatccagaga

SEQ ID NO: 1072206 - DNA, 23 bp, Homo sapiens
ctaaaggatccagagagcagctc

SEQ ID NO: 1072207 - DNA, 16 bp, Homo sapiens
ctaaaggcatccttgt

SEQ ID NO: 1072208 - DNA, 17 bp, Homo sapiens
ctaaaggctacctttgt

SEQ ID NO: 1072209 - DNA, 17 bp, Homo sapiens
ctaaagggaccatctgc

SEQ ID NO: 1072210 - DNA, 21 bp, Homo sapiens
ctaaagggaccatctgctgca

SEQ ID NO: 1072211 - DNA, 23 bp, Homo sapiens
ctaaagggaccatctgctgcagt

SEQ ID NO: 1072212 - DNA, 14 bp, Homo sapiens
ctaaagggagaaat

SEQ ID NO: 1072213 - DNA, 17 bp, Homo sapiens
ctaaagggcagggccca

SEQ ID NO: 1072214 - DNA, 18 bp, Homo sapiens
ctaaagggcagggcccac

SEQ ID NO: 1072215 - DNA, 18 bp, Homo sapiens
ctaaaggggagaaactga

SEQ ID NO: 1072216 - DNA, 16 bp, Homo sapiens
ctaaaggtgtatttaa

SEQ ID NO: 1072217 - DNA, 20 bp, Homo sapiens
ctaaaggtgttgtcccttct

SEQ ID NO: 1072218 - DNA, 16 bp, Homo sapiens
ctaaagtatgtaaagt

SEQ ID NO: 1072219 - DNA, 12 bp, Homo sapiens
ctaaagtgctgc

SEQ ID NO: 1072220 - DNA, 9 bp, Homo sapiens
ctaaagtgt

SEQ ID NO: 1072221 - DNA, 20 bp, Homo sapiens
ctaaagtgtattttcagagc

SEQ ID NO: 1072222 - DNA, 22 bp, Homo sapiens
ctaaagtgtatttttttactaa

SEQ ID NO: 1072223 - DNA, 15 bp, Homo sapiens
ctaaagtgtcaaggt

SEQ ID NO: 1072224 - DNA, 14 bp, Homo sapiens
ctaaagtgtttagc

SEQ ID NO: 1072225 - DNA, 13 bp, Homo sapiens
ctaaagttatatt

SEQ ID NO: 1072226 - DNA, 16 bp, Homo sapiens
ctaaagttatatttca

SEQ ID NO: 1072227 - DNA, 17 bp, Homo sapiens
ctaaagttttcttccca

SEQ ID NO: 1072228 - DNA, 15 bp, Homo sapiens
ctaaagttttgcaac

SEQ ID NO: 1072229 - DNA, 14 bp, Homo sapiens
ctaaataaaaatat

SEQ ID NO: 1072230 - DNA, 20 bp, Homo sapiens
ctaaataaacacatagattc

SEQ ID NO: 1072231 - DNA, 15 bp, Homo sapiens
ctaaataaacacgat

SEQ ID NO: 1072232 - DNA, 22 bp, Homo sapiens
ctaaataatgaataaactgaat

SEQ ID NO: 1072233 - DNA, 19 bp, Homo sapiens
ctaaatacctcaatcagtc

SEQ ID NO: 1072234 - DNA, 17 bp, Homo sapiens
ctaaatatatattatgc

SEQ ID NO: 1072235 - DNA, 11 bp, Homo sapiens
ctaaatatatg

SEQ ID NO: 1072236 - DNA, 13 bp, Homo sapiens
ctaaatatccaaa

SEQ ID NO: 1072237 - DNA, 17 bp, Homo sapiens
ctaaatatccaaagact

SEQ ID NO: 1072238 - DNA, 20 bp, Homo sapiens
ctaaatatccaaagactgta

SEQ ID NO: 1072239 - DNA, 21 bp, Homo sapiens
ctaaatatccaaagactgtac

SEQ ID NO: 1072240 - DNA, 23 bp, Homo sapiens
ctaaatattcagaatctttgtta

SEQ ID NO: 1072241 - DNA, 19 bp, Homo sapiens
ctaaatatttaccttgaaa

SEQ ID NO: 1072242 - DNA, 13 bp, Homo sapiens
ctaaatatttcct

SEQ ID NO: 1072243 - DNA, 15 bp, Homo sapiens
ctaaatatttcctta

SEQ ID NO: 1072244 - DNA, 14 bp, Homo sapiens
ctaaatcagagaca

SEQ ID NO: 1072245 - DNA, 15 bp, Homo sapiens
ctaaatcagagacaa

SEQ ID NO: 1072246 - DNA, 18 bp, Homo sapiens
ctaaatccgacttgaata

SEQ ID NO: 1072247 - DNA, 14 bp, Homo sapiens
ctaaatcctcatgt

SEQ ID NO: 1072248 - DNA, 21 bp, Homo sapiens
ctaaatcctttactgttagtc

SEQ ID NO: 1072249 - DNA, 15 bp, Homo sapiens
ctaaatccttttgtt

SEQ ID NO: 1072250 - DNA, 20 bp, Homo sapiens
ctaaatccttttgttttgaa

SEQ ID NO: 1072251 - DNA, 16 bp, Homo sapiens
ctaaatctatttatta

SEQ ID NO: 1072252 - DNA, 21 bp, Homo sapiens
ctaaatctatttattaatatt

SEQ ID NO: 1072253 - DNA, 20 bp, Homo sapiens
ctaaatctccaaaataaaac

SEQ ID NO: 1072254 - DNA, 15 bp, Homo sapiens
ctaaatctctaatat

SEQ ID NO: 1072255 - DNA, 15 bp, Homo sapiens
ctaaatctttttgct

SEQ ID NO: 1072256 - DNA, 12 bp, Homo sapiens
ctaaatgaatgt

SEQ ID NO: 1072257 - DNA, 17 bp, Homo sapiens
ctaaatgcaatttaaaa

SEQ ID NO: 1072258 - DNA, 15 bp, Homo sapiens
ctaaatgctcataca

SEQ ID NO: 1072259 - DNA, 15 bp, Homo sapiens
ctaaatgctgaaaaa

SEQ ID NO: 1072260 - DNA, 16 bp, Homo sapiens
ctaaatggaaccactc

SEQ ID NO: 1072261 - DNA, 12 bp, Homo sapiens
ctaaatggcctc

SEQ ID NO: 1072262 - DNA, 19 bp, Homo sapiens
ctaaatggcctcatgtggc

SEQ ID NO: 1072263 - DNA, 17 bp, Homo sapiens
ctaaatgtttaaagaaa

SEQ ID NO: 1072264 - DNA, 18 bp, Homo sapiens
ctaaattaagacagcatt

SEQ ID NO: 1072265 - DNA, 22 bp, Homo sapiens
ctaaattactgttttatgttga

SEQ ID NO: 1072266 - DNA, 17 bp, Homo sapiens
ctccccctccttgtgcc

SEQ ID NO: 1072267 - DNA, 15 bp, Homo sapiens
ctccccctctgcttc

SEQ ID NO: 1072268 - DNA, 17 bp, Homo sapiens
ctccccctctgcttctc

SEQ ID NO: 1072269 - DNA, 15 bp, Homo sapiens
ctccccctctgtctt

SEQ ID NO: 1072270 - DNA, 14 bp, Homo sapiens
ctccccctgcaact

SEQ ID NO: 1072271 - DNA, 11 bp, Homo sapiens
ctccccctgcc

SEQ ID NO: 1072272 - DNA, 16 bp, Homo sapiens
ctccccctgccagtgc

SEQ ID NO: 1072273 - DNA, 14 bp, Homo sapiens
ctcccccttcagct

SEQ ID NO: 1072274 - DNA, 17 bp, Homo sapiens
ctcccccttcagctcct

SEQ ID NO: 1072275 - DNA, 20 bp, Homo sapiens
ctcccccttcagctcctgag

SEQ ID NO: 1072276 - DNA, 14 bp, Homo sapiens
ctcccccttctccc

SEQ ID NO: 1072277 - DNA, 13 bp, Homo sapiens
ctcccccttgtct

SEQ ID NO: 1072278 - DNA, 19 bp, Homo sapiens
ctcccccttgtcttccccc

SEQ ID NO: 1072279 - DNA, 16 bp, Homo sapiens
ctccccgaggctgccc

SEQ ID NO: 1072280 - DNA, 17 bp, Homo sapiens
ctccccgatccccgaca

SEQ ID NO: 1072281 - DNA, 24 bp, Homo sapiens
ctccccgatccccgacagtggctc

SEQ ID NO: 1072282 - DNA, 20 bp, Homo sapiens
ctccccgcagcccgcctgcc

SEQ ID NO: 1072283 - DNA, 13 bp, Homo sapiens
ctccccgcccctg

SEQ ID NO: 1072284 - DNA, 23 bp, Homo sapiens
ctccccgcccctgtggccctggc

SEQ ID NO: 1072285 - DNA, 13 bp, Homo sapiens
ctccccgcctcca

SEQ ID NO: 1072286 - DNA, 17 bp, Homo sapiens
ctccccgcctcctccca

SEQ ID NO: 1072287 - DNA, 18 bp, Homo sapiens
ctccccgcctcctcccac

SEQ ID NO: 1072288 - DNA, 20 bp, Homo sapiens
ctccccgcctcctcccactg

SEQ ID NO: 1072289 - DNA, 16 bp, Homo sapiens
ctccccggcaggcctg

SEQ ID NO: 1072290 - DNA, 13 bp, Homo sapiens
ctccccggcccta

SEQ ID NO: 1072291 - DNA, 19 bp, Homo sapiens
ctccccggtaatgtcactg

SEQ ID NO: 1072292 - DNA, 15 bp, Homo sapiens
ctccccgtccctgtc

SEQ ID NO: 1072293 - DNA, 22 bp, Homo sapiens
ctccccgtccctgtcccccagc

SEQ ID NO: 1072294 - DNA, 16 bp, Homo sapiens
ctcccctaaagcctca

SEQ ID NO: 1072295 - DNA, 16 bp, Homo sapiens
ctcccctaaccctact

SEQ ID NO: 1072296 - DNA, 19 bp, Homo sapiens
ctcccctatccacccagcc

SEQ ID NO: 1072297 - DNA, 17 bp, Homo sapiens
ctcccctattttttggt

SEQ ID NO: 1072298 - DNA, 19 bp, Homo sapiens
ctcccctcacatcctcctg

SEQ ID NO: 1072299 - DNA, 11 bp, Homo sapiens
ctcccctcaga

SEQ ID NO: 1072300 - DNA, 14 bp, Homo sapiens
ctcccctcagagcc

SEQ ID NO: 1072301 - DNA, 19 bp, Homo sapiens
ctcccctcagcgcaggctg

SEQ ID NO: 1072302 - DNA, 21 bp, Homo sapiens
ctcccctcagcgcaggctgca

SEQ ID NO: 1072303 - DNA, 12 bp, Homo sapiens
ctcccctccaca

SEQ ID NO: 1072304 - DNA, 18 bp, Homo sapiens
ctcccctccacagctgca

SEQ ID NO: 1072305 - DNA, 14 bp, Homo sapiens
ctcccctccatccc

SEQ ID NO: 1072306 - DNA, 12 bp, Homo sapiens
ctcccctcccag

SEQ ID NO: 1072307 - DNA, 15 bp, Homo sapiens
ctcccctcccagtcc

SEQ ID NO: 1072308 - DNA, 19 bp, Homo sapiens
ctcccctccctcttccttc

SEQ ID NO: 1072309 - DNA, 20 bp, Homo sapiens
ctcccctccctcttccttcc

SEQ ID NO: 1072310 - DNA, 15 bp, Homo sapiens
ctcccctcctcttcc

SEQ ID NO: 1072311 - DNA, 23 bp, Homo sapiens
ctcccctcctcttcccttagcct

SEQ ID NO: 1072312 - DNA, 14 bp, Homo sapiens
ctcccctcctgcac

SEQ ID NO: 1072313 - DNA, 15 bp, Homo sapiens
ctcccctcctgctgg

SEQ ID NO: 1072314 - DNA, 16 bp, Homo sapiens
ctcccctccttgcctc

SEQ ID NO: 1072315 - DNA, 19 bp, Homo sapiens
ctcccctccttgcctcctg

SEQ ID NO: 1072316 - DNA, 20 bp, Homo sapiens
ctcccctcgtgtcagctcag

SEQ ID NO: 1072317 - DNA, 14 bp, Homo sapiens
ctcccctctcagaa

SEQ ID NO: 1072318 - DNA, 23 bp, Homo sapiens
ctcccctctcagaacatactgat

SEQ ID NO: 1072319 - DNA, 13 bp, Homo sapiens
ctcccctcttcct

SEQ ID NO: 1072320 - DNA, 16 bp, Homo sapiens
ctcccctcttcctctt

SEQ ID NO: 1072321 - DNA, 22 bp, Homo sapiens
ctcccctgacctgtgagcccag

SEQ ID NO: 1072322 - DNA, 13 bp, Homo sapiens
ctcccctgaggct

SEQ ID NO: 1072323 - DNA, 21 bp, Homo sapiens
ctcccctgatagaagattgtt

SEQ ID NO: 1072324 - DNA, 13 bp, Homo sapiens
ctcccctgccacc

SEQ ID NO: 1072325 - DNA, 23 bp, Homo sapiens
ctcccctgccaccaggccacctc

SEQ ID NO: 1072326 - DNA, 12 bp, Homo sapiens
ctcccctgccct

SEQ ID NO: 1072327 - DNA, 16 bp, Homo sapiens
ctcccctgccctgctg

SEQ ID NO: 1072328 - DNA, 18 bp, Homo sapiens
ctcccctgcgtcacactg

SEQ ID NO: 1072329 - DNA, 14 bp, Homo sapiens
ctcccctgtacctt

SEQ ID NO: 1072330 - DNA, 18 bp, Homo sapiens
ctcccctgttcccctctc

SEQ ID NO: 1072331 - DNA, 21 bp, Homo sapiens
ctcccctgttcccctctccct

SEQ ID NO: 1072332 - DNA, 15 bp, Homo sapiens
ctccccttccctggg

SEQ ID NO: 1072333 - DNA, 18 bp, Homo sapiens
ctccccttccctggggag

SEQ ID NO: 1072334 - DNA, 19 bp, Homo sapiens
ctccccttccctggggagc

SEQ ID NO: 1072335 - DNA, 12 bp, Homo sapiens
ctccccttcctg

SEQ ID NO: 1072336 - DNA, 18 bp, Homo sapiens
ctccccttcctggacaca

SEQ ID NO: 1072337 - DNA, 13 bp, Homo sapiens
ctccccttggacc

SEQ ID NO: 1072338 - DNA, 22 bp, Homo sapiens
ctccccttggacctccaggggc

SEQ ID NO: 1072339 - DNA, 13 bp, Homo sapiens
ctccccttgggcg

SEQ ID NO: 1072340 - DNA, 15 bp, Homo sapiens
ctccccttgggcggc

SEQ ID NO: 1072341 - DNA, 18 bp, Homo sapiens
ctccccttgggcggctga

SEQ ID NO: 1072342 - DNA, 17 bp, Homo sapiens
ctccccttttctatgtt

SEQ ID NO: 1072343 - DNA, 16 bp, Homo sapiens
ctcccctttttttccc

SEQ ID NO: 1072344 - DNA, 20 bp, Homo sapiens
ctcccgaaagcctttcctcg

SEQ ID NO: 1072345 - DNA, 16 bp, Homo sapiens
ctcccgacagcccatc

SEQ ID NO: 1072346 - DNA, 13 bp, Homo sapiens
ctcccgagaaatt

SEQ ID NO: 1072347 - DNA, 18 bp, Homo sapiens
ctcccgagaccgggccct

SEQ ID NO: 1072348 - DNA, 23 bp, Homo sapiens
ctcccgagaccgggccctgggtt

SEQ ID NO: 1072349 - DNA, 19 bp, Homo sapiens
ctcccgagctcctcttcca

SEQ ID NO: 1072350 - DNA, 24 bp, Homo sapiens
ctcccgagctcctcttccatgctg

SEQ ID NO: 1072351 - DNA, 16 bp, Homo sapiens
ctcccgagtagctggg

SEQ ID NO: 1072352 - DNA, 17 bp, Homo sapiens
ctcccgagtagctggga

SEQ ID NO: 1072353 - DNA, 21 bp, Homo sapiens
ctcccgccagactgttagaaa

SEQ ID NO: 1072354 - DNA, 21 bp, Homo sapiens
ctcccgccccccacacttccc

SEQ ID NO: 1072355 - DNA, 13 bp, Homo sapiens
ctcccgctcccag

SEQ ID NO: 1072356 - DNA, 19 bp, Homo sapiens
ctcccgctgcacacagacg

SEQ ID NO: 1072357 - DNA, 22 bp, Homo sapiens
ctcccgctgcacacagacggcc

SEQ ID NO: 1072358 - DNA, 14 bp, Homo sapiens
ctcccgctgctgct

SEQ ID NO: 1072359 - DNA, 15 bp, Homo sapiens
ctcccgctgctgctg

SEQ ID NO: 1072360 - DNA, 18 bp, Homo sapiens
ctcccggcactccatgct

SEQ ID NO: 1072361 - DNA, 16 bp, Homo sapiens
ctcccggctgccccca

SEQ ID NO: 1072362 - DNA, 14 bp, Homo sapiens
ctcccggctgcctg

SEQ ID NO: 1072363 - DNA, 15 bp, Homo sapiens
ctcccggctgcctgc

SEQ ID NO: 1072364 - DNA, 16 bp, Homo sapiens
ctcccggctgcctgcc

SEQ ID NO: 1072365 - DNA, 17 bp, Homo sapiens
ctcccggctgcctgccg

SEQ ID NO: 1072366 - DNA, 23 bp, Homo sapiens
ctcccgggccacgccccagcccg

SEQ ID NO: 1072367 - DNA, 20 bp, Homo sapiens
ctcccgggccctcccttgga

SEQ ID NO: 1072368 - DNA, 22 bp, Homo sapiens
ctcccgggccctcccttggaaa

SEQ ID NO: 1072369 - DNA, 14 bp, Homo sapiens
ctcccgggcctcag

SEQ ID NO: 1072370 - DNA, 17 bp, Homo sapiens
ctcccggggacgctttt

SEQ ID NO: 1072371 - DNA, 14 bp, Homo sapiens
ctcccggggactca

SEQ ID NO: 1072372 - DNA, 20 bp, Homo sapiens
ctcccggggactcaagagga

SEQ ID NO: 1072373 - DNA, 15 bp, Homo sapiens
ctcccggtgcccaag

SEQ ID NO: 1072374 - DNA, 21 bp, Homo sapiens
ctcccggttcttccagtggtt

SEQ ID NO: 1072375 - DNA, 17 bp, Homo sapiens
ctcccgtagtctcctgg

SEQ ID NO: 1072376 - DNA, 21 bp, Homo sapiens
ctcccgtcagggcccaagtcc

SEQ ID NO: 1072377 - DNA, 21 bp, Homo sapiens
ctcccgtgtgtggttggaaaa

SEQ ID NO: 1072378 - DNA, 17 bp, Homo sapiens
ctccctaagccagcctg

SEQ ID NO: 1072379 - DNA, 17 bp, Homo sapiens
ctccctaaggaatctga

SEQ ID NO: 1072380 - DNA, 19 bp, Homo sapiens
ctccctaaggaatctgaaa

SEQ ID NO: 1072381 - DNA, 20 bp, Homo sapiens
ctccctacctccctcctcag

SEQ ID NO: 1072382 - DNA, 22 bp, Homo sapiens
ctccctacctccctcctcaggg

SEQ ID NO: 1072383 - DNA, 15 bp, Homo sapiens
ctccctacttccaag

SEQ ID NO: 1072384 - DNA, 21 bp, Homo sapiens
ctccctagccagcacttgtat

SEQ ID NO: 1072385 - DNA, 16 bp, Homo sapiens
ctccctagcccttcca

SEQ ID NO: 1072386 - DNA, 22 bp, Homo sapiens
ctccctagtagctgggattaca

SEQ ID NO: 1072387 - DNA, 21 bp, Homo sapiens
ctccctcaaatgacagaccta

SEQ ID NO: 1072388 - DNA, 15 bp, Homo sapiens
ctccctcaactgaag

SEQ ID NO: 1072389 - DNA, 13 bp, Homo sapiens
ctccctcaccctg

SEQ ID NO: 1072390 - DNA, 12 bp, Homo sapiens
ctccctcagccc

SEQ ID NO: 1072391 - DNA, 16 bp, Homo sapiens
ctccctcccagctgca

SEQ ID NO: 1072392 - DNA, 18 bp, Homo sapiens
ctccctcccagctgcact

SEQ ID NO: 1072393 - DNA, 12 bp, Homo sapiens
ctccctccccac

SEQ ID NO: 1072394 - DNA, 22 bp, Homo sapiens
ctccctccccacacctccctac

SEQ ID NO: 1072395 - DNA, 13 bp, Homo sapiens
ctccctccccacc

SEQ ID NO: 1072396 - DNA, 20 bp, Homo sapiens
ctccctccccacccaagaga

SEQ ID NO: 1072397 - DNA, 19 bp, Homo sapiens
ctccctccccgctgccctt

SEQ ID NO: 1072398 - DNA, 19 bp, Homo sapiens
ctccctcccctctcagaac

SEQ ID NO: 1072399 - DNA, 16 bp, Homo sapiens
ctccctcccctgccct

SEQ ID NO: 1072400 - DNA, 19 bp, Homo sapiens
ctccctcccggctgccccc

SEQ ID NO: 1072401 - DNA, 23 bp, Homo sapiens
ctccctccctagcccttccagcc

SEQ ID NO: 1072402 - DNA, 20 bp, Homo sapiens
ctccctcccttccttgggca

SEQ ID NO: 1072403 - DNA, 16 bp, Homo sapiens
ctccctccgcctccca

SEQ ID NO: 1072404 - DNA, 11 bp, Homo sapiens
ctccctcctca

SEQ ID NO: 1072405 - DNA, 15 bp, Homo sapiens
ctccctcctcacctc

SEQ ID NO: 1072406 - DNA, 12 bp, Homo sapiens
ctccctcctcag

SEQ ID NO: 1072407 - DNA, 15 bp, Homo sapiens
ctccctcctcagggg

SEQ ID NO: 1072408 - DNA, 12 bp, Homo sapiens
ctccctcctctg

SEQ ID NO: 1072409 - DNA, 15 bp, Homo sapiens
ctccctcctctggca

SEQ ID NO: 1072410 - DNA, 16 bp, Homo sapiens
ctccctcctctggcag

SEQ ID NO: 1072411 - DNA, 17 bp, Homo sapiens
ctccctcctgccgactc

SEQ ID NO: 1072412 - DNA, 20 bp, Homo sapiens
ctccctcctggagctctgtg

SEQ ID NO: 1072413 - DNA, 21 bp, Homo sapiens
ctccctcctggagctctgtgg

SEQ ID NO: 1072414 - DNA, 15 bp, Homo sapiens
ctccctcgggggctc

SEQ ID NO: 1072415 - DNA, 14 bp, Homo sapiens
ctccctcgtgggct

SEQ ID NO: 1072416 - DNA, 15 bp, Homo sapiens
ctccctcgtgggctt

SEQ ID NO: 1072417 - DNA, 19 bp, Homo sapiens
ctccctcgtgggcttgtgc

SEQ ID NO: 1072418 - DNA, 20 bp, Homo sapiens
ctccctcgtgggcttgtgct

SEQ ID NO: 1072419 - DNA, 14 bp, Homo sapiens
ctccctctactctt

SEQ ID NO: 1072420 - DNA, 17 bp, Homo sapiens
ctccctctactcttcct

SEQ ID NO: 1072421 - DNA, 18 bp, Homo sapiens
ctccctctactcttcctg

SEQ ID NO: 1072422 - DNA, 19 bp, Homo sapiens
ctccctctactcttcctgt

SEQ ID NO: 1072423 - DNA, 20 bp, Homo sapiens
ctccctctctcttctgctcc

SEQ ID NO: 1072424 - DNA, 21 bp, Homo sapiens
ctccctctctcttctgctcca

SEQ ID NO: 1072425 - DNA, 22 bp, Homo sapiens
ctccctctctcttctgctccac

SEQ ID NO: 1072426 - DNA, 21 bp, Homo sapiens
ctccctctcttccgggagctg

SEQ ID NO: 1072427 - DNA, 17 bp, Homo sapiens
ctccctctgacctgcag

SEQ ID NO: 1072428 - DNA, 21 bp, Homo sapiens
ctccctctgccccaagcagcc

SEQ ID NO: 1072429 - DNA, 23 bp, Homo sapiens
ctccctctgcccctcccccagcc

SEQ ID NO: 1072430 - DNA, 14 bp, Homo sapiens
ctccctctggccct

SEQ ID NO: 1072431 - DNA, 17 bp, Homo sapiens
ctccctctggccctgcc

SEQ ID NO: 1072432 - DNA, 20 bp, Homo sapiens
ctccctctggccctgccttc

SEQ ID NO: 1072433 - DNA, 20 bp, Homo sapiens
ctccctctgggttccagcag

SEQ ID NO: 1072434 - DNA, 22 bp, Homo sapiens
ctccctctgggttccagcagag

SEQ ID NO: 1072435 - DNA, 15 bp, Homo sapiens
ctccctctggtccca

SEQ ID NO: 1072436 - DNA, 13 bp, Homo sapiens
ctccctctgtctt

SEQ ID NO: 1072437 - DNA, 12 bp, Homo sapiens
ctccctctgtta

SEQ ID NO: 1072438 - DNA, 22 bp, Homo sapiens
ctccctctgttaggtccatttt

SEQ ID NO: 1072439 - DNA, 23 bp, Homo sapiens
ctccctctgttaggtccattttc

SEQ ID NO: 1072440 - DNA, 12 bp, Homo sapiens
ctccctcttcct

SEQ ID NO: 1072441 - DNA, 22 bp, Homo sapiens
ctccctctttcccaccctccac

SEQ ID NO: 1072442 - DNA, 17 bp, Homo sapiens
ctccctgaaacactgct

SEQ ID NO: 1072443 - DNA, 19 bp, Homo sapiens
ctccctgaaacactgcttc

SEQ ID NO: 1072444 - DNA, 17 bp, Homo sapiens
ctccctgacatttctaa

SEQ ID NO: 1072445 - DNA, 16 bp, Homo sapiens
ctccctgacccgtcta

SEQ ID NO: 1072446 - DNA, 12 bp, Homo sapiens
ctccctgaccct

SEQ ID NO: 1072447 - DNA, 20 bp, Homo sapiens
ctccctgactccctgtgggg

SEQ ID NO: 1072448 - DNA, 14 bp, Homo sapiens
ctccctgacttctc

SEQ ID NO: 1072449 - DNA, 17 bp, Homo sapiens
ctccctgacttctcccc

SEQ ID NO: 1072450 - DNA, 18 bp, Homo sapiens
ctccctgacttctccccc

SEQ ID NO: 1072451 - DNA, 20 bp, Homo sapiens
ctccctgacttctcccccgc

SEQ ID NO: 1072452 - DNA, 14 bp, Homo sapiens
ctccctgagtctgg

SEQ ID NO: 1072453 - DNA, 21 bp, Homo sapiens
ctccctgagtctggacctcca

SEQ ID NO: 1072454 - DNA, 23 bp, Homo sapiens
ctccctgagtctggacctccatc

SEQ ID NO: 1072455 - DNA, 14 bp, Homo sapiens
ctccctgcaccgcc

SEQ ID NO: 1072456 - DNA, 16 bp, Homo sapiens
ctccctgcaccgccgc

SEQ ID NO: 1072457 - DNA, 22 bp, Homo sapiens
ctccctgcactccctcctggag

SEQ ID NO: 1072458 - DNA, 16 bp, Homo sapiens
ctccctgcagccacca

SEQ ID NO: 1072459 - DNA, 14 bp, Homo sapiens
ctccctgcagcctt

SEQ ID NO: 1072460 - DNA, 18 bp, Homo sapiens
ctccctgcagccttttct

SEQ ID NO: 1072461 - DNA, 13 bp, Homo sapiens
ctccctgcatcct

SEQ ID NO: 1072462 - DNA, 14 bp, Homo sapiens
ctccctgcatcctg

SEQ ID NO: 1072463 - DNA, 16 bp, Homo sapiens
ctccctgcatcctgag

SEQ ID NO: 1072464 - DNA, 17 bp, Homo sapiens
ctccctgcatcctgagg

SEQ ID NO: 1072465 - DNA, 18 bp, Homo sapiens
ctccctgcatcctgaggc

SEQ ID NO: 1072466 - DNA, 20 bp, Homo sapiens
ctccctgcatctgaccagca

SEQ ID NO: 1072467 - DNA, 23 bp, Homo sapiens
ctccctgcatctgaccagcagcg

SEQ ID NO: 1072468 - DNA, 23 bp, Homo sapiens
ctccctgccatccccctctcacg

SEQ ID NO: 1072469 - DNA, 12 bp, Homo sapiens
ctccctgcccaa

SEQ ID NO: 1072470 - DNA, 17 bp, Homo sapiens
ctccctgcccaaactcc

SEQ ID NO: 1072471 - DNA, 13 bp, Homo sapiens
ctccctgcccccc

SEQ ID NO: 1072472 - DNA, 23 bp, Homo sapiens
ctccctgccccccaaggttctgg

SEQ ID NO: 1072473 - DNA, 17 bp, Homo sapiens
ctccctgccccccagcc

SEQ ID NO: 1072474 - DNA, 23 bp, Homo sapiens
ctccctgccccccagccctcctt

SEQ ID NO: 1072475 - DNA, 13 bp, Homo sapiens
ctccctgcccctc

SEQ ID NO: 1072476 - DNA, 17 bp, Homo sapiens
ctccctgcccctccctt

SEQ ID NO: 1072477 - DNA, 16 bp, Homo sapiens
ctccctgccgcctcaa

SEQ ID NO: 1072478 - DNA, 21 bp, Homo sapiens
ctccctgcctacacacacagc

SEQ ID NO: 1072479 - DNA, 14 bp, Homo sapiens
ctccctgcctgctc

SEQ ID NO: 1072480 - DNA, 16 bp, Homo sapiens
ctccctgcctgctcct

SEQ ID NO: 1072481 - DNA, 13 bp, Homo sapiens
ctccctgcctggc

SEQ ID NO: 1072482 - DNA, 18 bp, Homo sapiens
ctccctgcctggccccca

SEQ ID NO: 1072483 - DNA, 12 bp, Homo sapiens
ctccctgccttt

SEQ ID NO: 1072484 - DNA, 16 bp, Homo sapiens
ctccctgctcagtgct

SEQ ID NO: 1072485 - DNA, 13 bp, Homo sapiens
ctccctgctcctc

SEQ ID NO: 1072486 - DNA, 14 bp, Homo sapiens
ctccctgctcctca

SEQ ID NO: 1072487 - DNA, 15 bp, Homo sapiens
ctccctgctcctcat

SEQ ID NO: 1072488 - DNA, 12 bp, Homo sapiens
ctccctgctttg

SEQ ID NO: 1072489 - DNA, 21 bp, Homo sapiens
ctccctggaccccattctgag

SEQ ID NO: 1072490 - DNA, 11 bp, Homo sapiens
ctccctggagc

SEQ ID NO: 1072491 - DNA, 15 bp, Homo sapiens
ctccctggagccctg

SEQ ID NO: 1072492 - DNA, 22 bp, Homo sapiens
ctccctggagtgcagtttccaa

SEQ ID NO: 1072493 - DNA, 14 bp, Homo sapiens
ctccctggctccca

SEQ ID NO: 1072494 - DNA, 16 bp, Homo sapiens
ctccctggctccctcc

SEQ ID NO: 1072495 - DNA, 17 bp, Homo sapiens
ctccctggctgccctgg

SEQ ID NO: 1072496 - DNA, 18 bp, Homo sapiens
ctccctggctgccctggc

SEQ ID NO: 1072497 - DNA, 20 bp, Homo sapiens
ctccctggctgccctggccc

SEQ ID NO: 1072498 - DNA, 22 bp, Homo sapiens
ctccctggctgccctggccctg

SEQ ID NO: 1072499 - DNA, 19 bp, Homo sapiens
ctccggaggactgagcccc

SEQ ID NO: 1072500 - DNA, 17 bp, Homo sapiens
ctccggaggagcagcct

SEQ ID NO: 1072501 - DNA, 19 bp, Homo sapiens
ctccggaggagcagcctcg

SEQ ID NO: 1072502 - DNA, 21 bp, Homo sapiens
ctccggaggagcagcctcgag

SEQ ID NO: 1072503 - DNA, 12 bp, Homo sapiens
ctccggagggga

SEQ ID NO: 1072504 - DNA, 21 bp, Homo sapiens
ctccggaggggacccagctcc

SEQ ID NO: 1072505 - DNA, 22 bp, Homo sapiens
ctccggaggggacccagctcct

SEQ ID NO: 1072506 - DNA, 24 bp, Homo sapiens
ctccggaggggacccagctcctct

SEQ ID NO: 1072507 - DNA, 17 bp, Homo sapiens
ctccggccatactgcct

SEQ ID NO: 1072508 - DNA, 23 bp, Homo sapiens
ctccggcgtcttgcccagcagct

SEQ ID NO: 1072509 - DNA, 22 bp, Homo sapiens
ctccgggaccattgacctcagc

SEQ ID NO: 1072510 - DNA, 19 bp, Homo sapiens
ctccgggcaggggagccag

SEQ ID NO: 1072511 - DNA, 20 bp, Homo sapiens
ctccgggcaggggagccagg

SEQ ID NO: 1072512 - DNA, 20 bp, Homo sapiens
ctccggggccccactggctg

SEQ ID NO: 1072513 - DNA, 16 bp, Homo sapiens
ctccggggtctgtgct

SEQ ID NO: 1072514 - DNA, 18 bp, Homo sapiens
ctccggggtggccacagg

SEQ ID NO: 1072515 - DNA, 15 bp, Homo sapiens
ctccgggtcactgct

SEQ ID NO: 1072516 - DNA, 16 bp, Homo sapiens
ctccgggtcactgctg

SEQ ID NO: 1072517 - DNA, 15 bp, Homo sapiens
ctccgggtcctccta

SEQ ID NO: 1072518 - DNA, 17 bp, Homo sapiens
ctccgggtgtggcctca

SEQ ID NO: 1072519 - DNA, 18 bp, Homo sapiens
ctccgggtgtggcctcag

SEQ ID NO: 1072520 - DNA, 19 bp, Homo sapiens
ctccgggtgtggcctcagc

SEQ ID NO: 1072521 - DNA, 22 bp, Homo sapiens
ctccgggtgtggcctcagccct

SEQ ID NO: 1072522 - DNA, 21 bp, Homo sapiens
ctccgtagggtctttcttggg

SEQ ID NO: 1072523 - DNA, 22 bp, Homo sapiens
ctccgtagggtctttcttggga

SEQ ID NO: 1072524 - DNA, 16 bp, Homo sapiens
ctccgtccacccaggc

SEQ ID NO: 1072525 - DNA, 15 bp, Homo sapiens
ctccgtccagccgcc

SEQ ID NO: 1072526 - DNA, 20 bp, Homo sapiens
ctccgtccaggagcctgtgc

SEQ ID NO: 1072527 - DNA, 22 bp, Homo sapiens
ctccgtccaggagcctgtgcct

SEQ ID NO: 1072528 - DNA, 17 bp, Homo sapiens
ctccgtcctgtcactga

SEQ ID NO: 1072529 - DNA, 16 bp, Homo sapiens
ctccgtctctgtcctc

SEQ ID NO: 1072530 - DNA, 13 bp, Homo sapiens
ctccgtctgaccc

SEQ ID NO: 1072531 - DNA, 14 bp, Homo sapiens
ctccgtctgaccct

SEQ ID NO: 1072532 - DNA, 13 bp, Homo sapiens
ctccgtgcctcca

SEQ ID NO: 1072533 - DNA, 16 bp, Homo sapiens
ctccgtggaacattct

SEQ ID NO: 1072534 - DNA, 12 bp, Homo sapiens
ctccgtggagga

SEQ ID NO: 1072535 - DNA, 22 bp, Homo sapiens
ctccgtggaggaggttgggagg

SEQ ID NO: 1072536 - DNA, 15 bp, Homo sapiens
ctccgtgtggagcac

SEQ ID NO: 1072537 - DNA, 15 bp, Homo sapiens
ctccgttagctcctg

SEQ ID NO: 1072538 - DNA, 16 bp, Homo sapiens
ctccgttagctcctgt

SEQ ID NO: 1072539 - DNA, 18 bp, Homo sapiens
ctccgttagctcctgtgg

SEQ ID NO: 1072540 - DNA, 12 bp, Homo sapiens
ctccgttggcca

SEQ ID NO: 1072541 - DNA, 20 bp, Homo sapiens
ctccgttggccactccgaga

SEQ ID NO: 1072542 - DNA, 12 bp, Homo sapiens
ctcctaaaacaa

SEQ ID NO: 1072543 - DNA, 20 bp, Homo sapiens
ctcctaaaacaacagatgta

SEQ ID NO: 1072544 - DNA, 16 bp, Homo sapiens
ctcctaaggctcccca

SEQ ID NO: 1072545 - DNA, 18 bp, Homo sapiens
ctcctaaggctccccacc

SEQ ID NO: 1072546 - DNA, 17 bp, Homo sapiens
ctcctacatccagctcc

SEQ ID NO: 1072547 - DNA, 20 bp, Homo sapiens
ctcctaccccttcctgtcct

SEQ ID NO: 1072548 - DNA, 22 bp, Homo sapiens
ctcctaccccttcctgtcctgc

SEQ ID NO: 1072549 - DNA, 18 bp, Homo sapiens
ctcctaccctcccaccag

SEQ ID NO: 1072550 - DNA, 18 bp, Homo sapiens
ctcctaccctgcgcccag

SEQ ID NO: 1072551 - DNA, 12 bp, Homo sapiens
ctcctacctcag

SEQ ID NO: 1072552 - DNA, 14 bp, Homo sapiens
ctcctacctcagcc

SEQ ID NO: 1072553 - DNA, 16 bp, Homo sapiens
ctcctacctcagccta

SEQ ID NO: 1072554 - DNA, 18 bp, Homo sapiens
ctcctacctcagcctaga

SEQ ID NO: 1072555 - DNA, 18 bp, Homo sapiens
ctcctacctcagcctcct

SEQ ID NO: 1072556 - DNA, 21 bp, Homo sapiens
ctcctacctcagcctcctggg

SEQ ID NO: 1072557 - DNA, 14 bp, Homo sapiens
ctcctacctgggga

SEQ ID NO: 1072558 - DNA, 19 bp, Homo sapiens
ctcctacctggggactcct

SEQ ID NO: 1072559 - DNA, 21 bp, Homo sapiens
ctcctacctggggactcctca

SEQ ID NO: 1072560 - DNA, 12 bp, Homo sapiens
ctcctactctgt

SEQ ID NO: 1072561 - DNA, 14 bp, Homo sapiens
ctcctactctgtgt

SEQ ID NO: 1072562 - DNA, 15 bp, Homo sapiens
ctcctactctgtgta

SEQ ID NO: 1072563 - DNA, 12 bp, Homo sapiens
ctcctagaagaa

SEQ ID NO: 1072564 - DNA, 13 bp, Homo sapiens
ctcctagagggag

SEQ ID NO: 1072565 - DNA, 15 bp, Homo sapiens
ctcctagagggaggg

SEQ ID NO: 1072566 - DNA, 19 bp, Homo sapiens
ctcctagagggaggggcct

SEQ ID NO: 1072567 - DNA, 22 bp, Homo sapiens
ctcctagaggtgggcagctggg

SEQ ID NO: 1072568 - DNA, 15 bp, Homo sapiens
ctcctagagtgcagg

SEQ ID NO: 1072569 - DNA, 18 bp, Homo sapiens
ctcctagagtgcagggat

SEQ ID NO: 1072570 - DNA, 16 bp, Homo sapiens
ctcctagcccctctct

SEQ ID NO: 1072571 - DNA, 18 bp, Homo sapiens
ctcctagcccctctctca

SEQ ID NO: 1072572 - DNA, 21 bp, Homo sapiens
ctcctagcccctctctcacac

SEQ ID NO: 1072573 - DNA, 22 bp, Homo sapiens
ctcctagcctgtgcctctggga

SEQ ID NO: 1072574 - DNA, 12 bp, Homo sapiens
ctcctaggctgg

SEQ ID NO: 1072575 - DNA, 13 bp, Homo sapiens
ctcctaggggaag

SEQ ID NO: 1072576 - DNA, 16 bp, Homo sapiens
ctcctaggggaagggg

SEQ ID NO: 1072577 - DNA, 17 bp, Homo sapiens
ctcctaggggaaggggg

SEQ ID NO: 1072578 - DNA, 16 bp, Homo sapiens
ctcctagggggtgtca

SEQ ID NO: 1072579 - DNA, 17 bp, Homo sapiens
ctcctagggggtgtcag

SEQ ID NO: 1072580 - DNA, 16 bp, Homo sapiens
ctcctataatctgtca

SEQ ID NO: 1072581 - DNA, 17 bp, Homo sapiens
ctcctataatctgtcaa

SEQ ID NO: 1072582 - DNA, 18 bp, Homo sapiens
ctcctataatctgtcaaa

SEQ ID NO: 1072583 - DNA, 17 bp, Homo sapiens
ctcctatatatttctat

SEQ ID NO: 1072584 - DNA, 14 bp, Homo sapiens
ctcctatccttgga

SEQ ID NO: 1072585 - DNA, 22 bp, Homo sapiens
ctcctatgggttgtcaccaagc

SEQ ID NO: 1072586 - DNA, 22 bp, Homo sapiens
ctcctatgtgtgcctcctagag

SEQ ID NO: 1072587 - DNA, 23 bp, Homo sapiens
ctcctattgaaagaccagatcct

SEQ ID NO: 1072588 - DNA, 22 bp, Homo sapiens
ctcctcaaaccacttgcctggg

SEQ ID NO: 1072589 - DNA, 14 bp, Homo sapiens
ctcctcaagcctgt

SEQ ID NO: 1072590 - DNA, 15 bp, Homo sapiens
ctcctcaagcctgtg

SEQ ID NO: 1072591 - DNA, 17 bp, Homo sapiens
ctcctcaagcctgtggg

SEQ ID NO: 1072592 - DNA, 20 bp, Homo sapiens
ctcctcaatttttgtctcag

SEQ ID NO: 1072593 - DNA, 15 bp, Homo sapiens
ctcctcacacaccct

SEQ ID NO: 1072594 - DNA, 14 bp, Homo sapiens
ctcctcacagacct

SEQ ID NO: 1072595 - DNA, 18 bp, Homo sapiens
ctcctcacagacctctgc

SEQ ID NO: 1072596 - DNA, 21 bp, Homo sapiens
ctcctcacccacctctgggtc

SEQ ID NO: 1072597 - DNA, 20 bp, Homo sapiens
ctcctcacccccagctttgc

SEQ ID NO: 1072598 - DNA, 15 bp, Homo sapiens
ctcctcaccccgtct

SEQ ID NO: 1072599 - DNA, 17 bp, Homo sapiens
ctcctcacctcatgccc

SEQ ID NO: 1072600 - DNA, 14 bp, Homo sapiens
ctcctcacctctgg

SEQ ID NO: 1072601 - DNA, 12 bp, Homo sapiens
ctcctcacctgt

SEQ ID NO: 1072602 - DNA, 15 bp, Homo sapiens
ctcctcacctgtcta

SEQ ID NO: 1072603 - DNA, 14 bp, Homo sapiens
ctcctcactctgtc

SEQ ID NO: 1072604 - DNA, 19 bp, Homo sapiens
ctcctcactgtatccaggt

SEQ ID NO: 1072605 - DNA, 23 bp, Homo sapiens
ctcctcagccatgggaacctcat

SEQ ID NO: 1072606 - DNA, 14 bp, Homo sapiens
ctcctcagccccca

SEQ ID NO: 1072607 - DNA, 19 bp, Homo sapiens
ctcctcagcccccaggcca

SEQ ID NO: 1072608 - DNA, 21 bp, Homo sapiens
ctcctcagcccccaggccagg

SEQ ID NO: 1072609 - DNA, 17 bp, Homo sapiens
ctcctcagcctctgcaa

SEQ ID NO: 1072610 - DNA, 23 bp, Homo sapiens
ctcctcagctgcatggagcctgg

SEQ ID NO: 1072611 - DNA, 20 bp, Homo sapiens
ctcctcaggaccctcagccc

SEQ ID NO: 1072612 - DNA, 12 bp, Homo sapiens
ctcctcaggagc

SEQ ID NO: 1072613 - DNA, 17 bp, Homo sapiens
ctcctcaggcacacagc

SEQ ID NO: 1072614 - DNA, 23 bp, Homo sapiens
ctcctcagggggtaggagagcac

SEQ ID NO: 1072615 - DNA, 16 bp, Homo sapiens
ctcctcatccatttct

SEQ ID NO: 1072616 - DNA, 11 bp, Homo sapiens
ctcctcatggg

SEQ ID NO: 1072617 - DNA, 20 bp, Homo sapiens
ctcctcatgtacataccctg

SEQ ID NO: 1072618 - DNA, 14 bp, Homo sapiens
ctcctccacagtgc

SEQ ID NO: 1072619 - DNA, 12 bp, Homo sapiens
ctcctccactca

SEQ ID NO: 1072620 - DNA, 13 bp, Homo sapiens
ctcctccactcac

SEQ ID NO: 1072621 - DNA, 17 bp, Homo sapiens
ctcctccactccacctc

SEQ ID NO: 1072622 - DNA, 20 bp, Homo sapiens
ctcctccagcccctgtccca

SEQ ID NO: 1072623 - DNA, 14 bp, Homo sapiens
ctcctccagccctt

SEQ ID NO: 1072624 - DNA, 23 bp, Homo sapiens
ctctcaattaaagtctattcaaa

SEQ ID NO: 1072625 - DNA, 13 bp, Homo sapiens
ctctcaatttttg

SEQ ID NO: 1072626 - DNA, 19 bp, Homo sapiens
ctctcaatttttggttgaa

SEQ ID NO: 1072627 - DNA, 19 bp, Homo sapiens
ctctcacactggttctcaa

SEQ ID NO: 1072628 - DNA, 19 bp, Homo sapiens
ctctcaccatgatgtgaag

SEQ ID NO: 1072629 - DNA, 15 bp, Homo sapiens
ctctcacccaccagc

SEQ ID NO: 1072630 - DNA, 22 bp, Homo sapiens
ctctcacccaccagctccacac

SEQ ID NO: 1072631 - DNA, 20 bp, Homo sapiens
ctctcaccccaagcggcctt

SEQ ID NO: 1072632 - DNA, 13 bp, Homo sapiens
ctctcacccccat

SEQ ID NO: 1072633 - DNA, 15 bp, Homo sapiens
ctctcacctctccct

SEQ ID NO: 1072634 - DNA, 16 bp, Homo sapiens
ctctcacctgtactct

SEQ ID NO: 1072635 - DNA, 15 bp, Homo sapiens
ctctcacgggccctg

SEQ ID NO: 1072636 - DNA, 17 bp, Homo sapiens
ctctcacgggccctgcc

SEQ ID NO: 1072637 - DNA, 16 bp, Homo sapiens
ctctcactagtgccaa

SEQ ID NO: 1072638 - DNA, 19 bp, Homo sapiens
ctctcactccacccagagt

SEQ ID NO: 1072639 - DNA, 21 bp, Homo sapiens
ctctcactccacccagagtag

SEQ ID NO: 1072640 - DNA, 12 bp, Homo sapiens
ctctcactccag

SEQ ID NO: 1072641 - DNA, 21 bp, Homo sapiens
ctctcactgtgttactgcttt

SEQ ID NO: 1072642 - DNA, 12 bp, Homo sapiens
ctctcagaacat

SEQ ID NO: 1072643 - DNA, 12 bp, Homo sapiens
ctctcagaccca

SEQ ID NO: 1072644 - DNA, 17 bp, Homo sapiens
ctctcagatacccagtg

SEQ ID NO: 1072645 - DNA, 11 bp, Homo sapiens
ctctcagccaa

SEQ ID NO: 1072646 - DNA, 17 bp, Homo sapiens
ctctcagccagctgttt

SEQ ID NO: 1072647 - DNA, 13 bp, Homo sapiens
ctctcagccccat

SEQ ID NO: 1072648 - DNA, 12 bp, Homo sapiens
ctctcagctcca

SEQ ID NO: 1072649 - DNA, 13 bp, Homo sapiens
ctctcagctccag

SEQ ID NO: 1072650 - DNA, 13 bp, Homo sapiens
ctctcaggagagt

SEQ ID NO: 1072651 - DNA, 16 bp, Homo sapiens
ctctcaggagcacagg

SEQ ID NO: 1072652 - DNA, 19 bp, Homo sapiens
ctctcaggcatgcctgtgt

SEQ ID NO: 1072653 - DNA, 20 bp, Homo sapiens
ctctcaggcatgcctgtgtg

SEQ ID NO: 1072654 - DNA, 18 bp, Homo sapiens
ctctcagtgttttggact

SEQ ID NO: 1072655 - DNA, 21 bp, Homo sapiens
ctctcagttctctcccttcct

SEQ ID NO: 1072656 - DNA, 18 bp, Homo sapiens
ctctcatcaactgaatga

SEQ ID NO: 1072657 - DNA, 14 bp, Homo sapiens
ctctcatccccctg

SEQ ID NO: 1072658 - DNA, 15 bp, Homo sapiens
ctctcatccccctgt

SEQ ID NO: 1072659 - DNA, 19 bp, Homo sapiens
ctctcatcctccagtacct

SEQ ID NO: 1072660 - DNA, 18 bp, Homo sapiens
ctctcatcgccagacaac

SEQ ID NO: 1072661 - DNA, 13 bp, Homo sapiens
ctctcatctcagg

SEQ ID NO: 1072662 - DNA, 16 bp, Homo sapiens
ctctcatctgatcact

SEQ ID NO: 1072663 - DNA, 15 bp, Homo sapiens
ctctcatgcgtgttt

SEQ ID NO: 1072664 - DNA, 12 bp, Homo sapiens
ctctcattgtct

SEQ ID NO: 1072665 - DNA, 16 bp, Homo sapiens
ctctccaaaggggctg

SEQ ID NO: 1072666 - DNA, 18 bp, Homo sapiens
ctctccaaaggggctgct

SEQ ID NO: 1072667 - DNA, 21 bp, Homo sapiens
ctctccaaatattattcaagt

SEQ ID NO: 1072668 - DNA, 19 bp, Homo sapiens
ctctccaaccactgtgcca

SEQ ID NO: 1072669 - DNA, 16 bp, Homo sapiens
ctctccaacctggaca

SEQ ID NO: 1072670 - DNA, 12 bp, Homo sapiens
ctctccaagggc

SEQ ID NO: 1072671 - DNA, 14 bp, Homo sapiens
ctctccaagggctt

SEQ ID NO: 1072672 - DNA, 20 bp, Homo sapiens
ctctccaagtctctctgtga

SEQ ID NO: 1072673 - DNA, 14 bp, Homo sapiens
ctctccacagtgtt

SEQ ID NO: 1072674 - DNA, 22 bp, Homo sapiens
ctctccacagtgttgtgcccct

SEQ ID NO: 1072675 - DNA, 22 bp, Homo sapiens
ctctccaccagacgccttcctc

SEQ ID NO: 1072676 - DNA, 13 bp, Homo sapiens
ctctccacctcag

SEQ ID NO: 1072677 - DNA, 18 bp, Homo sapiens
ctctccacctcagccttg

SEQ ID NO: 1072678 - DNA, 20 bp, Homo sapiens
ctctccacctcagccttgga

SEQ ID NO: 1072679 - DNA, 15 bp, Homo sapiens
ctctccactcttctc

SEQ ID NO: 1072680 - DNA, 13 bp, Homo sapiens
ctctccactgctg

SEQ ID NO: 1072681 - DNA, 22 bp, Homo sapiens
ctctccacttctggtcccctgt

SEQ ID NO: 1072682 - DNA, 19 bp, Homo sapiens
ctctccagaaacagctgct

SEQ ID NO: 1072683 - DNA, 23 bp, Homo sapiens
ctctccagaaacagctgcttctc

SEQ ID NO: 1072684 - DNA, 18 bp, Homo sapiens
ctctccaggcacccttct

SEQ ID NO: 1072685 - DNA, 14 bp, Homo sapiens
ctctccaggccagg

SEQ ID NO: 1072686 - DNA, 12 bp, Homo sapiens
ctctccaggccc

SEQ ID NO: 1072687 - DNA, 13 bp, Homo sapiens
ctctccaggcccc

SEQ ID NO: 1072688 - DNA, 17 bp, Homo sapiens
ctctccaggccccacca

SEQ ID NO: 1072689 - DNA, 14 bp, Homo sapiens
ctctccagggtgct

SEQ ID NO: 1072690 - DNA, 17 bp, Homo sapiens
ctctccagtttgcacct

SEQ ID NO: 1072691 - DNA, 19 bp, Homo sapiens
ctctccagtttgcacctgt

SEQ ID NO: 1072692 - DNA, 20 bp, Homo sapiens
ctctccagtttgcacctgtc

SEQ ID NO: 1072693 - DNA, 22 bp, Homo sapiens
ctctccatacctgcccctgcct

SEQ ID NO: 1072694 - DNA, 20 bp, Homo sapiens
ctctccatatcccttcctct

SEQ ID NO: 1072695 - DNA, 19 bp, Homo sapiens
ctctccattttagcccagt

SEQ ID NO: 1072696 - DNA, 13 bp, Homo sapiens
ctctcccacagag

SEQ ID NO: 1072697 - DNA, 23 bp, Homo sapiens
ctctcccacagagtgctggactg

SEQ ID NO: 1072698 - DNA, 13 bp, Homo sapiens
ctctcccaccccg

SEQ ID NO: 1072699 - DNA, 22 bp, Homo sapiens
ctctcccaccccggcctccact

SEQ ID NO: 1072700 - DNA, 19 bp, Homo sapiens
ctctcccacccggccacag

SEQ ID NO: 1072701 - DNA, 22 bp, Homo sapiens
ctctcccacccggccacagctg

SEQ ID NO: 1072702 - DNA, 15 bp, Homo sapiens
ctctcccacttcctc

SEQ ID NO: 1072703 - DNA, 21 bp, Homo sapiens
ctctcccacttcctcctacct

SEQ ID NO: 1072704 - DNA, 13 bp, Homo sapiens
ctctcccatcact

SEQ ID NO: 1072705 - DNA, 18 bp, Homo sapiens
ctctcccatcacttccct

SEQ ID NO: 1072706 - DNA, 18 bp, Homo sapiens
ctctccccaacccccatt

SEQ ID NO: 1072707 - DNA, 20 bp, Homo sapiens
ctctccccaacccccattct

SEQ ID NO: 1072708 - DNA, 18 bp, Homo sapiens
ctctccccacgagggctg

SEQ ID NO: 1072709 - DNA, 19 bp, Homo sapiens
ctctccccacgagggctgg

SEQ ID NO: 1072710 - DNA, 21 bp, Homo sapiens
ctctccccacgagggctggct

SEQ ID NO: 1072711 - DNA, 15 bp, Homo sapiens
ctctccccaggtcca

SEQ ID NO: 1072712 - DNA, 23 bp, Homo sapiens
ctctccccaggtccagctctgga

SEQ ID NO: 1072713 - DNA, 11 bp, Homo sapiens
ctctccccagt

SEQ ID NO: 1072714 - DNA, 14 bp, Homo sapiens
ctctccccagtgcc

SEQ ID NO: 1072715 - DNA, 19 bp, Homo sapiens
ctctccccagtgcctgcca

SEQ ID NO: 1072716 - DNA, 22 bp, Homo sapiens
ctctccccagtgcctgccactc

SEQ ID NO: 1072717 - DNA, 13 bp, Homo sapiens
ctctccccctctg

SEQ ID NO: 1072718 - DNA, 19 bp, Homo sapiens
ctctccccctctgtcttct

SEQ ID NO: 1072719 - DNA, 14 bp, Homo sapiens
ctctcccccttcag

SEQ ID NO: 1072720 - DNA, 20 bp, Homo sapiens
ctctcccccttcagctcctg

SEQ ID NO: 1072721 - DNA, 23 bp, Homo sapiens
ctctcccccttcagctcctgagt

SEQ ID NO: 1072722 - DNA, 16 bp, Homo sapiens
ctctcccccttggatt

SEQ ID NO: 1072723 - DNA, 14 bp, Homo sapiens
ctctccccctttca

SEQ ID NO: 1072724 - DNA, 19 bp, Homo sapiens
ctctccccctttcaaggaa

SEQ ID NO: 1072725 - DNA, 23 bp, Homo sapiens
ctctccccggcaggcctgagaat

SEQ ID NO: 1072726 - DNA, 18 bp, Homo sapiens
ctctcccctcacatcctc

SEQ ID NO: 1072727 - DNA, 19 bp, Homo sapiens
ctctcccctcacatcctcc

SEQ ID NO: 1072728 - DNA, 22 bp, Homo sapiens
ctctcccctcacatcctcctgc

SEQ ID NO: 1072729 - DNA, 21 bp, Homo sapiens
ctctcccctcagagtgcaagc

SEQ ID NO: 1072730 - DNA, 12 bp, Homo sapiens
ctctcccctccc

SEQ ID NO: 1072731 - DNA, 14 bp, Homo sapiens
ctctcccctccctt

SEQ ID NO: 1072732 - DNA, 17 bp, Homo sapiens
ctctcccctgacctgtg

SEQ ID NO: 1072733 - DNA, 17 bp, Homo sapiens
ctctcccctgccctgct

SEQ ID NO: 1072734 - DNA, 13 bp, Homo sapiens
ctctccccttggt

SEQ ID NO: 1072735 - DNA, 15 bp, Homo sapiens
ctctccccttggttc

SEQ ID NO: 1072736 - DNA, 23 bp, Homo sapiens
ctctcccggaggttgggtgggcc

SEQ ID NO: 1072737 - DNA, 16 bp, Homo sapiens
ctctcccggctgcctg

SEQ ID NO: 1072738 - DNA, 17 bp, Homo sapiens
ctctcccggctgcctgc

SEQ ID NO: 1072739 - DNA, 21 bp, Homo sapiens
ctctcccgtcagggcccaagt

SEQ ID NO: 1072740 - DNA, 21 bp, Homo sapiens
ctctccctacctccctcctca

SEQ ID NO: 1072741 - DNA, 22 bp, Homo sapiens
ctctccctacctccctcctcag

SEQ ID NO: 1072742 - DNA, 23 bp, Homo sapiens
ctctccctcaacaagggagagac

SEQ ID NO: 1072743 - DNA, 13 bp, Homo sapiens
ctctccctcaggg

SEQ ID NO: 1072744 - DNA, 14 bp, Homo sapiens
ctctccctcagggg

SEQ ID NO: 1072745 - DNA, 13 bp, Homo sapiens
ctctccctcccct

SEQ ID NO: 1072746 - DNA, 13 bp, Homo sapiens
ctctccctctggc

SEQ ID NO: 1072747 - DNA, 19 bp, Homo sapiens
ctctccctctggccctgcc

SEQ ID NO: 1072748 - DNA, 16 bp, Homo sapiens
ctctccctcttctcaa

SEQ ID NO: 1072749 - DNA, 14 bp, Homo sapiens
ctctaaagagcatc

SEQ ID NO: 1072750 - DNA, 15 bp, Homo sapiens
ctctaacagtggaca

SEQ ID NO: 1072751 - DNA, 19 bp, Homo sapiens
ctctaacagtggacaaagt

SEQ ID NO: 1072752 - DNA, 17 bp, Homo sapiens
ctctaaccattcaaatg

SEQ ID NO: 1072753 - DNA, 13 bp, Homo sapiens
ctctaaccctcat

SEQ ID NO: 1072754 - DNA, 19 bp, Homo sapiens
ctctaaccctcattgctgt

SEQ ID NO: 1072755 - DNA, 21 bp, Homo sapiens
ctctaaccctcattgctgtct

SEQ ID NO: 1072756 - DNA, 18 bp, Homo sapiens
ctctaactcactgcctag

SEQ ID NO: 1072757 - DNA, 16 bp, Homo sapiens
ctctaactgtatattt

SEQ ID NO: 1072758 - DNA, 16 bp, Homo sapiens
ctctaagcagccagga

SEQ ID NO: 1072759 - DNA, 14 bp, Homo sapiens
ctctaaggttgggc

SEQ ID NO: 1072760 - DNA, 16 bp, Homo sapiens
ctctaagtcatgtatg

SEQ ID NO: 1072761 - DNA, 21 bp, Homo sapiens
ctctaagtcatgtatgtttct

SEQ ID NO: 1072762 - DNA, 19 bp, Homo sapiens
ctctaagttccactgagct

SEQ ID NO: 1072763 - DNA, 21 bp, Homo sapiens
ctctaagttccactgagctcc

SEQ ID NO: 1072764 - DNA, 13 bp, Homo sapiens
ctctaataataaa

SEQ ID NO: 1072765 - DNA, 15 bp, Homo sapiens
ctctaatagaggcag

SEQ ID NO: 1072766 - DNA, 15 bp, Homo sapiens
ctctaatagtcctgt

SEQ ID NO: 1072767 - DNA, 18 bp, Homo sapiens
ctctaatctaatatataa

SEQ ID NO: 1072768 - DNA, 18 bp, Homo sapiens
ctctaatctggatgttaa

SEQ ID NO: 1072769 - DNA, 16 bp, Homo sapiens
ctctaattcacagtgc

SEQ ID NO: 1072770 - DNA, 20 bp, Homo sapiens
ctctaattcacagtgctctt

SEQ ID NO: 1072771 - DNA, 22 bp, Homo sapiens
ctctaattggaagaaattcctg

SEQ ID NO: 1072772 - DNA, 13 bp, Homo sapiens
ctctacaaaaagc

SEQ ID NO: 1072773 - DNA, 22 bp, Homo sapiens
ctctacaaaaagtaaaaattaa

SEQ ID NO: 1072774 - DNA, 23 bp, Homo sapiens
ctctacacggactgaggtgcctg

SEQ ID NO: 1072775 - DNA, 15 bp, Homo sapiens
ctctacactcttgta

SEQ ID NO: 1072776 - DNA, 20 bp, Homo sapiens
ctctacactgaaacgtattc

SEQ ID NO: 1072777 - DNA, 18 bp, Homo sapiens
ctctacagagcttccctg

SEQ ID NO: 1072778 - DNA, 21 bp, Homo sapiens
ctctacagctaatcagcattc

SEQ ID NO: 1072779 - DNA, 13 bp, Homo sapiens
ctctacagtgcca

SEQ ID NO: 1072780 - DNA, 14 bp, Homo sapiens
ctctaccagtctat

SEQ ID NO: 1072781 - DNA, 20 bp, Homo sapiens
ctctaccatcccctgtagag

SEQ ID NO: 1072782 - DNA, 22 bp, Homo sapiens
ctctaccatttgcagagtcctg

SEQ ID NO: 1072783 - DNA, 14 bp, Homo sapiens
ctctacccaaaccc

SEQ ID NO: 1072784 - DNA, 17 bp, Homo sapiens
ctctacccaaaccctag

SEQ ID NO: 1072785 - DNA, 21 bp, Homo sapiens
ctctacccatcttaaaaacaa

SEQ ID NO: 1072786 - DNA, 18 bp, Homo sapiens
ctctacccatgagcctgc

SEQ ID NO: 1072787 - DNA, 16 bp, Homo sapiens
ctctacccctgctccc

SEQ ID NO: 1072788 - DNA, 16 bp, Homo sapiens
ctctacccctttcttc

SEQ ID NO: 1072789 - DNA, 17 bp, Homo sapiens
ctctacccctttcttct

SEQ ID NO: 1072790 - DNA, 19 bp, Homo sapiens
ctctacccggcccagagac

SEQ ID NO: 1072791 - DNA, 16 bp, Homo sapiens
ctctacctccaccctg

SEQ ID NO: 1072792 - DNA, 20 bp, Homo sapiens
ctctacctctctcctctccg

SEQ ID NO: 1072793 - DNA, 13 bp, Homo sapiens
ctctacctctctt

SEQ ID NO: 1072794 - DNA, 22 bp, Homo sapiens
ctctacgccaaagtgcagccct

SEQ ID NO: 1072795 - DNA, 15 bp, Homo sapiens
ctctactaaaaagaa

SEQ ID NO: 1072796 - DNA, 16 bp, Homo sapiens
ctctactaaaaatgca

SEQ ID NO: 1072797 - DNA, 19 bp, Homo sapiens
ctctactcttacagagcct

SEQ ID NO: 1072798 - DNA, 17 bp, Homo sapiens
ctctactgaatgtcatt

SEQ ID NO: 1072799 - DNA, 17 bp, Homo sapiens
ctctactgttgcacagc

SEQ ID NO: 1072800 - DNA, 18 bp, Homo sapiens
ctctacttaatccaatgg

SEQ ID NO: 1072801 - DNA, 15 bp, Homo sapiens
ctctacttaatgaga

SEQ ID NO: 1072802 - DNA, 17 bp, Homo sapiens
ctctacttccccttctt

SEQ ID NO: 1072803 - DNA, 11 bp, Homo sapiens
ctctagaacat

SEQ ID NO: 1072804 - DNA, 22 bp, Homo sapiens
ctctagaagccaagggaaaggg

SEQ ID NO: 1072805 - DNA, 21 bp, Homo sapiens
ctctagacaagatattgtaca

SEQ ID NO: 1072806 - DNA, 16 bp, Homo sapiens
ctctagacactgccac

SEQ ID NO: 1072807 - DNA, 15 bp, Homo sapiens
ctctagagccttcag

SEQ ID NO: 1072808 - DNA, 22 bp, Homo sapiens
ctctagagggttgctgcctttc

SEQ ID NO: 1072809 - DNA, 14 bp, Homo sapiens
ctctagcaggccta

SEQ ID NO: 1072810 - DNA, 21 bp, Homo sapiens
ctctagccaggagtctgtgct

SEQ ID NO: 1072811 - DNA, 21 bp, Homo sapiens
ctctagccatcccttggggaa

SEQ ID NO: 1072812 - DNA, 22 bp, Homo sapiens
ctctagcctggcaacagagcga

SEQ ID NO: 1072813 - DNA, 14 bp, Homo sapiens
ctctagctggcagg

SEQ ID NO: 1072814 - DNA, 17 bp, Homo sapiens
ctctgagtggaggaagc

SEQ ID NO: 1072815 - DNA, 17 bp, Homo sapiens
ctctgagtttaccattt

SEQ ID NO: 1072816 - DNA, 20 bp, Homo sapiens
ctctgagtttaccatttgta

SEQ ID NO: 1072817 - DNA, 13 bp, Homo sapiens
ctctgagttttga

SEQ ID NO: 1072818 - DNA, 19 bp, Homo sapiens
ctctgagtttttgtatgta

SEQ ID NO: 1072819 - DNA, 20 bp, Homo sapiens
ctctgataatatattttcaa

SEQ ID NO: 1072820 - DNA, 15 bp, Homo sapiens
ctctgatacacagta

SEQ ID NO: 1072821 - DNA, 21 bp, Homo sapiens
ctctgatacacagtaattgtg

SEQ ID NO: 1072822 - DNA, 22 bp, Homo sapiens
ctctgatacacagtaattgtga

SEQ ID NO: 1072823 - DNA, 17 bp, Homo sapiens
ctctgatacccagagca

SEQ ID NO: 1072824 - DNA, 18 bp, Homo sapiens
ctctgatagactttgtga

SEQ ID NO: 1072825 - DNA, 23 bp, Homo sapiens
ctctgatagctgtttcaaatgtg

SEQ ID NO: 1072826 - DNA, 22 bp, Homo sapiens
ctctgatctccataaacatgaa

SEQ ID NO: 1072827 - DNA, 11 bp, Homo sapiens
ctctgatgcag

SEQ ID NO: 1072828 - DNA, 14 bp, Homo sapiens
ctctgatgcagaaa

SEQ ID NO: 1072829 - DNA, 18 bp, Homo sapiens
ctctgatgcagcttatac

SEQ ID NO: 1072830 - DNA, 19 bp, Homo sapiens
ctctgatggaatgtgccac

SEQ ID NO: 1072831 - DNA, 23 bp, Homo sapiens
ctctgatggaatgtgccacctgt

SEQ ID NO: 1072832 - DNA, 22 bp, Homo sapiens
ctctgatggttcttcacctcct

SEQ ID NO: 1072833 - DNA, 13 bp, Homo sapiens
ctctgattcacct

SEQ ID NO: 1072834 - DNA, 18 bp, Homo sapiens
ctctgattggaatttctg

SEQ ID NO: 1072835 - DNA, 20 bp, Homo sapiens
ctctgattggaatttctggc

SEQ ID NO: 1072836 - DNA, 18 bp, Homo sapiens
ctctgatttattttgtat

SEQ ID NO: 1072837 - DNA, 19 bp, Homo sapiens
ctctgattttcaaagcttt

SEQ ID NO: 1072838 - DNA, 22 bp, Homo sapiens
ctctgattttcaaagctttttc

SEQ ID NO: 1072839 - DNA, 14 bp, Homo sapiens
ctctgcaaaggcct

SEQ ID NO: 1072840 - DNA, 15 bp, Homo sapiens
ctctgcaaaggcctg

SEQ ID NO: 1072841 - DNA, 14 bp, Homo sapiens
ctctgcaacacttt

SEQ ID NO: 1072842 - DNA, 14 bp, Homo sapiens
ctctgcaactgctc

SEQ ID NO: 1072843 - DNA, 23 bp, Homo sapiens
ctctgcaatgggcactgggatga

SEQ ID NO: 1072844 - DNA, 16 bp, Homo sapiens
ctctgcaattcccctc

SEQ ID NO: 1072845 - DNA, 19 bp, Homo sapiens
ctctgcaattcccctctgc

SEQ ID NO: 1072846 - DNA, 20 bp, Homo sapiens
ctctctgcagccagcccagc

SEQ ID NO: 1072847 - DNA, 15 bp, Homo sapiens
ctctctgcagctgcc

SEQ ID NO: 1072848 - DNA, 14 bp, Homo sapiens
ctctctgccctctc

SEQ ID NO: 1072849 - DNA, 15 bp, Homo sapiens
ctctctgccctgtgt

SEQ ID NO: 1072850 - DNA, 16 bp, Homo sapiens
ctctctgcctgtaaat

SEQ ID NO: 1072851 - DNA, 12 bp, Homo sapiens
ctctctgctcat

SEQ ID NO: 1072852 - DNA, 12 bp, Homo sapiens
ctctctgctcct

SEQ ID NO: 1072853 - DNA, 13 bp, Homo sapiens
ctctctgctcctt

SEQ ID NO: 1072854 - DNA, 14 bp, Homo sapiens
ctctctgctctagc

SEQ ID NO: 1072855 - DNA, 17 bp, Homo sapiens
ctctctgctctagccag

SEQ ID NO: 1072856 - DNA, 18 bp, Homo sapiens
ctctctgctctagccagg

SEQ ID NO: 1072857 - DNA, 22 bp, Homo sapiens
ctctctgctctgcgtgtcacct

SEQ ID NO: 1072858 - DNA, 17 bp, Homo sapiens
ctctctgctgagctggg

SEQ ID NO: 1072859 - DNA, 17 bp, Homo sapiens
ctctctggaaagaggct

SEQ ID NO: 1072860 - DNA, 13 bp, Homo sapiens
ctctctggcctcc

SEQ ID NO: 1072861 - DNA, 17 bp, Homo sapiens
ctctctggcctcccacc

SEQ ID NO: 1072862 - DNA, 19 bp, Homo sapiens
ctctctggcctcccacccg

SEQ ID NO: 1072863 - DNA, 18 bp, Homo sapiens
ctctctggctggtcttca

SEQ ID NO: 1072864 - DNA, 13 bp, Homo sapiens
ctctctgggacct

SEQ ID NO: 1072865 - DNA, 12 bp, Homo sapiens
ctctctgggact

SEQ ID NO: 1072866 - DNA, 20 bp, Homo sapiens
ctctctgggcccaggggctg

SEQ ID NO: 1072867 - DNA, 22 bp, Homo sapiens
ctctctggggaagtcaggggag

SEQ ID NO: 1072868 - DNA, 22 bp, Homo sapiens
ctctctggggccctgggcctca

SEQ ID NO: 1072869 - DNA, 18 bp, Homo sapiens
ctctctgggggaggcagg

SEQ ID NO: 1072870 - DNA, 21 bp, Homo sapiens
ctctctgggggaggcagggct

SEQ ID NO: 1072871 - DNA, 23 bp, Homo sapiens
ctctctgtcccttgctgtatgct

SEQ ID NO: 1072872 - DNA, 15 bp, Homo sapiens
ctctctgtgaataca

SEQ ID NO: 1072873 - DNA, 19 bp, Homo sapiens
ctctcttatagaatattta

SEQ ID NO: 1072874 - DNA, 9 bp, Homo sapiens
ctctcttca

SEQ ID NO: 1072875 - DNA, 16 bp, Homo sapiens
ctctcttcaatctctg

SEQ ID NO: 1072876 - DNA, 18 bp, Homo sapiens
ctctcttcaatctctgga

SEQ ID NO: 1072877 - DNA, 12 bp, Homo sapiens
ctctcttccctc

SEQ ID NO: 1072878 - DNA, 15 bp, Homo sapiens
ctctcttccctcaga

SEQ ID NO: 1072879 - DNA, 18 bp, Homo sapiens
ctctcttcgtcctgatcc

SEQ ID NO: 1072880 - DNA, 15 bp, Homo sapiens
ctctcttctgctcca

SEQ ID NO: 1072881 - DNA, 13 bp, Homo sapiens
ctctcttgccagc

SEQ ID NO: 1072882 - DNA, 14 bp, Homo sapiens
ctctcttgcccctt

SEQ ID NO: 1072883 - DNA, 10 bp, Homo sapiens
ctctgtctca

SEQ ID NO: 1072884 - DNA, 14 bp, Homo sapiens
ctctgtctcatcct

SEQ ID NO: 1072885 - DNA, 21 bp, Homo sapiens
ctctgtctcatcctcctggaa

SEQ ID NO: 1072886 - DNA, 14 bp, Homo sapiens
ctctgtctcccagg

SEQ ID NO: 1072887 - DNA, 15 bp, Homo sapiens
ctctgtctcccaggc

SEQ ID NO: 1072888 - DNA, 18 bp, Homo sapiens
ctctgtctcccaggctgc

SEQ ID NO: 1072889 - DNA, 19 bp, Homo sapiens
ctctgtctcccaggctgga

SEQ ID NO: 1072890 - DNA, 20 bp, Homo sapiens
ctctgtctcccaggctggag

SEQ ID NO: 1072891 - DNA, 18 bp, Homo sapiens
ctctgtctctcctagccc

SEQ ID NO: 1072892 - DNA, 22 bp, Homo sapiens
ctctgtctctcctagcccctct

SEQ ID NO: 1072893 - DNA, 16 bp, Homo sapiens
ctctgtctctgtggaa

SEQ ID NO: 1072894 - DNA, 18 bp, Homo sapiens
ctctgtctgtctctcccc

SEQ ID NO: 1072895 - DNA, 23 bp, Homo sapiens
ctctgtctgtctctccccctctg

SEQ ID NO: 1072896 - DNA, 17 bp, Homo sapiens
ctctgtcttcaaggact

SEQ ID NO: 1072897 - DNA, 16 bp, Homo sapiens
ctctgtcttctctcca

SEQ ID NO: 1072898 - DNA, 18 bp, Homo sapiens
ctctgtcttctctccact

SEQ ID NO: 1072899 - DNA, 19 bp, Homo sapiens
ctctgtcttttctcctccg

SEQ ID NO: 1072900 - DNA, 23 bp, Homo sapiens
ctctgtgaacgatttagaaagaa

SEQ ID NO: 1072901 - DNA, 14 bp, Homo sapiens
ctctgtgaatacaa

SEQ ID NO: 1072902 - DNA, 19 bp, Homo sapiens
ctctgtgaatacaattaaa

SEQ ID NO: 1072903 - DNA, 14 bp, Homo sapiens
ctctgtgaccaatg

SEQ ID NO: 1072904 - DNA, 23 bp, Homo sapiens
ctctgtgacctgccccgcccagc

SEQ ID NO: 1072905 - DNA, 17 bp, Homo sapiens
ctctgtgagggtgctga

SEQ ID NO: 1072906 - DNA, 15 bp, Homo sapiens
ctctgtgattacata

SEQ ID NO: 1072907 - DNA, 14 bp, Homo sapiens
ctctgtgcacagtg

SEQ ID NO: 1072908 - DNA, 13 bp, Homo sapiens
ctctgtgctgtgt

SEQ ID NO: 1072909 - DNA, 20 bp, Homo sapiens
ctctgtggaaaagccatctc

SEQ ID NO: 1072910 - DNA, 22 bp, Homo sapiens
ctctgtggaaaagccatctcag

SEQ ID NO: 1072911 - DNA, 13 bp, Homo sapiens
ctctgtggcctgt

SEQ ID NO: 1072912 - DNA, 16 bp, Homo sapiens
ctctgtggcctgtctc

SEQ ID NO: 1072913 - DNA, 16 bp, Homo sapiens
ctctgtgggtctctgg

SEQ ID NO: 1072914 - DNA, 14 bp, Homo sapiens
ctctgtgtatttat

SEQ ID NO: 1072915 - DNA, 20 bp, Homo sapiens
ctctgtgtatttatataaaa

SEQ ID NO: 1072916 - DNA, 18 bp, Homo sapiens
ctctgtgtatttgctttt

SEQ ID NO: 1072917 - DNA, 19 bp, Homo sapiens
ctctgtgtatttgcttttt

SEQ ID NO: 1072918 - DNA, 15 bp, Homo sapiens
ctctgtgtgcacaaa

SEQ ID NO: 1072919 - DNA, 16 bp, Homo sapiens
ctctgtgttcccagag

SEQ ID NO: 1072920 - DNA, 22 bp, Homo sapiens
ctctgtgtttgaagtttcagtt

SEQ ID NO: 1072921 - DNA, 11 bp, Homo sapiens
ctctgttaaca

SEQ ID NO: 1072922 - DNA, 19 bp, Homo sapiens
ctctgttaacatctagcct

SEQ ID NO: 1072923 - DNA, 21 bp, Homo sapiens
ctctgttaggtccattttcta

SEQ ID NO: 1072924 - DNA, 19 bp, Homo sapiens
ctctgttatcagctgggca

SEQ ID NO: 1072925 - DNA, 16 bp, Homo sapiens
ctctgttcccccaccc

SEQ ID NO: 1072926 - DNA, 21 bp, Homo sapiens
ctctgttcccccaccctccat

SEQ ID NO: 1072927 - DNA, 15 bp, Homo sapiens
ctctgttcccttcct

SEQ ID NO: 1072928 - DNA, 19 bp, Homo sapiens
ctctgttcccttcctcacc

SEQ ID NO: 1072929 - DNA, 21 bp, Homo sapiens
ctctgttcctcaatggccttt

SEQ ID NO: 1072930 - DNA, 16 bp, Homo sapiens
ctctgttccttcacat

SEQ ID NO: 1072931 - DNA, 22 bp, Homo sapiens
ctctgttccttcacatcctgtg

SEQ ID NO: 1072932 - DNA, 19 bp, Homo sapiens
ctctgttctgcacacagca

SEQ ID NO: 1072933 - DNA, 21 bp, Homo sapiens
ctctgttctgcacacagcacg

SEQ ID NO: 1072934 - DNA, 17 bp, Homo sapiens
ctctgttgagtaaaaca

SEQ ID NO: 1072935 - DNA, 20 bp, Homo sapiens
ctctgttgatctacccgtgc

SEQ ID NO: 1072936 - DNA, 17 bp, Homo sapiens
ctctgttgcccaggctg

SEQ ID NO: 1072937 - DNA, 14 bp, Homo sapiens
ctctgttgcgctcc

SEQ ID NO: 1072938 - DNA, 19 bp, Homo sapiens
ctctgttggtccactgtgt

SEQ ID NO: 1072939 - DNA, 20 bp, Homo sapiens
ctctgttggtccactgtgtt

SEQ ID NO: 1072940 - DNA, 16 bp, Homo sapiens
ctctgtttctccttct

SEQ ID NO: 1072941 - DNA, 18 bp, Homo sapiens
ctctgtttgatgctattt

SEQ ID NO: 1072942 - DNA, 18 bp, Homo sapiens
ctctgtttgtgggactgg

SEQ ID NO: 1072943 - DNA, 18 bp, Homo sapiens
ctcttaaaaagacactta

SEQ ID NO: 1072944 - DNA, 13 bp, Homo sapiens
ctcttaaaaccca

SEQ ID NO: 1072945 - DNA, 14 bp, Homo sapiens
ctcttaaaatatct

SEQ ID NO: 1072946 - DNA, 15 bp, Homo sapiens
ctcttaaataaaaat

SEQ ID NO: 1072947 - DNA, 15 bp, Homo sapiens
ctcttaaatcatttg

SEQ ID NO: 1072948 - DNA, 17 bp, Homo sapiens
ctcttaacaatttctgt

SEQ ID NO: 1072949 - DNA, 16 bp, Homo sapiens
ctcttaatcactactg

SEQ ID NO: 1072950 - DNA, 18 bp, Homo sapiens
ctcttaatcactactgta

SEQ ID NO: 1072951 - DNA, 15 bp, Homo sapiens
ctcttaatctgtgtg

SEQ ID NO: 1072952 - DNA, 21 bp, Homo sapiens
ctcttaatctgtgtgtatatt

SEQ ID NO: 1072953 - DNA, 17 bp, Homo sapiens
ctcttaattgttcattt

SEQ ID NO: 1072954 - DNA, 22 bp, Homo sapiens
ctcttacaataagctaaacgca

SEQ ID NO: 1072955 - DNA, 14 bp, Homo sapiens
ctcttacagagcct

SEQ ID NO: 1072956 - DNA, 20 bp, Homo sapiens
ctcttacagctttgccttgt

SEQ ID NO: 1072957 - DNA, 21 bp, Homo sapiens
ctcttacctgttatttatcaa

SEQ ID NO: 1072958 - DNA, 14 bp, Homo sapiens
ctcttactctttcc

SEQ ID NO: 1072959 - DNA, 20 bp, Homo sapiens
ctcttactctttcctatttc

SEQ ID NO: 1072960 - DNA, 19 bp, Homo sapiens
ctcttagaagccatgggac

SEQ ID NO: 1072961 - DNA, 19 bp, Homo sapiens
ctcttaggaagagaaacca

SEQ ID NO: 1072962 - DNA, 12 bp, Homo sapiens
ctcttaggtcag

SEQ ID NO: 1072963 - DNA, 14 bp, Homo sapiens
ctcttagtcccaag

SEQ ID NO: 1072964 - DNA, 20 bp, Homo sapiens
ctcttagtgcccgcctagga

SEQ ID NO: 1072965 - DNA, 21 bp, Homo sapiens
ctcttatagaatatttattac

SEQ ID NO: 1072966 - DNA, 17 bp, Homo sapiens
ctcttatcctctctctc

SEQ ID NO: 1072967 - DNA, 18 bp, Homo sapiens
ctcttatctcatcctttc

SEQ ID NO: 1072968 - DNA, 16 bp, Homo sapiens
ctcttatgtgtgcctt

SEQ ID NO: 1072969 - DNA, 18 bp, Homo sapiens
ctcttattccaggagaag

SEQ ID NO: 1072970 - DNA, 12 bp, Homo sapiens
ctcttattctaa

SEQ ID NO: 1072971 - DNA, 17 bp, Homo sapiens
ctcttcaactgaccagc

SEQ ID NO: 1072972 - DNA, 15 bp, Homo sapiens
ctcttcaatctctgg

SEQ ID NO: 1072973 - DNA, 16 bp, Homo sapiens
ctcttcaccccccact

SEQ ID NO: 1072974 - DNA, 18 bp, Homo sapiens
ctcttcaccccccactca

SEQ ID NO: 1072975 - DNA, 20 bp, Homo sapiens
ctcttcactgtggccacagc

SEQ ID NO: 1072976 - DNA, 21 bp, Homo sapiens
ctcttcactgtggccacagcc

SEQ ID NO: 1072977 - DNA, 12 bp, Homo sapiens
ctcttcagaact

SEQ ID NO: 1072978 - DNA, 19 bp, Homo sapiens
ctcttcagatctctaactt

SEQ ID NO: 1072979 - DNA, 13 bp, Homo sapiens
ctcttcaggcctc

SEQ ID NO: 1072980 - DNA, 16 bp, Homo sapiens
ctcttcaggcctccct

SEQ ID NO: 1072981 - DNA, 18 bp, Homo sapiens
ctcttcaggcctccctct

SEQ ID NO: 1072982 - DNA, 19 bp, Homo sapiens
ctcttcaggcctccctctc

SEQ ID NO: 1072983 - DNA, 12 bp, Homo sapiens
ctcttcaggttc

SEQ ID NO: 1072984 - DNA, 18 bp, Homo sapiens
ctcttcagttaattctta

SEQ ID NO: 1072985 - DNA, 22 bp, Homo sapiens
ctcttcatgcttgacataccta

SEQ ID NO: 1072986 - DNA, 18 bp, Homo sapiens
ctcttcattattctctgc

SEQ ID NO: 1072987 - DNA, 13 bp, Homo sapiens
ctcttcatttctg

SEQ ID NO: 1072988 - DNA, 13 bp, Homo sapiens
ctcttcatttttt

SEQ ID NO: 1072989 - DNA, 21 bp, Homo sapiens
ctcttcatttttttttcaatc

SEQ ID NO: 1072990 - DNA, 22 bp, Homo sapiens
ctcttccagaagatgccctcca

SEQ ID NO: 1072991 - DNA, 16 bp, Homo sapiens
ctcttccagcttcttt

SEQ ID NO: 1072992 - DNA, 23 bp, Homo sapiens
ctctgtccccacgaggggaccca

SEQ ID NO: 1072993 - DNA, 14 bp, Homo sapiens
ctctgtccccaggc

SEQ ID NO: 1072994 - DNA, 18 bp, Homo sapiens
ctctgtccccaggcctgg

SEQ ID NO: 1072995 - DNA, 20 bp, Homo sapiens
ctctgtccccaggcctggct

SEQ ID NO: 1072996 - DNA, 14 bp, Homo sapiens
ctctgtccctgtcc

SEQ ID NO: 1072997 - DNA, 16 bp, Homo sapiens
ctctgtccctgtcctt

SEQ ID NO: 1072998 - DNA, 13 bp, Homo sapiens
ctctgtcctccca

SEQ ID NO: 1072999 - DNA, 14 bp, Homo sapiens
ctctgtcctcccat

SEQ ID NO: 1073000 - DNA, 17 bp, Homo sapiens
ctctgtcctcccatccc

SEQ ID NO: 1073001 - DNA, 20 bp, Homo sapiens
ctctgtctaggactgcagtg

SEQ ID NO: 1073002 - DNA, 23 bp, Homo sapiens
ctctgtctaggactgcagtgtgg

SEQ ID NO: 1073003 - DNA, 17 bp, Homo sapiens
ctgaaacactgcttctc

SEQ ID NO: 1073004 - DNA, 13 bp, Homo sapiens
ctgaaacactgga

SEQ ID NO: 1073005 - DNA, 18 bp, Homo sapiens
ctgaaacactggacctgg

SEQ ID NO: 1073006 - DNA, 20 bp, Homo sapiens
ctgaaacactggacctgggg

SEQ ID NO: 1073007 - DNA, 20 bp, Homo sapiens
ctgaaacattcacacagggc

SEQ ID NO: 1073008 - DNA, 16 bp, Homo sapiens
ctgaaaccaaaacata

SEQ ID NO: 1073009 - DNA, 23 bp, Homo sapiens
ctgaaacccaaagccctggtaaa

SEQ ID NO: 1073010 - DNA, 15 bp, Homo sapiens
ctgaaacccacagat

SEQ ID NO: 1073011 - DNA, 22 bp, Homo sapiens
ctgaaacccacagatgtctctg

SEQ ID NO: 1073012 - DNA, 23 bp, Homo sapiens
ctgaaaccttagtttcaagagtc

SEQ ID NO: 1073013 - DNA, 20 bp, Homo sapiens
ctgaaacgtattcagagtta

SEQ ID NO: 1073014 - DNA, 14 bp, Homo sapiens
ctgaaagaaacagt

SEQ ID NO: 1073015 - DNA, 15 bp, Homo sapiens
ctgaaagaaacagtt

SEQ ID NO: 1073016 - DNA, 19 bp, Homo sapiens
ctgaaagaaacagttaact

SEQ ID NO: 1073017 - DNA, 19 bp, Homo sapiens
ctgaaagaacatggacttg

SEQ ID NO: 1073018 - DNA, 23 bp, Homo sapiens
ctgaaagaagaaaacagtacaga

SEQ ID NO: 1073019 - DNA, 19 bp, Homo sapiens
ctgaaagaagaacagctgt

SEQ ID NO: 1073020 - DNA, 20 bp, Homo sapiens
ctgaaagaagaacagctgtt

SEQ ID NO: 1073021 - DNA, 23 bp, Homo sapiens
ctgaaagaagaacagctgttcct

SEQ ID NO: 1073022 - DNA, 16 bp, Homo sapiens
ctgaaagacagaatgt

SEQ ID NO: 1073023 - DNA, 21 bp, Homo sapiens
ctgaaagacagaatgtcacca

SEQ ID NO: 1073024 - DNA, 20 bp, Homo sapiens
ctgaaagacagtatgagaaa

SEQ ID NO: 1073025 - DNA, 21 bp, Homo sapiens
ctgaaagactgaagaaagtgt

SEQ ID NO: 1073026 - DNA, 14 bp, Homo sapiens
ctgaaagaggctga

SEQ ID NO: 1073027 - DNA, 20 bp, Homo sapiens
ctgaaagatctctgtcacat

SEQ ID NO: 1073028 - DNA, 13 bp, Homo sapiens
ctgaaagcagcag

SEQ ID NO: 1073029 - DNA, 18 bp, Homo sapiens
ctgaaagcagcagctagg

SEQ ID NO: 1073030 - DNA, 16 bp, Homo sapiens
ctgaaagccaaggcag

SEQ ID NO: 1073031 - DNA, 11 bp, Homo sapiens
ctgaaagccac

SEQ ID NO: 1073032 - DNA, 21 bp, Homo sapiens
ctgaaagccacgttccttact

SEQ ID NO: 1073033 - DNA, 23 bp, Homo sapiens
ctgaaagccagctgccgaccaga

SEQ ID NO: 1073034 - DNA, 16 bp, Homo sapiens
ctgaaagccctgagct

SEQ ID NO: 1073035 - DNA, 12 bp, Homo sapiens
ctgaaagcctgt

SEQ ID NO: 1073036 - DNA, 15 bp, Homo sapiens
ctgaaagcctgtctc

SEQ ID NO: 1073037 - DNA, 23 bp, Homo sapiens
ctgaaagcctgtctctttccact

SEQ ID NO: 1073038 - DNA, 16 bp, Homo sapiens
ctgaaaggaacactgg

SEQ ID NO: 1073039 - DNA, 18 bp, Homo sapiens
ctgaaaggaaggtttcta

SEQ ID NO: 1073040 - DNA, 22 bp, Homo sapiens
ctgaaagggcacttaatttgta

SEQ ID NO: 1073041 - DNA, 18 bp, Homo sapiens
ctgaaagtcctgctttcc

SEQ ID NO: 1073042 - DNA, 23 bp, Homo sapiens
ctgaaagtgaaagtccagaaact

SEQ ID NO: 1073043 - DNA, 13 bp, Homo sapiens
ctgaaagtgtttt

SEQ ID NO: 1073044 - DNA, 21 bp, Homo sapiens
ctgaaagtgttttactctttt

SEQ ID NO: 1073045 - DNA, 23 bp, Homo sapiens
ctgaaagtgttttactctttttc

SEQ ID NO: 1073046 - DNA, 12 bp, Homo sapiens
ctgaaagttggc

SEQ ID NO: 1073047 - DNA, 16 bp, Homo sapiens
ctgaaagttttgtaaa

SEQ ID NO: 1073048 - DNA, 17 bp, Homo sapiens
ctgaaagttttgtaaaa

SEQ ID NO: 1073049 - DNA, 23 bp, Homo sapiens
ctgaaagttttgtaaaagaaatc

SEQ ID NO: 1073050 - DNA, 15 bp, Homo sapiens
ctgaaataatatatt

SEQ ID NO: 1073051 - DNA, 18 bp, Homo sapiens
ctgaaatatccacccagc

SEQ ID NO: 1073052 - DNA, 22 bp, Homo sapiens
ctgaaatgaaacaaataatcac

SEQ ID NO: 1073053 - DNA, 21 bp, Homo sapiens
ctgaaatgccaagtgcctgct

SEQ ID NO: 1073054 - DNA, 22 bp, Homo sapiens
ctgaaatgccaagtgcctgctt

SEQ ID NO: 1073055 - DNA, 20 bp, Homo sapiens
ctgaaatgctgcattttaat

SEQ ID NO: 1073056 - DNA, 18 bp, Homo sapiens
ctgaaatgtcagttctga

SEQ ID NO: 1073057 - DNA, 19 bp, Homo sapiens
ctgaaatgtcagttctgat

SEQ ID NO: 1073058 - DNA, 15 bp, Homo sapiens
ctgaaatgttcttaa

SEQ ID NO: 1073059 - DNA, 11 bp, Homo sapiens
ctgaaattaaa

SEQ ID NO: 1073060 - DNA, 17 bp, Homo sapiens
ctgaaattaatttgtga

SEQ ID NO: 1073061 - DNA, 19 bp, Homo sapiens
ctgaaattatatatataca

SEQ ID NO: 1073062 - DNA, 18 bp, Homo sapiens
ctgaaattcaaaatgctc

SEQ ID NO: 1073063 - DNA, 14 bp, Homo sapiens
ctgaaattctcctg

SEQ ID NO: 1073064 - DNA, 19 bp, Homo sapiens
ctgaaattctcctggaggt

SEQ ID NO: 1073065 - DNA, 20 bp, Homo sapiens
ctgaaattctcctggaggtc

SEQ ID NO: 1073066 - DNA, 23 bp, Homo sapiens
ctgaaattgagaatccagtttct

SEQ ID NO: 1073067 - DNA, 18 bp, Homo sapiens
ctgaaatttattcacata

SEQ ID NO: 1073068 - DNA, 22 bp, Homo sapiens
ctgaaatttgttatacttcaaa

SEQ ID NO: 1073069 - DNA, 16 bp, Homo sapiens
ctgaaatttttcttct

SEQ ID NO: 1073070 - DNA, 16 bp, Homo sapiens
ctgaacaaaacctaca

SEQ ID NO: 1073071 - DNA, 17 bp, Homo sapiens
ctgaacaaaagctcagg

SEQ ID NO: 1073072 - DNA, 20 bp, Homo sapiens
ctgaacaaacactgaatcat

SEQ ID NO: 1073073 - DNA, 13 bp, Homo sapiens
ctgaacaagaatt

SEQ ID NO: 1073074 - DNA, 16 bp, Homo sapiens
ctgaacacacacgcca

SEQ ID NO: 1073075 - DNA, 21 bp, Homo sapiens
ctgaacacacacgccagctcc

SEQ ID NO: 1073076 - DNA, 17 bp, Homo sapiens
ctgaacacagtgtctgt

SEQ ID NO: 1073077 - DNA, 22 bp, Homo sapiens
ctgaacacagtgtctgttcagc

SEQ ID NO: 1073078 - DNA, 19 bp, Homo sapiens
ctgaacactttaggtagat

SEQ ID NO: 1073079 - DNA, 20 bp, Homo sapiens
ctgaacacttttgttgtaaa

SEQ ID NO: 1073080 - DNA, 13 bp, Homo sapiens
ctgaacagaagct

SEQ ID NO: 1073081 - DNA, 13 bp, Homo sapiens
ctgaacagctgta

SEQ ID NO: 1073082 - DNA, 17 bp, Homo sapiens
ctgaacaggctggggcc

SEQ ID NO: 1073083 - DNA, 13 bp, Homo sapiens
ctgaacaggttct

SEQ ID NO: 1073084 - DNA, 12 bp, Homo sapiens
ctgaacagtgga

SEQ ID NO: 1073085 - DNA, 20 bp, Homo sapiens
ctgaacatctgagtcctgga

SEQ ID NO: 1073086 - DNA, 23 bp, Homo sapiens
ctgaacatctgagtcctggatga

SEQ ID NO: 1073087 - DNA, 13 bp, Homo sapiens
ctgaacatgcctg

SEQ ID NO: 1073088 - DNA, 18 bp, Homo sapiens
ctgaacatgcctgccaaa

SEQ ID NO: 1073089 - DNA, 13 bp, Homo sapiens
ctgaacatgttta

SEQ ID NO: 1073090 - DNA, 15 bp, Homo sapiens
ctgaacatgtttaca

SEQ ID NO: 1073091 - DNA, 15 bp, Homo sapiens
ctgaacattccagag

SEQ ID NO: 1073092 - DNA, 21 bp, Homo sapiens
ctgaaccaacagaagcagact

SEQ ID NO: 1073093 - DNA, 13 bp, Homo sapiens
ctgaaccacagaa

SEQ ID NO: 1073094 - DNA, 14 bp, Homo sapiens
ctgaaccacagaaa

SEQ ID NO: 1073095 - DNA, 17 bp, Homo sapiens
ctgaaccacgaggctgc

SEQ ID NO: 1073096 - DNA, 18 bp, Homo sapiens
ctgaaccacgaggctgcc

SEQ ID NO: 1073097 - DNA, 19 bp, Homo sapiens
ctgaaccacgaggctgccc

SEQ ID NO: 1073098 - DNA, 20 bp, Homo sapiens
ctgaaccactgcttctcttt

SEQ ID NO: 1073099 - DNA, 21 bp, Homo sapiens
ctgaaccactgcttctctttt

SEQ ID NO: 1073100 - DNA, 21 bp, Homo sapiens
ctgaaccagccacgaacagcc

SEQ ID NO: 1073101 - DNA, 14 bp, Homo sapiens
ctgaacccacacct

SEQ ID NO: 1073102 - DNA, 18 bp, Homo sapiens
ctgaacccacacctgggc

SEQ ID NO: 1073103 - DNA, 18 bp, Homo sapiens
ctgaacccagctgtgccc

SEQ ID NO: 1073104 - DNA, 21 bp, Homo sapiens
ctgaacccagctgtgcccctc

SEQ ID NO: 1073105 - DNA, 22 bp, Homo sapiens
ctgaacccagctgtgcccctcc

SEQ ID NO: 1073106 - DNA, 19 bp, Homo sapiens
ctgaaccccatgggcttgg

SEQ ID NO: 1073107 - DNA, 16 bp, Homo sapiens
ctgaacccctccctcc

SEQ ID NO: 1073108 - DNA, 16 bp, Homo sapiens
ctgaacccgtccattc

SEQ ID NO: 1073109 - DNA, 17 bp, Homo sapiens
ctgaaccgactgaccct

SEQ ID NO: 1073110 - DNA, 21 bp, Homo sapiens
ctgaaccgactgaccctgagg

SEQ ID NO: 1073111 - DNA, 16 bp, Homo sapiens
ctgaaccgcaaggagc

SEQ ID NO: 1073112 - DNA, 17 bp, Homo sapiens
ctgaaccgcacagctca

SEQ ID NO: 1073113 - DNA, 19 bp, Homo sapiens
ctgaaccgcacagctcagg

SEQ ID NO: 1073114 - DNA, 23 bp, Homo sapiens
ctgaaccgcaccccatcccacca

SEQ ID NO: 1073115 - DNA, 16 bp, Homo sapiens
ctgaaccttgagcaaa

SEQ ID NO: 1073116 - DNA, 16 bp, Homo sapiens
ctgaacgttttcttct

SEQ ID NO: 1073117 - DNA, 17 bp, Homo sapiens
ctgaacgttttcttctt

SEQ ID NO: 1073118 - DNA, 23 bp, Homo sapiens
ctgaactaagttttgtgtgtata

SEQ ID NO: 1073119 - DNA, 23 bp, Homo sapiens
ctgaactacaagtgtaggccacc

SEQ ID NO: 1073120 - DNA, 13 bp, Homo sapiens
ctgaactccagag

SEQ ID NO: 1073121 - DNA, 21 bp, Homo sapiens
ctgaactccatacagcctcta

SEQ ID NO: 1073122 - DNA, 21 bp, Homo sapiens
ctgaactcctgccatagtctt

SEQ ID NO: 1073123 - DNA, 17 bp, Homo sapiens
ctgaactccttccccac

SEQ ID NO: 1073124 - DNA, 13 bp, Homo sapiens
ctgaactctcaaa

SEQ ID NO: 1073125 - DNA, 18 bp, Homo sapiens
ctgaactctcaaaagtct

SEQ ID NO: 1073126 - DNA, 23 bp, Homo sapiens
ctgaactcttcagaacacacaga

SEQ ID NO: 1073127 - DNA, 15 bp, Homo sapiens
ctgaactgacaatga

SEQ ID NO: 1073128 - DNA, 13 bp, Homo sapiens
ctgaactgagaag

SEQ ID NO: 1073129 - DNA, 14 bp, Homo sapiens
ctgaactgagaagg

SEQ ID NO: 1073130 - DNA, 23 bp, Homo sapiens
ctgaactgaggagatgaccaggg

SEQ ID NO: 1073131 - DNA, 16 bp, Homo sapiens
ctgaactgaggccttg

SEQ ID NO: 1073132 - DNA, 21 bp, Homo sapiens
ctgaactgctctactttgaga

SEQ ID NO: 1073133 - DNA, 15 bp, Homo sapiens
ctgaactgtgtgtaa

SEQ ID NO: 1073134 - DNA, 13 bp, Homo sapiens
ctgaactgtttgg

SEQ ID NO: 1073135 - DNA, 22 bp, Homo sapiens
ctgaacttcaggataataaagt

SEQ ID NO: 1073136 - DNA, 17 bp, Homo sapiens
ctgaactttctccctca

SEQ ID NO: 1073137 - DNA, 14 bp, Homo sapiens
ctgaagaaaaaatc

SEQ ID NO: 1073138 - DNA, 13 bp, Homo sapiens
ctgaagaaagtgt

SEQ ID NO: 1073139 - DNA, 19 bp, Homo sapiens
ctgaagaaatcctgggaat

SEQ ID NO: 1073140 - DNA, 17 bp, Homo sapiens
ctgaagaattaagatac

SEQ ID NO: 1073141 - DNA, 20 bp, Homo sapiens
ctgaagaattttgagtgaat

SEQ ID NO: 1073142 - DNA, 15 bp, Homo sapiens
ctgaagacctttaat

SEQ ID NO: 1073143 - DNA, 19 bp, Homo sapiens
ctgaagacgagcatccccc

SEQ ID NO: 1073144 - DNA, 18 bp, Homo sapiens
ctgaagactctgcagccc

SEQ ID NO: 1073145 - DNA, 20 bp, Homo sapiens
ctgaagactctgcagccctc

SEQ ID NO: 1073146 - DNA, 17 bp, Homo sapiens
ctgaagactgagaactt

SEQ ID NO: 1073147 - DNA, 21 bp, Homo sapiens
ctgaagactgagaactttttt

SEQ ID NO: 1073148 - DNA, 14 bp, Homo sapiens
ctgaagactgagga

SEQ ID NO: 1073149 - DNA, 16 bp, Homo sapiens
ctgaagactgcacagg

SEQ ID NO: 1073150 - DNA, 13 bp, Homo sapiens
ctgaagagcaagg

SEQ ID NO: 1073151 - DNA, 14 bp, Homo sapiens
ctgaagaggcgggc

SEQ ID NO: 1073152 - DNA, 23 bp, Homo sapiens
ctgaagaggcgggccagccaggc

SEQ ID NO: 1073153 - DNA, 14 bp, Homo sapiens
ctgaagagtcctct

SEQ ID NO: 1073154 - DNA, 16 bp, Homo sapiens
ctgaagagtcctctga

SEQ ID NO: 1073155 - DNA, 22 bp, Homo sapiens
ctgaagatgcccctgctccctc

SEQ ID NO: 1073156 - DNA, 15 bp, Homo sapiens
ctgaagatgccttga

SEQ ID NO: 1073157 - DNA, 11 bp, Homo sapiens
ctgaagatgtc

SEQ ID NO: 1073158 - DNA, 19 bp, Homo sapiens
ctgaagcaggttcccaagc

SEQ ID NO: 1073159 - DNA, 20 bp, Homo sapiens
ctgaagccacttggcccaga

SEQ ID NO: 1073160 - DNA, 14 bp, Homo sapiens
ctgaagccagctgc

SEQ ID NO: 1073161 - DNA, 21 bp, Homo sapiens
ctgaagccatgtagccaccca

SEQ ID NO: 1073162 - DNA, 13 bp, Homo sapiens
ctgaagcctctgc

SEQ ID NO: 1073163 - DNA, 17 bp, Homo sapiens
ctgaagcgactctcctg

SEQ ID NO: 1073164 - DNA, 15 bp, Homo sapiens
ctgaagcttgactcc

SEQ ID NO: 1073165 - DNA, 14 bp, Homo sapiens
ctgaaggaaaaaca

SEQ ID NO: 1073166 - DNA, 17 bp, Homo sapiens
ctgaaggaaaaacacaa

SEQ ID NO: 1073167 - DNA, 22 bp, Homo sapiens
ctgaaggaaaagcaagaaacag

SEQ ID NO: 1073168 - DNA, 14 bp, Homo sapiens
ctgaaggaagagaa

SEQ ID NO: 1073169 - DNA, 20 bp, Homo sapiens
ctgaaggaatagccagagag

SEQ ID NO: 1073170 - DNA, 23 bp, Homo sapiens
ctgaaggaatagccagagaggag

SEQ ID NO: 1073171 - DNA, 20 bp, Homo sapiens
ctgaaggaccccaggtaaga

SEQ ID NO: 1073172 - DNA, 12 bp, Homo sapiens
ctgaaggagaag

SEQ ID NO: 1073173 - DNA, 13 bp, Homo sapiens
ctgaaggagcccc

SEQ ID NO: 1073174 - DNA, 19 bp, Homo sapiens
ctgaaggctaaaaagcaac

SEQ ID NO: 1073175 - DNA, 17 bp, Homo sapiens
ctgaagggaactagagg

SEQ ID NO: 1073176 - DNA, 20 bp, Homo sapiens
ctgaagggaaggcaaaggca

SEQ ID NO: 1073177 - DNA, 16 bp, Homo sapiens
ctgaaggggcacacca

SEQ ID NO: 1073178 - DNA, 20 bp, Homo sapiens
ctgaaggggcacaccactgc

SEQ ID NO: 1073179 - DNA, 22 bp, Homo sapiens
ctgaaggggcacaccactgccc

SEQ ID NO: 1073180 - DNA, 20 bp, Homo sapiens
ctgaaggggcgtctgttccc

SEQ ID NO: 1073181 - DNA, 21 bp, Homo sapiens
ctgaaggggtgcacccacctg

SEQ ID NO: 1073182 - DNA, 22 bp, Homo sapiens
ctgaaggggtgcacccacctgt

SEQ ID NO: 1073183 - DNA, 19 bp, Homo sapiens
ctgaaggtattggcctgtt

SEQ ID NO: 1073184 - DNA, 21 bp, Homo sapiens
ctgaaggtattggcctgttca

SEQ ID NO: 1073185 - DNA, 16 bp, Homo sapiens
ctgaaggtccaggctt

SEQ ID NO: 1073186 - DNA, 21 bp, Homo sapiens
ctgaaggttttttttttaagt

SEQ ID NO: 1073187 - DNA, 17 bp, Homo sapiens
ctgaagtaaacagctgt

SEQ ID NO: 1073188 - DNA, 14 bp, Homo sapiens
ctgaagtacaaaca

SEQ ID NO: 1073189 - DNA, 16 bp, Homo sapiens
ctgaagtacaaacatg

SEQ ID NO: 1073190 - DNA, 19 bp, Homo sapiens
ctgaagtacaaacatgaaa

SEQ ID NO: 1073191 - DNA, 21 bp, Homo sapiens
ctgaagtcacatcacaggaca

SEQ ID NO: 1073192 - DNA, 22 bp, Homo sapiens
ctgaagtcactgcacagtgcat

SEQ ID NO: 1073193 - DNA, 21 bp, Homo sapiens
ctgaagtgcctactggggggc

SEQ ID NO: 1073194 - DNA, 16 bp, Homo sapiens
ctgaagtgcttagtgt

SEQ ID NO: 1073195 - DNA, 20 bp, Homo sapiens
ctgaagtgcttgcagatcat

SEQ ID NO: 1073196 - DNA, 17 bp, Homo sapiens
ctgaagtggccctccct

SEQ ID NO: 1073197 - DNA, 13 bp, Homo sapiens
ctgaagtggctgg

SEQ ID NO: 1073198 - DNA, 12 bp, Homo sapiens
ctgaagtgggaa

SEQ ID NO: 1073199 - DNA, 22 bp, Homo sapiens
ctgaagtgtgtccatcctgacc

SEQ ID NO: 1073200 - DNA, 23 bp, Homo sapiens
ctgaagtgtgtccatcctgacct

SEQ ID NO: 1073201 - DNA, 15 bp, Homo sapiens
ctgaagttctgagcc

SEQ ID NO: 1073202 - DNA, 18 bp, Homo sapiens
ctgaagttgctgctgtga

SEQ ID NO: 1073203 - DNA, 14 bp, Homo sapiens
ctgaagttggacag

SEQ ID NO: 1073204 - DNA, 15 bp, Homo sapiens
ctgaagttggacagc

SEQ ID NO: 1073205 - DNA, 15 bp, Homo sapiens
ctgaagttggccacc

SEQ ID NO: 1073206 - DNA, 17 bp, Homo sapiens
ctgaagtttttttgctg

SEQ ID NO: 1073207 - DNA, 23 bp, Homo sapiens
ctgaagtttttttgctgctgcct

SEQ ID NO: 1073208 - DNA, 15 bp, Homo sapiens
ctgaataaaaaagat

SEQ ID NO: 1073209 - DNA, 17 bp, Homo sapiens
ctgaataaaaaagattc

SEQ ID NO: 1073210 - DNA, 18 bp, Homo sapiens
ctgaataaagtgtaacaa

SEQ ID NO: 1073211 - DNA, 15 bp, Homo sapiens
ctgaataaatacctc

SEQ ID NO: 1073212 - DNA, 12 bp, Homo sapiens
ctgaataaatgg

SEQ ID NO: 1073213 - DNA, 14 bp, Homo sapiens
ctgaataacttgaa

SEQ ID NO: 1073214 - DNA, 14 bp, Homo sapiens
ctgaataatatcaa

SEQ ID NO: 1073215 - DNA, 16 bp, Homo sapiens
ctgaatacaaagtgat

SEQ ID NO: 1073216 - DNA, 18 bp, Homo sapiens
ctgaatacattctgcttt

SEQ ID NO: 1073217 - DNA, 15 bp, Homo sapiens
ctgaataccactctg

SEQ ID NO: 1073218 - DNA, 22 bp, Homo sapiens
ctgaataccactctgtaattgc

SEQ ID NO: 1073219 - DNA, 22 bp, Homo sapiens
ctgaatacgctaagcctggaag

SEQ ID NO: 1073220 - DNA, 15 bp, Homo sapiens
ctgaatatctgttca

SEQ ID NO: 1073221 - DNA, 18 bp, Homo sapiens
ctgaatattttggaaact

SEQ ID NO: 1073222 - DNA, 14 bp, Homo sapiens
ctgaatattttgta

SEQ ID NO: 1073223 - DNA, 18 bp, Homo sapiens
ctgaatcaagcacactgt

SEQ ID NO: 1073224 - DNA, 19 bp, Homo sapiens
ctgaatcaagcacactgta

SEQ ID NO: 1073225 - DNA, 11 bp, Homo sapiens
ctgaatcactg

SEQ ID NO: 1073226 - DNA, 16 bp, Homo sapiens
ctgaatcagaaaagct

SEQ ID NO: 1073227 - DNA, 12 bp, Homo sapiens
ctgaatcagctg

SEQ ID NO: 1073228 - DNA, 13 bp, Homo sapiens
ctgaatcagctgg

SEQ ID NO: 1073229 - DNA, 14 bp, Homo sapiens
ctgaatcagctgga

SEQ ID NO: 1073230 - DNA, 15 bp, Homo sapiens
ctgaatcagctggac

SEQ ID NO: 1073231 - DNA, 16 bp, Homo sapiens
ctgaatcagctggaca

SEQ ID NO: 1073232 - DNA, 21 bp, Homo sapiens
ctgaatcatgagcctgctgga

SEQ ID NO: 1073233 - DNA, 19 bp, Homo sapiens
ctgaatccaaactaatcca

SEQ ID NO: 1073234 - DNA, 20 bp, Homo sapiens
ctgaatccaaactaatccat

SEQ ID NO: 1073235 - DNA, 21 bp, Homo sapiens
ctgaatcctggtaattaaaag

SEQ ID NO: 1073236 - DNA, 17 bp, Homo sapiens
ctgaatctatggcttta

SEQ ID NO: 1073237 - DNA, 15 bp, Homo sapiens
ctgaatctgtacatg

SEQ ID NO: 1073238 - DNA, 23 bp, Homo sapiens
ctgaatcttaatcgatgaatgta

SEQ ID NO: 1073239 - DNA, 13 bp, Homo sapiens
ctgaatcttcacg

SEQ ID NO: 1073240 - DNA, 12 bp, Homo sapiens
ctgaatcttctg

SEQ ID NO: 1073241 - DNA, 14 bp, Homo sapiens
ctgaatgaagcagt

SEQ ID NO: 1073242 - DNA, 18 bp, Homo sapiens
ctgaatgaagctgccatc

SEQ ID NO: 1073243 - DNA, 20 bp, Homo sapiens
ctgaatgaggtcagcatgtc

SEQ ID NO: 1073244 - DNA, 21 bp, Homo sapiens
ctgaatgatcttgtgtaaggt

SEQ ID NO: 1073245 - DNA, 23 bp, Homo sapiens
ctgaatgcagggaatgcaatcct

SEQ ID NO: 1073246 - DNA, 22 bp, Homo sapiens
ctgaatgcctcaatgtgaccag

SEQ ID NO: 1073247 - DNA, 12 bp, Homo sapiens
ctgaatgctctg

SEQ ID NO: 1073248 - DNA, 14 bp, Homo sapiens
ctgaatgctgccac

SEQ ID NO: 1073249 - DNA, 14 bp, Homo sapiens
ctgaatgcttctaa

SEQ ID NO: 1073250 - DNA, 15 bp, Homo sapiens
ctgaatggtccaggg

SEQ ID NO: 1073251 - DNA, 16 bp, Homo sapiens
ctgaatggtccagggt

SEQ ID NO: 1073252 - DNA, 20 bp, Homo sapiens
ctgaatggttttcaaaataa

SEQ ID NO: 1073253 - DNA, 16 bp, Homo sapiens
ctgaatgtatgtaaat

SEQ ID NO: 1073254 - DNA, 22 bp, Homo sapiens
ctgaatgtgcctaatggagaag

SEQ ID NO: 1073255 - DNA, 19 bp, Homo sapiens
ctgaatgttctgacattaa

SEQ ID NO: 1073256 - DNA, 23 bp, Homo sapiens
ctgaatgttctgacattaacagt

SEQ ID NO: 1073257 - DNA, 16 bp, Homo sapiens
ctgaatgttgggactg

SEQ ID NO: 1073258 - DNA, 19 bp, Homo sapiens
ctgaatgtttgtttcagtg

SEQ ID NO: 1073259 - DNA, 19 bp, Homo sapiens
ctgaatgttttatttatca

SEQ ID NO: 1073260 - DNA, 12 bp, Homo sapiens
ctgaattaaaat

SEQ ID NO: 1073261 - DNA, 16 bp, Homo sapiens
ctgaattaaataaata

SEQ ID NO: 1073262 - DNA, 17 bp, Homo sapiens
ctgaattaatcatctat

SEQ ID NO: 1073263 - DNA, 19 bp, Homo sapiens
ctgaattaatgagaagata

SEQ ID NO: 1073264 - DNA, 16 bp, Homo sapiens
ctgaattctatttgct

SEQ ID NO: 1073265 - DNA, 17 bp, Homo sapiens
ctgaattctatttgctg

SEQ ID NO: 1073266 - DNA, 21 bp, Homo sapiens
ctgaattgagaataagaattt

SEQ ID NO: 1073267 - DNA, 15 bp, Homo sapiens
ctgaattgtccccag

SEQ ID NO: 1073268 - DNA, 20 bp, Homo sapiens
ctgaatttcaggcattttgt

SEQ ID NO: 1073269 - DNA, 12 bp, Homo sapiens
ctgaatttggag

SEQ ID NO: 1073270 - DNA, 21 bp, Homo sapiens
ctgaatttggcctgcactaat

SEQ ID NO: 1073271 - DNA, 14 bp, Homo sapiens
ctgaatttgggcct

SEQ ID NO: 1073272 - DNA, 11 bp, Homo sapiens
ctgaattttta

SEQ ID NO: 1073273 - DNA, 16 bp, Homo sapiens
ctgaatttttttgtaa

SEQ ID NO: 1073274 - DNA, 17 bp, Homo sapiens
ctgaatttttttgtaat

SEQ ID NO: 1073275 - DNA, 18 bp, Homo sapiens
ctgaatttttttgtaata

SEQ ID NO: 1073276 - DNA, 23 bp, Homo sapiens
ctgacaaaggagccttgataata

SEQ ID NO: 1073277 - DNA, 16 bp, Homo sapiens
ctgacaaagtcatccc

SEQ ID NO: 1073278 - DNA, 18 bp, Homo sapiens
ctgacaaagtcatcccct

SEQ ID NO: 1073279 - DNA, 20 bp, Homo sapiens
ctgacaaagtcatcccctct

SEQ ID NO: 1073280 - DNA, 22 bp, Homo sapiens
ctgacaaatattttagaagcta

SEQ ID NO: 1073281 - DNA, 22 bp, Homo sapiens
ctgacaacatttctatagccaa

SEQ ID NO: 1073282 - DNA, 21 bp, Homo sapiens
ctgacaaccaccgctccccag

SEQ ID NO: 1073283 - DNA, 18 bp, Homo sapiens
ctgacaaccactggtctg

SEQ ID NO: 1073284 - DNA, 18 bp, Homo sapiens
ctgacaaccattaaagtc

SEQ ID NO: 1073285 - DNA, 15 bp, Homo sapiens
ctgacaacgtctctt

SEQ ID NO: 1073286 - DNA, 17 bp, Homo sapiens
ctgacaacgtctcttca

SEQ ID NO: 1073287 - DNA, 18 bp, Homo sapiens
ctgacaacttagctcagg

SEQ ID NO: 1073288 - DNA, 13 bp, Homo sapiens
ctgacaacttgaa

SEQ ID NO: 1073289 - DNA, 14 bp, Homo sapiens
ctgacaagccatct

SEQ ID NO: 1073290 - DNA, 22 bp, Homo sapiens
ctgacaagggcccttctctact

SEQ ID NO: 1073291 - DNA, 13 bp, Homo sapiens
ctgacaatgaagg

SEQ ID NO: 1073292 - DNA, 17 bp, Homo sapiens
ctgacaatggcagctag

SEQ ID NO: 1073293 - DNA, 13 bp, Homo sapiens
ctgacacactaac

SEQ ID NO: 1073294 - DNA, 20 bp, Homo sapiens
ctgacacactaaccaagctg

SEQ ID NO: 1073295 - DNA, 18 bp, Homo sapiens
ctgacacattgctgatat

SEQ ID NO: 1073296 - DNA, 15 bp, Homo sapiens
ctgacaccccctccc

SEQ ID NO: 1073297 - DNA, 18 bp, Homo sapiens
ctgacaccgtccctcagt

SEQ ID NO: 1073298 - DNA, 19 bp, Homo sapiens
ctgacaccgtcgaccagga

SEQ ID NO: 1073299 - DNA, 19 bp, Homo sapiens
ctgacacctaccatgctgc

SEQ ID NO: 1073300 - DNA, 19 bp, Homo sapiens
ctgacacgcaagtgtgtga

SEQ ID NO: 1073301 - DNA, 16 bp, Homo sapiens
ctgacacgcagcctgc

SEQ ID NO: 1073302 - DNA, 19 bp, Homo sapiens
ctgacacgcagcctgctct

SEQ ID NO: 1073303 - DNA, 16 bp, Homo sapiens
ctgacactgagcccca

SEQ ID NO: 1073304 - DNA, 15 bp, Homo sapiens
ctgacacttcctgtc

SEQ ID NO: 1073305 - DNA, 16 bp, Homo sapiens
ctgacacttcctgtcc

SEQ ID NO: 1073306 - DNA, 19 bp, Homo sapiens
ctgacacttcctgtccttg

SEQ ID NO: 1073307 - DNA, 20 bp, Homo sapiens
ctgacacttcctgtccttgt

SEQ ID NO: 1073308 - DNA, 16 bp, Homo sapiens
ctgacagaaggtgcca

SEQ ID NO: 1073309 - DNA, 17 bp, Homo sapiens
ctgacagaagttatttc

SEQ ID NO: 1073310 - DNA, 15 bp, Homo sapiens
ctgacagactcactg

SEQ ID NO: 1073311 - DNA, 19 bp, Homo sapiens
ctgacagcagcctgtgagg

SEQ ID NO: 1073312 - DNA, 22 bp, Homo sapiens
ctgacagcatgtgccctcctga

SEQ ID NO: 1073313 - DNA, 21 bp, Homo sapiens
ctgacagcccaacttccagag

SEQ ID NO: 1073314 - DNA, 20 bp, Homo sapiens
ctgacagcctcccaccccca

SEQ ID NO: 1073315 - DNA, 14 bp, Homo sapiens
ctgacagccttccc

SEQ ID NO: 1073316 - DNA, 21 bp, Homo sapiens
ctgacagccttccccagctcc

SEQ ID NO: 1073317 - DNA, 17 bp, Homo sapiens
ctgacagctcttcacag

SEQ ID NO: 1073318 - DNA, 13 bp, Homo sapiens
ctgacagctgctc

SEQ ID NO: 1073319 - DNA, 14 bp, Homo sapiens
ctgacagctgctcc

SEQ ID NO: 1073320 - DNA, 22 bp, Homo sapiens
ctgacagggacatgccctgtgt

SEQ ID NO: 1073321 - DNA, 12 bp, Homo sapiens
ctgacagggagc

SEQ ID NO: 1073322 - DNA, 13 bp, Homo sapiens
ctgacagggagca

SEQ ID NO: 1073323 - DNA, 19 bp, Homo sapiens
ctgacaggtgatgctctgg

SEQ ID NO: 1073324 - DNA, 18 bp, Homo sapiens
ctgacagtattaagggta

SEQ ID NO: 1073325 - DNA, 13 bp, Homo sapiens
ctgacagtccaca

SEQ ID NO: 1073326 - DNA, 14 bp, Homo sapiens
ctgacagtttttct

SEQ ID NO: 1073327 - DNA, 20 bp, Homo sapiens
ctgacatcatcattcttgtg

SEQ ID NO: 1073328 - DNA, 19 bp, Homo sapiens
ctgacatgccctcccttct

SEQ ID NO: 1073329 - DNA, 13 bp, Homo sapiens
ctgacatgctaac

SEQ ID NO: 1073330 - DNA, 19 bp, Homo sapiens
ctgacatgtggggccaggt

SEQ ID NO: 1073331 - DNA, 20 bp, Homo sapiens
ctgacatgtttgtgctctgt

SEQ ID NO: 1073332 - DNA, 21 bp, Homo sapiens
ctgacattaacagttttccat

SEQ ID NO: 1073333 - DNA, 23 bp, Homo sapiens
ctgacattaacagttttccatga

SEQ ID NO: 1073334 - DNA, 22 bp, Homo sapiens
ctgacattcctaagagtggagg

SEQ ID NO: 1073335 - DNA, 14 bp, Homo sapiens
ctgacattgccaaa

SEQ ID NO: 1073336 - DNA, 17 bp, Homo sapiens
ctgacattgccaaaaag

SEQ ID NO: 1073337 - DNA, 14 bp, Homo sapiens
ctgacattgctcca

SEQ ID NO: 1073338 - DNA, 19 bp, Homo sapiens
ctgacatttctaacatatg

SEQ ID NO: 1073339 - DNA, 22 bp, Homo sapiens
ctgacatttctaacatatgtat

SEQ ID NO: 1073340 - DNA, 15 bp, Homo sapiens
ctgacattttttcct

SEQ ID NO: 1073341 - DNA, 14 bp, Homo sapiens
ctgaccaagagaga

SEQ ID NO: 1073342 - DNA, 23 bp, Homo sapiens
ctgaccaagcggctcaagaataa

SEQ ID NO: 1073343 - DNA, 14 bp, Homo sapiens
ctgaccaattgtgc

SEQ ID NO: 1073344 - DNA, 22 bp, Homo sapiens
ctgaccaattgtgctgccattt

SEQ ID NO: 1073345 - DNA, 16 bp, Homo sapiens
ctgaccacacttcctg

SEQ ID NO: 1073346 - DNA, 17 bp, Homo sapiens
ctgaccacacttcctgt

SEQ ID NO: 1073347 - DNA, 22 bp, Homo sapiens
ctgaccacggacgtttccatca

SEQ ID NO: 1073348 - DNA, 23 bp, Homo sapiens
ctgaccacggacgtttccatcag

SEQ ID NO: 1073349 - DNA, 21 bp, Homo sapiens
ctgaccagcagcgcctttccc

SEQ ID NO: 1073350 - DNA, 22 bp, Homo sapiens
ctgaccagcagcgcctttccca

SEQ ID NO: 1073351 - DNA, 17 bp, Homo sapiens
ctgaccagcctccatgc

SEQ ID NO: 1073352 - DNA, 21 bp, Homo sapiens
ctgaccagcctccatgctgcc

SEQ ID NO: 1073353 - DNA, 23 bp, Homo sapiens
ctgaccagcctccatgctgcctc

SEQ ID NO: 1073354 - DNA, 12 bp, Homo sapiens
ctgaccagctgg

SEQ ID NO: 1073355 - DNA, 17 bp, Homo sapiens
ctgaccagctggagtga

SEQ ID NO: 1073356 - DNA, 15 bp, Homo sapiens
ctgaccatccactct

SEQ ID NO: 1073357 - DNA, 14 bp, Homo sapiens
ctgaccatgcattt

SEQ ID NO: 1073358 - DNA, 20 bp, Homo sapiens
ctgaccatgctcatctgctg

SEQ ID NO: 1073359 - DNA, 18 bp, Homo sapiens
ctgaccatggttttggct

SEQ ID NO: 1073360 - DNA, 18 bp, Homo sapiens
ctgaccatttcaggggtc

SEQ ID NO: 1073361 - DNA, 14 bp, Homo sapiens
ctgacccaacaccc

SEQ ID NO: 1073362 - DNA, 19 bp, Homo sapiens
ctgacccaacacccccgac

SEQ ID NO: 1073363 - DNA, 14 bp, Homo sapiens
ctgacccaactggg

SEQ ID NO: 1073364 - DNA, 14 bp, Homo sapiens
ctgacccacggggc

SEQ ID NO: 1073365 - DNA, 16 bp, Homo sapiens
ctgacccacggggcag

SEQ ID NO: 1073366 - DNA, 16 bp, Homo sapiens
ctgacccagagtggag

SEQ ID NO: 1073367 - DNA, 14 bp, Homo sapiens
ctgacccagcatct

SEQ ID NO: 1073368 - DNA, 18 bp, Homo sapiens
ctgacccagcatctccca

SEQ ID NO: 1073369 - DNA, 15 bp, Homo sapiens
ctgacccaggccgca

SEQ ID NO: 1073370 - DNA, 18 bp, Homo sapiens
ctgacccaggccgcagct

SEQ ID NO: 1073371 - DNA, 14 bp, Homo sapiens
ctgacccagtccct

SEQ ID NO: 1073372 - DNA, 16 bp, Homo sapiens
ctgacccagtccctgg

SEQ ID NO: 1073373 - DNA, 13 bp, Homo sapiens
ctgacccagtgag

SEQ ID NO: 1073374 - DNA, 13 bp, Homo sapiens
ctgacccatccct

SEQ ID NO: 1073375 - DNA, 20 bp, Homo sapiens
ctgaccccacttatgctgct

SEQ ID NO: 1073376 - DNA, 21 bp, Homo sapiens
ctgaccccacttatgctgctg

SEQ ID NO: 1073377 - DNA, 22 bp, Homo sapiens
ctgaccccacttatgctgctgt

SEQ ID NO: 1073378 - DNA, 22 bp, Homo sapiens
ctgaccccaggtcagccctgtg

SEQ ID NO: 1073379 - DNA, 16 bp, Homo sapiens
ctgaccccctcccctg

SEQ ID NO: 1073380 - DNA, 20 bp, Homo sapiens
ctgaccccgagaagtgctct

SEQ ID NO: 1073381 - DNA, 23 bp, Homo sapiens
ctgaccccgagaagtgctcttgg

SEQ ID NO: 1073382 - DNA, 17 bp, Homo sapiens
ctgacccctccctgcag

SEQ ID NO: 1073383 - DNA, 22 bp, Homo sapiens
ctgacccctccctgcaggggct

SEQ ID NO: 1073384 - DNA, 14 bp, Homo sapiens
ctgacccctgctca

SEQ ID NO: 1073385 - DNA, 16 bp, Homo sapiens
ctgacccctgctcagt

SEQ ID NO: 1073386 - DNA, 14 bp, Homo sapiens
ctgaccccttgctc

SEQ ID NO: 1073387 - DNA, 20 bp, Homo sapiens
ctgacccggttgcagtcact

SEQ ID NO: 1073388 - DNA, 15 bp, Homo sapiens
ctgaccctcccactc

SEQ ID NO: 1073389 - DNA, 19 bp, Homo sapiens
ctgaccctcccactcccat

SEQ ID NO: 1073390 - DNA, 13 bp, Homo sapiens
ctgaccctcccag

SEQ ID NO: 1073391 - DNA, 14 bp, Homo sapiens
ctgaccctcccagt

SEQ ID NO: 1073392 - DNA, 22 bp, Homo sapiens
ctgaccctcctccactccacct

SEQ ID NO: 1073393 - DNA, 13 bp, Homo sapiens
ctgaccctccttc

SEQ ID NO: 1073394 - DNA, 16 bp, Homo sapiens
ctgaccctccttctat

SEQ ID NO: 1073395 - DNA, 17 bp, Homo sapiens
ctgaccctgaggaggcc

SEQ ID NO: 1073396 - DNA, 21 bp, Homo sapiens
ctgaccctgtatatagcccag

SEQ ID NO: 1073397 - DNA, 20 bp, Homo sapiens
ctgacccttacagcctctga

SEQ ID NO: 1073398 - DNA, 22 bp, Homo sapiens
ctgacccttacagcctctgact

SEQ ID NO: 1073399 - DNA, 20 bp, Homo sapiens
ctgaccgatgtgtctcccag

SEQ ID NO: 1073400 - DNA, 21 bp, Homo sapiens
ctgaccgatgtgtctcccaga

SEQ ID NO: 1073401 - DNA, 22 bp, Homo sapiens
ctgaccgatgtgtctcccagaa

SEQ ID NO: 1073402 - DNA, 20 bp, Homo sapiens
ctgaccgggatccagttcca

SEQ ID NO: 1073403 - DNA, 18 bp, Homo sapiens
ctgaccgggctcacttgc

SEQ ID NO: 1073404 - DNA, 18 bp, Homo sapiens
ctgaccgtgtacatagcc

SEQ ID NO: 1073405 - DNA, 20 bp, Homo sapiens
ctgacctagaccagtttgca

SEQ ID NO: 1073406 - DNA, 20 bp, Homo sapiens
ctgacctcaagcaaccatga

SEQ ID NO: 1073407 - DNA, 23 bp, Homo sapiens
ctgacctcccagccctatggatg

SEQ ID NO: 1073408 - DNA, 16 bp, Homo sapiens
ctgacctccgccatcc

SEQ ID NO: 1073409 - DNA, 17 bp, Homo sapiens
ctgacctccgccatcca

SEQ ID NO: 1073410 - DNA, 17 bp, Homo sapiens
ctgacctctgctgagtg

SEQ ID NO: 1073411 - DNA, 21 bp, Homo sapiens
ctgacctctgctgagtgctgg

SEQ ID NO: 1073412 - DNA, 24 bp, Homo sapiens
ctgacctctgctgagtgctgggca

SEQ ID NO: 1073413 - DNA, 16 bp, Homo sapiens
ctgacctcttgctgtc

SEQ ID NO: 1073414 - DNA, 18 bp, Homo sapiens
ctgacctcttgctgtctc

SEQ ID NO: 1073415 - DNA, 13 bp, Homo sapiens
ctgacctgcaggc

SEQ ID NO: 1073416 - DNA, 13 bp, Homo sapiens
ctgacctgctgaa

SEQ ID NO: 1073417 - DNA, 19 bp, Homo sapiens
ctgacctgctgacctgtgc

SEQ ID NO: 1073418 - DNA, 15 bp, Homo sapiens
ctgacctgtcatgcc

SEQ ID NO: 1073419 - DNA, 17 bp, Homo sapiens
ctgacctgtcatgcccc

SEQ ID NO: 1073420 - DNA, 22 bp, Homo sapiens
ctgacctgtcatgcccccctca

SEQ ID NO: 1073421 - DNA, 15 bp, Homo sapiens
ctgacctgtccaggt

SEQ ID NO: 1073422 - DNA, 18 bp, Homo sapiens
ctgacctgtgagcccagc

SEQ ID NO: 1073423 - DNA, 19 bp, Homo sapiens
ctgaccttaaatgcaacca

SEQ ID NO: 1073424 - DNA, 17 bp, Homo sapiens
ctgaccttagcgttctg

SEQ ID NO: 1073425 - DNA, 20 bp, Homo sapiens
ctgaccttagcgttctggac

SEQ ID NO: 1073426 - DNA, 15 bp, Homo sapiens
ctgaccttccttcct

SEQ ID NO: 1073427 - DNA, 16 bp, Homo sapiens
ctgaccttccttcctg

SEQ ID NO: 1073428 - DNA, 17 bp, Homo sapiens
ctgaccttgctgccaca

SEQ ID NO: 1073429 - DNA, 20 bp, Homo sapiens
ctgaccttggaggaatgaca

SEQ ID NO: 1073430 - DNA, 16 bp, Homo sapiens
ctgacgcaccactgcc

SEQ ID NO: 1073431 - DNA, 18 bp, Homo sapiens
ctgacgcaccactgccaa

SEQ ID NO: 1073432 - DNA, 18 bp, Homo sapiens
ctgacgcttgtgacagtg

SEQ ID NO: 1073433 - DNA, 20 bp, Homo sapiens
ctgacgcttgtgacagtgcc

SEQ ID NO: 1073434 - DNA, 16 bp, Homo sapiens
ctgacggagtcctgtg

SEQ ID NO: 1073435 - DNA, 15 bp, Homo sapiens
ctgacggctggggac

SEQ ID NO: 1073436 - DNA, 13 bp, Homo sapiens
ctgacgtccacct

SEQ ID NO: 1073437 - DNA, 14 bp, Homo sapiens
ctgacgtgcctttt

SEQ ID NO: 1073438 - DNA, 17 bp, Homo sapiens
ctgacgtgccttttgca

SEQ ID NO: 1073439 - DNA, 18 bp, Homo sapiens
ctgacgtgccttttgcac

SEQ ID NO: 1073440 - DNA, 22 bp, Homo sapiens
ctgacgtgccttttgcacccct

SEQ ID NO: 1073441 - DNA, 16 bp, Homo sapiens
ctgactaggctgatca

SEQ ID NO: 1073442 - DNA, 16 bp, Homo sapiens
ctgactagtagatttc

SEQ ID NO: 1073443 - DNA, 17 bp, Homo sapiens
ctgactagtagatttct

SEQ ID NO: 1073444 - DNA, 19 bp, Homo sapiens
ctgactcagggctcctggg

SEQ ID NO: 1073445 - DNA, 20 bp, Homo sapiens
ctgactccagagtctgagcc

SEQ ID NO: 1073446 - DNA, 16 bp, Homo sapiens
ctgactccctccccac

SEQ ID NO: 1073447 - DNA, 17 bp, Homo sapiens
ctgactccctccccacc

SEQ ID NO: 1073448 - DNA, 23 bp, Homo sapiens
ctgactccctccccacccaagag

SEQ ID NO: 1073449 - DNA, 17 bp, Homo sapiens
ctgactccctgtggggg

SEQ ID NO: 1073450 - DNA, 12 bp, Homo sapiens
ctgactcctctg

SEQ ID NO: 1073451 - DNA, 17 bp, Homo sapiens
ctgactcctctggcttt

SEQ ID NO: 1073452 - DNA, 21 bp, Homo sapiens
ctgactcctctggctttccca

SEQ ID NO: 1073453 - DNA, 14 bp, Homo sapiens
ctgactcctgggtg

SEQ ID NO: 1073454 - DNA, 18 bp, Homo sapiens
ctgactcggtttctccaa

SEQ ID NO: 1073455 - DNA, 16 bp, Homo sapiens
ctgactctctgagctg

SEQ ID NO: 1073456 - DNA, 23 bp, Homo sapiens
ctgactctctgagctggggaggt

SEQ ID NO: 1073457 - DNA, 16 bp, Homo sapiens
ctgactctctgtgacc

SEQ ID NO: 1073458 - DNA, 17 bp, Homo sapiens
ctgactctgaaatctga

SEQ ID NO: 1073459 - DNA, 19 bp, Homo sapiens
ctgactctgagtccactgc

SEQ ID NO: 1073460 - DNA, 15 bp, Homo sapiens
ctgactgaaggaaaa

SEQ ID NO: 1073461 - DNA, 18 bp, Homo sapiens
ctgactgagcaggctgtg

SEQ ID NO: 1073462 - DNA, 21 bp, Homo sapiens
ctgactgcaccagcgccccca

SEQ ID NO: 1073463 - DNA, 15 bp, Homo sapiens
ctgactgccaggacc

SEQ ID NO: 1073464 - DNA, 18 bp, Homo sapiens
ctgactgccaggacccca

SEQ ID NO: 1073465 - DNA, 19 bp, Homo sapiens
ctgactgccaggaccccag

SEQ ID NO: 1073466 - DNA, 20 bp, Homo sapiens
ctgactgccaggaccccagg

SEQ ID NO: 1073467 - DNA, 22 bp, Homo sapiens
ctgactgcccgctcctcgggaa

SEQ ID NO: 1073468 - DNA, 13 bp, Homo sapiens
ctgactgctcaga

SEQ ID NO: 1073469 - DNA, 16 bp, Homo sapiens
ctgactggttgtcaga

SEQ ID NO: 1073470 - DNA, 16 bp, Homo sapiens
ctgactgtcagggagg

SEQ ID NO: 1073471 - DNA, 17 bp, Homo sapiens
ctgactgtccaggagct

SEQ ID NO: 1073472 - DNA, 13 bp, Homo sapiens
ctgactgtccctg

SEQ ID NO: 1073473 - DNA, 12 bp, Homo sapiens
ctgactgtggcc

SEQ ID NO: 1073474 - DNA, 16 bp, Homo sapiens
ctgactgtggccccct

SEQ ID NO: 1073475 - DNA, 18 bp, Homo sapiens
ctgactgtttcattcact

SEQ ID NO: 1073476 - DNA, 19 bp, Homo sapiens
ctgactgttttttttgcag

SEQ ID NO: 1073477 - DNA, 18 bp, Homo sapiens
ctgacttaactttaactt

SEQ ID NO: 1073478 - DNA, 19 bp, Homo sapiens
ctgacttaagcaaaagaaa

SEQ ID NO: 1073479 - DNA, 20 bp, Homo sapiens
ctgacttaagcaaaagaaaa

SEQ ID NO: 1073480 - DNA, 20 bp, Homo sapiens
ctgacttcatggaatggaca

SEQ ID NO: 1073481 - DNA, 14 bp, Homo sapiens
ctgacttcatttgt

SEQ ID NO: 1073482 - DNA, 20 bp, Homo sapiens
ctgacttcatttgtgccaca

SEQ ID NO: 1073483 - DNA, 22 bp, Homo sapiens
ctgacttcatttgtgccacacg

SEQ ID NO: 1073484 - DNA, 22 bp, Homo sapiens
ctgacttccccaaacccagaaa

SEQ ID NO: 1073485 - DNA, 13 bp, Homo sapiens
ctgacttctcccc

SEQ ID NO: 1073486 - DNA, 20 bp, Homo sapiens
ctgacttctctgaatcagaa

SEQ ID NO: 1073487 - DNA, 22 bp, Homo sapiens
ctgacttctctgaatcagaaaa

SEQ ID NO: 1073488 - DNA, 14 bp, Homo sapiens
ctgacttgagccac

SEQ ID NO: 1073489 - DNA, 19 bp, Homo sapiens
ctgacttgagccactcctt

SEQ ID NO: 1073490 - DNA, 14 bp, Homo sapiens
ctgacttgagtgtt

SEQ ID NO: 1073491 - DNA, 22 bp, Homo sapiens
ctgacttgagtgttccttttta

SEQ ID NO: 1073492 - DNA, 17 bp, Homo sapiens
ctgacttggcacttaag

SEQ ID NO: 1073493 - DNA, 16 bp, Homo sapiens
ctgacttggttctgaa

SEQ ID NO: 1073494 - DNA, 15 bp, Homo sapiens
ctgactttacttgtg

SEQ ID NO: 1073495 - DNA, 16 bp, Homo sapiens
ctgactttgcttgctt

SEQ ID NO: 1073496 - DNA, 18 bp, Homo sapiens
ctgactttgcttgctttg

SEQ ID NO: 1073497 - DNA, 12 bp, Homo sapiens
ctgagaaaagta

SEQ ID NO: 1073498 - DNA, 20 bp, Homo sapiens
ctgagaaaagtattctcaaa

SEQ ID NO: 1073499 - DNA, 22 bp, Homo sapiens
ctgagctcggtggacccaggga

SEQ ID NO: 1073500 - DNA, 12 bp, Homo sapiens
ctgagctctcca

SEQ ID NO: 1073501 - DNA, 19 bp, Homo sapiens
ctgagctctccaggccagg

SEQ ID NO: 1073502 - DNA, 20 bp, Homo sapiens
ctgagctctccaggccaggt

SEQ ID NO: 1073503 - DNA, 18 bp, Homo sapiens
ctgagctgaggcagcagt

SEQ ID NO: 1073504 - DNA, 17 bp, Homo sapiens
ctgagctgagtggccag

SEQ ID NO: 1073505 - DNA, 23 bp, Homo sapiens
ctgagctgagtggccagccagtg

SEQ ID NO: 1073506 - DNA, 14 bp, Homo sapiens
ctgagctggaaggg

SEQ ID NO: 1073507 - DNA, 18 bp, Homo sapiens
ctgagctggaaggggcca

SEQ ID NO: 1073508 - DNA, 15 bp, Homo sapiens
ctgagctgggcccag

SEQ ID NO: 1073509 - DNA, 16 bp, Homo sapiens
ctgagctgggcccagc

SEQ ID NO: 1073510 - DNA, 12 bp, Homo sapiens
ctgagctgggga

SEQ ID NO: 1073511 - DNA, 13 bp, Homo sapiens
ctgagctggggag

SEQ ID NO: 1073512 - DNA, 16 bp, Homo sapiens
ctgagctggggccaca

SEQ ID NO: 1073513 - DNA, 16 bp, Homo sapiens
ctgagctggggggatg

SEQ ID NO: 1073514 - DNA, 19 bp, Homo sapiens
ctgagctgtatcttgatgt

SEQ ID NO: 1073515 - DNA, 19 bp, Homo sapiens
ctgagctgtgacattgctg

SEQ ID NO: 1073516 - DNA, 23 bp, Homo sapiens
ctgagctgtgacattgctggtca

SEQ ID NO: 1073517 - DNA, 15 bp, Homo sapiens
ctgagcttagccttg

SEQ ID NO: 1073518 - DNA, 19 bp, Homo sapiens
ctgagcttagccttgtgcc

SEQ ID NO: 1073519 - DNA, 22 bp, Homo sapiens
ctgagcttcagtataaaagaca

SEQ ID NO: 1073520 - DNA, 20 bp, Homo sapiens
ctgagcttcggttctccaga

SEQ ID NO: 1073521 - DNA, 22 bp, Homo sapiens
ctgagcttcggttctccagaat

SEQ ID NO: 1073522 - DNA, 16 bp, Homo sapiens
ctgagcttctgagaca

SEQ ID NO: 1073523 - DNA, 12 bp, Homo sapiens
ctgagcttggcc

SEQ ID NO: 1073524 - DNA, 15 bp, Homo sapiens
ctgagcttggccaga

SEQ ID NO: 1073525 - DNA, 17 bp, Homo sapiens
ctgagcttggccagaag

SEQ ID NO: 1073526 - DNA, 17 bp, Homo sapiens
ctgagctttagacagca

SEQ ID NO: 1073527 - DNA, 14 bp, Homo sapiens
ctgagctttctgct

SEQ ID NO: 1073528 - DNA, 15 bp, Homo sapiens
ctgagctttctgcta

SEQ ID NO: 1073529 - DNA, 14 bp, Homo sapiens
ctgagcttttcatg

SEQ ID NO: 1073530 - DNA, 19 bp, Homo sapiens
ctgagcttttcatggaagt

SEQ ID NO: 1073531 - DNA, 22 bp, Homo sapiens
ctgagcttttgatgccaggtgc

SEQ ID NO: 1073532 - DNA, 22 bp, Homo sapiens
ctgaggaacccttacagtagga

SEQ ID NO: 1073533 - DNA, 21 bp, Homo sapiens
ctgaggaagcagttggggccc

SEQ ID NO: 1073534 - DNA, 13 bp, Homo sapiens
ctgaggacagctg

SEQ ID NO: 1073535 - DNA, 22 bp, Homo sapiens
ctgaggacaggctctagagaga

SEQ ID NO: 1073536 - DNA, 14 bp, Homo sapiens
ctgaggacctctca

SEQ ID NO: 1073537 - DNA, 23 bp, Homo sapiens
ctgaggacctctcagcatagcct

SEQ ID NO: 1073538 - DNA, 14 bp, Homo sapiens
ctgaggactcctga

SEQ ID NO: 1073539 - DNA, 14 bp, Homo sapiens
ctgaggactgattt

SEQ ID NO: 1073540 - DNA, 22 bp, Homo sapiens
ctgaggactgatttcagagtga

SEQ ID NO: 1073541 - DNA, 15 bp, Homo sapiens
ctgaggactggagac

SEQ ID NO: 1073542 - DNA, 19 bp, Homo sapiens
ctgaggactgtcctcccac

SEQ ID NO: 1073543 - DNA, 22 bp, Homo sapiens
ctgaggagatgaccagggatgc

SEQ ID NO: 1073544 - DNA, 14 bp, Homo sapiens
ctgaggagcagcca

SEQ ID NO: 1073545 - DNA, 20 bp, Homo sapiens
ctgaggagcagccaggaccc

SEQ ID NO: 1073546 - DNA, 14 bp, Homo sapiens
ctgaggagccctga

SEQ ID NO: 1073547 - DNA, 20 bp, Homo sapiens
ctgaggagctgttactgaat

SEQ ID NO: 1073548 - DNA, 21 bp, Homo sapiens
ctgaggaggaggacacagcac

SEQ ID NO: 1073549 - DNA, 23 bp, Homo sapiens
ctgaggaggccgcttagtgctgc

SEQ ID NO: 1073550 - DNA, 17 bp, Homo sapiens
ctgaggagtctgaggac

SEQ ID NO: 1073551 - DNA, 15 bp, Homo sapiens
ctgaggagtgaggaa

SEQ ID NO: 1073552 - DNA, 17 bp, Homo sapiens
ctgaggatataagcttt

SEQ ID NO: 1073553 - DNA, 22 bp, Homo sapiens
ctgaggatattcagatgtatgt

SEQ ID NO: 1073554 - DNA, 14 bp, Homo sapiens
ctgaggatggcctg

SEQ ID NO: 1073555 - DNA, 20 bp, Homo sapiens
ctgaggatgggtcagagcta

SEQ ID NO: 1073556 - DNA, 22 bp, Homo sapiens
ctgaggatgtagagagaacagg

SEQ ID NO: 1073557 - DNA, 18 bp, Homo sapiens
ctgaggatttcaagcctg

SEQ ID NO: 1073558 - DNA, 14 bp, Homo sapiens
ctgaggatttcctg

SEQ ID NO: 1073559 - DNA, 20 bp, Homo sapiens
ctgaggatttcctggagtgc

SEQ ID NO: 1073560 - DNA, 22 bp, Homo sapiens
ctgaggatttcctggagtgccc

SEQ ID NO: 1073561 - DNA, 13 bp, Homo sapiens
ctgaggcagacag

SEQ ID NO: 1073562 - DNA, 17 bp, Homo sapiens
ctgaggcagacagcagc

SEQ ID NO: 1073563 - DNA, 18 bp, Homo sapiens
ctgaggcagacagcagct

SEQ ID NO: 1073564 - DNA, 23 bp, Homo sapiens
ctgaggcagcagtgtgaggccag

SEQ ID NO: 1073565 - DNA, 15 bp, Homo sapiens
ctgaggcaggaggat

SEQ ID NO: 1073566 - DNA, 12 bp, Homo sapiens
ctgaggccacac

SEQ ID NO: 1073567 - DNA, 14 bp, Homo sapiens
ctgaggccacactc

SEQ ID NO: 1073568 - DNA, 24 bp, Homo sapiens
ctgaggccacactcagcacaaggc

SEQ ID NO: 1073569 - DNA, 17 bp, Homo sapiens
ctgaggccagagtcacc

SEQ ID NO: 1073570 - DNA, 22 bp, Homo sapiens
ctgaggccatcagggccctgcc

SEQ ID NO: 1073571 - DNA, 13 bp, Homo sapiens
ctgaggcccagtg

SEQ ID NO: 1073572 - DNA, 17 bp, Homo sapiens
ctgaggccctcactgag

SEQ ID NO: 1073573 - DNA, 17 bp, Homo sapiens
ctgaggccctgggctgg

SEQ ID NO: 1073574 - DNA, 15 bp, Homo sapiens
ctgaggcctagactc

SEQ ID NO: 1073575 - DNA, 19 bp, Homo sapiens
ctgaggcctcgaggggcct

SEQ ID NO: 1073576 - DNA, 17 bp, Homo sapiens
ctgaggcctgccccctg

SEQ ID NO: 1073577 - DNA, 23 bp, Homo sapiens
ctgaggcctgccccctgggctgg

SEQ ID NO: 1073578 - DNA, 15 bp, Homo sapiens
ctgaggcctggactt

SEQ ID NO: 1073579 - DNA, 15 bp, Homo sapiens
ctgaggcctgggccg

SEQ ID NO: 1073580 - DNA, 19 bp, Homo sapiens
ctgaggcctgggccgctgc

SEQ ID NO: 1073581 - DNA, 22 bp, Homo sapiens
ctgaggcctgggccgctgccac

SEQ ID NO: 1073582 - DNA, 20 bp, Homo sapiens
ctgaggccttctcttgaggc

SEQ ID NO: 1073583 - DNA, 12 bp, Homo sapiens
ctgaggccttgt

SEQ ID NO: 1073584 - DNA, 22 bp, Homo sapiens
ctgaggccttgtgtgtcaggcc

SEQ ID NO: 1073585 - DNA, 17 bp, Homo sapiens
ctgaggcggaggctgtg

SEQ ID NO: 1073586 - DNA, 19 bp, Homo sapiens
ctgaggcggaggctgtgct

SEQ ID NO: 1073587 - DNA, 21 bp, Homo sapiens
ctgaggcggaggctgtgctcc

SEQ ID NO: 1073588 - DNA, 18 bp, Homo sapiens
ctgaggcgggtggatcac

SEQ ID NO: 1073589 - DNA, 16 bp, Homo sapiens
ctgaggctcagggaaa

SEQ ID NO: 1073590 - DNA, 22 bp, Homo sapiens
ctgaggctctgacccagtgaga

SEQ ID NO: 1073591 - DNA, 15 bp, Homo sapiens
ctgaggctgagactg

SEQ ID NO: 1073592 - DNA, 15 bp, Homo sapiens
ctgaggctggatcct

SEQ ID NO: 1073593 - DNA, 11 bp, Homo sapiens
ctgaggctggc

SEQ ID NO: 1073594 - DNA, 17 bp, Homo sapiens
ctgaggctggcacagga

SEQ ID NO: 1073595 - DNA, 18 bp, Homo sapiens
ctgaggctggcacaggac

SEQ ID NO: 1073596 - DNA, 19 bp, Homo sapiens
ctgaggctggcacaggaca

SEQ ID NO: 1073597 - DNA, 20 bp, Homo sapiens
ctgaggctgggggagagccg

SEQ ID NO: 1073598 - DNA, 13 bp, Homo sapiens
ctgaggctgtggt

SEQ ID NO: 1073599 - DNA, 18 bp, Homo sapiens
ctgaggcttagagagagg

SEQ ID NO: 1073600 - DNA, 19 bp, Homo sapiens
ctgaggcttagagagagga

SEQ ID NO: 1073601 - DNA, 20 bp, Homo sapiens
ctgaggcttagagagaggag

SEQ ID NO: 1073602 - DNA, 23 bp, Homo sapiens
ctgaggcttagagagaggaggca

SEQ ID NO: 1073603 - DNA, 14 bp, Homo sapiens
ctgaggcttccaga

SEQ ID NO: 1073604 - DNA, 14 bp, Homo sapiens
ctgaggctttggat

SEQ ID NO: 1073605 - DNA, 21 bp, Homo sapiens
ctgaggctttggtacccccaa

SEQ ID NO: 1073606 - DNA, 15 bp, Homo sapiens
ctgagggaggacctg

SEQ ID NO: 1073607 - DNA, 19 bp, Homo sapiens
ctgagggaggacctggggc

SEQ ID NO: 1073608 - DNA, 16 bp, Homo sapiens
ctgagggaggaggcca

SEQ ID NO: 1073609 - DNA, 18 bp, Homo sapiens
ctgagggaggaggccacc

SEQ ID NO: 1073610 - DNA, 19 bp, Homo sapiens
ctgagggaggaggccacct

SEQ ID NO: 1073611 - DNA, 20 bp, Homo sapiens
ctgagggaggaggccacctc

SEQ ID NO: 1073612 - DNA, 19 bp, Homo sapiens
ctgagggagggagccatgg

SEQ ID NO: 1073613 - DNA, 15 bp, Homo sapiens
ctgagggatctttac

SEQ ID NO: 1073614 - DNA, 23 bp, Homo sapiens
ctgagggattttagcctcttccc

SEQ ID NO: 1073615 - DNA, 15 bp, Homo sapiens
ctgagggccacacta

SEQ ID NO: 1073616 - DNA, 16 bp, Homo sapiens
ctgagggcccctctgc

SEQ ID NO: 1073617 - DNA, 19 bp, Homo sapiens
ctgagggcccctctgccca

SEQ ID NO: 1073618 - DNA, 20 bp, Homo sapiens
ctgagggcccctctgcccag

SEQ ID NO: 1073619 - DNA, 21 bp, Homo sapiens
ctgagggcccctctgcccagc

SEQ ID NO: 1073620 - DNA, 17 bp, Homo sapiens
ctgagggccctgtggag

SEQ ID NO: 1073621 - DNA, 18 bp, Homo sapiens
ctgagggctaattctggg

SEQ ID NO: 1073622 - DNA, 21 bp, Homo sapiens
ctgagggctaattctgggaag

SEQ ID NO: 1073623 - DNA, 15 bp, Homo sapiens
ctgagggctctgttt

SEQ ID NO: 1073624 - DNA, 22 bp, Homo sapiens
ctgagggctctgtttgtgggac

SEQ ID NO: 1073625 - DNA, 24 bp, Homo sapiens
ctgaggggacgggcaagtgagagg

SEQ ID NO: 1073626 - DNA, 16 bp, Homo sapiens
ctgaggggaggcacct

SEQ ID NO: 1073627 - DNA, 16 bp, Homo sapiens
ctgaggggattctcta

SEQ ID NO: 1073628 - DNA, 22 bp, Homo sapiens
ctgaggggcaacgaagaaaaaa

SEQ ID NO: 1073629 - DNA, 15 bp, Homo sapiens
ctgaggggcagggag

SEQ ID NO: 1073630 - DNA, 24 bp, Homo sapiens
ctgaggggcagggagagcgcctct

SEQ ID NO: 1073631 - DNA, 18 bp, Homo sapiens
ctgaggggcctgcgccca

SEQ ID NO: 1073632 - DNA, 20 bp, Homo sapiens
ctgaggggcctgcgcccaga

SEQ ID NO: 1073633 - DNA, 22 bp, Homo sapiens
ctgaggggcctgcgcccagagc

SEQ ID NO: 1073634 - DNA, 17 bp, Homo sapiens
ctgaggggctaccagga

SEQ ID NO: 1073635 - DNA, 18 bp, Homo sapiens
ctgaggggctaccaggaa

SEQ ID NO: 1073636 - DNA, 20 bp, Homo sapiens
ctgaggggctaccaggaaag

SEQ ID NO: 1073637 - DNA, 13 bp, Homo sapiens
ctgaggggtgtcc

SEQ ID NO: 1073638 - DNA, 20 bp, Homo sapiens
ctgaggggtgtccgagaggc

SEQ ID NO: 1073639 - DNA, 15 bp, Homo sapiens
ctgagggtccccacc

SEQ ID NO: 1073640 - DNA, 19 bp, Homo sapiens
ctgagggtccccacctggg

SEQ ID NO: 1073641 - DNA, 20 bp, Homo sapiens
ctgagggtccccacctggga

SEQ ID NO: 1073642 - DNA, 19 bp, Homo sapiens
ctgagggtggagactaagc

SEQ ID NO: 1073643 - DNA, 20 bp, Homo sapiens
ctgagggtggagactaagcc

SEQ ID NO: 1073644 - DNA, 16 bp, Homo sapiens
ctgaggtataaagaca

SEQ ID NO: 1073645 - DNA, 17 bp, Homo sapiens
ctgaggtataaagacaa

SEQ ID NO: 1073646 - DNA, 18 bp, Homo sapiens
ctgaggtataaagacaag

SEQ ID NO: 1073647 - DNA, 19 bp, Homo sapiens
ctgaggtatggccatgccc

SEQ ID NO: 1073648 - DNA, 16 bp, Homo sapiens
ctgaggtcaataaagc

SEQ ID NO: 1073649 - DNA, 21 bp, Homo sapiens
ctgaggtccaagattctggag

SEQ ID NO: 1073650 - DNA, 17 bp, Homo sapiens
ctgaggtccacagacct

SEQ ID NO: 1073651 - DNA, 22 bp, Homo sapiens
ctgaggtcccttcaaggcctcc

SEQ ID NO: 1073652 - DNA, 23 bp, Homo sapiens
ctgaggtcccttcaaggcctccc

SEQ ID NO: 1073653 - DNA, 17 bp, Homo sapiens
ctgaggtcgggagttcg

SEQ ID NO: 1073654 - DNA, 17 bp, Homo sapiens
ctgaggtgaaagggagc

SEQ ID NO: 1073655 - DNA, 14 bp, Homo sapiens
ctgaggtgcctgct

SEQ ID NO: 1073656 - DNA, 22 bp, Homo sapiens
ctgaggtgcctgctcaggtgct

SEQ ID NO: 1073657 - DNA, 19 bp, Homo sapiens
ctgaggtgcctgtcccacc

SEQ ID NO: 1073658 - DNA, 14 bp, Homo sapiens
ctgaggtgggccca

SEQ ID NO: 1073659 - DNA, 16 bp, Homo sapiens
ctgaggtgggcccagg

SEQ ID NO: 1073660 - DNA, 17 bp, Homo sapiens
ctgaggtgggcccagga

SEQ ID NO: 1073661 - DNA, 20 bp, Homo sapiens
ctgaggtgggcccaggacca

SEQ ID NO: 1073662 - DNA, 22 bp, Homo sapiens
ctgaggtgggcccaggaccagc

SEQ ID NO: 1073663 - DNA, 13 bp, Homo sapiens
ctgaggtggggaa

SEQ ID NO: 1073664 - DNA, 16 bp, Homo sapiens
ctgaggtggggaagga

SEQ ID NO: 1073665 - DNA, 14 bp, Homo sapiens
ctgaggtgtggggg

SEQ ID NO: 1073666 - DNA, 14 bp, Homo sapiens
ctgaggttcctctg

SEQ ID NO: 1073667 - DNA, 16 bp, Homo sapiens
ctgaggttcctctgcc

SEQ ID NO: 1073668 - DNA, 17 bp, Homo sapiens
ctgaggttcctctgcct

SEQ ID NO: 1073669 - DNA, 18 bp, Homo sapiens
ctgaggttcctctgcctg

SEQ ID NO: 1073670 - DNA, 20 bp, Homo sapiens
ctgaggttcctctgcctgcc

SEQ ID NO: 1073671 - DNA, 23 bp, Homo sapiens
ctgaggttcctctgcctgccccg

SEQ ID NO: 1073672 - DNA, 13 bp, Homo sapiens
ctgaggttttgaa

SEQ ID NO: 1073673 - DNA, 20 bp, Homo sapiens
ctgaggttttgaataaaaag

SEQ ID NO: 1073674 - DNA, 12 bp, Homo sapiens
ctgagtaaattg

SEQ ID NO: 1073675 - DNA, 19 bp, Homo sapiens
ctgagtaaattggaaacat

SEQ ID NO: 1073676 - DNA, 20 bp, Homo sapiens
ctgagtaaattggaaacatt

SEQ ID NO: 1073677 - DNA, 13 bp, Homo sapiens
ctgatgcttgaag

SEQ ID NO: 1073678 - DNA, 19 bp, Homo sapiens
ctgatgcttttgtctaatt

SEQ ID NO: 1073679 - DNA, 22 bp, Homo sapiens
ctgatggaacagaatagagaat

SEQ ID NO: 1073680 - DNA, 20 bp, Homo sapiens
ctgatggaactgtgtattta

SEQ ID NO: 1073681 - DNA, 15 bp, Homo sapiens
ctgatggaagatggt

SEQ ID NO: 1073682 - DNA, 16 bp, Homo sapiens
ctgatggaagatggtc

SEQ ID NO: 1073683 - DNA, 16 bp, Homo sapiens
ctgatggaatgtgcca

SEQ ID NO: 1073684 - DNA, 18 bp, Homo sapiens
ctgatggaatgtgccacc

SEQ ID NO: 1073685 - DNA, 20 bp, Homo sapiens
ctgatggaatgtgccacctg

SEQ ID NO: 1073686 - DNA, 20 bp, Homo sapiens
ctgatggaccgggtgggcct

SEQ ID NO: 1073687 - DNA, 15 bp, Homo sapiens
ctgatggacctgccc

SEQ ID NO: 1073688 - DNA, 15 bp, Homo sapiens
ctgatggagccttcc

SEQ ID NO: 1073689 - DNA, 15 bp, Homo sapiens
ctgatggaggaaaaa

SEQ ID NO: 1073690 - DNA, 16 bp, Homo sapiens
ctgatggagtgtgcag

SEQ ID NO: 1073691 - DNA, 17 bp, Homo sapiens
ctgatggcacagaagga

SEQ ID NO: 1073692 - DNA, 11 bp, Homo sapiens
ctgatggccaa

SEQ ID NO: 1073693 - DNA, 17 bp, Homo sapiens
ctgatggccaagggggt

SEQ ID NO: 1073694 - DNA, 14 bp, Homo sapiens
ctgatggccttaat

SEQ ID NO: 1073695 - DNA, 20 bp, Homo sapiens
ctgatggccttaatttcctt

SEQ ID NO: 1073696 - DNA, 20 bp, Homo sapiens
ctgatggcctttggacccag

SEQ ID NO: 1073697 - DNA, 19 bp, Homo sapiens
ctgatggctgctagatttt

SEQ ID NO: 1073698 - DNA, 13 bp, Homo sapiens
ctgatggcttgac

SEQ ID NO: 1073699 - DNA, 16 bp, Homo sapiens
ctgatggcttgacatg

SEQ ID NO: 1073700 - DNA, 20 bp, Homo sapiens
ctgatggcttgacatgtgca

SEQ ID NO: 1073701 - DNA, 23 bp, Homo sapiens
ctgatggcttgacatgtgcaatt

SEQ ID NO: 1073702 - DNA, 22 bp, Homo sapiens
ctgatgggaaaactgccaatat

SEQ ID NO: 1073703 - DNA, 17 bp, Homo sapiens
ctgatgggaaggagggg

SEQ ID NO: 1073704 - DNA, 21 bp, Homo sapiens
ctgatgggaaggaggggagcc

SEQ ID NO: 1073705 - DNA, 17 bp, Homo sapiens
ctgatgggctggggcag

SEQ ID NO: 1073706 - DNA, 16 bp, Homo sapiens
ctgatggtacaggaaa

SEQ ID NO: 1073707 - DNA, 19 bp, Homo sapiens
ctgatggtcagctcccttc

SEQ ID NO: 1073708 - DNA, 18 bp, Homo sapiens
ctgatggtcttaaatgct

SEQ ID NO: 1073709 - DNA, 15 bp, Homo sapiens
ctgatggtgagctgg

SEQ ID NO: 1073710 - DNA, 16 bp, Homo sapiens
ctgatggtgagctggg

SEQ ID NO: 1073711 - DNA, 17 bp, Homo sapiens
ctgatggtgagctggga

SEQ ID NO: 1073712 - DNA, 19 bp, Homo sapiens
ctgatggtgagctgggaag

SEQ ID NO: 1073713 - DNA, 16 bp, Homo sapiens
ctgatggtgctcacga

SEQ ID NO: 1073714 - DNA, 22 bp, Homo sapiens
ctgatggtgtcattctgcctgc

SEQ ID NO: 1073715 - DNA, 16 bp, Homo sapiens
ctgatgtaacaaggtg

SEQ ID NO: 1073716 - DNA, 13 bp, Homo sapiens
ctgatgtattaca

SEQ ID NO: 1073717 - DNA, 18 bp, Homo sapiens
ctgatgtcaatttctgtg

SEQ ID NO: 1073718 - DNA, 15 bp, Homo sapiens
ctgatgtcatatcat

SEQ ID NO: 1073719 - DNA, 16 bp, Homo sapiens
ctgatgtgatattctg

SEQ ID NO: 1073720 - DNA, 16 bp, Homo sapiens
ctgatgtggcaaaagg

SEQ ID NO: 1073721 - DNA, 20 bp, Homo sapiens
ctgatgttacatcacagtgt

SEQ ID NO: 1073722 - DNA, 15 bp, Homo sapiens
ctgatgttactagcc

SEQ ID NO: 1073723 - DNA, 17 bp, Homo sapiens
ctgatgttactagcctc

SEQ ID NO: 1073724 - DNA, 22 bp, Homo sapiens
ctgatgttcctttggaagaaaa

SEQ ID NO: 1073725 - DNA, 15 bp, Homo sapiens
ctgatgtttataaac

SEQ ID NO: 1073726 - DNA, 23 bp, Homo sapiens
ctgatgtttcctgggtgccctgg

SEQ ID NO: 1073727 - DNA, 22 bp, Homo sapiens
ctgattaaaaagggagaaagaa

SEQ ID NO: 1073728 - DNA, 20 bp, Homo sapiens
ctgattaaaaataccttcta

SEQ ID NO: 1073729 - DNA, 14 bp, Homo sapiens
ctgattaaaacaca

SEQ ID NO: 1073730 - DNA, 21 bp, Homo sapiens
ctgattaaaatgcttcctccc

SEQ ID NO: 1073731 - DNA, 15 bp, Homo sapiens
ctgattaatatattt

SEQ ID NO: 1073732 - DNA, 18 bp, Homo sapiens
ctgattaccagtctgatt

SEQ ID NO: 1073733 - DNA, 23 bp, Homo sapiens
ctgattactgtcaataaacagct

SEQ ID NO: 1073734 - DNA, 23 bp, Homo sapiens
ctgattagaaatgaccaatatta

SEQ ID NO: 1073735 - DNA, 21 bp, Homo sapiens
ctgattagaagtataaggtgc

SEQ ID NO: 1073736 - DNA, 20 bp, Homo sapiens
ctgattagagtggttattca

SEQ ID NO: 1073737 - DNA, 17 bp, Homo sapiens
ctgattattttcttcat

SEQ ID NO: 1073738 - DNA, 12 bp, Homo sapiens
ctgattcaaacc

SEQ ID NO: 1073739 - DNA, 18 bp, Homo sapiens
ctgattcaaaccaaagct

SEQ ID NO: 1073740 - DNA, 19 bp, Homo sapiens
ctgattcacctcttcctct

SEQ ID NO: 1073741 - DNA, 22 bp, Homo sapiens
ctgattcacctcttcctctggt

SEQ ID NO: 1073742 - DNA, 13 bp, Homo sapiens
ctgattcactgca

SEQ ID NO: 1073743 - DNA, 15 bp, Homo sapiens
ctgattcactgcatg

SEQ ID NO: 1073744 - DNA, 17 bp, Homo sapiens
ctgattcatactccttt

SEQ ID NO: 1073745 - DNA, 18 bp, Homo sapiens
ctgattcatactcctttt

SEQ ID NO: 1073746 - DNA, 12 bp, Homo sapiens
ctgattccaaat

SEQ ID NO: 1073747 - DNA, 13 bp, Homo sapiens
ctgattcctggag

SEQ ID NO: 1073748 - DNA, 15 bp, Homo sapiens
ctgattcctttaaaa

SEQ ID NO: 1073749 - DNA, 18 bp, Homo sapiens
ctgattcctttaaaatat

SEQ ID NO: 1073750 - DNA, 19 bp, Homo sapiens
ctgattctctttaactgtg

SEQ ID NO: 1073751 - DNA, 22 bp, Homo sapiens
ctgattcttgattcctggctct

SEQ ID NO: 1073752 - DNA, 20 bp, Homo sapiens
ctgattcttgtaaatctttt

SEQ ID NO: 1073753 - DNA, 17 bp, Homo sapiens
ctgattgatcacacagt

SEQ ID NO: 1073754 - DNA, 15 bp, Homo sapiens
ctgattggacatttt

SEQ ID NO: 1073755 - DNA, 17 bp, Homo sapiens
ctgattgggaggtgcgt

SEQ ID NO: 1073756 - DNA, 17 bp, Homo sapiens
ctgattgtgttgaagaa

SEQ ID NO: 1073757 - DNA, 14 bp, Homo sapiens
ctgattgtttacag

SEQ ID NO: 1073758 - DNA, 16 bp, Homo sapiens
ctgatttaatatgcaa

SEQ ID NO: 1073759 - DNA, 17 bp, Homo sapiens
ctgatttaatgttttct

SEQ ID NO: 1073760 - DNA, 16 bp, Homo sapiens
ctgatttagatatgca

SEQ ID NO: 1073761 - DNA, 16 bp, Homo sapiens
ctgatttcagaagaga

SEQ ID NO: 1073762 - DNA, 18 bp, Homo sapiens
ctgatttcagaagagact

SEQ ID NO: 1073763 - DNA, 17 bp, Homo sapiens
ctgatttcaggcagcag

SEQ ID NO: 1073764 - DNA, 22 bp, Homo sapiens
ctgatttcagtttttcatttgt

SEQ ID NO: 1073765 - DNA, 12 bp, Homo sapiens
ctgatttcataa

SEQ ID NO: 1073766 - DNA, 16 bp, Homo sapiens
ctgatttccaggcccc

SEQ ID NO: 1073767 - DNA, 14 bp, Homo sapiens
ctgatttcctttgg

SEQ ID NO: 1073768 - DNA, 23 bp, Homo sapiens
ctgatttctctgaacagaaaaca

SEQ ID NO: 1073769 - DNA, 13 bp, Homo sapiens
ctgatttgtcctg

SEQ ID NO: 1073770 - DNA, 19 bp, Homo sapiens
ctgatttgtcctgcagtgc

SEQ ID NO: 1073771 - DNA, 14 bp, Homo sapiens
ctgatttgttttca

SEQ ID NO: 1073772 - DNA, 23 bp, Homo sapiens
ctgatttgttttcattatagaca

SEQ ID NO: 1073773 - DNA, 18 bp, Homo sapiens
ctgattttaaaatgaata

SEQ ID NO: 1073774 - DNA, 14 bp, Homo sapiens
ctgattttaacaat

SEQ ID NO: 1073775 - DNA, 17 bp, Homo sapiens
ctgattttaacaataac

SEQ ID NO: 1073776 - DNA, 14 bp, Homo sapiens
ctgattttctcact

SEQ ID NO: 1073777 - DNA, 20 bp, Homo sapiens
ctgattttctcactgaactc

SEQ ID NO: 1073778 - DNA, 18 bp, Homo sapiens
ctgattttgtagttaatt

SEQ ID NO: 1073779 - DNA, 13 bp, Homo sapiens
ctgattttgtatg

SEQ ID NO: 1073780 - DNA, 13 bp, Homo sapiens
ctgatttttcctt

SEQ ID NO: 1073781 - DNA, 16 bp, Homo sapiens
ctgatttttcctttcg

SEQ ID NO: 1073782 - DNA, 19 bp, Homo sapiens
ctgattttttttcctttta

SEQ ID NO: 1073783 - DNA, 16 bp, Homo sapiens
ctgcaaaaaaagcctc

SEQ ID NO: 1073784 - DNA, 17 bp, Homo sapiens
ctgcaaaaaaagcctcc

SEQ ID NO: 1073785 - DNA, 20 bp, Homo sapiens
ctgcaaaaaaagcctccaag

SEQ ID NO: 1073786 - DNA, 22 bp, Homo sapiens
ctgcaaaaaaagcctccaaggg

SEQ ID NO: 1073787 - DNA, 23 bp, Homo sapiens
ctgcaaaaaatactttttctaat

SEQ ID NO: 1073788 - DNA, 21 bp, Homo sapiens
ctgcaaaaatatttataaaac

SEQ ID NO: 1073789 - DNA, 19 bp, Homo sapiens
ctgcaaaaggcctcttgta

SEQ ID NO: 1073790 - DNA, 11 bp, Homo sapiens
ctgcaaaattt

SEQ ID NO: 1073791 - DNA, 14 bp, Homo sapiens
ctgcaaacagaaat

SEQ ID NO: 1073792 - DNA, 15 bp, Homo sapiens
ctgcaaacagaaatc

SEQ ID NO: 1073793 - DNA, 16 bp, Homo sapiens
ctgcaaacagaacagg

SEQ ID NO: 1073794 - DNA, 19 bp, Homo sapiens
ctgcaaacagaacagggtc

SEQ ID NO: 1073795 - DNA, 20 bp, Homo sapiens
ctgcaaacagaacagggtca

SEQ ID NO: 1073796 - DNA, 18 bp, Homo sapiens
ctgcaaacctgacccctg

SEQ ID NO: 1073797 - DNA, 14 bp, Homo sapiens
ctgcaaaccttcct

SEQ ID NO: 1073798 - DNA, 17 bp, Homo sapiens
ctgcaaaccttcctggg

SEQ ID NO: 1073799 - DNA, 13 bp, Homo sapiens
ctgcaaagcccag

SEQ ID NO: 1073800 - DNA, 16 bp, Homo sapiens
ctgcaaagctttggct

SEQ ID NO: 1073801 - DNA, 13 bp, Homo sapiens
ctgcaaaggactg

SEQ ID NO: 1073802 - DNA, 21 bp, Homo sapiens
ctgcaccgccgcagaagcagc

SEQ ID NO: 1073803 - DNA, 14 bp, Homo sapiens
ctgcacctcccccc

SEQ ID NO: 1073804 - DNA, 14 bp, Homo sapiens
ctgcacctccgctt

SEQ ID NO: 1073805 - DNA, 18 bp, Homo sapiens
ctgcacctgcctgccgct

SEQ ID NO: 1073806 - DNA, 17 bp, Homo sapiens
ctgcacctgctgcgtcc

SEQ ID NO: 1073807 - DNA, 13 bp, Homo sapiens
ctgcacctggcct

SEQ ID NO: 1073808 - DNA, 16 bp, Homo sapiens
ctgcacctggcctggg

SEQ ID NO: 1073809 - DNA, 13 bp, Homo sapiens
ctgcacctgggca

SEQ ID NO: 1073810 - DNA, 16 bp, Homo sapiens
ctgcacctgggcagct

SEQ ID NO: 1073811 - DNA, 18 bp, Homo sapiens
ctgcacctgggcagctcc

SEQ ID NO: 1073812 - DNA, 13 bp, Homo sapiens
ctgcacctgtgca

SEQ ID NO: 1073813 - DNA, 17 bp, Homo sapiens
ctgcacgctcccctcca

SEQ ID NO: 1073814 - DNA, 14 bp, Homo sapiens
ctgcacgggatgcg

SEQ ID NO: 1073815 - DNA, 22 bp, Homo sapiens
ctgcacgggatgcgtgggaggc

SEQ ID NO: 1073816 - DNA, 18 bp, Homo sapiens
ctgcacgtaggttcccca

SEQ ID NO: 1073817 - DNA, 22 bp, Homo sapiens
ctgcacgtaggttccccagaga

SEQ ID NO: 1073818 - DNA, 21 bp, Homo sapiens
ctgcactaaaacccatcttcc

SEQ ID NO: 1073819 - DNA, 18 bp, Homo sapiens
ctgcactaaagccagcct

SEQ ID NO: 1073820 - DNA, 16 bp, Homo sapiens
ctgcactaatttgatg

SEQ ID NO: 1073821 - DNA, 20 bp, Homo sapiens
ctgcactccaatctgggtga

SEQ ID NO: 1073822 - DNA, 16 bp, Homo sapiens
ctgcactccagcctgg

SEQ ID NO: 1073823 - DNA, 14 bp, Homo sapiens
ctgcactccatggc

SEQ ID NO: 1073824 - DNA, 16 bp, Homo sapiens
ctgcactcccacctga

SEQ ID NO: 1073825 - DNA, 18 bp, Homo sapiens
ctgcactcccacctgaca

SEQ ID NO: 1073826 - DNA, 19 bp, Homo sapiens
ctgcactcccacctgacac

SEQ ID NO: 1073827 - DNA, 12 bp, Homo sapiens
ctgcactcccga

SEQ ID NO: 1073828 - DNA, 20 bp, Homo sapiens
ctgcactccctcctggagct

SEQ ID NO: 1073829 - DNA, 15 bp, Homo sapiens
ctgcactccctggcc

SEQ ID NO: 1073830 - DNA, 16 bp, Homo sapiens
ctgcactccctggcct

SEQ ID NO: 1073831 - DNA, 20 bp, Homo sapiens
ctgcactccggcctgatgac

SEQ ID NO: 1073832 - DNA, 18 bp, Homo sapiens
ctgcactcctttatctgt

SEQ ID NO: 1073833 - DNA, 17 bp, Homo sapiens
ctgcactctaaactgca

SEQ ID NO: 1073834 - DNA, 19 bp, Homo sapiens
ctgcactctaaactgcaaa

SEQ ID NO: 1073835 - DNA, 19 bp, Homo sapiens
ctgcactcttaagcttccg

SEQ ID NO: 1073836 - DNA, 16 bp, Homo sapiens
ctgcactggagccaca

SEQ ID NO: 1073837 - DNA, 20 bp, Homo sapiens
ctgcactggagccacaggca

SEQ ID NO: 1073838 - DNA, 19 bp, Homo sapiens
ctgcactgggaaggaaaca

SEQ ID NO: 1073839 - DNA, 11 bp, Homo sapiens
ctgcactgtga

SEQ ID NO: 1073840 - DNA, 12 bp, Homo sapiens
ctgcactgtgaa

SEQ ID NO: 1073841 - DNA, 23 bp, Homo sapiens
ctgcactgtgccccgcgggcttt

SEQ ID NO: 1073842 - DNA, 21 bp, Homo sapiens
ctgcactgtgtcatcttttca

SEQ ID NO: 1073843 - DNA, 16 bp, Homo sapiens
ctgcacttacttgctt

SEQ ID NO: 1073844 - DNA, 19 bp, Homo sapiens
ctgcacttatacccatgaa

SEQ ID NO: 1073845 - DNA, 13 bp, Homo sapiens
ctgcactttcccc

SEQ ID NO: 1073846 - DNA, 18 bp, Homo sapiens
ctgcactttgtttagaaa

SEQ ID NO: 1073847 - DNA, 20 bp, Homo sapiens
ctgcactttgtttagaaaaa

SEQ ID NO: 1073848 - DNA, 10 bp, Homo sapiens
ctgcactttt

SEQ ID NO: 1073849 - DNA, 11 bp, Homo sapiens
ctgcacttttt

SEQ ID NO: 1073850 - DNA, 16 bp, Homo sapiens
ctgcagaaactactga

SEQ ID NO: 1073851 - DNA, 21 bp, Homo sapiens
ctgcagaacagcatcatgtca

SEQ ID NO: 1073852 - DNA, 22 bp, Homo sapiens
ctgcagaacatcgatatgtata

SEQ ID NO: 1073853 - DNA, 12 bp, Homo sapiens
ctgcagaaccca

SEQ ID NO: 1073854 - DNA, 15 bp, Homo sapiens
ctgcagaacccacca

SEQ ID NO: 1073855 - DNA, 21 bp, Homo sapiens
ctgcagaacgtattggtccag

SEQ ID NO: 1073856 - DNA, 13 bp, Homo sapiens
ctgcagaagccag

SEQ ID NO: 1073857 - DNA, 15 bp, Homo sapiens
ctgcagaagccagaa

SEQ ID NO: 1073858 - DNA, 23 bp, Homo sapiens
ctgcagaagccagaaggtgcagg

SEQ ID NO: 1073859 - DNA, 14 bp, Homo sapiens
ctgcagaaggaaaa

SEQ ID NO: 1073860 - DNA, 21 bp, Homo sapiens
ctgcagaaggaaaaatgtgta

SEQ ID NO: 1073861 - DNA, 14 bp, Homo sapiens
ctgcagaaggccaa

SEQ ID NO: 1073862 - DNA, 15 bp, Homo sapiens
ctgcagaaggccaag

SEQ ID NO: 1073863 - DNA, 23 bp, Homo sapiens
ctgcagacaggctctgaggggca

SEQ ID NO: 1073864 - DNA, 14 bp, Homo sapiens
ctgcagacattctc

SEQ ID NO: 1073865 - DNA, 16 bp, Homo sapiens
ctgcagacattctcaa

SEQ ID NO: 1073866 - DNA, 15 bp, Homo sapiens
ctgcagaccatgcca

SEQ ID NO: 1073867 - DNA, 13 bp, Homo sapiens
ctgcagacctcaa

SEQ ID NO: 1073868 - DNA, 17 bp, Homo sapiens
ctgcagacctcaagcca

SEQ ID NO: 1073869 - DNA, 18 bp, Homo sapiens
ctgcagacgggaatgcct

SEQ ID NO: 1073870 - DNA, 21 bp, Homo sapiens
ctgcagacgggaatgcctagg

SEQ ID NO: 1073871 - DNA, 23 bp, Homo sapiens
ctgcagacgggaatgcctaggtc

SEQ ID NO: 1073872 - DNA, 21 bp, Homo sapiens
ctgcagagaaacttaagcaaa

SEQ ID NO: 1073873 - DNA, 23 bp, Homo sapiens
ctgcagagaaacttaagcaaagg

SEQ ID NO: 1073874 - DNA, 18 bp, Homo sapiens
ctgcagagcagcagcacc

SEQ ID NO: 1073875 - DNA, 22 bp, Homo sapiens
ctgcagagcagcagcacctttc

SEQ ID NO: 1073876 - DNA, 15 bp, Homo sapiens
ctgcagagcccggcc

SEQ ID NO: 1073877 - DNA, 15 bp, Homo sapiens
ctgcagagctatggt

SEQ ID NO: 1073878 - DNA, 21 bp, Homo sapiens
ctgcagagctatggtgaggtg

SEQ ID NO: 1073879 - DNA, 16 bp, Homo sapiens
ctgcagagctgaccca

SEQ ID NO: 1073880 - DNA, 21 bp, Homo sapiens
ctgcagaggaccacagtgggt

SEQ ID NO: 1073881 - DNA, 20 bp, Homo sapiens
ctgcagaggccagaggcccc

SEQ ID NO: 1073882 - DNA, 14 bp, Homo sapiens
ctgcagagggagac

SEQ ID NO: 1073883 - DNA, 15 bp, Homo sapiens
ctgcagagggagacg

SEQ ID NO: 1073884 - DNA, 17 bp, Homo sapiens
ctgcagaggtctgtgct

SEQ ID NO: 1073885 - DNA, 18 bp, Homo sapiens
ctgcagaggtctgtgctg

SEQ ID NO: 1073886 - DNA, 19 bp, Homo sapiens
ctgcagaggtctgtgctga

SEQ ID NO: 1073887 - DNA, 22 bp, Homo sapiens
ctgcagaggtctgtgctgaggc

SEQ ID NO: 1073888 - DNA, 19 bp, Homo sapiens
ctgcagatagcccaggagc

SEQ ID NO: 1073889 - DNA, 14 bp, Homo sapiens
ctgcagatgccacc

SEQ ID NO: 1073890 - DNA, 17 bp, Homo sapiens
ctgcagcaataaagcag

SEQ ID NO: 1073891 - DNA, 21 bp, Homo sapiens
ctgcagcacgcggccttgtct

SEQ ID NO: 1073892 - DNA, 22 bp, Homo sapiens
ctgcagcagagtgagcaagggg

SEQ ID NO: 1073893 - DNA, 15 bp, Homo sapiens
ctgcagcagccggaa

SEQ ID NO: 1073894 - DNA, 13 bp, Homo sapiens
ctgcagcaggagt

SEQ ID NO: 1073895 - DNA, 21 bp, Homo sapiens
ctgcagcagggcaggaagggg

SEQ ID NO: 1073896 - DNA, 23 bp, Homo sapiens
ctgcagcagggcaggaaggggaa

SEQ ID NO: 1073897 - DNA, 20 bp, Homo sapiens
ctgcagcaggtgctgggctg

SEQ ID NO: 1073898 - DNA, 23 bp, Homo sapiens
ctgcagcaggtgctgggctggac

SEQ ID NO: 1073899 - DNA, 11 bp, Homo sapiens
ctgcagcatga

SEQ ID NO: 1073900 - DNA, 18 bp, Homo sapiens
ctgcagcatgttgctgag

SEQ ID NO: 1073901 - DNA, 20 bp, Homo sapiens
ctgcagcatgttgctgagga

SEQ ID NO: 1073902 - DNA, 22 bp, Homo sapiens
ctgcagccaccagacttggcct

SEQ ID NO: 1073903 - DNA, 18 bp, Homo sapiens
ctgcagccagcccagccc

SEQ ID NO: 1073904 - DNA, 14 bp, Homo sapiens
ctgcagccagctca

SEQ ID NO: 1073905 - DNA, 20 bp, Homo sapiens
ctgcagcccaaaacccaggg

SEQ ID NO: 1073906 - DNA, 11 bp, Homo sapiens
ctgcagcccag

SEQ ID NO: 1073907 - DNA, 18 bp, Homo sapiens
ctgcagccccagaagaaa

SEQ ID NO: 1073908 - DNA, 15 bp, Homo sapiens
ctgcagccccccaga

SEQ ID NO: 1073909 - DNA, 18 bp, Homo sapiens
ctgcagcccttgggcagt

SEQ ID NO: 1073910 - DNA, 21 bp, Homo sapiens
ctgcagcctcaacctcctggg

SEQ ID NO: 1073911 - DNA, 18 bp, Homo sapiens
ctgcagcctcctcctgac

SEQ ID NO: 1073912 - DNA, 20 bp, Homo sapiens
ctgcagcctcctcctgacca

SEQ ID NO: 1073913 - DNA, 12 bp, Homo sapiens
ctgcagcctgct

SEQ ID NO: 1073914 - DNA, 15 bp, Homo sapiens
ctgcagcctgctggg

SEQ ID NO: 1073915 - DNA, 22 bp, Homo sapiens
ctgcagcctgctggggctaagc

SEQ ID NO: 1073916 - DNA, 13 bp, Homo sapiens
ctgcagcctgggc

SEQ ID NO: 1073917 - DNA, 20 bp, Homo sapiens
ctgcagcctgggtctggatg

SEQ ID NO: 1073918 - DNA, 14 bp, Homo sapiens
ctgcagccttttct

SEQ ID NO: 1073919 - DNA, 15 bp, Homo sapiens
ctgcagcgcctccct

SEQ ID NO: 1073920 - DNA, 14 bp, Homo sapiens
ctgcagcgcgctcc

SEQ ID NO: 1073921 - DNA, 20 bp, Homo sapiens
ctgcagctatgcgcaatgtg

SEQ ID NO: 1073922 - DNA, 21 bp, Homo sapiens
ctgcagctatgcgcaatgtgg

SEQ ID NO: 1073923 - DNA, 10 bp, Homo sapiens
ctgcagctgc

SEQ ID NO: 1073924 - DNA, 22 bp, Homo sapiens
ctgcagctgccgggcctgattt

SEQ ID NO: 1073925 - DNA, 13 bp, Homo sapiens
ctgcagctggaca

SEQ ID NO: 1073926 - DNA, 15 bp, Homo sapiens
ctgcagctggacaga

SEQ ID NO: 1073927 - DNA, 19 bp, Homo sapiens
ctgcagctgggccccatgc

SEQ ID NO: 1073928 - DNA, 21 bp, Homo sapiens
ctgcagctgggccccatgctc

SEQ ID NO: 1073929 - DNA, 23 bp, Homo sapiens
ctgcagctgggccccatgctctg

SEQ ID NO: 1073930 - DNA, 12 bp, Homo sapiens
ctgcagctgtga

SEQ ID NO: 1073931 - DNA, 13 bp, Homo sapiens
ctgcagctgtgag

SEQ ID NO: 1073932 - DNA, 22 bp, Homo sapiens
ctgcaggaaacatttctgacac

SEQ ID NO: 1073933 - DNA, 12 bp, Homo sapiens
ctgcaggaccct

SEQ ID NO: 1073934 - DNA, 21 bp, Homo sapiens
ctgcaggaccctgtcctgcag

SEQ ID NO: 1073935 - DNA, 16 bp, Homo sapiens
ctgcaggagcagggcg

SEQ ID NO: 1073936 - DNA, 20 bp, Homo sapiens
ctgcaggagtgtcctgccca

SEQ ID NO: 1073937 - DNA, 19 bp, Homo sapiens
ctgcaggcaacactttagc

SEQ ID NO: 1073938 - DNA, 22 bp, Homo sapiens
ctgcaggcaccgggctggctgc

SEQ ID NO: 1073939 - DNA, 14 bp, Homo sapiens
ctgcaggcagacac

SEQ ID NO: 1073940 - DNA, 14 bp, Homo sapiens
ctgcaggcaggaac

SEQ ID NO: 1073941 - DNA, 15 bp, Homo sapiens
ctgcaggcaggaaca

SEQ ID NO: 1073942 - DNA, 19 bp, Homo sapiens
ctgcaggcaggcggctcct

SEQ ID NO: 1073943 - DNA, 22 bp, Homo sapiens
ctgcaggcaggcggctcctcct

SEQ ID NO: 1073944 - DNA, 23 bp, Homo sapiens
ctgcaggccaagagcagaggcag

SEQ ID NO: 1073945 - DNA, 22 bp, Homo sapiens
ctgcaggccccgcttgtccagc

SEQ ID NO: 1073946 - DNA, 13 bp, Homo sapiens
ctgcaggccctgg

SEQ ID NO: 1073947 - DNA, 19 bp, Homo sapiens
ctgcaggccctggcctccc

SEQ ID NO: 1073948 - DNA, 13 bp, Homo sapiens
ctgcaggctgcag

SEQ ID NO: 1073949 - DNA, 20 bp, Homo sapiens
ctgcaggctgcaggagggca

SEQ ID NO: 1073950 - DNA, 12 bp, Homo sapiens
ctgcaggctggg

SEQ ID NO: 1073951 - DNA, 14 bp, Homo sapiens
ctgcaggctgggga

SEQ ID NO: 1073952 - DNA, 17 bp, Homo sapiens
ctgcaggctggggaggt

SEQ ID NO: 1073953 - DNA, 20 bp, Homo sapiens
ctgcaggctggggaggtgct

SEQ ID NO: 1073954 - DNA, 21 bp, Homo sapiens
ctgcaggctggggaggtgctg

SEQ ID NO: 1073955 - DNA, 15 bp, Homo sapiens
ctgcagggagcaact

SEQ ID NO: 1073956 - DNA, 23 bp, Homo sapiens
ctgcagggagcaactctccactc

SEQ ID NO: 1073957 - DNA, 17 bp, Homo sapiens
ctgcagggcacggggac

SEQ ID NO: 1073958 - DNA, 19 bp, Homo sapiens
ctgcagggcacggggacct

SEQ ID NO: 1073959 - DNA, 21 bp, Homo sapiens
ctgcagggcacggggacctgg

SEQ ID NO: 1073960 - DNA, 14 bp, Homo sapiens
ctgcagggctccca

SEQ ID NO: 1073961 - DNA, 12 bp, Homo sapiens
ctgcaggggagc

SEQ ID NO: 1073962 - DNA, 12 bp, Homo sapiens
ctgcaggggcct

SEQ ID NO: 1073963 - DNA, 17 bp, Homo sapiens
ctgcaggggcctggagg

SEQ ID NO: 1073964 - DNA, 12 bp, Homo sapiens
ctgcaggggcta

SEQ ID NO: 1073965 - DNA, 14 bp, Homo sapiens
ctgcagggggagga

SEQ ID NO: 1073966 - DNA, 21 bp, Homo sapiens
ctgcagggggaggaggacttg

SEQ ID NO: 1073967 - DNA, 17 bp, Homo sapiens
ctgcagggggtgtgtct

SEQ ID NO: 1073968 - DNA, 16 bp, Homo sapiens
ctgcagggtgacgcct

SEQ ID NO: 1073969 - DNA, 17 bp, Homo sapiens
ctgcagggtgacgcctg

SEQ ID NO: 1073970 - DNA, 21 bp, Homo sapiens
ctgcagggtgacgcctgagac

SEQ ID NO: 1073971 - DNA, 20 bp, Homo sapiens
ctgcagggtggtgctgggac

SEQ ID NO: 1073972 - DNA, 23 bp, Homo sapiens
ctgcagggtggtgctgggactga

SEQ ID NO: 1073973 - DNA, 15 bp, Homo sapiens
ctgcaggtacttcct

SEQ ID NO: 1073974 - DNA, 15 bp, Homo sapiens
ctgcaggtcagttgt

SEQ ID NO: 1073975 - DNA, 17 bp, Homo sapiens
ctgcaggtcagttgtaa

SEQ ID NO: 1073976 - DNA, 19 bp, Homo sapiens
ctgcaggtcagttgtaata

SEQ ID NO: 1073977 - DNA, 13 bp, Homo sapiens
ctgcaggtgggct

SEQ ID NO: 1073978 - DNA, 19 bp, Homo sapiens
ctgcaggtgggctgggccc

SEQ ID NO: 1073979 - DNA, 22 bp, Homo sapiens
ctgcaggtgggctgggcccacc

SEQ ID NO: 1073980 - DNA, 19 bp, Homo sapiens
ctgcaggttgaagccatgt

SEQ ID NO: 1073981 - DNA, 15 bp, Homo sapiens
ctgcagtaaaacaca

SEQ ID NO: 1073982 - DNA, 16 bp, Homo sapiens
ctgcagtaaaacacat

SEQ ID NO: 1073983 - DNA, 17 bp, Homo sapiens
ctgcagtaaaacacatt

SEQ ID NO: 1073984 - DNA, 14 bp, Homo sapiens
ctgcagtaaatctt

SEQ ID NO: 1073985 - DNA, 17 bp, Homo sapiens
ctgcagtaaatctttta

SEQ ID NO: 1073986 - DNA, 21 bp, Homo sapiens
ctgcagtacatacgtctgcca

SEQ ID NO: 1073987 - DNA, 15 bp, Homo sapiens
ctgcagtagtctctg

SEQ ID NO: 1073988 - DNA, 16 bp, Homo sapiens
ctgcagtagtctctgt

SEQ ID NO: 1073989 - DNA, 20 bp, Homo sapiens
ctgcagtagtctctgtgctt

SEQ ID NO: 1073990 - DNA, 22 bp, Homo sapiens
ctgcagtcctactcaagcgggt

SEQ ID NO: 1073991 - DNA, 23 bp, Homo sapiens
ctgcagtcctactcaagcgggtg

SEQ ID NO: 1073992 - DNA, 17 bp, Homo sapiens
ctgcagtcttatttcca

SEQ ID NO: 1073993 - DNA, 16 bp, Homo sapiens
ctgcagtgaggctgtg

SEQ ID NO: 1073994 - DNA, 15 bp, Homo sapiens
ctgcagtgaggggcc

SEQ ID NO: 1073995 - DNA, 20 bp, Homo sapiens
ctgcagtgaggggccctcca

SEQ ID NO: 1073996 - DNA, 17 bp, Homo sapiens
ctgcagtggagaagaca

SEQ ID NO: 1073997 - DNA, 14 bp, Homo sapiens
ctgcagtggtgtga

SEQ ID NO: 1073998 - DNA, 16 bp, Homo sapiens
ctgcagtgtggagttc

SEQ ID NO: 1073999 - DNA, 15 bp, Homo sapiens
ctgcagttaccacag

SEQ ID NO: 1074000 - DNA, 22 bp, Homo sapiens
ctgcagttaccacagcaactga

SEQ ID NO: 1074001 - DNA, 19 bp, Homo sapiens
ctgcagtttgagacaggag

SEQ ID NO: 1074002 - DNA, 21 bp, Homo sapiens
ctgcagtttgagacaggagac

SEQ ID NO: 1074003 - DNA, 20 bp, Homo sapiens
ctgcagtttggccctggagc

SEQ ID NO: 1074004 - DNA, 19 bp, Homo sapiens
ctgcagtttgggagacatg

SEQ ID NO: 1074005 - DNA, 20 bp, Homo sapiens
ctgcagtttgggagacatgg

SEQ ID NO: 1074006 - DNA, 21 bp, Homo sapiens
ctgcagttttgctatctgggc

SEQ ID NO: 1074007 - DNA, 15 bp, Homo sapiens
ctgcagtttttccca

SEQ ID NO: 1074008 - DNA, 22 bp, Homo sapiens
ctgcataatgtttctggatttc

SEQ ID NO: 1074009 - DNA, 13 bp, Homo sapiens
ctgccctctgctg

SEQ ID NO: 1074010 - DNA, 19 bp, Homo sapiens
ctgccctctgctgctgccc

SEQ ID NO: 1074011 - DNA, 11 bp, Homo sapiens
ctgccctgaga

SEQ ID NO: 1074012 - DNA, 15 bp, Homo sapiens
ctgccctgaggggct

SEQ ID NO: 1074013 - DNA, 23 bp, Homo sapiens
ctgccctgaggggctggggaggg

SEQ ID NO: 1074014 - DNA, 20 bp, Homo sapiens
ctgccctgcacgtcatggga

SEQ ID NO: 1074015 - DNA, 12 bp, Homo sapiens
ctgccctgcagc

SEQ ID NO: 1074016 - DNA, 12 bp, Homo sapiens
ctgccctgcatg

SEQ ID NO: 1074017 - DNA, 13 bp, Homo sapiens
ctgccctgccact

SEQ ID NO: 1074018 - DNA, 13 bp, Homo sapiens
ctgccctgcccaa

SEQ ID NO: 1074019 - DNA, 14 bp, Homo sapiens
ctgccctgccctca

SEQ ID NO: 1074020 - DNA, 13 bp, Homo sapiens
ctgccctgcctcc

SEQ ID NO: 1074021 - DNA, 13 bp, Homo sapiens
ctgccctgcctgc

SEQ ID NO: 1074022 - DNA, 12 bp, Homo sapiens
ctgccctgcctt

SEQ ID NO: 1074023 - DNA, 14 bp, Homo sapiens
ctgccctgccttgc

SEQ ID NO: 1074024 - DNA, 15 bp, Homo sapiens
ctgccctgccttgcc

SEQ ID NO: 1074025 - DNA, 12 bp, Homo sapiens
ctgccctgctcc

SEQ ID NO: 1074026 - DNA, 13 bp, Homo sapiens
ctgccctgctcct

SEQ ID NO: 1074027 - DNA, 14 bp, Homo sapiens
ctgccctgctccta

SEQ ID NO: 1074028 - DNA, 12 bp, Homo sapiens
ctgccctgctgc

SEQ ID NO: 1074029 - DNA, 19 bp, Homo sapiens
ctgccctgctgccacagca

SEQ ID NO: 1074030 - DNA, 17 bp, Homo sapiens
ctgccctggcagggtca

SEQ ID NO: 1074031 - DNA, 13 bp, Homo sapiens
ctgccctggccct

SEQ ID NO: 1074032 - DNA, 16 bp, Homo sapiens
ctgccctggccctgag

SEQ ID NO: 1074033 - DNA, 14 bp, Homo sapiens
ctgccctggctgct

SEQ ID NO: 1074034 - DNA, 21 bp, Homo sapiens
ctgccctggctgctgccccca

SEQ ID NO: 1074035 - DNA, 19 bp, Homo sapiens
ctgccctggtgctgccaca

SEQ ID NO: 1074036 - DNA, 21 bp, Homo sapiens
ctgccctggtgctgccacact

SEQ ID NO: 1074037 - DNA, 17 bp, Homo sapiens
ctgccctgtccaaaagc

SEQ ID NO: 1074038 - DNA, 14 bp, Homo sapiens
ctgccctgtccctg

SEQ ID NO: 1074039 - DNA, 21 bp, Homo sapiens
ctgccctgttgtgtatagatg

SEQ ID NO: 1074040 - DNA, 12 bp, Homo sapiens
ctgcccttccag

SEQ ID NO: 1074041 - DNA, 14 bp, Homo sapiens
ctgcccttccctct

SEQ ID NO: 1074042 - DNA, 18 bp, Homo sapiens
ctgcccttccctctgggc

SEQ ID NO: 1074043 - DNA, 15 bp, Homo sapiens
ctgcccttcctcagt

SEQ ID NO: 1074044 - DNA, 20 bp, Homo sapiens
ctgcccttcctcctgatgga

SEQ ID NO: 1074045 - DNA, 22 bp, Homo sapiens
ctgcccttcctcctgatggagt

SEQ ID NO: 1074046 - DNA, 10 bp, Homo sapiens
ctgcccttga

SEQ ID NO: 1074047 - DNA, 17 bp, Homo sapiens
ctgcccttgctgcccgc

SEQ ID NO: 1074048 - DNA, 15 bp, Homo sapiens
ctgcccttggcacca

SEQ ID NO: 1074049 - DNA, 21 bp, Homo sapiens
ctgcccttggcaccaccaggg

SEQ ID NO: 1074050 - DNA, 15 bp, Homo sapiens
ctgccctttcctagg

SEQ ID NO: 1074051 - DNA, 13 bp, Homo sapiens
ctgccctttggcc

SEQ ID NO: 1074052 - DNA, 14 bp, Homo sapiens
ctgccctttggcca

SEQ ID NO: 1074053 - DNA, 23 bp, Homo sapiens
ctgccctttggccaacagggtag

SEQ ID NO: 1074054 - DNA, 19 bp, Homo sapiens
ctgcccttttcaggaagct

SEQ ID NO: 1074055 - DNA, 13 bp, Homo sapiens
ctgccgaccagag

SEQ ID NO: 1074056 - DNA, 22 bp, Homo sapiens
ctgccgaccgaggctggagctg

SEQ ID NO: 1074057 - DNA, 13 bp, Homo sapiens
ctgccgactcccc

SEQ ID NO: 1074058 - DNA, 23 bp, Homo sapiens
ctgccgacttggagactcctggt

SEQ ID NO: 1074059 - DNA, 21 bp, Homo sapiens
ctgccgagacagaccctctgc

SEQ ID NO: 1074060 - DNA, 12 bp, Homo sapiens
ctgccgagccac

SEQ ID NO: 1074061 - DNA, 20 bp, Homo sapiens
ctgccgagccaccatgcttg

SEQ ID NO: 1074062 - DNA, 16 bp, Homo sapiens
ctgccgcaccccagag

SEQ ID NO: 1074063 - DNA, 17 bp, Homo sapiens
ctgccgcaccccagagt

SEQ ID NO: 1074064 - DNA, 16 bp, Homo sapiens
ctgccgcccacctcgc

SEQ ID NO: 1074065 - DNA, 17 bp, Homo sapiens
ctgccgcccacctcgct

SEQ ID NO: 1074066 - DNA, 20 bp, Homo sapiens
ctgccgcccacctcgctccc

SEQ ID NO: 1074067 - DNA, 18 bp, Homo sapiens
ctgccgccccctcctgaa

SEQ ID NO: 1074068 - DNA, 16 bp, Homo sapiens
ctgccgcctcccagcc

SEQ ID NO: 1074069 - DNA, 13 bp, Homo sapiens
ctgccgctacctc

SEQ ID NO: 1074070 - DNA, 17 bp, Homo sapiens
ctgccgctacctccctc

SEQ ID NO: 1074071 - DNA, 16 bp, Homo sapiens
ctgccgctgcaccacg

SEQ ID NO: 1074072 - DNA, 18 bp, Homo sapiens
ctgccgctgccgctgcac

SEQ ID NO: 1074073 - DNA, 19 bp, Homo sapiens
ctgccgctgccgctgcacc

SEQ ID NO: 1074074 - DNA, 20 bp, Homo sapiens
ctgccgctgccgctgcacca

SEQ ID NO: 1074075 - DNA, 22 bp, Homo sapiens
ctgccgctgcttccaggctggg

SEQ ID NO: 1074076 - DNA, 15 bp, Homo sapiens
ctgccggacacagca

SEQ ID NO: 1074077 - DNA, 21 bp, Homo sapiens
ctgccggcaggatgcagcgcc

SEQ ID NO: 1074078 - DNA, 22 bp, Homo sapiens
ctgccggctctttccttgctca

SEQ ID NO: 1074079 - DNA, 15 bp, Homo sapiens
ctgccgggctgaggg

SEQ ID NO: 1074080 - DNA, 18 bp, Homo sapiens
ctgccgggctgagggcct

SEQ ID NO: 1074081 - DNA, 22 bp, Homo sapiens
ctgccgggctgagggcctgctg

SEQ ID NO: 1074082 - DNA, 19 bp, Homo sapiens
ctgccgggttctagtctcc

SEQ ID NO: 1074083 - DNA, 23 bp, Homo sapiens
ctgccgggttctagtctcctttg

SEQ ID NO: 1074084 - DNA, 18 bp, Homo sapiens
ctgccggtcacccaggct

SEQ ID NO: 1074085 - DNA, 21 bp, Homo sapiens
ctgccggtcatttgaatgaga

SEQ ID NO: 1074086 - DNA, 20 bp, Homo sapiens
ctgccggtttgaaaatatgc

SEQ ID NO: 1074087 - DNA, 15 bp, Homo sapiens
ctgccgtaatttaac

SEQ ID NO: 1074088 - DNA, 19 bp, Homo sapiens
ctgccgtcaccaccacccc

SEQ ID NO: 1074089 - DNA, 17 bp, Homo sapiens
ctgccgtctctcctgct

SEQ ID NO: 1074090 - DNA, 14 bp, Homo sapiens
ctgccgtctctgga

SEQ ID NO: 1074091 - DNA, 15 bp, Homo sapiens
ctgccgtctctggag

SEQ ID NO: 1074092 - DNA, 14 bp, Homo sapiens
ctgccgtgcatggc

SEQ ID NO: 1074093 - DNA, 19 bp, Homo sapiens
ctgccgtgcatggctcctg

SEQ ID NO: 1074094 - DNA, 15 bp, Homo sapiens
ctgcctaagtggctg

SEQ ID NO: 1074095 - DNA, 20 bp, Homo sapiens
ctgcctaagtggctgctgac

SEQ ID NO: 1074096 - DNA, 16 bp, Homo sapiens
ctgcctacagccaggt

SEQ ID NO: 1074097 - DNA, 18 bp, Homo sapiens
ctgcctacgttctcttta

SEQ ID NO: 1074098 - DNA, 12 bp, Homo sapiens
ctgcctagaaaa

SEQ ID NO: 1074099 - DNA, 14 bp, Homo sapiens
ctgcctagagtgta

SEQ ID NO: 1074100 - DNA, 20 bp, Homo sapiens
ctgcctagatccacgtgtgg

SEQ ID NO: 1074101 - DNA, 22 bp, Homo sapiens
ctgcctagcatggggtcagccc

SEQ ID NO: 1074102 - DNA, 19 bp, Homo sapiens
ctgcctaggaattcccagc

SEQ ID NO: 1074103 - DNA, 17 bp, Homo sapiens
ctgcctagtgggagtta

SEQ ID NO: 1074104 - DNA, 17 bp, Homo sapiens
ctgcctattatctgtca

SEQ ID NO: 1074105 - DNA, 21 bp, Homo sapiens
ctgcctcaatgtgaatcagac

SEQ ID NO: 1074106 - DNA, 16 bp, Homo sapiens
ctgcctcacccacacc

SEQ ID NO: 1074107 - DNA, 13 bp, Homo sapiens
ctgcctcagccag

SEQ ID NO: 1074108 - DNA, 18 bp, Homo sapiens
ctgcctcagccaggccct

SEQ ID NO: 1074109 - DNA, 21 bp, Homo sapiens
ctgcctcagccagtggcacag

SEQ ID NO: 1074110 - DNA, 22 bp, Homo sapiens
ctgcctcagccagtggcacagg

SEQ ID NO: 1074111 - DNA, 23 bp, Homo sapiens
ctgcctcagccagtggcacagga

SEQ ID NO: 1074112 - DNA, 14 bp, Homo sapiens
ctgcctcagcccgc

SEQ ID NO: 1074113 - DNA, 22 bp, Homo sapiens
ctgcctcagccttctgagtagc

SEQ ID NO: 1074114 - DNA, 10 bp, Homo sapiens
ctgcctcagg

SEQ ID NO: 1074115 - DNA, 12 bp, Homo sapiens
ctgcctcaggac

SEQ ID NO: 1074116 - DNA, 18 bp, Homo sapiens
ctgcctcaggcactctcc

SEQ ID NO: 1074117 - DNA, 21 bp, Homo sapiens
ctgcctcaggcactctcctgt

SEQ ID NO: 1074118 - DNA, 12 bp, Homo sapiens
ctgcctccaccc

SEQ ID NO: 1074119 - DNA, 21 bp, Homo sapiens
ctgcctccacccgtcctccct

SEQ ID NO: 1074120 - DNA, 13 bp, Homo sapiens
ctgcctccaggaa

SEQ ID NO: 1074121 - DNA, 18 bp, Homo sapiens
ctgcctccattctgacca

SEQ ID NO: 1074122 - DNA, 15 bp, Homo sapiens
ctgcctcccacttca

SEQ ID NO: 1074123 - DNA, 16 bp, Homo sapiens
ctgcctcccatgcctg

SEQ ID NO: 1074124 - DNA, 16 bp, Homo sapiens
ctgcctcccattctgc

SEQ ID NO: 1074125 - DNA, 18 bp, Homo sapiens
ctgcctccccaaccctgc

SEQ ID NO: 1074126 - DNA, 17 bp, Homo sapiens
ctgcctccctctcttcc

SEQ ID NO: 1074127 - DNA, 19 bp, Homo sapiens
ctgcctccctctcttccgg

SEQ ID NO: 1074128 - DNA, 23 bp, Homo sapiens
ctgcctccctctcttccgggagc

SEQ ID NO: 1074129 - DNA, 21 bp, Homo sapiens
ctgcctcccttgtggcagcaa

SEQ ID NO: 1074130 - DNA, 15 bp, Homo sapiens
ctgcctccctttctg

SEQ ID NO: 1074131 - DNA, 14 bp, Homo sapiens
ctgcctcctaggct

SEQ ID NO: 1074132 - DNA, 17 bp, Homo sapiens
ctgcctcctaggctgga

SEQ ID NO: 1074133 - DNA, 12 bp, Homo sapiens
ctgcctcctcag

SEQ ID NO: 1074134 - DNA, 15 bp, Homo sapiens
ctgcctcctccctcc

SEQ ID NO: 1074135 - DNA, 23 bp, Homo sapiens
ctgccttcagtaggaacaagctg

SEQ ID NO: 1074136 - DNA, 11 bp, Homo sapiens
ctgccttccag

SEQ ID NO: 1074137 - DNA, 14 bp, Homo sapiens
ctgccttcccccaa

SEQ ID NO: 1074138 - DNA, 16 bp, Homo sapiens
ctgccttccctagctt

SEQ ID NO: 1074139 - DNA, 12 bp, Homo sapiens
ctgccttcctca

SEQ ID NO: 1074140 - DNA, 14 bp, Homo sapiens
ctgccttcctctga

SEQ ID NO: 1074141 - DNA, 18 bp, Homo sapiens
ctgccttcctctgaggac

SEQ ID NO: 1074142 - DNA, 16 bp, Homo sapiens
ctgccttcgcaccttg

SEQ ID NO: 1074143 - DNA, 13 bp, Homo sapiens
ctgccttcgcttc

SEQ ID NO: 1074144 - DNA, 20 bp, Homo sapiens
ctgccttcgcttcttgcctc

SEQ ID NO: 1074145 - DNA, 13 bp, Homo sapiens
ctgccttcgttaa

SEQ ID NO: 1074146 - DNA, 17 bp, Homo sapiens
ctgccttctcctctctg

SEQ ID NO: 1074147 - DNA, 18 bp, Homo sapiens
ctgccttctcctctctgg

SEQ ID NO: 1074148 - DNA, 20 bp, Homo sapiens
ctgccttctcctctctgggc

SEQ ID NO: 1074149 - DNA, 22 bp, Homo sapiens
ctgccttctcctctctgggcct

SEQ ID NO: 1074150 - DNA, 20 bp, Homo sapiens
ctgccttgaagccactgaag

SEQ ID NO: 1074151 - DNA, 15 bp, Homo sapiens
ctgccttgccgctcc

SEQ ID NO: 1074152 - DNA, 12 bp, Homo sapiens
ctgccttgctcc

SEQ ID NO: 1074153 - DNA, 13 bp, Homo sapiens
ctgccttgctgtt

SEQ ID NO: 1074154 - DNA, 16 bp, Homo sapiens
ctgccttgctgttggt

SEQ ID NO: 1074155 - DNA, 21 bp, Homo sapiens
ctgccttgctgttggtcatgt

SEQ ID NO: 1074156 - DNA, 21 bp, Homo sapiens
ctgccttggacaccatcccct

SEQ ID NO: 1074157 - DNA, 19 bp, Homo sapiens
ctgccttggcctcccaaag

SEQ ID NO: 1074158 - DNA, 15 bp, Homo sapiens
ctgccttggctcaga

SEQ ID NO: 1074159 - DNA, 23 bp, Homo sapiens
ctgcctttagcctggaccaaagg

SEQ ID NO: 1074160 - DNA, 15 bp, Homo sapiens
ctgcctttcccccct

SEQ ID NO: 1074161 - DNA, 18 bp, Homo sapiens
ctgcctttcccccctcac

SEQ ID NO: 1074162 - DNA, 17 bp, Homo sapiens
ctgcctttctcccccga

SEQ ID NO: 1074163 - DNA, 23 bp, Homo sapiens
ctgcctttctcccccgacactgc

SEQ ID NO: 1074164 - DNA, 18 bp, Homo sapiens
ctgcctttgatcacagga

SEQ ID NO: 1074165 - DNA, 21 bp, Homo sapiens
ctgcctttgatcacaggagca

SEQ ID NO: 1074166 - DNA, 18 bp, Homo sapiens
ctgcctttgatgttacag

SEQ ID NO: 1074167 - DNA, 15 bp, Homo sapiens
ctgcctttgtatgtg

SEQ ID NO: 1074168 - DNA, 18 bp, Homo sapiens
ctgcctttgtatgtggaa

SEQ ID NO: 1074169 - DNA, 19 bp, Homo sapiens
ctgcctttgtggtgggcgc

SEQ ID NO: 1074170 - DNA, 20 bp, Homo sapiens
ctgcctttgtggtgggcgct

SEQ ID NO: 1074171 - DNA, 22 bp, Homo sapiens
ctgcctttgtggtgggcgctgg

SEQ ID NO: 1074172 - DNA, 23 bp, Homo sapiens
ctgcctttgtggtgggcgctggg

SEQ ID NO: 1074173 - DNA, 17 bp, Homo sapiens
ctgccttttctggagtt

SEQ ID NO: 1074174 - DNA, 18 bp, Homo sapiens
ctgccttttttcacagcc

SEQ ID NO: 1074175 - DNA, 22 bp, Homo sapiens
ctgcgaccttgcaacctcacct

SEQ ID NO: 1074176 - DNA, 14 bp, Homo sapiens
ctgcgactttctgc

SEQ ID NO: 1074177 - DNA, 17 bp, Homo sapiens
ctgcgactttctgcctg

SEQ ID NO: 1074178 - DNA, 23 bp, Homo sapiens
ctgcgagacgcacacagctgagc

SEQ ID NO: 1074179 - DNA, 17 bp, Homo sapiens
ctgcgatcttcagagca

SEQ ID NO: 1074180 - DNA, 12 bp, Homo sapiens
ctgcgcactgtg

SEQ ID NO: 1074181 - DNA, 12 bp, Homo sapiens
ctgcgcagggtg

SEQ ID NO: 1074182 - DNA, 13 bp, Homo sapiens
ctgcgccaggcag

SEQ ID NO: 1074183 - DNA, 18 bp, Homo sapiens
ctgcgccaggcagagctg

SEQ ID NO: 1074184 - DNA, 20 bp, Homo sapiens
ctgcgccagtcctgctacct

SEQ ID NO: 1074185 - DNA, 18 bp, Homo sapiens
ctgcgcccagagctggcc

SEQ ID NO: 1074186 - DNA, 21 bp, Homo sapiens
ctgcgcccagagctggcctcc

SEQ ID NO: 1074187 - DNA, 23 bp, Homo sapiens
ctgcgcccagtccttccacctcg

SEQ ID NO: 1074188 - DNA, 14 bp, Homo sapiens
ctgcgcccccagct

SEQ ID NO: 1074189 - DNA, 16 bp, Homo sapiens
ctgcgcccccagcttc

SEQ ID NO: 1074190 - DNA, 19 bp, Homo sapiens
ctgcgcccccagcttctct

SEQ ID NO: 1074191 - DNA, 22 bp, Homo sapiens
ctgcgcccttaactgcatccag

SEQ ID NO: 1074192 - DNA, 18 bp, Homo sapiens
ctgcgcccttaccttccc

SEQ ID NO: 1074193 - DNA, 22 bp, Homo sapiens
ctgcgcccttgaggggccccag

SEQ ID NO: 1074194 - DNA, 16 bp, Homo sapiens
ctgctcagcttctcct

SEQ ID NO: 1074195 - DNA, 18 bp, Homo sapiens
ctgctcagcttctcctgt

SEQ ID NO: 1074196 - DNA, 17 bp, Homo sapiens
ctgctcaggaaacgaga

SEQ ID NO: 1074197 - DNA, 20 bp, Homo sapiens
ctgctcaggtgctatgtccc

SEQ ID NO: 1074198 - DNA, 20 bp, Homo sapiens
ctgctcagtgcttgggctcc

SEQ ID NO: 1074199 - DNA, 12 bp, Homo sapiens
ctgctcatcatt

SEQ ID NO: 1074200 - DNA, 17 bp, Homo sapiens
ctgctcatcattctctg

SEQ ID NO: 1074201 - DNA, 18 bp, Homo sapiens
ctgctcatcattctctgt

SEQ ID NO: 1074202 - DNA, 15 bp, Homo sapiens
ctgctcatgggtggc

SEQ ID NO: 1074203 - DNA, 21 bp, Homo sapiens
ctgctcattacagttctttcc

SEQ ID NO: 1074204 - DNA, 23 bp, Homo sapiens
ctgctcattactacactggtgtg

SEQ ID NO: 1074205 - DNA, 22 bp, Homo sapiens
ctgctcattttgacaaagtgcc

SEQ ID NO: 1074206 - DNA, 15 bp, Homo sapiens
ctgctccaccagcag

SEQ ID NO: 1074207 - DNA, 12 bp, Homo sapiens
ctgctccaccct

SEQ ID NO: 1074208 - DNA, 15 bp, Homo sapiens
ctgctccacccttgg

SEQ ID NO: 1074209 - DNA, 21 bp, Homo sapiens
ctgctccacgaagccttaagc

SEQ ID NO: 1074210 - DNA, 13 bp, Homo sapiens
ctgctccagaaga

SEQ ID NO: 1074211 - DNA, 20 bp, Homo sapiens
ctgctccagaagatgccagc

SEQ ID NO: 1074212 - DNA, 20 bp, Homo sapiens
ctgctccagaatttggaaat

SEQ ID NO: 1074213 - DNA, 21 bp, Homo sapiens
ctgctccagaatttggaaatc

SEQ ID NO: 1074214 - DNA, 16 bp, Homo sapiens
ctgctccagactcact

SEQ ID NO: 1074215 - DNA, 23 bp, Homo sapiens
ctgctccagcaactgcccttcca

SEQ ID NO: 1074216 - DNA, 23 bp, Homo sapiens
ctgctccagcccctttgcctctg

SEQ ID NO: 1074217 - DNA, 20 bp, Homo sapiens
ctgctccagctgttcagctg

SEQ ID NO: 1074218 - DNA, 12 bp, Homo sapiens
ctgctccaggcc

SEQ ID NO: 1074219 - DNA, 23 bp, Homo sapiens
ctgctccatttataaccccagcc

SEQ ID NO: 1074220 - DNA, 18 bp, Homo sapiens
ctgctcccacacttgtgc

SEQ ID NO: 1074221 - DNA, 23 bp, Homo sapiens
ctgctcccacacttgtgccagcc

SEQ ID NO: 1074222 - DNA, 23 bp, Homo sapiens
ctgctcccagatgccttctagat

SEQ ID NO: 1074223 - DNA, 17 bp, Homo sapiens
ctgctcccagcagccct

SEQ ID NO: 1074224 - DNA, 14 bp, Homo sapiens
ctgctcccattcct

SEQ ID NO: 1074225 - DNA, 15 bp, Homo sapiens
ctgctccccacccct

SEQ ID NO: 1074226 - DNA, 16 bp, Homo sapiens
ctgctccccagccctg

SEQ ID NO: 1074227 - DNA, 20 bp, Homo sapiens
ctgctccccagccctggctc

SEQ ID NO: 1074228 - DNA, 23 bp, Homo sapiens
ctgctcccctgagaccaccccca

SEQ ID NO: 1074229 - DNA, 13 bp, Homo sapiens
ctgctcccctgga

SEQ ID NO: 1074230 - DNA, 16 bp, Homo sapiens
ctgctcccctttgggg

SEQ ID NO: 1074231 - DNA, 13 bp, Homo sapiens
ctgctccctaagc

SEQ ID NO: 1074232 - DNA, 20 bp, Homo sapiens
ctgctccctgtggcactcag

SEQ ID NO: 1074233 - DNA, 15 bp, Homo sapiens
ctgctccgccaggaa

SEQ ID NO: 1074234 - DNA, 16 bp, Homo sapiens
ctgctccgctgctcct

SEQ ID NO: 1074235 - DNA, 21 bp, Homo sapiens
ctgctccgctgctccttggct

SEQ ID NO: 1074236 - DNA, 13 bp, Homo sapiens
ctgctcctcactg

SEQ ID NO: 1074237 - DNA, 18 bp, Homo sapiens
ctgctcctcactggagga

SEQ ID NO: 1074238 - DNA, 13 bp, Homo sapiens
ctgctcctccagc

SEQ ID NO: 1074239 - DNA, 16 bp, Homo sapiens
ctgctcctccagccct

SEQ ID NO: 1074240 - DNA, 16 bp, Homo sapiens
ctgctcctccagggcc

SEQ ID NO: 1074241 - DNA, 11 bp, Homo sapiens
ctgctcctccc

SEQ ID NO: 1074242 - DNA, 13 bp, Homo sapiens
ctgctcctccctg

SEQ ID NO: 1074243 - DNA, 16 bp, Homo sapiens
ctgctcctccctgccc

SEQ ID NO: 1074244 - DNA, 17 bp, Homo sapiens
ctgctcctccctggctg

SEQ ID NO: 1074245 - DNA, 19 bp, Homo sapiens
ctgctcctccctggctgcc

SEQ ID NO: 1074246 - DNA, 20 bp, Homo sapiens
ctgctcctccctggctgccc

SEQ ID NO: 1074247 - DNA, 21 bp, Homo sapiens
ctgctcctccctggctgccct

SEQ ID NO: 1074248 - DNA, 22 bp, Homo sapiens
ctgctcctccctggctgccctg

SEQ ID NO: 1074249 - DNA, 23 bp, Homo sapiens
ctgctcctccctggctgccctgg

SEQ ID NO: 1074250 - DNA, 15 bp, Homo sapiens
ctgctcctgcttttc

SEQ ID NO: 1074251 - DNA, 18 bp, Homo sapiens
ctgctcctgcttttctgt

SEQ ID NO: 1074252 - DNA, 15 bp, Homo sapiens
ctgctcctgtacttg

SEQ ID NO: 1074253 - DNA, 19 bp, Homo sapiens
ctgctccttcactgttccc

SEQ ID NO: 1074254 - DNA, 12 bp, Homo sapiens
ctgctccttgct

SEQ ID NO: 1074255 - DNA, 16 bp, Homo sapiens
ctgctccttggcaccc

SEQ ID NO: 1074256 - DNA, 21 bp, Homo sapiens
ctgctccttggcacccccatg

SEQ ID NO: 1074257 - DNA, 22 bp, Homo sapiens
ctgctccttggcacccccatgc

SEQ ID NO: 1074258 - DNA, 23 bp, Homo sapiens
ctgctccttggcacccccatgct

SEQ ID NO: 1074259 - DNA, 13 bp, Homo sapiens
ctgctccttggct

SEQ ID NO: 1074260 - DNA, 20 bp, Homo sapiens
ctgctccttggcttacctga

SEQ ID NO: 1074261 - DNA, 16 bp, Homo sapiens
ctgctcctttaccctc

SEQ ID NO: 1074262 - DNA, 19 bp, Homo sapiens
ctgctcctttaccctcttg

SEQ ID NO: 1074263 - DNA, 19 bp, Homo sapiens
ctgctcgtggactgtgctg

SEQ ID NO: 1074264 - DNA, 21 bp, Homo sapiens
ctgctctacccatgagcctgc

SEQ ID NO: 1074265 - DNA, 22 bp, Homo sapiens
ctgctctacccatgagcctgcc

SEQ ID NO: 1074266 - DNA, 13 bp, Homo sapiens
ctgctctagccag

SEQ ID NO: 1074267 - DNA, 16 bp, Homo sapiens
ctgctctagccaggag

SEQ ID NO: 1074268 - DNA, 17 bp, Homo sapiens
ctgctctagccaggagt

SEQ ID NO: 1074269 - DNA, 17 bp, Homo sapiens
ctgctctagctggcagg

SEQ ID NO: 1074270 - DNA, 22 bp, Homo sapiens
ctgctctagggaatctggatta

SEQ ID NO: 1074271 - DNA, 17 bp, Homo sapiens
ctgctctagtgggacag

SEQ ID NO: 1074272 - DNA, 23 bp, Homo sapiens
ctgctctagtgggacagcccaga

SEQ ID NO: 1074273 - DNA, 19 bp, Homo sapiens
ctgctctcagcctcccaca

SEQ ID NO: 1074274 - DNA, 20 bp, Homo sapiens
ctgctctcctcttgccactg

SEQ ID NO: 1074275 - DNA, 15 bp, Homo sapiens
ctgctctctgctcat

SEQ ID NO: 1074276 - DNA, 15 bp, Homo sapiens
ctgctctcttcagga

SEQ ID NO: 1074277 - DNA, 12 bp, Homo sapiens
ctgctggctgcc

SEQ ID NO: 1074278 - DNA, 13 bp, Homo sapiens
ctgctggctgcct

SEQ ID NO: 1074279 - DNA, 14 bp, Homo sapiens
ctgctggctgcggc

SEQ ID NO: 1074280 - DNA, 11 bp, Homo sapiens
ctgctgggaac

SEQ ID NO: 1074281 - DNA, 16 bp, Homo sapiens
ctgctgggaagagctc

SEQ ID NO: 1074282 - DNA, 19 bp, Homo sapiens
ctgctgggactggccaggt

SEQ ID NO: 1074283 - DNA, 15 bp, Homo sapiens
ctgctgggagcagaa

SEQ ID NO: 1074284 - DNA, 19 bp, Homo sapiens
ctgctgggagcagaacagt

SEQ ID NO: 1074285 - DNA, 18 bp, Homo sapiens
ctgctgggaggttaaaaa

SEQ ID NO: 1074286 - DNA, 19 bp, Homo sapiens
ctgctgggcgtgtgtgaca

SEQ ID NO: 1074287 - DNA, 16 bp, Homo sapiens
ctgctgggctctccac

SEQ ID NO: 1074288 - DNA, 14 bp, Homo sapiens
ctgctgggctgagt

SEQ ID NO: 1074289 - DNA, 22 bp, Homo sapiens
ctgctgggctgagtgacacaag

SEQ ID NO: 1074290 - DNA, 21 bp, Homo sapiens
ctgctggggaagggttttctt

SEQ ID NO: 1074291 - DNA, 13 bp, Homo sapiens
ctgctggggatcc

SEQ ID NO: 1074292 - DNA, 22 bp, Homo sapiens
ctgctggggatccccgcctggc

SEQ ID NO: 1074293 - DNA, 19 bp, Homo sapiens
ctgctgggttttcctccgg

SEQ ID NO: 1074294 - DNA, 14 bp, Homo sapiens
ctgctggtatttct

SEQ ID NO: 1074295 - DNA, 15 bp, Homo sapiens
ctgctggtatttcta

SEQ ID NO: 1074296 - DNA, 16 bp, Homo sapiens
ctgctggtatttctaa

SEQ ID NO: 1074297 - DNA, 15 bp, Homo sapiens
ctgctgtaactgctg

SEQ ID NO: 1074298 - DNA, 16 bp, Homo sapiens
ctgctgtaactgctga

SEQ ID NO: 1074299 - DNA, 18 bp, Homo sapiens
ctgctgtaactgctgagc

SEQ ID NO: 1074300 - DNA, 22 bp, Homo sapiens
ctgctgtaactgctgagccact

SEQ ID NO: 1074301 - DNA, 23 bp, Homo sapiens
ctgctgtaactgctgagccactc

SEQ ID NO: 1074302 - DNA, 18 bp, Homo sapiens
ctgctgtcaataaatgac

SEQ ID NO: 1074303 - DNA, 11 bp, Homo sapiens
ctgctgtccct

SEQ ID NO: 1074304 - DNA, 20 bp, Homo sapiens
ctgctgtccctcccccttgt

SEQ ID NO: 1074305 - DNA, 18 bp, Homo sapiens
ctgctgtcgctctcagtt

SEQ ID NO: 1074306 - DNA, 15 bp, Homo sapiens
ctgctgtctctctgg

SEQ ID NO: 1074307 - DNA, 19 bp, Homo sapiens
ctgctgtctctctgggctg

SEQ ID NO: 1074308 - DNA, 15 bp, Homo sapiens
ctgctgtcttccaag

SEQ ID NO: 1074309 - DNA, 14 bp, Homo sapiens
ctgctgtcttctgg

SEQ ID NO: 1074310 - DNA, 12 bp, Homo sapiens
ctgctgtcttgt

SEQ ID NO: 1074311 - DNA, 15 bp, Homo sapiens
ctgctgtgaaccctg

SEQ ID NO: 1074312 - DNA, 17 bp, Homo sapiens
ctgctgtgaatctgaaa

SEQ ID NO: 1074313 - DNA, 17 bp, Homo sapiens
ctgctgtgagtgcgcct

SEQ ID NO: 1074314 - DNA, 19 bp, Homo sapiens
ctgctgtgatgccgtcctg

SEQ ID NO: 1074315 - DNA, 21 bp, Homo sapiens
ctgctgtgatgccgtcctgct

SEQ ID NO: 1074316 - DNA, 22 bp, Homo sapiens
ctgctgtgattccactacacct

SEQ ID NO: 1074317 - DNA, 15 bp, Homo sapiens
ctgctgtgcccagcc

SEQ ID NO: 1074318 - DNA, 13 bp, Homo sapiens
ctgctgtgcccca

SEQ ID NO: 1074319 - DNA, 19 bp, Homo sapiens
ctgctgtgccccaccacgt

SEQ ID NO: 1074320 - DNA, 17 bp, Homo sapiens
ctgctgtgctctgggga

SEQ ID NO: 1074321 - DNA, 14 bp, Homo sapiens
ctgctgtgctgctc

SEQ ID NO: 1074322 - DNA, 16 bp, Homo sapiens
ctgctgtgctgctcaa

SEQ ID NO: 1074323 - DNA, 14 bp, Homo sapiens
ctgctgtgctggga

SEQ ID NO: 1074324 - DNA, 13 bp, Homo sapiens
ctgctgtggcccc

SEQ ID NO: 1074325 - DNA, 15 bp, Homo sapiens
ctgctgtggccccct

SEQ ID NO: 1074326 - DNA, 12 bp, Homo sapiens
ctgctgtggggc

SEQ ID NO: 1074327 - DNA, 17 bp, Homo sapiens
ctgctgtgtccttcctc

SEQ ID NO: 1074328 - DNA, 20 bp, Homo sapiens
ctgctgtgtccttcctccac

SEQ ID NO: 1074329 - DNA, 19 bp, Homo sapiens
ctgctgttctcaggacagc

SEQ ID NO: 1074330 - DNA, 20 bp, Homo sapiens
ctgctgttgccatagcccca

SEQ ID NO: 1074331 - DNA, 13 bp, Homo sapiens
ctgctgttgcctc

SEQ ID NO: 1074332 - DNA, 21 bp, Homo sapiens
ctgctgtttgacacctctttt

SEQ ID NO: 1074333 - DNA, 14 bp, Homo sapiens
ctgcttaaacaaag

SEQ ID NO: 1074334 - DNA, 19 bp, Homo sapiens
ctgcttaaacttgacccag

SEQ ID NO: 1074335 - DNA, 21 bp, Homo sapiens
ctgcttaaagcttccctctca

SEQ ID NO: 1074336 - DNA, 15 bp, Homo sapiens
ctgcttaacttcaca

SEQ ID NO: 1074337 - DNA, 23 bp, Homo sapiens
ctgcttaccagataatgctactt

SEQ ID NO: 1074338 - DNA, 18 bp, Homo sapiens
ctgcttacccttcacctt

SEQ ID NO: 1074339 - DNA, 20 bp, Homo sapiens
ctgcttagctgccttgagct

SEQ ID NO: 1074340 - DNA, 19 bp, Homo sapiens
ctgcttagcttgcaccttg

SEQ ID NO: 1074341 - DNA, 15 bp, Homo sapiens
ctgcttaggagagac

SEQ ID NO: 1074342 - DNA, 20 bp, Homo sapiens
ctgcttcaaagattatctga

SEQ ID NO: 1074343 - DNA, 14 bp, Homo sapiens
ctgcttcaaatatt

SEQ ID NO: 1074344 - DNA, 19 bp, Homo sapiens
ctgcttcaaggcttccact

SEQ ID NO: 1074345 - DNA, 19 bp, Homo sapiens
ctgcttcagtgtatggaaa

SEQ ID NO: 1074346 - DNA, 15 bp, Homo sapiens
ctgcttcattttgga

SEQ ID NO: 1074347 - DNA, 15 bp, Homo sapiens
ctgcttccaggctgg

SEQ ID NO: 1074348 - DNA, 13 bp, Homo sapiens
ctgcttccatggc

SEQ ID NO: 1074349 - DNA, 20 bp, Homo sapiens
ctgcttccatggcttcctga

SEQ ID NO: 1074350 - DNA, 18 bp, Homo sapiens
ctgcttcccatcctaccc

SEQ ID NO: 1074351 - DNA, 23 bp, Homo sapiens
ctgcttcccattgagtaatcata

SEQ ID NO: 1074352 - DNA, 11 bp, Homo sapiens
ctgcttcccct

SEQ ID NO: 1074353 - DNA, 13 bp, Homo sapiens
ctgcttcccctcc

SEQ ID NO: 1074354 - DNA, 15 bp, Homo sapiens
ctgcttcccctccct

SEQ ID NO: 1074355 - DNA, 15 bp, Homo sapiens
ctgcttccccttcct

SEQ ID NO: 1074356 - DNA, 17 bp, Homo sapiens
ctgcttccccttcctaa

SEQ ID NO: 1074357 - DNA, 18 bp, Homo sapiens
ctgcttccccttcctaag

SEQ ID NO: 1074358 - DNA, 22 bp, Homo sapiens
ctgcttccctctgcctgtccct

SEQ ID NO: 1074359 - DNA, 12 bp, Homo sapiens
ctgcttcctcct

SEQ ID NO: 1074360 - DNA, 14 bp, Homo sapiens
ctgcttccttcagt

SEQ ID NO: 1074361 - DNA, 23 bp, Homo sapiens
ctgcttctagaaactctggctca

SEQ ID NO: 1074362 - DNA, 24 bp, Homo sapiens
ctgcttctagaaactctggctcag

SEQ ID NO: 1074363 - DNA, 15 bp, Homo sapiens
ctgcttctcatccca

SEQ ID NO: 1074364 - DNA, 11 bp, Homo sapiens
ctgcttctccc

SEQ ID NO: 1074365 - DNA, 16 bp, Homo sapiens
ctgcttctccccccat

SEQ ID NO: 1074366 - DNA, 19 bp, Homo sapiens
ctgcttctcggccagcccg

SEQ ID NO: 1074367 - DNA, 16 bp, Homo sapiens
ctgcttctctcagcca

SEQ ID NO: 1074368 - DNA, 20 bp, Homo sapiens
ctgcttctctgacttctgcc

SEQ ID NO: 1074369 - DNA, 22 bp, Homo sapiens
ctgcttctctgacttctgcctg

SEQ ID NO: 1074370 - DNA, 22 bp, Homo sapiens
ctgcttctcttttcctcgcaga

SEQ ID NO: 1074371 - DNA, 14 bp, Homo sapiens
ctgcttctgctcca

SEQ ID NO: 1074372 - DNA, 16 bp, Homo sapiens
ctgcttctgctccagc

SEQ ID NO: 1074373 - DNA, 19 bp, Homo sapiens
ctgcttctgctccagcccc

SEQ ID NO: 1074374 - DNA, 15 bp, Homo sapiens
ctgcttcttggagct

SEQ ID NO: 1074375 - DNA, 13 bp, Homo sapiens
ctgcttgaggcaa

SEQ ID NO: 1074376 - DNA, 22 bp, Homo sapiens
ctgcttgaggcaactcatctta

SEQ ID NO: 1074377 - DNA, 17 bp, Homo sapiens
ctgcttgcacacttccc

SEQ ID NO: 1074378 - DNA, 22 bp, Homo sapiens
ctgcttgcacacttccccatct

SEQ ID NO: 1074379 - DNA, 22 bp, Homo sapiens
ctgctttgggatttaatttcca

SEQ ID NO: 1074380 - DNA, 18 bp, Homo sapiens
ctgctttgggctgccctg

SEQ ID NO: 1074381 - DNA, 19 bp, Homo sapiens
ctgctttgggctgccctgg

SEQ ID NO: 1074382 - DNA, 17 bp, Homo sapiens
ctgctttggtcttgccc

SEQ ID NO: 1074383 - DNA, 14 bp, Homo sapiens
ctgctttgtgcata

SEQ ID NO: 1074384 - DNA, 20 bp, Homo sapiens
ctgctttgtgcatatgttaa

SEQ ID NO: 1074385 - DNA, 22 bp, Homo sapiens
ctgcttttattaaatttgttga

SEQ ID NO: 1074386 - DNA, 13 bp, Homo sapiens
ctgcttttccagg

SEQ ID NO: 1074387 - DNA, 20 bp, Homo sapiens
ctgcttttccaggatcctgc

SEQ ID NO: 1074388 - DNA, 22 bp, Homo sapiens
ctgcttttccaggatcctgcag

SEQ ID NO: 1074389 - DNA, 24 bp, Homo sapiens
ctgcttttccaggatcctgcagga

SEQ ID NO: 1074390 - DNA, 18 bp, Homo sapiens
ctgcttttcctcaagcaa

SEQ ID NO: 1074391 - DNA, 18 bp, Homo sapiens
ctgcttttctgccctggc

SEQ ID NO: 1074392 - DNA, 19 bp, Homo sapiens
ctgcttttctgccctggct

SEQ ID NO: 1074393 - DNA, 16 bp, Homo sapiens
ctgcttttctgtcctg

SEQ ID NO: 1074394 - DNA, 19 bp, Homo sapiens
ctgcttttctgtcctgggc

SEQ ID NO: 1074395 - DNA, 19 bp, Homo sapiens
ctgctttttaaagaatgct

SEQ ID NO: 1074396 - DNA, 20 bp, Homo sapiens
ctgctttttggaaagtcaga

SEQ ID NO: 1074397 - DNA, 17 bp, Homo sapiens
ctgctttttggcacagt

SEQ ID NO: 1074398 - DNA, 17 bp, Homo sapiens
ctgcttttttttttcca

SEQ ID NO: 1074399 - DNA, 18 bp, Homo sapiens
ctgcttttttttttccag

SEQ ID NO: 1074400 - DNA, 20 bp, Homo sapiens
ctggaaaaaaaatatatata

SEQ ID NO: 1074401 - DNA, 18 bp, Homo sapiens
ctggaaaacagaacactt

SEQ ID NO: 1074402 - DNA, 22 bp, Homo sapiens
ctggaaaactattgagccttgc

SEQ ID NO: 1074403 - DNA, 18 bp, Homo sapiens
ctggaaaagaagaaactt

SEQ ID NO: 1074404 - DNA, 14 bp, Homo sapiens
ctggaaaagaggag

SEQ ID NO: 1074405 - DNA, 19 bp, Homo sapiens
ctggaaaagggtcttggga

SEQ ID NO: 1074406 - DNA, 19 bp, Homo sapiens
ctggaaaaggtgaaaatgt

SEQ ID NO: 1074407 - DNA, 22 bp, Homo sapiens
ctggaaaaggtgaaaatgtttt

SEQ ID NO: 1074408 - DNA, 22 bp, Homo sapiens
ctggaaaagtgatgtattttca

SEQ ID NO: 1074409 - DNA, 21 bp, Homo sapiens
ctggaaacaagtgaccccagg

SEQ ID NO: 1074410 - DNA, 15 bp, Homo sapiens
ctggaaacacagtca

SEQ ID NO: 1074411 - DNA, 22 bp, Homo sapiens
ctggaaacttttgttagggctg

SEQ ID NO: 1074412 - DNA, 14 bp, Homo sapiens
ctggaaaggctcag

SEQ ID NO: 1074413 - DNA, 20 bp, Homo sapiens
ctggaaaggctcagtctcag

SEQ ID NO: 1074414 - DNA, 15 bp, Homo sapiens
ctggaaaggggagag

SEQ ID NO: 1074415 - DNA, 16 bp, Homo sapiens
ctggaaaggggagagc

SEQ ID NO: 1074416 - DNA, 17 bp, Homo sapiens
ctggaaaggggagagcc

SEQ ID NO: 1074417 - DNA, 18 bp, Homo sapiens
ctggaaaggggagagcct

SEQ ID NO: 1074418 - DNA, 23 bp, Homo sapiens
ctggaaaggggagagcctgctgg

SEQ ID NO: 1074419 - DNA, 19 bp, Homo sapiens
ctggaaaggggggagctgg

SEQ ID NO: 1074420 - DNA, 23 bp, Homo sapiens
ctggaaatatcagttactcagcc

SEQ ID NO: 1074421 - DNA, 19 bp, Homo sapiens
ctggaaatctgttttgtat

SEQ ID NO: 1074422 - DNA, 20 bp, Homo sapiens
ctggaaatctgttttgtata

SEQ ID NO: 1074423 - DNA, 16 bp, Homo sapiens
ctggaacaaattattt

SEQ ID NO: 1074424 - DNA, 15 bp, Homo sapiens
ctggaacaacttgta

SEQ ID NO: 1074425 - DNA, 21 bp, Homo sapiens
ctggaacaacttgtagcagct

SEQ ID NO: 1074426 - DNA, 14 bp, Homo sapiens
ctggaacatggcta

SEQ ID NO: 1074427 - DNA, 23 bp, Homo sapiens
ctggaacatgggcattgggttct

SEQ ID NO: 1074428 - DNA, 15 bp, Homo sapiens
ctggaacatttgata

SEQ ID NO: 1074429 - DNA, 19 bp, Homo sapiens
ctggaacatttgatatttt

SEQ ID NO: 1074430 - DNA, 13 bp, Homo sapiens
ctggaacccagga

SEQ ID NO: 1074431 - DNA, 15 bp, Homo sapiens
ctggaaccccccagg

SEQ ID NO: 1074432 - DNA, 21 bp, Homo sapiens
ctggaacctgcaaaaaatact

SEQ ID NO: 1074433 - DNA, 14 bp, Homo sapiens
ctggaaccttctag

SEQ ID NO: 1074434 - DNA, 17 bp, Homo sapiens
ctggaaccttgctgtcc

SEQ ID NO: 1074435 - DNA, 18 bp, Homo sapiens
ctggaaccttgctgtcct

SEQ ID NO: 1074436 - DNA, 22 bp, Homo sapiens
ctggaacggtgaaggtgacagc

SEQ ID NO: 1074437 - DNA, 22 bp, Homo sapiens
ctggaactgaagtccaaattgt

SEQ ID NO: 1074438 - DNA, 19 bp, Homo sapiens
ctggaactggctgtgaaga

SEQ ID NO: 1074439 - DNA, 13 bp, Homo sapiens
ctggaactgtagg

SEQ ID NO: 1074440 - DNA, 14 bp, Homo sapiens
ctggaactttagtg

SEQ ID NO: 1074441 - DNA, 16 bp, Homo sapiens
ctggaactttagtgaa

SEQ ID NO: 1074442 - DNA, 12 bp, Homo sapiens
ctggaagaaaaa

SEQ ID NO: 1074443 - DNA, 14 bp, Homo sapiens
ctggaagaaaaaaa

SEQ ID NO: 1074444 - DNA, 20 bp, Homo sapiens
ctggaagaaactaaaaatat

SEQ ID NO: 1074445 - DNA, 16 bp, Homo sapiens
ctggaagaacaaatct

SEQ ID NO: 1074446 - DNA, 19 bp, Homo sapiens
ctggaagaacatcaagata

SEQ ID NO: 1074447 - DNA, 20 bp, Homo sapiens
ctggaagaacatcaagatac

SEQ ID NO: 1074448 - DNA, 18 bp, Homo sapiens
ctggaagacaacccaggc

SEQ ID NO: 1074449 - DNA, 16 bp, Homo sapiens
ctggaagacacttcag

SEQ ID NO: 1074450 - DNA, 20 bp, Homo sapiens
ctggaagacacttcagatct

SEQ ID NO: 1074451 - DNA, 13 bp, Homo sapiens
ctggaagagagga

SEQ ID NO: 1074452 - DNA, 11 bp, Homo sapiens
ctggaagagcc

SEQ ID NO: 1074453 - DNA, 15 bp, Homo sapiens
ctggaagagcccagt

SEQ ID NO: 1074454 - DNA, 20 bp, Homo sapiens
ctggaagagttggtctctgc

SEQ ID NO: 1074455 - DNA, 22 bp, Homo sapiens
ctggaagatcccctctcctgcc

SEQ ID NO: 1074456 - DNA, 18 bp, Homo sapiens
ctggaagcacagcctcgg

SEQ ID NO: 1074457 - DNA, 21 bp, Homo sapiens
ctggaagcacagcctcgggga

SEQ ID NO: 1074458 - DNA, 22 bp, Homo sapiens
ctggaagcatttgtttctactt

SEQ ID NO: 1074459 - DNA, 15 bp, Homo sapiens
ctggaagccagcttt

SEQ ID NO: 1074460 - DNA, 17 bp, Homo sapiens
ctggaagccagctttcc

SEQ ID NO: 1074461 - DNA, 17 bp, Homo sapiens
ctggaagccatcctgcc

SEQ ID NO: 1074462 - DNA, 22 bp, Homo sapiens
ctggacctatgcagggaggcca

SEQ ID NO: 1074463 - DNA, 19 bp, Homo sapiens
ctggacctatgtcctaagg

SEQ ID NO: 1074464 - DNA, 19 bp, Homo sapiens
ctggacctcaggagggcag

SEQ ID NO: 1074465 - DNA, 21 bp, Homo sapiens
ctggacctcaggagggcaggc

SEQ ID NO: 1074466 - DNA, 12 bp, Homo sapiens
ctggacctccat

SEQ ID NO: 1074467 - DNA, 16 bp, Homo sapiens
ctggacctccatccct

SEQ ID NO: 1074468 - DNA, 20 bp, Homo sapiens
ctggacctccatccctgctc

SEQ ID NO: 1074469 - DNA, 13 bp, Homo sapiens
ctggacctgagtc

SEQ ID NO: 1074470 - DNA, 15 bp, Homo sapiens
ctggacctgagtcgg

SEQ ID NO: 1074471 - DNA, 20 bp, Homo sapiens
ctggacctgcctcctgcctg

SEQ ID NO: 1074472 - DNA, 21 bp, Homo sapiens
ctggacctgcctcctgcctgc

SEQ ID NO: 1074473 - DNA, 12 bp, Homo sapiens
ctggacctggaa

SEQ ID NO: 1074474 - DNA, 13 bp, Homo sapiens
ctggaccttgaca

SEQ ID NO: 1074475 - DNA, 16 bp, Homo sapiens
ctggaccttgacagag

SEQ ID NO: 1074476 - DNA, 17 bp, Homo sapiens
ctggaccttgacagagc

SEQ ID NO: 1074477 - DNA, 21 bp, Homo sapiens
ctggaccttgacagagcagct

SEQ ID NO: 1074478 - DNA, 12 bp, Homo sapiens
ctggacgctgcc

SEQ ID NO: 1074479 - DNA, 24 bp, Homo sapiens
ctggacgctgccctgcatgctgcc

SEQ ID NO: 1074480 - DNA, 13 bp, Homo sapiens
ctggacggcaggc

SEQ ID NO: 1074481 - DNA, 14 bp, Homo sapiens
ctggacggcaggct

SEQ ID NO: 1074482 - DNA, 15 bp, Homo sapiens
ctggacggcattcct

SEQ ID NO: 1074483 - DNA, 17 bp, Homo sapiens
ctggacggcattcctgc

SEQ ID NO: 1074484 - DNA, 20 bp, Homo sapiens
ctggacggcattcctgctta

SEQ ID NO: 1074485 - DNA, 22 bp, Homo sapiens
ctggacggggtcggacggggca

SEQ ID NO: 1074486 - DNA, 16 bp, Homo sapiens
ctggactacacccaag

SEQ ID NO: 1074487 - DNA, 21 bp, Homo sapiens
ctggactagagggacctctcc

SEQ ID NO: 1074488 - DNA, 23 bp, Homo sapiens
ctggactagagggacctctccca

SEQ ID NO: 1074489 - DNA, 15 bp, Homo sapiens
ctggactagtgtcct

SEQ ID NO: 1074490 - DNA, 13 bp, Homo sapiens
ctggactcaggaa

SEQ ID NO: 1074491 - DNA, 21 bp, Homo sapiens
ctggactccggaggactgagc

SEQ ID NO: 1074492 - DNA, 19 bp, Homo sapiens
ctggactcctctgtccagg

SEQ ID NO: 1074493 - DNA, 20 bp, Homo sapiens
ctggactcctctgtccaggc

SEQ ID NO: 1074494 - DNA, 22 bp, Homo sapiens
ctggactctaagctggagctct

SEQ ID NO: 1074495 - DNA, 17 bp, Homo sapiens
ctggactctcagtctct

SEQ ID NO: 1074496 - DNA, 18 bp, Homo sapiens
ctggactctcagtctctg

SEQ ID NO: 1074497 - DNA, 20 bp, Homo sapiens
ctggactctcagtctctgag

SEQ ID NO: 1074498 - DNA, 21 bp, Homo sapiens
ctggactctcagtctctgagc

SEQ ID NO: 1074499 - DNA, 23 bp, Homo sapiens
ctggactctgcatcccagcacct

SEQ ID NO: 1074500 - DNA, 14 bp, Homo sapiens
ctggactctgcccc

SEQ ID NO: 1074501 - DNA, 18 bp, Homo sapiens
ctggactctgccccaatc

SEQ ID NO: 1074502 - DNA, 14 bp, Homo sapiens
ctggactctggact

SEQ ID NO: 1074503 - DNA, 23 bp, Homo sapiens
ctggactgaagcctgcaggagtt

SEQ ID NO: 1074504 - DNA, 21 bp, Homo sapiens
ctggactgacagcatgtgccc

SEQ ID NO: 1074505 - DNA, 15 bp, Homo sapiens
ctggactgaccctgc

SEQ ID NO: 1074506 - DNA, 19 bp, Homo sapiens
ctggactggaggtgggcat

SEQ ID NO: 1074507 - DNA, 14 bp, Homo sapiens
ctggactggcgttc

SEQ ID NO: 1074508 - DNA, 20 bp, Homo sapiens
ctggactggcgttcacctcc

SEQ ID NO: 1074509 - DNA, 23 bp, Homo sapiens
ctggactggcgttcacctccctg

SEQ ID NO: 1074510 - DNA, 15 bp, Homo sapiens
ctggactggctagag

SEQ ID NO: 1074511 - DNA, 21 bp, Homo sapiens
ctggactggctagagtcctca

SEQ ID NO: 1074512 - DNA, 13 bp, Homo sapiens
ctggactgttcca

SEQ ID NO: 1074513 - DNA, 21 bp, Homo sapiens
ctggactgttccaggccctcc

SEQ ID NO: 1074514 - DNA, 22 bp, Homo sapiens
ctggacttaagcatctggctct

SEQ ID NO: 1074515 - DNA, 18 bp, Homo sapiens
ctggacttcctataatac

SEQ ID NO: 1074516 - DNA, 18 bp, Homo sapiens
ctggacttctacctgccc

SEQ ID NO: 1074517 - DNA, 13 bp, Homo sapiens
ctggacttcttag

SEQ ID NO: 1074518 - DNA, 13 bp, Homo sapiens
ctggacttgagct

SEQ ID NO: 1074519 - DNA, 14 bp, Homo sapiens
ctgctggccgaccc

SEQ ID NO: 1074520 - DNA, 22 bp, Homo sapiens
ctgctggccgacccactgaccc

SEQ ID NO: 1074521 - DNA, 11 bp, Homo sapiens
ctgctggcctg

SEQ ID NO: 1074522 - DNA, 15 bp, Homo sapiens
ctgctggcctggatc

SEQ ID NO: 1074523 - DNA, 16 bp, Homo sapiens
ctgctggcctggatct

SEQ ID NO: 1074524 - DNA, 13 bp, Homo sapiens
ctgctggcctggc

SEQ ID NO: 1074525 - DNA, 16 bp, Homo sapiens
ctgctggcctggccgg

SEQ ID NO: 1074526 - DNA, 13 bp, Homo sapiens
ctgctggcctgtc

SEQ ID NO: 1074527 - DNA, 23 bp, Homo sapiens
ctgctggcctgtctccctaggga

SEQ ID NO: 1074528 - DNA, 20 bp, Homo sapiens
ctgctggctgacctgggccc

SEQ ID NO: 1074529 - DNA, 13 bp, Homo sapiens
ctggcttgcccca

SEQ ID NO: 1074530 - DNA, 15 bp, Homo sapiens
ctggcttgccccagg

SEQ ID NO: 1074531 - DNA, 16 bp, Homo sapiens
ctggcttgccccagga

SEQ ID NO: 1074532 - DNA, 14 bp, Homo sapiens
ctggcttgctccag

SEQ ID NO: 1074533 - DNA, 16 bp, Homo sapiens
ctggcttgctccaggg

SEQ ID NO: 1074534 - DNA, 14 bp, Homo sapiens
ctggctttcccagg

SEQ ID NO: 1074535 - DNA, 15 bp, Homo sapiens
ctggctttcccagga

SEQ ID NO: 1074536 - DNA, 19 bp, Homo sapiens
ctggctttcccaggagatg

SEQ ID NO: 1074537 - DNA, 13 bp, Homo sapiens
ctggctttgctct

SEQ ID NO: 1074538 - DNA, 14 bp, Homo sapiens
ctggctttggcttc

SEQ ID NO: 1074539 - DNA, 16 bp, Homo sapiens
ctggctttggtcccca

SEQ ID NO: 1074540 - DNA, 17 bp, Homo sapiens
ctggctttggtccccag

SEQ ID NO: 1074541 - DNA, 19 bp, Homo sapiens
ctggctttggtccccagca

SEQ ID NO: 1074542 - DNA, 14 bp, Homo sapiens
ctggcttttattaa

SEQ ID NO: 1074543 - DNA, 20 bp, Homo sapiens
ctggcttttcaccccagagg

SEQ ID NO: 1074544 - DNA, 15 bp, Homo sapiens
ctggcttttcactgc

SEQ ID NO: 1074545 - DNA, 18 bp, Homo sapiens
ctggctttttaaaatata

SEQ ID NO: 1074546 - DNA, 23 bp, Homo sapiens
ctgggaaaaaagttttgatgaaa

SEQ ID NO: 1074547 - DNA, 16 bp, Homo sapiens
ctgggaaacagaggct

SEQ ID NO: 1074548 - DNA, 15 bp, Homo sapiens
ctgggaaacctgcct

SEQ ID NO: 1074549 - DNA, 19 bp, Homo sapiens
ctgggaaagacatccataa

SEQ ID NO: 1074550 - DNA, 16 bp, Homo sapiens
ctgggaaatgcagaaa

SEQ ID NO: 1074551 - DNA, 14 bp, Homo sapiens
ctgggaacaggccc

SEQ ID NO: 1074552 - DNA, 21 bp, Homo sapiens
ctgggaacaggccccacgccc

SEQ ID NO: 1074553 - DNA, 19 bp, Homo sapiens
ctgggaacatgacccagcc

SEQ ID NO: 1074554 - DNA, 21 bp, Homo sapiens
ctgggaacatgacccagcctg

SEQ ID NO: 1074555 - DNA, 14 bp, Homo sapiens
ctgggaaccactcc

SEQ ID NO: 1074556 - DNA, 17 bp, Homo sapiens
ctgggaacctcccagag

SEQ ID NO: 1074557 - DNA, 21 bp, Homo sapiens
ctgggaacctcccagaggtcc

SEQ ID NO: 1074558 - DNA, 23 bp, Homo sapiens
ctgggaacgtgtgtccaggctct

SEQ ID NO: 1074559 - DNA, 19 bp, Homo sapiens
ctgggaagacgcctgagct

SEQ ID NO: 1074560 - DNA, 18 bp, Homo sapiens
ctgggaagataggctctg

SEQ ID NO: 1074561 - DNA, 24 bp, Homo sapiens
ctgggaagataggctctgcacaga

SEQ ID NO: 1074562 - DNA, 18 bp, Homo sapiens
ctgggaagcccacccaga

SEQ ID NO: 1074563 - DNA, 13 bp, Homo sapiens
ctgggaagccctt

SEQ ID NO: 1074564 - DNA, 20 bp, Homo sapiens
ctgggaagcctgtgccagca

SEQ ID NO: 1074565 - DNA, 13 bp, Homo sapiens
ctgggaagctgga

SEQ ID NO: 1074566 - DNA, 19 bp, Homo sapiens
ctgggaagctggagtgctg

SEQ ID NO: 1074567 - DNA, 21 bp, Homo sapiens
ctgggaagctgtactcagagc

SEQ ID NO: 1074568 - DNA, 15 bp, Homo sapiens
ctgggaaggaaacaa

SEQ ID NO: 1074569 - DNA, 15 bp, Homo sapiens
ctgggaagggagagt

SEQ ID NO: 1074570 - DNA, 15 bp, Homo sapiens
ctgggaatggaataa

SEQ ID NO: 1074571 - DNA, 17 bp, Homo sapiens
ctgggaatggaataact

SEQ ID NO: 1074572 - DNA, 18 bp, Homo sapiens
ctgggaatggaataacta

SEQ ID NO: 1074573 - DNA, 19 bp, Homo sapiens
ctgggatgggaccagggat

SEQ ID NO: 1074574 - DNA, 20 bp, Homo sapiens
ctgggatgggaccagggatg

SEQ ID NO: 1074575 - DNA, 15 bp, Homo sapiens
ctgggatgggctccc

SEQ ID NO: 1074576 - DNA, 18 bp, Homo sapiens
ctgggatgggctcccacc

SEQ ID NO: 1074577 - DNA, 17 bp, Homo sapiens
ctgggatgtcacagtcc

SEQ ID NO: 1074578 - DNA, 18 bp, Homo sapiens
ctgggatgtcacagtcca

SEQ ID NO: 1074579 - DNA, 15 bp, Homo sapiens
ctgggattaagggca

SEQ ID NO: 1074580 - DNA, 20 bp, Homo sapiens
ctgggattacaggcatgagc

SEQ ID NO: 1074581 - DNA, 21 bp, Homo sapiens
ctgggattacaggcatgagcc

SEQ ID NO: 1074582 - DNA, 22 bp, Homo sapiens
ctgggattacaggcatgtgcca

SEQ ID NO: 1074583 - DNA, 21 bp, Homo sapiens
ctgggattacaggcgtgagcc

SEQ ID NO: 1074584 - DNA, 21 bp, Homo sapiens
ctgggattataggcatgagcc

SEQ ID NO: 1074585 - DNA, 15 bp, Homo sapiens
ctgggattcccacca

SEQ ID NO: 1074586 - DNA, 20 bp, Homo sapiens
ctgggattcccaccaaggtc

SEQ ID NO: 1074587 - DNA, 14 bp, Homo sapiens
ctgggattcctccc

SEQ ID NO: 1074588 - DNA, 17 bp, Homo sapiens
ctgggattctactttaa

SEQ ID NO: 1074589 - DNA, 21 bp, Homo sapiens
ctgggatttcttcgctgctct

SEQ ID NO: 1074590 - DNA, 14 bp, Homo sapiens
ctgggatttgagat

SEQ ID NO: 1074591 - DNA, 13 bp, Homo sapiens
ctgggcaaagcca

SEQ ID NO: 1074592 - DNA, 21 bp, Homo sapiens
ctgggcaaagccacaaggctg

SEQ ID NO: 1074593 - DNA, 15 bp, Homo sapiens
ctgggcaaagcctag

SEQ ID NO: 1074594 - DNA, 15 bp, Homo sapiens
ctgggcaacactgca

SEQ ID NO: 1074595 - DNA, 19 bp, Homo sapiens
ctgggcaacagagcaagac

SEQ ID NO: 1074596 - DNA, 21 bp, Homo sapiens
ctgggcaagagatgggacaag

SEQ ID NO: 1074597 - DNA, 16 bp, Homo sapiens
ctgggcaagggctcct

SEQ ID NO: 1074598 - DNA, 15 bp, Homo sapiens
ctgggcaagtagcag

SEQ ID NO: 1074599 - DNA, 18 bp, Homo sapiens
ctgggcaagtagcaggac

SEQ ID NO: 1074600 - DNA, 21 bp, Homo sapiens
ctgggcaagtagcaggactag

SEQ ID NO: 1074601 - DNA, 22 bp, Homo sapiens
ctgggcaagtagcaggactagg

SEQ ID NO: 1074602 - DNA, 18 bp, Homo sapiens
ctgggcacagattgaaga

SEQ ID NO: 1074603 - DNA, 20 bp, Homo sapiens
ctgggcacagattgaagaat

SEQ ID NO: 1074604 - DNA, 17 bp, Homo sapiens
ctgggcacagtgctgcc

SEQ ID NO: 1074605 - DNA, 18 bp, Homo sapiens
ctgggcacagtgctgccc

SEQ ID NO: 1074606 - DNA, 17 bp, Homo sapiens
ctgggcaccagcatttg

SEQ ID NO: 1074607 - DNA, 14 bp, Homo sapiens
ctgggcaccgtgtc

SEQ ID NO: 1074608 - DNA, 21 bp, Homo sapiens
ctgggcacctgcgcacaggtg

SEQ ID NO: 1074609 - DNA, 16 bp, Homo sapiens
ctgggcacctggggag

SEQ ID NO: 1074610 - DNA, 19 bp, Homo sapiens
ctgggcacctggggagtgg

SEQ ID NO: 1074611 - DNA, 21 bp, Homo sapiens
ctgggcacgcctgctggccga

SEQ ID NO: 1074612 - DNA, 20 bp, Homo sapiens
ctgggcacggctccgagggc

SEQ ID NO: 1074613 - DNA, 21 bp, Homo sapiens
ctgggcacggctccgagggcg

SEQ ID NO: 1074614 - DNA, 14 bp, Homo sapiens
ctgggcactgctcc

SEQ ID NO: 1074615 - DNA, 17 bp, Homo sapiens
ctgggcactgctccaag

SEQ ID NO: 1074616 - DNA, 20 bp, Homo sapiens
ctgggcactgctccaaggga

SEQ ID NO: 1074617 - DNA, 23 bp, Homo sapiens
ctgggcactgctccaagggacag

SEQ ID NO: 1074618 - DNA, 18 bp, Homo sapiens
ctgggcagaagtgagccc

SEQ ID NO: 1074619 - DNA, 16 bp, Homo sapiens
ctgggcagagcctgtc

SEQ ID NO: 1074620 - DNA, 18 bp, Homo sapiens
ctgggcagagcctgtccc

SEQ ID NO: 1074621 - DNA, 13 bp, Homo sapiens
ctgggcagcaagg

SEQ ID NO: 1074622 - DNA, 14 bp, Homo sapiens
ctgggcagcaaggc

SEQ ID NO: 1074623 - DNA, 17 bp, Homo sapiens
ctgggcagcacctctgg

SEQ ID NO: 1074624 - DNA, 18 bp, Homo sapiens
ctgggcagcacctctggt

SEQ ID NO: 1074625 - DNA, 17 bp, Homo sapiens
ctgggcagcatagcaag

SEQ ID NO: 1074626 - DNA, 16 bp, Homo sapiens
ctgggcagccaggctg

SEQ ID NO: 1074627 - DNA, 23 bp, Homo sapiens
ctgggcagccgttttcctcatcc

SEQ ID NO: 1074628 - DNA, 23 bp, Homo sapiens
ctgggcagcctgctttggccttt

SEQ ID NO: 1074629 - DNA, 12 bp, Homo sapiens
ctgggcagcctt

SEQ ID NO: 1074630 - DNA, 23 bp, Homo sapiens
ctgggcagcttctgttggcagag

SEQ ID NO: 1074631 - DNA, 12 bp, Homo sapiens
ctgggcaggacc

SEQ ID NO: 1074632 - DNA, 20 bp, Homo sapiens
ctgggcaggaccctgctgac

SEQ ID NO: 1074633 - DNA, 21 bp, Homo sapiens
ctgggcaggcggtccccatcc

SEQ ID NO: 1074634 - DNA, 20 bp, Homo sapiens
ctgggcagggatgatggcag

SEQ ID NO: 1074635 - DNA, 14 bp, Homo sapiens
ctgggcagggcagg

SEQ ID NO: 1074636 - DNA, 23 bp, Homo sapiens
ctgggcagggcagggcagcctgt

SEQ ID NO: 1074637 - DNA, 12 bp, Homo sapiens
ctgggcaggtgg

SEQ ID NO: 1074638 - DNA, 19 bp, Homo sapiens
ctgggcaggtgggagctga

SEQ ID NO: 1074639 - DNA, 15 bp, Homo sapiens
ctgggcaggttcctg

SEQ ID NO: 1074640 - DNA, 18 bp, Homo sapiens
ctgggcaggttcctgggg

SEQ ID NO: 1074641 - DNA, 19 bp, Homo sapiens
ctgggcaggttcctggggc

SEQ ID NO: 1074642 - DNA, 22 bp, Homo sapiens
ctgggcaggttcctggggccgc

SEQ ID NO: 1074643 - DNA, 23 bp, Homo sapiens
ctgggcaggttcctggggccgcc

SEQ ID NO: 1074644 - DNA, 20 bp, Homo sapiens
ctgggcaggttggtgggggc

SEQ ID NO: 1074645 - DNA, 21 bp, Homo sapiens
ctgggcagtgagtgccatgct

SEQ ID NO: 1074646 - DNA, 22 bp, Homo sapiens
ctgggcagtgagtgccatgctt

SEQ ID NO: 1074647 - DNA, 13 bp, Homo sapiens
ctgggcagtgcca

SEQ ID NO: 1074648 - DNA, 16 bp, Homo sapiens
ctgggcagtgccacag

SEQ ID NO: 1074649 - DNA, 20 bp, Homo sapiens
ctgggcatactttctctcta

SEQ ID NO: 1074650 - DNA, 20 bp, Homo sapiens
ctgggcatcagggcctttct

SEQ ID NO: 1074651 - DNA, 14 bp, Homo sapiens
ctgggcatcccagc

SEQ ID NO: 1074652 - DNA, 16 bp, Homo sapiens
ctgggcatcccagctt

SEQ ID NO: 1074653 - DNA, 16 bp, Homo sapiens
ctgggcatcttctggc

SEQ ID NO: 1074654 - DNA, 17 bp, Homo sapiens
ctgggcatcttctggct

SEQ ID NO: 1074655 - DNA, 19 bp, Homo sapiens
ctgggcatcttctggcttg

SEQ ID NO: 1074656 - DNA, 22 bp, Homo sapiens
ctgggcatgggtccagggcctg

SEQ ID NO: 1074657 - DNA, 22 bp, Homo sapiens
ctgggcatttcacgaactgttc

SEQ ID NO: 1074658 - DNA, 18 bp, Homo sapiens
ctgggcatttggtgagag

SEQ ID NO: 1074659 - DNA, 17 bp, Homo sapiens
ctgggcattttcctcct

SEQ ID NO: 1074660 - DNA, 18 bp, Homo sapiens
ctgggcattttcctcctc

SEQ ID NO: 1074661 - DNA, 19 bp, Homo sapiens
ctgggcattttcctcctct

SEQ ID NO: 1074662 - DNA, 21 bp, Homo sapiens
ctgggcattttcctcctctgc

SEQ ID NO: 1074663 - DNA, 18 bp, Homo sapiens
ctgggccaagttcctcta

SEQ ID NO: 1074664 - DNA, 21 bp, Homo sapiens
ctgggccaagttcctctagtg

SEQ ID NO: 1074665 - DNA, 16 bp, Homo sapiens
ctgggccacacctgag

SEQ ID NO: 1074666 - DNA, 18 bp, Homo sapiens
ctgggccacagccccgat

SEQ ID NO: 1074667 - DNA, 13 bp, Homo sapiens
ctgggccacctcc

SEQ ID NO: 1074668 - DNA, 17 bp, Homo sapiens
ctgggccacctcctacc

SEQ ID NO: 1074669 - DNA, 18 bp, Homo sapiens
ctgggccacctcctaccc

SEQ ID NO: 1074670 - DNA, 12 bp, Homo sapiens
ctgggccactgg

SEQ ID NO: 1074671 - DNA, 15 bp, Homo sapiens
ctgggccactgggga

SEQ ID NO: 1074672 - DNA, 16 bp, Homo sapiens
ctgggccactggggac

SEQ ID NO: 1074673 - DNA, 19 bp, Homo sapiens
ctgggccagccctgcagcc

SEQ ID NO: 1074674 - DNA, 15 bp, Homo sapiens
ctgggccaggcaggc

SEQ ID NO: 1074675 - DNA, 14 bp, Homo sapiens
ctgggccagggtct

SEQ ID NO: 1074676 - DNA, 15 bp, Homo sapiens
ctgggccagggtctg

SEQ ID NO: 1074677 - DNA, 23 bp, Homo sapiens
ctgggccatgtccaaagaggctg

SEQ ID NO: 1074678 - DNA, 22 bp, Homo sapiens
ctgggccattctccacagcaac

SEQ ID NO: 1074679 - DNA, 19 bp, Homo sapiens
ctgggcccaaaggcccagg

SEQ ID NO: 1074680 - DNA, 22 bp, Homo sapiens
ctgggcccaaaggcccagggag

SEQ ID NO: 1074681 - DNA, 16 bp, Homo sapiens
ctgggcccacagagcc

SEQ ID NO: 1074682 - DNA, 18 bp, Homo sapiens
ctgggcccacagagcctg

SEQ ID NO: 1074683 - DNA, 20 bp, Homo sapiens
ctgggcccacagagcctggc

SEQ ID NO: 1074684 - DNA, 14 bp, Homo sapiens
ctgggcccaggcag

SEQ ID NO: 1074685 - DNA, 15 bp, Homo sapiens
ctgggcccaggggct

SEQ ID NO: 1074686 - DNA, 18 bp, Homo sapiens
ctgggcccatctccctgc

SEQ ID NO: 1074687 - DNA, 21 bp, Homo sapiens
ctgggcccatctccctgcttt

SEQ ID NO: 1074688 - DNA, 24 bp, Homo sapiens
ctgggccccaaacgggctgccctg

SEQ ID NO: 1074689 - DNA, 14 bp, Homo sapiens
ctgggccccaccta

SEQ ID NO: 1074690 - DNA, 16 bp, Homo sapiens
ctgggccccacctact

SEQ ID NO: 1074691 - DNA, 12 bp, Homo sapiens
ctgggccccact

SEQ ID NO: 1074692 - DNA, 14 bp, Homo sapiens
ctgggccccactgg

SEQ ID NO: 1074693 - DNA, 14 bp, Homo sapiens
ctgggccccatgct

SEQ ID NO: 1074694 - DNA, 22 bp, Homo sapiens
ctgggccccatgctctgcccca

SEQ ID NO: 1074695 - DNA, 15 bp, Homo sapiens
ctgggcccccagcct

SEQ ID NO: 1074696 - DNA, 17 bp, Homo sapiens
ctgggcccccagcctgg

SEQ ID NO: 1074697 - DNA, 18 bp, Homo sapiens
ctgggcccccagcctggc

SEQ ID NO: 1074698 - DNA, 19 bp, Homo sapiens
ctgggcccccagcctggcc

SEQ ID NO: 1074699 - DNA, 14 bp, Homo sapiens
ctgggcccctccac

SEQ ID NO: 1074700 - DNA, 19 bp, Homo sapiens
ctgggcccctccacgcctc

SEQ ID NO: 1074701 - DNA, 16 bp, Homo sapiens
ctgggcccctcccctc

SEQ ID NO: 1074702 - DNA, 18 bp, Homo sapiens
ctgggcccctcccctcag

SEQ ID NO: 1074703 - DNA, 21 bp, Homo sapiens
ctgggcccctcccctcagagc

SEQ ID NO: 1074704 - DNA, 16 bp, Homo sapiens
ctgggcccctgcacag

SEQ ID NO: 1074705 - DNA, 17 bp, Homo sapiens
ctgggcccctgggatgg

SEQ ID NO: 1074706 - DNA, 15 bp, Homo sapiens
ctgggcccctgggga

SEQ ID NO: 1074707 - DNA, 19 bp, Homo sapiens
ctgggcccctggggacaga

SEQ ID NO: 1074708 - DNA, 22 bp, Homo sapiens
ctgggcccggaagggctttggt

SEQ ID NO: 1074709 - DNA, 18 bp, Homo sapiens
ctgggcccgggcaggcca

SEQ ID NO: 1074710 - DNA, 16 bp, Homo sapiens
ctgggccctctttccc

SEQ ID NO: 1074711 - DNA, 23 bp, Homo sapiens
ctgggccctctttccctgcgaga

SEQ ID NO: 1074712 - DNA, 13 bp, Homo sapiens
ctgggccctgggc

SEQ ID NO: 1074713 - DNA, 18 bp, Homo sapiens
ctgggccctgggctgatg

SEQ ID NO: 1074714 - DNA, 16 bp, Homo sapiens
ctgggccctgggctgg

SEQ ID NO: 1074715 - DNA, 18 bp, Homo sapiens
ctgggccctgggctggaa

SEQ ID NO: 1074716 - DNA, 15 bp, Homo sapiens
ctgggcccttgtgct

SEQ ID NO: 1074717 - DNA, 16 bp, Homo sapiens
ctgggcccttgtgctc

SEQ ID NO: 1074718 - DNA, 20 bp, Homo sapiens
ctgggccgggcctggggctc

SEQ ID NO: 1074719 - DNA, 13 bp, Homo sapiens
ctgggccgggctg

SEQ ID NO: 1074720 - DNA, 19 bp, Homo sapiens
ctgggccgtggcacagctg

SEQ ID NO: 1074721 - DNA, 20 bp, Homo sapiens
ctgggccgtggcacagctgg

SEQ ID NO: 1074722 - DNA, 21 bp, Homo sapiens
ctgggcctcagttcaacctgg

SEQ ID NO: 1074723 - DNA, 15 bp, Homo sapiens
ctgggcctcccttgg

SEQ ID NO: 1074724 - DNA, 18 bp, Homo sapiens
ctgggcctcccttgggct

SEQ ID NO: 1074725 - DNA, 19 bp, Homo sapiens
ctgggcctcccttgggctg

SEQ ID NO: 1074726 - DNA, 20 bp, Homo sapiens
ctgggcctctgactctgagt

SEQ ID NO: 1074727 - DNA, 12 bp, Homo sapiens
ctgggcctgctt

SEQ ID NO: 1074728 - DNA, 13 bp, Homo sapiens
ctgggcctggggt

SEQ ID NO: 1074729 - DNA, 12 bp, Homo sapiens
ctgggcctgtgc

SEQ ID NO: 1074730 - DNA, 14 bp, Homo sapiens
ctgggcctgtgcac

SEQ ID NO: 1074731 - DNA, 18 bp, Homo sapiens
ctgggcctgtgcactggg

SEQ ID NO: 1074732 - DNA, 21 bp, Homo sapiens
ctgggcctgtgcactgggcag

SEQ ID NO: 1074733 - DNA, 22 bp, Homo sapiens
ctgggcctgtgcactgggcagg

SEQ ID NO: 1074734 - DNA, 23 bp, Homo sapiens
ctgggcctgtgcactgggcaggt

SEQ ID NO: 1074735 - DNA, 15 bp, Homo sapiens
ctgggcctgtgcagc

SEQ ID NO: 1074736 - DNA, 16 bp, Homo sapiens
ctgggcctgtgcagca

SEQ ID NO: 1074737 - DNA, 17 bp, Homo sapiens
ctgggcctgtgcagcag

SEQ ID NO: 1074738 - DNA, 18 bp, Homo sapiens
ctgggcctgtgcagcagc

SEQ ID NO: 1074739 - DNA, 22 bp, Homo sapiens
ctgggcctgtgcagcagcccag

SEQ ID NO: 1074740 - DNA, 20 bp, Homo sapiens
ctgggcctgtgtgtgggtgg

SEQ ID NO: 1074741 - DNA, 19 bp, Homo sapiens
ctgggccttggctgggcct

SEQ ID NO: 1074742 - DNA, 21 bp, Homo sapiens
ctgggcctttccagagaactg

SEQ ID NO: 1074743 - DNA, 14 bp, Homo sapiens
ctgggcctttcctg

SEQ ID NO: 1074744 - DNA, 16 bp, Homo sapiens
ctgggcctttgcaaga

SEQ ID NO: 1074745 - DNA, 17 bp, Homo sapiens
ctgggcctttgtttcct

SEQ ID NO: 1074746 - DNA, 21 bp, Homo sapiens
ctgggcgacagagcgagactc

SEQ ID NO: 1074747 - DNA, 16 bp, Homo sapiens
ctgggcgccctggaag

SEQ ID NO: 1074748 - DNA, 15 bp, Homo sapiens
ctgggcgcggtggct

SEQ ID NO: 1074749 - DNA, 22 bp, Homo sapiens
ctgggcggcccgtggacacccc

SEQ ID NO: 1074750 - DNA, 22 bp, Homo sapiens
ctgggcggcgggcggctgggtc

SEQ ID NO: 1074751 - DNA, 17 bp, Homo sapiens
ctgggcgtccagctcag

SEQ ID NO: 1074752 - DNA, 19 bp, Homo sapiens
ctgggcgtccagctcagcc

SEQ ID NO: 1074753 - DNA, 23 bp, Homo sapiens
ctgggcgtccagctcagccctgg

SEQ ID NO: 1074754 - DNA, 21 bp, Homo sapiens
ctgggcgtctgactccctccc

SEQ ID NO: 1074755 - DNA, 20 bp, Homo sapiens
ctgggctactgccactgtgt

SEQ ID NO: 1074756 - DNA, 18 bp, Homo sapiens
ctgggctatggacacagg

SEQ ID NO: 1074757 - DNA, 19 bp, Homo sapiens
ctgggctatggacacaggg

SEQ ID NO: 1074758 - DNA, 14 bp, Homo sapiens
ctgggctcagggct

SEQ ID NO: 1074759 - DNA, 15 bp, Homo sapiens
ctgggctcagggctg

SEQ ID NO: 1074760 - DNA, 16 bp, Homo sapiens
ctgggctcagggctgg

SEQ ID NO: 1074761 - DNA, 17 bp, Homo sapiens
ctgggctcagggctgga

SEQ ID NO: 1074762 - DNA, 20 bp, Homo sapiens
ctgggctcagggctggagtg

SEQ ID NO: 1074763 - DNA, 21 bp, Homo sapiens
ctgggctcagggctggagtgc

SEQ ID NO: 1074764 - DNA, 22 bp, Homo sapiens
ctgggctccggaggactcacca

SEQ ID NO: 1074765 - DNA, 14 bp, Homo sapiens
ctgggctctccacc

SEQ ID NO: 1074766 - DNA, 15 bp, Homo sapiens
ctgggctctccacct

SEQ ID NO: 1074767 - DNA, 23 bp, Homo sapiens
ctgggctctgcaattcccctctg

SEQ ID NO: 1074768 - DNA, 13 bp, Homo sapiens
ctgggctctgcca

SEQ ID NO: 1074769 - DNA, 21 bp, Homo sapiens
ctgggctctgccaccctacct

SEQ ID NO: 1074770 - DNA, 13 bp, Homo sapiens
ctgggctctgccc

SEQ ID NO: 1074771 - DNA, 20 bp, Homo sapiens
ctgggctctgcctgtctggt

SEQ ID NO: 1074772 - DNA, 14 bp, Homo sapiens
ctgggctctggacc

SEQ ID NO: 1074773 - DNA, 19 bp, Homo sapiens
ctgggctctggacctcagg

SEQ ID NO: 1074774 - DNA, 12 bp, Homo sapiens
ctgggctgagcc

SEQ ID NO: 1074775 - DNA, 14 bp, Homo sapiens
ctgggctgagcccc

SEQ ID NO: 1074776 - DNA, 19 bp, Homo sapiens
ctgggctgctacccagaaa

SEQ ID NO: 1074777 - DNA, 12 bp, Homo sapiens
ctgggctggact

SEQ ID NO: 1074778 - DNA, 15 bp, Homo sapiens
ctgggctggactgga

SEQ ID NO: 1074779 - DNA, 19 bp, Homo sapiens
ctgggctggactggaggtg

SEQ ID NO: 1074780 - DNA, 21 bp, Homo sapiens
ctgggctggactggaggtggg

SEQ ID NO: 1074781 - DNA, 17 bp, Homo sapiens
ctgggctggactggcca

SEQ ID NO: 1074782 - DNA, 18 bp, Homo sapiens
ctgggctggactggccat

SEQ ID NO: 1074783 - DNA, 16 bp, Homo sapiens
ctgggctgggcacctg

SEQ ID NO: 1074784 - DNA, 17 bp, Homo sapiens
ctgggctgggcacctga

SEQ ID NO: 1074785 - DNA, 14 bp, Homo sapiens
ctgggctgggcagc

SEQ ID NO: 1074786 - DNA, 15 bp, Homo sapiens
ctgggctgggcagcc

SEQ ID NO: 1074787 - DNA, 17 bp, Homo sapiens
ctgggctgggcagcctt

SEQ ID NO: 1074788 - DNA, 16 bp, Homo sapiens
ctgggctgggccctct

SEQ ID NO: 1074789 - DNA, 12 bp, Homo sapiens
ctgggctgggct

SEQ ID NO: 1074790 - DNA, 19 bp, Homo sapiens
ctgggctgggctgagcccc

SEQ ID NO: 1074791 - DNA, 14 bp, Homo sapiens
ctgggctgggctgg

SEQ ID NO: 1074792 - DNA, 15 bp, Homo sapiens
ctgggctggggagga

SEQ ID NO: 1074793 - DNA, 13 bp, Homo sapiens
ctgggctggggcc

SEQ ID NO: 1074794 - DNA, 18 bp, Homo sapiens
ctgggctggggcctcaga

SEQ ID NO: 1074795 - DNA, 19 bp, Homo sapiens
ctgggctgggtgctgggaa

SEQ ID NO: 1074796 - DNA, 22 bp, Homo sapiens
ctgggctgggtggcccctgtct

SEQ ID NO: 1074797 - DNA, 13 bp, Homo sapiens
ctgggctgtccag

SEQ ID NO: 1074798 - DNA, 12 bp, Homo sapiens
ctgggctgtctc

SEQ ID NO: 1074799 - DNA, 22 bp, Homo sapiens
ctgggctgtctctcccttccag

SEQ ID NO: 1074800 - DNA, 14 bp, Homo sapiens
ctgggctgtggggc

SEQ ID NO: 1074801 - DNA, 14 bp, Homo sapiens
ctgggctgttggca

SEQ ID NO: 1074802 - DNA, 17 bp, Homo sapiens
ctggtattgttctcaca

SEQ ID NO: 1074803 - DNA, 17 bp, Homo sapiens
ctggtcaaacaaactct

SEQ ID NO: 1074804 - DNA, 17 bp, Homo sapiens
ctggtcaacctcctgga

SEQ ID NO: 1074805 - DNA, 21 bp, Homo sapiens
ctggtcacaggactctgcctc

SEQ ID NO: 1074806 - DNA, 18 bp, Homo sapiens
ctggtcaccaaggcagtg

SEQ ID NO: 1074807 - DNA, 20 bp, Homo sapiens
ctggtcaccaaggcagtgca

SEQ ID NO: 1074808 - DNA, 22 bp, Homo sapiens
ctggtcaccaaggcagtgcatg

SEQ ID NO: 1074809 - DNA, 19 bp, Homo sapiens
ctggtcaccctggggctgc

SEQ ID NO: 1074810 - DNA, 19 bp, Homo sapiens
ctggtcaccttgcactcct

SEQ ID NO: 1074811 - DNA, 22 bp, Homo sapiens
ctggtcaccttgcactcctcac

SEQ ID NO: 1074812 - DNA, 18 bp, Homo sapiens
ctggtcactctgccctct

SEQ ID NO: 1074813 - DNA, 24 bp, Homo sapiens
ctggtcactctgccctctgctgct

SEQ ID NO: 1074814 - DNA, 18 bp, Homo sapiens
ctggtcagagagacctca

SEQ ID NO: 1074815 - DNA, 22 bp, Homo sapiens
ctggtcagagagacctcatcct

SEQ ID NO: 1074816 - DNA, 13 bp, Homo sapiens
ctggtcagagtgg

SEQ ID NO: 1074817 - DNA, 15 bp, Homo sapiens
ctggtcagggcagtg

SEQ ID NO: 1074818 - DNA, 17 bp, Homo sapiens
ctggtcagggcagtggc

SEQ ID NO: 1074819 - DNA, 18 bp, Homo sapiens
ctggtcagggcagtggcc

SEQ ID NO: 1074820 - DNA, 21 bp, Homo sapiens
ctggtcagggcagtggccaag

SEQ ID NO: 1074821 - DNA, 13 bp, Homo sapiens
ctggtcaggtccc

SEQ ID NO: 1074822 - DNA, 14 bp, Homo sapiens
ctggtcaggtcccc

SEQ ID NO: 1074823 - DNA, 18 bp, Homo sapiens
ctggtcaggtccccatgg

SEQ ID NO: 1074824 - DNA, 20 bp, Homo sapiens
ctggtcaggtccccatggct

SEQ ID NO: 1074825 - DNA, 12 bp, Homo sapiens
ctggtcagtctt

SEQ ID NO: 1074826 - DNA, 22 bp, Homo sapiens
ctggtcatccttggtgctcttg

SEQ ID NO: 1074827 - DNA, 12 bp, Homo sapiens
ctggtccagctc

SEQ ID NO: 1074828 - DNA, 13 bp, Homo sapiens
ctggtccagctct

SEQ ID NO: 1074829 - DNA, 21 bp, Homo sapiens
ctggtccagctctgacatccc

SEQ ID NO: 1074830 - DNA, 15 bp, Homo sapiens
ctggtccagggaagc

SEQ ID NO: 1074831 - DNA, 16 bp, Homo sapiens
ctggtccatgatggag

SEQ ID NO: 1074832 - DNA, 18 bp, Homo sapiens
ctggtccatgcagggggc

SEQ ID NO: 1074833 - DNA, 19 bp, Homo sapiens
ctggtcccacgagggtgcc

SEQ ID NO: 1074834 - DNA, 15 bp, Homo sapiens
ctggtccccactgct

SEQ ID NO: 1074835 - DNA, 20 bp, Homo sapiens
ctggtccccactgctgagct

SEQ ID NO: 1074836 - DNA, 14 bp, Homo sapiens
ctggtcccctgtgg

SEQ ID NO: 1074837 - DNA, 15 bp, Homo sapiens
ctggtcccctgtggt

SEQ ID NO: 1074838 - DNA, 20 bp, Homo sapiens
ctggtccctcttctctcctc

SEQ ID NO: 1074839 - DNA, 16 bp, Homo sapiens
ctggtccgtgggacgg

SEQ ID NO: 1074840 - DNA, 21 bp, Homo sapiens
ctggtccgtgggacggtgccc

SEQ ID NO: 1074841 - DNA, 21 bp, Homo sapiens
ctggtcctaggtcctctgagg

SEQ ID NO: 1074842 - DNA, 23 bp, Homo sapiens
ctggtcctaggtcctctgaggca

SEQ ID NO: 1074843 - DNA, 21 bp, Homo sapiens
ctggtcctccactttgctggt

SEQ ID NO: 1074844 - DNA, 12 bp, Homo sapiens
ctggtcctcgga

SEQ ID NO: 1074845 - DNA, 16 bp, Homo sapiens
ctggtcctcggagctg

SEQ ID NO: 1074846 - DNA, 21 bp, Homo sapiens
ctggtcctggacacctcccag

SEQ ID NO: 1074847 - DNA, 14 bp, Homo sapiens
ctggtcctggctgc

SEQ ID NO: 1074848 - DNA, 15 bp, Homo sapiens
ctggtcctggctgca

SEQ ID NO: 1074849 - DNA, 16 bp, Homo sapiens
ctggtcctggctgcac

SEQ ID NO: 1074850 - DNA, 17 bp, Homo sapiens
ctggtcctggctgcact

SEQ ID NO: 1074851 - DNA, 22 bp, Homo sapiens
ctggtcctggctgcactcttga

SEQ ID NO: 1074852 - DNA, 13 bp, Homo sapiens
ctggtccttattt

SEQ ID NO: 1074853 - DNA, 14 bp, Homo sapiens
ctggtccttattta

SEQ ID NO: 1074854 - DNA, 17 bp, Homo sapiens
ctggtccttccaggccc

SEQ ID NO: 1074855 - DNA, 19 bp, Homo sapiens
ctggtccttccaggccccc

SEQ ID NO: 1074856 - DNA, 15 bp, Homo sapiens
ctggtctaatgtttg

SEQ ID NO: 1074857 - DNA, 17 bp, Homo sapiens
ctggtctattttgattt

SEQ ID NO: 1074858 - DNA, 23 bp, Homo sapiens
ctggtctcaaactcctgacctca

SEQ ID NO: 1074859 - DNA, 22 bp, Homo sapiens
ctggtctcgaactcctgacctc

SEQ ID NO: 1074860 - DNA, 19 bp, Homo sapiens
ctggtctcttcaccactgt

SEQ ID NO: 1074861 - DNA, 18 bp, Homo sapiens
ctggtctgaggatgtaga

SEQ ID NO: 1074862 - DNA, 18 bp, Homo sapiens
ctggtctgccaggggctt

SEQ ID NO: 1074863 - DNA, 18 bp, Homo sapiens
ctggtctggagtcccacc

SEQ ID NO: 1074864 - DNA, 21 bp, Homo sapiens
ctggtctggagtcccacccgg

SEQ ID NO: 1074865 - DNA, 17 bp, Homo sapiens
ctggtctgtgaagagcc

SEQ ID NO: 1074866 - DNA, 19 bp, Homo sapiens
ctggtctgtggagatggac

SEQ ID NO: 1074867 - DNA, 23 bp, Homo sapiens
ctggtcttcactttcctcagttg

SEQ ID NO: 1074868 - DNA, 14 bp, Homo sapiens
ctggtcttgagatg

SEQ ID NO: 1074869 - DNA, 16 bp, Homo sapiens
ctggtcttttctccta

SEQ ID NO: 1074870 - DNA, 17 bp, Homo sapiens
ctggtgaacactgtgac

SEQ ID NO: 1074871 - DNA, 18 bp, Homo sapiens
ctggtgaacactgtgacc

SEQ ID NO: 1074872 - DNA, 19 bp, Homo sapiens
ctggtgaacactgtgacca

SEQ ID NO: 1074873 - DNA, 20 bp, Homo sapiens
ctggtgaagctcacttctgg

SEQ ID NO: 1074874 - DNA, 15 bp, Homo sapiens
ctggtgacagccttg

SEQ ID NO: 1074875 - DNA, 17 bp, Homo sapiens
ctggtgacagccttggg

SEQ ID NO: 1074876 - DNA, 13 bp, Homo sapiens
ctggtgacctcct

SEQ ID NO: 1074877 - DNA, 21 bp, Homo sapiens
ctggtgactgcgatcttcaga

SEQ ID NO: 1074878 - DNA, 22 bp, Homo sapiens
ctggtgactgcgatcttcagag

SEQ ID NO: 1074879 - DNA, 16 bp, Homo sapiens
ctggtgagaccccgca

SEQ ID NO: 1074880 - DNA, 14 bp, Homo sapiens
ctggtgaggcccag

SEQ ID NO: 1074881 - DNA, 16 bp, Homo sapiens
ctggtgaggcccagcc

SEQ ID NO: 1074882 - DNA, 17 bp, Homo sapiens
ctggtgaggcccagcct

SEQ ID NO: 1074883 - DNA, 19 bp, Homo sapiens
ctggtgaggcccagcctgt

SEQ ID NO: 1074884 - DNA, 14 bp, Homo sapiens
ctggtgaggtggcc

SEQ ID NO: 1074885 - DNA, 16 bp, Homo sapiens
ctggtgaggtggccca

SEQ ID NO: 1074886 - DNA, 19 bp, Homo sapiens
ctggtgaggtggcccaggc

SEQ ID NO: 1074887 - DNA, 17 bp, Homo sapiens
ctggtgatgttgaaata

SEQ ID NO: 1074888 - DNA, 17 bp, Homo sapiens
ctggtgcaaattcagaa

SEQ ID NO: 1074889 - DNA, 22 bp, Homo sapiens
ctggtgcaattacagcaaaaag

SEQ ID NO: 1074890 - DNA, 20 bp, Homo sapiens
ctggtgcacgcctgagcgtc

SEQ ID NO: 1074891 - DNA, 15 bp, Homo sapiens
ctggtgcattacaga

SEQ ID NO: 1074892 - DNA, 16 bp, Homo sapiens
ctggtgcattacagag

SEQ ID NO: 1074893 - DNA, 14 bp, Homo sapiens
ctggtgcattctgt

SEQ ID NO: 1074894 - DNA, 13 bp, Homo sapiens
ctggtgccagcct

SEQ ID NO: 1074895 - DNA, 17 bp, Homo sapiens
ctggtgccagccttcct

SEQ ID NO: 1074896 - DNA, 21 bp, Homo sapiens
ctggtgccagccttcctctgc

SEQ ID NO: 1074897 - DNA, 16 bp, Homo sapiens
ctggtgcccacagcag

SEQ ID NO: 1074898 - DNA, 17 bp, Homo sapiens
ctggtgcccacagcagg

SEQ ID NO: 1074899 - DNA, 16 bp, Homo sapiens
ctggtgccccacagct

SEQ ID NO: 1074900 - DNA, 20 bp, Homo sapiens
ctggtgccccacagctacct

SEQ ID NO: 1074901 - DNA, 12 bp, Homo sapiens
ctggtgcctcct

SEQ ID NO: 1074902 - DNA, 12 bp, Homo sapiens
ctggtgcctctg

SEQ ID NO: 1074903 - DNA, 15 bp, Homo sapiens
ctggtgcctctgtgc

SEQ ID NO: 1074904 - DNA, 18 bp, Homo sapiens
ctggtgctcctgcccagc

SEQ ID NO: 1074905 - DNA, 19 bp, Homo sapiens
ctggtgctcctgcccagcc

SEQ ID NO: 1074906 - DNA, 21 bp, Homo sapiens
ctggtgctcgggaagggaggg

SEQ ID NO: 1074907 - DNA, 18 bp, Homo sapiens
ctggtgctctctgccact

SEQ ID NO: 1074908 - DNA, 13 bp, Homo sapiens
ctggtgctgccac

SEQ ID NO: 1074909 - DNA, 14 bp, Homo sapiens
ctggtgctgcctct

SEQ ID NO: 1074910 - DNA, 12 bp, Homo sapiens
ctggtgctgctg

SEQ ID NO: 1074911 - DNA, 20 bp, Homo sapiens
ctggtgctggatattttcaa

SEQ ID NO: 1074912 - DNA, 16 bp, Homo sapiens
ctggtgctgtggccag

SEQ ID NO: 1074913 - DNA, 18 bp, Homo sapiens
ctggtgctgtggccaggg

SEQ ID NO: 1074914 - DNA, 21 bp, Homo sapiens
ctggtggagaaagcactgacc

SEQ ID NO: 1074915 - DNA, 16 bp, Homo sapiens
ctggtggaggagctga

SEQ ID NO: 1074916 - DNA, 23 bp, Homo sapiens
ctggtggaggagctgagggaggg

SEQ ID NO: 1074917 - DNA, 15 bp, Homo sapiens
ctgtagccacagctg

SEQ ID NO: 1074918 - DNA, 18 bp, Homo sapiens
ctgtagccacagctgctg

SEQ ID NO: 1074919 - DNA, 12 bp, Homo sapiens
ctgtagccatgg

SEQ ID NO: 1074920 - DNA, 20 bp, Homo sapiens
ctgtagccatggctcaggca

SEQ ID NO: 1074921 - DNA, 18 bp, Homo sapiens
ctgtagccccagtgacag

SEQ ID NO: 1074922 - DNA, 23 bp, Homo sapiens
ctgtagcctaaaacgaatggtct

SEQ ID NO: 1074923 - DNA, 21 bp, Homo sapiens
ctgtagctattagcggctcct

SEQ ID NO: 1074924 - DNA, 22 bp, Homo sapiens
ctgtagctattagcggctcctc

SEQ ID NO: 1074925 - DNA, 12 bp, Homo sapiens
ctgtagctcagt

SEQ ID NO: 1074926 - DNA, 16 bp, Homo sapiens
ctgtagctcagtcatc

SEQ ID NO: 1074927 - DNA, 22 bp, Homo sapiens
ctgtagctcagtcatcaaagca

SEQ ID NO: 1074928 - DNA, 15 bp, Homo sapiens
ctgtagctctgcctc

SEQ ID NO: 1074929 - DNA, 20 bp, Homo sapiens
ctgtagctctgcctccctct

SEQ ID NO: 1074930 - DNA, 22 bp, Homo sapiens
ctgtagctgatgaaactcctga

SEQ ID NO: 1074931 - DNA, 18 bp, Homo sapiens
ctgtagcttgttccctgt

SEQ ID NO: 1074932 - DNA, 14 bp, Homo sapiens
ctgtaggaaaccca

SEQ ID NO: 1074933 - DNA, 18 bp, Homo sapiens
ctgtaggaaggttaatgt

SEQ ID NO: 1074934 - DNA, 15 bp, Homo sapiens
ctgtaggcagaggct

SEQ ID NO: 1074935 - DNA, 22 bp, Homo sapiens
ctgtaggcctcaggtgaaactc

SEQ ID NO: 1074936 - DNA, 18 bp, Homo sapiens
ctgtagggaaaccttgga

SEQ ID NO: 1074937 - DNA, 21 bp, Homo sapiens
ctgtagggaattcttctgtta

SEQ ID NO: 1074938 - DNA, 18 bp, Homo sapiens
ctgtagggagaagcttta

SEQ ID NO: 1074939 - DNA, 16 bp, Homo sapiens
ctgtagggctggacct

SEQ ID NO: 1074940 - DNA, 17 bp, Homo sapiens
ctgtagggctggaccta

SEQ ID NO: 1074941 - DNA, 21 bp, Homo sapiens
ctgtagggctggacctatgtc

SEQ ID NO: 1074942 - DNA, 17 bp, Homo sapiens
ctgtaggtgtctctggg

SEQ ID NO: 1074943 - DNA, 21 bp, Homo sapiens
ctgtaggtgtctctgggcctg

SEQ ID NO: 1074944 - DNA, 18 bp, Homo sapiens
ctgtaggttatttaaaat

SEQ ID NO: 1074945 - DNA, 20 bp, Homo sapiens
ctgtaggttcatgcccaagc

SEQ ID NO: 1074946 - DNA, 21 bp, Homo sapiens
ctgtagtagccctttctgtgt

SEQ ID NO: 1074947 - DNA, 15 bp, Homo sapiens
ctgtagtcccagcca

SEQ ID NO: 1074948 - DNA, 22 bp, Homo sapiens
ctgtagtcccagctactcggga

SEQ ID NO: 1074949 - DNA, 14 bp, Homo sapiens
ctgtagtctcagtt

SEQ ID NO: 1074950 - DNA, 17 bp, Homo sapiens
ctgtagtgagaaactga

SEQ ID NO: 1074951 - DNA, 22 bp, Homo sapiens
ctgtagtgagatagcattgtga

SEQ ID NO: 1074952 - DNA, 16 bp, Homo sapiens
ctgtagtgtattaatc

SEQ ID NO: 1074953 - DNA, 21 bp, Homo sapiens
ctgtagtgtattaatctctgt

SEQ ID NO: 1074954 - DNA, 21 bp, Homo sapiens
ctgtagtttatggcagaaggg

SEQ ID NO: 1074955 - DNA, 21 bp, Homo sapiens
ctgtagtttttgaaaattatg

SEQ ID NO: 1074956 - DNA, 20 bp, Homo sapiens
ctgtataagacactttgcca

SEQ ID NO: 1074957 - DNA, 15 bp, Homo sapiens
ctgtataagcactga

SEQ ID NO: 1074958 - DNA, 16 bp, Homo sapiens
ctgtataagtaagaaa

SEQ ID NO: 1074959 - DNA, 22 bp, Homo sapiens
ctgtataagtggaggcacttta

SEQ ID NO: 1074960 - DNA, 13 bp, Homo sapiens
ctgtatacagtgc

SEQ ID NO: 1074961 - DNA, 21 bp, Homo sapiens
ctgtatacagtgcagagcctt

SEQ ID NO: 1074962 - DNA, 15 bp, Homo sapiens
ctgtatactgtaaaa

SEQ ID NO: 1074963 - DNA, 16 bp, Homo sapiens
ctgtatactgtaaaag

SEQ ID NO: 1074964 - DNA, 18 bp, Homo sapiens
ctgtatactgtaaaagtt

SEQ ID NO: 1074965 - DNA, 20 bp, Homo sapiens
ctgtatactgtaaaagttat

SEQ ID NO: 1074966 - DNA, 14 bp, Homo sapiens
ctgtatagacatgc

SEQ ID NO: 1074967 - DNA, 16 bp, Homo sapiens
ctgtatagttaggata

SEQ ID NO: 1074968 - DNA, 15 bp, Homo sapiens
ctgtatataaaataa

SEQ ID NO: 1074969 - DNA, 18 bp, Homo sapiens
ctgtatatacaataacat

SEQ ID NO: 1074970 - DNA, 19 bp, Homo sapiens
ctgtatatacaataacata

SEQ ID NO: 1074971 - DNA, 23 bp, Homo sapiens
ctgtatatacaataacataattt

SEQ ID NO: 1074972 - DNA, 13 bp, Homo sapiens
ctgtatatacttt

SEQ ID NO: 1074973 - DNA, 14 bp, Homo sapiens
ctgtatatactttt

SEQ ID NO: 1074974 - DNA, 19 bp, Homo sapiens
ctgtatatgattatggcct

SEQ ID NO: 1074975 - DNA, 18 bp, Homo sapiens
ctgtatatgattctctgt

SEQ ID NO: 1074976 - DNA, 22 bp, Homo sapiens
ctgtatattacagatatttgtc

SEQ ID NO: 1074977 - DNA, 19 bp, Homo sapiens
ctgtatattccatgtataa

SEQ ID NO: 1074978 - DNA, 14 bp, Homo sapiens
ctgtatatttgtca

SEQ ID NO: 1074979 - DNA, 16 bp, Homo sapiens
ctgtatatttgtcatg

SEQ ID NO: 1074980 - DNA, 17 bp, Homo sapiens
ctgtatatttgtcatga

SEQ ID NO: 1074981 - DNA, 16 bp, Homo sapiens
ctgtatcaggacccag

SEQ ID NO: 1074982 - DNA, 22 bp, Homo sapiens
ctgtatcaggacccagaggaag

SEQ ID NO: 1074983 - DNA, 17 bp, Homo sapiens
ctgtatcggagacagtg

SEQ ID NO: 1074984 - DNA, 14 bp, Homo sapiens
ctgtatctgtaatt

SEQ ID NO: 1074985 - DNA, 13 bp, Homo sapiens
ctgtatctgtgta

SEQ ID NO: 1074986 - DNA, 18 bp, Homo sapiens
ctgtatctgtgtagacta

SEQ ID NO: 1074987 - DNA, 12 bp, Homo sapiens
ctgtatgattta

SEQ ID NO: 1074988 - DNA, 16 bp, Homo sapiens
ctgtatgccttctgta

SEQ ID NO: 1074989 - DNA, 22 bp, Homo sapiens
ctgtatgctgatcatcgccaga

SEQ ID NO: 1074990 - DNA, 20 bp, Homo sapiens
ctgtatgtctcgtggtagga

SEQ ID NO: 1074991 - DNA, 23 bp, Homo sapiens
ctgtatgtgtgtaggttatcttt

SEQ ID NO: 1074992 - DNA, 13 bp, Homo sapiens
ctgtatgttgtcc

SEQ ID NO: 1074993 - DNA, 15 bp, Homo sapiens
ctgtattaaatctta

SEQ ID NO: 1074994 - DNA, 20 bp, Homo sapiens
ctgtattaaatcttaaacaa

SEQ ID NO: 1074995 - DNA, 15 bp, Homo sapiens
ctgtattaagccact

SEQ ID NO: 1074996 - DNA, 21 bp, Homo sapiens
ctgtattactgaataatatca

SEQ ID NO: 1074997 - DNA, 13 bp, Homo sapiens
ctgtattctagtg

SEQ ID NO: 1074998 - DNA, 18 bp, Homo sapiens
ctgtattctagtggctgt

SEQ ID NO: 1074999 - DNA, 22 bp, Homo sapiens
ctgtattctagtggctgttcat

SEQ ID NO: 1075000 - DNA, 23 bp, Homo sapiens
ctgtattctagtggctgttcatg

SEQ ID NO: 1075001 - DNA, 16 bp, Homo sapiens
ctgtattcttgtttga

SEQ ID NO: 1075002 - DNA, 15 bp, Homo sapiens
ctgtccacatgacct

SEQ ID NO: 1075003 - DNA, 18 bp, Homo sapiens
ctgtccacatgacctcca

SEQ ID NO: 1075004 - DNA, 19 bp, Homo sapiens
ctgtccacatgacctccat

SEQ ID NO: 1075005 - DNA, 15 bp, Homo sapiens
ctgtccaccagaccc

SEQ ID NO: 1075006 - DNA, 13 bp, Homo sapiens
ctgtccaccagtt

SEQ ID NO: 1075007 - DNA, 19 bp, Homo sapiens
ctgtccacctgtgctgctg

SEQ ID NO: 1075008 - DNA, 12 bp, Homo sapiens
ctgtccactctc

SEQ ID NO: 1075009 - DNA, 22 bp, Homo sapiens
ctgtccactctcggggcccttg

SEQ ID NO: 1075010 - DNA, 15 bp, Homo sapiens
ctgtccagcccccag

SEQ ID NO: 1075011 - DNA, 13 bp, Homo sapiens
ctgtccagcctgg

SEQ ID NO: 1075012 - DNA, 17 bp, Homo sapiens
ctgtccagcctgggcag

SEQ ID NO: 1075013 - DNA, 13 bp, Homo sapiens
ctgtccagcctta

SEQ ID NO: 1075014 - DNA, 13 bp, Homo sapiens
ctgtccagctggg

SEQ ID NO: 1075015 - DNA, 17 bp, Homo sapiens
ctgtccaggcactgctg

SEQ ID NO: 1075016 - DNA, 21 bp, Homo sapiens
ctgtccaggcactgctgccca

SEQ ID NO: 1075017 - DNA, 21 bp, Homo sapiens
ctgtccaggcagctccctcct

SEQ ID NO: 1075018 - DNA, 14 bp, Homo sapiens
ctgtccaggccact

SEQ ID NO: 1075019 - DNA, 15 bp, Homo sapiens
ctgtccaggccactg

SEQ ID NO: 1075020 - DNA, 18 bp, Homo sapiens
ctgtccagggccctgagc

SEQ ID NO: 1075021 - DNA, 20 bp, Homo sapiens
ctgtccagggccctgagctc

SEQ ID NO: 1075022 - DNA, 23 bp, Homo sapiens
ctgtccagggccctgagctcggt

SEQ ID NO: 1075023 - DNA, 20 bp, Homo sapiens
ctgtccaggtgagtgtgagg

SEQ ID NO: 1075024 - DNA, 18 bp, Homo sapiens
ctgtccatctgtctgtcc

SEQ ID NO: 1075025 - DNA, 18 bp, Homo sapiens
ctgtcccaccaactctgc

SEQ ID NO: 1075026 - DNA, 20 bp, Homo sapiens
ctgtcccaccaactctgcac

SEQ ID NO: 1075027 - DNA, 21 bp, Homo sapiens
ctgtcccaccaactctgcact

SEQ ID NO: 1075028 - DNA, 23 bp, Homo sapiens
ctgtcccacccacacagctgccc

SEQ ID NO: 1075029 - DNA, 19 bp, Homo sapiens
ctgtcccaccgggagcctc

SEQ ID NO: 1075030 - DNA, 13 bp, Homo sapiens
ctgtcccacctct

SEQ ID NO: 1075031 - DNA, 15 bp, Homo sapiens
ctgtcccacctcttc

SEQ ID NO: 1075032 - DNA, 21 bp, Homo sapiens
ctgtcccagagcttattggcc

SEQ ID NO: 1075033 - DNA, 23 bp, Homo sapiens
ctgtcccagagcttattggccac

SEQ ID NO: 1075034 - DNA, 13 bp, Homo sapiens
ctgtcccagaggt

SEQ ID NO: 1075035 - DNA, 13 bp, Homo sapiens
ctgtcccagcccc

SEQ ID NO: 1075036 - DNA, 22 bp, Homo sapiens
ctgtcccagccccggcaagcca

SEQ ID NO: 1075037 - DNA, 19 bp, Homo sapiens
ctgtcccaggcatgcagct

SEQ ID NO: 1075038 - DNA, 20 bp, Homo sapiens
ctgtcccaggcatgcagctg

SEQ ID NO: 1075039 - DNA, 22 bp, Homo sapiens
ctgtcccaggcatgcagctgcc

SEQ ID NO: 1075040 - DNA, 12 bp, Homo sapiens
ctgtcccaggcc

SEQ ID NO: 1075041 - DNA, 15 bp, Homo sapiens
ctgtcccatccccag

SEQ ID NO: 1075042 - DNA, 15 bp, Homo sapiens
ctgtcccatgcaggc

SEQ ID NO: 1075043 - DNA, 17 bp, Homo sapiens
ctgtcccatggacactc

SEQ ID NO: 1075044 - DNA, 23 bp, Homo sapiens
ctgtcccattccctgggatctgg

SEQ ID NO: 1075045 - DNA, 23 bp, Homo sapiens
ctgtccccaacaggaatttttaa

SEQ ID NO: 1075046 - DNA, 12 bp, Homo sapiens
ctgtccccaaga

SEQ ID NO: 1075047 - DNA, 23 bp, Homo sapiens
ctgtccccaagacacttcccctt

SEQ ID NO: 1075048 - DNA, 22 bp, Homo sapiens
ctgtccccacctaagcctggtg

SEQ ID NO: 1075049 - DNA, 15 bp, Homo sapiens
ctgtccccacgaggg

SEQ ID NO: 1075050 - DNA, 17 bp, Homo sapiens
ctgtccccacgagggga

SEQ ID NO: 1075051 - DNA, 22 bp, Homo sapiens
ctgtcctgcagtcccacactgt

SEQ ID NO: 1075052 - DNA, 12 bp, Homo sapiens
ctgtcctgcctc

SEQ ID NO: 1075053 - DNA, 14 bp, Homo sapiens
ctgtcctgcctcct

SEQ ID NO: 1075054 - DNA, 16 bp, Homo sapiens
ctgtcctgcctcctca

SEQ ID NO: 1075055 - DNA, 17 bp, Homo sapiens
ctgtcctgcctcctcat

SEQ ID NO: 1075056 - DNA, 14 bp, Homo sapiens
ctgtcctgcgttca

SEQ ID NO: 1075057 - DNA, 20 bp, Homo sapiens
ctgtcctgcgttcagcccct

SEQ ID NO: 1075058 - DNA, 21 bp, Homo sapiens
ctgtcctgcgttcagcccctg

SEQ ID NO: 1075059 - DNA, 21 bp, Homo sapiens
ctgtcctggaacctgtctcca

SEQ ID NO: 1075060 - DNA, 22 bp, Homo sapiens
ctgtcctgggcatgggtccagg

SEQ ID NO: 1075061 - DNA, 12 bp, Homo sapiens
ctgtcctgggcg

SEQ ID NO: 1075062 - DNA, 23 bp, Homo sapiens
ctgtcctgggcgccctggaagcc

SEQ ID NO: 1075063 - DNA, 19 bp, Homo sapiens
ctgtcctggtggtattttc

SEQ ID NO: 1075064 - DNA, 20 bp, Homo sapiens
ctgtcctggtggtattttca

SEQ ID NO: 1075065 - DNA, 21 bp, Homo sapiens
ctgtcctggtggtattttcaa

SEQ ID NO: 1075066 - DNA, 18 bp, Homo sapiens
ctgtcctgttttcttagg

SEQ ID NO: 1075067 - DNA, 17 bp, Homo sapiens
ctgtccttagactcctt

SEQ ID NO: 1075068 - DNA, 17 bp, Homo sapiens
ctgtccttcagatggaa

SEQ ID NO: 1075069 - DNA, 21 bp, Homo sapiens
ctgtccttccctgttctccct

SEQ ID NO: 1075070 - DNA, 22 bp, Homo sapiens
ctgtccttccctgttctccctt

SEQ ID NO: 1075071 - DNA, 17 bp, Homo sapiens
ctgtccttgaaaaacaa

SEQ ID NO: 1075072 - DNA, 14 bp, Homo sapiens
ctgtccttttagga

SEQ ID NO: 1075073 - DNA, 15 bp, Homo sapiens
ctgtccttttaggaa

SEQ ID NO: 1075074 - DNA, 14 bp, Homo sapiens
ctgtcgagacactt

SEQ ID NO: 1075075 - DNA, 18 bp, Homo sapiens
ctgtcgagacacttgcct

SEQ ID NO: 1075076 - DNA, 17 bp, Homo sapiens
ctgtcgattagactgga

SEQ ID NO: 1075077 - DNA, 19 bp, Homo sapiens
ctgtcgattagactggaca

SEQ ID NO: 1075078 - DNA, 23 bp, Homo sapiens
ctgtcgattagactggacagctt

SEQ ID NO: 1075079 - DNA, 17 bp, Homo sapiens
ctgtcgcccacccagct

SEQ ID NO: 1075080 - DNA, 18 bp, Homo sapiens
ctgtcgcccacccagctg

SEQ ID NO: 1075081 - DNA, 16 bp, Homo sapiens
ctgtcgccccaggccc

SEQ ID NO: 1075082 - DNA, 18 bp, Homo sapiens
ctgtcgccccaggccctc

SEQ ID NO: 1075083 - DNA, 22 bp, Homo sapiens
ctgtcgccccaggccctccctg

SEQ ID NO: 1075084 - DNA, 16 bp, Homo sapiens
ctgtcggagaggctgt

SEQ ID NO: 1075085 - DNA, 13 bp, Homo sapiens
ctgtcgggaccac

SEQ ID NO: 1075086 - DNA, 14 bp, Homo sapiens
ctgtcgggaccaca

SEQ ID NO: 1075087 - DNA, 18 bp, Homo sapiens
ctgtcgggaccacatctg

SEQ ID NO: 1075088 - DNA, 12 bp, Homo sapiens
ctgtcgtctgac

SEQ ID NO: 1075089 - DNA, 14 bp, Homo sapiens
ctgtcgtctgactc

SEQ ID NO: 1075090 - DNA, 16 bp, Homo sapiens
ctgtcgtctgactctg

SEQ ID NO: 1075091 - DNA, 19 bp, Homo sapiens
ctgtcgtctgactctgggt

SEQ ID NO: 1075092 - DNA, 19 bp, Homo sapiens
ctgtctaaagccttaacta

SEQ ID NO: 1075093 - DNA, 16 bp, Homo sapiens
ctgtctaacctgtgac

SEQ ID NO: 1075094 - DNA, 19 bp, Homo sapiens
ctgtctaatttgcaccttt

SEQ ID NO: 1075095 - DNA, 21 bp, Homo sapiens
ctgtctacagtagctgctacc

SEQ ID NO: 1075096 - DNA, 16 bp, Homo sapiens
ctgtctagaatgtgga

SEQ ID NO: 1075097 - DNA, 18 bp, Homo sapiens
ctgtctagagagggaggc

SEQ ID NO: 1075098 - DNA, 18 bp, Homo sapiens
ctgtctaggactgcagtg

SEQ ID NO: 1075099 - DNA, 23 bp, Homo sapiens
ctgtctaggttaaagctaaactg

SEQ ID NO: 1075100 - DNA, 22 bp, Homo sapiens
ctgtctcaagagggcactggtg

SEQ ID NO: 1075101 - DNA, 23 bp, Homo sapiens
ctgtctcaagagggcactggtgg

SEQ ID NO: 1075102 - DNA, 12 bp, Homo sapiens
ctgtctcacctg

SEQ ID NO: 1075103 - DNA, 14 bp, Homo sapiens
ctgtctcacctgga

SEQ ID NO: 1075104 - DNA, 23 bp, Homo sapiens
ctgtctcactttttacccagaac

SEQ ID NO: 1075105 - DNA, 16 bp, Homo sapiens
ctgtctcagcctccca

SEQ ID NO: 1075106 - DNA, 18 bp, Homo sapiens
ctgtctcatcacataaaa

SEQ ID NO: 1075107 - DNA, 17 bp, Homo sapiens
ctgtctcatccccaggg

SEQ ID NO: 1075108 - DNA, 21 bp, Homo sapiens
ctgtctcatccccaggggtcc

SEQ ID NO: 1075109 - DNA, 14 bp, Homo sapiens
ctgtctcatcctcc

SEQ ID NO: 1075110 - DNA, 17 bp, Homo sapiens
ctgtctcatcctcctgg

SEQ ID NO: 1075111 - DNA, 22 bp, Homo sapiens
ctgtctcatcctcctggaacct

SEQ ID NO: 1075112 - DNA, 12 bp, Homo sapiens
ctgtctccagac

SEQ ID NO: 1075113 - DNA, 22 bp, Homo sapiens
ctgtctccagacccccacccct

SEQ ID NO: 1075114 - DNA, 16 bp, Homo sapiens
ctgtctccagctgcct

SEQ ID NO: 1075115 - DNA, 21 bp, Homo sapiens
ctgtctccagctgcctgggcc

SEQ ID NO: 1075116 - DNA, 21 bp, Homo sapiens
ctgtctccagggcccccaccg

SEQ ID NO: 1075117 - DNA, 15 bp, Homo sapiens
ctgtctccatgctgg

SEQ ID NO: 1075118 - DNA, 20 bp, Homo sapiens
ctgtctccatggccctgcaa

SEQ ID NO: 1075119 - DNA, 16 bp, Homo sapiens
ctgtctcccaggctgg

SEQ ID NO: 1075120 - DNA, 19 bp, Homo sapiens
ctgtctccctccccaaatg

SEQ ID NO: 1075121 - DNA, 21 bp, Homo sapiens
ctgtctccctcccctctcaga

SEQ ID NO: 1075122 - DNA, 16 bp, Homo sapiens
ctgtctcctccctggg

SEQ ID NO: 1075123 - DNA, 14 bp, Homo sapiens
ctgtctcgatgcct

SEQ ID NO: 1075124 - DNA, 18 bp, Homo sapiens
ctgtctcgggctgaccct

SEQ ID NO: 1075125 - DNA, 21 bp, Homo sapiens
ctgtctcgggctgaccctttt

SEQ ID NO: 1075126 - DNA, 22 bp, Homo sapiens
ctgtctcgggctgacccttttc

SEQ ID NO: 1075127 - DNA, 19 bp, Homo sapiens
ctgtctctaaccattcaaa

SEQ ID NO: 1075128 - DNA, 14 bp, Homo sapiens
ctgtctctactaaa

SEQ ID NO: 1075129 - DNA, 20 bp, Homo sapiens
ctgtctctccccctctgtct

SEQ ID NO: 1075130 - DNA, 21 bp, Homo sapiens
ctgtctctcctagcccctctc

SEQ ID NO: 1075131 - DNA, 15 bp, Homo sapiens
ctgtctctgcacaga

SEQ ID NO: 1075132 - DNA, 16 bp, Homo sapiens
ctgtctctgcctccct

SEQ ID NO: 1075133 - DNA, 17 bp, Homo sapiens
ctgtctctgcctgcggc

SEQ ID NO: 1075134 - DNA, 13 bp, Homo sapiens
ctgtctctgctcg

SEQ ID NO: 1075135 - DNA, 14 bp, Homo sapiens
ctgtctctgtggaa

SEQ ID NO: 1075136 - DNA, 14 bp, Homo sapiens
ctgtctcttggctt

SEQ ID NO: 1075137 - DNA, 15 bp, Homo sapiens
ctgtctcttttctct

SEQ ID NO: 1075138 - DNA, 16 bp, Homo sapiens
ctgtctgaatgatctt

SEQ ID NO: 1075139 - DNA, 21 bp, Homo sapiens
ctgtctgaggagtaagtgtac

SEQ ID NO: 1075140 - DNA, 19 bp, Homo sapiens
ctgtctgcagtgcccggct

SEQ ID NO: 1075141 - DNA, 14 bp, Homo sapiens
ctgtctgccagcca

SEQ ID NO: 1075142 - DNA, 20 bp, Homo sapiens
ctgtctgccagccagcagcc

SEQ ID NO: 1075143 - DNA, 15 bp, Homo sapiens
ctgtctgccaggcac

SEQ ID NO: 1075144 - DNA, 13 bp, Homo sapiens
ctgtctgccccag

SEQ ID NO: 1075145 - DNA, 15 bp, Homo sapiens
ctgtctgccccagcc

SEQ ID NO: 1075146 - DNA, 21 bp, Homo sapiens
ctgtctgcgtctgctcttctg

SEQ ID NO: 1075147 - DNA, 20 bp, Homo sapiens
ctgtctggaagacgtggctc

SEQ ID NO: 1075148 - DNA, 22 bp, Homo sapiens
ctgtctggctcggacccacccc

SEQ ID NO: 1075149 - DNA, 23 bp, Homo sapiens
ctgtctggctcggacccacccca

SEQ ID NO: 1075150 - DNA, 13 bp, Homo sapiens
ctgtctgggatta

SEQ ID NO: 1075151 - DNA, 20 bp, Homo sapiens
ctgtctggggccccatcagc

SEQ ID NO: 1075152 - DNA, 22 bp, Homo sapiens
ctgtctggggccccatcagctg

SEQ ID NO: 1075153 - DNA, 13 bp, Homo sapiens
ctgtctggggcct

SEQ ID NO: 1075154 - DNA, 19 bp, Homo sapiens
ctgtgaccaccttctgtcc

SEQ ID NO: 1075155 - DNA, 22 bp, Homo sapiens
ctgtgaccaccttctgtcccca

SEQ ID NO: 1075156 - DNA, 23 bp, Homo sapiens
ctgtgaccaggaaggaagtcagc

SEQ ID NO: 1075157 - DNA, 14 bp, Homo sapiens
ctgtgaccctctca

SEQ ID NO: 1075158 - DNA, 22 bp, Homo sapiens
ctgtgacctgccccgcccagct

SEQ ID NO: 1075159 - DNA, 13 bp, Homo sapiens
ctgtgaccttggg

SEQ ID NO: 1075160 - DNA, 18 bp, Homo sapiens
ctgtgacgcagacagagg

SEQ ID NO: 1075161 - DNA, 22 bp, Homo sapiens
ctgtgactaggcatacactgta

SEQ ID NO: 1075162 - DNA, 17 bp, Homo sapiens
ctgtgactctgggcagg

SEQ ID NO: 1075163 - DNA, 19 bp, Homo sapiens
ctgtgactctgggcaggga

SEQ ID NO: 1075164 - DNA, 14 bp, Homo sapiens
ctgtgactcttttt

SEQ ID NO: 1075165 - DNA, 21 bp, Homo sapiens
ctgtgacttctccaggtctca

SEQ ID NO: 1075166 - DNA, 15 bp, Homo sapiens
ctgtgagacccccac

SEQ ID NO: 1075167 - DNA, 19 bp, Homo sapiens
ctgtgagacccccacacct

SEQ ID NO: 1075168 - DNA, 19 bp, Homo sapiens
ctgtgagagttgtctctgt

SEQ ID NO: 1075169 - DNA, 14 bp, Homo sapiens
ctgtgagcccagct

SEQ ID NO: 1075170 - DNA, 21 bp, Homo sapiens
ctgtgaggaatgctctgtgcc

SEQ ID NO: 1075171 - DNA, 13 bp, Homo sapiens
ctgtgaggcaggg

SEQ ID NO: 1075172 - DNA, 18 bp, Homo sapiens
ctgtgaggcaggggcgga

SEQ ID NO: 1075173 - DNA, 15 bp, Homo sapiens
ctgtgaggcccctgg

SEQ ID NO: 1075174 - DNA, 12 bp, Homo sapiens
ctgtgaggctgt

SEQ ID NO: 1075175 - DNA, 15 bp, Homo sapiens
ctgtgaggctgtcct

SEQ ID NO: 1075176 - DNA, 17 bp, Homo sapiens
ctgtgaggctgtcctgt

SEQ ID NO: 1075177 - DNA, 16 bp, Homo sapiens
ctgtgaggggaaggcc

SEQ ID NO: 1075178 - DNA, 14 bp, Homo sapiens
ctgtgagtaggctg

SEQ ID NO: 1075179 - DNA, 19 bp, Homo sapiens
ctgtgagtaggctgggcct

SEQ ID NO: 1075180 - DNA, 20 bp, Homo sapiens
ctgtgagtctccccttgcag

SEQ ID NO: 1075181 - DNA, 22 bp, Homo sapiens
ctgtgctgggtgagctcttcca

SEQ ID NO: 1075182 - DNA, 21 bp, Homo sapiens
ctgtgctggtgtcctgaccac

SEQ ID NO: 1075183 - DNA, 23 bp, Homo sapiens
ctgtgctggtgtcctgaccaccc

SEQ ID NO: 1075184 - DNA, 12 bp, Homo sapiens
ctgtgctgtgcc

SEQ ID NO: 1075185 - DNA, 15 bp, Homo sapiens
ctgtgctgtgcctgc

SEQ ID NO: 1075186 - DNA, 17 bp, Homo sapiens
ctgtgcttcaattaata

SEQ ID NO: 1075187 - DNA, 23 bp, Homo sapiens
ctgtgcttctcttctttattgca

SEQ ID NO: 1075188 - DNA, 17 bp, Homo sapiens
ctgtgcttgaaggccct

SEQ ID NO: 1075189 - DNA, 18 bp, Homo sapiens
ctgtgcttgaaggccctg

SEQ ID NO: 1075190 - DNA, 13 bp, Homo sapiens
ctgtgcttggcca

SEQ ID NO: 1075191 - DNA, 16 bp, Homo sapiens
ctgtgctttgagattt

SEQ ID NO: 1075192 - DNA, 17 bp, Homo sapiens
ctgtgcttttaaatgca

SEQ ID NO: 1075193 - DNA, 16 bp, Homo sapiens
ctgtggaaaagccatc

SEQ ID NO: 1075194 - DNA, 18 bp, Homo sapiens
ctgtggaaaagccatctc

SEQ ID NO: 1075195 - DNA, 14 bp, Homo sapiens
ctgtggaaagctag

SEQ ID NO: 1075196 - DNA, 15 bp, Homo sapiens
ctgtggaaatgccaa

SEQ ID NO: 1075197 - DNA, 18 bp, Homo sapiens
ctgtggaacataaaaagg

SEQ ID NO: 1075198 - DNA, 21 bp, Homo sapiens
ctgtggaacataaaaaggaca

SEQ ID NO: 1075199 - DNA, 20 bp, Homo sapiens
ctgtggaagcatggctgtct

SEQ ID NO: 1075200 - DNA, 19 bp, Homo sapiens
ctgtggaaggcctccctct

SEQ ID NO: 1075201 - DNA, 15 bp, Homo sapiens
ctgtggaatataaat

SEQ ID NO: 1075202 - DNA, 16 bp, Homo sapiens
ctgtggaatataaata

SEQ ID NO: 1075203 - DNA, 13 bp, Homo sapiens
ctgtggactgtcc

SEQ ID NO: 1075204 - DNA, 18 bp, Homo sapiens
ctgtggactgtcctgagg

SEQ ID NO: 1075205 - DNA, 13 bp, Homo sapiens
ctgtggagaaata

SEQ ID NO: 1075206 - DNA, 22 bp, Homo sapiens
ctgtggagagaagtgagcaagg

SEQ ID NO: 1075207 - DNA, 17 bp, Homo sapiens
ctgtggagatggactca

SEQ ID NO: 1075208 - DNA, 19 bp, Homo sapiens
ctgtggagcaaaaggcagc

SEQ ID NO: 1075209 - DNA, 22 bp, Homo sapiens
ctgtggagcaaaaggcagctca

SEQ ID NO: 1075210 - DNA, 22 bp, Homo sapiens
ctgtggagcccgcacccccacc

SEQ ID NO: 1075211 - DNA, 18 bp, Homo sapiens
ctgtggagctgccacaga

SEQ ID NO: 1075212 - DNA, 19 bp, Homo sapiens
ctgtggagctgccacagag

SEQ ID NO: 1075213 - DNA, 15 bp, Homo sapiens
ctgtggaggacagac

SEQ ID NO: 1075214 - DNA, 22 bp, Homo sapiens
ctgtggaggcctgatgctgccc

SEQ ID NO: 1075215 - DNA, 21 bp, Homo sapiens
ctgtggagggagggcagctgg

SEQ ID NO: 1075216 - DNA, 22 bp, Homo sapiens
ctgtggagggagtgttcaaaat

SEQ ID NO: 1075217 - DNA, 16 bp, Homo sapiens
ctgtggagtccagctc

SEQ ID NO: 1075218 - DNA, 16 bp, Homo sapiens
ctgtggagttcctgct

SEQ ID NO: 1075219 - DNA, 18 bp, Homo sapiens
ctgtggatacagtgccca

SEQ ID NO: 1075220 - DNA, 22 bp, Homo sapiens
ctgtggatacagtgcccaccgc

SEQ ID NO: 1075221 - DNA, 15 bp, Homo sapiens
ctgtggatcagagat

SEQ ID NO: 1075222 - DNA, 21 bp, Homo sapiens
ctgtggatgggatcctctcca

SEQ ID NO: 1075223 - DNA, 23 bp, Homo sapiens
ctgtggcacagacttctggaagg

SEQ ID NO: 1075224 - DNA, 13 bp, Homo sapiens
ctgtggcactggc

SEQ ID NO: 1075225 - DNA, 17 bp, Homo sapiens
ctgtggcatctttgcct

SEQ ID NO: 1075226 - DNA, 13 bp, Homo sapiens
ctgtggcatttcc

SEQ ID NO: 1075227 - DNA, 15 bp, Homo sapiens
ctgtggccacagccc

SEQ ID NO: 1075228 - DNA, 14 bp, Homo sapiens
ctgtggccagagct

SEQ ID NO: 1075229 - DNA, 18 bp, Homo sapiens
ctgtggccagagctggaa

SEQ ID NO: 1075230 - DNA, 23 bp, Homo sapiens
ctgtggccagcttgttatttata

SEQ ID NO: 1075231 - DNA, 15 bp, Homo sapiens
ctgtggccaggcctt

SEQ ID NO: 1075232 - DNA, 17 bp, Homo sapiens
ctgtggccatatatgct

SEQ ID NO: 1075233 - DNA, 17 bp, Homo sapiens
ctgtggccccaagaggg

SEQ ID NO: 1075234 - DNA, 17 bp, Homo sapiens
ctgtggccccaccctgg

SEQ ID NO: 1075235 - DNA, 20 bp, Homo sapiens
ctgtggccccaccctgggcc

SEQ ID NO: 1075236 - DNA, 22 bp, Homo sapiens
ctgtggccccatccaaccactg

SEQ ID NO: 1075237 - DNA, 10 bp, Homo sapiens
ctgtggccct

SEQ ID NO: 1075238 - DNA, 11 bp, Homo sapiens
ctgtggccctg

SEQ ID NO: 1075239 - DNA, 14 bp, Homo sapiens
ctgtggccctgccc

SEQ ID NO: 1075240 - DNA, 14 bp, Homo sapiens
ctgtggccctggag

SEQ ID NO: 1075241 - DNA, 22 bp, Homo sapiens
ctgtggccctggccactaaagc

SEQ ID NO: 1075242 - DNA, 15 bp, Homo sapiens
ctgtggccgcacgcc

SEQ ID NO: 1075243 - DNA, 22 bp, Homo sapiens
ctgtggccgcacgcctctccct

SEQ ID NO: 1075244 - DNA, 16 bp, Homo sapiens
ctgtggccgccatctg

SEQ ID NO: 1075245 - DNA, 21 bp, Homo sapiens
ctgtggccgttatctggaagt

SEQ ID NO: 1075246 - DNA, 11 bp, Homo sapiens
ctgtggcctgg

SEQ ID NO: 1075247 - DNA, 14 bp, Homo sapiens
ctgtggcctgtctc

SEQ ID NO: 1075248 - DNA, 21 bp, Homo sapiens
ctgtggcctgtgtccagcagc

SEQ ID NO: 1075249 - DNA, 22 bp, Homo sapiens
ctgtggcctgtgtccagcagct

SEQ ID NO: 1075250 - DNA, 24 bp, Homo sapiens
ctgtggcctgtgtccagcagctgc

SEQ ID NO: 1075251 - DNA, 20 bp, Homo sapiens
ctgtggcctgtgtcccatga

SEQ ID NO: 1075252 - DNA, 22 bp, Homo sapiens
ctgtggcctgtgtcccatgacc

SEQ ID NO: 1075253 - DNA, 19 bp, Homo sapiens
ctgtggcgctgcagcaggg

SEQ ID NO: 1075254 - DNA, 24 bp, Homo sapiens
ctgtggcgctgcagcagggcagga

SEQ ID NO: 1075255 - DNA, 14 bp, Homo sapiens
ctgtggcggtgcct

SEQ ID NO: 1075256 - DNA, 20 bp, Homo sapiens
ctgtggctaaacagatgtaa

SEQ ID NO: 1075257 - DNA, 14 bp, Homo sapiens
ctgtggctggctct

SEQ ID NO: 1075258 - DNA, 15 bp, Homo sapiens
ctgtggctggtgagc

SEQ ID NO: 1075259 - DNA, 16 bp, Homo sapiens
ctgtggcttggagtgg

SEQ ID NO: 1075260 - DNA, 20 bp, Homo sapiens
ctgtggcttggagtggccaa

SEQ ID NO: 1075261 - DNA, 21 bp, Homo sapiens
ctgtggctttttgttcagaat

SEQ ID NO: 1075262 - DNA, 18 bp, Homo sapiens
ctgtgggaaggccagctg

SEQ ID NO: 1075263 - DNA, 12 bp, Homo sapiens
ctgtgggaccgc

SEQ ID NO: 1075264 - DNA, 15 bp, Homo sapiens
ctgtgggaccgcctg

SEQ ID NO: 1075265 - DNA, 18 bp, Homo sapiens
ctgtgggaccgcctggcc

SEQ ID NO: 1075266 - DNA, 20 bp, Homo sapiens
ctgtgggaccgcctggccct

SEQ ID NO: 1075267 - DNA, 23 bp, Homo sapiens
ctgtgggaccgcctggccctccc

SEQ ID NO: 1075268 - DNA, 13 bp, Homo sapiens
ctgtgggaggggg

SEQ ID NO: 1075269 - DNA, 17 bp, Homo sapiens
ctgtgggcactggtggg

SEQ ID NO: 1075270 - DNA, 13 bp, Homo sapiens
ctgtgggcagcac

SEQ ID NO: 1075271 - DNA, 15 bp, Homo sapiens
ctgtgggcagcaccc

SEQ ID NO: 1075272 - DNA, 23 bp, Homo sapiens
ctgtgggcagcaccctcccccgc

SEQ ID NO: 1075273 - DNA, 16 bp, Homo sapiens
ctgtgggcagcatgcc

SEQ ID NO: 1075274 - DNA, 17 bp, Homo sapiens
ctgtgggcatggccgct

SEQ ID NO: 1075275 - DNA, 19 bp, Homo sapiens
ctgtgggcctcaaggactt

SEQ ID NO: 1075276 - DNA, 17 bp, Homo sapiens
ctgtgggcctcacctgc

SEQ ID NO: 1075277 - DNA, 15 bp, Homo sapiens
ctgtgggcttcccca

SEQ ID NO: 1075278 - DNA, 18 bp, Homo sapiens
ctgtgggcttggccttgt

SEQ ID NO: 1075279 - DNA, 19 bp, Homo sapiens
ctgtgggcttggccttgtg

SEQ ID NO: 1075280 - DNA, 14 bp, Homo sapiens
ctgtggggaaaggg

SEQ ID NO: 1075281 - DNA, 14 bp, Homo sapiens
cttaatctaaatgg

SEQ ID NO: 1075282 - DNA, 14 bp, Homo sapiens
cttaatctaagaaa

SEQ ID NO: 1075283 - DNA, 20 bp, Homo sapiens
cttaatctaagaaacaaagt

SEQ ID NO: 1075284 - DNA, 18 bp, Homo sapiens
cttaatgacattcccctc

SEQ ID NO: 1075285 - DNA, 19 bp, Homo sapiens
cttaatgagactttaaaag

SEQ ID NO: 1075286 - DNA, 12 bp, Homo sapiens
cttaatgagata

SEQ ID NO: 1075287 - DNA, 24 bp, Homo sapiens
cttaatggtaggtcaagtaataaa

SEQ ID NO: 1075288 - DNA, 19 bp, Homo sapiens
cttaatggtatcctactga

SEQ ID NO: 1075289 - DNA, 23 bp, Homo sapiens
cttaatggtatcctactgagcat

SEQ ID NO: 1075290 - DNA, 21 bp, Homo sapiens
cttaatgtatgttaccaaaaa

SEQ ID NO: 1075291 - DNA, 20 bp, Homo sapiens
cttaatgtgattactgctct

SEQ ID NO: 1075292 - DNA, 17 bp, Homo sapiens
cttaattattataaaaa

SEQ ID NO: 1075293 - DNA, 19 bp, Homo sapiens
cttaattattataaaaata

SEQ ID NO: 1075294 - DNA, 21 bp, Homo sapiens
cttaattattataaaaatatt

SEQ ID NO: 1075295 - DNA, 19 bp, Homo sapiens
cttaattctttgttctgtt

SEQ ID NO: 1075296 - DNA, 17 bp, Homo sapiens
cttaattgccagcaaat

SEQ ID NO: 1075297 - DNA, 18 bp, Homo sapiens
cttaattgccagcaaata

SEQ ID NO: 1075298 - DNA, 16 bp, Homo sapiens
cttaattgttcatttt

SEQ ID NO: 1075299 - DNA, 19 bp, Homo sapiens
cttaattgttcattttgag

SEQ ID NO: 1075300 - DNA, 18 bp, Homo sapiens
cttaatttaattgctttg

SEQ ID NO: 1075301 - DNA, 17 bp, Homo sapiens
cttaatttccttctgtt

SEQ ID NO: 1075302 - DNA, 23 bp, Homo sapiens
cttaatttctgcctttcccccct

SEQ ID NO: 1075303 - DNA, 15 bp, Homo sapiens
cttaatttgcacagt

SEQ ID NO: 1075304 - DNA, 22 bp, Homo sapiens
cttaatttggataataaaaatt

SEQ ID NO: 1075305 - DNA, 16 bp, Homo sapiens
cttaatttgtaaactt

SEQ ID NO: 1075306 - DNA, 20 bp, Homo sapiens
cttaatttgtaaacttctga

SEQ ID NO: 1075307 - DNA, 20 bp, Homo sapiens
cttaatttttttttcataga

SEQ ID NO: 1075308 - DNA, 14 bp, Homo sapiens
cttacaaaaacact

SEQ ID NO: 1075309 - DNA, 15 bp, Homo sapiens
cttacaaaaacactt

SEQ ID NO: 1075310 - DNA, 11 bp, Homo sapiens
cttacaaaatc

SEQ ID NO: 1075311 - DNA, 16 bp, Homo sapiens
cttacaagaaaggcct

SEQ ID NO: 1075312 - DNA, 18 bp, Homo sapiens
cttacaagaaaggcctga

SEQ ID NO: 1075313 - DNA, 17 bp, Homo sapiens
cttacaagcttaaagct

SEQ ID NO: 1075314 - DNA, 18 bp, Homo sapiens
cttacaaggccctttcct

SEQ ID NO: 1075315 - DNA, 22 bp, Homo sapiens
cttacaagtggtgaccaaaatt

SEQ ID NO: 1075316 - DNA, 14 bp, Homo sapiens
cttacaatcaaatc

SEQ ID NO: 1075317 - DNA, 17 bp, Homo sapiens
cttacaatcaaatctcc

SEQ ID NO: 1075318 - DNA, 14 bp, Homo sapiens
cttacaatgtaaac

SEQ ID NO: 1075319 - DNA, 19 bp, Homo sapiens
cttacaattccctgctgtc

SEQ ID NO: 1075320 - DNA, 20 bp, Homo sapiens
cttacaattgcactgctgtt

SEQ ID NO: 1075321 - DNA, 12 bp, Homo sapiens
cttacacttctt

SEQ ID NO: 1075322 - DNA, 23 bp, Homo sapiens
cttacacttggagcccgtgcagt

SEQ ID NO: 1075323 - DNA, 13 bp, Homo sapiens
cttacagaaatga

SEQ ID NO: 1075324 - DNA, 15 bp, Homo sapiens
cttacagcctctgac

SEQ ID NO: 1075325 - DNA, 23 bp, Homo sapiens
cttacaggggggtcggaagcctg

SEQ ID NO: 1075326 - DNA, 15 bp, Homo sapiens
cttacagtaactaat

SEQ ID NO: 1075327 - DNA, 23 bp, Homo sapiens
cttacagtaggagcccagctctg

SEQ ID NO: 1075328 - DNA, 15 bp, Homo sapiens
cttacagtgtgataa

SEQ ID NO: 1075329 - DNA, 19 bp, Homo sapiens
cttacataaagctcccttg

SEQ ID NO: 1075330 - DNA, 16 bp, Homo sapiens
cttacataatttttta

SEQ ID NO: 1075331 - DNA, 16 bp, Homo sapiens
cttacatctgtaaaga

SEQ ID NO: 1075332 - DNA, 16 bp, Homo sapiens
cttacatcttctgtga

SEQ ID NO: 1075333 - DNA, 16 bp, Homo sapiens
cttacatcttttctaa

SEQ ID NO: 1075334 - DNA, 14 bp, Homo sapiens
cttacatgcatttg

SEQ ID NO: 1075335 - DNA, 20 bp, Homo sapiens
cttacatgtgtaaaggtttc

SEQ ID NO: 1075336 - DNA, 14 bp, Homo sapiens
cttacatgttttct

SEQ ID NO: 1075337 - DNA, 20 bp, Homo sapiens
cttacattagcagtttgctt

SEQ ID NO: 1075338 - DNA, 21 bp, Homo sapiens
cttacattagcagtttgcttt

SEQ ID NO: 1075339 - DNA, 15 bp, Homo sapiens
cttacattgtgaaac

SEQ ID NO: 1075340 - DNA, 22 bp, Homo sapiens
cttacatttacaaactgaagag

SEQ ID NO: 1075341 - DNA, 11 bp, Homo sapiens
cttacatttca

SEQ ID NO: 1075342 - DNA, 22 bp, Homo sapiens
cttacatttcagacatatccaa

SEQ ID NO: 1075343 - DNA, 22 bp, Homo sapiens
cttacattttcgtcctgtagca

SEQ ID NO: 1075344 - DNA, 23 bp, Homo sapiens
cttaccaagttgtgcttttctgt

SEQ ID NO: 1075345 - DNA, 13 bp, Homo sapiens
cttaccagaagct

SEQ ID NO: 1075346 - DNA, 19 bp, Homo sapiens
cttaccattaacatttttt

SEQ ID NO: 1075347 - DNA, 20 bp, Homo sapiens
cttacccgaaagcatcactg

SEQ ID NO: 1075348 - DNA, 22 bp, Homo sapiens
cttacccgaaagcatcactgcc

SEQ ID NO: 1075349 - DNA, 16 bp, Homo sapiens
cttaccctcctctgct

SEQ ID NO: 1075350 - DNA, 18 bp, Homo sapiens
cttaccctcctctgctgg

SEQ ID NO: 1075351 - DNA, 20 bp, Homo sapiens
cttaccctcctctgctggga

SEQ ID NO: 1075352 - DNA, 15 bp, Homo sapiens
cttaccgtagcctcc

SEQ ID NO: 1075353 - DNA, 16 bp, Homo sapiens
cttaccgtagcctccg

SEQ ID NO: 1075354 - DNA, 18 bp, Homo sapiens
cttacctaacttgaacat

SEQ ID NO: 1075355 - DNA, 13 bp, Homo sapiens
cttacctcctgcc

SEQ ID NO: 1075356 - DNA, 16 bp, Homo sapiens
cttacctcctgcccag

SEQ ID NO: 1075357 - DNA, 20 bp, Homo sapiens
cttacctcctgcccaggaga

SEQ ID NO: 1075358 - DNA, 18 bp, Homo sapiens
cttacctcggggagaggg

SEQ ID NO: 1075359 - DNA, 21 bp, Homo sapiens
cttacctcggggagaggggga

SEQ ID NO: 1075360 - DNA, 17 bp, Homo sapiens
cttacctctcatgcgtg

SEQ ID NO: 1075361 - DNA, 13 bp, Homo sapiens
cttacctctctgg

SEQ ID NO: 1075362 - DNA, 14 bp, Homo sapiens
cttacctctggaac

SEQ ID NO: 1075363 - DNA, 17 bp, Homo sapiens
cttacctgacctcttgc

SEQ ID NO: 1075364 - DNA, 19 bp, Homo sapiens
cttacctgacctcttgctg

SEQ ID NO: 1075365 - DNA, 21 bp, Homo sapiens
cttacctgacctcttgctgtc

SEQ ID NO: 1075366 - DNA, 19 bp, Homo sapiens
cttacctgttcagtactct

SEQ ID NO: 1075367 - DNA, 15 bp, Homo sapiens
cttaccttctgctgt

SEQ ID NO: 1075368 - DNA, 23 bp, Homo sapiens
cttacgaatacttttgccctttg

SEQ ID NO: 1075369 - DNA, 14 bp, Homo sapiens
cttacgtaaaacat

SEQ ID NO: 1075370 - DNA, 21 bp, Homo sapiens
cttactaaaaagtataaaata

SEQ ID NO: 1075371 - DNA, 23 bp, Homo sapiens
cttactaagctttgccagctgct

SEQ ID NO: 1075372 - DNA, 12 bp, Homo sapiens
cttactatttaa

SEQ ID NO: 1075373 - DNA, 13 bp, Homo sapiens
cttactatttctg

SEQ ID NO: 1075374 - DNA, 24 bp, Homo sapiens
cttactcccccaccactcaggcca

SEQ ID NO: 1075375 - DNA, 22 bp, Homo sapiens
cttactcctcctctttctctcc

SEQ ID NO: 1075376 - DNA, 13 bp, Homo sapiens
cttactctgagcc

SEQ ID NO: 1075377 - DNA, 16 bp, Homo sapiens
cttactctgagcccag

SEQ ID NO: 1075378 - DNA, 18 bp, Homo sapiens
cttactctgagcccaggc

SEQ ID NO: 1075379 - DNA, 21 bp, Homo sapiens
cttactctgagcccaggccgt

SEQ ID NO: 1075380 - DNA, 22 bp, Homo sapiens
cttactctgagcccaggccgtt

SEQ ID NO: 1075381 - DNA, 17 bp, Homo sapiens
cttactctgtccattta

SEQ ID NO: 1075382 - DNA, 24 bp, Homo sapiens
cttactctgtctcccaggctgctg

SEQ ID NO: 1075383 - DNA, 15 bp, Homo sapiens
cttactctttcctat

SEQ ID NO: 1075384 - DNA, 16 bp, Homo sapiens
cttactctttcctatt

SEQ ID NO: 1075385 - DNA, 12 bp, Homo sapiens
cttactgatata

SEQ ID NO: 1075386 - DNA, 21 bp, Homo sapiens
cttactgatatattttacaat

SEQ ID NO: 1075387 - DNA, 14 bp, Homo sapiens
cttactgatattat

SEQ ID NO: 1075388 - DNA, 15 bp, Homo sapiens
cttactgatgatgtg

SEQ ID NO: 1075389 - DNA, 19 bp, Homo sapiens
cttactgggccctggggaa

SEQ ID NO: 1075390 - DNA, 19 bp, Homo sapiens
cttactgggtgaggaaatc

SEQ ID NO: 1075391 - DNA, 17 bp, Homo sapiens
cttactgtagcctcaga

SEQ ID NO: 1075392 - DNA, 13 bp, Homo sapiens
cttactgtatatg

SEQ ID NO: 1075393 - DNA, 17 bp, Homo sapiens
cttactgtccaccagtt

SEQ ID NO: 1075394 - DNA, 18 bp, Homo sapiens
cttactgtccaccagttt

SEQ ID NO: 1075395 - DNA, 21 bp, Homo sapiens
cttactgtccaccagtttata

SEQ ID NO: 1075396 - DNA, 21 bp, Homo sapiens
cttactttgcttgagaatcct

SEQ ID NO: 1075397 - DNA, 22 bp, Homo sapiens
cttacttttccagtctgtacag

SEQ ID NO: 1075398 - DNA, 17 bp, Homo sapiens
cttactttttaattttt

SEQ ID NO: 1075399 - DNA, 15 bp, Homo sapiens
cttagaaaattaaaa

SEQ ID NO: 1075400 - DNA, 15 bp, Homo sapiens
cttagaaaattcaag

SEQ ID NO: 1075401 - DNA, 20 bp, Homo sapiens
cttagaaatcattgtagaaa

SEQ ID NO: 1075402 - DNA, 23 bp, Homo sapiens
cttagaaatcattgtagaaacac

SEQ ID NO: 1075403 - DNA, 16 bp, Homo sapiens
cttagaaattgcattt

SEQ ID NO: 1075404 - DNA, 20 bp, Homo sapiens
cttagaacagtggaaactat

SEQ ID NO: 1075405 - DNA, 19 bp, Homo sapiens
cttagaacattttaattca

SEQ ID NO: 1075406 - DNA, 18 bp, Homo sapiens
cttagaagaaattaatat

SEQ ID NO: 1075407 - DNA, 17 bp, Homo sapiens
cttagaagaatattgta

SEQ ID NO: 1075408 - DNA, 16 bp, Homo sapiens
cttagaagagagccag

SEQ ID NO: 1075409 - DNA, 18 bp, Homo sapiens
cttagaagccatgggacc

SEQ ID NO: 1075410 - DNA, 22 bp, Homo sapiens
cttagaagccatgggacctcct

SEQ ID NO: 1075411 - DNA, 12 bp, Homo sapiens
cttagaatccaa

SEQ ID NO: 1075412 - DNA, 13 bp, Homo sapiens
cttagaatgccat

SEQ ID NO: 1075413 - DNA, 14 bp, Homo sapiens
cttagacctcagcc

SEQ ID NO: 1075414 - DNA, 15 bp, Homo sapiens
cttagacctcagcct

SEQ ID NO: 1075415 - DNA, 18 bp, Homo sapiens
cttagacctcagcctgtg

SEQ ID NO: 1075416 - DNA, 20 bp, Homo sapiens
cttagacctcagcctgtgct

SEQ ID NO: 1075417 - DNA, 22 bp, Homo sapiens
cttagacctcctaaatgcccca

SEQ ID NO: 1075418 - DNA, 15 bp, Homo sapiens
cttagactccttctc

SEQ ID NO: 1075419 - DNA, 18 bp, Homo sapiens
cttagactctagtattta

SEQ ID NO: 1075420 - DNA, 21 bp, Homo sapiens
cttagactctagtatttatgg

SEQ ID NO: 1075421 - DNA, 20 bp, Homo sapiens
cttagacttcgactcaggat

SEQ ID NO: 1075422 - DNA, 19 bp, Homo sapiens
cttagagcaacctctgtat

SEQ ID NO: 1075423 - DNA, 19 bp, Homo sapiens
cttagagccaagtgtcttt

SEQ ID NO: 1075424 - DNA, 22 bp, Homo sapiens
cttagagccttttatctgcaga

SEQ ID NO: 1075425 - DNA, 14 bp, Homo sapiens
cttagagtgcccag

SEQ ID NO: 1075426 - DNA, 15 bp, Homo sapiens
cttagagtgcccagc

SEQ ID NO: 1075427 - DNA, 17 bp, Homo sapiens
cttagagtgcccagcag

SEQ ID NO: 1075428 - DNA, 18 bp, Homo sapiens
cttagagtgtagctgtaa

SEQ ID NO: 1075429 - DNA, 15 bp, Homo sapiens
cttagagttcttctt

SEQ ID NO: 1075430 - DNA, 18 bp, Homo sapiens
cttagagtttctgtttga

SEQ ID NO: 1075431 - DNA, 22 bp, Homo sapiens
cttagagtttctgtttgattct

SEQ ID NO: 1075432 - DNA, 23 bp, Homo sapiens
cttagagtttctgtttgattctt

SEQ ID NO: 1075433 - DNA, 17 bp, Homo sapiens
cttagataatatttctg

SEQ ID NO: 1075434 - DNA, 20 bp, Homo sapiens
cttagatattaaaatttggt

SEQ ID NO: 1075435 - DNA, 21 bp, Homo sapiens
cttagatccaaggcagggaaa

SEQ ID NO: 1075436 - DNA, 18 bp, Homo sapiens
cttagatctctcctgcaa

SEQ ID NO: 1075437 - DNA, 18 bp, Homo sapiens
cttagatgttaaatgtta

SEQ ID NO: 1075438 - DNA, 20 bp, Homo sapiens
cttagatgttccagtaatct

SEQ ID NO: 1075439 - DNA, 14 bp, Homo sapiens
cttagatgttctaa

SEQ ID NO: 1075440 - DNA, 20 bp, Homo sapiens
cttagattaagattttactt

SEQ ID NO: 1075441 - DNA, 17 bp, Homo sapiens
cttagattagctctgga

SEQ ID NO: 1075442 - DNA, 20 bp, Homo sapiens
cttagattagctctggacca

SEQ ID NO: 1075443 - DNA, 22 bp, Homo sapiens
cttagattgtgttcctgaagaa

SEQ ID NO: 1075444 - DNA, 13 bp, Homo sapiens
cttagcacagaga

SEQ ID NO: 1075445 - DNA, 14 bp, Homo sapiens
cttagcacagagag

SEQ ID NO: 1075446 - DNA, 17 bp, Homo sapiens
cttagcacagagaggga

SEQ ID NO: 1075447 - DNA, 20 bp, Homo sapiens
cttagcacagagagggacac

SEQ ID NO: 1075448 - DNA, 17 bp, Homo sapiens
cttagcaccttcagggc

SEQ ID NO: 1075449 - DNA, 15 bp, Homo sapiens
cttagcagcttccag

SEQ ID NO: 1075450 - DNA, 17 bp, Homo sapiens
cttagcagcttccagat

SEQ ID NO: 1075451 - DNA, 12 bp, Homo sapiens
cttagcatgtga

SEQ ID NO: 1075452 - DNA, 20 bp, Homo sapiens
cttagccagttcaaagtgta

SEQ ID NO: 1075453 - DNA, 18 bp, Homo sapiens
cttagccgcaccctgcac

SEQ ID NO: 1075454 - DNA, 20 bp, Homo sapiens
cttagccgtccatggcacca

SEQ ID NO: 1075455 - DNA, 15 bp, Homo sapiens
cttagcctccctgaa

SEQ ID NO: 1075456 - DNA, 12 bp, Homo sapiens
cttagcctctcc

SEQ ID NO: 1075457 - DNA, 20 bp, Homo sapiens
cttagcctcttggaaatcag

SEQ ID NO: 1075458 - DNA, 22 bp, Homo sapiens
cttagcctcttggaaatcaggt

SEQ ID NO: 1075459 - DNA, 10 bp, Homo sapiens
cttagcctgc

SEQ ID NO: 1075460 - DNA, 13 bp, Homo sapiens
cttagcctgcctc

SEQ ID NO: 1075461 - DNA, 16 bp, Homo sapiens
cttagccttgtgccct

SEQ ID NO: 1075462 - DNA, 18 bp, Homo sapiens
cttagcgctctggacaga

SEQ ID NO: 1075463 - DNA, 17 bp, Homo sapiens
cttagcgtcaagacatt

SEQ ID NO: 1075464 - DNA, 23 bp, Homo sapiens
cttagcgtcaagacatttgctga

SEQ ID NO: 1075465 - DNA, 18 bp, Homo sapiens
cttagcgttctggactct

SEQ ID NO: 1075466 - DNA, 13 bp, Homo sapiens
cttagctatttat

SEQ ID NO: 1075467 - DNA, 12 bp, Homo sapiens
cttagctcaggt

SEQ ID NO: 1075468 - DNA, 22 bp, Homo sapiens
cttagctggatataatgtattt

SEQ ID NO: 1075469 - DNA, 13 bp, Homo sapiens
cttagctgtacta

SEQ ID NO: 1075470 - DNA, 18 bp, Homo sapiens
cttagctgtactataagt

SEQ ID NO: 1075471 - DNA, 15 bp, Homo sapiens
cttagcttacaggaa

SEQ ID NO: 1075472 - DNA, 17 bp, Homo sapiens
cttagcttacaggaagc

SEQ ID NO: 1075473 - DNA, 17 bp, Homo sapiens
cttagcttagacctcag

SEQ ID NO: 1075474 - DNA, 19 bp, Homo sapiens
cttagcttagacctcagcc

SEQ ID NO: 1075475 - DNA, 21 bp, Homo sapiens
cttagcttagacctcagcctg

SEQ ID NO: 1075476 - DNA, 19 bp, Homo sapiens
cttagcttattgatcccac

SEQ ID NO: 1075477 - DNA, 21 bp, Homo sapiens
cttagcttattgatcccacat

SEQ ID NO: 1075478 - DNA, 23 bp, Homo sapiens
cttaggaaccttctcccttcttg

SEQ ID NO: 1075479 - DNA, 22 bp, Homo sapiens
cttaggagacagatcactcctg

SEQ ID NO: 1075480 - DNA, 19 bp, Homo sapiens
cttaggagcaagaagaaaa

SEQ ID NO: 1075481 - DNA, 21 bp, Homo sapiens
cttaggatggggctcccagct

SEQ ID NO: 1075482 - DNA, 14 bp, Homo sapiens
cttaggatgtgtgc

SEQ ID NO: 1075483 - DNA, 13 bp, Homo sapiens
cttaggattctaa

SEQ ID NO: 1075484 - DNA, 21 bp, Homo sapiens
cttaggcactgagggatctga

SEQ ID NO: 1075485 - DNA, 13 bp, Homo sapiens
cttaggcatgtgc

SEQ ID NO: 1075486 - DNA, 22 bp, Homo sapiens
cttaggcattatttaatgtttg

SEQ ID NO: 1075487 - DNA, 12 bp, Homo sapiens
cttaggccttcc

SEQ ID NO: 1075488 - DNA, 15 bp, Homo sapiens
cttaggccttcctct

SEQ ID NO: 1075489 - DNA, 22 bp, Homo sapiens
cttagggaaagatgtagaaaga

SEQ ID NO: 1075490 - DNA, 15 bp, Homo sapiens
cttagggaagaaaaa

SEQ ID NO: 1075491 - DNA, 13 bp, Homo sapiens
cttagggaagctg

SEQ ID NO: 1075492 - DNA, 22 bp, Homo sapiens
cttagggaagttgtctccttcc

SEQ ID NO: 1075493 - DNA, 20 bp, Homo sapiens
cttagggacaggaccccagc

SEQ ID NO: 1075494 - DNA, 15 bp, Homo sapiens
cttagggcaccaggg

SEQ ID NO: 1075495 - DNA, 14 bp, Homo sapiens
cttagggccctgga

SEQ ID NO: 1075496 - DNA, 16 bp, Homo sapiens
cttagggccctggagg

SEQ ID NO: 1075497 - DNA, 18 bp, Homo sapiens
cttagggccctggaggcg

SEQ ID NO: 1075498 - DNA, 21 bp, Homo sapiens
cttagggtggctttaattgta

SEQ ID NO: 1075499 - DNA, 19 bp, Homo sapiens
cttaggtttttaggagtct

SEQ ID NO: 1075500 - DNA, 13 bp, Homo sapiens
cttagtaatagca

SEQ ID NO: 1075501 - DNA, 17 bp, Homo sapiens
cttagtagtttttacaa

SEQ ID NO: 1075502 - DNA, 13 bp, Homo sapiens
cttagtatgcagt

SEQ ID NO: 1075503 - DNA, 17 bp, Homo sapiens
cttagtatggttctcag

SEQ ID NO: 1075504 - DNA, 15 bp, Homo sapiens
cttagtcactgcctg

SEQ ID NO: 1075505 - DNA, 17 bp, Homo sapiens
cttagtcactgcctgca

SEQ ID NO: 1075506 - DNA, 23 bp, Homo sapiens
cttagtcactgcctgcagaggtc

SEQ ID NO: 1075507 - DNA, 13 bp, Homo sapiens
cttagtcccaagc

SEQ ID NO: 1075508 - DNA, 15 bp, Homo sapiens
cttagtcccaagcta

SEQ ID NO: 1075509 - DNA, 12 bp, Homo sapiens
cttagtccccca

SEQ ID NO: 1075510 - DNA, 23 bp, Homo sapiens
cttagtcgaatgttagattcctc

SEQ ID NO: 1075511 - DNA, 15 bp, Homo sapiens
cttagtctaggtcct

SEQ ID NO: 1075512 - DNA, 21 bp, Homo sapiens
cttagtctaggtccttgttgt

SEQ ID NO: 1075513 - DNA, 13 bp, Homo sapiens
cttagtctcagtt

SEQ ID NO: 1075514 - DNA, 18 bp, Homo sapiens
cttagtctcagtttgtgt

SEQ ID NO: 1075515 - DNA, 19 bp, Homo sapiens
cttagtctcagtttgtgtg

SEQ ID NO: 1075516 - DNA, 20 bp, Homo sapiens
cttagtctcagtttgtgtgt

SEQ ID NO: 1075517 - DNA, 20 bp, Homo sapiens
cttagtcttctcatagcatt

SEQ ID NO: 1075518 - DNA, 19 bp, Homo sapiens
cttagtgatcatttaaaaa

SEQ ID NO: 1075519 - DNA, 16 bp, Homo sapiens
cttagtgcaaaaaaca

SEQ ID NO: 1075520 - DNA, 18 bp, Homo sapiens
cttagtgcaaaaaacata

SEQ ID NO: 1075521 - DNA, 21 bp, Homo sapiens
cttagtgcccgcctaggagtt

SEQ ID NO: 1075522 - DNA, 19 bp, Homo sapiens
cttagtgcggacaagtttt

SEQ ID NO: 1075523 - DNA, 22 bp, Homo sapiens
cttagtgcggacaagttttaat

SEQ ID NO: 1075524 - DNA, 20 bp, Homo sapiens
cttagtgcttcagagtttgt

SEQ ID NO: 1075525 - DNA, 13 bp, Homo sapiens
cttagtgggccag

SEQ ID NO: 1075526 - DNA, 21 bp, Homo sapiens
cttagtgggccagggctgccc

SEQ ID NO: 1075527 - DNA, 21 bp, Homo sapiens
cttagtgttcaaaacaaaatg

SEQ ID NO: 1075528 - DNA, 12 bp, Homo sapiens
cttagttaaaaa

SEQ ID NO: 1075529 - DNA, 18 bp, Homo sapiens
cttataccttctgacagc

SEQ ID NO: 1075530 - DNA, 15 bp, Homo sapiens
cttatactgtacaat

SEQ ID NO: 1075531 - DNA, 19 bp, Homo sapiens
cttatactgtacaataaaa

SEQ ID NO: 1075532 - DNA, 17 bp, Homo sapiens
cttatagaataaaagct

SEQ ID NO: 1075533 - DNA, 21 bp, Homo sapiens
cttatagaataaaagctataa

SEQ ID NO: 1075534 - DNA, 13 bp, Homo sapiens
cttatagaatatt

SEQ ID NO: 1075535 - DNA, 20 bp, Homo sapiens
cttatagaatatttattacc

SEQ ID NO: 1075536 - DNA, 14 bp, Homo sapiens
cttataggtgttgg

SEQ ID NO: 1075537 - DNA, 13 bp, Homo sapiens
cttatagtacatg

SEQ ID NO: 1075538 - DNA, 17 bp, Homo sapiens
cttatagtacatgataa

SEQ ID NO: 1075539 - DNA, 19 bp, Homo sapiens
cttatagttaatattttgt

SEQ ID NO: 1075540 - DNA, 14 bp, Homo sapiens
cttatagttactgt

SEQ ID NO: 1075541 - DNA, 23 bp, Homo sapiens
cttatatatgcacttaatttgtt

SEQ ID NO: 1075542 - DNA, 22 bp, Homo sapiens
cttatatctggcctctgctttc

SEQ ID NO: 1075543 - DNA, 20 bp, Homo sapiens
cttatattaatagtaatttg

SEQ ID NO: 1075544 - DNA, 23 bp, Homo sapiens
cttatattgaagacaatttgata

SEQ ID NO: 1075545 - DNA, 22 bp, Homo sapiens
cttatatttctgtgtacacatc

SEQ ID NO: 1075546 - DNA, 16 bp, Homo sapiens
cttatattttatgaac

SEQ ID NO: 1075547 - DNA, 22 bp, Homo sapiens
cttatattttatgaacattgta

SEQ ID NO: 1075548 - DNA, 12 bp, Homo sapiens
cttatcaagtgt

SEQ ID NO: 1075549 - DNA, 19 bp, Homo sapiens
cttatcaagtgtcttccat

SEQ ID NO: 1075550 - DNA, 12 bp, Homo sapiens
cttatcagagct

SEQ ID NO: 1075551 - DNA, 15 bp, Homo sapiens
cttatcattcattct

SEQ ID NO: 1075552 - DNA, 15 bp, Homo sapiens
cttatccaggactct

SEQ ID NO: 1075553 - DNA, 19 bp, Homo sapiens
cttatccaggactctgtca

SEQ ID NO: 1075554 - DNA, 18 bp, Homo sapiens
cttatcctacagtacaat

SEQ ID NO: 1075555 - DNA, 22 bp, Homo sapiens
cttatcctctctctcttctagg

SEQ ID NO: 1075556 - DNA, 23 bp, Homo sapiens
cttatcctctctctcttctaggc

SEQ ID NO: 1075557 - DNA, 14 bp, Homo sapiens
cttatcctctgatc

SEQ ID NO: 1075558 - DNA, 18 bp, Homo sapiens
cttatcctctgatctcca

SEQ ID NO: 1075559 - DNA, 23 bp, Homo sapiens
cttatcctgctagcaggccccct

SEQ ID NO: 1075560 - DNA, 22 bp, Homo sapiens
cttatccttgggccataattat

SEQ ID NO: 1075561 - DNA, 13 bp, Homo sapiens
cttatctccaaga

SEQ ID NO: 1075562 - DNA, 16 bp, Homo sapiens
cttatctccaagacca

SEQ ID NO: 1075563 - DNA, 12 bp, Homo sapiens
cttatctctttt

SEQ ID NO: 1075564 - DNA, 19 bp, Homo sapiens
cttatctgtgcgtgaaaca

SEQ ID NO: 1075565 - DNA, 22 bp, Homo sapiens
cttatctttctaaaactgcctt

SEQ ID NO: 1075566 - DNA, 21 bp, Homo sapiens
cttatgaaatctcacagatgt

SEQ ID NO: 1075567 - DNA, 13 bp, Homo sapiens
cttatgagaaact

SEQ ID NO: 1075568 - DNA, 14 bp, Homo sapiens
cttatgaggagggg

SEQ ID NO: 1075569 - DNA, 22 bp, Homo sapiens
cttatgatgttttcccttaact

SEQ ID NO: 1075570 - DNA, 20 bp, Homo sapiens
cttatgattaaacttccttc

SEQ ID NO: 1075571 - DNA, 15 bp, Homo sapiens
cttatgattttatta

SEQ ID NO: 1075572 - DNA, 17 bp, Homo sapiens
cttatgattttattaca

SEQ ID NO: 1075573 - DNA, 14 bp, Homo sapiens
cttatgccacggga

SEQ ID NO: 1075574 - DNA, 18 bp, Homo sapiens
cttatgcggttaattttg

SEQ ID NO: 1075575 - DNA, 21 bp, Homo sapiens
cttatgctacacagacattaa

SEQ ID NO: 1075576 - DNA, 16 bp, Homo sapiens
cttatgctgctgtgaa

SEQ ID NO: 1075577 - DNA, 14 bp, Homo sapiens
cttatggaattgat

SEQ ID NO: 1075578 - DNA, 16 bp, Homo sapiens
cttatggaattgattt

SEQ ID NO: 1075579 - DNA, 18 bp, Homo sapiens
cttatgggatccttgtct

SEQ ID NO: 1075580 - DNA, 21 bp, Homo sapiens
cttatgggtccccctcagcaa

SEQ ID NO: 1075581 - DNA, 15 bp, Homo sapiens
cttatgggtggcttt

SEQ ID NO: 1075582 - DNA, 17 bp, Homo sapiens
cttatgggtggctttca

SEQ ID NO: 1075583 - DNA, 20 bp, Homo sapiens
cttatgtaaagtatgttttt

SEQ ID NO: 1075584 - DNA, 15 bp, Homo sapiens
cttatgtacagaaaa

SEQ ID NO: 1075585 - DNA, 14 bp, Homo sapiens
cttatgtgaaaaat

SEQ ID NO: 1075586 - DNA, 16 bp, Homo sapiens
cttatgtgaaaaatta

SEQ ID NO: 1075587 - DNA, 19 bp, Homo sapiens
cttatgtgaaaaattaact

SEQ ID NO: 1075588 - DNA, 13 bp, Homo sapiens
cttatgtgttaca

SEQ ID NO: 1075589 - DNA, 14 bp, Homo sapiens
cttatgtgttacat

SEQ ID NO: 1075590 - DNA, 15 bp, Homo sapiens
cttatgtgttacatt

SEQ ID NO: 1075591 - DNA, 21 bp, Homo sapiens
cttatgtgttacattattcca

SEQ ID NO: 1075592 - DNA, 19 bp, Homo sapiens
cttatgttaatagtaattc

SEQ ID NO: 1075593 - DNA, 13 bp, Homo sapiens
cttattaaaaaat

SEQ ID NO: 1075594 - DNA, 17 bp, Homo sapiens
cttattagagtgtcttt

SEQ ID NO: 1075595 - DNA, 18 bp, Homo sapiens
cttattaggataatacat

SEQ ID NO: 1075596 - DNA, 14 bp, Homo sapiens
cttattataaaatg

SEQ ID NO: 1075597 - DNA, 14 bp, Homo sapiens
cttattatcccagc

SEQ ID NO: 1075598 - DNA, 21 bp, Homo sapiens
cttattattaataatgaagta

SEQ ID NO: 1075599 - DNA, 17 bp, Homo sapiens
cttattcaaagagaaaa

SEQ ID NO: 1075600 - DNA, 16 bp, Homo sapiens
cttattccaggagaag

SEQ ID NO: 1075601 - DNA, 20 bp, Homo sapiens
cttattcccaaactacagaa

SEQ ID NO: 1075602 - DNA, 21 bp, Homo sapiens
cttattccgagaatgccgagg

SEQ ID NO: 1075603 - DNA, 20 bp, Homo sapiens
cttattccgagcattccagt

SEQ ID NO: 1075604 - DNA, 15 bp, Homo sapiens
cttattctgacataa

SEQ ID NO: 1075605 - DNA, 14 bp, Homo sapiens
cttattctgtagat

SEQ ID NO: 1075606 - DNA, 20 bp, Homo sapiens
cttattgaaaaaaaaaatgt

SEQ ID NO: 1075607 - DNA, 18 bp, Homo sapiens
cttattgaatttgttaga

SEQ ID NO: 1075608 - DNA, 18 bp, Homo sapiens
cttattgcctcccaggca

SEQ ID NO: 1075609 - DNA, 17 bp, Homo sapiens
cttattgcgctgctacc

SEQ ID NO: 1075610 - DNA, 14 bp, Homo sapiens
cttattgctgccaa

SEQ ID NO: 1075611 - DNA, 17 bp, Homo sapiens
cttattgctgccaaaac

SEQ ID NO: 1075612 - DNA, 20 bp, Homo sapiens
cttattgctgccaaaaccac

SEQ ID NO: 1075613 - DNA, 17 bp, Homo sapiens
cttattggaaatgtact

SEQ ID NO: 1075614 - DNA, 21 bp, Homo sapiens
cttattggaaatgtacttttg

SEQ ID NO: 1075615 - DNA, 17 bp, Homo sapiens
cttattggaactctgct

SEQ ID NO: 1075616 - DNA, 18 bp, Homo sapiens
cttattggaactctgctt

SEQ ID NO: 1075617 - DNA, 14 bp, Homo sapiens
cttattgttccaag

SEQ ID NO: 1075618 - DNA, 21 bp, Homo sapiens
cttattgttccaagacattgt

SEQ ID NO: 1075619 - DNA, 22 bp, Homo sapiens
cttattgttccaagacattgtc

SEQ ID NO: 1075620 - DNA, 13 bp, Homo sapiens
cttatttaaaaat

SEQ ID NO: 1075621 - DNA, 21 bp, Homo sapiens
cttatttaaaaatatttcaga

SEQ ID NO: 1075622 - DNA, 13 bp, Homo sapiens
cttatttaagtat

SEQ ID NO: 1075623 - DNA, 17 bp, Homo sapiens
cttatttaatgaaagac

SEQ ID NO: 1075624 - DNA, 18 bp, Homo sapiens
cttatttaatgaaagact

SEQ ID NO: 1075625 - DNA, 13 bp, Homo sapiens
cttatttcactaa

SEQ ID NO: 1075626 - DNA, 19 bp, Homo sapiens
cttatttccaagtaagagt

SEQ ID NO: 1075627 - DNA, 18 bp, Homo sapiens
cttatttctatgacaaat

SEQ ID NO: 1075628 - DNA, 12 bp, Homo sapiens
cttatttctcat

SEQ ID NO: 1075629 - DNA, 20 bp, Homo sapiens
cttatttctcattgcctctt

SEQ ID NO: 1075630 - DNA, 18 bp, Homo sapiens
cttatttctctctcctgg

SEQ ID NO: 1075631 - DNA, 11 bp, Homo sapiens
cttatttctgc

SEQ ID NO: 1075632 - DNA, 19 bp, Homo sapiens
cttatttctgctctggaat

SEQ ID NO: 1075633 - DNA, 20 bp, Homo sapiens
cttatttcttaaagcttttt

SEQ ID NO: 1075634 - DNA, 18 bp, Homo sapiens
cttatttgccagagccaa

SEQ ID NO: 1075635 - DNA, 14 bp, Homo sapiens
cttatttggaaatt

SEQ ID NO: 1075636 - DNA, 21 bp, Homo sapiens
cttattttcagtgcatcatta

SEQ ID NO: 1075637 - DNA, 16 bp, Homo sapiens
cttattttcatgtata

SEQ ID NO: 1075638 - DNA, 14 bp, Homo sapiens
cttattttctctgt

SEQ ID NO: 1075639 - DNA, 19 bp, Homo sapiens
cttattttgcattccagaa

SEQ ID NO: 1075640 - DNA, 15 bp, Homo sapiens
cttattttgtattac

SEQ ID NO: 1075641 - DNA, 16 bp, Homo sapiens
cttattttgtcttatt

SEQ ID NO: 1075642 - DNA, 18 bp, Homo sapiens
cttattttgtcttattct

SEQ ID NO: 1075643 - DNA, 21 bp, Homo sapiens
cttattttgtcttattcttaa

SEQ ID NO: 1075644 - DNA, 18 bp, Homo sapiens
cttatttttagccataat

SEQ ID NO: 1075645 - DNA, 19 bp, Homo sapiens
cttatttttataattaaag

SEQ ID NO: 1075646 - DNA, 15 bp, Homo sapiens
cttatttttatgtgg

SEQ ID NO: 1075647 - DNA, 17 bp, Homo sapiens
cttatttttgacagtgt

SEQ ID NO: 1075648 - DNA, 21 bp, Homo sapiens
cttatttttttaagaaaaaag

SEQ ID NO: 1075649 - DNA, 15 bp, Homo sapiens
cttcaaaaataatgt

SEQ ID NO: 1075650 - DNA, 22 bp, Homo sapiens
cttcaaaatattgagcagaatt

SEQ ID NO: 1075651 - DNA, 18 bp, Homo sapiens
cttcaaagattatctgat

SEQ ID NO: 1075652 - DNA, 12 bp, Homo sapiens
cttcaaagcaga

SEQ ID NO: 1075653 - DNA, 20 bp, Homo sapiens
cttcaaagcagagtgggact

SEQ ID NO: 1075654 - DNA, 15 bp, Homo sapiens
cttcaaagtttaata

SEQ ID NO: 1075655 - DNA, 15 bp, Homo sapiens
cttcaaataaagaaa

SEQ ID NO: 1075656 - DNA, 21 bp, Homo sapiens
cttcaaataaagaaatttggt

SEQ ID NO: 1075657 - DNA, 15 bp, Homo sapiens
cttcaaatatttccc

SEQ ID NO: 1075658 - DNA, 15 bp, Homo sapiens
cttcaaatctcagca

SEQ ID NO: 1075659 - DNA, 16 bp, Homo sapiens
cttcaaattatagaaa

SEQ ID NO: 1075660 - DNA, 16 bp, Homo sapiens
cttcaaattcaaggcc

SEQ ID NO: 1075661 - DNA, 24 bp, Homo sapiens
cttcaacagaccccctctagaaat

SEQ ID NO: 1075662 - DNA, 19 bp, Homo sapiens
cttcaacatcaatgttcat

SEQ ID NO: 1075663 - DNA, 14 bp, Homo sapiens
cttcaacccagtgg

SEQ ID NO: 1075664 - DNA, 15 bp, Homo sapiens
cttcaacccagtggg

SEQ ID NO: 1075665 - DNA, 13 bp, Homo sapiens
cttcaactcctgg

SEQ ID NO: 1075666 - DNA, 16 bp, Homo sapiens
cttcaactcctggctc

SEQ ID NO: 1075667 - DNA, 23 bp, Homo sapiens
cttcaactgaccagcctccatgc

SEQ ID NO: 1075668 - DNA, 18 bp, Homo sapiens
cttcaacttttctcttta

SEQ ID NO: 1075669 - DNA, 16 bp, Homo sapiens
cttcaagctctctgtt

SEQ ID NO: 1075670 - DNA, 21 bp, Homo sapiens
cttcaaggactgtttcagtgt

SEQ ID NO: 1075671 - DNA, 18 bp, Homo sapiens
cttcaagggaagaaacac

SEQ ID NO: 1075672 - DNA, 20 bp, Homo sapiens
cttcaagtgttgctcttgga

SEQ ID NO: 1075673 - DNA, 12 bp, Homo sapiens
cttcaagttgta

SEQ ID NO: 1075674 - DNA, 15 bp, Homo sapiens
cttcaataaatcttt

SEQ ID NO: 1075675 - DNA, 21 bp, Homo sapiens
cttcaatctctggaaaaataa

SEQ ID NO: 1075676 - DNA, 16 bp, Homo sapiens
cttcaatgacttctaa

SEQ ID NO: 1075677 - DNA, 16 bp, Homo sapiens
cttcaatgctagaaaa

SEQ ID NO: 1075678 - DNA, 18 bp, Homo sapiens
cttcaatgtgcataatga

SEQ ID NO: 1075679 - DNA, 20 bp, Homo sapiens
cttcaatgtgtcatttccgg

SEQ ID NO: 1075680 - DNA, 15 bp, Homo sapiens
cttcaattaataaaa

SEQ ID NO: 1075681 - DNA, 15 bp, Homo sapiens
cttcaattcctgggc

SEQ ID NO: 1075682 - DNA, 20 bp, Homo sapiens
cttcaatttattactgaaaa

SEQ ID NO: 1075683 - DNA, 12 bp, Homo sapiens
cttcaatttgga

SEQ ID NO: 1075684 - DNA, 22 bp, Homo sapiens
cttcacaaatgtcattgtctac

SEQ ID NO: 1075685 - DNA, 21 bp, Homo sapiens
cttcacacacaggcaactgag

SEQ ID NO: 1075686 - DNA, 13 bp, Homo sapiens
cttcacactgcaa

SEQ ID NO: 1075687 - DNA, 14 bp, Homo sapiens
cttcacagccacac

SEQ ID NO: 1075688 - DNA, 15 bp, Homo sapiens
cttcacaggcagtgc

SEQ ID NO: 1075689 - DNA, 21 bp, Homo sapiens
cttcacagtagagccagcttg

SEQ ID NO: 1075690 - DNA, 22 bp, Homo sapiens
cttcacagtgcagcttgcagtc

SEQ ID NO: 1075691 - DNA, 12 bp, Homo sapiens
cttcacagtgtt

SEQ ID NO: 1075692 - DNA, 14 bp, Homo sapiens
cttcacatattgat

SEQ ID NO: 1075693 - DNA, 14 bp, Homo sapiens
cttcacattaaaaa

SEQ ID NO: 1075694 - DNA, 23 bp, Homo sapiens
cttcaccagtctgtctactgtgg

SEQ ID NO: 1075695 - DNA, 18 bp, Homo sapiens
cttcaccatctacctgct

SEQ ID NO: 1075696 - DNA, 17 bp, Homo sapiens
cttcacccgagttcctc

SEQ ID NO: 1075697 - DNA, 20 bp, Homo sapiens
cttcaccgctccccacagct

SEQ ID NO: 1075698 - DNA, 18 bp, Homo sapiens
cttcacctaagtctctgt

SEQ ID NO: 1075699 - DNA, 19 bp, Homo sapiens
cttcacctaagtctctgtg

SEQ ID NO: 1075700 - DNA, 13 bp, Homo sapiens
cttcacctcagag

SEQ ID NO: 1075701 - DNA, 20 bp, Homo sapiens
cttcacctccaggttcaagt

SEQ ID NO: 1075702 - DNA, 11 bp, Homo sapiens
cttcacctcta

SEQ ID NO: 1075703 - DNA, 15 bp, Homo sapiens
cttcacctgttatgt

SEQ ID NO: 1075704 - DNA, 22 bp, Homo sapiens
cttcacctttcctctccctcag

SEQ ID NO: 1075705 - DNA, 13 bp, Homo sapiens
cttcacctttgta

SEQ ID NO: 1075706 - DNA, 19 bp, Homo sapiens
cttcacggaagagccttgc

SEQ ID NO: 1075707 - DNA, 15 bp, Homo sapiens
cttcactaccctgat

SEQ ID NO: 1075708 - DNA, 18 bp, Homo sapiens
cttcactactttaataaa

SEQ ID NO: 1075709 - DNA, 14 bp, Homo sapiens
cttcactccggtgt

SEQ ID NO: 1075710 - DNA, 24 bp, Homo sapiens
cttcactccggtgtgcctgcagcc

SEQ ID NO: 1075711 - DNA, 20 bp, Homo sapiens
cttcactgaacatgcctagt

SEQ ID NO: 1075712 - DNA, 14 bp, Homo sapiens
cttcactgccatga

SEQ ID NO: 1075713 - DNA, 17 bp, Homo sapiens
cttcactgtgaggggaa

SEQ ID NO: 1075714 - DNA, 23 bp, Homo sapiens
cttcactgtgaggggaaggcctt

SEQ ID NO: 1075715 - DNA, 16 bp, Homo sapiens
cttcactgtggccaca

SEQ ID NO: 1075716 - DNA, 17 bp, Homo sapiens
cttcactgtggccacag

SEQ ID NO: 1075717 - DNA, 18 bp, Homo sapiens
cttcactgtggccacagc

SEQ ID NO: 1075718 - DNA, 21 bp, Homo sapiens
cttcactgtggccacagcccc

SEQ ID NO: 1075719 - DNA, 18 bp, Homo sapiens
cttcactgttccctctgg

SEQ ID NO: 1075720 - DNA, 23 bp, Homo sapiens
cttcactgttccctctggcttcc

SEQ ID NO: 1075721 - DNA, 15 bp, Homo sapiens
cttcactgttgaaaa

SEQ ID NO: 1075722 - DNA, 18 bp, Homo sapiens
cttcactgttgaaaatta

SEQ ID NO: 1075723 - DNA, 19 bp, Homo sapiens
cttcactgttgaaaattat

SEQ ID NO: 1075724 - DNA, 18 bp, Homo sapiens
cttcacttaatccattta

SEQ ID NO: 1075725 - DNA, 19 bp, Homo sapiens
cttcacttgagttggctgt

SEQ ID NO: 1075726 - DNA, 17 bp, Homo sapiens
cttcactttcctcagtt

SEQ ID NO: 1075727 - DNA, 18 bp, Homo sapiens
cttcactttcctcagttg

SEQ ID NO: 1075728 - DNA, 17 bp, Homo sapiens
cttcagaaaaggagtgg

SEQ ID NO: 1075729 - DNA, 23 bp, Homo sapiens
cttcagaaacccggcttcctgtg

SEQ ID NO: 1075730 - DNA, 16 bp, Homo sapiens
cttcagaacacacaga

SEQ ID NO: 1075731 - DNA, 20 bp, Homo sapiens
cttcagaacacacagacttt

SEQ ID NO: 1075732 - DNA, 23 bp, Homo sapiens
cttcagaacacacagactttctg

SEQ ID NO: 1075733 - DNA, 16 bp, Homo sapiens
cttcagaacagaggca

SEQ ID NO: 1075734 - DNA, 19 bp, Homo sapiens
cttcagaacagaggcattt

SEQ ID NO: 1075735 - DNA, 15 bp, Homo sapiens
cttcagaactgccct

SEQ ID NO: 1075736 - DNA, 20 bp, Homo sapiens
cttcagaactgcccttgctg

SEQ ID NO: 1075737 - DNA, 17 bp, Homo sapiens
cttcagaagacactgca

SEQ ID NO: 1075738 - DNA, 14 bp, Homo sapiens
cttcagacccagag

SEQ ID NO: 1075739 - DNA, 16 bp, Homo sapiens
cttcagacccagagaa

SEQ ID NO: 1075740 - DNA, 14 bp, Homo sapiens
cttcagactttgct

SEQ ID NO: 1075741 - DNA, 19 bp, Homo sapiens
cttcagactttgcttccca

SEQ ID NO: 1075742 - DNA, 14 bp, Homo sapiens
cttcagagagctgg

SEQ ID NO: 1075743 - DNA, 12 bp, Homo sapiens
cttcagagggaa

SEQ ID NO: 1075744 - DNA, 19 bp, Homo sapiens
cttcagagtgaagaatctt

SEQ ID NO: 1075745 - DNA, 13 bp, Homo sapiens
cttcagagtttgt

SEQ ID NO: 1075746 - DNA, 21 bp, Homo sapiens
cttcagagtttgtgtgtattt

SEQ ID NO: 1075747 - DNA, 19 bp, Homo sapiens
cttcagatattattgcttt

SEQ ID NO: 1075748 - DNA, 16 bp, Homo sapiens
cttcagatgctcttgg

SEQ ID NO: 1075749 - DNA, 18 bp, Homo sapiens
cttcagatggaaactctt

SEQ ID NO: 1075750 - DNA, 13 bp, Homo sapiens
cttcagcacagga

SEQ ID NO: 1075751 - DNA, 13 bp, Homo sapiens
cttcagcacttta

SEQ ID NO: 1075752 - DNA, 21 bp, Homo sapiens
cttcagcagtacctataaagt

SEQ ID NO: 1075753 - DNA, 14 bp, Homo sapiens
cttcagccatcaac

SEQ ID NO: 1075754 - DNA, 12 bp, Homo sapiens
cttcagcccagg

SEQ ID NO: 1075755 - DNA, 16 bp, Homo sapiens
cttcagcccccaccag

SEQ ID NO: 1075756 - DNA, 21 bp, Homo sapiens
cttcagcccccaccaggggaa

SEQ ID NO: 1075757 - DNA, 19 bp, Homo sapiens
cttcagccctggccaagct

SEQ ID NO: 1075758 - DNA, 16 bp, Homo sapiens
cttcagccctggcccc

SEQ ID NO: 1075759 - DNA, 13 bp, Homo sapiens
cttcagcctagcc

SEQ ID NO: 1075760 - DNA, 16 bp, Homo sapiens
cttcagcctccctcag

SEQ ID NO: 1075761 - DNA, 17 bp, Homo sapiens
cttcagcctccctcagc

SEQ ID NO: 1075762 - DNA, 13 bp, Homo sapiens
cttcagccttaat

SEQ ID NO: 1075763 - DNA, 20 bp, Homo sapiens
cttcagctagcttttaggaa

SEQ ID NO: 1075764 - DNA, 21 bp, Homo sapiens
cttcagctcaactcacagctt

SEQ ID NO: 1075765 - DNA, 13 bp, Homo sapiens
cttcagctccagg

SEQ ID NO: 1075766 - DNA, 13 bp, Homo sapiens
cttcagctgactc

SEQ ID NO: 1075767 - DNA, 14 bp, Homo sapiens
cttcagctgcctga

SEQ ID NO: 1075768 - DNA, 14 bp, Homo sapiens
cttcccctccctgg

SEQ ID NO: 1075769 - DNA, 16 bp, Homo sapiens
cttcccctccctggct

SEQ ID NO: 1075770 - DNA, 18 bp, Homo sapiens
cttcccctccctggctcc

SEQ ID NO: 1075771 - DNA, 22 bp, Homo sapiens
cttcccctgagagtttcctcag

SEQ ID NO: 1075772 - DNA, 23 bp, Homo sapiens
cttcccctgagagtttcctcaga

SEQ ID NO: 1075773 - DNA, 12 bp, Homo sapiens
cttcccctgcac

SEQ ID NO: 1075774 - DNA, 17 bp, Homo sapiens
cttcccctgcacctggc

SEQ ID NO: 1075775 - DNA, 13 bp, Homo sapiens
cttcccctgctga

SEQ ID NO: 1075776 - DNA, 13 bp, Homo sapiens
cttcccctgggat

SEQ ID NO: 1075777 - DNA, 15 bp, Homo sapiens
cttcccctgggatgc

SEQ ID NO: 1075778 - DNA, 17 bp, Homo sapiens
cttccccttccccgtcc

SEQ ID NO: 1075779 - DNA, 15 bp, Homo sapiens
cttccccttcctaag

SEQ ID NO: 1075780 - DNA, 14 bp, Homo sapiens
cttccccttctgtg

SEQ ID NO: 1075781 - DNA, 17 bp, Homo sapiens
cttccccttcttgccat

SEQ ID NO: 1075782 - DNA, 23 bp, Homo sapiens
cttccccttgcccagggctcagc

SEQ ID NO: 1075783 - DNA, 17 bp, Homo sapiens
cttccccttgcccttgc

SEQ ID NO: 1075784 - DNA, 13 bp, Homo sapiens
cttcccctttccc

SEQ ID NO: 1075785 - DNA, 16 bp, Homo sapiens
cttcccctttgtcctg

SEQ ID NO: 1075786 - DNA, 18 bp, Homo sapiens
cttcccctttgtcctgcg

SEQ ID NO: 1075787 - DNA, 19 bp, Homo sapiens
cttcccctttgtcctgcgt

SEQ ID NO: 1075788 - DNA, 19 bp, Homo sapiens
cttcccgacccagccagct

SEQ ID NO: 1075789 - DNA, 16 bp, Homo sapiens
cttcccgccccacctc

SEQ ID NO: 1075790 - DNA, 19 bp, Homo sapiens
cttcccgccccacctccca

SEQ ID NO: 1075791 - DNA, 19 bp, Homo sapiens
cttcccgtcccatatcctg

SEQ ID NO: 1075792 - DNA, 20 bp, Homo sapiens
cttcccgtcccatatcctgc

SEQ ID NO: 1075793 - DNA, 21 bp, Homo sapiens
cttcccgtcccatatcctgcc

SEQ ID NO: 1075794 - DNA, 23 bp, Homo sapiens
cttcccgtcccatatcctgcctc

SEQ ID NO: 1075795 - DNA, 13 bp, Homo sapiens
cttcccgttctta

SEQ ID NO: 1075796 - DNA, 23 bp, Homo sapiens
cttccctagagggttcctgtaga

SEQ ID NO: 1075797 - DNA, 15 bp, Homo sapiens
cttccctcacaccgc

SEQ ID NO: 1075798 - DNA, 13 bp, Homo sapiens
cttccctcacccc

SEQ ID NO: 1075799 - DNA, 20 bp, Homo sapiens
cttccctcactcttcctcat

SEQ ID NO: 1075800 - DNA, 11 bp, Homo sapiens
cttccctcctc

SEQ ID NO: 1075801 - DNA, 17 bp, Homo sapiens
cttccctcctcccatgt

SEQ ID NO: 1075802 - DNA, 16 bp, Homo sapiens
cttccctcctgctttg

SEQ ID NO: 1075803 - DNA, 19 bp, Homo sapiens
cttccctcctgtgccccag

SEQ ID NO: 1075804 - DNA, 14 bp, Homo sapiens
cttccctctcagct

SEQ ID NO: 1075805 - DNA, 15 bp, Homo sapiens
cttccctctctgatg

SEQ ID NO: 1075806 - DNA, 20 bp, Homo sapiens
cttccctctctgatgtccca

SEQ ID NO: 1075807 - DNA, 21 bp, Homo sapiens
cttccctctctgatgtcccag

SEQ ID NO: 1075808 - DNA, 23 bp, Homo sapiens
cttccctctctgatgtcccagtg

SEQ ID NO: 1075809 - DNA, 19 bp, Homo sapiens
cttccctctgcctgtccct

SEQ ID NO: 1075810 - DNA, 16 bp, Homo sapiens
cttccctctgggcacg

SEQ ID NO: 1075811 - DNA, 17 bp, Homo sapiens
cttccctctgtttctct

SEQ ID NO: 1075812 - DNA, 17 bp, Homo sapiens
cttccctgacttgcttt

SEQ ID NO: 1075813 - DNA, 19 bp, Homo sapiens
cttccctgattgacctgct

SEQ ID NO: 1075814 - DNA, 20 bp, Homo sapiens
cttccctgattgacctgctc

SEQ ID NO: 1075815 - DNA, 13 bp, Homo sapiens
cttccctgcccca

SEQ ID NO: 1075816 - DNA, 18 bp, Homo sapiens
cttccctgcgcctgtgat

SEQ ID NO: 1075817 - DNA, 11 bp, Homo sapiens
cttccctggct

SEQ ID NO: 1075818 - DNA, 13 bp, Homo sapiens
cttccctgggcct

SEQ ID NO: 1075819 - DNA, 17 bp, Homo sapiens
cttccctgggctgtgct

SEQ ID NO: 1075820 - DNA, 18 bp, Homo sapiens
cttccctgggctgtgcta

SEQ ID NO: 1075821 - DNA, 11 bp, Homo sapiens
cttccctgggg

SEQ ID NO: 1075822 - DNA, 12 bp, Homo sapiens
cttccctgggga

SEQ ID NO: 1075823 - DNA, 21 bp, Homo sapiens
cttccctggggagccctcagg

SEQ ID NO: 1075824 - DNA, 22 bp, Homo sapiens
cttccctggggagccctcaggc

SEQ ID NO: 1075825 - DNA, 17 bp, Homo sapiens
cttccctgtcagcctga

SEQ ID NO: 1075826 - DNA, 12 bp, Homo sapiens
cttccctgtccc

SEQ ID NO: 1075827 - DNA, 17 bp, Homo sapiens
cttcccttagcctctcc

SEQ ID NO: 1075828 - DNA, 19 bp, Homo sapiens
cttcccttgagatgagttt
